United States Patent 9,107,886 (MODIFIED POLYNUCLEOTIDES ENCODING BASIC HELIX-LOOP-HELIX FAMILY MEMBER E41) - sequence listing, part 11

SEQ ID NO: 17982 - DNA, 1218 bp, Artificial Sequence
  Description of Artificial Sequence: Synthetic coding sequence
atgaccctggatgtcggacccgaggacgagctgccggattgggccgcagcaaaggagttctaccagaagtacgatccaaaggatgtgatcgggcgcggagtctcgagcgttgttagaagatgtgtgcacagagcaactggccacgaattcgcagtgaagattatggaggtgactgcggagaggctgtccccagaacagctggaagaggtgcgtgaagcaaccagacgagaaactcatatcctgagacaagtcgcaggacatccccacatcattaccctgatagattcctatgagtcgtcatcctttatgttcttggtctttgatttgatgcggaaaggagaacttttcgactacctgaccgaaaaagtggcgctctccgagaaggaaacccgctcgattatgcgttcgctgcttgaagctgtctcctttcttcacgccaataacatcgttcatagagatctgaagccagaaaacattctccttgacgataacatgcaaatccgcctttccgattttggctttagctgtcacctcgagcccggagaaaagctgcgcgaactttgtggtaccccaggatacctggcccctgagattctcaagtgttcgatggacgaaacgcatccaggctacggcaaagaggtggatctttgggcctgtggggtgatcctttttacgctgctcgcgggaagccctccattctggcaccggcggcaaatcctgatgctgcgcatgatcatggagggccagtaccagttttcaagccctgaatgggatgatagatccagcacggtgaaggatctgatttccagactgcttcaggtcgaccctgaggctcgccttaccgcggagcaggcactccaacacccgttttttgaacgatgcgagggatcgcaaccctggaacttgactcctagacaacgcttccgagtggccgtctggaccgtgctcgcagcaggccgggtcgcactgagcacccatcgggtgcggcctctgacgaagaatgcactcctgagagatccttacgccctgaggtccgtgaggcacctcattgataactgtgctttccgcctttatggccactgggtcaagaagggagaacagcaaaatcgcgcggccctgtttcaacatcggcctccaggaccgtttccaatcatgggtcctgaggaagaaggcgattccgcagcaataaccgaggatgaagcagtcttggtcctggga

SEQ ID NO: 17983 - DNA, 1218 bp, Artificial Sequence
  Description of Artificial Sequence: Synthetic coding sequence
atgaccctcgatgtgggccctgaggacgagcttccggattgggccgctgcgaaagagttctaccagaagtacgacccgaaggacgtcatcggaagaggcgtgagctcggtcgtgagacggtgcgtgcacagagcgaccggacatgaattcgctgtcaaaatcatggaagtcactgccgagcggctgagccctgagcagctcgaagaagtgagagaagcgaccagacgcgaaactcacatcctgaggcaagtcgcgggacacccgcacatcattactcttatcgactcgtacgaatcaagctcgttcatgttcctggtgttcgacctgatgcgcaagggagagctgtttgactacttgaccgaaaaagtcgccctgtccgagaaggaaacccgcagtatcatgcgctcactgttggaagccgtgagcttcctccacgcgaataacatcgtgcaccgggacctcaagccggaaaacatcctgctcgatgataatatgcaaattaggctgtccgatttcggattttcctgtcatctcgagccaggagaaaaactccgtgagttgtgcgggactccaggataccttgcccctgagatcttgaaatgctcaatggatgagactcatccaggctacgggaaggaagtggatctgtgggcctgtggtgtcattctgttcaccttgctcgcgggctcaccgccattctggcatcgccgccagatcctgatgctccgaatgataatggaaggccagtaccaattttcgtccccggaatgggacgaccggtcctctactgtgaaggacctgatctcgcgcctgctgcaagtggaccccgaggcacggctgaccgcagaacaggctctgcaacacccgttcttcgaaagatgcgagggaagccaaccgtggaacctgacccctcggcagaggttccgagtggcggtgtggaccgtgctggctgccgggcgcgttgcactgtccactcatcgcgtgaggccgctcacgaagaacgcccttctgcgcgatccctatgcacttagatcggtccgccacctcatcgacaattgcgcctttcggctctacggacattgggtgaagaagggagaacagcagaaccgggccgcactgttccagcaccggcctcccggaccatttccaatcatgggtccggaggaagagggcgactccgccgcaatcacggaggatgaagctgtgctggttctcggt

SEQ ID NO: 17984 - DNA, 1218 bp, Artificial Sequence
  Description of Artificial Sequence: Synthetic coding sequence
atgactctggatgtgggacctgaagatgagctcccggactgggctgccgcaaaggagttttaccaaaagtacgacccaaaggatgtgattggaagaggagtatcctccgtggtgagacggtgtgtgcaccgagccaccggccatgaatttgcagtgaaaatcatggaagtgactgcagaacgactcagcccagaacaactggaagaggtccgtgaggctacccggagagaaacgcatatccttagacaagtcgcagggcatcctcatatcattactctgattgatagctacgagagctcgtcatttatgttcctggtgttcgacctcatgcgcaagggggagctgttcgactatctgactgagaaggtggccctgtcggagaaggaaaccagatcgattatgaggtcgctgctggaagccgtgtcttttcttcatgcaaacaatattgtgcatcgcgatctcaagcctgagaacattctgcttgacgataacatgcaaatccgcctttccgattttggcttttcctgtcacctcgaaccgggagaaaagctgagggagttgtgcggaactcccggctatttggccccagaaattctgaaatgctccatggatgaaactcatcctggctacggtaaggaagttgatctttgggcgtgcggcgtgattctgttcactctgctggcaggcagcccacctttttggcatcggcgacagatcttgatgctgcgcatgataatggaaggccaatatcaattctcaagccctgaatgggacgaccggtcatcgacggtgaaggacctcataagcaggcttctgcaagtggaccctgaagcaaggcttaccgcagaacaggctcttcagcatccttttttcgagcgatgcgaaggaagccagccatggaatcttacgcccagacaacggtttcgcgtggccgtgtggactgtgctcgccgcaggtagggtggcactgtcaacgcatcgggtgcgtcccctcactaagaacgcccttcttcgggatccatacgccctccgtagcgtgagacatcttattgacaactgtgcattcaggctctacggccactgggtgaaaaaaggtgaacagcaaaatagagcagcattgttccagcacagacctccaggcccttttcctatcatgggtcctgaagaggaaggggactcggcagcgatcactgaagatgaagcagtgctggtgttggga

SEQ ID NO: 17985 - DNA, 1218 bp, Artificial Sequence
  Description of Artificial Sequence: Synthetic coding sequence
atgaccctcgatgtgggtccagaagatgaactcccagactgggcggccgcgaaggaattctaccagaaatacgatcctaaggatgttatcggaaggggcgtgtccagtgttgtacgcaggtgcgtccaccgcgccaccggccacgagttcgccgtgaagattatggaagtgaccgctgagaggctgagccccgaacagcttgaggaagttagggaagcaaccaggagagagactcacattttgagacaggtggccggccacccacacattatcaccctgatcgattcttatgaatccagcagcttcatgtttctggttttcgatctgatgcgcaagggagaactgttcgactaccttaccgagaaggttgctttgtccgaaaaagaaacccgctcaattatgaggagcctcctcgaggctgtatccttcttgcatgcaaacaacatcgttcatagggacctgaagcctgaaaacattttgcttgacgataacatgcagattaggctttccgattttggcttctcatgccacctggagccgggagagaaactcagggagctctgtggaacacccggatacttggccccggagatccttaagtgctccatggacgagacccaccccggatacggtaaggaggttgatttgtgggcttgcggtgtgattctgtttactctgcttgccggctctccaccgttctggcaccgccgccagattcttatgctgagaatgatcatggagggccagtatcaattctcttcacctgagtgggatgacagatctagcactgttaaggacttgatctccagactcctccaggtcgaccctgaggccaggctcacagccgagcaagcccttcaacaccccttcttcgagaggtgcgagggctcccagccttggaatctgacccccagacagagatttagggtcgccgtgtggacagtgcttgctgcaggtagagtggccctgagcacacaccgcgtgaggccgttgacaaagaacgccctgctgagagacccttatgctctgagatctgtccgccacctgattgacaactgtgcatttaggctctacggtcattgggttaagaagggcgagcaacagaacagggccgctctgtttcagcacagaccccccggaccatttcccatcatgggccctgaggaagaaggtgacagcgcagctattaccgaggacgaggctgtgttggtgctcggc

SEQ ID NO: 17986 - DNA, 1218 bp, Artificial Sequence
  Description of Artificial Sequence: Synthetic coding sequence
atgacacttgatgtaggtcccgaagacgaactccccgattgggccgccgccaaagaattttatcagaagtatgatcctaaggacgtgatcggaagaggggtgagcagcgttgtgcgtagatgtgttcatagagccacaggacatgagtttgctgtgaaaattatggaggtgaccgccgagagattgagtcctgagcaacttgaggaagtgcgcgaggcaacccgcagagagacccatattctgaggcaggtagcaggtcaccctcacataattaccctgattgatagttacgaatctagctcatttatgttcctggtttttgatctgatgaggaaaggcgagctgtttgactatctaaccgagaaagtggccttaagtgaaaaggaaacccgctctattatgcgctcattgctggaggctgtctccttcttgcatgctaataacattgttcatcgcgatttgaagcctgaaaacatcctcctggatgacaatatgcagattcggctttctgacttcgggttctcttgccacctcgaacctggtgaaaaattacgcgaactatgcgggacaccaggatatcttgcacccgagatactcaagtgttcgatggatgagacccatcctggttatggcaaggaggtggacctctgggcctgtggagtaatcctcttcacactgttggcaggtagtcccccgttttggcaccgcaggcagattctgatgcttagaatgatcatggaaggacagtatcaattctctagtcccgagtgggacgacagatcctccacagtgaaagatctgatctctcggttactgcaggtggatcccgaggctcggctaaccgcagaacaggctttacaacatccctttttcgaaagatgcgagggaagtcagccttggaatttgaccccgaggcagcgattcagggtggcggtctggacagtgctggctgcgggacgagtggcattgagtactcatagagtccgccccctgactaagaacgccctactccgggatccgtatgctctgagatctgtacggcatctgattgacaactgcgcctttaggctatacggccattgggtcaaaaaaggcgagcaacagaatagagctgcactgttccagcatagaccacccggcccatttcccattatgggcccggaggaggaaggcgattccgcagctattaccgaagacgaagcagtcctagttctgggc

SEQ ID NO: 17987 - DNA, 1218 bp, Artificial Sequence
  Description of Artificial Sequence: Synthetic coding sequence
atgacccttgatgtggggcctgaggatgagctgcctgattgggccgcggccaaggaattctaccagaagtacgatccgaaggatgtcatcggaagaggcgtcagctcggtcgtgagacgttgcgtccaccgcgccaccgggcacgaattcgcggtgaagattatggaagtgactgcggagcgtctgtcgccggaacaactcgaggaagtccgggaggcaaccaggagagaaacccatatcctgcggcaggtcgcaggtcacccgcacatcatcactctgatcgattcatacgaatcctcgtcgttcatgttcctcgtctttgatctcatgcgcaagggagagctgttcgactatctgaccgagaaggtcgcgctgtcggagaaggagactcggtcaatcatgcgatcgctcctggaggccgtctccttcctgcacgccaacaacatcgtgcaccgagatctcaaaccggagaatatcctgctggacgacaatatgcagatccgcttgtccgacttcgggtttagctgccaccttgaacctggcgagaagctcagggagctgtgcggtacccctggatacctcgctcctgaaatccttaaatgttcaatggatgagactcacccaggttacggaaaagaagtcgacctgtgggcatgtggagtgatcctgttcactctcttggcagggtcgccgccattttggcaccgcagacagatcctgatgctgcgcatgatcatggaggggcagtaccagttcagctccccagaatgggatgaccggagctcaaccgtcaaggatctgattagcaggctgctgcaggtggatccagaggcacgcctcactgccgagcaagcccttcagcatccgtttttcgaaagatgcgaaggctcgcagccgtggaatctcaccccacggcaaagattccgggtggcggtttggaccgtactggccgccggaagggtcgcattgagcacccatcgggtgcgcccgctgacgaaaaacgctctgttgcgcgatccttacgcgctgagatccgtccgacacctcatcgataattgcgctttccggctgtacgggcactgggtgaaaaagggagaacagcaaaaccgggcggcattgttccaacatcgcccccctggaccgttccctatcatgggtcctgaggaggaaggagacagcgcggccatcactgaggacgaagcagtgctggtgctcgga

SEQ ID NO: 17988 - DNA, 1218 bp, Artificial Sequence
  Description of Artificial Sequence: Synthetic coding sequence
atgacgcttgacgtgggtccagaagatgagcttccagattgggccgccgcgaaggagttttaccagaagtacgatccgaaggatgttatcggtcggggagtgtcctcggtggtgaggagatgcgtccatagagccactggacacgagtttgctgtgaagatcatggaagtgactgccgaacggctctcacccgaacagctcgaagaagtgcgcgaggcaacccgacgggaaactcacattctgcggcaggtcgcaggacacccgcatatcataacccttatcgactcgtacgaatcgtcctccttcatgttcctggtgttcgacttgatgcgcaagggagaactgttcgactacctgaccgaaaaagtggcgctctccgagaaggaaaccaggtcgatcatgcggtcgctcctggaagcggtgtctttcctgcacgccaacaatattgtgcaccgggacctcaagccggagaacattctgctggatgacaacatgcagatccgcttgtcggacttcggattctcatgccacttggagccaggggagaagctcagagaattgtgcggtaccccaggctacctggcaccagaaatcctgaaatgctccatggatgaaacccacccggggtacggcaaggaggtcgacctgtgggcttgtggagtgatcctcttcactctgctggccggaagcccaccattctggcaccggcggcagattctcatgctgcgcatgatcatggagggccagtaccaattttcatccccggagtgggatgatcggtctagcaccgtcaaggacctcatctcgcgattgttgcaagtggaccctgaagcacgtttgacggctgagcaggcgcttcaacacccgttttttgaaaggtgcgaaggaagccagccgtggaatctcactccgcggcaaagatttcgcgtggccgtgtggaccgtgcttgccgcggggcgggtggccctgtctactcaccgcgtgcgccccctgaccaaaaacgcactcctccgcgatccttacgccttgcggagcgtgcgccatctcatagataactgcgctttccgcctctatgggcactgggtgaagaagggagagcagcagaaccgggccgccctgttccagcaccgaccaccaggcccattccctatcatgggacctgaagaagaaggagactccgcggcgatcactgaggatgaggctgtactcgtcctcgga

SEQ ID NO: 17989 - DNA, 1218 bp, Artificial Sequence
  Description of Artificial Sequence: Synthetic coding sequence
atgaccctcgatgtggggccggaggatgaactcccagattgggccgcagctaaggagttctatcagaagtatgaccctaaagacgttatcgggaggggagtgagttcagtggtgagaaggtgcgtgcatagagcaacgggccatgaattcgctgtaaagatcatggaggtgactgctgaacggctgagccctgaacaactcgaagaagtaagagaggccacgcgccgggaaacccatatcctgcgtcaagtggctggacatccccacattatcacattaatcgatagttatgagagctcaagtttcatgtttctggtgtttgatctcatgcgcaaaggagaactgtttgactaccttacagaaaaagtcgctctgtctgagaaggaaacccggagcatcatgagatcattgctggaagcagtgtcatttctgcatgctaataatattgtgcaccgcgatcttaaacctgagaatatcctgttggatgataacatgcaaattcgcctgagtgattttggattcagttgccatttagagcccggcgagaagttgagggagttgtgcggcacccctggctatctggctcctgagatattgaaatgcagcatggatgagacccatccgggctacggtaaagaggtggacttgtgggcctgcggcgtcatccttttcacactgcttgccgggtccccacctttttggcacagaagacagattttaatgttgagaatgatcatggagggacaatatcagtttagtagcccagaatgggacgataggtcttcgaccgtgaaagatctcattagtcggctcttacaggtggatccagaggctcggctgaccgctgaacaggccctgcagcatccgtttttcgagcgctgcgaagggtctcagccgtggaaccttaccccacgccaacgctttagagtcgccgtgtggactgtccttgcagcaggcagagtggcactcagcacccatcgtgtgcgccctcttaccaaaaacgcactgctgcgggacccatacgctcttaggtccgtgaggcatctgatcgataattgcgcttttagactttacggacattgggttaagaagggcgaacaacagaatagggccgccttatttcagcatcgcccgccaggccctttcccaattatggggcctgaggaagagggtgacagcgcggcgatcacagaagacgaagcagtcctcgttctggga

SEQ ID NO: 17990 - DNA, 1218 bp, Artificial Sequence; identical to SEQ ID NO: 17986
  Description of Artificial Sequence: Synthetic coding sequence

SEQ ID NO: 17991 - DNA, 1218 bp, Artificial Sequence
  Description of Artificial Sequence: Synthetic coding sequence
atgaccctggatgtgggacctgaagacgagctacctgactgggctgccgcaaaggagttttatcagaagtatgatcctaaggacgtgatagggaggggtgtgtcaagcgttgtgagaagatgtgtgcacagggccactggccacgaatttgccgtaaagataatggaggtgaccgccgagcgcttgtctccagaacaactagaggaggttagagaagctacccgaagagaaacccatatactgcgacaggtggccgggcatccccatatcatcacactgattgactcctatgagagcagtagtttcatgttcctcgtcttcgatctgatgaggaaaggagagctgtttgactacctgactgagaaagtggccttaagcgaaaaggaaacaaggtcaatcatgcggagcctgctggaagcagtgtctttcctacacgctaacaatatagtgcaccgggatctgaaaccagagaacatcctgctggacgataatatgcagattaggctttctgactttggcttcagctgccatcttgaaccaggagaaaagctgagagaactgtgcggaacccccggatacctggcaccagagatattaaaatgctcaatggacgagacacatcctggctatgggaaggaagtggacctgtgggcttgcggcgtaatactattcaccctcctcgccggctctccacctttttggcaccgaagacagattctgatgctgcgaatgataatggaggggcagtaccagttctcttcccccgagtgggatgaccgcagtagcaccgtcaaagacctgattagtcgtttgcttcaagtggatcccgaagcaagattaacagccgagcaagctctccagcaccctttcttcgagcggtgcgagggcagccaaccatggaatttaaccccccggcaaaggtttagggtggcagtctggaccgttctcgctgctggaagagtagcactaagtacacaccgcgttcgtcctttgaccaagaacgccctgctgcgggatccctatgctctaaggtctgtaaggcacttgattgacaattgcgccttcaggctgtacgggcactgggtgaagaagggagagcagcaaaatagggccgccctgtttcagcacaggccacccggcccctttccaatcatgggccctgaggaggaaggggacagcgcagccatcaccgaggatgaggccgtgctggtgctgggc

SEQ ID NO: 17992 - DNA, 1218 bp, Artificial Sequence
  Description of Artificial Sequence: Synthetic coding sequence
atgaccctcgatgtgggaccggaggatgaactccctgactgggctgccgcgaaggaattctaccagaaatacgacccaaaggacgtgatcggacgcggagtgagctcggtggtccgccgatgcgtccaccgcgcaactggacatgagttcgcagtcaaaatcatggaagtgactgcggagcgcctgtcgcccgagcagctcgaagaggtgcgggaagcaaccaggcgggaaactcacattctgagacaggtggccgggcacccccacatcattaccctgatcgactcctacgaatcgtcctcctttatgttcctggtgttcgacctgatgcgtaagggagagctcttcgactacttgaccgagaaggtggcattgtcagagaaggaaactagatcgatcatgcgctccctgctggaagcagtgtcattcctgcacgcgaataacattgtgcacagggacctgaagccggaaaacatccttcttgacgataacatgcagatcaggctttcagatttcggattttcgtgccatctcgaaccgggcgagaagctgcgcgaactgtgcggtactccgggatacctggctccggagatcctcaagtgttccatggacgagacgcacccgggatacggaaaagaggtggatctctgggcatgcggcgttatactttttactctcctcgccggatcaccaccgttctggcatcggcgccagatccttatgctcagaatgattatggagggccagtatcaattcagttcgcctgaatgggacgacagatcctcgactgttaaggatcttatcagcaggctgctgcaggtggatccggaagctcgccttactgcagaacaggccctgcagcaccccttctttgaacgctgcgaggggagccagccgtggaacctgaccccacggcagagattccgggtggcagtgtggaccgtgctggccgcagggcgggtggcacttagcactcatcgggtgcggccgctgactaaaaacgcgctgctgagggacccatacgcactgaggtcagtaagacatctgatcgacaattgtgcatttcgcttgtacggccactgggtgaagaagggagaacagcaaaatcgagcggcgctcttccagcatagacctcctggaccattccctatcatggggccggaagaagaaggagactccgcagccattaccgaggacgaggcggtgctggtcttgggt

SEQ ID NO: 17993 - DNA, 1218 bp, Artificial Sequence
  Description of Artificial Sequence: Synthetic coding sequence
atgactttggacgttggaccagaagatgaattgcctgactgggctgctgctaaagaattttatcaaaaatatgatccaaaagatgttattggaagaggagtttcatctgtagtaagaagatgtgttcatagagctactggacatgaattcgctgttaaaattatggaagttacagcagaaagattgtctccagagcaattagaagaagttagagaagctacaagaagagaaacacatattcttcgacaagttgctggacatccacatattattactcttattgattcttatgaatcatctagttttatgtttcttgtttttgatttaatgcgtaaaggagaattatttgattatttaacagagaaagttgctttaagtgagaaagaaacaagatcaattatgcgttctttattggaagcagttagtttcctccatgcaaacaatattgtacatagagatttaaaaccagaaaatattttattggatgataatatgcaaattagattatcagatttcggattttcatgtcatcttgaaccaggtgaaaaattacgtgaattatgtggaacaccaggttatttggctcctgaaattcttaaatgtagtatggatgaaacacatccagggtatggaaaagaagttgatttgtgggcatgcggtgttattctttttactctcttagcaggttcgcctccattttggcatcgaagacaaattcttatgcttagaatgattatggaaggacaatatcagttcagttcaccagaatgggacgatagaagttcaactgttaaagatttaatatctaggcttttacaagttgaccctgaggctagattgactgctgaacaagcacttcaacaccctttttttgaaagatgtgaagggtcacaaccatggaatttaactccaagacaaagatttcgtgtagcagtctggactgtattagcagctggaagagttgcattatctacacatagagtaagaccattgactaaaaatgctcttcttagagatccttatgcattaagaagtgttagacatctaattgataattgtgcttttagattatatggtcattgggttaaaaaaggtgaacaacagaatcgtgcagctttatttcaacatcgaccaccaggaccatttcctattatgggaccagaagaagaaggagatagcgctgcaattactgaagatgaagctgtattagtcttgggt

SEQ ID NO: 17994 - DNA, 1218 bp, Artificial Sequence
  Description of Artificial Sequence: Synthetic coding sequence
atgacgctggatgtggggcccgaagatgaactgccagattgggcggctgccaaggagttttaccagaagtacgacccaaaggacgtcattggccgcggagtctcctccgtggtgaggaggtgtgtgcacagggctacgggccatgaatttgcggtcaaaatcatggaagttactgcagagcggctgagcccggagcagctcgaggaagtgagggaagccacccggcgcgaaactcatatcttgcgccaagtcgcgggacacccacatatcatcaccctgatcgactcctacgagtcgtcgtccttcatgttccttgtgttcgacctgatgcgaaaaggtgagctgttcgactatctcactgagaaagtagcattgtcagaaaaggaaacccgaagcatcatgcgctcgttgttggaggccgtctcgttcttgcatgcaaataacattgtgcatcgggatcttaagccggaaaacatcctgctggacgacaatatgcaaattcgtctttcggatttcggcttttcttgccacttggaaccaggggaaaagctcagagagctgtgcgggacgccgggatacctggcgcctgaaatcctgaagtgttctatggatgaaactcacccgggctacggtaaagaagtcgacctctgggcatgcggagtgatactgtttaccctgttggccggaagtccacctttttggcaccgcaggcaaatccttatgctgaggatgatcatggaaggtcagtaccagttctcatccccggagtgggacgatcgctcgtcgaccgttaaagacctgatctcgagactcctgcaagtggatccggaagcccggctcactgccgagcaggccctccagcacccgttcttcgaacgctgcgaggggtcgcagccttggaaccttaccccgagacaacgctttcgggtggcggtctggactgtgctggccgcgggaagggtggccctgtcgacccaccgggtccggcccttgaccaagaacgcactcctccgggacccttacgccctgaggtcggtgcgccacctgatcgataattgcgctttccgcctctacggtcattgggtgaagaagggagaacagcagaaccgggcggctctgttccagcacagaccaccgggaccattcccgatcatggggcccgaggaggagggagatagcgctgccataaccgaggacgaggccgtgctggtgctcggc

SEQ ID NO: 17995 - DNA, 1218 bp, Artificial Sequence
  Description of Artificial Sequence: Synthetic coding sequence
atgacgttggatgtggggcccgaggacgaattgcctgattgggcagcagccaaagaattctaccaaaaatacgacccaaaagatgttatcggtagaggggtctccagcgtagttcgccggtgtgtccatcgtgcaactggccacgagttcgcggtgaagattatggaagtcacagcagaaagactgagcccagagcaactagaagaggtcagggaggcaaccaggagagagacacacattcttaggcaggtcgctggacacccgcatattatcacgctgatagattcttatgagtcgagttccttcatgttcctcgtctttgacttgatgaggaaaggagaactcttcgactaccttactgaaaaggtcgccctttccgaaaaggaaacccgttctattatgaggtctttactggaagctgtgtcattccttcatgcaaacaatattgtgcacagagacttgaagcctgaaaacatattgcttgatgacaacatgcagatcaggctctctgattttggcttctcatgtcatttggaacctggggagaagctacgggaactgtgcggtacaccagggtacctggcccccgaaatcctgaaatgtagtatggacgagactcaccccggatatggaaaggaggtggacctgtgggcttgcggagtgatattatttactttgctggccggctctccgcccttctggcaccgcaggcagattctgatgctgcggatgattatggagggtcagtatcagttctcatctcccgagtgggatgaccgatcgagtaccgtaaaggacctgatcagtcgattactgcaggtggacccggaagcccgattaacagccgaacaggccctgcagcacccttttttcgagagatgcgaggggtcacagccctggaacctcacgccgcgccaacgattccgggtggcggtttggactgtactggcggccggtcgagtggcactgtctacacatcgggtgaggcctctcacaaaaaacgccctgttgagagacccttacgcgttgcgctcagtgcggcatttaatcgataattgtgctttccgcctctacgggcactgggtaaagaagggagagcagcagaaccgggctgcccttttccagcatcgtcctcctggcccttttccaattatgggcccggaggaagagggggactccgcggccataaccgaggatgaggccgtacttgtgctgggc

SEQ ID NO: 17996 - DNA, 1218 bp, Artificial Sequence
  Description of Artificial Sequence: Synthetic coding sequence
atgactcttgatgttggacctgaggacgagcttccagactgggcagcggccaaggaattctaccagaaatacgaccctaaggatgtgatcggacggggggtgtcctccgtggtccgacgatgcgtgcacagggccaccggacatgagttcgccgtgaagattatggaagtgactgcggagcgccttagcccagaacagcttgaggaagtgagggaagcgactagacgcgagactcacatcctcagacaggtcgcaggacacccacatatcattacgctgattgattcgtatgaatcgagctcttttatgttcctggtgtttgacctgatgcgcaaaggggagctcttcgattaccttaccgaaaaggttgctctgtctgagaaagaaaccagatcaatcatgcgatcgctgcttgaggcagtgtcctttctccacgctaataacatcgtccatcgggatctgaagcctgagaatattcttctggatgacaatatgcagattcggctcagcgattttggcttttcctgccacctggagccgggcgaaaagctccgggaactgtgtggtactcccggatacctcgctcctgagattctgaagtgttcaatggacgaaacgcatcccggttacggtaaggaagtggacctgtgggcatgtggcgtgattctcttcactctgttggcaggttcacctccattttggcatcgcagacaaatactcatgcttcgcatgataatggagggtcaataccagttcagcagccctgaatgggacgacaggagctcaaccgtgaaggatctcatctctcgccttctgcaagtggacccagaggcaaggcttacggccgaacaggcgctccagcacccttttttcgagcggtgtgaaggatcgcaaccttggaaccttaccccaagacaaaggtttagagtggcagtgtggaccgtccttgcagccggcagagtagcactgtctacccatcgggtccggccgctcactaagaacgcacttctcagggatccttacgcccttaggtccgtcaggcatttgattgataactgtgcatttcgcctttacggacattgggtcaagaaaggtgaacaacaaaaccgtgcagcactctttcaacatcggccccccggccctttccctattatgggcccggaagaagaaggcgattccgctgcaatcaccgaggatgaggcagtgctggtgctcggg

SEQ ID NO: 17997 - DNA, 1218 bp, Artificial Sequence
  Description of Artificial Sequence: Synthetic coding sequence
atgaccctcgacgtcggcccggaagatgagctgcctgactgggctgcagccaaggaattctatcaaaagtacgacccgaaagatgtcattgggcggggagtgtcatctgtggtccggcggtgcgtgcatcgcgcgaccggacatgaattcgccgtgaagatcatggaggttaccgctgagcgcctgtcaccagagcagctcgaggaagtgcgcgaagctacgagacgggaaacccacatcttgagacaagttgcgggtcatccacatatcattactctgatcgacagctacgagtccagctcgtttatgttcctcgtgttcgatctgatgcgcaagggggaactgttcgactacttgactgagaaagttgcactttcggagaaagagactagatccatcatgaggtcgctgctggaggcggtgtctttcctccacgcgaacaacatcgtgcaccgggacctcaagcctgaaaacatcctgctcgacgacaatatgcaaattcggctgtcggatttcggattttcctgtcacctggagcccggcgaaaagctgcgagagctgtgcggcaccccgggatacttggctccggagatcctgaagtgcagcatggatgaaacgcacccaggctatgggaaagaggtagatctgtgggcttgcggagtcatcctgttcaccctgcttgcaggaagccctcctttctggcaccgtcggcagatactgatgttgagaatgatcatggaaggacaataccagttctcatccccagagtgggacgaccggagctcgactgtgaaggacctcatctcacgccttctgcaggtggatccggaagctcgcttgactgccgaacaggccctgcagcatccgtttttcgaaagatgcgaggggagccagccctggaatctcactccacgccagagatttcgggtggcagtctggacggtgctggcagcaggaagagttgcgttgtcgacgcatagggtcaggccgcttaccaaaaacgccctgctccgggatccgtatgctctgcgctcagtgcgccatctgatcgacaactgtgctttccggctctacggccactgggtcaaaaagggagaacagcaaaacagggctgcgcttttccagcatcggccccccggaccattcccaataatgggaccggaagaggaaggggactcggcagccattaccgaagatgaggccgtgctggtgctggga

SEQ ID NO: 17998 - DNA, 1218 bp, Artificial Sequence
  Description of Artificial Sequence: Synthetic coding sequence
atgacactcgatgtcggccccgaagacgagctgcctgactgggcagcagctaaggagttctaccaaaagtatgatcccaaagacgtcatcggcaggggggtttcctccgtggttagaagatgtgtgcacagagctaccggccacgagtttgcagtaaagattatggaggttaccgccgaacggctgagcccagaacagctggaagaggtaagagaggcaacccgcagggagacccatatcttgaggcaggtggctgggcatccacacataatcacgttaatcgattcatatgagtcaagcagcttcatgttcctggtctttgacctcatgaggaaaggggagctttttgactacctcaccgagaaggtcgccttatcggagaaggagactcggagcattatgagatctctacttgaggctgtgtctttcctgcatgccaataatatagtgcacagggacctaaagccggagaacatcctgctcgacgataacatgcagatccgcctgagtgattttgggttttcctgtcaccttgagcccggagagaagttgcgcgaattgtgcgggacacccggctaccttgcaccagagatcctcaaatgtagcatggatgagacccatcccggttacggcaaggaggtcgacctgtgggcatgtggcgttatcctgttcaccctcctcgcagggtccccgcctttttggcataggcgccagatcctgatgttgaggatgataatggagggccagtatcagttttcctctccggagtgggatgatcgctcctctactgttaaggacctcattagccgccttcttcaggttgatccggaggctaggttaaccgcggagcaagcactgcaacaccccttcttcgaacgctgcgaagggtcacagccatggaacctcacgcctcgtcagagattccgcgtggcagtatggacagtcctggccgccggtcgggtcgccctgtctacccatcgagtgagaccccttacaaagaacgccctactgcgggatccttacgcactgcgaagtgttcgccacctgatcgacaactgcgcatttcggctgtacggacactgggtcaagaaaggcgagcagcagaatcgcgccgcacttttccaacatagacctcctggccctttcccaatcatgggacctgaggaagagggtgactctgcagctattacagaggacgaagcagtcctggtcctgggc

SEQ ID NO: 17999 - DNA, 1218 bp, Artificial Sequence
  Description of Artificial Sequence: Synthetic coding sequence
atgacgttagacgtggggccagaggatgaacttcccgactgggccgccgctaaggagttttaccaaaagtacgatcctaaggatgtgatcggaagaggtgtgtcatccgtagtgagacggtgtgtgcaccgtgctacaggacacgagttcgccgttaagatcatggaggtgacagctgaaagactctctcccgaacagctagaagaagtgcgggaggctactcggcgcgagacccatattctgcgacaagtggccggccacccacacataatcacgctcatcgactcttacgagagctcatccttcatgttcctggttttcgatctgatgaggaagggagaactattcgattacttaactgagaaggtggcgctgagcgagaaagagacaaggtctatcatgcgctccctattggaggcggtgtcctttttgcacgcgaacaacattgtgcaccgggatttgaaacccgagaatatcctgctagacgataatatgcagatccgtctgtcagactttgggttcagctgccacctggagcccggcgagaagctgagggagctatgtgggactcctgggtacttggccccagagatcctgaaatgttccatggacgagacacaccccggttatggtaaagaggtggatctgtgggcttgcggcgtgatcttgttcacactgctggccggatcacctcccttttggcatagacgtcagatcctgatgctgcgcatgatcatggaggggcagtaccaatttagcagtcctgaatgggacgaccgatctagcactgttaaagatttgatctcaagactgcttcaagtcgatccagaggcacggctgacagccgagcaggccctgcagcatccctttttcgagcgatgcgagggaagtcagccttggaacctgacccctagacagaggttcagagtggctgtttggaccgtccttgctgccgggcgagtagctctttccacacaccgtgtgcggcccctaacaaagaacgccctgctgagggacccttatgcactgaggtcagtccggcatctaatagacaactgcgcatttcgactctatgggcactgggtgaagaagggcgaacagcagaatcgggctgcactgttccagcacaggcccccgggaccatttcctataatgggtcccgaggaggagggagattccgccgcaattacagaagacgaagccgtgctcgtcctgggc

SEQ ID NO: 18000 - DNA, 1218 bp, Artificial Sequence
  Description of Artificial Sequence: Synthetic coding sequence
atgaccttagacgtaggtccagaggacgaactcccagactgggcggcagcgaaggagttctaccagaagtacgatccaaaggatgtgatcggccgcggtgtgagcagcgttgttcgccgttgtgtacaccgcgctactggtcatgagtttgctgtgaagattatggaggttaccgcggagcgcttgagccctgaacaactggaggaagtgagggaagcgacccgaagggagacccacatcttgcgacaagtggcaggtcaccctcatatcattaccctgattgattcgtatgaatcttcttccttcatgttcctggtgtttgatttgatgcgtaagggtgagctgtttgattatctgaccgagaaagtcgctcttagcgagaaggagacccgtagcatcatgcgcagtctgttagaagcggttagtttcctacatgccaataacattgtccaccgagatctgaaacctgaaaatatactgcttgacgacaacatgcagattcgactgtccgatttcggttttagctgtcatctggaaccaggtgaaaagctgcgagagttgtgcggcaccccgggctatcttgctccagaaatcctgaagtgttcaatggacgagacacacccaggatatggcaaggaggtggacctgtgggcgtgcggtgtcattctatttaccctgcttgcaggcagcccacccttttggcataggcgccagatcctcatgctgcgcatgatcatggaaggccaatatcagttcagcagcccagagtgggatgatagaagcagcaccgtgaaagatctgatttcccgcctgctccaggttgatccagaggcacgtttgaccgcggagcaagctctccagcacccgttttttgagagatgtgagggcagtcaaccttggaacctgacgccacgccagcgctttcgcgtggcagtttggactgttctggcagccggtcgcgtcgcgctgtcaacccatcgtgtgcgcccgctgactaaaaatgccctgctgcgcgacccctacgcgctgcgcagcgtccgtcacctcatcgacaactgcgccttccgcctgtacggacactgggttaaaaaaggcgagcaacagaatagagcggcattgttccaacatcgcccccctgggccgttccccatcatgggtcctgaggaggagggcgatagcgcagcgataactgaggacgaggcggttttggtgctgggc

SEQ ID NO: 18001 - DNA, 1218 bp, Artificial Sequence
  Description of Artificial Sequence: Synthetic coding sequence
atgaccctggacgtgggacctgaggatgaactgccggattgggctgcagcgaaggagttttaccagaagtacgatccgaaggacgtgattggccggggcgtttcgtccgttgtgagaaggtgcgtgcacagggcaactggtcatgaattcgccgtcaagatcatggaggtcaccgcagagcgcctgtcaccagaacaacttgaagaagtgcgcgaggctacgcggagagaaacccatatcctgagacaagtggccggtcacccgcatatcattactttgatcgattcgtacgagtcgtcgtcatttatgtttctggtgtttgatcttatgcgaaagggggaactgttcgactacttgaccgaaaaggtggccttgagcgaaaaggaaacccgttcaattatgcgttcgcttttggaagcagtcagcttccttcatgcaaataacattgtccaccgagatctgaagcccgaaaacattcttctggatgataacatgcagataagactttcagatttcggattttcgtgccacctcgaaccaggtgaaaagctgagagaactgtgtggcactcctggctacttggcgcccgagattcttaaatgctccatggatgaaactcatccaggatacggtaaggaagtggacctctgggcctgtggtgtgattcttttcactctgcttgcaggatccccgcctttttggcatcgccgccagatcctcatgctccggatgattatggaagggcagtaccaatttagctcgcccgaatgggatgatcgttccagcactgtcaaggaccttatttcccggctcctccaggtggatccagaagcacggcttactgcagaacaggcccttcaacatccgtttttcgagagatgcgaagggagccagccttggaacctcactccacgtcaacggtttcgagtggcagtttggactgtgctcgcagcaggcagagtcgcactgtccacccatcgcgtgcgaccgctcactaagaacgcactgctgcgggacccatacgcacttcggagcgtgcgccatcttattgacaactgtgccttcaggctttacggccactgggtgaagaagggagaacaacaaaatcgggcagcactgttccagcatagaccacccggtccttttccaatcatgggaccagaagaggagggtgatagcgcagcaattaccgaggacgaggcagtcttggttcttggt

SEQ ID NO: 18002 - DNA, 1218 bp, Artificial Sequence
  Description of Artificial Sequence: Synthetic coding sequence
atgactcttgacgtggggcctgaggacgaacttccagactgggcagcagcaaaagaattctaccaaaagtacgatcctaaggacgtcataggtcgaggtgtctcctcagtggtgcggcgatgcgtccacagagctactggacatgaattcgcagtgaagataatggaagtcaccgcagaaagattgtcgccagaacaactggaggaagttagagaggcaacgagaagggaaactcatatcctccggcaggtcgcagggcacccccatatcattaccctgatcgatagttacgagtcgtcgtcatttatgtttctcgtattcgacttgatgcggaagggagaacttttcgattacttgactgaaaaagtggcactttccgagaaggagactcgtagcatcatgcgaagcctgcttgaggcagtgtcctttctccacgccaacaatatcgtgcatagggacctgaagcctgagaatatcctgctggatgacaacatgcaaattcgactgtcagattttggattttcgtgtcatcttgaaccgggcgaaaaacttcgggaactgtgtgggacccctggatacttggctcctgaaattctgaagtgttcgatggatgagactcatcccggatacgggaaggaggtggatctgtgggcctgtggcgtgattctgtttacgctgcttgcgggcagcccaccattctggcatcgccggcagatcctcatgcttagaatgataatggagggtcaatatcaattttcatcccccgaatgggacgataggtcgtccactgtgaaagatctgataagcagactcctgcaggtggaccccgaagcacgactcactgcagaacaggcgctccagcatcctttctttgagcgatgcgaaggaagccagccttggaatctgaccccccgccaaaggtttagagtcgccgtgtggactgtcctggcagccggacgagtcgcactctcgacccaccgagtccgtcctctgacgaagaacgcccttctccgggatccatacgcactcaggtcggtgagacacttgattgataactgtgcgtttcggctctacggccattgggttaagaagggtgaacaacagaacagggcagcattgttccaacacaggccaccaggtccgttccctattatgggcccagaagaggaaggggattcggcagctattaccgaagatgaagctgtactggtgcttggg

SEQ ID NO: 18003 - DNA, 1218 bp, Artificial Sequence
  Description of Artificial Sequence: Synthetic coding sequence
atgaccctcgacgtgggaccggaggacgaactgccggattgggcagctgccaaggagttctaccagaagtacgatccaaaggatgtgatcggccggggagtgtcctcagtcgtccgcagatgcgtccatagagcgacgggacacgagttcgctgtgaaaatcatggaagttactgccgagagactgtccccggaacaacttgaggaggtccgggaagcgactcggagagagactcatattctgagacaggtggccggacatccacacattatcactctcatcgacagctacgaatcctcgtcgttcatgttcctggtgttcgacctgatgcggaagggggagctgttcgattacctgactgaaaaagtcgcactctcggagaaagaaacgagatcgattatgcggtcactccttgaagccgtgagcttcctccacgcgaacaatatcgtccatcgcgaccttaagccagaaaacatcctcctggatgacaatatgcagatccgcctctcagactttggattcagctgccacctcgagccgggagagaagctccgcgagctctgtggcaccccgggatacctggcgccagaaatcctcaagtgttccatggacgaaacccatccgggttatggcaaggaagtggacttgtgggcttgcggagtgatcctgttcactctgctggcgggatcgccaccgttttggcaccgccggcagatcctgatgcttaggatgatcatggaagggcagtaccagtttagctcgccagaatgggatgaccgtagcagtaccgtgaaggatctgatctcccgacttcttcaggtcgacccggaagcgcgcctgaccgctgaacaagccctccagcacccattcttcgagagatgcgaagggagccagccttggaatctgaccccccgccaacggttcagagtggcggtgtggacggtcctcgctgcggggcgggtggcgctgtccacccatcgggtccgcccccttaccaagaatgctctcctccgcgacccatacgccctgcggtcagtcaggcacctcatagataactgcgccttccggctttacggccactgggtgaaaaaaggcgagcagcagaatcgggcggccctctttcagcacagaccgcctggtccattcccgatcatgggaccagaggaagaaggagatagcgccgctattaccgaggatgaagctgtgctggtgctcggg

SEQ ID NO: 18004 - DNA, 1218 bp, Artificial Sequence
  Description of Artificial Sequence: Synthetic coding sequence
atgacactcgatgtcggtcccgaagacgaactcccggattgggctgccgctaaagaattttaccagaagtatgacccgaaagatgtgatcggacgaggcgtgagtagcgttgtgagaaggtgtgtgcatcgggctacggggcacgagtttgcggtgaagattatggaggtcacagccgaacgactgagtcccgagcaactcgaggaagtgagggaggctacaaggagggagactcacatattgcgacaggttgccggtcacccccatatcataactctcatcgattcctacgagtcctcatcattcatgtttctcgtgttcgaccttatgcgaaagggggagctgttcgattatcttactgagaaagtcgcactcagtgaaaaggagacccggtctatcatgaggtccctgctggaagctgtctcttttctccacgccaataatattgtccatcgagatctcaagcctgaaaatattctgcttgatgacaacatgcagataagactcagcgacttcggattctcatgtcacttggagccaggagagaagctgcgggaactgtgtggtacccccggttacctggccccggagattctgaagtgttccatggatgaaacccatccgggctatggtaaggaagtagacctctgggcttgtggtgtcattctctttacactcttggcagggtccccgcctttctggcatcgccgacaaatcctgatgttgaggatgatcatggagggccagtaccagttctctagtcccgagtgggacgaccgcagtagcacggtgaaagacctgatctcacggttgctgcaggtggatcccgaagcccgcctcacagccgagcaggccctccagcacccgttcttcgagcggtgcgagggatcccagccttggaatcttactccccgacagagattccgcgtagccgtttggacagtgcttgccgccggcagggtcgcactttcaacacaccgcgtgcgccccctgactaagaatgccctgttgcgggatccttatgcattgcgcagtgtccggcaccttatagataattgtgctttcaggttgtacggacactgggtcaagaagggtgaacagcagaaccgggctgcactgttccagcataggcccccagggcccttccctatcatgggccctgaggaagaaggcgattccgcggccattactgaggacgaggcggtgctggtcctggga

SEQ ID NO: 18005 - DNA, 1218 bp, Artificial Sequence
  Description of Artificial Sequence: Synthetic coding sequence
atgacgctagatgtaggtccggaagatgaactaccggattgggcggcggcgaaagaattttatcaaaaatatgatccgaaagatgtaataggtcgtggtgtatcgtcggtagtacgacgatgtgttcatcgtgcgacgggtcatgaatttgcggttaaaataatggaagtaacggcggaacgtctatcgccggaacaattagaagaagttcgtgaagcgacgcgtcgtgaaacgcatatattacgacaagttgcgggtcatccgcatataataacgctaatagattcgtatgaatcgtcgtcgtttatgtttttagtatttgatttaatgcgtaaaggtgaattatttgattatctaacggaaaaagtagcgttatcggaaaaagaaacgcgatcgataatgcgttcgttactagaagcggtatcgtttttacatgcgaataatatagtacatcgagatctaaaaccggaaaatatactattagatgataatatgcaaatacgattatcggattttggtttttcgtgtcatctagaaccgggtgaaaaactacgtgaattatgtggtacgccgggttatttagcgccggaaatattaaaatgttcgatggatgaaacgcatccgggttatggtaaagaagtagatttatgggcgtgtggtgtaatattatttacgttattagcgggttcgccgccgttttggcatcgtcgtcaaatactaatgttacgaatgataatggaaggtcaatatcaattttcgtcgccggaatgggatgatcgatcgtcgacggttaaagatctaatatcgcgattattacaagttgatccggaagcgcgtttaacggcggaacaagcgttacaacatccgttttttgaacgatgtgaaggttcgcaaccgtggaatttaacgccgcgtcaacgatttcgagttgcggtttggacggtactagcggcgggtcgagtagcgttatcgacgcatcgagtacgtccgttaacgaaaaatgcgttattacgagatccgtatgcgctacgttcggtacgtcatttaatagataattgtgcgtttcgtttatatggtcattgggttaaaaaaggtgaacaacaaaatcgtgcggcgctatttcaacatcgtccgccgggtccgtttccgataatgggtccggaagaagaaggtgattcggcggcgataacggaagatgaagcggtattagtattaggt

SEQ ID NO: 18006 - DNA, 1218 bp, Artificial Sequence
  Description of Artificial Sequence: Synthetic coding sequence
atgactctggacgtgggacctgaagatgagctccctgactgggcagcagccaaagaattctaccaaaagtatgatccaaaggatgtgattggtcgcggtgtgtcgtccgtggtgcgtcgctgtgtgcacagagcaaccgggcatgagttcgctgttaagattatggaagtcaccgcagagcgcctgtccccagaacagttggaagaggtgcgcgaagctacccgcagagagacgcacatcctccgccaggtggccggacatccccatatcattaccctgatagattcatacgagtcatcatcctttatgttcctggtgttcgatctgatgcggaagggtgagctgtttgattacctgaccgaaaaagtggcgctgtccgaaaaagaaactcgcagcattatgagatcgttgctcgaagcagtgtcgttcttgcatgccaacaatatcgtgcatcgagatttgaagcctgagaacattctgcttgatgacaatatgcaaattcgactttccgatttcggtttctcgtgtcatctcgaaccgggggaaaagctcagggaactctgcggcacccctggataccttgctcctgagattctgaaatgttcgatggacgagactcatccaggctacgggaaagaggtggatctgtgggcctgtggagtgattctttttaccctgcttgcaggaagcccaccattctggcatcggcgccaaatccttatgctcagaatgatcatggaaggtcagtaccagtttagctcgccagagtgggacgatagatcttccactgtgaaggaccttatctcccgccttcttcaagttgatcctgaagcgaggcttactgctgagcaagccctgcaacaccctttctttgagaggtgcgagggatcccaaccctggaacctcaccccacgtcagagatttcgggtggcagtgtggaccgtgctcgcagcaggaagggtggcgctcagcactcatcgggtccgccccctgaccaagaatgcactccttcgggatccatacgctcttagatcagtgcgccacctgatcgataattgtgcctttcgcctgtacggacattgggtaaagaagggagagcagcagaatagggcggcgcttttccaacatagaccaccaggaccatttcctatcatgggccctgaagaggaaggagattccgcagctattaccgaagatgaagcagtgcttgtcctcggg

SEQ ID NO: 18007 - DNA, 1218 bp, Artificial Sequence
  Description of Artificial Sequence: Synthetic coding sequence
atgacactggacgttggcccagaggatgaactgccggactgggccgcagccaaagaattttatcagaagtacgacccgaaagatgttattggccgtggggttagttcggtagtgcgccgctgtgtacatagggctactggacacgaattcgccgttaagatcatggaggtcaccgccgagcggttatcacctgaacagctggaggaggttagagaagccactagaagggagactcacatccttaggcaagtggccggccatccgcatattatcaccctgatcgactcctacgagtcaagctccttcatgttcctggtgtttgatctgatgagaaagggagagcttttcgactacctgactgagaaggtggcactgagtgagaaagagacccgatccattatgcgctcactcctggaggcggtgtctttcctccacgcgaacaatattgtgcacagggacttgaagcctgagaacatcttactggacgacaatatgcagattagactgagcgatttcggcttctcctgccatctggaaccgggagaaaagttacgagagctgtgcggaactcctggatacctcgcccctgaaatccttaagtgtagtatggatgagactcatccaggttacggtaaagaggtggacctgtgggcgtgcggcgtcatccttttcaccttgctcgccgggtcacctcccttttggcatcgccgacagattctgatgctgcggatgatcatggaaggccagtatcagttctcctctccggagtgggatgatcggtctagcacggttaaagacttgatttcaaggctgctgcaggtagatccagaagccagactcactgccgagcaggcactgcagcacccattctttgagcgctgtgaggggtcgcagccctggaacctcactcccagacagcggttccgtgtagccgtctggaccgttctagcggcaggcagagtggcattgtctacgcatagagtgcggcccctcacaaagaacgctctgttgcgggatccctatgctctgcgcagtgtccggcatttaatcgataactgcgcctttcggttgtacggccattgggtgaagaaaggcgaacagcagaaccgggctgcactgttccagcatagacccccaggcccattccctatcatgggcccggaggaggagggagacagcgcagctatcaccgaggatgaggcggttcttgttttggga

SEQ ID NO: 18008 - DNA, 1218 bp, Artificial Sequence
  Description of Artificial Sequence: Synthetic coding sequence
atgactctggacgttggtcctgaggacgaactgccagattgggccgccgctaaggagttctaccagaaatatgaccctaaggacgttattggacgcggcgtgtcttctgttgtccggaggtgcgttcatcgcgccactggtcatgagtttgcagtcaagatcatggaagtaactgccgagaggctgagcccagagcaattggaggaggtcagggaagccaccaggagagagacccacatcctgcgacaagtcgccgggcacccccacattatcactcttatcgactcatacgaatcttcttccttcatgtttctcgtcttcgatcttatgcggaagggcgagctgttcgattacctcaccgagaaagtggctttgtccgagaaagagacaagaagcataatgcgaagtcttctggaggccgtgtctttcttgcacgccaacaacattgtacacagagacctgaaaccagagaatatcctgctcgacgataacatgcagatccgcctgagcgacttcggattttcatgtcatctcgaacctggagagaagctgagagagctttgtggcaccccaggatatctcgcaccagaaatcctgaaatgttctatggatgagacccatcctggctacggcaaagaagtggacctgtgggcctgcggggtgatcctttttaccctcctggccggctctccacctttttggcatcggcgacagatattgatgctccgaatgataatggaagggcaatatcagttctctagccctgaatgggatgatcgctcttctactgtgaaggatctgattagcaggcttcttcaggttgatccagaagctagactgacggcagagcaagccctgcaacacccattcttcgaaaggtgcgagggctcccagccctggaatctgacgcccaggcagagattcagggtggcggtgtggacagtgcttgcagctggccgagtcgctttgagcacgcaccgagtacgccctcttactaagaatgccctgctgagggatccatacgcgctgcgctcagtcaggcatcttatcgacaattgcgccttccgcctgtacggccattgggtgaaaaaaggagagcaacagaacagggccgcactttttcagcatcgcccacctgggccattccctattatggggcctgaagaggaaggcgatagcgcagctatcactgaggacgaggcagtgctggtgttgggc

SEQ ID NO: 18009 - DNA, 1218 bp, Artificial Sequence
  Description of Artificial Sequence: Synthetic coding sequence
atgactctggatgtaggcccagaggacgagctgccagattgggccgcggccaaggaattctatcagaagtatgaccctaaggacgtgatcggacggggagtgagctcagtggtgcgcagatgcgtgcatagagccaccggtcatgaattcgcagtgaagatcatggaggtgactgcggaacgactgtcgccagaacaactcgaagaggtgcgggaagccacccgccgggagacgcatattctgaggcaagtggccggacacccgcacattatcaccctgatcgattcttacgagtcgtcctcgttcatgtttctggtgttcgacctgatgcggaagggcgagttgtttgactacctgacggaaaaggtggctctgtcggaaaaggagactcggtcgatcatgcgctcgctgctcgaagcggtgtcgttcctccacgccaacaacatcgtgcatcgcgacctgaagccagaaaacatcctgctcgacgataacatgcaaatcagactgagcgacttcggcttcagctgtcatctcgaaccgggggagaagctgagggagctctgcggaacccctggatacctggcgccggaaatcttgaaatgctccatggatgagactcacccggggtacggcaaagaggtcgatttgtgggcttgcggagtgatcctctttactctgcttgcgggctcgcctccgttttggcatcgccgccaaatcctgatgctcagaatgatcatggaaggacaataccagttcagctcaccggaatgggacgacaggtcatccaccgtcaaggacctgatctcccggctgctgcaggtggacccggaggcacggctgactgccgaacaggccctccagcatccattcttcgagcggtgtgagggatcccagccatggaatctcactcctcgacagagattccgggtcgccgtgtggacggtgctcgcagcgggacgcgtggccctgtccactcatcgggtgcggccactcaccaagaacgctcttctccgggacccctacgcactccgctccgtgcgccacctcatcgataattgtgcctttcgcctttacggacactgggtgaagaagggcgaacagcagaacagggccgcgctgtttcaacaccggccgccgggaccctttccgatcatgggacctgaagaggagggagatagcgcggccatcactgaagatgaggccgtgctcgtgctggga

SEQ ID NO: 18010 - DNA, 1218 bp, Artificial Sequence
  Description of Artificial Sequence: Synthetic coding sequence
atgacccttgacgtcggaccagaggacgagctgcccgattgggccgctgctaaggagttctaccagaaatacgacccaaaggacgtgatcggccggggagtgtcctctgttgtgcgccggtgcgtccaccgggccaccggacacgagttcgcggtcaagattatggaggtcaccgcagaacgcctgagcccggaacagctggaggaggtccgggaagcgaccaggcgcgagactcacatccttcggcaggtcgcgggacacccacacatcatcactctcatcgactcgtatgaatcatcgtcgttcatgtttctcgtgtttgaccttatgcggaagggtgagcttttcgactacttgactgaaaaggtagccctctcggaaaaggagacgaggtccattatgcgtagcttgctcgaagccgtgtccttcctgcacgcaaataacatcgtgcaccgggacctgaagccggagaacatcctgctggatgacaacatgcagattcgtttgagcgacttcggattctcgtgccatctggagccgggcgaaaagctgcgggaactgtgcggcactcctggatacctggcgccagaaatccttaagtgttcgatggacgagacgcatcccggctacggcaaggaggtggacctgtgggcctgcggtgttattctcttcactcttttggcaggatcgccgccgttttggcataggcgccaaatcctgatgctccggatgatcatggaagggcagtatcaattttcgtcccctgagtgggatgataggtcgtctactgtcaaggatctgatctcgagactgctgcaggttgacccggaagcgcgcctgactgccgagcaagctcttcagcaccctttcttcgaacggtgtgaagggagccagccctggaacctcaccccacgccagagattcagagtcgccgtgtggactgtgctggccgcaggacgcgtggctctctccacccaccgcgtgcggccattgactaagaatgccctgctgcgcgacccttacgccctgcgctccgtccgccatttgatcgacaactgtgcattccgcctgtacggacactgggtgaaaaaaggagaacagcagaatagggccgcactcttccagcatcgccccccaggaccatttccgataatgggcccggaggaggaaggagattcggcggccatcaccgaggacgaggcggtgttggttctcgga

SEQ ID NO: 18011 - DNA, 1218 bp, Artificial Sequence
  Description of Artificial Sequence: Synthetic coding sequence
atgaccttggatgtcggtccagaagacgagctgccagattgggccgccgctaaggagttctatcagaagtatgatcccaaagacgtgatcggacggggggtcagcagtgtcgtaagacgctgtgtgcacagagcgactggacatgagtttgccgtgaagatcatggaggtgaccgccgaaaggctgtctcccgagcagctagaggaagtcagggaagcaacgagaagagagacccacattctaagacaggtcgccgggcacccccacattattacgctgatcgacagttatgaaagctcctcttttatgtttttggtgttcgatttgatgaggaagggcgagctatttgactatctgaccgagaaagtcgccctgagcgaaaaagaaacaaggagcatcatgcgctcattactggaggctgtgagtttcctgcacgccaataatatagtgcatagggatttaaaaccagaaaacattctgctggacgacaacatgcagatccgtctctctgactttgggttcagctgccacctcgaacctggtgaaaagctcagggaactctgcggaacccccggatacctggcccctgagatcctgaaatgctccatggatgagacgcacccgggctacggaaaggaggtcgacctgtgggcttgtggcgttatcctgttcaccctgttggccggctcgccacccttttggcatagacggcagattcttatgctccgaatgatcatggaggggcagtatcaattttcctctccagagtgggacgatcgatcctcgacggtgaaagatctgatcagtcgcctgttacaggtggatcccgaagccagattaacggccgagcaggcgctccagcatccttttttcgagcggtgtgaaggctcccagccttggaatttgacccctcgccagagattccgcgtggccgtgtggaccgtgttggccgccgggagggttgctttgagcacccacagggttagaccgctaaccaagaatgctctgctgagagacccttacgccttgcgttccgtcaggcaccttattgacaattgcgcatttcggctctatggacactgggtgaagaaaggggagcaacagaaccgggctgctctattccagcacaggccaccgggcccgtttcctattatgggacctgaggaggagggcgactccgcagctatcactgaggacgaggccgttctggtgctaggc

SEQ ID NO: 18012 - DNA, 1218 bp, Artificial Sequence
  Description of Artificial Sequence: Synthetic coding sequence
atgacattggacgtgggccccgaggacgagctacctgactgggcagctgccaaggaattttaccagaaatatgatcccaaggacgtgatagggaggggcgtaagttccgtggtcagacgctgtgtacacagagctactgggcacgagttcgccgtgaagatcatggaggtcaccgcagagaggctgtctcccgagcagctagaggaggtgagggaggctacacgaagggaaacacatatcttgaggcaggttgctgggcacccccatattatcactctgatcgatagttatgaatcctcttcattcatgttccttgtgttcgacctaatgcgaaagggagaattgttcgactacctcactgaaaaggtcgcactttctgaaaaggaaactagatccatcatgcgatctctgctggaggccgtgagctttcttcatgccaacaatatcgtccatcgagatctcaagccagagaatatcctgctcgatgacaacatgcaaatcaggttgagcgattttggattctcctgccatctggagcccggtgaaaagctgagggagttgtgtggtaccccgggctatctggcacctgaaatcttgaaatgttctatggatgaaacacatccaggttacggcaaggaagtggacctctgggcttgcggcgttatcctctttaccctgctcgccggctcaccacccttttggcaccggcgacagatcctgatgttgcgaatgatcatggagggtcagtatcagttctcttcccccgaatgggatgacaggtcaagcactgtcaaagacctgatttcccggctcctgcaggtcgaccctgaagcgagactaacagccgagcaagcccttcagcacccattcttcgaaagatgcgagggttctcaaccctggaatctaaccccgcggcaacgttttagagtcgcagtgtggactgtcctcgccgccgggagggtggcactgagtactcacagagtaaggccactgactaagaatgcgctgctgcgagatccctacgccctcaggagcgtccgacatctcatcgataattgtgcgttccggttgtacggccactgggttaagaagggcgaacagcagaatcgagctgccctttttcagcaccgacctccagggccattccctatcatggggccagaagaggagggggactcggcggccatcacggaagacgaggcggtgcttgtcctggga

SEQ ID NO: 18013 - DNA, 1218 bp, Artificial Sequence
  Description of Artificial Sequence: Synthetic coding sequence
atgacactcgatgtcggacccgaggatgaacttcctgattgggcagcggctaaagaattctatcagaagtacgatcctaaagatgtaattggacggggagtcagtagtgttgtaaggaggtgtgtgcaccgggccactggacacgaatttgccgtgaaaatcatggaagtcactgccgaaagactgtcccccgagcagctcgaggaagtacgagaagcaactagaagggaaacacatatactgaggcaggtagccggacatccgcacataataacgcttatagactcctatgaatcctcctcatttatgttccttgtgtttgatcttatgcggaaaggggaactgtttgactatctgacagagaaagtcgcattgtccgaaaaagaaactcgaagtataatgagatctctcctcgaagcagtgagttttcttcacgcaaacaatattgtgcatagggatctcaaaccagaaaacatcctcctggatgataatatgcagattaggctttctgacttcgggttttcttgccacctggaaccaggagaaaaactgcgggaactttgtggaacacctgggtacctcgcgccagaaatcctcaaatgttccatggatgaaacacatcccgggtatggaaaggaagtagacctatgggcctgtggggtaatcctcttcacactgctggccgggtctccaccgttttggcaccgcagacagatcctaatgctgaggatgataatggaagggcagtatcagttttcctccccagaatgggatgatcgctcctcaactgtcaaggaccttatctccaggctcctacaggttgaccccgaagcacggctaacagctgaacaggctttacagcatccattttttgaaagatgtgaagggtcgcagccttggaatcttacaccaaggcagcggttccgggttgccgtttggactgtcctggccgccggaagagtggccctttctacacacagagtaagaccccttactaaaaatgctctcctccgggacccttacgccctgaggtctgttaggcacctcatagacaactgcgcttttaggctctatggacactgggtaaagaaaggagaacagcaaaatagagcagctctatttcagcatagacctcccgggccattcccaatcatgggacccgaagaggaaggagattcggcggccatcacagaagatgaggctgtgttagttcttgga

SEQ ID NO: 18014 - DNA, 1218 bp, Artificial Sequence
  Description of Artificial Sequence: Synthetic coding sequence
atgaccctcgacgtcggacctgaagatgaactgcccgactgggccgctgctaaggagttctatcaaaagtacgatccgaaggatgtgatcggtcgcggagtaagctccgtcgtgcggcgatgcgtgcatcgcgctaccggtcacgagttcgcggtcaagataatggaggtcaccgccgagcgtctctcccccgagcagttggaggaagttcgcgaggctacgcgtcgcgagacccacattctacgccaagtggctgggcacccccacatcattacccttattgatagctacgaaagtagcagcttcatgttcttggtcttcgacctgatgaggaagggcgagctgttcgactacttgaccgagaaggttgcgctctcggaaaaggagacccgctcaatcatgcggtccttgttggaggctgtttcgttcctgcatgctaacaatatagtccatagagacctgaagccggaaaacattcttttagacgacaacatgcaaatccgcctgtccgacttcggattcagttgtcaccttgagcctggagaaaagctccgcgagctttgtggcacgccaggctacctcgctcctgagatccttaagtgctccatggatgaaactcaccccggttacggaaaggaagtcgacctgtgggcctgtggtgtgatcctcttcacccttttagctggctcgcctccgttctggcaccgcagacagattctcatgctgcgtatgatcatggaaggccaataccagttctcgtcaccagagtgggacgaccgcagttccacagtcaaggacctaatttctcgcctgcttcaggtggaccccgaggcgcgtcttacagcggaacaggccctccagcaccctttcttcgagcggtgtgagggatcacagccgtggaatctcacccctcggcagcggttccgagttgctgtttggacggtcctcgcggccggtcgcgtggccttgtcaacccaccgggtccgccccttgactaagaatgctttgcttcgggacccctacgctcttaggagcgtccgccatctcatcgacaactgcgcgtttcgcctgtacggacactgggtgaaaaagggcgagcaacagaaccgtgccgcgttgttccagcaccgtccgcccggtcccttccctatcatgggcccggaagaggagggagactccgccgccattaccgaggacgaggctgttctggtccttggc

SEQ ID NO: 18015 - DNA, 1218 bp, Artificial Sequence
  Description of Artificial Sequence: Synthetic coding sequence
atgaccctggatgtggggcctgaggacgagcttcctgattgggctgcagctaaggaattttaccagaaatacgaccctaaggatgttatagggcggggcgtgtccagcgtagtccggcgctgcgtccacagagctactggccatgagttcgccgttaagatcatggaagtgactgcggagcgcctgagccccgaacagctggaagaggtcagggaagcaacaaggcgcgaaacccatatcttgaggcaggttgcaggacaccctcatatcataaccttgattgactcctacgaatcttcatctttcatgtttcttgtattcgaccttatgcggaaaggagagctgttcgattatttgaccgagaaggtcgccttgtctgagaaagaaacgcgctctataatgcgaagcctgctggaggccgtgtcattcctgcatgctaacaatatcgtgcacagagacctgaaacctgaaaacatccttctggatgataacatgcagatccgattgagtgacttcggattttcttgccacctggagcccggcgaaaagctgagggagctttgcggcactccggggtacctggcgcccgaaatcctcaaatgcagcatggacgaaacacatcctggctacgggaaggaggtggacctttgggcttgtggagttatactgtttaccttgctggccgggtcccctccgttctggcatcgacgccagattctgatgctcagaatgattatggagggccaataccaattcagctcccccgagtgggacgaccgctccagcaccgttaaagaccttataagcagattgctgcaggtagaccccgaagcccgactcacagcagaacaagctctgcagcatccattttttgagaggtgtgagggatcacagccatggaatctgactccaaggcagaggtttcgcgtagctgtgtggactgttctggctgccggaagggtggcactgtctactcatcgcgtgcgcccgctgaccaagaacgccctgctgcgggacccttacgccctgcggagcgtccgacatttgattgataactgcgccttccggctttatggacactgggtgaagaagggggaacagcagaaccgcgcggctttgtttcagcacagaccacctggacctttccctataatggggcccgaggaagagggggactccgcagcaattacggaggacgaggctgtcctggtgctcgga

SEQ ID NO: 18016 - DNA, 1218 bp, Artificial Sequence
  Description of Artificial Sequence: Synthetic coding sequence
atgaccctcgacgtcggtccagaggatgaactgcctgactgggcagctgccaaggaattctatcaaaagtatgacccaaaggatgtgataggaaggggtgtctcttccgttgtgagaaggtgcgtgcatagggctactggccatgaatttgccgtgaagataatggaagtaaccgccgagagattaagtcctgagcagctggaagaggtccgggaggccacaagacgcgaaacccatattctcagacaagtcgcaggccacccacatattatcaccctaatagactcctatgagagctccagcttcatgttccttgttttcgacctgatgagaaagggggagttgttcgattatctcacagagaaagtggcgctgtctgagaaggagacaagatcaattatgaggagcctgctcgaggcagtgtccttcttgcatgctaataacatcgtccatagagacctgaagcccgagaatatcctgttggatgacaacatgcagatcaggctaagtgattttggcttttcatgccatttggagcctggcgagaagctcagagagctatgcggcacacctggttatctggcacccgaaatcctcaagtgctctatggatgaaacccatcccggctatgggaaagaggtcgatttatgggcttgcggggttatcctctttacgctgttggcaggctcacctcccttttggcaccgccggcagatcctcatgctgcgaatgattatggaggggcagtaccagttcagctcccctgaatgggacgacaggagctcaaccgttaaagacctgataagtaggcttcttcaggtggatccagaggccaggttgactgccgagcaggctctgcagcaccctttttttgaaaggtgcgagggttcccagccatggaatttaacaccgcgtcagcgctttagagtggctgtgtggaccgtgcttgccgctggcagggtggcattgagcacccatagagtccgccccctgacaaagaacgctctgttgagggatccctacgccttgagatccgtgcgccaccttattgataattgtgcgttcagactgtacggacattgggtgaagaaaggggagcaacaaaatagagccgcactgtttcagcaccgacccccagggcccttccctatcatggggccagaggaggaaggggatagtgctgcaatcacagaggacgaagctgtccttgtgctgggt

SEQ ID NO: 18017 - DNA, 1218 bp, Artificial Sequence
  Description of Artificial Sequence: Synthetic coding sequence
atgactctcgacgttggcccagaagacgagcttccagattgggccgctgcgaaggaattctatcagaaatacgatccaaaggacgttattggacgtggtgtgtcaagtgtggttcgcaggtgcgtccaccgtgccaccggacatgagtttgcggtcaagataatggaagtgacggccgaacggctgtcccccgaacagctcgaagaagtcagagaagccactaggcgagagacacacatccttcgtcaggtagctggccatccgcatatcatcacactaattgattcatatgaatctagcagtttcatgttcctggtgtttgatctgatgcggaagggtgaactgtttgactatctcaccgagaaggttgcgctctcggaaaaagagacgagatctattatgcgctctctgctggaggccgtttcctttctgcatgccaacaacatagtgcatagggacctcaagcccgaaaatatactcctggatgataacatgcagattagactgagtgattttggcttcagctgccatctggagccgggtgaaaaactgagagagctctgtgggacacccggctatctagcccccgagatactgaagtgttccatggatgaaacacacccaggctatggaaaggaagttgacctgtgggcctgcggtgtgatcctgttcaccttactcgccgggtcccctccattttggcaccgcaggcagattctgatgttgcgtatgataatggaaggtcagtatcaattttccagtcctgagtgggacgacaggtcaagcacggtgaaagatctcatcagccgcttgttgcaagtcgatcctgaagccaggcttaccgccgaacaggctttacagcacccctttttcgagcgctgtgagggatcccagccgtggaatttgacacccaggcagagatttcgtgtggccgtgtggactgtgttagccgccgggagagtagccctatctacgcatagggtgcggcctctgaccaaaaacgccctcttaagggacccgtatgcactccggagtgtacggcaccttatagacaactgcgcttttcggctgtacgggcactgggttaaaaaaggcgagcagcaaaaccgagcagccctgttccagcatcgccctcccggacctttccctatcatgggaccggaggaggaaggcgactccgcggccattactgaagacgaggcggtgctcgtgctgggg

SEQ ID NO: 18018 - DNA, 1218 bp, Artificial Sequence
  Description of Artificial Sequence: Synthetic coding sequence
atgaccctcgacgtcggccctgaagacgagcttccagattgggccgccgccaaggaattttatcagaaatacgacccgaaggacgttatcggacgtggagtttcaagcgtggtccgtagatgcgtccatcgtgccaccggacatgaattcgcagtaaaaatcatggaggtgaccgcagagagactatcacctgaacaattggaagaagtgagggaggccaccaggcgagaaacccatatcctgcgtcaggtcgcaggccaccctcacatcatcacactcatagacagctacgaatcttctagttttatgtttctggtgtttgacttgatgaggaagggtgagttgtttgattatcttaccgagaaagtcgccctgtccgagaaggagacacgctcaatcatgcgctcattgctggaggctgtatcattcctgcacgcaaacaacattgtgcatcgagaccttaaacctgaaaatattctgctggacgataacatgcagatccggctgagcgatttcgggttcagctgtcacctggagccaggagaaaaactgcgcgaactctgcggcacaccaggatacctggctcctgagatccttaaatgcagcatggacgaaacccaccctggctacgggaaggaggtggacctgtgggcatgcggagtgatcctgtttactcttctagcggggagcccccctttttggcacagaaggcagattctgatgctgcgcatgatcatggaaggccaatatcaattcagtagccccgaatgggacgatcggtctagcaccgtgaaggacctgattagcaggttgctgcaagtcgacccggaagctcgactgaccgccgagcaagctttacaacatccatttttcgagcggtgtgagggatcccagccgtggaacttgaccccacgccagagatttagggtcgccgtatggaccgtgctggctgccggccgtgtcgcattatctacccatcgggtcagaccactgacgaaaaacgcactcctgagggatccctacgccttaaggagcgtcagacaccttatcgacaactgtgcctttcgactctacggacattgggtgaagaagggcgaacagcagaaccgggcggctcttttccagcatcgccctccaggcccatttcctatcatgggccccgaagaagaaggagattcagccgctatcacagaagatgaagccgtcctcgtccttggc

SEQ ID NO: 18019 - DNA, 1218 bp, Artificial Sequence
  Description of Artificial Sequence: Synthetic coding sequence
atgactcttgacgttggccccgaggatgagctgcctgactgggcagccgccaaagagttctaccagaagtatgatcccaaggacgtgataggccggggtgtgtcgtcggtggtacgccgatgcgtccatcgagctacgggtcatgagtttgccgtgaagattatggaagtgaccgctgagcgactcagtcctgagcagctggaggaggttcgtgaagcaacgcgacgcgagacccacatcctgcgccaagttgcgggacaccctcacattataaccctgatcgattcttatgagtcgtccagtttcatgttccttgtgtttgaccttatgcgcaaaggtgaactgttcgactatctcaccgaaaaggtcgcccttagtgagaaggagactcggtccatcatgcgttccctgttggaagcggtgagctttctacatgcgaataatatagtgcaccgtgacctgaagcctgagaatattctgcttgatgacaacatgcaaatcagactgagtgactttggcttttcctgccatctcgagcccggcgagaagcttagggagctgtgcggtactccggggtatctggccccagagatcctgaagtgctcgatggatgagactcaccccggatacggaaaagaggtcgatctgtgggcctgtggagtgattctctttaccctgctggcgggatccccaccgttttggcaccggcgacagattctgatgctgaggatgataatggaaggacaatatcagttttcgagccctgagtgggatgatagatcgtccactgtgaaggacctgattagccggcttctacaggtcgacccagaggcccgcctgaccgcagagcaggccctccagcatcccttctttgaacgctgcgagggctctcaaccctggaacctaacgccccgccagcggtttagggtggcggtttggacagtgttggctgccggccgcgtagcgcttagcacccaccgtgtccgaccactgacaaaaaatgccctactacgggatccatatgcgctgcgatcagtgcgtcatctgatcgataactgtgcattccggttgtacggccattgggtgaagaagggggagcagcaaaaccgggcggccctgttccaacataggccccccggcccctttcccattatgggccctgaggaagaaggcgactcagctgccatcaccgaggatgaggcagtgctagtactgggc

SEQ ID NO: 18020 - DNA, 1218 bp, Artificial Sequence
  Description of Artificial Sequence: Synthetic coding sequence
atgacgctggacgtcgggccggaggacgaacttcccgactgggcagccgcgaaggagttttaccagaaatatgatcccaaggacgtgatcgggcgcggtgtgagctcagtcgtgagacgctgcgtgcaccgcgcaaccggacatgaattcgcggtgaagatcatggaagtgaccgcagaacgcctctccccggagcagctcgaggaggttagggaagctacccgcagagaaacccatatcctgaggcaggtggccgggcatccgcacattatcaccctcatagactcgtacgaaagctcctccttcatgttcctggtgttcgatctcatgcgaaagggagaactgttcgactacctcactgaaaaagtggctctctcagaaaaggagactaggtcgattatgagatctctgctcgaagcagtctcgtttttgcacgctaataacatcgtgcacagagacttgaaaccagagaacatcttgctggacgataacatgcaaatccggctgtcagatttcggtttctcatgtcatcttgaaccgggggaaaagctgcgcgagctttgcggcactccgggatacctggcgccggagatcctcaaatgcagcatggacgagacgcatccgggatatggcaaggaagtcgatctgtgggcatgcggagtgatcctcttcaccctgttggctggctcaccgccattctggcatcggcgccaaatcctcatgctgagaatgattatggaaggacaataccaattcagctcaccggaatgggacgaccggtcatcgaccgtgaaggatctgatctccagactgctccaggtggaccctgaggcgagactcactgccgaacaggcgctgcaacacccgttcttcgaaaggtgcgaaggatcacagccgtggaatctgactccaagacagcggtttcgagtggccgtgtggaccgtcctcgcggccggacgggtcgccctctccacccaccgcgtgaggccgttgacgaagaatgcactcttgcgcgatccttacgcgctgagatcagtccgccaccttatcgataactgtgcctttcgactgtacggtcactgggttaagaaaggtgagcagcagaaccgcgccgcgctctttcagcaccggccaccgggtcccttcccaatcatgggaccagaggaggaaggggactcggccgctatcacggaggatgaggcggtgctggtgttggga

SEQ ID NO: 18021 - DNA, 1218 bp, Artificial Sequence
  Description of Artificial Sequence: Synthetic coding sequence
atgactcttgatgtcggtccggaggacgaactcccagattgggctgcagctaaggagttttatcaaaagtacgaccctaaggatgtcatcggccgaggggtgtcctcggtggttcgccggtgtgttcatagagccaccggacacgagtttgcagttaagattatggaggtgacggcagaacgactttcaccagagcagctggaagaagtgcgcgaggcgacccgccgcgagactcatatcctcagacaagtggcggggcatccgcacatcattaccctcattgatagctacgagagctcgtccttcatgtttctcgtgttcgatctgatgagaaagggagaacttttcgactaccttaccgaaaaagtggcactctcggaaaaggaaaccagaagcatcatgcgaagcctccttgaagcggtgtcctttctgcacgcaaacaatatcgtccatagagatcttaagccagaaaacattctgctggacgacaacatgcagattcggctgtcagatttcggtttcagctgtcaccttgaacctggcgagaaactgagagaactttgcggcactcctggatacttggcaccggaaattctgaaatgttcgatggacgaaactcatccaggatatggcaaggaagtcgatctttgggcgtgcggcgtgattcttttcacgcttctggccggctcgcctcctttttggcacagaaggcaaatcctcatgctcagaatgattatggaaggacagtaccagttttcctcgcctgagtgggacgacagatcttcgacggtgaaggaccttatctccaggctgctccaagtcgatccagaggcacgccttaccgcggaacaggcccttcaacacccattctttgagcgctgtgagggctcacagccatggaacctgactccacgacaacgctttagagtggcagtgtggaccgtccttgccgcaggacgtgtggccctgtcgactcatcgggtgcgccccctgaccaaaaacgcgctgcttagagatccatacgcacttagaagtgtgagacatctgattgataattgtgctttccgattgtacggacattgggtgaagaaaggagagcagcaaaacagggcagcactgtttcaacacagaccacctggcccatttccaattatgggaccagaagaagaaggcgactccgcagcaatcacggaagatgaggcggtcctggtgctcggg

SEQ ID NO: 18022 - DNA, 1218 bp, Artificial Sequence
  Description of Artificial Sequence: Synthetic coding sequence
atgacactcgatgttggccctgaagacgagcttcctgactgggctgccgccaaggagttttatcagaagtacgaccctaaggatgtgatcggccgtggagtgtccagcgtagtaagacgctgcgtccaccgcgctacaggccacgagttcgccgttaaaatcatggaggtaaccgccgagaggttgtctccagaacagctcgaggaagttagagaggctacaagacgtgaaactcacattctgcgccaggtggccggtcatcctcacattattactctgatcgacagttacgagagcagtagtttcatgttcctcgttttcgatctcatgagaaaaggcgagctgttcgactacctgaccgaaaaggtagccctgtctgagaaagaaacacgttcaattatgcgctctctgcttgaggcagtgtcctttctgcacgccaacaacattgtgcaccgtgacctgaagcctgagaatattttgctggatgacaatatgcaaatcaggctgagcgatttcggcttctcttgccatctcgaacccggtgaaaagttgcgtgagttgtgcggcaccccaggctacctcgccccagaaatcctgaaatgcagtatggatgagactcatcccggttacggcaaggaggtcgacctgtgggcatgtggtgtgatcttgttcacccttcttgctggttccccccctttctggcacagaagacagatcctcatgctcagaatgattatggaaggtcagtaccaattctcaagtcctgaatgggatgaccgctcatccactgtgaaggacctgatttctcgcctcttgcaggtggatcccgaagcacgcctgaccgccgaacaggccctgcagcacccatttttcgagcgctgcgagggatcccaaccctggaacctgaccccccgccagcgctttagagtcgctgtgtggacagtgctggccgccggaagagtagcactgtccacacaccgtgttcgcccactgactaaaaacgctctgctgagagacccctacgcactccgcagcgtcaggcacctcattgacaattgcgcctttaggctttacggtcattgggtcaagaaaggcgagcagcaaaatcgcgcagctctcttccagcaccgcccaccaggtccttttcccataatgggacccgaggaggaaggtgatagtgctgccatcactgaggacgaagctgtgctggtactgggc

SEQ ID NO: 18023 - DNA, 1218 bp, Artificial Sequence
  Description of Artificial Sequence: Synthetic coding sequence
atgactttggacgtgggcccagaagatgaactgcccgattgggctgcggccaaagaattttatcaaaagtatgatcccaaagatgtgatcggacgcggggtctcaagtgtggtacgcagatgcgtccaccgggcgacagggcacgagttcgctgtgaaaatcatggaggtcacagccgaacgtctgtcccctgagcagctggaggaggtgagggaagctacccgccgggagacccacatcctcaggcaggtggctggacacccccacatcatcacgctgatagatagctacgagtccagttctttcatgtttcttgtgttcgaccttatgagaaagggtgagctgtttgactatctgaccgagaaagttgctctgagtgagaaggagactagaagtatcatgcgctccctgctggaagcggtgtccttcttgcacgcgaataacatcgtccatcgcgacctgaagcccgagaacatccttctcgacgacaatatgcagattcgcctgtccgacttcggtttctcctgtcacctggagccaggggagaagctgcgggagctgtgcgggacgccgggatacctcgcccccgagattctcaagtgctcaatggacgaaacgcaccctggctacggcaaagaggtggacctctgggcttgcggtgttatattatttactttgctggccgggagcccgcccttctggcacaggcgtcagatcctgatgctgcgcatgatcatggagggacagtaccagttctcctcccccgagtgggacgaccgctcaagcacggtcaaagacctgatcagtagactactgcaggtggatcctgaggcccggttgactgcagaacaagccctgcagcaccctttttttgagcgctgcgaagggagtcagccttggaacctgactcctaggcagcggtttcgtgtcgccgtctggacggttctcgccgctggaagagtagccctctctactcatcgcgtgcgcccattaaccaaaaacgcattgttgcgtgacccctacgcgctgcgctccgtccggcaccttattgacaactgtgccttccgcctttatggtcactgggtaaaaaaaggagaacagcagaatcgagcagctctcttccaacaccggccccccggaccctttcccattatggggcccgaagaggagggcgacagtgctgccatcacagaagatgaagctgtgctcgtgctcggg

SEQ ID NO: 18024 - DNA, 1218 bp, Artificial Sequence
  Description of Artificial Sequence: Synthetic coding sequence
atgaccctcgatgttggaccagaggacgagctcccagactgggcggctgccaaggaattctaccagaagtacgatcctaaggatgtgatcggtagaggtgtcagcagcgtggtccggaggtgtgtgcaccgggccactgggcacgaatttgcagtgaagataatggaagtgactgcagaaagattgagccctgaacaactggaagaagtgagagaggcgactcgccgcgagactcatatccttcgccaggtcgcaggccacccacacataatcacccttatcgattcctatgaaagctcgtcgtttatgtttcttgtgtttgatctcatgcggaagggtgaactgtttgattatcttaccgaaaaagtggctctgtccgaaaaggaaactcgctccatcatgcgctcattgctggaagcagtgtccttcctccacgccaataacatcgtgcatagggatctgaagccagagaacattttgctggatgacaacatgcaaattcggctgtcagattttggtttttcgtgccacctggaacctggagagaaacttcgagaactttgtggtactccgggatacctggcacccgaaatcttgaagtgttccatggatgaaacccacccaggctacggtaaggaagtggatctctgggcctgtggagtgatactttttactcttctggcaggatcacctcctttttggcaccgcagacaaattcttatgctcaggatgataatggagggtcaataccaattttcatccccagaatgggatgacagaagctcgaccgtgaaggatctgatatccaggcttcttcaggtggatcctgaggcacgccttaccgcagaacaagcactgcagcatccttttttcgaaagatgtgagggctcgcagccctggaaccttactcctcgacagcgattccgcgtggccgtgtggaccgtgctcgcagcaggtcgggtggctctttctactcatagggtcaggccacttaccaagaacgcactgctgagggatccttacgctcttagatcggtccgacacctgatcgataactgcgcgttcagattgtacggacattgggtcaagaagggagagcagcagaatcgtgccgcactgttccaacacagacccccgggaccattccctattatggggccagaggaggagggtgatagcgcagccataactgaagatgaggcagtcctcgtgctgggt

SEQ ID NO: 18025 - DNA, 1218 bp, Artificial Sequence
  Description of Artificial Sequence: Synthetic coding sequence
atgactctggatgtgggtcctgaggacgaactcccggattgggccgcggctaaagagttctaccagaaatacgaccccaaagatgttattggtcgcggggtgtcatccgtggtgaggcgctgcgttcaccgggcgacggggcatgagttcgctgtcaagatcatggaagtgaccgctgaaagactgtcgccagagcagctcgaagaagtgcgggaggcgactagacgggagactcatatcctgagacaggtggcaggccacccacacatcataaccctcatcgacagctacgagtcatcttcgtttatgttcttggtgttcgatctgatgcgcaaaggcgagctgtttgattacctcactgaaaaagtggccctgtcagaaaaggagactagatccatcatgcgctcgctcctggaagccgtgtccttcctgcacgccaacaatatcgtgcaccgcgacttgaaacctgagaatattctgctggatgacaatatgcaaattcgcctgagcgatttcggattctcatgccatctggagccaggggaaaagctccgcgagttgtgcggcacgccgggataccttgctccggaaatcctcaaatgctccatggatgaaacccatcctggatacggaaaggaagtggacttgtgggcgtgcggagttattctgttcaccctgctcgcaggatccccaccgttttggcaccgccggcaaatcctgatgctgcgcatgataatggaaggccagtaccagttctcctcccccgaatgggatgaccggagctcgactgtgaaggacctcatctcgcggctgctgcaggttgacccggaggcccggctcactgccgagcaggcacttcaacatccgttttttgaacggtgtgaaggcagccagccgtggaatctcaccccaagacaacggttccgcgtggcagtgtggactgttctggcggctggaagggtggcgctgtcgactcaccgggtgcgcccgctgactaagaacgccctgctgcgggacccatacgccctgcgttcagtcagacacctgatcgacaactgtgcgttccgcttgtacggtcattgggtgaaaaagggagaacaacagaatagggcagcgctcttccagcaccgcccacctggaccgttcccgatcatggggccagaagaagaaggagactcagccgccattactgaggacgaagcggtgctcgtgctggga

SEQ ID NO: 18026 - DNA, 1218 bp, Artificial Sequence
  Description of Artificial Sequence: Synthetic coding sequence
atgactttggatgtggggcctgaagacgaattgcccgattgggctgctgccaaggagttctatcagaagtacgatcccaaggatgtaatcggtagaggtgtctcgtctgtggtgagaaggtgcgtccatcgagctacagggcacgagttcgcagttaagataatggaggttacggccgagaggctgtctccagaacagcttgaggaggtgagagaggccactagaagggaaacacatatattaaggcaggtggctggtcatccgcacattattacattgattgactcgtatgaaagctcgtctttcatgtttttggttttcgacttgatgagaaaaggagaactgttcgattacttaaccgaaaaggttgccctttcagagaaggagacccgcagcattatgcgctcccttctagaagcagtgtctttccttcatgctaataatatcgtgcatcgtgatttaaaaccagaaaacattttgttagatgacaacatgcaaatcaggctttcagattttggattctcttgtcatctggagcctggtgaaaaacttcgtgaactttgcggtacacccgggtatcttgcgcctgaaatcttgaagtgctcgatggacgagactcatcctggctacggaaaagaagttgacctgtgggcttgtggagttattctgtttactttgttagctggaagtcctcctttttggcacagaagacagattttaatgttgaggatgattatggaaggtcaatatcaatttagttcaccagagtgggatgaccgttcttccacagtgaaggatttgatctctcgattactccaggttgatcctgaggctaggttgactgctgaacaagcacttcaacatccattcttcgagcgttgcgagggatcacagccttggaacctaacccctcgccagagattcagggttgctgtttggactgtactcgctgctggccgtgttgcactatcgactcatagggtacgacctcttaccaagaacgcactccttcgggatccttacgctttgcgttcagtgcgtcatctgattgataactgcgcttttagactctacggccattgggtgaaaaagggagagcaacaaaatcgggcagctctctttcaacatcgacccccaggaccttttcctattatggggcctgaggaggaaggagattcagctgctattaccgaggatgaagcagtacttgttttggga

SEQ ID NO: 18027 - DNA, 1218 bp, Artificial Sequence
  Description of Artificial Sequence: Synthetic coding sequence
atgaccctggacgttggccccgaggacgaactccctgattgggcggcagcaaaagaattctatcagaaatatgatccaaaggacgtgatcgggagaggcgtgtcctcggttgtacggcggtgcgtgcacagggctaccggtcatgagtttgcggttaaaattatggaggtgacagccgaaagactttcacccgagcagttggaggaggtgcgagaagccactcggagagagacccatatattgcgtcaggtggcggggcatccacacattatcacgctgatcgatagctacgagagctcaagcttcatgttcctcgtgtttgatttgatgcgcaagggagaactgttcgactatctcaccgagaaggtcgctctgagcgaaaaggagactagaagcattatgcgatccctgttggaggcagtgagcttcttgcacgccaataatatcgtgcaccgagacttaaaacctgagaacatcctcctggatgacaacatgcagatacgcttgagcgacttcgggtttagttgccacctggagccaggggagaagttacgggagctgtgcggaacacccggttatttggcgccagagattctgaaatgttccatggatgagactcacccaggttatggcaaagaggtggatctgtgggcctgcggggtaattctgtttaccctgttagcaggaagcccccccttctggcataggagacagatcctgatgttgagaatgatcatggaagggcagtaccagttctcatccccagagtgggacgataggagctccaccgttaaggacctgatcagtcgtctcctccaagtcgatccagaggcccgactaaccgccgagcaggctctgcagcacccttttttcgaacgttgcgaaggctctcaaccttggaatttgactccgcgacaaagattccgggtagcagtgtggacagtcctggccgcaggtagggtcgcactgagcacccaccgcgtgagaccacttacaaagaacgcgctgctacgcgacccatacgcccttaggtcagtgcggcacttgatagacaactgcgcctttagactctacggtcactgggttaagaagggagaacaacaaaaccgtgcagcgttgttccagcaccgcccacccggccccttcccaatcatgggaccggaagaggagggggacagtgctgccatcactgaagatgaagctgtgttagtgttaggt

SEQ ID NO: 18028 - DNA, 1218 bp, Artificial Sequence
  Description of Artificial Sequence: Synthetic coding sequence
atgaccctcgacgtggggccagaagatgaactcccggattgggcggccgcaaaagaattctatcaaaagtacgaccccaaggatgtcatcggacgtggcgtgagtagcgtagtgcgccggtgtgtgcatcgggcaaccggccacgagtttgccgtcaaaatcatggaggtcacggcagagagactttctcctgaacaattggaagaagtgagagaagcaacccgcagggaaactcatattcttcgccaggtcgccggtcacccccacattatcacgcttatcgactcatacgagtctagcagcttcatgtttctggtctttgatttgatgcggaagggagaactttttgactaccttactgagaaggtcgcgctctctgaaaaggaaacccgttccattatgaggtccctgcttgaagcagtgtcgttccttcatgcaaataacattgtgcacagggacctgaagccagagaatatactcttggatgataacatgcaaattcgactgtccgatttcggttttagctgtcatctggagccaggtgagaaattgcgtgaactctgcggaacccctggatacctggctcccgaaatactgaaatgctcgatggacgaaacccatcctgggtacggcaaagaggtggacttgtgggcatgcggagttattctttttaccctgctcgctggctcaccgccattttggcaccgccgccagatccttatgctgaggatgattatggaaggacaataccagttcagcagccctgagtgggacgatcgaagctcgactgtcaaggatttgatctcgaggctcctgcaagtagatccggaggcacgattgactgcggagcaggcccttcaacatccttttttcgaacgttgtgaggggtcacagccttggaatcttaccccacgacaacgattcagagtggcagtgtggacggtgttggcagcgggtcgggtcgcactctcaactcaccgtgttcgtcctctgaccaagaacgcactgcttcgggacccttacgccctgcgctccgtcagacatcttattgataactgtgcttttcggctctacggacattgggtgaagaagggcgaacaacagaacagagcagccctcttccagcatcggccacctggaccttttcctatcatgggtccagaagaagaaggagattcggcagcgattactgaggatgaagcagtgctggtgctgggg

SEQ ID NO: 18029 - DNA, 1218 bp, Artificial Sequence
  Description of Artificial Sequence: Synthetic coding sequence
atgactctcgacgtgggaccagaggacgaactgccggattgggcggccgcaaaggagttctaccaaaagtacgacccgaaagacgtcatcggccggggtgtctcctccgtggtgcgcagatgtgtgcatcgggctaccggccacgagtttgccgtgaaaatcatggaggtgaccgctgaaaggctgtcgccagagcaattggaggaggtccgcgaagcaacccggcgtgagacgcatatccttagacaggtggccggtcaccctcacatcattactctgattgactcgtatgaaagctcatcgttcatgttcttggtctttgatctgatgcgcaagggagagctctttgactatctcactgaaaaagtcgccctgtcggaaaaggaaactaggtcgataatgcgctcactcctcgaggcagtctcttttctgcacgccaacaacatcgtgcatcgcgatctgaaaccggagaacatcttgttggacgataacatgcagatccggctgtcagattttggcttttcgtgtcaccttgaacccggagagaagctgcgggaactgtgcgggaccccgggctacctggcccccgagatcctcaagtgctcgatggatgaaacccaccccggttacggaaaggaagtggatctgtgggcgtgcggtgtcattctgtttactctgctggcgggctcacccccgttctggcatcgcagacaaatcctcatgctgcgcatgatcatggaaggacaataccagttctccagccctgaatgggatgatcggtctagcaccgtgaaggatcttatctcccgcttgctgcaggtggaccctgaagctcgcttgaccgccgaacaggccctgcagcatccgttcttcgaacggtgcgagggtagccagccttggaatctgactccgaggcaacggttccgcgtggctgtctggacggtgctggccgccgggcgggtcgctctgagcacccaccgggttcgcccactgacgaagaatgcgcttcttagggacccttacgcgctgcgatctgttcgccatttgatcgataattgcgcgttccgcctttacggccactgggtgaagaaaggagaacaacagaaccgtgctgctcttttccagcaccgcccgccgggaccgttccctatcatggggccagaggaggaaggagactccgcggctatcaccgaggacgaagcagttctcgtgctcgga

SEQ ID NO: 18030 - DNA, 1218 bp, Artificial Sequence
  Description of Artificial Sequence: Synthetic coding sequence
atgacattggatgtcggtccagaagacgaactgcccgattgggctgctgcaaaggagttttaccagaagtacgaccccaaggacgttatcggaagaggagtgtccagcgtcgtccgccgctgcgtgcatcgggcgacgggtcatgaattcgccgtcaagattatggaggtgacggcagagcgcctttctccggagcaactggaggaagtccgtgaagcaactcgacgcgagacacatatactgaggcaggttgccggccatccccacatcatcactcttatagactcttatgagtcatcttcgttcatgttcctggtgttcgatcttatgagaaaaggggaattatttgattacctaaccgagaaggtggctctgtcagagaaggagacacgaagcatcatgcggagcctgctcgaagcagtgtcattcttgcatgctaataacatcgtccacagagacctgaagcctgagaacattcttcttgatgataacatgcaaatccgtctaagtgactttggattctcttgccacctggagcccggagagaagcttcgcgaactgtgcggcaccccagggtacctcgcccccgaaatactgaaatgctctatggatgagactcatcctggctacgggaaggaggtggatctctgggcatgcggcgtcatcctgttcactctgcttgctggctcacctccattttggcaccggagacagattctgatgttgcggatgataatggagggccagtatcagtttagttctccagagtgggatgacaggtcttccacagtgaaggatttaattagccggctcctgcaagtagacccggaggccagactaacggccgaacaggccctgcagcaccccttctttgagcggtgcgagggttcacagccgtggaatttaaccccacgccagcgatttagagtggcggtatggactgttctagcagcaggacgggtcgctctgtctactcaccgggtccgacctctcacaaagaacgcactcctgcgggacccttacgcgctgcgaagcgtgaggcaccttattgacaattgcgcatttagactttatggccactgggtgaaaaaaggcgaacagcagaatcgcgctgctttgtttcagcaccggccaccaggcccatttcccatcatgggacctgaggaggagggcgattcagcagccataacggaggatgaggctgtgctcgtgctggga

SEQ ID NO: 18031 - DNA, 1218 bp, Artificial Sequence
  Description of Artificial Sequence: Synthetic coding sequence
atgacactggacgtgggtccagaggatgaattgccggactgggctgccgccaaagagttctatcagaaatatgaccctaaggatgtgattggtcggggcgtgagcagtgtggttcgcagatgtgtgcatagagccacgggacacgaatttgccgtcaaaatcatggaggtgaccgcggagcgcctgagccctgagcagctggaagaggtcagggaggctacccgccgtgaaactcatatccttcgtcaagtcgccggacacccgcatattattacacttattgatagctacgagagtagctcatttatgttcctggtgtttgacttgatgaggaagggtgaactgtttgattatctgactgagaaagtggcactgagtgagaaagagaccagatctatcatgagatccttgcttgaggcagtgtcctttctgcacgcaaataacatcgtgcaccgggacttgaagcccgagaacattttattggacgacaacatgcagattcgcctgtctgatttcggtttttcttgccatctggaacctggggagaagctccgcgagctctgtggaactcccggctacttagcgcctgaaatattaaagtgctccatggacgagactcaccctggatacggtaaggaggtggatctctgggcctgcggagtgatactgttcaccctcctggcgggttccccacctttttggcaccgccggcagatactgatgctgcggatgatcatggaaggccagtatcagttttcttcccctgagtgggacgatcgctcctcaaccgtgaaagatctgatttccagactgctgcaggtggacccggaggctagactcaccgctgagcaagctctgcaacaccccttcttcgagaggtgtgaggggagtcagccttggaatctgacccctaggcagcggttccgcgtggccgtttggactgtgttggcagccggacgtgtcgcactctctacccatcgcgtgcggccccttacgaagaacgcactactccgcgacccttatgccctgagaagcgtcagacacctgatcgacaattgcgctttcagactctatggacactgggtcaagaagggggaacagcagaaccgcgcagctctattccagcataggccccctggcccatttcctataatgggccccgaagaggaaggggacagcgcagccattaccgaggatgaagctgtgctcgttctggga

SEQ ID NO: 18032 - DNA, 1218 bp, Artificial Sequence
  Description of Artificial Sequence: Synthetic coding sequence
atgactcttgatgtgggaccagaagatgaacttcccgattgggcggcggctaaggagttttatcagaagtacgatcctaaagacgtcattggtcgcggtgtgtcgtcggtggtgcggaggtgtgtgcatagagcaactgggcacgaattcgcagtcaagattatggaggtgactgcagagagactttcccctgaacaactggaagaagtgagagaggcaactagaagggaaactcatattcttcggcaagttgcaggacacccccacattatcactcttattgattcctacgaaagctcatcgtttatgttcctcgtttttgatctcatgcgaaaaggagagctttttgattatctcaccgaaaaggtggcactgtcggagaaggaaactagatcaataatgcgctcccttctggaggcagtgtcatttctgcatgcaaataacatcgtccatcgtgatcttaagcccgaaaacattctcctcgatgacaacatgcaaatcagactttcggattttgggtttagctgtcacctggaacctggagagaagttgcgggagctttgcggcacccctgggtaccttgcacccgaaattctgaagtgtagcatggatgaaacccatcctggttacggaaaagaagttgacctctgggcctgcggagtcattctttttacccttcttgcaggatcgcctcctttctggcacaggcgccaaatcctgatgctccgcatgataatggaagggcaataccagttcagtagcccagagtgggatgatcgcagctccactgtcaaggacctgatctcgcggcttctgcaggttgaccctgaggctcgacttacggccgaacaggccctccaacatcctttctttgaaagatgtgaaggctcgcagccttggaaccttactccgcggcagagattccgtgtggcggtctggactgtccttgcggcaggccgagtcgcactctcgacccacagggtccggcctcttactaagaacgcactgctcagggacccatacgcactgcgttcagtgagacatcttatagacaactgcgcatttcggctttacggacattgggtgaaaaagggtgaacagcaaaaccgggccgcactttttcaacatagaccgcctggacccttcccaattatgggccccgaagaagagggtgactccgcagcaataactgaagatgaagccgtgctggtccttggg

SEQ ID NO: 18033 - DNA, 1218 bp, Artificial Sequence
  Description of Artificial Sequence: Synthetic coding sequence
atgaccctggacgtgggtccagaggatgagttgccagactgggctgcagcaaaggagttctaccagaagtacgaccctaaagatgtgatagggcgtggtgtgagctcggtggttcgacgatgtgtgcatcgggccaccggacatgagtttgcagtcaagattatggaagtcaccgcagaaagattgtcccccgaacagctcgaggaggtcagagaggccacccgccgggaaactcacatcctccggcaggttgctgggcatccgcatatcattaccctgattgattcgtacgaaagcagctcatttatgtttctcgtgtttgacttgatgcgtaagggagaattgtttgactaccttaccgagaaggttgccctttcagaaaaggaaactcgttcgattatgcgcagccttcttgaagccgtgtcgtttctgcacgcgaataacatcgtgcaccgggacctcaagccagaaaacatacttcttgatgacaatatgcagattcgcctcagcgactttggcttctcgtgccatctggaaccgggagagaaacttcgagaactttgtggtaccccgggataccttgcccctgaaatcctgaagtgctcgatggatgaaactcatcctgggtacggtaaggaggtcgatctctgggcatgtggagtcattctcttcaccctgctcgcaggcagccccccattttggcaccgacgccaaattctgatgctgagaatgattatggagggtcagtaccaattctcaagccctgagtgggatgaccgaagttcgaccgttaaagaccttattagcaggctgctccaagtggaccctgaagcacgccttactgcagaacaagcgctgcaacatccatttttcgaaaggtgtgaggggtcccaaccgtggaaccttaccccacggcaacgttttcgcgtggcagtgtggactgtccttgcagcaggacgggtggccctctcgacccaccgtgtcaggcctctcaccaaaaatgcactgctgcgtgacccatacgcacttcgctcggtcaggcatcttattgataactgtgcgtttcggttgtatggtcattgggtgaaaaaaggagagcagcagaacagggctgcactgtttcaacacagaccacccggtccctttcctatcatgggccccgaagaagaaggagattccgctgcaataaccgaagatgaggcagtgttggtgcttggg

SEQ ID NO: 18034 - DNA, 1218 bp, Artificial Sequence
  Description of Artificial Sequence: Synthetic coding sequence
atgactttggatgtgggaccagaggacgagctccctgactgggcggcggccaaagaattttatcagaagtacgatcctaaggacgtcatcggccgaggagtcagttctgtcgtccgcagatgcgtacatcgcgcgacagggcacgagttcgcggtgaagataatggaggtgacagcagagcgtctttcccccgagcagctagaggaagtacgggaggccactaggagggaaactcacatactgcgccaagtcgcaggccacccccacatcattacgctgatcgactcctatgagtcaagtagctttatgttcctcgtctttgatctgatgcggaaaggtgaattgttcgattatttgacagagaaggttgctctctctgaaaaggagacacgctccataatgaggagcctgctggaagcagtttcgttcctccatgctaataacatcgtgcatcgtgaccttaaaccagagaatatattactggacgataacatgcagatccggctttcagattttgggttctcttgccacctggaacctggcgaaaaattgagggagctatgcggcacaccgggttaccttgcaccagaaattctgaagtgcagcatggatgagactcaccccggctacggcaaagaggtggatctgtgggcctgcggagtgattctgtttacactgctggccggcagccctcctttctggcaccgtaggcagattctcatgctgcgcatgattatggagggccaatatcaattctccagcccagagtgggatgaccgtagttcgacggttaaagatctaatttcaaggctactccaggtagatcccgaggctagattgacagcagaacaagctctgcagcaccccttcttcgaaaggtgtgagggcagccaaccttggaatctgaccccacggcagaggttcagagtcgcagtctggaccgtcttggccgcagggcgggtggccctctccacgcatagggtaagaccgctgaccaaaaacgccctgctgcgcgacccctacgctctgagaagcgtccgacacctgatagacaactgcgccttccgcttgtatgggcactgggtgaagaagggtgaacaacagaaccgggcagctctgttccagcacagacccccaggcccttttccgatcatgggacctgaggaggagggagattccgctgcgataaccgaggatgaggctgtactggtgctcggt

SEQ ID NO: 18035 - DNA, 1218 bp, Artificial Sequence
  Description of Artificial Sequence: Synthetic coding sequence
atgaccctcgacgtggggccagaggatgaattgcctgactgggccgcagcgaaggaattctaccaaaagtacgatccaaaagacgtgatcggacgaggtgtctcctcagtggtccggcgctgcgtgcatcgcgcaaccgggcacgaatttgctgtcaagattatggaagtgactgccgagcgcctgtcgccggagcaacttgaggaggtgcgcgaagcgaccaggcgggagactcacatcctccggcaggtggctggccatccacacatcatcaccttgatcgactcgtatgaaagttcctcattcatgttcctggtgttcgatctgatgcgcaaaggcgaattgttcgactacttgaccgaaaaagtggcgctgagcgagaaagagactagatctatcatgcgttcgctgctggaagccgtgtcattcctgcacgctaacaacatcgtccatcgcgatctgaagccggaaaatatcctgttggacgataacatgcaaatccgcctgtcagatttcgggttcagctgccatctcgaaccaggagagaaacttcgagaactctgcggtaccccgggatacctcgcccctgagatcctgaagtgctcgatggacgagacgcatcctggatacgggaaggaagtcgatctgtgggcttgcggagtcatcctgttcactcttcttgctggaagccctccattctggcacagacggcagatcttgatgctgcgaatgatcatggaaggacaatatcaatttagctccccggagtgggacgataggtcgtccactgtcaaggacctgatctcccgcctcctgcaagtggacccggaagcgcggttgaccgctgagcaggccctccagcacccgttcttcgaacgctgcgagggctcacagccgtggaatctgactccaagacagcggtttcgtgtggcggtgtggacggttctggccgcagggagggtggccctgtccactcatcgggtcaggccactgaccaagaacgctctgctgcgagatccctacgctctgcgctccgtcagacatctgatcgacaactgcgcattcagactctacggacactgggtgaaaaaaggggagcaacagaatagagcggcgctcttccaacacaggccaccaggcccattcccaattatgggtccggaagaggagggcgactcggcagccatcaccgaggatgaggcagtgcttgtgctgggt

SEQ ID NO: 18036 - DNA, 1218 bp, Artificial Sequence
  Description of Artificial Sequence: Synthetic coding sequence
atgactctggatgtcggacccgaagatgaactcccggactgggcggccgcgaaggaattctaccagaaatatgatccaaaagacgtgatcggcagaggcgtgagctccgtcgtgcggcggtgcgtgcatcgggctaccggccacgagttcgccgtgaagattatggaggtgactgctgaaagattgtcgcccgagcagctcgaggaagtaagagaagcgacccgccgggaaactcacatcctccgccaagtcgccggccacccgcatatcatcaccctgatcgactcctacgaatcatcctcctttatgttcctggtgttcgatctgatgcggaaaggggaactgttcgattacttgactgagaaggttgctctctcggaaaaggagactcggtcaatcatgcgctcactgctcgaggcagtgtcgtttctgcacgcgaataacatagtgcacagagatctcaagccggaaaacatcctgttggatgataacatgcagatcaggttgagcgactttggattctcctgccatctcgaacccggggagaaacttcgggagctgtgcggcaccccaggatacctggctccagaaattctcaagtgcagcatggatgaaacccatccaggatatggaaaagaagtggacctgtgggcctgcggagtcatcctgttcactttgctcgcgggatcgccgccattctggcatcgccgccagatcttgatgctccgtatgatcatggaaggacagtatcagttctcatcgccggagtgggacgaccggtcgagcactgtgaaggatctgatcagccgcctgctccaagtcgatccagaagcgaggctcactgccgaacaggccctgcagcacccattctttgagagatgcgaaggatcgcagccatggaacttgacgcctagacagaggttccgggtcgcagtgtggacggtcctggccgccggacgggtggcactgtccacgcatagagtgcggccgctgaccaaaaacgccctcctccgggacccgtacgcactccgatcggtccgccacctgatcgacaattgcgccttccgactgtacggacactgggtgaagaaaggagagcagcagaatcgcgccgccctgttccagcatcggccacctggcccatttccgatcatgggtccggaggaagagggcgactccgcagccatcaccgaagatgaagccgtgctggtgctcggc

SEQ ID NO: 18037 - DNA, 1218 bp, Artificial Sequence
  Description of Artificial Sequence: Synthetic coding sequence
atgaccctcgacgttggaccggaggacgagctcccagactgggcggctgcaaaggagttctaccagaagtacgatccgaaggacgtcataggcaggggcgtgtccagcgttgtgcggcggtgcgtccatcgcgcgactgggcacgaattcgccgtaaagatcatggaagtcaccgccgagagactctcgcctgaacagctcgaagaggtgagagaagcaacccgcagggaaactcacatcctgcggcaagtggcaggacatccgcacattatcaccttgatagactcctacgaatcctcgtcttttatgttcctggtgtttgacctcatgcggaagggagagttgttcgattaccttactgagaaagtggcattgtctgagaaggagactcgctcgatcatgcgctccttgctcgaggccgtgtcgtttctgcacgccaacaacattgtacatcgggacttgaagccagaaaacattttgctcgatgataacatgcaaatccggctttccgacttcggattttcctgccacctggaaccgggggagaaacttagagaactgtgcggaacccctggctacctggccccagaaatccttaagtgtagcatggacgaaactcaccctggttacggaaaggaagtcgacctctgggcttgcggagtcatcttgttcactctgctcgcgggcagcccaccgttctggcaccgacggcagatcttgatgcttagaatgatcatggagggacaatatcaattctcctcaccggaatgggacgatcgttcgtcgactgttaaggatctgatctcacggctgctgcaggtcgaccctgaggcgaggctgaccgccgaacaggccctgcaacatccgttcttcgagcggtgtgaaggcagccagccgtggaatctcacgccccgccagagattccgcgtcgctgtgtggaccgtgctggcagcggggcgcgtggcgctgtcaacccaccgtgtgcgcccattgaccaaaaatgccctcctgcgcgatccctacgcgcttcgctcagtccgtcatctgatcgacaattgcgcattcaggctttacgggcactgggtgaaaaagggtgaacagcagaaccgggctgccctgttccagcaccgtcccccgggaccgtttccaatcatgggaccagaggaagagggagattcggctgccatcacggaggacgaagccgtgctcgtcctgggg

SEQ ID NO: 18038 - DNA, 1218 bp, Artificial Sequence
  Description of Artificial Sequence: Synthetic coding sequence
atgactctggacgtgggaccagaagatgagttaccggattgggccgctgcgaaagagttctatcagaaatatgaccctaaggatgtgataggtagaggggtgtctagcgtggtccgaagatgcgtccaccgcgctactggacatgaattcgctgtgaagattatggaggttacagccgaaaggctgtccccagagcagctggaggaagttagggaggccactcgtcgagaaacgcatatccttaggcaagtcgctggccaccctcacatcattaccctgatcgactcttacgagtctagttctttcatgtttctcgtgtttgacctgatgcggaagggcgaactgttcgattaccttacggaaaaagtcgccctctcagaaaaggagacacggtctattatgaggagtctcctggaggcagtatccttcctgcatgctaacaacatcgttcatcgcgacctgaaacctgaaaatatactgctggatgacaacatgcagatcaggttaagcgacttcgggttcagttgtcacttggaaccaggtgagaaacttagagagctttgtggaacaccaggttatctcgcacccgagatcctgaagtgctccatggatgagactcatcctggttacggcaaggaggtggacctatgggcatgtggggtgatccttttcaccctgctggctggctctccccccttttggcacagaagacagatcctgatgttgcggatgatcatggaagggcaataccagttctcctctcctgagtgggatgaccggagctctacagtaaaagacctaatttcaagactcctgcaggtagatccagaggctagactgacagcagagcaagctctgcagcatccattcttcgaacgctgtgaggggtcacaaccctggaatctgacccctaggcagcgttttcgggtggcagtgtggactgtgctggctgctgggcgggtcgctctgtccacccaccgggtaaggcccctgactaagaacgccctgttacgggacccttacgccttgcgttctgtacggcatcttattgacaattgtgcattcagactgtacggtcactgggtcaagaagggtgagcagcagaatcgcgcagctctgttccagcaccggcccccgggacctttccccattatgggtcctgaagaggagggcgactctgccgcgatcacggaggacgaggcggtcctggtcctcggt

SEQ ID NO: 18039 - DNA, 1218 bp, Artificial Sequence
  Description of Artificial Sequence: Synthetic coding sequence
atgacactcgacgtcggtccggaggatgagttaccggattgggccgcagcaaaagagttctatcaaaagtacgatccaaaagatgttatcggcaggggggtcagctctgtcgtgcgccggtgtgtccaccgggcgacagggcacgaattcgccgttaagatcatggaagtcaccgcagagcggctctccccggagcagctcgaggaggttcgggaagccacacggcgcgaaacgcatatcttacggcaggttgccggccatccccacatcatcactttgatcgacagctatgagtcatctagttttatgttcctggtgttcgacctcatgcgaaagggagaactgttcgactatttgaccgaaaaagttgctctgtcagaaaaagagacgcggtccattatgcggagcctgttagaagccgtgagctttctgcatgctaacaatattgtccacagagacctaaagccagagaacatcttgctggacgacaacatgcaaatcagattgtcagatttcggtttcagttgtcacctggagccaggagagaagctcagggaattgtgtgggacccctggttatttagcccccgagattctgaagtgctctatggatgagacccatcctggatacggcaaggaggtggacttgtgggcatgtggcgtaatactcttcaccctgctagctggttctcctcccttctggcacaggcggcagatcctgatgctacggatgattatggaaggacagtaccagttttcctcacctgagtgggacgaccgaagtagtaccgtgaaagacctgatttcccgtctgttacaggtagacccagaagcacgcctcaccgccgaacaggctttgcagcacccgttcttcgagcggtgcgagggctctcaaccctggaacctcaccccgagacaacgttttagggttgccgtatggactgtcctagctgccgggcgtgtcgccctatccacacatcgcgtaagaccgctgactaagaacgcgttgctccgagacccttacgcgctcaggagcgtgcgccatctcatagataactgtgcttttagattgtacggccactgggttaagaagggagagcagcagaatagggctgcactcttccaacacagaccgcctggaccgttcccaattatgggccctgaagaagagggtgattccgccgcaatcacggaggatgaggccgttctggtccttggc

SEQ ID NO: 18040 - DNA, 1218 bp, Artificial Sequence
  Description of Artificial Sequence: Synthetic coding sequence
atgactcttgacgtgggcccagaggatgaactcccagactgggccgccgctaaagagttctaccagaagtatgaccccaaggacgtgatcgggcgcggagtgtctagcgttgttaggagatgcgtgcaccgggccaccggccatgagttcgccgtgaagatcatggaagttactgcggagcgtctctcgccggagcagttggaagaagtccgggaggctacccggcgggagacgcacatcttacggcaggtggcaggccatccccacataatcacactaattgacagttacgagagcagttcgtttatgttccttgtgttcgacctgatgcggaaaggggagttattcgattacttgactgagaaagtggcgttgtcggagaaggagacaaggtccattatgaggagcctgctcgaagctgtgagcttcctgcacgccaacaatatcgtgcaccgagatctcaagcctgaaaatatactgctggatgacaacatgcaaattaggctcagtgatttcggcttcagctgtcacctggagccgggtgagaaacttcgggagttatgcggcacccccggttaccttgcccccgagatcctgaagtgttctatggacgaaacacaccctggttacggaaaggaggttgacctctgggcctgcggggtgatcctgtttacgcttctggccgggtctccaccattttggcaccggcgccagatacttatgttgcggatgattatggaaggccagtatcagttctcaagcccggagtgggacgaccgttcctctaccgtgaaggacttgatctcacggttgctgcaggtggatcctgaggcgcgcctgacagcggaacaggcccttcagcatccctttttcgaacggtgcgagggctcacaaccttggaacctgaccccccgccagcgctttagagtagcagtgtggactgtcctagcagcaggacgggtcgctctctcgacacatcgggttaggcccctgaccaaaaatgccttactacgagatccctatgcactccggtcagtcagacacttaatagacaactgcgccttccggctgtatggccattgggtaaagaagggtgagcagcagaacagggccgctttgtttcagcatcggccaccgggtcccttcccaatcatgggacccgaagaggagggtgactccgccgccatcaccgaggatgaggccgttttggtgcttggt

SEQ ID NO: 18041 - DNA, 1218 bp, Artificial Sequence
  Description of Artificial Sequence: Synthetic coding sequence
atgactctggatgtgggtccagaagatgagctgccagactgggcagcagcaaaagaattctaccaaaagtacgaccccaaagatgtgataggccgcggggtgtcgtccgtcgtccgacggtgtgtccaccgtgcaactggtcatgaatttgctgtgaagattatggaagtcacggcagagagactttcaccagaacagcttgaggaagtcagagaggctacgagacgtgaaacccatattctgaggcaggtggcgggccatccacacattatcaccctcatcgacagctacgaatcgtcctccttcatgtttcttgtgtttgatttgatgcgaaaaggcgaactttttgactacctgactgaaaaggttgccctgtcggagaaagagactcggagcattatgagatccctcttggaagctgtctcgttccttcatgccaataacatcgtgcatcgcgatttgaaacccgagaatatactcctggatgataacatgcagatcaggttgtcagactttgggttttcatgtcacctggaacctggtgaaaagctgcgcgagctgtgcgggacccctggatacctcgcgccggaaattctgaagtgctcgatggacgaaactcatcctggttatgggaaggaggttgatctttgggcgtgtggagtcattctgtttacccttcttgctgggtcgccccctttttggcataggcggcaaatacttatgttgcgtatgatcatggaaggccaataccaattctctagccctgaatgggacgatcgctcaagcaccgtcaaggatctgatctcgcgtctgctgcaggtggatcccgaggcaaggttgaccgccgaacaggcactgcaacaccccttctttgaacgttgtgaaggaagccaaccctggaaccttaccccccgccagcggttccgcgtggctgtgtggacggttctcgcagcaggtagagtcgcgctttccacgcatcgggtcagaccgcttaccaagaacgcacttcttagagatccttacgctctgcgttcggtgagacatcttattgataactgtgccttccgactttacggtcactgggtgaaaaaaggcgaacaacaaaatagagcagcactcttccagcacagaccacctggtccatttccgattatgggccccgaagaggagggagatagcgcagcaatcactgaagatgaggcggtgctggtgcttgga

SEQ ID NO: 18042 - DNA, 1218 bp, Artificial Sequence
  Description of Artificial Sequence: Synthetic coding sequence
atgactcttgacgtggggccagaggacgagcttccggattgggcagccgcaaaggaattttaccagaagtatgatcccaaagatgtcatcgggcgcggcgtgtccagtgtggtgaggcgatgtgttcacagggctacgggacatgagtttgcagtaaagattatggaagtgacagccgagcgcttgagtcccgagcagctcgaagaagttcgtgaggccacccggagggaaacccacatcctgcggcaggttgctggccaccctcatataatcacactgatcgacagttacgagagctcctcattcatgtttcttgtttttgatctgatgcgcaaaggagaattgttcgattacttgactgaaaaggtcgccctgagtgaaaaggaaacaaggtcaatcatgcgcagtctgcttgaagccgtttcattcctgcatgccaacaatatcgtgcaccgtgacctgaaaccggaaaacatcctgctggatgacaacatgcagatacgactcagtgatttcggctttagctgccacttagagccaggtgagaagctgcgggagttgtgcggcactcccggctacctagcgcccgagattttgaaatgttccatggacgaaacacatccagggtacggcaaagaagtggatctgtgggcttgtggcgtaatcctgttcacattgctggccgggagtccaccattctggcacaggcgccagatattgatgctccgcatgatcatggagggtcagtatcaatttagtagccccgagtgggacgatagatcatccacagttaaggatttgattagccggttactacaggtggaccctgaggcccgtctgacagcggagcaggctcttcagcaccccttctttgagaggtgcgaggggtctcagccatggaacctaacgcctcgccaaagattcagggttgcagtctggactgtgctagccgccgggcgggtagcactgagcactcacagggtgagacctctgaccaaaaacgcactgcttagagatccctatgccctgagatccgtgcgacacctgattgataattgtgcttttcgtctgtatggccattgggtaaaaaagggagagcagcagaatcgagcggccctcttccaacatcggccgcctggacccttcccgataatgggtccggaggaggagggagactccgctgccatcactgaggatgaggcggttctggttttgggc

SEQ ID NO: 18043 - DNA, 1218 bp, Artificial Sequence
  Description of Artificial Sequence: Synthetic coding sequence
atgaccctggatgtgggtccagaggatgagctgcccgattgggcagcagcaaaagagttctaccagaaatacgatcctaaagatgtgataggtagaggagtgtcaagcgtcgttcgtaggtgtgtgcatagggcgactgggcatgaatttgcagtgaagataatggaagtgaccgccgagcgactgtcaccagaacaacttgaagaggtgagagaagcaactcggcgcgagactcatattctcagacaagtggctggacacccgcacatcattacccttattgatagctacgaatcctcgtcattcatgttccttgtgtttgacctgatgcggaagggggaactttttgattacctgaccgagaaggttgcactcagcgagaaagaaacccgcagcatcatgcggagcctcttggaggcagtgagcttccttcacgcaaacaatattgtgcaccgagatctgaagcccgaaaacatcctgctcgatgacaacatgcaaatcagacttagcgattttggattttcctgtcaccttgaaccgggtgaaaagctgagagaactgtgtgggacgcccggttacctggctcctgaaattctgaaatgcagcatggacgaaacccatccaggatacggaaaagaagtcgatctttgggcctgtggtgtgattctcttcaccctgcttgccggatccccacccttttggcatagaaggcagattctgatgctcaggatgatcatggaagggcaataccaattcagctcgcctgaatgggatgacaggtcgtcaactgtcaaggacctgattagcagactgttgcaagtcgaccctgaggcaaggctgaccgccgaacaggcacttcaacatccttttttcgaacggtgtgaaggctcccaaccttggaacctgacccctaggcagagatttcgtgtggcagtgtggactgtgcttgccgcaggaagagtcgcactgtcaacccaccgggtcagacctctcactaagaacgcacttctgcgtgatccttatgccctccgttcggtccggcatcttattgataactgcgccttccggctttacggacattgggtcaagaaaggtgaacagcagaatagagccgcactgtttcagcatcgtccaccaggcccattccctatcatgggccccgaggaagagggtgactcggcagccataactgaggatgaagccgtgttggtgctgggt

SEQ ID NO: 18044 - DNA, 1218 bp, Artificial Sequence
  Description of Artificial Sequence: Synthetic coding sequence
atgactctcgacgttggacctgaagatgaactccctgactgggccgcagcaaaggaattctaccagaaatatgatcccaaagatgttatcgggcggggggtgtcttccgtcgttcgtaggtgtgtgcatagggccactgggcatgagtttgctgttaaaatcatggaggtaactgcagaaagactctctcccgaacagctggaagaagttcgggaagccactcgaagggaaacacacattttaaggcaggttgctggacacccccatatcatcactcttatagattcgtacgagtcatcatcttttatgtttctcgtgttcgatcttatgcggaagggggaactatttgattatctaacagaaaaagtagccctctctgaaaaagaaacacgatcaattatgcgatctctcctggaggcagtttcatttttacatgctaacaacattgtgcatagagatctcaaacccgaaaacatcctacttgacgataatatgcaaatacgccttagtgattttggattctcatgccacctcgaaccaggggaaaaactccgggaactctgcggaactcctggatatctggctcccgaaatcctgaagtgctccatggatgaaacacaccctggatatgggaaggaagttgatctgtgggcttgtggggtcatcctgttcactcttctcgcgggatcaccccccttctggcatcggaggcagatactaatgctccgaatgattatggaggggcagtatcagttttcttcaccagaatgggatgatcgaagtagtactgtgaaagacctgatttccaggctgctccaggtggatcctgaagcacgattaacagccgaacaggccctacagcatcccttttttgaaagatgcgaaggaagtcagccttggaatctcactccacggcagcggtttcgggtcgcagtgtggactgtgcttgctgccgggcgggtcgcgctcagtacacatagggtccggcctcttactaagaacgcactccttagagacccctacgcgttgaggagtgtcaggcatctcatagataattgtgcatttagactctatggacactgggtgaaaaaaggggagcaacagaatcgggctgccttatttcagcataggccacctggacctttccctataatggggcctgaagaggaaggagattccgctgcaatcactgaggacgaagcagtccttgtgctcgga

SEQ ID NO: 18045 - DNA, 1218 bp, Artificial Sequence
  Description of Artificial Sequence: Synthetic coding sequence
atgacccttgatgtcggcccggaagatgaactgcctgattgggcagcggctaaggagttttaccaaaagtacgatcctaaggatgtcattggcagaggtgtgtctagcgtagtgagaaggtgtgtgcacagggcaaccggccacgaattcgcagtgaagattatggaagtcactgccgaaagactgtcacctgagcagctggaagaggttcgggaagcaaccagaagagaaacccatattctgaggcaagtggcaggacacccacatatcataacccttattgattcctacgaatcgtcgagctttatgtttttggtgtttgatctcatgagaaagggtgaactctttgattacctgacggagaaagtggccctgtccgagaaggaaacccgctcaatcatgcgctcgctgctcgaagcagtgtcctttcttcacgctaataacatcgttcacagagatctgaagccagaaaacattctgcttgacgataacatgcaaataagactgtcggattttgggttttcgtgtcacctggaacctggagaaaagttgcgggagctgtgtggaactcctggatacctggccccagaaatactgaagtgctccatggacgaaactcacccaggttacggcaaagaggtcgatctgtgggcatgcggggtcatactctttactcttttggcaggatcccctcctttttggcatagacgccagattcttatgcttcgaatgatcatggaaggacagtaccagtttagctccccagaatgggacgatcgctcgtcgaccgtgaaggacctgatctctcggcttctgcaagtcgatccagaggcacggctgaccgccgaacaggccctccaacatcccttttttgaacgatgtgagggaagccaaccatggaatctcactcccagacagcgcttcagagtggcggtgtggaccgtcttggctgccggcagagtcgctctgagcacccatcgggtcagaccacttaccaagaacgcactgcttcgtgatccttacgcccttaggtccgtgcgtcatctgatcgacaactgtgcattccgcctgtacggccattgggtgaagaagggggaacagcaaaacagggcagcactgtttcaacaccggccccctggacctttccctatcatggggcccgaagaagagggagatagcgccgctattactgaggatgaagcagtgctcgtcctgggc

SEQ ID NO: 18046 - DNA, 3705 bp, Artificial Sequence
  Description of Artificial Sequence: Synthetic coding sequence
atgcgaagtcggtctaacagtggggtccggttggatgggtatgctaggctggttcagcagacaatcctttgttatcagaatccagttactgggctactgagtgcctcacatgaacagaaagatgcatgggtcagggataacatctactctatattagccgtgtgggggctcggaatggcttatcggaaaaatgctgacagggatgaagataaagccaaagcctatgaactggaacaaaatgtggtcaaactcatgcgagggctcctgcagtgtatgatgcggcaggtggccaaagtggaaaaattcaaacacacacagtctacaaaggattcactacacgccaaatataatacagcaacgtgtggaacagtagtgggggatgatcagtgggggcatctccaggtggacgctactagtttgttcttactatttctggctcagatgactgcgtccgggctccgaattatctttacacttgatgaagtggcattcatccagaacctggtgttttatattgaggcagcctataaggtagctgattatgggatgtgggaaagaggggataaaacaaatcaggggatcccggagctcaatgcctcatccgttggaatggcaaaagctgcactggaagctatcgatgaactggatctctttggagcccacggagggcggaagtcagttatacatgtccttcccgatgaggtggaacactgccaatctatcctcttctcaatgttaccaagggcatccacatccaaagaaattgatgctgggctccttagtatcatctcctttcctgccttcgctgttgaagacgtcaacctcgtcaacgttacaaaaaatgaaataatttctaaactgcagggacggtacgggtgctgtaggttcctccgcgatgggtataagactcccagagaggacccgaaccggctgcactacgatcctgcagaactaaaattatttgagaatattgagtgcgaatggcctgtgttctggacatattttattattgatggagtgttctccggggacgccgtgcaggtgcaggaatatagagaagccctcgaaggaatccttataagaggaaaaaatggaattcgtctcgtgcccgaactctatgctgtgccacctaataaagtggatgaagaatataagaacccccacacagttgatagagtacctatgggaaaagtaccacacctttggggacagtcgctttatatcctatcgagtctcctcgctgaagggttccttgctgctggagaaatagatccgctcaaccggagattctccacttccgtaaagcctgatgtggttgtgcaggttactgtgctcgcagagaataatcatattaaagatctgctccgaaaacatggggtaaacgtccagagtatcgctgatatccacccaatacaggtacagcctgggagaatactttcccatatctacgctaaactcggaagaaacaagaacatgaacctgtctgggcggccttatcgacatattggagtgcttgggacatctaaattatacgtgatacggaaccagatctttacattcacaccacagttcactgatcagcatcatttttacctagcactggacaatgagatgatcgtggaaatgctgcgtattgaactcgcctatctctgtacatgttggcggatgacaggaaggccaacactcacttttccgatctctaggactatgctgacaaacgacggatctgatatacattctgcagtcttgtctactattagaaagctagaagatggatactttgggggagctagagtgaaattaggaaacctgtcagaattcttgacaacatctttttatacgtatctgactttccttgatcctgattgtgatgaaaaactgtttgataatgcctccgaagggacattttcccccgacagtgattcagatcttgtggggtatctggaagatacatgtaatcaggaatcccaggatgaactcgatcactacataaatcacttattgcagtcaacatccctccgatcctatctgccaccactatgtaagaatacagaagatcggcacgtgttttccgctatacactctactagagatatcctatcagtcatggccaaagcgaaaggactcgaagtaccctttgtacctatgacactccctactaaggtactttctgctcatcgcaaatctctaaacctcgtggattcaccccagcctctgcttgaaaaagtgcccgaaagtgactttcagtggccccgcgatgatcacggagatgtcgattgtgagaaattagttgaacagctgaaagactgttcaaatctccaggaccaggctgatatcctatacatcctgtacgtaatcaaaggaccctcttgggatacaaacctgtcaggacagcacggggttacagtccagaacctgctcggagaactctatggaaaagctgggctgaaccaggaatgggggctcattcgctatatatccggactcctgcggaaaaaagttgaagttctagctgaagcgtgcacagatctactatctcatcagaaacagcttacagtgggacttccacccgaacccagggagaagattatatctgctcccttacctcccgaagaattgactaaactaatatacgaagcatcaggacaagatatttctatcgccgtgctcactcaggaaatagttgtgtatctggctatgtatgttcgagctcagccttccctcttcgtcgaaatgctgaggctccggatcggactgatcatccaggtcatggcaacggagctcgctagatccctgaactgctctggagaagaagcttcagagagtttaatgaacctatctccattcgatatgaaaaacctgctccatcatatactctcaggaaaagaatttggggtggaacgcagtgtacgacctatacacagttcaacaagtagtccaactatatccatccacgaagtcgggcatacaggagtgactaaaacagaaaggtcaggaataaatcggctccggtctgaaatgaaacagatgactcgccgcttctctgctgatgaacagttttttagtgtcggacaggccgccagttcttccgcccactcttcaaaatcggctcgatcttctacaccttcttccccaacaggaacttcatcatctgattcgggagggcaccatataggatggggagaacgacagggacagtggctgagaaggaggcgcttggatggggctataaatagagtgcccgtgggattttatcagagagtgtggaaaattctgcagaaatgccatgggctatctatcgatgggtacgtactaccctccagtacaactcgagagatgactccccacgaaattaaattcgctgtccatgtggaatctgtgctcaaccgcgtaccacagcctgaatatcggcagctcctagtggaagcaataatggtacttactttattatcagatactgagatgacatcgataggagggatcattcacgtcgatcaaatcgttcagatggcctcacagcttttcctgcaggatcaggtgtctatcggagccatggatacgctagaaaaagatcaggccactgggatctgccactttttctacgattctgctccatctggagcgtacgggacaatgacatatctcactagggccgtggccagttacctgcaggaactgctccccaattctgggtgtcaaatgcag

SEQ ID NO: 18047 - DNA, 3705 bp, Artificial Sequence
  Description of Artificial Sequence: Synthetic coding sequence
atgcgatcacggtccaactcaggtgtccggcttgacggctacgctcgcctcgttcagcaaactatcctctgctaccaaaaccctgtgactgggctcctgtcggcctcacatgagcagaaggacgcctgggtgagggacaatatctacagcatcctggccgtgtggggactgggaatggcatacaggaagaatgcagacagggacgaggacaaggctaaggcctacgaactggaacagaacgtggtcaagctgatgagaggactcctgcaatgcatgatgaggcaggtggccaaggtggagaagttcaagcatactcagtccaccaaagactccttgcatgccaagtacaacactgcgacgtgcggtacggtggtgggcgatgatcagtgggggcaccttcaagtggacgcgacctcattgttcctgcttttcctggcacaaatgactgcttcggggctgcgcataatcttcaccctggacgaagtggcttttatccaaaatctcgtgttctacatcgaagccgcatacaaggtcgctgactacggaatgtgggaacgtggcgacaagactaaccagggaatcccggagctcaacgcctcatccgttggtatggcgaaggctgcactcgaggccattgatgagcttgatctgttcggtgcacatggtggtcggaaatcagtgatccacgtcctgccggatgaagtcgaacattgtcagtcgattctgttctcaatgctgccgcgggcttcaacctcgaaggagatcgatgcagggctgctctccatcatatcatttccggccttcgccgtcgaggacgtgaacctggtgaacgtcaccaagaacgagattatctccaagttgcagggccgctacggatgttgcaggttcttgcgagacggttacaagacgccgagagaagatccgaaccggcttcactatgatcccgccgaactgaagctgttcgagaatatcgaatgcgaatggccggtcttttggacctacttcatcatcgatggagtgttttctggagacgcggtgcaggtgcaggaataccgggaggcgctggaaggaatcctgatcagaggcaagaatggaattagattggtgccggaactgtacgctgtgccaccgaataaggtcgacgaggagtacaaaaatccacatactgtcgatcgcgtcccaatggggaaagtccctcacctttggggtcagagcctgtatatcctttcgagccttctcgcggaaggattcctcgctgccggagagatcgacccattgaaccggagattttccacttccgtgaagccggatgtggtggtccaagtcactgtgcttgctgagaataatcatatcaaagatctgttgcgcaaacacggggtgaacgtgcaatcgatcgccgacatccatccgatccaggtccagccaggccgaatcttgagccatatctacgcaaagctcgggcggaataagaatatgaacctctcgggtcgcccataccgccatattggagtgctgggcaccagcaaactctacgtgatccgaaaccaaatctttaccttcacgccacaatttactgaccaacatcacttttacttggccctggataacgaaatgatcgtggaaatgctcagaattgaacttgcctacctgtgtacttgctggaggatgaccgggcgcccgaccttgactttcccgatctcgcgcactatgctgaccaacgatggaagcgatatccattccgccgtcttgagcaccatcagaaagctggaagatggatacttcggaggggcccgcgtcaagctgggaaacttgtccgaattcctgaccacttcgttctacacctaccttactttcctcgacccggactgcgacgaaaagctgttcgataacgcgtccgagggaactttctcaccggactcggactccgatcttgtgggctacctcgaagatacttgtaaccaagagtcccaagatgagctggatcattacattaaccaccttctccagtcaaccagcctgaggtcatacctgccgccgctgtgcaagaataccgaggaccgccacgtgttctcggcaatccatagcactcgggacatcctgagcgtgatggccaaagcaaaaggattggaggtcccgttcgtgccgatgactctgcccacgaaggtcctctcagcacaccgcaaaagccttaatctcgtggactcgccgcagcctctgctcgagaaggtcccagaatctgacttccagtggccacgggatgaccacggagatgtggattgcgaaaaactggtggaacagctgaaggactgtagcaacctccaagaccaggcggacatcctgtacatcctttatgtgatcaaaggaccgagctgggataccaacttgtcgggacaacacggagtcaccgtgcagaacctcttgggcgaactctacggcaaggccggtctgaatcaagaatggggactgatcagatatatcagcggcctccttcgaaagaaggtggaagtcctggccgaggcgtgtactgatttgctgtcccaccagaaacagctcacggtgggcctgccgcccgagcctcgcgagaaaatcatctccgcgccgctcccacccgaagagcttaccaaactgatctacgaggcttcgggacaggatatttcaattgctgtcctgacccaggagattgtggtgtaccttgccatgtacgtccgcgcccagccgtccctgttcgtcgaaatgctccgcctgcgcatcggactgatcatccaggtgatggcgaccgaacttgcgagatccctcaactgcagcggagaggaagccagcgaaagcctgatgaacctgtcgccgttcgatatgaagaaccttttgcaccatatcttgtccggtaaagagtttggtgtggaacggtcggtgcgccccatccactcttcaacttcgtccccaactatctccatccacgaagtgggacataccggagtgactaagaccgagcgctccgggatcaaccgcctgagatcggagatgaagcaaatgacccggcgcttttccgccgacgagcagtttttctcggtcggacaggcagctagcagctccgcccattcttcgaagtcagccaggtcatcgacccctagcagccccactggaacctcctcctcggactcgggaggacaccacatcggctggggtgaacgccaaggccagtggctgcgacggcggaggttggacggagccatcaatcgggtgccggtcggattctaccagcgggtctggaagatccttcaaaagtgccacggcctgtcgatcgacggctacgttctgccttcttcaaccacccgcgaaatgactccgcacgagataaagtttgctgtccacgtggagtccgttctcaaccgggttccccagccagaatacagacagttgcttgtggaagcaatcatggtgctcacgttgttgagcgacaccgagatgacttcaatcggaggaatcatccacgtggaccagattgtgcagatggcttcccaactgttccttcaagaccaggtgtcgatcggagcaatggatacgttggaaaaagaccaggcaaccggaatctgccacttcttctacgatagcgcaccctccggagcgtacgggaccatgacctacctgactagagccgtggctagctacctccaagaactgctgcctaactcgggctgccagatgcag

SEQ ID NO: 18048 - DNA, 3705 bp, Artificial Sequence
  Description of Artificial Sequence: Synthetic coding sequence
atgcgctcccggtcaaattcgggagtgagactcgacggatacgctcggctcgtccaacagactattctctgctaccagaatcctgtgaccgggttgctgtctgcgtcacacgaacagaaagacgcctgggtccgggataacatctactctatcctggcggtgtggggacttggaatggcctacagaaagaacgcggatagggatgaagataaggccaaggcctacgagctggaacaaaacgtcgtcaagctgatgcggggccttctccaatgcatgatgcggcaggtggccaaggtggagaagttcaaacatacccaatcaaccaaggactcgctccatgccaagtacaatactgctacctgtggaactgtagtcggagatgaccagtggggccatctccaggtggacgccacttcgctcttcctgctgttcctcgcacagatgactgcctcgggactcagaattatctttactctggatgaagtggccttcatccagaacctggtgttttacatcgaggcggcgtacaaggtggctgactacggaatgtgggaacgcggagacaaaactaatcaaggaatccccgaactcaacgcgtcctccgtcggaatggcgaaggctgcccttgaggctatcgatgagctcgatctgttcggagcgcacggcggccggaagtccgtgatccacgtactgcctgatgaagtcgagcactgccaaagcattctcttctctatgctccccagagcctccacttcgaaggagattgacgccggcctgttgtcgatcatcagctttccggccttcgccgtggaggacgtgaatctcgtgaacgtgaccaagaacgagatcatttcgaaactccaggggcgatatggatgctgccgcttcctgcgcgacggctacaagactcctcgcgaagatccgaacaggctgcattacgacccggcagaactcaaactgttcgagaatatcgaatgcgagtggcccgtgttctggacctacttcatcatcgatggcgttttttcgggtgatgccgtgcaagtccaggagtacagagaggcgctcgaaggcatcctcatccggggaaaaaacggaatcaggctggtgcccgagctctacgcggtcccgccaaataaggtggatgaagaatacaagaacccccacactgtcgaccgcgtgccaatgggaaaggtgccacatctgtggggacagagcctctacatcttgtccagtctgctggcagaaggattcctcgcggctggagagattgatccgctcaaccggcgcttcagcaccagcgtgaagccagatgtggtggtgcaggtgactgtgctggcagagaacaatcacataaaagacctgttgaggaagcacggtgtgaatgtgcagtcgatcgccgatatccacccgatccaggtgcagccaggacggatactgtcccacatctacgcgaaactcggacggaataagaacatgaatctgtcgggtcggccatatcgccacatcggagtcctcgggacctccaagctctacgtcattagaaatcagatcttcaccttcactccacagttcacggatcaacaccacttttaccttgccctggataacgaaatgattgttgaaatgctgcgaattgaactggcctacctgtgcacttgctggcgcatgactggccggccgaccctcaccttccccatctcgcgcactatgcttacgaacgacggatctgacatccactccgctgttctgtctactatcaggaaattggaggacggttacttcggcggcgcacgggtcaagctcggaaacctctcggagtttctgactacttccttttacacttatctgactttcttggacccggactgtgacgaaaagctgttcgacaacgcaagcgagggtaccttctcccctgattcggactccgatctggtgggatacctcgaggacacctgcaaccaagaatcacaagacgaactggaccattacatcaaccatctgctccagagcacctcattgcgatcgtaccttccgcccctgtgcaaaaacaccgaagatcggcacgtttttagcgcgatccactcgactcgcgacatcctgtccgtgatggccaaggcgaaagggctcgaagtgcctttcgtgccaatgaccctgccaacgaaggtcctgtccgcccaccgcaagagcctgaacctggtggacagcccgcagccactgctggaaaaggtgccggagtcggatttccagtggccccgcgatgaccatggagacgtggactgtgaaaagctggtggaacaacttaaggattgctcaaatcttcaggatcaggccgacatcttgtacatcctctacgtgatcaaaggaccatcctgggataccaacctgtcaggacaacacggagtgaccgtgcaaaacctcctgggcgaactctacggcaaggccgggctcaaccaagagtggggactgatcagatacatctcaggactgctccggaagaaggtcgaggtgctggccgaagcctgtaccgacctgttgtcccatcagaaacagctcaccgtcggactgccgccagagccgcgggagaaaatcatctcggcgccactccctcctgaagagctgacgaagctcatctacgaggcctcagggcaagacattagcattgccgtgctgacccaggagatcgtggtgtatctggctatgtacgtcagagcacagccgtcactgtttgtagaaatgctcaggctgcgcatcggtcttatcatccaagtcatggctaccgagctcgctcgctcactgaattgctcgggagaagaggcaagcgaatctcttatgaatctctcgccttttgacatgaagaacctgctgcatcacatcctgtcaggcaaggaattcggagtggaaagatcggtccggccaatccactcttcgaccagctccccgactatctctatccatgaagtaggccatactggagtgaccaaaactgaacggtccggcatcaatagactgagatcggaaatgaagcagatgaccaggcgcttctcggcagacgaacagtttttctcggtgggtcaggcagcttcctccagcgcacactccagcaaaagcgcgcggtccagcaccccctcatcccccacgggcactagctcaagcgactccggaggtcaccatatcggctggggtgagcgccaaggacagtggctcagaaggcgccgcctcgacggagcgatcaaccgcgtcccggtcggcttctaccagcgagtctggaagatcttgcagaagtgtcacggccttagtatagacggatatgtccttccatcatcgaccaccagggagatgacgccgcacgaaatcaaattcgccgtgcacgtggagtccgtgctgaatcgcgtcccacagcccgagtacaggcaattgcttgtcgaagccatcatggtgctcactctgctgtcagacaccgagatgacgtctatcggggggattatacatgtggaccaaatcgtgcagatggcctcccagcttttcttgcaggaccaggtgagcatcggagccatggataccctggaaaaggaccaggctactggcatctgtcatttcttttacgacagcgctccctcgggcgcttacggaaccatgacctacctgactcgcgctgtcgcatcgtaccttcaggaactgctgccgaactcgggatgccaaatgcaa

SEQ ID NO: 18049 - DNA, 3705 bp, Artificial Sequence
  Description of Artificial Sequence: Synthetic coding sequence
atgcgctcccgatccaactctggcgtcagactcgacggctatgctcgcctcgtccaacagactattctttgttatcagaaccccgttacgggactcctgtctgcttctcatgagcaaaaggacgcctgggtccgagacaacatttactccatcttggcggtgtggggcctgggaatggcctaccgcaagaatgcagatcgagacgaagataaggcgaaggcctacgagctggagcagaacgtcgttaagctgatgcgcggacttcttcaatgcatgatgcgccaggtggctaaggtcgagaagtttaaacacacccagtccaccaaggactcattgcacgccaagtacaacacggcgacgtgcggcacggtcgtcggcgatgaccagtggggtcacctccaggtagatgctacttccctcttcttgttattcttggcacaaatgaccgcgagcggactacgtatcatcttcactctcgacgaggtggcgttcattcagaacctggtgttctacatcgaggcagcttacaaggtcgctgactacggaatgtgggagcggggagataagactaaccagggcattcccgagttgaatgcttcatccgtcggcatggctaaggccgctctggaggcaatcgacgagttggacctttttggggcccacggcggccgcaagagtgttatccacgtcctgcctgacgaagtagagcactgccagagcatcttgttctcaatgctgcctcgcgcctccactagtaaggagatcgacgctggactgctgagcatcatttcattccctgctttcgcggtggaggatgtgaatctggttaatgtcaccaagaacgagatcatttccaagctccagggccgctatggctgctgccgtttcctgagggatggatacaagaccccgcgtgaagatcctaaccggctccactatgatccggcagaattgaagctatttgagaacatcgagtgtgaatggcccgttttctggacatacttcatcatcgacggagtgttttcgggtgatgctgtccaggttcaggagtacagagaagctttggagggaatcctgatccgtggaaagaacggcatccgcctggtgcccgaactctatgctgttccaccgaataaggtcgatgaggagtataagaaccctcatacggtggatcgcgtccccatgggtaaggtgccccatctttggggtcagtccctctacatcctgtcgtccctgctggcggagggtttccttgccgctggcgagatcgaccccttgaatcgccgtttttcaacctccgtgaagccggatgtagtcgtgcaggttaccgttctggcggagaacaatcatatcaaggatctgctgaggaagcacggagtcaacgttcagtccatagcagatatccatcctattcaggtgcagcccggacgtattctgtcccacatctacgccaagctgggccgtaacaagaacatgaacctcagcggccgcccctaccgccacatcggcgtcctcggcacgtcgaagttgtacgttattcgcaaccagatattcactttcactccccaatttacggatcagcaccacttttacttagccctagataacgagatgatcgttgagatgctgcgcatcgagctggcctacctctgcacttgctggcggatgactggacgtccgaccctcacctttccgatctcgcgcaccatgttgaccaacgatggttctgatatccactccgctgttctgtctaccattcggaagctggaggacggttattttggaggagcccgcgtaaagctgggtaacttgagtgaattcctcacaactagcttttacacttacctcacgttcttggatcctgattgcgacgagaagctgttcgacaatgcctcggagggtacattttcaccggattctgatagcgacttggtgggttatttggaggacacgtgcaaccaggagagccaagatgagctcgatcactacatcaatcatctcctccaaagcacctcgctccgctcgtacctcccccccctctgcaagaacaccgaagaccgacacgtgttctcggccatccactctactcgcgatattctctcggtcatggcaaaggctaaggggctggaagtgccattcgtccccatgactctccccaccaaggtgctctctgcgcaccggaagagtttaaacctggtcgatagcccccagcccctcctcgagaaagttccggagtcggatttccagtggcctcgagacgatcacggtgatgtggattgtgaaaagctcgttgagcagctcaaggattgctccaacctccaggaccaggcggatatcctctacatcctgtacgtaatcaagggtccttcctgggacaccaacctgagcggtcagcacggtgtcactgtccagaacctcctcggagagttatacggaaaggccggattgaaccaggagtggggactaattaggtacattagtggactgcttaggaagaaggttgaagtgcttgcggaggcctgcacggaccttctgagccaccagaaacagctcacggtgggcctcccccccgagccccgggaaaagatcatctcggcgcctctgccgccggaggaattgacgaagcttatttacgaagcttcgggtcaggacatctcgatagcggtcctcacgcaggagatcgtagtctacctggccatgtacgtccgtgcacagccgtccctctttgtcgagatgcttcggcttagaattggcttgataatccaagttatggccacagagctcgcgcgcagcctgaactgtagcggggaggaggccagcgagagcctcatgaacctgtccccctttgatatgaagaacctgttgcatcatatcctctccggtaaggagttcggtgttgagcggtccgttcggcccattcatagcagcaccagctcccctacaatctctattcacgaggtgggtcacaccggcgttacgaagacggagcgttccggaattaaccgcctccggtccgagatgaaacaaatgacgcggcgcttctccgccgatgagcagttcttctcggtgggacaggctgccagctcctcggcccattcctcgaagtccgcgagatccagcactccctcttcccccaccggcacctcctcgtcggattccgggggccaccatattggatggggagagagacagggacaatggcttcgccgtcgtagactggacggcgcaatcaaccgcgttcccgtcgggttctatcaacgtgtttggaagatcctacagaagtgccacgggctgtccattgacggctacgtgctgcccagctccactacgcgcgagatgaccccccacgaaatcaagttcgctgtgcatgtcgagtcggtcttgaatcgggttcctcagccggaataccgccaactgctggttgaggctattatggtcttgaccctactgagtgatactgagatgacctctatcggaggcataatccacgtggaccagatcgtccaaatggctagccaattgtttttgcaggatcaggtgtctatcggagcgatggataccctcgagaaggaccaagccaccggcatctgccacttcttctatgatagcgcacccagtggagcctatggcaccatgacataccttactcgcgccgtcgccagttacttgcaggagctcctgcctaacagcggttgccagatgcag

SEQ ID NO: 18050 - DNA, 3705 bp, Artificial Sequence
  Description of Artificial Sequence: Synthetic coding sequence
atgcggagccgctcgaattcgggagtcaggctggacggatacgcgcgcctggtgcagcagaccatcctgtgctaccagaatccggtgaccgggcttctgtcagcctcacacgaacagaaggacgcgtgggtccgcgacaacatctactccatcttggcggtgtggggactggggatggcctaccggaagaatgccgatagagacgaggacaaggcgaaggcctatgagctggagcagaacgtggtgaagctcatgcggggtcttttgcagtgtatgatgcgccaggtggccaaggtcgagaaattcaagcacacccaatccactaaagactcgctccacgccaagtacaacaccgccacgtgtggcaccgtggttggagatgatcagtggggacacctgcaagtggatgcgacttctctgttcctcttgttcctggcccagatgaccgcatcaggactgcgaatcatcttcaccctggacgaagtggcattcattcagaatctggtgttctatatcgaagcggcttacaaggtggcagattacgggatgtgggaaagaggagacaagacgaaccagggcatcccggagttgaatgccagctcggtgggaatggcgaaagctgcgcttgaagccatcgatgaactggatctgttcggcgcccacggtggacgcaagtcggtgatccacgtgctgcccgatgaagtcgaacactgccagtcgattctcttctcgatgctcccgagggcctccacctcaaaagagatcgatgccggtttgctcagcatcattagctttccggccttcgccgtggaggatgtgaatctggtgaacgtcaccaagaacgaaatcatctcaaaactgcagggacgatacggatgttgtcgcttcttgcgcgacggctacaagactcctcgggaggatccgaacaggctgcattacgacccggcagagcttaaactgtttgagaacatcgaatgcgaatggccggtgttttggacttacttcatcatcgacggagtgttcagcggggatgcagtgcaagtgcaagaatacagagaagctctggagggaatcctgatccggggaaagaacggaatccggctcgtcccagagctgtacgccgtcccgccaaacaaagtggacgaggagtacaaaaacccgcacactgtcgatcgcgtgcctatgggtaaggtgccgcacctctggggtcaatcactctacattctgtcgagcttgctggctgaaggattcctggcagcaggagaaattgacccgttgaaccgccgcttctcgacctcggtgaagccagacgtcgtggtgcaagtgactgtgttggcagaaaacaatcacatcaaggatctcctcagaaaacatggcgtgaacgtgcaatccatcgcagatattcacccgatccaggtccagccaggccgcatcctgtcccatatctatgcgaagttggggagaaacaaaaacatgaacttgtccggtaggccgtacagacatattggagttctgggcacctcgaaactctacgtgatcagaaaccagatcttcacctttaccccgcagtttaccgatcagcaccatttctatctggccctggataacgagatgatcgtcgaaatgctgaggattgaactcgcgtacctgtgcacctgctggagaatgactggccgtccgacccttacgtttccgatttcacggactatgctcaccaacgacggttcagatatccatagcgctgtcttgtctactatccgaaaacttgaggacggatatttcggcggtgcccgagtgaaacttggaaacctgtcggagttccttactacgtccttctacacttacctcactttcctggatccagattgcgacgagaagctgttcgataatgccagcgaggggactttcagccctgattccgattcggacctcgtcgggtatctcgaagatacgtgcaaccaagagtctcaggatgaattggatcattacatcaatcacctgctgcaatcgacctccttgcggtcctacctgccgccgctctgcaagaatactgaggatcgccacgtgttttcagcgatacacagcacccgggacattctgagcgtgatggccaaagccaaagggctcgaagttccgtttgtcccgatgactttgccgactaaagtcttgtctgcacatagaaagtcgctgaatctggtggactcaccgcaaccgctgctggaaaaagtgccagaatcagacttccagtggccgcgggacgaccatggagatgtggattgtgaaaaactggtggaacagctgaaagattgcagcaatctgcaagaccaagcggacatcctgtatatcctgtacgtcatcaaaggaccgtcatgggacaccaatctcagcggacagcacggagtcaccgtccagaacctcctgggtgaactgtacgggaaggccggcctcaaccaggagtgggggctgatcagatacatctctgggttgcttagaaagaaggtcgaggttcttgctgaggcttgcactgatctgctgtcgcaccaaaaacaactgactgttggacttcccccggagccgcgcgagaagatcatctcagccccgctccctccggaggagctgactaaactgatttacgaagctagcggtcaggacatctcaatcgccgtgctgacccaggagattgtggtgtacctggcgatgtacgtcagggctcagccgtcactgttcgtcgagatgctgcggctgagaatcggactgatcatccaggtgatggcgaccgaattggccagatctctcaactgcagcggagaagaagcgtccgagtccctgatgaatctttccccattcgacatgaagaatctgttgcaccatatcctctccggaaaggaattcggagtcgaacgctcggttagaccgatccactcaagcacctcgtcgccaaccatctcaattcacgaggtgggacacactggagtgactaagaccgaacgcagcggcatcaacaggctgcggtccgagatgaagcagatgactaggagattttcagctgatgagcagttcttttcggtgggacaggcggcatcgagctccgcccatagctccaagagcgcccgctcctccactccatcctcgccgactgggaccagctcctccgactccggcggccatcatatcggatggggcgagcggcagggacagtggctccgccgcagacggctggacggagcaattaacagagtgcctgtcggattttaccagagagtttggaagattctgcagaagtgccacggactgtcgatcgacggatacgtgctgccctcgtcgaccactcgggaaatgaccccgcacgaaatcaaatttgccgtgcacgtcgaatcagtcctcaatcgggtccctcagccggagtacagacaactgctcgtggaggcaatcatggtgctcacgctcttgtcggataccgaaatgacttccattggcggaatcatccacgtggaccagatcgtgcaaatggcgagccaactgttcctgcaagatcaggtgtccataggagcgatggatacgctggaaaaggaccaggccactggcatttgtcacttcttctacgactccgccccttccggcgcttatgggactatgacctacctgacgagagctgttgctagctacctgcaagagctgctgcctaacagtggctgccagatgcag

SEQ ID NO: 18051 - DNA, 3705 bp, Artificial Sequence
  Description of Artificial Sequence: Synthetic coding sequence
atgcggagcaggtcaaactccggtgtgcgattggatggatacgctaggctggtgcagcaaactattttgtgctaccagaaccccgtgacggggctgctgtccgcatcccacgaacaaaaagatgcctgggtgagagacaacatttactcgattcttgcagtgtgggggttgggtatggcataccgcaagaatgccgatagggacgaagataaggcaaaggcatacgagctggaacagaacgtggtcaagctcatgcgcggactccttcagtgcatgatgaggcaagtggccaaagtggagaaattcaagcatacccagagcaccaaggattcccttcacgccaagtataacaccgcaacctgcgggaccgtggtgggagatgaccagtggggacatctccaagtggacgcaacctccctgtttctcctgttcttggcccaaatgaccgcttccggactgcggatcattttcaccctggatgaggtggcgtttattcaaaatctcgtcttttacatcgaggcggcatacaaggtggcggattacggaatgtgggaaagaggtgacaagactaaccaaggaattccggaactcaacgcatcctccgtgggtatggcaaaagcagcgttggaggcgattgatgagctcgatctgttcggagcccacggaggcaggaagtccgtgattcacgtgcttccagatgaagtggaacattgtcaaagcattttgttctcaatgcttccaagagcatcgacttccaaggagattgacgcaggacttctctcgattatctcattccctgcattcgcagtggaagatgtcaacctggtcaatgtgaccaagaatgaaatcatctccaagttgcaaggtcgttacggttgttgtaggttcctgcgggatggatacaagacccctagagaagatccgaacagattgcattacgatccagctgagcttaagctgtttgaaaacattgagtgtgaatggccagttttctggacttacttcattatagatggcgtgttttcgggggatgcggtgcaagtgcaagaataccgggaagcactcgaaggaattctgattcgtggcaagaacggtatcagacttgtgcctgaactgtacgcagtgccgccgaacaaagtcgatgaagagtacaaaaatcctcacacggtggatagggtgccaatgggtaaggtccctcatttgtggggacaaagcctgtacattctttcaagcctgctggcagaaggatttcttgccgcaggggagattgacccactcaatcggaggttttccacctccgtgaagccagacgtggtggtgcaggtgaccgtgctggcggaaaacaatcacattaaggacctgctgagaaagcatggggtgaacgtgcagtccatagcagacatccatcctattcaagtccaacctggacggattctctcacatatctacgcaaaactgggcagaaacaagaacatgaatctgagcggcagaccatacagacatattggagttctgggaacttccaaactgtacgtgatacggaaccaaatctttacttttacccctcaatttaccgatcagcaccatttctaccttgcactggataatgagatgattgtcgaaatgcttcggattgagctggcatacctctgtacttgctggcggatgactggtcggcctaccctgactttccctatatcccgcaccatgttgaccaacgacggatcggatatccattccgcagtcctgagcactattagaaagctggaggacgggtacttcggaggtgcacgggtcaaacttggtaatctttccgaatttctgaccacttcattctacacctaccttacttttcttgaccctgattgtgacgagaaactgtttgataacgcctccgaaggtacctttagccctgattccgatagcgatctcgtcggctaccttgaagatacgtgcaaccaggagagccaagatgaactggaccattacattaatcatctgctccagagcacctccctcagaagctacctgccacctctttgtaaaaacacggaggataggcatgtcttttccgcaattcactcaacgcgcgatatcttgtcggtgatggccaaggcaaaggggctggaagtgccgtttgttccgatgacccttccaaccaaagtgctctcagcccatcgcaagtcactgaatctggtggattccccacagccactgctggagaaggtacccgagtccgattttcaatggccaagagatgatcacggggatgtggattgtgagaaactggtcgaacaactcaaagattgctcgaaccttcaggatcaggcggatattctgtatatcctgtacgtgattaaggggcctagctgggacactaatctctcgggacaacatggagtcacggtgcaaaacctgctgggcgagctttacggcaaagctgggcttaaccaagagtgggggcttattagatacatttccggcctgctgcggaagaaggttgaagtcctggcggaagcctgtaccgatcttcttagtcatcagaagcaactgaccgtggggttgcctcccgaaccccgggagaagatcatttccgctccgcttcctccagaagagcttacgaagctgatatacgaagccagcggccaggatatatccattgcggtgcttactcaggaaattgtggtgtatctggctatgtacgtgagggcacagccctcactgtttgtggagatgctccggctgagaataggactgataattcaggtcatggcgactgaacttgcacgctcacttaactgctcgggagaagaggcatccgaatcactgatgaatctgagtccttttgacatgaagaatctccttcaccatatcctgagcggcaaagagtttggtgtggaacgctctgtccgccccatccattcgtccactagctcgccaactatttcgatccacgaggtcgggcataccggggtgactaagacggagcgctcaggaatcaaccgacttcgatcagagatgaagcagatgaccagacgattctccgcggatgaacagttcttttcggtcggacaagccgcaagctcttccgcccactcgtcgaaatccgctcgctcgagcactccctcctccccaaccggaacctcgtcatccgattccgggggtcaccacattggatggggcgagcgccagggacaatggctccggagaaggcggctcgatggagcaatcaatagggtgcctgtcggattttaccaaagagtctggaaaattctccagaagtgtcacgggctctccatcgatggctacgtgctgccgagctccaccaccagagaaatgacccctcatgagatcaagttcgcagtgcatgtggaatcggtgctgaatagggtcccccagccagaatatagacaactgcttgtggaagcaattatggtgcttaccctgctttcggatactgaaatgacgagcatcggaggaattatccatgtggatcaaatagtgcaaatggcttcgcaactgtttctgcaggaccaagtctcgattggtgcaatggacacgctcgagaaggatcaggcgactggtatctgtcacttcttttacgactcggccccgtcaggtgcatatggtaccatgacctacttgacccgagccgtggcgtcgtaccttcaagagttgctgcccaacagcggatgtcaaatgcag

SEQ ID NO: 18052 - DNA, 3705 bp, Artificial Sequence
  Description of Artificial Sequence: Synthetic coding sequence
atgcgctcgcgctcgaactccggcgtgagattggacggatacgcccggctggtgcagcaaaccattctctgctaccaaaatcctgtgacgggacttttgtcagctagccatgaacaaaaggacgcatgggtcagagataacatttacagcatcctcgccgtctggggcctgggaatggcatatcgcaagaatgctgatcgggacgaagataaagcgaaagcatacgagctggaacagaacgtggtcaagctgatgcgcggcctcctccagtgcatgatgcgtcaggtcgccaaggtggagaagttcaaacacactcagtccaccaaagactcgctgcacgctaagtacaacaccgcgacttgtggaactgtggtcggagacgaccagtgggggcatcttcaagtggacgcgactagcctcttcttgctgttcctggcccaaatgaccgcctccggactccgcatcatctttaccctggacgaagttgcgtttatccagaacctggtgttctacatcgaagccgcttacaaggtcgcggactacggcatgtgggagcgcggtgataagaccaaccaaggtatcccggaactcaacgccagcagcgtcggaatggccaaagccgccctcgaggccattgacgaactcgaccttttcggagcacatggcgggcgcaaatccgtcatccacgtcttgccggacgaagtggaacattgtcaatcaatcctcttctcaatgctcccccgggcctcgacgtcaaaggagattgacgctggactcctctccatcatcagcttcccagctttcgctgtggaagatgtcaacctggtcaatgtcaccaagaacgagattatctcgaagctgcaggggcggtacggctgttgtcgctttctgagagacggatacaaaaccccacgggaggatccgaatcgcctccactacgacccagcggagctgaagctcttcgagaatatcgaatgtgaatggccagtgttttggacttacttcatcatcgacggagtgttctccggagacgcggtgcaggtgcaggaataccgcgaagccctggaagggattttgatacgcggtaagaatggcatccgcctcgtgcccgagctgtacgccgtgccgccgaacaaagtggacgaggagtacaaaaacccgcacactgtcgaccgggtcccgatgggaaaggtgcctcacctgtggggtcagagcctctacatcctctcctccctgttggccgagggcttcctggcagccggagagatcgaccccttgaaccggcgcttttcgacgtcggtcaagccagacgtggtggtgcaggtcaccgtcctggctgaaaacaaccatatcaaggacctgctcaggaaacacggagtcaacgttcaatcaatcgcggacatccatccgatccaagtgcagccaggccgcatcctttcccacatctatgcgaaactcggtaggaacaagaacatgaatttgagcggccggccttaccggcatatcggggtccttggaacctccaagctgtacgtgatccgcaatcagatcttcactttcactccgcaatttaccgatcagcaccacttctacctggcgctggacaatgaaatgattgttgagatgctgagaattgaactggcctatctttgcacttgctggcgcatgaccggacgcccaaccctgaccttcccgatctccagaaccatgctgactaatgacggaagcgatatccattccgctgttctgtcgaccatccggaaactggaagatgggtacttcggaggcgcccgggtcaagttgggcaatctttccgaattcctgacgacctcgttttacacttacttgactttcctcgacccggattgcgatgaaaagctgttcgacaatgcctcggagggtacttttagccccgactctgattccgatctggtgggatacctggaggacacttgcaaccaggagtcgcaagatgagctggatcactacatcaaccacttgctccagtcgacttcgctgcgctcgtacctcccaccactgtgtaagaacaccgaagataggcacgtgttctccgcaattcattcaactcgcgacatactctcagtgatggcgaaggccaagggactggaggtgccctttgtgccgatgaccttgccgactaaagtgctcagcgcccatcggaagtccctcaacttggtggattccccacagcctcttctggaaaaggtcccggaatccgacttccagtggccgcgggatgatcacggtgatgttgattgcgagaaactggtggaacagctcaaggactgcagcaatctccaggatcaggcagatatcctgtatatcctgtatgtcatcaagggaccgagctgggacaccaacctgtcggggcagcacggagttactgtgcagaatttgttgggcgagctctacggcaaggctggactgaaccaggagtggggactgatccgctacatctccggactgcttcgcaaaaaagtcgaggtgctcgccgaggcctgcactgacctgctgtctcaccaaaagcaacttaccgtgggactgccgcccgaaccgcgtgaaaagattatctccgctcctctccccccagaagaactgactaaactcatctacgaggcatccgggcaggatatcagcattgcagtcctgacgcaggagatcgtggtctacctcgccatgtatgtgcgggcccaaccttccctgttcgtcgagatgctgcgtctgagaatcgggctgatcattcaagtaatggcgactgagctggccagatcgctcaactgctctggagaagaggcctcggaaagcctcatgaacctgagcccatttgacatgaagaacctgcttcaccatatcttgtcaggtaaggagttcggagtcgaacgatcggttagaccgatccactcgtccaccagctcgcctaccatctccatccatgaagtcggacatactggcgtcactaagaccgaacggtccggcatcaatagactccgctcagaaatgaagcagatgacgcgcaggttttccgcagacgaacagttcttctcggtgggacaggcggcatcgagctcagcacatagctcgaagtcggccagatcctccaccccgtcatcgccgactggaactagctcctccgatagcggtggacatcatatcggatggggcgaacggcaggggcagtggctgcggaggcgccgcttggatggtgccatcaatcgcgtgcctgtggggttctaccagagggtgtggaagatacttcagaagtgtcacggactgtcaatcgacggatacgtgctgccttcatccactacccgcgaaatgaccccgcacgaaatcaagttcgctgtccatgtggagtccgtgctgaaccgcgtcccccagccggaataccggcaacttctggtggaagcaattatggtgctgacgctgctctccgacaccgaaatgacgtcgatcggaggcatcatccacgtggaccagatcgtgcagatggcctcccagttgttcctgcaggatcaagtcagcatcggtgccatggacacgttggaaaaagaccaagcgactggtatttgccatttcttctacgactccgcaccgtcaggggcttacggaaccatgacctaccttactagagcggtcgccagctacctgcaagaactgttgccgaactcggggtgccagatgcaa

SEQ ID NO: 18053 - DNA, 3705 bp, Artificial Sequence
  Description of Artificial Sequence: Synthetic coding sequence
atgcgctcacggagcaactcgggcgtcagactcgacggctacgccagacttgtccaacaaaccatcctctgctaccagaacccggtcactggtctgctgagcgcgtcccacgaacagaaagatgcctgggtccgggacaatatctattcaattctcgcggtgtggggtctgggaatggcgtacagaaagaatgcagatcgcgacgaggacaaggcaaaggcctacgaactggaacaaaatgtggtcaagttgatgcgaggactgctccagtgcatgatgcggcaagtggcaaaggtggaaaagtttaagcatactcagagcaccaaggatagcttgcacgcaaagtacaacacggccacctgcggaaccgtcgtgggtgacgaccagtggggacatttgcaggtagacgccacttcgttgttcctcctcttccttgcgcaaatgacggcgtctggcctccgaatcatattcaccctggatgaagtggctttcattcaaaacctggtgttttacatcgaagcagcctacaaggtcgcagactacggaatgtgggaaaggggcgataaaaccaaccagggcatcccggagcttaacgcctcaagcgtgggaatggcaaaggcagcgctggaggcgatcgacgagttggacttgtttggagcccatggcggacgaaagtcagtcatccacgttctcccggatgaggtggaacactgccagtctatcctcttcagcatgcttccgcgggctagcacctcgaaggagattgatgctgggctcttgtctatcatctccttcccagctttcgccgtggaggacgtcaatctggtgaatgtcaccaagaacgagatcatctctaagctccaaggtagatacggctgttgcaggttcctgcgcgatggttacaagaccccacgcgaggaccctaaccgcctccactacgacccggcagaactgaagctgttcgaaaacattgagtgtgaatggcccgtattctggacctacttcatcatcgacggtgtgttcagcggagacgcagtccaggtgcaggaatacagagaagcgctggaaggaattctgatccggggaaagaacggtattcgcctcgtcccggagctgtacgccgtgccgcctaacaaggtcgacgaagagtacaagaatccccacaccgtggatcgtgtgccgatgggcaaagtcccgcacctctggggccaatcgctgtacattctgtcgtccttgctggccgaaggattcctggctgcgggcgagatcgacccgctcaatcggcgattctccacttccgtgaaaccagatgtggtggtccaggttactgtgctcgcggagaataaccacatcaaggatcttctgcgcaagcatggggtgaacgtgcagtcgatcgctgacattcatcctattcaagtgcaacctggacgcatcctctcccacatctacgctaaactgggacgcaacaagaacatgaacctctcgggtagaccgtatcggcatatcggagtcctcggaacgtcgaagctctacgtaatcaggaaccagattttcacttttaccccacagttcactgaccagcaccatttctacctcgccctcgataatgaaatgattgtagagatgctccggatcgagctcgcatacctgtgtacttgctggcggatgacggggcgccccaccctgacttttccgattagccgcaccatgctcaccaacgacggaagcgacatccactccgcggtcctgtccactataagaaaactggaggatggatacttcggaggggcacgcgtcaagctcgggaacctgtccgaatttctcactacttccttctacacttatctgacgtttctcgacccggactgcgatgagaaattgttcgacaacgcctccgagggaactttctcccctgactctgacagcgatctggtgggataccttgaggatacctgcaatcaggagtcacaagatgagcttgaccactacatcaatcatctgctgcaatcgactagcctgcggagctacctgcctccactgtgcaagaacaccgaagatcgtcacgtgttttctgccatccattccacccgcgacatcctttcggtgatggctaaagccaagggactggaagtgcctttcgtccctatgactctcccaacgaaggtgctctcagcacatcgcaagtcactgaacttggtggactctcctcagccgttgctggagaaggtgccagaatcggacttccaatggcccagagacgaccacggtgacgtggactgcgagaagctggtggaacagctcaaagactgttcgaacctgcaggaccaagctgatatcctttacatcctgtacgtcatcaagggaccgtcctgggataccaacctttccggacaacatggggtgaccgtccaaaaccttctgggagaactgtacggaaaagccggcctgaatcaggagtggggactcatccggtacatctctggtctgctgcggaagaaggtggaagtgctggccgaggcgtgcactgacctgctgtcgcaccaaaagcagctgacggtgggtctgccgccagaaccgagagagaaaatcatctccgccccgttgcccccggaagagctgaccaaattgatctacgaagcgtcgggacaagacattagcatcgctgttctgacccaggaaatcgtggtgtacctggccatgtacgttcgcgcccagccatccctctttgtcgaaatgcttagactgaggatcgggctgatcatccaggtgatggcgactgagctcgcacggtcgctcaattgctccggagaggaagcctctgaatcactgatgaatctgtctcctttcgacatgaaaaatcttctgcaccacatcttgtcgggcaaggaattcggcgtggaacggagtgtaagacccatacattcatcgacctccagccccactatctcgatccacgaagttgggcacaccggggttactaaaaccgaacggagtgggatcaaccgacttcggtcggaaatgaagcagatgacccgccgcttctcagccgatgagcagttcttttccgtgggccaggccgcgtccagctcagctcatagctcgaaaagcgccaggtcgtccaccccaagctcaccaacggggacttcatcaagcgattcagggggccaccatatcggatggggagagagacaaggacagtggctcaggcgccgccggctggatggggccatcaacagagtgccggtgggattctaccagcgcgtgtggaaaatacttcagaagtgtcatggcctcagcatcgatggctatgtcttgccttcgagcactacccgcgagatgaccccacacgaaatcaagtttgctgtgcacgtggagtcggtgctgaatcgggtgccacaaccggaatacaggcagttgctggtcgaagcaatcatggtgctgactttgctgtctgatacggagatgacttcaatcggaggaatcattcacgtggatcagatcgttcagatggcctcccaactgttcctgcaagaccaagtgtcgatcggagcgatggacaccctcgaaaaagaccaggccaccggcatttgccatttcttttacgattccgccccgagcggtgcatatggtactatgacctacctgactcgggcggtggcctcctatctgcaggaactgctgccgaacagcgggtgccagatgcag

SEQ ID NO: 18054 - DNA, 3705 bp, Artificial Sequence
  Description of Artificial Sequence: Synthetic coding sequence
atgcgctctcgctcaaacagtggagtccgcctcgacggttacgcccgcctggtgcagcagaccatactttgctaccagaaccccgtgacaggcctgctttcagcatcccacgagcaaaaggacgcttgggttagggataacatctattcaatcctggcagtatggggtctgggaatggcctacagaaaaaacgccgaccgtgatgaagacaaggctaaagcctatgagttggaacagaatgtcgtcaaacttatgcgcggactgctgcaatgtatgatgcgccaagtggccaaagttgagaaattcaaacacactcagtcaacaaaggacagtctgcacgcaaagtacaataccgccacctgcggcaccgttgtgggcgacgatcaatggggccacctccaggtggacgccaccagcctgtttcttctgttcctggctcagatgacagcctccggactgagaatcatttttaccctggacgaagtggctttcatccagaatctggtgttctacatcgaggctgcatacaaagtcgccgactatggcatgtgggaacgtggtgacaagactaaccagggcattcctgaactgaacgcttcctccgttggcatggctaaagctgccttggaggctatcgacgaactggacctttttggcgctcatggtggcagaaagagtgtaattcacgttctgcccgatgaggtcgaacactgccagagcatcctcttctcaatgctcccacgtgcctctacctccaaagagatcgatgctggccttctgagtataatttcatttccagcttttgctgttgaagatgtcaaccttgtgaatgtaacaaagaacgagatcattagcaaactgcagggccgctacggctgctgccgcttcctccgtgacggctacaagacacctcgcgaggaccccaacagacttcactacgaccccgccgaattgaagttgtttgagaatatagagtgcgagtggcctgttttttggacctactttatcatcgacggtgtgttttctggagacgctgttcaggtccaagagtatcgtgaggctctggagggtattctgatcagaggaaagaatggcattcgtctggtacctgagctttacgcagtcccacccaacaaagtggatgaagaatataagaatcctcacactgttgaccgtgtaccaatgggaaaagttccacacctttggggacaatcactgtatatcctgagctcactgttggccgaaggcttcctggctgctggagaaatcgatcccttgaacagaaggtttagtactagtgtcaagccagatgtcgttgttcaggtgacagtccttgccgaaaataaccacataaaggacctgctgagaaaacacggagttaacgtgcaatccatagccgacattcaccccatacaggttcagcctggccgcattctttcccatatctatgccaagttgggcagaaataagaacatgaacctttccggacgtccctaccgtcatataggcgtgctgggaacttcaaagttgtacgtgatcaggaaccagatctttactttcactcctcaattcactgatcagcatcatttctatttggccctggacaacgagatgattgttgagatgctgagaatcgaactcgcatacttgtgtacatgctggagaatgaccggccgccctacactgacattccctatttctcgcactatgcttacaaatgacggttctgacatccattctgccgtcctctccacaattagaaagttggaagatggctacttcggcggcgcccgtgtaaagctcggcaacctctcagagttcctcaccacctctttttacacatatctcacatttttggatccagattgcgacgaaaagttgttcgacaacgcatccgaaggaacttttagccccgattccgatagcgacctggtaggttacctggaagatacttgcaaccaggagtcacaggatgagctggatcactacataaaccacctgctccagagcaccagtcttagaagctaccttcctcctctttgtaaaaacacagaggataggcatgtgttcagcgctatccattccacccgtgatatcctcagtgtcatggctaaagcaaaaggcttggaagtgccttttgtgcccatgacactcccaactaaagtcctttccgcacacaggaaatcattgaatttggtggatagcccccaacctttgttggagaaggtgccagaatccgacttccagtggcctagggacgaccacggcgatgtagactgcgaaaagctggttgagcaactgaaggactgtagcaatctgcaagaccaggccgacattttgtatatcctttacgttatcaagggcccttcttgggatacaaacctgtccggtcagcacggcgtcacagtgcagaaccttttgggagagttgtacggtaaggccggccttaatcaggagtggggcctgattaggtatatctccggcctgttgagaaagaaggtcgaagttcttgccgaagcttgcactgaccttctgtcccaccagaagcaactcactgtgggcctgccacccgagcctagagaaaaaatcatttccgctcccttgccccccgaagagcttacaaaactgatctacgaggcatccggccaagatatttctattgctgtattgacacaggagatcgttgtatacctggctatgtatgtccgtgcacagccttccctgtttgtagagatgctcaggttgcgcattggtctcatcatccaagtaatggctacagagctcgccagaagtctgaattgcagcggcgaggaagccagtgagtctctgatgaatctgagccccttcgacatgaagaacttgcttcaccatatcctgagcggaaaggaattcggcgttgagcgtagcgtacgcccaattcatagctccacatcatctcccaccatttccatccatgaggtgggtcacaccggtgtcacaaagactgagaggagtggcatcaataggctccgcagcgaaatgaagcaaatgacccgccgcttcagtgccgacgaacaattcttttccgtaggtcaagctgcttccagtagcgctcactctagcaaatcagcccgctcctccactccctcttcccccacaggaactagcagttctgacagcggtggtcatcacattggatggggagaaagacagggacagtggctgcgtagacgcaggctggacggcgctattaatcgtgtgccagttggattctaccaacgcgtctggaaaattctgcaaaagtgtcacggtttgtcaattgacggctatgtattgccatcctcaacaactcgcgagatgacacctcacgagatcaagttcgccgtgcacgtcgagtcagtcctgaacagagtgccacagcctgaatacaggcaactcctggtggaggccatcatggtgctgacattgctcagcgatacagagatgacttccattggaggcattatccacgtggaccagattgttcagatggctagtcaactcttcttgcaggaccaggtcagcatcggcgccatggataccttggaaaaggatcaggcaacaggtatctgccatttcttctacgatagtgcaccatctggagcatacggcacaatgacctacctgacacgtgctgtggcttcctatctccaggaactgctcccaaacagcggatgccaaatgcag

SEQ ID NO: 18055 - DNA, 3705 bp, Artificial Sequence
  Description of Artificial Sequence: Synthetic coding sequence
atgcgttctcggtcgaatagtggagtgcgtctggacggttacgcacgattggtgcagcagactattctgtgttatcagaacccagtgaccggactgctgtctgcatcgcatgaacaaaaggacgcatgggtcagagataacatttactcaatacttgctgtgtggggtctgggaatggcataccgtaagaacgcggatagagatgaagataaggcgaaggcatacgaactcgaacagaacgtcgtgaaactgatgagaggcctgcttcaatgcatgatgagacaggtggccaaggtggaaaagttcaaacacacgcaatcgaccaaggactcgctgcatgcaaaatacaatactgcaacctgtgggactgtggtcggggatgatcaatggggtcaccttcaagtggacgcaacttcccttttcctgctttttctcgcacaaatgactgcctcgggactgagaattatcttcaccctcgacgaggtggcctttatacagaatcttgtgttttacattgaagcagcttacaaggtggctgattacggaatgtgggaaagaggagataagactaatcagggaattcccgagcttaatgccagctcagtggggatggcgaaggccgccctcgaagcaattgacgagctggatctttttggagcacatggtggtcgcaaatcggtgatccatgtgcttccggacgaggtggagcattgccaatcaattctcttttcaatgctgcctagagcatctacctcgaaggaaattgacgctggccttctttcgatcattagctttcctgcattcgcagtggaagatgtcaacctcgttaatgtgacgaagaatgagatcatctccaagctgcaaggaagatacggatgttgccgttttcttcgggatggatataagacccctcgagaagatcctaaccggctgcactacgaccctgcggaactgaaactttttgaaaacatagagtgtgaatggcctgtgttttggacctacttcattatcgatggcgtgttttcgggagatgctgtgcaagtgcaagaatacagagaagccctggaaggaatccttatacggggtaagaacgggatccgactggtccccgaactgtacgctgtgcctccaaacaaggtcgacgaggaatacaaaaatccacacaccgtcgatagggttcctatgggcaaggtgcctcatctctggggacagtcgctttacattctgtcatcgcttctggctgaaggttttctggcggcgggtgaaatcgatccacttaatcgcaggtttagcacctccgtgaagccagatgtggtcgtgcaggtgaccgtgcttgcggaaaacaaccatatcaaggacctcctgcgcaaacatggtgttaacgtacagtcgattgccgatatccatcctatacaggtgcagccgggacgtattctgtcacatatctacgccaagctgggtagaaacaagaatatgaacctttctggcagaccttacagacacattggagtcctgggaacctcgaagttgtacgtgatacgtaatcagatctttacgtttactcctcaattcactgatcagcatcatttctatctggccttggataacgaaatgatcgtggagatgctgagaatcgaacttgcatatttgtgcacctgctggagaatgacgggcagaccaactctgacctttcctatcagccgtaccatgctcaccaacgacggttcggatatccatagcgcagttctgtcgactattcgaaaactggaagatggatactttggaggtgcaagggtgaaactcggcaacctgtcggagttcctcactacctcattctacacttacctcacttttctggacccagactgtgacgaaaaactgtttgataacgcatccgaaggaacttttagcccagattcagatagcgatcttgtgggttacctggaggatacctgcaatcaggagtcgcaagacgaacttgaccattacataaaccacctgctgcaatccacctccctgagatcgtaccttcctccactgtgtaagaacaccgaggaccgacatgtgttctccgcaattcatagcaccagagatatcctttcagtcatggcaaaagcaaaaggactggaagtgccattcgtccctatgacccttccaactaaggtgttgtccgctcatagaaagtccttgaacctggtcgacagccctcagcccctcctcgaaaaggtgcctgagtcggatttccaatggccacgcgacgatcatggtgacgtggactgtgaaaaacttgtggaacaactgaaggattgctccaacctgcaagaccaagcagacatactttacatcctctacgtcataaagggtccctcctgggacactaaccttagcggacagcatggagtgaccgtgcagaacctgctgggcgaactgtacggtaaggcagggttgaatcaggagtgggggcttatcagatacatatcaggactgctgcgaaagaaggtggaagtgttggcagaagcatgtactgacctcctgtcccaccaaaaacaactgaccgtgggactccctccggaaccccgggaaaagattatctccgcaccactccccccagaagaactgactaaactcatttacgaggcatctggtcaagatatttccattgcggtgctgactcaagaaatcgtggtttacctggcaatgtacgtgcgtgctcagccatcactgtttgttgagatgctccgccttagaataggactcatcattcaggtgatggcaaccgagcttgcacgttcccttaactgttcaggtgaagaagcctcggagtcactgatgaacctttcccccttcgacatgaaaaaccttctgcatcatattctcagcggaaaggaattcggagtggaacgttccgtgcggccgatccattcatccacgtccagcccgacgatttcaatacatgaggtcggacatactggggtgacgaaaactgagaggtcaggaatcaaccgcctcaggtcagagatgaagcagatgacgcgcaggttttcagcagacgaacagttctttagtgtcggacaagcagctagcagcagcgctcacagctcaaaatccgcacggtcgagcactccatcatcgcctactggaactagctcgtccgacagcggaggtcatcatatcggatggggcgagagacaaggacaatggctgcgacgacgccgattggacggtgccatcaaccgcgtcccggtcggattttaccagcgcgtgtggaagatccttcaaaaatgtcatgggctttccattgatggttacgtcctcccatcgagcaccacccgggagatgacccctcacgagattaagtttgcggtgcatgtcgaaagcgtgctgaacagggtcccacaacctgaatataggcaacttctggtggaagcaatcatggtgctgaccttgctgagcgacacggaaatgaccagcattggtggcataattcacgtcgatcagattgtgcagatggcctcgcaactgttcctccaagatcaagtgagcattggagcaatggataccctcgaaaaagaccaggccactggcatctgtcatttcttttacgattcggctcctagcggtgcgtacggcaccatgacttatcttactcgcgcagtggcatcgtacctccaagaactccttcctaatagcggctgtcaaatgcag

SEQ ID NO: 18056 - DNA, 3705 bp, Artificial Sequence
  Description of Artificial Sequence: Synthetic coding sequence
atgaggtctcgctctaacagcggcgtgcggctggacggttacgctcgtctcgtgcagcaaacaattctgtgttatcagaaccctgttactggcctgctgtcggctagccatgagcagaaggacgcatgggtccgcgacaacatttactccattctggccgtgtggggactggggatggcctatcgtaagaatgcagatcgggacgaggataaggctaaggcttacgagttggaacaaaacgtggtgaagctgatgagaggtctactacagtgcatgatgagacaggtagctaaggtggaaaagttcaaacatacccagtctaccaaggacagtctgcatgccaaatacaatacagctacgtgcgggaccgtggtcggcgatgaccagtggggacatcttcaagttgacgccacatccctcttcctgctcttcctcgcacagatgaccgcatcaggcctgagaatcatatttacccttgacgaagtggcctttattcagaatctggtcttctatatcgaggctgcctacaaagtagcagactatggaatgtgggagcgcggcgacaaaacaaaccagggcatccctgagttaaatgctagcagcgtaggcatggcaaaggctgctctggaggcaattgacgagttagacctctttggtgcccatgggggccggaaatctgtgatccacgtgttacctgatgaggtagaacactgccaatccattctgttttctatgctgccccgggccagcacctctaaggagatcgacgcaggactgttaagcatcatctcattccccgctttcgcagtagaggatgtaaatctcgtcaacgttaccaagaatgaaatcataagtaagctgcaaggccgctacggatgctgtcggtttctgcgggacggatacaagacgcccagggaggaccctaacaggctgcattatgaccctgccgaactgaaactgtttgagaatatcgagtgcgagtggccagtgttctggacttattttatcatcgacggagtcttctccggcgacgcggttcaagtgcaggaataccgggaggcccttgagggcattttgattaggggaaaaaacggcatccgcctcgtccccgaactgtacgccgtgccgccgaataaggtggatgaggagtacaagaatccccacaccgttgatcgagtcccgatgggtaaggtgccacacctgtggggccagagtctctacatcttgtcttccttacttgcagagggttttcttgccgccggtgagatcgatcctctgaacaggcgcttctcaacttccgttaagcccgacgtagtcgtgcaagtcacagttctggcggagaataaccacataaaagatcttcttaggaagcacggcgtgaacgtgcagagtatcgctgatatccatcccatccaagtgcagcccggcagaatcctgagtcacatctatgccaaattgggtcggaacaagaacatgaacctctctggacggccctacaggcatataggcgtactgggtactagcaagctgtatgtgattagaaaccagatctttacatttacccctcagtttacagatcagcaccatttttacttggcactcgacaacgagatgatcgttgagatgctcagaattgagctggcttacctctgtacttgctggcgcatgaccggccgtcccacactaacctttcccataagtaggactatgctgactaatgacgggtccgacatccacagcgcagttctgtccacaattagaaagctggaggatgggtactttgggggcgcacgcgtaaagctggggaatctgtctgagttcctgactacttcattctatacatatctgacttttctagacccagactgtgatgagaaactatttgacaatgcaagcgaggggacctttagccccgactcagattcagatctagtgggatacctggaggacacttgcaaccaggagtcacaggatgaactcgaccattatataaatcacttgctccagtctacgtcgcttcgaagttacctcccccccctttgcaaaaatacagaagataggcacgttttttcagcaatccattccaccagggacattttatccgtcatggccaaagcaaagggcctcgaagttccttttgtaccaatgactctgcccactaaggtgctttccgcccataggaagtccctgaacctggtagatagtccacaacctctcttggagaaagtcccggagtctgatttccaatggccgcgcgatgatcatggggacgtcgactgcgagaaattggtggaacagctcaaagattgtagcaatctgcaggaccaggccgacatcctttacattctctacgtaattaaggggcctagctgggatacaaatctctcgggacagcacggggtgacagtccagaatctgttaggggagctgtacggtaaggctggactcaatcaggagtggggactgatacggtacatttctgggctactgcggaaaaaagtggaggttcttgcagaagcttgcaccgatcttttgtctcaccagaaacaactgaccgtgggcctgccacctgaaccaagagagaaaatcatctctgcgccactgccaccggaggaactgaccaaactcatctacgaggccagtggacaggacatctcaattgcagtactcacacaggaaatcgttgtctatctggctatgtacgtcagagctcagccatccctcttcgtggaaatgctaaggctccgaatcggactgattatccaggtgatggcgaccgagctcgccagaagcctgaattgctccggagaagaggcttctgaaagccttatgaatctcagtccattcgacatgaagaatctattgcaccatattctgtctggcaaagaatttggtgtcgaaaggagcgttagacctatccactcttcgacatcctctcccacaataagtattcacgaggtgggacataccggggtaaccaagacagagagatccggcattaaccggctccgaagcgagatgaagcagatgactcgacgattttctgcagacgagcaatttttttcggtggggcaggcggccagcagctccgcacattcaagcaaatccgcgcgtagcagcaccccctctagtcccactggaacctcctcgtcagactctggtgggcatcatatcgggtggggagaacggcaaggacagtggctgaggcgacgccgcctcgacggagctattaatcgggtgccggtgggattttaccagcgcgtctggaagatactgcagaagtgccatggactttccattgatgggtatgtgctcccctcatctaccacgcgcgagatgactcctcacgagatcaagttcgcagttcacgtggaatcagttctgaaccgcgtccctcaacccgagtatcgccagttactcgttgaagcgattatggttttgaccctgctctccgacaccgagatgactagtattggaggcattatacatgttgaccagatcgttcaaatggcttcccaactattcttgcaggatcaggttagcatcggagctatggacacgcttgagaaggaccaagcgacaggcatttgccatttcttctacgattcagccccatccggtgcttacggtacaatgacgtaccttacccgcgccgtcgcatcttacctccaggaactccttcccaattcaggatgtcagatgcag

SEQ ID NO: 18057 - DNA, 3705 bp, Artificial Sequence
  Description of Artificial Sequence: Synthetic coding sequence
atgagatcgcggtccaattcaggcgtgagactggatggctacgcaagacttgtccagcagaccattctctgctaccaaaacccggtgactggcctgctgagcgcatcgcacgagcagaaggatgcgtgggtgcgggacaatatctactctatcctcgctgtctgggggttgggcatggcctaccggaagaacgcggacagggatgaggacaaggccaaggcctacgagctcgagcagaatgtggtcaagctgatgcgcgggctgctccagtgcatgatgagacaagtcgcgaaggtcgaaaagtttaagcacacccaatcaaccaaggatagcttgcatgcgaagtacaatactgcgacctgtggaaccgtggtgggcgacgatcagtggggacatctccaggtggatgccactagcctgttcctcctgttcttggcccagatgaccgcgtcgggtctgcggatcattttcactctggatgaagtggcattcatacagaatctggtgttctacatcgaagcggcctataaggtcgccgattacggcatgtgggaacgcggagacaagaccaaccaggggattcctgaactgaacgcgagctccgtgggaatggcgaaggccgcactggaggccatcgatgaactcgacttgtttggagcccacggcgggcggaagtctgtgatccacgtcctgccggacgaagtggaacactgtcagagcatcctgttcagtatgctcccacgcgcatcaacctccaaggaaatcgatgcaggcttgttgagcatcatctcatttcctgccttcgcggtggaagatgtcaatttggtgaatgtcaccaaaaatgagatcatttcaaagttgcagggccgatacgggtgctgccgcttcctgcgcgatggatacaagaccccacgcgaagatccgaatcggctgcactacgatccagccgagctgaaacttttcgagaatatcgaatgtgaatggccggtgttttggacgtatttcatcatcgatggagtgttcagcggggacgccgtgcaggtgcaggagtatcgggaggcccttgaaggcattctgatcagagggaaaaatggcatcagactggttccggaactgtacgccgtcccgccgaataaagtggacgaggagtacaaaaatccacatactgtggatcgcgtgccgatggggaaggtgccgcacctgtggggccagagcctctacatcctgtcctccctgcttgcggaaggatttctggcagccggagaaattgaccctctcaatcgccgcttttcaacgtccgtcaagccagatgttgtggtccaggtgactgtgctggctgagaacaaccatatcaaggacctcctcagaaagcatggcgtgaatgtgcagtccattgctgatatccaccctattcaggtgcagcctggaaggattttgtcacatatctacgctaagttgggcagaaacaagaacatgaacctgagtggacgcccgtaccggcacattggcgtgctgggcacctcaaagctctacgtgatccgcaatcaaatcttcactttcactccccaattcactgaccagcaccacttctacctcgcactggacaacgaaatgatcgtggaaatgcttcgcatcgagctggcatacctgtgtacctgctggcggatgaccggcaggcccaccctgaccttcccaatctccaggaccatgctcactaacgacggttcggacatccactcggcagtgctttccaccatccggaaacttgaagatggatacttcggtggagcacgggtgaaactcggaaacctctccgaatttctgactacttccttttacacttacctcactttcctggacccggattgcgacgagaaactctttgacaatgcgagtgaaggtacgttcagccctgatagcgattcggatttggtcgggtaccttgaggacacctgcaaccaggagtcgcaagacgagctggaccactacatcaatcatcttctccagtccacgtcactgcgctcatacctcccaccgctgtgcaaaaacactgaggaccggcatgtgttctccgcaattcactcgaccagagacattctgtcggtgatggcaaaagccaaaggactggaagtgccgttcgtccccatgacccttccgaccaaggtcctgtcggctcaccgtaagtcgctgaacttggtggattccccgcagccactcctggagaaggtgccagagtccgactttcaatggccacgagacgatcacggcgatgtggactgcgaaaagctcgtggagcaactcaaggactgttcaaacctccaagaccaggcggatatcctgtacattctgtacgtgatcaagggcccatcgtgggacactaatctctccggacagcatggtgtgacggtgcaaaatctgctgggggaactgtacggtaaggcaggattgaaccaagagtggggcctcatcagatacatctcgggcctgctccgtaagaaggtcgaggtgctggccgaagcatgtactgatctgctctcgcatcagaagcaactgaccgttggactgcctccagaaccgcgggaaaagatcatctcagccccgcttccaccggaggaacttaccaaacttatctacgaagcatccggccaggatatcagcatcgccgttctcactcaggagatcgtggtctacctcgctatgtacgtgagggctcaaccgtccctgtttgtggaaatgctgcgcctgcggattggactgatcatccaggtgatggcaaccgagctggctcggtcattgaactgtagcggtgaagaagcctccgagtccctgatgaatctgagcccattcgacatgaagaacctgctgcatcacatcctgtcaggaaaggaattcggagtggaacggtctgtcagaccgatccatagcagcacttcgtcacctaccatctcgatccacgaggtcggccacaccggcgtgactaagactgaacgctccggaatcaacagacttagatcggaaatgaagcagatgactaggcgattctcagcagacgaacagtttttctccgtgggacaggccgcttcaagctccgcgcactccagcaagtcggccagatcctcaactcctagctcccctaccggcacctctagcagcgactcgggcggtcatcacatcggatggggagagcggcaaggacagtggctccggagacggagactcgatggagccataaaccgggtccccgtgggcttttaccaacgggtgtggaagatcctgcagaagtgccacggactgtcaattgatggctacgttctcccaagctcgaccacccgagaaatgaccccacacgagattaagttcgccgtgcatgtggaatccgtcttgaaccgagtgcctcagccggagtaccggcaactcctggtcgaagcgattatggtgctcactcttctgtcggacactgagatgactagcatcggaggaatcatccacgtggaccagatcgtgcagatggcgtcccagctgtttctgcaggaccaagtgagcatcggagcgatggatactttggaaaaggaccaggccactggcatctgccacttcttctatgacagcgccccatctggggcctacggaaccatgacctacctcactagggcagtggccagctacctgcaggaactgcttccgaactcaggatgtcaaatgcag

SEQ ID NO: 18058 - DNA, 3705 bp, Artificial Sequence
  Description of Artificial Sequence: Synthetic coding sequence
atgagaagcaggtctaattcaggcgtgaggcttgatggctatgcaagactggtccagcaaactattctttgctaccagaatcctgttacgggtctgctgtccgcctctcacgagcagaaagatgcctgggtgcgcgataacatatactccatcctggccgtttggggcttgggtatggcgtacaggaagaacgctgacagggatgaagacaaggcaaaagcatatgagctggaacagaatgtcgtaaagctcatgaggggactgctgcagtgtatgatgcgccaagttgcgaaggttgagaagttcaaacacactcaatctaccaaagacagcctgcacgccaagtacaacactgccacctgcggcacagtcgtgggagacgaccagtggggccacttgcaggtggacgccacatccttgttcctgctgtttctggcccaaatgaccgctagtggactgagaatcatcttcaccctggatgaagtggccttcatccagaacttggtgttctacatagaagccgcgtacaaagtggccgactatggcatgtgggagagaggcgataaaacaaaccagggcatccctgaactcaatgcctcatcagtcggaatggcgaaggcagcccttgaagctatcgacgaactcgacttgtttggtgctcatggaggcagaaagtctgtcatccacgtactgccagacgaggtggagcattgccagtctatcttgttcagcatgctcccaagagcctccacaagcaaagagattgacgcgggcttgctgagtatcataagttttccagcatttgcagtagaggacgtcaatttggtaaacgtcaccaaaaacgaaattatctccaagcttcagggccgctatggatgttgtaggtttctcagggacggttacaagacccccagggaggatcccaaccgcctgcattacgaccccgccgagctcaaactgttcgagaatattgagtgtgagtggcctgtattttggacttactttatcatcgatggtgtgttcagcggcgacgctgtacaagtgcaggaatatagggaggctctggaaggaatcctcattcgcggtaagaatggtattcgcctggtgccggagctttatgccgtcccgcccaataaggtggatgaggagtacaaaaacccccacaccgtcgatagggtcccaatgggcaaggttccccacttgtggggtcaaagcttgtatatcttgtccagccttctggccgaaggattcctggctgcgggcgagatcgatccgcttaataggcgcttcagtacctccgtgaagccagacgtggtagtgcaagttaccgtattggctgaaaacaatcatatcaaagacttgcttcgcaagcatggagtcaacgtccaaagcattgccgacatccaccccattcaagtgcagcccggtagaatcctgtcccacatttacgccaagcttggacgcaataaaaacatgaacctgagcggccgcccgtatcgccacatcggcgtgctgggcacgagtaaactgtacgttatccgcaaccaaattttcactttcaccccgcaattcacggatcagcaccacttctatctcgccctcgataacgagatgatagtcgagatgcttaggatcgaattggcttatctttgcacctgttggaggatgactggccgccccacattgacgttcccgatctcaagaaccatgctcaccaacgatggatccgatattcactcagcagtactttctaccatcaggaagctcgaggacggctatttcggtggagcccgcgtcaagctgggaaatctgtccgaatttctgactactagcttttacacctacctgacattcctggacccagactgcgacgagaaattgttcgataatgcctcagaaggaaccttctcccctgactctgattctgacctcgtcggttacctggaggacacgtgtaatcaggagtctcaagatgagctcgatcactacattaaccatctgcttcaatctacctccctgagatcttacctcccgcccttgtgcaagaacacagaagatcgccacgttttctccgcgatccactctacaagagacatcctttccgtgatggccaaggccaagggactggaggttcctttcgtgcctatgaccctgcccacaaaggtgctgtctgcacacagaaagagcctgaacctcgtcgattctccccagccccttctggagaaggttcccgagtcagattttcagtggcctcgcgacgaccatggcgacgtggattgcgagaagcttgttgaacagcttaaagactgttcaaacctccaggaccaagccgatatcctgtacatcttgtatgtcatcaaaggcccttcttgggacaccaacctgtctggtcagcacggcgttactgtgcagaacctcctgggtgaactgtacggtaaagccggcttgaaccaagagtggggcctgattcgctatatctccggtttgctgaggaaaaaagtggaagttctggccgaggcctgtactgacttgttgtcccaccaaaagcagctgacagtgggcctcccacccgagcccagggaaaaaattatctctgcacctctgccgcccgaggaactcactaagctcatttacgaggcatctggtcaagacatctcaatagcggtcctcactcaggagatcgtggtctacttggcgatgtacgtaagagcgcagccatcactgttcgttgagatgttgagactcaggataggactcatcatccaggtgatggccacagaacttgcgaggtcactgaactgttctggagaggaagcctccgaatctctcatgaatctgtccccatttgatatgaagaacttgctccatcacatcctgtcaggaaaagagtttggcgtcgaaaggtcagtgagacccatccacagctcaacaagctctcctactattagcattcacgaagtcggacacaccggagtgacaaaaacagagaggtccggaatcaaccgcttgcgcagcgagatgaaacaaatgacaaggcgctttagcgcagatgaacagttcttcagcgtgggtcaagctgcgagttcaagcgcgcactctagtaagtcagctagatcttcaacaccttcctccccaacaggaaccagttctagtgattccggtggccatcatatcggctggggcgaaaggcagggacagtggcttaggagacgcaggctggacggagccatcaacagagtgccagtaggcttctaccagcgcgtctggaagatcctgcagaagtgccatggtctctccattgacggatacgtactcccttcttccactacacgcgagatgactcctcatgagatcaagtttgccgtgcacgtggaaagcgtgcttaacagggtgccacaacctgagtaccgccagttgctggttgaggcgatcatggtcctgacactgctctctgataccgaaatgacctctattggaggtattatacacgtcgaccagatagtgcagatggcgtcccagcttttcctgcaagaccaagtctccatcggcgctatggatacgctcgagaaagatcaggccacgggcatctgtcattttttctatgactctgcgccttcaggtgcatatggtacaatgacctacctgacaagggcggtagcctcctacctccaagaattgctccccaactcaggctgccagatgcag

SEQ ID NO: 18059 - DNA, 3705 bp, Artificial Sequence
  Description of Artificial Sequence: Synthetic coding sequence
atgcgttcacggagcaattcaggtgtgcggctggacggttacgcccgactggtccagcagaccattctttgttaccagaatcccgttacgggtctgctaagcgctagtcatgaacagaaagatgcttgggttcgcgacaacatttacagcatcctggctgtgtggggtctgggaatggcctatcgcaagaatgccgaccgcgacgaagacaaagccaaagcgtacgaactcgagcagaacgtggtcaagctgatgcgcggtctgctgcaatgtatgatgcggcaggtggcaaaagtcgaaaaattcaagcacacacagagcaccaaggactcactgcatgcgaagtacaacactgcgacctgcggtaccgtggtgggtgacgaccagtgggggcacctgcaggttgatgcgacgagcctgtttctgctgtttctggctcagatgactgcaagcggcctgcgcattatttttaccctggatgaagttgcattcattcaaaatctagtgttctatatagaggccgcttataaagttgcggactatgggatgtgggagagaggtgacaagaccaatcaaggtattccagagttaaatgcgtccagcgtgggcatggccaaggccgccctggaagcgattgatgaactagatctgtttggagcgcacggcggacgcaaaagcgtgatacacgttctgcctgacgaggttgaacactgtcaaagcattctcttcagcatgctgcctcgcgcatcgacctcgaaggagatcgacgcgggactgctgagcatcattagctttccggcgttcgcagttgaggacgtgaacctggtgaatgtgacgaaaaatgagatcatcagtaaactgcaagggagatacgggtgttgtcgttttttgcgcgatggttacaagacacctcgcgaggacccaaatcgactgcactacgacccggctgagctgaagctgttcgaaaacattgagtgcgaatggccggtattctggacctattttatcattgatggcgttttttctggggacgccgttcaggtgcaggaatatcgcgaggctcttgaaggtatactgatccgtggtaagaatgggattcgtttggtgcctgaactgtacgctgtgccgccgaacaaggtggatgaggagtataaaaatcctcacacggttgatcgggttcctatgggtaaggtgccgcacctgtgggggcagagcctttacattctgtccagcttgctcgccgaaggttttctggccgcaggggagattgatcctctgaaccgccgcttttcaaccagcgtgaaaccggacgtggtcgttcaagtgacagttttggcggagaacaatcacatcaaggatttgctccgtaaacacggggttaatgttcagagcatcgcggatattcacccaatccaggtgcagcctggccgtattctgtcacacatttacgccaaactggggcgcaacaagaatatgaatcttagcggtcggccataccggcatatcggcgtcctgggaacctctaaactctatgttatccgaaaccagatttttacgtttactcctcagttcaccgatcagcaccacttttacttagccctggacaacgagatgatcgttgagatgctgcgcattgagcttgcctacctgtgcacttgctggcgcatgacgggacgccctaccctgacgtttccgatcagtcgcactatgctgaccaacgatggctccgacatccactcagcagtgctgtccacaattcgtaaactggaggatggttactttggaggtgcacgagttaaattggggaatctgtcagagttcctgactacctctttttatacctacttgacctttctggatccagactgcgatgagaagctgttcgacaacgctagcgagggtactttttcccctgattccgatagcgacctggttggctatctggaagatacttgcaaccaggagtcgcaggatgaactggatcattacatcaaccatctcttgcagagcacctcactgcgatcttatctgcctccactgtgtaaaaatactgaggatagacacgtcttcagcgcaatccatagcacccgtgacattctgagcgttatggccaaagcaaaagggctggaggtcccttttgtgccaatgacactgccgaccaaggttctgtctgcgcaccgcaagtctctgaacctggtggacagcccacagccactattggagaaggttccggaaagcgattttcaatggcctcgcgacgaccacggcgatgttgactgcgagaagcttgtggagcagctaaaggactgtagcaatctgcaggaccaggccgacatactctacatcctatacgttattaagggcccatcttgggacaccaatctgagcggtcaacatggagtaactgtccagaatctcctgggcgagctgtatggtaaggcgggcctgaatcaggagtggggtttaattaggtacataagcggcctgttgcgcaaaaaagtggaggttctggcagaggcctgtaccgacctgctgtcccatcaaaagcaattgaccgtgggtctgccacctgaaccgcgcgaaaagattatttctgccccactgcctccagaggagctgaccaagttgatctacgaagcttcgggccaggacatctccatcgcagtgctgacgcaggagatcgtggtttacctggctatgtacgtacgcgcgcagccaagcctgtttgttgagatgttaaggctgcgcattggtctgatcatacaggtgatggccacggagctggccagaagcttgaactgcagcggtgaagaagccagtgagtctctgatgaatctgagccctttcgatatgaagaatctgctgcaccacattctcagcggaaaggagttcggcgtcgagcgttctgtgagaccaatccacagctctacctccagcccgactatcagcatccatgaggtgggtcacaccggtgtcacaaaaacggaacgcagcggtatcaaccgcctgcgcagcgagatgaagcagatgacacgtcgttttagcgcagatgagcagttcttttctgttggccaggcggccagttcctctgcgcacagctctaaaagcgcacgaagctccacgccatcatctccgacgggaaccagctcctcggattccggaggtcatcatatcggctggggtgaacggcaaggtcaatggttacgacgtagacgactggacggtgcaattaaccgcgtgccggtcggtttttatcagcgcgtttggaagattctgcaaaaatgccacggtctgagcatcgatggctacgtgctgccaagcagcacgactcgcgaaatgacccctcatgagattaagtttgcggtgcatgtcgagagcgtgctgaatagagtcccgcagccggagtaccggcaattgctggtcgaggcaatcatggtgctgaccctgctgagcgacactgaaatgactagcatcggtgggattatacacgttgaccagattgtgcaaatggcaagccagttgttcctgcaggaccaggttagcatcggtgccatggatacccttgaaaaagatcaggccacaggcatttgccacttcttctatgactcagctcctagtggagcttatggcaccatgacctatctgacccgcgccgtagcatcataccttcaagagcttctgccaaactctggttgccagatgcaa

SEQ ID NO: 18060 - DNA, 3705 bp, Artificial Sequence
  Description of Artificial Sequence: Synthetic coding sequence
atgcgctcccgctctaacagcggcgtcaggttggatggatacgcaagactcgtgcaacaaactatcctttgctaccaaaatcctgtcaccggacttctgtcggcatcacacgaacagaaggacgcctgggtgagagacaatatctactcgatccttgcagtctggggcctcgggatggcctaccgcaagaatgcagacagagatgaagataaggcaaaagcgtacgagctggagcagaacgtggtgaaactcatgaggggccttctccagtgtatgatgcgtcaggtggctaaagtggagaagtttaagcacactcagtccaccaaggactccctgcatgccaaatacaataccgcaacttgtggaactgtggtgggggatgatcaatggggacatctccaggtggatgcaaccagcctttttcttctgtttctggcgcagatgaccgcatcgggtctgagaatcatattcactctcgatgaggtcgcattcattcaaaacctggtgttttacatcgaagcagcgtacaaagtcgccgattacggcatgtgggaacgcggtgataagaccaatcagggtattcccgaacttaacgcgtcctccgtcggaatggccaaagcggcactcgaagccatcgacgaactggacctgtttggagcacatggaggccgcaagtccgtgatccatgtgcttcctgatgaagtggaacattgtcagagcattctgttttcgatgcttccgagagcatccactagcaaggaaatcgatgcgggtttgctgtctataatctcgtttcctgcttttgcagtcgaagatgtgaacctggtgaacgtcactaagaacgagatcatttccaagttgcagggtagatacggctgctgtagatttctcagagatggatacaagacccctagagaagatcccaaccggctgcattacgacccggctgaattgaagctgttcgaaaacatagaatgtgaatggcctgtgttctggacttactttatcatcgatggagtgttttccggagacgcggtccaggtgcaagagtatagagaggccctcgagggaattctcattcggggaaagaacggaattagactggtgcccgaactctacgccgtccctccaaacaaggtggatgaagagtacaagaatcctcatactgtggaccgagtcccaatgggaaaggtgcctcatctctggggccagagtctctacatcctgagcagcctgctggcagaaggctttctggcagcaggtgaaattgacccactgaataggcggttttccacgtctgtgaagccagatgtggtggtgcaagtgacggtccttgccgagaataatcatatcaaggacctgctgcggaaacacggagtgaacgttcagtcaattgcagatatccacccaatccaggtccagccgggcagaatcttgagccatatctatgccaagctggggaggaataagaacatgaatctgagcggacgtccgtaccggcatatcggcgtccttggaacctcgaaactgtacgtcatccggaaccagatctttacgtttaccccacaatttactgatcagcatcatttctacctggcactggataacgaaatgatagtggaaatgttgaggattgaattggcatacctgtgcacttgttggaggatgaccggcaggccgaccctcacctttcctatttcgagaaccatgcttaccaacgacggctcagatattcattccgcagtgctctcaaccataagaaagctggaggacggttactttggcggcgcccgtgtcaagctgggaaacctgtccgaattccttaccaccagcttttacacctaccttacctttctcgatccagattgcgatgaaaaactttttgataacgcctcggaaggcacctttagccccgattcggattcggatcttgtcgggtacctggaagatacttgtaatcaggaatcacaagacgagctggatcattacattaaccatcttctgcaatccacctcattgcggagctaccttccacctctgtgtaagaacaccgaggatcggcacgtgttttccgcaatccatagcactagagacattctttccgtcatggctaaggcaaagggacttgaggtgccattcgtccctatgaccctgcctacgaaggtgctcagcgcacatcggaagtcactgaatctggtcgattcaccacaaccactcctggaaaaggtgcccgaatccgattttcagtggccacgtgatgaccatggggacgtggattgcgagaagctcgtggagcaactcaaggactgttcgaaccttcaggaccaggcagacatcctttacattctttacgtgattaagggaccttcctgggacactaacctgtcaggtcaacacggagttacggtccagaatcttcttggggaattgtatggaaaagcaggtcttaaccaggaatggggattgattcggtacatcagcgggctgcttcgcaaaaaggttgaggttcttgccgaggcctgcaccgaccttctctcccaccaaaagcaactgactgtcggactgccgcccgaaccgcgagaaaagattatctcagccccactgcccccggaggaacttaccaaactgatttacgaagcgtcgggtcaagatatttctattgccgtgctgactcaagagatcgtggtgtacctggccatgtacgtcagggcacagccttcgctcttcgtagagatgctgcgactgcgaatcggactcataattcaggtgatggccaccgaactcgcccgttcactcaattgctcgggagaagaagcatcggagtcgcttatgaacctctcgccattcgacatgaagaacctcctgcatcatatccttagcggcaaggagtttggagttgaacgctccgtccgccctattcattccagcacgagttctcccactatctccatccatgaagtcggacacaccggtgtcactaaaaccgaacgatcaggtatcaatcgactcagatccgaaatgaagcagatgaccaggcgttttagcgcggacgaacaattcttttccgttgggcaagccgcatcgtcctctgcacattcgtccaaatcggcccggtcgtcaaccccttcgtcgcctactggcacctccagctcggactcgggaggtcatcatatcggatggggtgaacggcaaggccagtggcttcgcagaaggcgcctcgacggagccattaatcgggtccccgtgggtttttaccaacgggtgtggaagatcctccaaaaatgccacggtctgtccattgacggatatgtgctgccatcctccaccacccgagaaatgacccctcacgaaatcaaatttgcagtccacgtcgaaagcgtcctcaacagagtccctcagcctgaatacagacaactgcttgtggaagcaattatggtgcttactcttctctcagacaccgaaatgacttcaattggtggtatcattcatgtcgaccaaattgtgcagatggcaagccagctttttctgcaggatcaggtcagcattggagccatggatacgttggagaaggaccaggcaaccggaatatgccatttcttctatgattcggcaccttcgggagcctacggaactatgacgtacctgaccagggccgtggcatcgtaccttcaagaactcctcccaaactcgggttgccagatgcaa

SEQ ID NO: 18061 - DNA, 3705 bp, Artificial Sequence
  Description of Artificial Sequence: Synthetic coding sequence
atgagatctagatccaacagcggagttcggctagatggatacgcgagactggtccagcagaccatactgtgctaccagaatccagttaccggactgctgtcagcttcccacgagcagaaggatgcttgggtgcgcgacaatatctactccatcctggccgtctgggggctgggaatggcctatcgcaaaaatgccgacagagacgaggataaagccaaggcctatgaactggaacagaacgttgtcaaactcatgagggggctactccaatgtatgatgcgccaagtggccaaagttgaaaaatttaaacatacccagagtacgaaggattccctgcacgctaaatacaatacggccacatgtggaaccgtggtaggggacgaccagtggggacacctgcaggtggacgccacgtcacttttcctgctttttctggctcagatgactgcgtcaggtctcaggatcatcttcaccctcgacgaggtggcctttatccagaacttggtgttctatattgaggccgcgtacaaggtggccgattacggtatgtgggagcggggcgacaaaacaaaccaaggtatccctgaactaaacgcctcttctgtggggatggctaaggcagctctggaagctatcgatgagctggacctatttggcgcacacgggggacggaagagtgtgatccatgtgttaccagatgaagtcgagcactgtcagtctatcctgttttcgatgctacccagagcatcaacttctaaagagattgatgcgggcctgctgtccataatcagttttccggccttcgcagttgaagacgttaatctcgttaacgtcactaaaaatgagattatctccaaacttcagggtaggtatggttgttgtagattcctgcgtgacggctacaagaccccacgagaggaccctaacaggctgcactacgaccccgcagagctcaaattatttgagaatatcgaatgcgagtggcccgtcttttggacatacttcatcatcgacggggtattcagcggagacgcagtacaagtgcaggagtacagggaagctttggaggggattctaatcagggggaagaacggaatacggctggtgcccgaactgtacgctgtgcctcccaacaaagttgatgaagagtataagaacccccacactgtggatcgagttcctatggggaaggtgccccatctgtggggccagagcctttacatactctccagcctgcttgctgagggatttctggccgccggcgaaatcgatccactgaatagacgattctccacctcagttaagcctgacgtcgtggtgcaagttaccgtactggccgaaaacaaccatatcaaagatctcttgagaaagcacggcgttaatgtgcagtctattgcggacattcatcctatacaggtgcagcccggtagaatcctgagccatatctacgctaaactgggacggaacaagaacatgaatctatcgggacgaccctatagacatattggtgtcctcggaacttcaaaattgtatgttattcgcaaccagatatttacgtttacacctcaattcactgatcagcaccacttttacctggccctcgataatgaaatgatcgtggagatgctacggattgaactggcctacctatgtacatgctggaggatgacagggagacccactctgactttccctatctcccggaccatgctgactaacgacggctcagacattcactctgccgtcctgtcaaccattcgaaagctggaagatggatactttggtggcgctagagtaaaattaggaaacctttcagagttcttgacgacttcattttacacctacttaacattcctggaccctgattgcgacgaaaagctcttcgataacgcctctgaggggaccttctcccccgattctgactccgatctggtaggctaccttgaagatacttgtaatcaggaatcacaggacgaactggaccactacattaatcaccttctgcagtcgacttctctccgctcctaccttccacctctatgcaagaatacagaggaccgccatgtgttttccgcgatccactcgacacgagacatcctgagcgtgatggctaaggcgaagggtctggaagtcccttttgtaccaatgaccctgcccacaaaagtgttatctgcacacaggaagtccctcaatctggtggacagtccccagcccttactggaaaaggtgcccgaatcggatttccagtggcctcgcgacgatcacggggacgtggactgcgagaagcttgtggaacagctcaaggattgctccaacctccaggatcaggccgacatcctttacattctctatgtgatcaagggcccgtcatgggacaccaacctgtctgggcagcatggtgtgaccgtgcaaaaccttttaggggagctctatggcaaggcaggcctcaaccaagagtggggtcttattcgttacatatcgggtctcttaagaaagaaggtggaggtgctggctgaggcctgtactgacctcctctcacaccagaagcagctcaccgtaggtctcccgcccgagccgcgagagaaaattatctcggccccgcttccgcccgaagaattaacgaagcttatatatgaagcgtcagggcaggacatatccatagccgtcttaacacaggagattgtagtgtaccttgccatgtatgtgcgcgcccaaccctccctgtttgtagagatgctgcgattgcgcataggacttattatccaagtcatggctaccgaactagcccgatcgctcaattgtagtggcgaggaggcaagcgagtcacttatgaatcttagtccctttgacatgaaaaacctgcttcaccatatcctaagcggcaaggaatttggagtggaacggtccgtgagacctatccatagcagtacttcctccccaactatctccatacacgaggtgggacatacaggagttacaaagaccgaacggagcggaattaaccggcttaggagcgagatgaaacagatgacacgaagatttagcgccgatgagcagttctttagcgttggccaggctgcctcttccagtgcccattcctctaagtcagctcgtagcagcacgcccagctcgcctactggaacttcatcctctgactctggaggacatcatattgggtggggtgaaaggcagggccagtggctgcggcggaggcggttggatggggcgattaaccgcgtacccgtgggcttttatcagcgggtctggaaaatccttcagaagtgccacggtctctcaatcgacggatacgttctaccttcctcgacgaccagagaaatgacgcctcacgaaattaagttcgcagttcacgtcgagagcgttctcaaccgggtgccccagcccgaatacaggcagctgctcgtggaagcaataatggttctaacgcttctgtctgacaccgagatgacatccatcggcggaattatccacgtggaccagatcgttcagatggcatcccagctcttcctgcaggaccaagtttctatcggagcaatggacacattggaaaaggaccaggctactgggatctgccacttcttttacgacagcgcaccctcgggtgcatatggcacaatgacctacttaacgcgggctgtcgcttcatacctgcaggagttactgcccaacagcgggtgccagatgcaa

SEQ ID NO: 18062 - DNA, 3705 bp, Artificial Sequence
  Description of Artificial Sequence: Synthetic coding sequence
atgcgatctaggtccaatagtggcgtgcggcttgacggatatgcccggctggtgcagcagacgatcctgtgttaccagaaccccgtcacaggtctactgagcgccagccacgaacagaaagacgcctgggttcgagataatatctactccatacttgccgtgtggggtctgggcatggcctaccggaagaatgccgatcgtgatgaagacaaggccaaagcctacgagctagaacagaatgtggtaaagcttatgagaggactgctccagtgcatgatgcgtcaagtggccaaagtggagaagtttaaacatacacagagcacgaaagattcactgcacgccaagtacaacaccgccacttgcggtacagtagtcggcgatgaccaatggggacacctgcaagtggatgcgacatccttatttttgctctttttagctcagatgactgcctctggactgcggattatctttaccctcgatgaggtggctttcatccagaacctggtattttatatcgaggcggcctacaaggtagctgattacggcatgtgggagagaggggataagactaaccaggggatccccgagctcaacgctagctctgtgggaatggcaaaggctgccttagaagctatcgacgagcttgacttgttcggagcgcacgggggacgcaagtccgtaatccacgtactgccggacgaagtagagcactgtcaaagcatcctgttttctatgcttcctagagcgtccacgtcgaaagagatcgatgctggcctcctttcaataatcagttttcctgcgttcgctgtggaggacgtgaatctggtgaatgtgactaagaacgagatcatctccaagctccaggggaggtatggctgctgtagatttctgcgggatggttacaaaacgccccgggaggatcccaatcgattgcactacgatcctgcggagctgaagctcttcgagaacatcgaatgcgaatggccggtgttttggacttacttcattattgatggagtcttctcaggggacgccgtccaggtacaggagtaccgagaggcactagaggggatcttaattaggggaaaaaacggaatcagattggtcccagaattatatgcagtgccacccaacaaagtggacgaggagtataagaatccacacaccgttgaccgcgttccaatgggtaaagttccacacctgtggggtcagagtctctatatactttcaagcctgctggccgaaggcttcttggccgccggtgaaatcgacccccttaatcgacggttcagcacgagcgtaaaaccagacgtggtcgtgcaagtaacagtcctggccgaaaacaaccatataaaggaccttctcaggaaacatggcgtgaacgttcagtcaatcgccgatatacaccccatccaggttcagcccggccggattctctcgcacatttacgctaagctgggccgcaacaaaaacatgaacctctctggtagaccttatcgtcatatcggcgtgctgggcacttccaagctgtacgttattaggaaccaaattttcacattcacaccacagttcacggaccaacatcacttctatttagcccttgataatgaaatgatcgtagaaatgctgcgaatcgagttagcatacctgtgtacctgttggcggatgaccggtaggccaacattgacattccctatctcacgaacaatgctgaccaatgacgggagtgacatccattctgccgtactctcgactatccggaaactggaggatggctacttcggtggggcacgtgtaaagttgggcaatctctcggagtttctaaccacaagcttttacacttaccttacctttctggaccccgactgcgacgaaaagctgtttgacaacgcctcggagggtacgtttagccctgatagcgacagcgacctcgtcggatatcttgaagacacatgcaatcaggagtcacaggacgaactggaccactatatcaatcacctgttgcagtcgacatcactcagaagctatctgccgcctctgtgtaaaaataccgaagatagacacgttttctcagccattcactctaccagggacatcttgtcagttatggctaaagcgaaagggctagaggtcccgttcgtgcctatgaccctgccaaccaaggtgctctcggcgcataggaaatccctgaatctggtggactcaccccagccgctgctcgagaaggtccctgaaagcgatttccagtggccgagagatgaccatggagacgtggactgtgaaaagttggtcgagcagctaaaggactgtagcaacctccaggaccaggcggatattttgtacattctatacgttatcaaaggaccatcatgggatacaaatctcagcggacaacacggcgtcaccgttcagaatcttctgggagagctgtacggaaaagctggcctgaatcaagagtgggggctaatcagatacatctccggtttgctgcgaaagaaagttgaggtgctggccgaggcatgtacagatttgctcagtcaccagaagcagctgactgtgggcttgccccccgagccacgggagaagattatatccgctcccctaccaccagaggagctgaccaagttgatctacgaggccagtggtcaggatatttcaatcgccgtgttgacccaagagattgtcgtgtatcttgcaatgtatgttcgcgcccaaccttccctgtttgtggagatgctgcgcctccgtatcggactgattattcaggtgatggcaacagagttggcacgaagcctgaattgtagcggtgaagaagcctcagagagtttgatgaatcttagcccattcgatatgaagaatctcttgcatcacattctgtcaggcaaggagtttggggtggagagaagtgtgagaccaatccatagcagtacgagctcaccaacaatttccatacacgaagtcggccacacaggggtcaccaagactgagcgctccggaattaacagactccgtagcgaaatgaaacagatgacaaggaggttctcagccgatgagcagtttttctcagtgggccaggccgcctcctcctctgcccacagcagcaagtctgccaggtcaagcacacctagcagcccaaccggcacatccagctctgacagtggggggcaccatatcgggtggggagaaagacagggacagtggctccggcggagaagactggatggcgctattaatagggttcccgttggtttctaccagcgggtctggaagatcctgcagaaatgtcacggtctttccattgacgggtacgtattgccgtcctcaactactagagagatgacccctcatgagattaagtttgccgtgcacgttgaaagtgttctgaaccgcgtccctcagcctgagtaccggcagctattagtggaggccattatggtgctcaccttgctgtctgacacagagatgacttcaattggcgggataattcatgtcgatcaaatcgttcagatggcctcacagctgttcctgcaagatcaagtctcaatcggtgctatggacaccctggagaaagatcaggccacggggatttgccattttttttacgattctgctccaagtggcgcatatggaacaatgacctacctgacacgcgccgtcgcgtcctacctccaagaattgcttcctaactcggggtgccagatgcaa

SEQ ID NO: 18063 - DNA, 3705 bp, Artificial Sequence
  Description of Artificial Sequence: Synthetic coding sequence
atgcggtcaaggtctaattcaggggttaggctcgatggatatgcaagactcgttcagcagacaattttgtgctaccagaatcccgtgactggattattatctgcttcccacgaacagaaagatgcctgggtgagagataacatatacagtatccttgctgtgtgggggcttggaatggcataccgaaagaatgcagatagagacgaagataaagctaaagcctatgaattggagcagaatgtagttaaactgatgcgggggcttctgcagtgcatgatgagacaggtggccaaggtcgaaaagtttaaacatacacagagtacaaaagattctctacacgctaaatacaatacagctacatgtggaacagttgttggagatgatcagtggggacacctccaggtcgatgctacatcactcttcctcttgttcctagcacagatgacagcctctggattgaggatcatctttacactcgatgaggtcgcattcatccagaacctagtgttttacattgaagcggcctataaagttgccgactatggaatgtgggaaagaggagataagactaaccagggaatccctgaacttaatgcatcctcagtgggaatggccaaggcagcgctcgaagcaatcgatgagcttgacctattcggagcccacgggggaaggaaatcggtcattcacgtgctccctgacgaagttgaacattgccagtctatcctcttctccatgttaccccgtgcttcaacaagtaaggaaattgacgcgggactgctctcaattatatcgtttccagcctttgcagtggaagatgtgaacctggttaacgtcacaaaaaacgaaataatctctaaactacagggacgatatggatgttgtagatttctcagggatgggtataaaactccccgagaggatcccaatagactgcactacgatccggccgaattaaaactcttcgaaaacatagagtgcgaatggcctgtattctggacatactttataatcgatggagtattttccggggatgccgtgcaggtgcaggagtatagagaagccctagaggggatccttattcgaggaaaaaatggaataaggctagtcccagaactctatgccgtcccccctaacaaagtcgatgaggaatataagaacccccacacagtcgatcgggtgcctatggggaaggtgccccacctttggggacagtcattgtacatcctgtcaagtcttctcgccgaagggttcctagctgcaggggaaatagatccactaaaccgccgattttcgacatcggttaaacccgatgtagttgtgcaggtgactgtgctcgccgaaaataaccacataaaagaccttctaagaaagcacggggttaatgttcagtctatcgccgacattcatccgatccaggtccagcccgggaggatcctttcccacatctacgcaaagctaggaaggaataagaacatgaatctctcaggaagaccataccggcacatcggagtccttgggactagtaaattgtatgtcatcaggaaccagatctttactttcacaccccagtttactgatcagcatcatttctatctcgcactggacaatgaaatgatagtcgaaatgttaaggatagaactcgcatacttatgtacttgttggcggatgacagggcggcctactctcacatttcccatatcaaggacaatgctcactaatgatggaagtgatatccactctgctgtgctttctacaatccggaaactcgaagatgggtattttggaggagcccgcgtaaaactcggaaacctgagtgagttcctcactacttctttttatacatatctgacattccttgatcctgattgtgacgaaaaattatttgataacgctagtgaggggacattttctccagattctgattcagatcttgtagggtacctggaggatacatgtaatcaggaatcccaggatgaactggatcattatatcaaccacctccttcagagtacatccttaaggtcttatttacctcccctctgcaaaaacactgaagataggcatgtcttttctgccatccactctacacgggatattctgagtgtgatggccaaagcgaaagggctcgaagtgcccttcgtacctatgactctccctactaaagtgttgtcagctcatcgaaaaagtctcaatctcgtagatagtcctcagccactactcgaaaaagtgccagaatctgattttcagtggccaagggatgaccatggagatgtagactgtgagaaactcgtggaacagttgaaagattgctccaacctacaggatcaagccgatatcctctacatcctgtatgtgataaaagggccatcttgggatacaaatctttctggacagcatggagtgacagtgcagaacctgctcggagaactgtacgggaaagccgggctcaatcaggaatgggggctaatcagatatatctctggacttttacggaaaaaggtggaagtattggctgaagcatgtactgatctcctctctcaccagaaacagctcacagtggggctgcctccagaaccaagagaaaaaatcatctctgctcccctccctcccgaagagcttacaaagttaatatatgaagcaagtggacaggatatctccatagctgtgctaacacaagaaatcgtggtgtacctcgctatgtatgtgagagcacagccctcattgttcgttgaaatgcttcggctaaggataggacttatcattcaagtgatggctacggaacttgcacgcagtctgaattgcagtggggaagaggcttctgagtccctcatgaacctgtccccttttgatatgaagaacttacttcaccacatattgtccggaaaagaatttggagtggaaaggtccgtacggccaatacattcatccacttcttccccaactatctccatacatgaggttgggcatacaggggtaactaaaacagaaagatccgggatcaatcggctcaggtccgagatgaagcagatgacacgaaggttctcagcagacgagcaatttttcagtgtgggacaggccgcctcttcctcagctcacagttcaaagtcagccagatctagtacaccttcatcacctactggaacatcctcctcagatagtggagggcaccacatcggatggggagaaagacaggggcagtggctccgcaggcggcgactagatggggctattaatagagtgccagtgggattttaccaacgggtttggaagatattgcagaaatgccatggattatccattgatggatatgtgttaccctcttctacaactagagaaatgacacctcatgaaattaaattcgcagtgcatgtcgagtctgtgctcaaccgggtacctcagccagaataccggcagcttctggtagaagcaataatggtgctgacacttctttccgatacagagatgacatcaattggggggattatccatgttgatcagatagtacaaatggcctcccagctgttcctgcaagatcaggtgagtatcggggcaatggatacactcgagaaagatcaggctactgggatctgccacttcttttatgatagtgccccatccggagcctatgggactatgacatatttaactagggcggtcgctagttacctgcaggaattgctccctaatagtgggtgccagatgcaa

SEQ ID NO: 18064 - DNA, 3705 bp, Artificial Sequence
  Description of Artificial Sequence: Synthetic coding sequence
atgagatctagaagcaattctggggtccggctcgatggttacgctagactcgtgcagcagaccatcctgtgctatcagaacccggtaaccggcctgttatctgcgtcccatgagcagaaagatgcttgggtccgagataacatctattcaatcctagcggtgtgggggctcggcatggcctacagaaagaatgccgaccgtgacgaagacaaggctaaggcctacgaattggaacagaacgttgtcaagctgatgaggggccttctgcagtgtatgatgcgacaggtcgcgaaagttgagaagttcaaacatacccaatctactaaagattcactacacgccaaatataacaccgcaacctgcggaaccgtcgtaggggatgaccaatgggggcacttgcaggtggacgccacttccctgtttctcctttttctggcccaaatgaccgcctccggactgcggataattttcactctggatgaggtggcatttatccagaatctcgtgttctacatcgaagccgcgtacaaagtggcagattacggtatgtgggagaggggcgacaaaactaatcagggtattccggagctgaatgcatcctcagtgggtatggcaaaggcggccctggaggccattgatgagctggacctattcggagcccatggtggtcgaaagtcagtgattcacgttctacccgatgaggtggagcactgccagtcaattttgttttccatgctgcctcgagcctctacaagtaaagaaattgacgccggactgttgtccatcattagctttccagctttcgcggtggaggacgttaatctggtgaacgtgaccaaaaatgaaatcatatctaaattgcagggcaggtacgggtgctgcagatttcttcgagacggttacaagacccctagggaagacccaaacaggctacattacgaccccgctgaactcaaactgtttgagaacatcgaatgcgagtggccagtcttttggacctactttatcattgatggcgtgttttctggggacgcggtacaagtccaggagtacagggaggcgctggaaggcattctgatccgggggaagaacggaattaggttggtaccagagttgtatgctgtgcctccgaacaaggttgacgaggagtacaagaacccgcacactgtggacagggtccccatggggaaagtgcctcacctgtggggtcagagcctgtacattctctccagtttgctggctgaggggttcctggctgccggggagattgacccgctgaacagaagattctccactagcgtgaagcctgacgtggtggtgcaggtgactgtcttagccgagaacaaccacattaaggaccttctccgaaagcacggggtgaatgtgcagtctattgccgatattcatcctatccaggttcagcccgggagaatcttaagccatatttacgctaaactgggccggaataagaacatgaacctgtcaggcagaccctatagacacattggggtcctggggacatccaaattgtacgtcatcaggaaccagatttttacattcacccctcagttcactgatcagcaccacttttatctggcgctagacaatgaaatgattgtcgagatgctgagaattgaattggcttacttatgtacgtgctggaggatgacgggccggccgactctgacctttcccattagccgcaccatgctgacaaacgatggttcagacatacatagtgccgtcttgagcacaatcagaaagttggaggatggatacttcggcggcgccagggtgaagttgggaaatttgtcggagttcctgactacctccttctacacctacttaaccttccttgaccctgactgcgacgaaaagttgtttgacaatgcttcagaggggaccttctctcccgattcagattctgatctggttggttacctcgaagatacctgcaatcaggagtctcaggacgaacttgatcactacatcaaccatcttctgcagagcacctcactgcgctcttacctccctcccctttgcaagaacaccgaagacaggcatgtgttttcagcgattcacagtactagagatattctaagtgtgatggctaaggcaaagggactagaagttcccttcgtgcctatgactctgccgaccaaggtactgagtgcccatagaaagtccttgaacttggtggatagtccccagcccttgctcgaaaaggtacctgagagcgactttcagtggcctagggatgaccatggcgacgtggattgtgagaagctggtagaacagctcaaggactgttctaatctgcaggaccaggccgacatcctgtacattttatacgtgatcaaaggaccatcatgggataccaacctcagcggccagcatggagtgacagtgcagaatctcctgggggagctgtatgggaaggcaggacttaatcaagaatgggggcttatacggtacatttccggactgctgcggaagaaagtagaggtgctggcagaggcatgtacagacctgttgtctcaccagaaacagttgactgtagggctgcctcctgaaccccgggaaaagatcatatccgctcctctcccaccagaagagttgacgaaattgatttatgaagcttctggccaggatatttctattgccgtgctcactcaggaaattgtcgtttacctggctatgtacgtgcgggcccagccgtcgctgtttgtggagatgctgagactgcggataggactaattatccaagtcatggctaccgagctggctcgttctctgaactgctccggtgaggaggcatcagagagtctcatgaatctcagcccatttgacatgaagaacctcttacaccatatcctgagtgggaaggagttcggggtcgagagatctgtccgccccatccatagcagcactagctcacctaccatcagcatccatgaggtgggtcatacaggggtcaccaagactgaaagatccggcatcaacagacttcgatccgagatgaagcagatgaccagacgatttagtgccgacgagcagttcttttccgtgggccaggccgccagtagtagtgcccacagtagcaagtccgctagatcctctactcctagctcccccactgggacaagctcatctgacagtggcggtcaccatattggctggggggaaagacaaggtcagtggctgcgcagacggcgtttggacggcgcaataaacagggttccagtgggattttaccagagggtgtggaaaattctgcagaagtgtcacgggctgagtatagacggatacgtgctccctagcagcacgacacgcgaaatgacccctcacgaaataaagttcgcagtgcatgtggagagcgtcttgaaccgggtgccacagccggaatacaggcaactgttggtagaagctatcatggtgttaactctgttaagcgatactgaaatgacgtcaataggtggaatcatccacgtggatcagatcgttcagatggcttctcagctgtttctacaggaccaagtgtcaatcggagcgatggacactctagagaaggatcaggctacaggtatatgtcacttcttctatgatagtgctccaagtggggcctatgggactatgacctatctgacgagggcggttgcctcgtatctacaggagcttctgccaaactcgggctgccagatgcag

SEQ ID NO: 18065 - DNA, 3705 bp, Artificial Sequence
  Description of Artificial Sequence: Synthetic coding sequence
atgcgttctcgctccaattcaggggtgcgtcttgacggttacgctagactcgtgcagcagaccatcctctgctaccaaaatccagtaacagggttgttaagtgcctctcacgagcagaaagatgcctgggtcagagataacatatacagcatcctcgcggtttgggggctcggcatggcttacagaaagaacgccgatcgagacgaggataaggctaaggcttacgaactggagcagaacgttgtaaagctgatgaggggccttttgcagtgtatgatgcggcaggtcgccaaggtagagaagttcaagcatacccagtcgacgaaggacagcctccacgcaaaatataatacagcaacctgcggcactgtcgtgggggacgatcagtggggacatttgcaagtcgatgcaacaagtttgtttttattgttcctcgctcagatgaccgcttcaggtttgagaattatctttacattggatgaggtggcattcatccagaacctggtgttctatatcgaggccgcttataaggtggccgattatggaatgtgggaacgcggggacaagacgaatcaaggaatcccagagctcaacgctagctcagtcgggatggcaaaggctgcactcgaagcgatcgatgagctcgacctcttcggcgcccatggcggccgcaagtccgtcatacatgtcctacccgatgaagtggaacattgccaatcaattctgttctctatgctacctagggccagcacatctaaagagattgacgccgggttgctatctattatctctttccctgctttcgcagtggaagatgtgaacctcgttaacgttacaaagaatgaaattatatccaaactgcaaggaagatatggttgttgtaggttccttcgggacggatacaaaacacctcgggaagaccctaatcgtttacactacgatcctgccgagctcaagttgttcgagaacatcgagtgcgaatggcccgttttctggacatatttcattatagacggggtgtttagcggggatgcagttcaggtccaagaatacagggaagcactggaggggatcctaattcggggcaaaaacggaataagactcgtgcctgaactgtacgctgtgccaccgaacaaagtggatgaagaatacaagaatccccatacagtggacagagttcccatgggcaaagtgccccatctgtggggccagagtctttacattctcagttctcttctagccgaagggttcctagccgccggcgaaatcgaccccctcaacaggagattctccacatctgtaaaacctgatgtggtggtgcaggtgaccgtgttagctgaaaataaccatatcaaagacctcctgaggaagcacggcgttaacgtgcagagcattgctgatattcaccctatccaggttcagcccggtcgaatcctgagtcacatttatgcaaaactcggacggaacaaaaatatgaacctctccggccggccatacaggcatatcggcgttttgggcacttctaaactgtacgtgatcaggaaccagatatttacgtttacccctcaatttacagatcagcaccacttttatcttgccctagacaacgagatgattgtggaaatgcttcgcatcgagctggcgtacttatgtacctgttggagaatgactgggcggccaaccctgaccttcccaatcagccggaccatgctcacgaacgacgggtctgatatccactctgccgtcctatcaacaattaggaaactagaggacggctacttcggcggtgcgcgcgtgaaactaggcaacctatccgaatttctgacaacttctttttacacttatctaaccttcctggaccccgattgtgatgaaaaactgttcgataacgcctcagaaggtacttttagtccagattcagattcagatctggtggggtatctcgaggatacttgcaaccaggaaagtcaggatgagttggatcactatatcaatcatctgctgcaatccacgtcattgaggtcctatttaccgcccctatgcaagaatacggaggaccgccatgtgttcagtgccatacattccaccagagacattttgtctgtcatggccaaggctaagggtctcgaagtgcctttcgtccccatgaccctccctaccaaggtgttgtctgctcatcggaagagccttaatttggttgatagcccacagccactgttggagaaggtacctgaaagtgacttccagtggccacgtgatgaccatggagatgtggattgcgagaagctcgtggaacagctcaaagattgttccaaccttcaggatcaggcagatattctttacatcttatatgtgataaagggcccctcctgggacacaaatctgagtgggcagcatggcgtgacagtgcagaatctcttgggagaactttatggaaaagctggcttgaaccaggaatgggggctcattagatatattagcggactcctgcgcaaaaaggtagaggtactggccgaggcttgcacagaccttctctctcaccagaagcagctcacagtgggactcccccctgagcctagggaaaagatcatatcagctccgctacctccagaagagctgacgaaactgatctacgaggctagtggccaggacattagcattgctgtcctcacgcaggaaatagtcgtctatctggcaatgtacgtgcgggctcagcccagtctgttcgttgagatgctcaggctgcgtatcgggctgattatacaggtcatggctaccgagctggcgcgcagtctgaattgctctggggaggaggctagtgaatctctaatgaatctgtcacccttcgacatgaagaaccttctccatcacattctttccggcaaggaattcggggtcgagcgctctgtacgaccgatccacagctcaacgtcatccccgactatatcgatccacgaggttgggcatactggagtcactaagacagagcgatcaggcattaacaggctgcggagtgagatgaagcaaatgacccgccggtttagtgccgatgagcagttcttttctgtgggacaggcggccagctccagcgcccattccagtaagagtgccaggagttccaccccatccagccccacaggtacgtcctctagtgacagcggtggacatcatattggctggggtgaacgccaaggacagtggctgcgtcggagacgccttgacggggcaattaaccgagtgccagttggtttctaccagcgtgtgtggaagatccttcaaaaatgccacgggttaagcattgacggctatgtgctcccgtcatctacaactcgggaaatgacgccacacgaaatcaaatttgccgttcatgttgaatccgtgctgaaccgagtgccacagcctgagtatagacagcttctggtcgaggccatcatggttttgactctgctgagcgacacagagatgacctctatcggcggcattatccacgtcgatcagatagtgcagatggctagccagttatttctgcaggatcaggtttcgatcggagcaatggacactttggagaaggatcaggctactggtatttgccattttttctacgattccgcgccatccggtgcctacggtacaatgacttacctcacccgggccgtcgcatcatacctgcaggagctgctgcccaactctggctgtcaaatgcag

SEQ ID NO: 18066 - DNA, 3705 bp, Artificial Sequence
  Description of Artificial Sequence: Synthetic coding sequence
atgcggtcgagatctaattcgggcgtgagacttgacggatacgcgcgactcgtgcaacaaaccatactctgttaccaaaaccccgtgactgggcttctgtcggcctcccatgaacaaaaggacgcctgggtgcgcgataacatctactcgatactggccgtgtggggactcggaatggcatatcggaaaaatgccgacagagatgaagataaagcaaaggcctatgaattggaacagaacgtggtcaaactgatgcggggacttcttcaatgtatgatgcgtcaagtggccaaggtggagaagttcaagcatacccagtcgactaaggattccctccatgcaaagtacaataccgcaacttgcgggaccgtggtcggtgatgaccaatgggggcatcttcaggtggatgcaacttcactctttctgctgttcctggcccagatgacggcatcgggacttcgcattatctttacgctggatgaagtagcatttatccaaaacctcgtattctacattgaagcagcatacaaagtcgcagactacggcatgtgggaaagaggtgataagactaaccagggtattccagaacttaatgcaagctcggtggggatggcaaaggcggcactggaggcgatcgatgagctggatctgtttggagcacatggtggaagaaagtcggtcatccatgtcctcccggatgaggtggaacattgtcaatctatcctctttagcatgcttcctagggcatccactagcaaggaaattgacgccggtttgctgtcaattatcagttttcctgcatttgcagtcgaggatgtgaatttggtcaacgtgaccaagaacgaaatcattagcaaacttcagggacgttacggatgttgtcgatttttgcgagatggctacaagacccctagagaggacccaaatcggctgcactatgacccagctgagctgaaactgttcgagaatattgaatgcgaatggcctgtgttttggacctatttcatcattgatggggtgtttagcggggacgccgtgcaagtgcaggagtacagggaagcactcgaagggattctgatccgcggaaagaacggaatacggcttgtacctgaactgtacgcggtgcctcctaacaaggtcgatgaagaatacaagaatccacacaccgtggatcgcgtcccgatgggaaaagtgcctcatttgtgggggcagtcgctgtacatactctcctctcttctggcagaaggatttctcgcagcaggagaaattgatccgctgaaccggcgattttcaactagcgtcaaacctgatgtcgtggtgcaagtcacggtgttggcagaaaacaaccacattaaggatctccttaggaagcacggagtcaacgttcaatctattgcagatattcatccaattcaggtacagcctggtcgaatactgtcgcacatctacgcgaagctcggtcggaacaagaacatgaaccttagcggtagaccttaccgccatataggtgtccttggcacttcaaagctgtacgtgatacgaaatcagattttcacgttcactccacaatttaccgaccaacatcatttctatcttgccttggacaacgaaatgattgttgagatgttgcgaattgaattggcttacctttgtacttgctggcgcatgactggtcgccctactcttacgttcccaatttctaggactatgcttaccaacgacggttcagatattcactcggcagtcctgagcactatcaggaagctggaggacggatacttcggaggagcacgcgtcaagctcggcaatctgtctgaattcctgaccacttcattttacacgtacctgacctttctcgatcctgactgcgatgaaaaactttttgataacgcatccgaggggaccttctcgcctgatagcgatagcgatctggtgggatacctcgaagatacctgcaaccaggagtcacaggatgaacttgaccattacattaaccatctccttcaatcgacctcgctgcggtcgtacctccctccattgtgcaagaacactgaagatcgccatgtgtttagcgcaattcactcgactcgcgatatcctgtcagttatggcgaaggctaaaggtctggaagtcccatttgtgcccatgactctgccaactaaggtgctgtcggcacaccgaaaaagcctgaatcttgtcgactccccccagcctctgttggagaaagtgcctgagtccgactttcagtggccccgtgatgatcacggagatgtggattgtgaaaaactggtcgagcaactgaaggactgttcgaatctgcaagaccaagcagacatattgtacattctgtatgttatcaaaggcccttcatgggataccaacctgagcggtcaacacggagtgaccgtgcaaaacctgctcggagaactgtacggtaaggcaggcctgaatcaggaatggggactgattaggtacatcagcgggcttcttcggaagaaggtggaagtgcttgcggaagcatgcaccgaccttctgtcccaccagaagcaacttaccgtcggtctgccccctgaaccacgagaaaagatcattagcgcaccattgccacctgaagagcttactaaattgatttacgaagcaagcggtcaagacatcagcattgccgtgctgacccaagaaattgtggtctacctggcaatgtacgtgcgtgcccagccttcactgtttgtggagatgttgcgtcttagaattggtcttatcattcaggtgatggccacggaacttgccagatctctcaattgtagcggagaagaagcaagcgaatcgctgatgaatctctcaccattcgatatgaagaacctgcttcatcacatcctgagcggtaaggaatttggagtggagcggtcagtgcggcccatccattccagcacctcttccccgactatttcgattcacgaggtgggacatactggcgtgactaagactgagcggtcaggtattaacaggcttagaagcgaaatgaagcagatgacccgtcgcttctcggccgatgagcaattcttctcggtgggtcaggcagccagctcctccgcacactcgtcaaaatccgctcgctccagcactccaagttccccgacgggcacttcgtcgtccgattccggagggcatcatattggctggggagaacgtcagggacagtggttgcgcagaagaaggcttgacggcgccattaatcgagtgccagtcggattttaccagcgcgtctggaagatacttcaaaaatgtcacggcctctcaatagatggttacgtgcttccatcgtccaccacccgggaaatgaccccacatgagatcaagtttgcagtgcatgtggaatcggttctgaatagggtgccgcagcctgaatacaggcaactcctggtggaggccatcatggtgctgaccctcctgtcggacactgaaatgacctccatcggaggaatcatacatgtggaccaaatcgtccagatggcatcgcaactcttccttcaagatcaagtttcgatcggagctatggatacccttgagaaggatcaagctaccggcatctgccatttcttttacgacagcgcgccttccggagcatatggtaccatgacttatctgacgcgcgctgtggcgagctacctgcaagaactgctgccaaatagcggatgtcagatgcag

SEQ ID NO: 18067 - DNA, 3705 bp, Artificial Sequence
  Description of Artificial Sequence: Synthetic coding sequence
atgcggagcagatcaaattcaggcgtgcgactggacggttatgccaggttggttcagcagacaatcctttgttaccagaaccccgtgacaggcttgttgtccgcctcgcatgagcagaaggacgcctgggttcgggacaacatctatagtattctggctgtgtggggcctgggcatggcgtaccgaaagaacgccgatcgggatgaagacaaagccaaagcctacgaactcgaacagaacgtggttaagctaatgagagggctactgcagtgtatgatgaggcaggtagccaaggttgaaaagtttaagcatactcaaagtacaaaggatagtctgcatgcaaaatataacactgctacttgtgggaccgtggtgggtgatgatcagtggggtcacttgcaggtggacgcgacttccctcttcctcctgttcctcgcgcagatgactgcttcaggcctgagaatcatattcaccctggatgaggtcgcctttattcaaaaccttgtgttctacattgaagctgcatacaaggttgccgactacggaatgtgggaacgaggtgataaaaccaaccaagggataccggaactcaacgcctcaagcgttgggatggcgaaggctgccctggaggccatagacgaactggaccttttcggagcacatggtggcagaaagtccgtgatccacgtcctgcccgatgaagtcgaacactgccagtcaattcttttcagcatgctgccccgggcctcaacttccaaagagattgatgcaggactactgagcatcatcagctttcccgctttcgcagttgaagacgtaaatctggttaatgttacaaagaacgaaatcatctccaaactgcagggcagatatggatgttgtagatttttacgcgacgggtacaagacaccgagagaggaccccaatcggttgcactacgatcccgccgaattgaaacttttcgagaacatagagtgcgagtggcccgtattttggacgtactttatcattgacggggtattcagtggcgacgcagtacaggttcaggagtacagggaagcattggaaggcatattgatcagaggaaaaaatgggatcagactcgtccctgaattgtatgccgtgccccctaacaaggtcgacgaggagtacaaaaaccctcacactgtggatcgggttcccatgggcaaggttccccatctgtgggggcagagcttatatatcttaagttctctgctggccgagggattcctggctgctggagagatcgatccattgaaccggagattttctacatcagtgaagcctgatgtggtggttcaggtgaccgtgcttgccgaaaacaaccatatcaaagatctgttacgcaagcacggtgtgaatgtgcaaagcatagcagacatacatccaatacaagtccagccaggccggatactgagccatatttatgcaaagctcggcaggaacaaaaacatgaacctgagcgggagaccgtacagacatataggggtgctaggcacctccaagttatatgttatcagaaaccagatatttaccttcacaccccagttcacggaccagcaccacttctacctggcccttgacaatgagatgattgttgaaatgctacgtatcgagctcgcttacctctgcacctgttggagaatgacaggcagacccaccctgacgtttcccatttctcgtactatgctgacgaacgatggcagcgacatccacagcgccgtcctttccaccataagaaaactcgaagatggatacttcggaggcgcccgggtgaagctcggtaatctgtccgagtttctgacaaccagtttctatacctatttgactttcctcgaccccgactgtgacgagaagctgttcgacaatgccagcgagggtacattttctcctgactccgacagtgatctggtgggttatctggaggatacttgcaatcaagagagccaggatgaattggatcattacataaatcacctgctgcaatccaccagcctcagatcctatctgccccccctgtgcaagaataccgaggataggcatgttttctctgccattcattcaacaagagacatattgagcgtcatggccaaggcaaaaggcttagaggtgccctttgtgcccatgactctccctacaaaggtgctctcagctcatcggaagagtttgaatttggtggattcaccacaacccttgctggagaaggtgcctgagagcgattttcaatggcctcgtgatgaccacggcgacgtggattgcgagaagctggttgaacagctgaaggactgctcgaacctccaggaccaggctgacattctttatatattgtacgtgataaagggcccatcttgggatacgaatctgtccggccagcacggtgtgaccgtgcagaaccttctgggggaactgtatggtaaggccggacttaaccaggagtgggggctcataagatatatctcaggcttactgaggaaaaaagttgaggtgctagcagaggcctgcactgacctgctgagccaccaaaaacagctcactgtgggcctgcctcctgaaccaagggaaaagatcatctccgcaccactgccccctgaggagttaactaagttgatttacgaggcctccggacaggatatcagcatcgccgtactgacgcaggagattgtggtttatcttgcgatgtatgtgagggctcagccttccctttttgtcgaaatgttgagactccgtatcgggttgatcattcaggtaatggctacggagcttgctcgcagccttaactgtagtggtgaagaggcatccgagtccctgatgaatctgagccccttcgatatgaagaacctgttgcatcacatcctgtctggaaaggagttcggcgtagagcgctcagtaaggccgattcactcttcgacctctagtcctaccatttcaatccacgaggttggacacactggggtgacgaaaactgaaagatccggtatcaataggctgcgctcggaaatgaagcagatgacacgccgattttcagcagacgaacagttcttttctgtagggcaagccgcttcctctagtgctcacagctccaaaagtgcccgcagctctactccttcaagtcctacgggcacttcctcttccgactctggtggccaccatattggatggggcgagcggcaaggacagtggctgcggcgccggcggctggatggggccattaaccgggttcctgtgggcttttatcagcgggtatggaaaatcctgcagaagtgccacggactgagcattgacggatatgtgcttccttctagcacgacccgcgagatgacaccacacgagattaagtttgccgtgcatgttgagagtgtcctgaatcgggtaccccagcctgagtatcggcagcttctggttgaggcaattatggtgctaaccttgctctccgataccgaaatgacatcaataggaggaattatccatgtcgaccagattgtccagatggcatctcagctgtttctgcaggaccaggtgtcaattggtgccatggacaccttagagaaggatcaggcaaccggaatttgtcatttcttttatgacagcgccccttcaggcgcatatggcaccatgacctacctcacacgggcagtcgcctcatatttgcaggagctcctccccaacagcggctgtcagatgcaa

SEQ ID NO: 18068 - DNA, 3705 bp, Artificial Sequence
  Description of Artificial Sequence: Synthetic coding sequence
atgcgctctcgctcaaatagtggtgtgaggttggatggatacgcaaggttggtgcaacaaacaattctctgctaccagaatcccgtgaccggccttttgagcgcttcacacgagcagaaagatgcctgggtgagagacaacatctatagtatactcgcagtgtggggtctggggatggcctataggaagaatgcggaccgcgatgaggataaggccaaagcctatgaattggagcagaatgtagtcaaactgatgagagggctgctgcagtgcatgatgaggcaggtagccaaagtggagaagttcaagcacacgcaaagtaccaaagactcccttcacgctaagtacaacaccgcaacatgcgggactgtcgtgggggacgaccagtgggggcacttacaggtcgacgcaacgagcttgtttttactgtttctggctcaaatgactgctagcggactccgcataatttttactctggacgaggtcgccttcatccagaacttggtgttctatatcgaggccgcatataaggtggccgattacgggatgtgggaacgtggtgataagacaaaccagggaataccagagctgaatgcgtcatctgtgggaatggcgaaggctgcactggaggccattgacgaactagatttgtttggtgctcacggaggccggaagtccgtgatccatgtcctgcccgatgaagtggagcactgccagtcaattctgtttagtatgctgcctcgcgcttcaacctcgaaagagatcgatgccggactcctttcaatcattagtttcccagcgtttgctgtggaagacgtgaaccttgtcaacgtgacaaaaaacgagatcatctccaaactccaaggcagatacgggtgctgtcgatttttaagagatggttacaaaacaccaagagaggatcctaaccgtttacattacgacccagctgaattgaaactgtttgaaaatatagaatgcgagtggccggttttttggacttacttcatcatcgatggggtgttttccggcgacgctgtccaggtgcaggaatatagagaggcattagaaggcatcctgattcgtggcaaaaatgggattagactagtgccggagctatacgctgtgccccccaacaaggtcgatgaagaatataagaatcctcacacagtggatcgggtacctatggggaaggtgcctcacctgtggggacagtcactctatattctgagtagtctcttagctgaaggcttcttagccgccggcgaaattgatccactcaaccggaggttctctactagcgtgaaacccgacgtggtcgttcaggttacagtgctggctgaaaacaatcatattaaggacctgttgcggaagcacggggtcaatgtgcagtccattgcggatatacaccctatccaggtgcagccaggtcgcatactgagccatatctacgccaaactcggacgcaataagaatatgaacctctcaggccgaccctaccggcacattggggtgcttggaaccagcaagctgtacgtaattcgaaaccagatctttaccttcacgccacagttcactgatcaacatcacttctacctggcgcttgataatgagatgatcgttgaaatgctgcgaatagaactggcttatctgtgtacttgttggcgaatgacgggacgccctactttaacattccccatttctaggaccatgttgaccaatgatgggagtgatatacattccgcggttcttagtaccatccgcaaactggaggacgggtattttggcggggctcgcgtaaaactcggaaacctctctgagttcctgacaacatcattctacacatacctgacctttctagaccctgactgtgacgagaaactcttcgacaacgctagtgagggtacgttctctcccgattccgacagcgatctcgtgggctacttagaggatacttgcaatcaagagtcgcaggatgagttagaccactatatcaatcatcttctccaaagcacctctctgagaagctatctgcccccactatgcaagaacactgaagacagacatgtcttttccgcgatccactccacaagagatatattgtctgtgatggctaaagcaaaagggctagaggtcccatttgttcccatgactctacctactaaggttctgagcgcccatcggaaaagcctgaatttagtcgactcaccccagcccctgctggaaaaggttcccgaatcggactttcagtggcctcgggacgaccatggcgatgtggattgcgagaagctggtggaacagctgaaggattgttctaatttgcaggaccaggccgatatcttgtatattctgtatgttatcaagggccctagctgggatacaaatctcagtggccagcatggcgtaaccgtgcagaacctgctgggcgaactttacggaaaagctggccttaatcaggagtggggcctcattcggtacatctctggactgcttcggaagaaagtcgaagtcctcgccgaggcttgtaccgatttgttaagccaccagaagcaattgaccgtgggtctgcccccagagccgcgagagaaaatcatatctgcccccttacctcccgaggaactgacaaagttgatctacgaagcttccggccaagacatatcaatagcggtcttgactcaagaaatcgtggtttacctggcgatgtatgtgcgggcccagccttcgctgttcgtggaaatgttacgtcttcgaataggtctgatcattcaggtgatggccaccgagctggccagatccctaaattgcagcggggaggaagcgagtgagagtctgatgaacctgtcaccctttgatatgaagaatcttcttcaccatattctctcaggtaaagaattcggcgtggaacggtcagttagaccaatccactcctccacaagttcaccaaccattagcatccacgaagtagggcacacgggagtgaccaagacggaaagatctggaattaaccgattaaggagtgagatgaaacagatgacaagaagattttcggcagacgagcagtttttttccgtcggccaggctgcttctagcagcgctcacagcagtaagtccgcaagatcttccaccccaagttcccccactggtacatcctcttccgattccgggggccaccatatcggctggggcgagagacagggacagtggctccgcagacgccggctggatggagcgataaacagggttccagttggattctaccagcgcgtctggaagatcctacagaagtgtcacggactgtcgatcgacgggtacgtgttgccatcatccaccacccgtgagatgactccccacgaaattaaattcgccgtccacgtggagtcagtgcttaatagggttccccagccagagtaccgccaactgctcgtcgaagcaattatggtcctcaccttgctctctgacacagagatgacctctattggaggaattatacacgtggaccagatcgtgcagatggcgtcacagctgttcctccaagatcaggtatctatcggcgctatggacacactggaaaaagaccaggcaactggtatttgccactttttttatgactccgcccctagcggtgcctacgggactatgacgtacctgacccgggcagtggcttcttacctgcaggagttactgccgaacagcggctgtcaaatgcag

SEQ ID NO: 18069 - DNA, 3705 bp, Artificial Sequence
  Description of Artificial Sequence: Synthetic coding sequence
atgcgctcgcgctcgaactcgggcgtccggctggacggctacgcgcgcctcgtgcaacaaacgatcttgtgctaccaaaacccggtgactggactcctctcagccagccacgaacaaaaagacgcttgggtgcgcgacaatatctactccatcctcgcagtctggggactgggtatggcataccggaagaacgcggatcgtgatgaagataaggcaaaggcgtacgaactcgagcaaaacgtggttaagctgatgagaggccttctgcaatgcatgatgaggcaggtggccaaggtcgaaaagttcaagcatacgcaatccactaaggactccctgcacgctaaatacaacaccgcgacttgtggaaccgtggtgggagacgaccaatgggggcatctgcaagtcgatgcaacctccctgttcctcctgtttttggcccaaatgaccgcttcaggactgcgcatcatcttcaccctggatgaagtcgcttttatccaaaacctcgtgttctacatcgaagccgcgtacaaggtggcggactatggaatgtgggagcgaggtgacaagaccaaccaagggatcccagagcttaacgcctcatccgtgggaatggcgaaagccgccctcgaggcgatcgacgaactggatctgttcggagcccacggcggtaggaaatcggtgatccacgtgctccctgacgaggtggaacactgtcagtcgatcctgttctcgatgctgccgagagctagcaccagcaaagagattgacgcaggactcctgtcaattatctccttcccggccttcgcagtcgaggacgtgaacctcgtgaatgtgactaagaacgaaatcatctcgaagctccagggccgctacggatgttgccgctttctgcgggacggatacaaaacgccgcgggaggacccgaaccggcttcactacgacccagccgaactgaagctgttcgaaaatatcgaatgcgagtggccggtcttttggacgtacttcatcatagacggcgtgttttccggagacgcggttcaggtgcaggagtacagagaagcgctggaaggaatcttgatcagaggaaagaacggtatccgcttggtccccgaattgtacgccgtgccaccgaacaaagtcgacgaagaatataagaacccccacactgtcgatcgagtcccgatgggcaaagtgcctcatttgtggggacagtcgctctacattctttcgtcgctgttggccgagggattcctggcagcaggagaaatcgatccgctcaacaggcgattttctactagcgtgaagcctgacgtggtggtgcaggtgactgtactggccgagaataatcacatcaaagatctgctgaggaaacatggggtcaacgtgcaatcaatcgcagatattcatccgatccaagtccagcctgggcggatcctcagccatatctacgcgaagctcggccggaataagaacatgaatctgtcggggaggccataccgccatatcggagtgctgggaactagcaagctgtacgtgatccgcaaccagatcttcacgttcaccccacagttcaccgaccaacatcacttctacttggccctggataatgagatgatcgtggaaatgctccggatcgaactggcctacctctgtacttgctggagaatgactggacgcccaacgctgacctttcccataagccgcactatgctcactaacgacggatccgatatccatagcgccgtgctgtctaccatcaggaagctggaagatggttacttcggcggggcaagagtcaagctgggaaatctctccgaatttctcactacctcattctacacttacctcactttcctggacccggactgcgatgaaaagctcttcgacaacgcttcggagggaaccttctcccctgatagtgactcggaccttgtcggctacctggaggatacttgcaatcaggaaagccaggatgagctggaccactacatcaatcatctgttgcagtcgacctccctgcggtcatatctgccgccactttgcaagaataccgaagatcggcacgtcttttcagctatccattcaacccgggatattctctcggtgatggccaaggccaaaggactggaagtgcccttcgtccctatgaccctcccgactaaggtgctgtccgcccatcggaagtctctgaaccttgtggactcccctcaaccgctcctggagaaagttccagagagcgacttccagtggccccgcgatgatcacggggatgtcgattgcgaaaaactggtcgaacagttgaaggactgttcgaacctgcaggatcaggctgatatcctctacatcctgtacgttatcaagggtccgtcttgggacactaatctgtccggccaacacggcgtgaccgtccagaaccttcttggggaactgtacggcaaggcgggactgaaccaggaatggggcctcatcagatacatcagcggactgttgcgtaaaaaggtggaagtgctggccgaggcttgcactgaccttctctcacaccagaagcagctcaccgtcggcctcccgcccgagccacgggaaaagattatttccgcgcctctgccacctgaggaacttactaaactgatctacgaggcctcaggccaggacatctcaattgcagtgctcactcaggagatcgtggtgtacctggcgatgtacgtcagagcacaaccgtccctctttgtggaaatgttgcggctgcgcatcggattgatcattcaagtgatggctactgagctcgcacgcagccttaattgcagcggagaggaggccagcgaatcactgatgaatctgagcccgtttgatatgaaaaacctgttgcatcacatcctgagcggtaaagaattcggcgtggagcggagcgtgcgcccgatccattcctcgacctccagcccaacgatctcgatccacgaggtgggtcacaccggagtgaccaagactgaaagatcgggaattaaccgcctgagatcagaaatgaagcagatgactcggcgattctccgccgacgaacaatttttctccgtgggtcaggccgcctcgtcctcagctcactcgtcaaagagtgcacgctcatcgaccccgtcgtcgccgaccggtactagcagctcggacagcggagggcaccatatcgggtggggagagaggcaggggcagtggctgagacggagacgcctcgatggagcgattaatagagtcccggtgggattctaccagcgcgtctggaagatccttcagaagtgccacggcctgtccatcgacggatacgtcctgccctcgtccacgacccgggagatgacccctcacgaaatcaagttcgcagtgcacgtcgaatctgtgctgaacagggtcccacagccagagtaccggcagctcctcgttgaggctattatggttctgactcttctgtccgacaccgaaatgacctccatcggcggaatcattcacgtggaccagatcgtgcagatggcctcacagctgttcttgcaggaccaggtgtcgattggagcgatggataccctggagaaggaccaggccaccggcatctgccacttcttctacgactcggccccatccggagcttacgggaccatgacttatctgacccgcgccgtggcgagctatctgcaagagctccttccgaacagcggatgccaaatgcag

SEQ ID NO: 18070 - DNA, 3705 bp, Artificial Sequence
  Description of Artificial Sequence: Synthetic coding sequence
atgcgctcccgctcgaactccggcgtcaggcttgatggctacgcgagactggtgcaacaaactattctttgttaccaaaatcccgtgactggacttctctccgcgtcgcacgaacagaaagatgcctgggtccgggacaacatttactcgattctggcagtgtggggtctgggtatggcatatcggaagaacgctgacagggacgaagataaggctaaggcgtacgaactcgaacaaaatgtggtgaaactcatgaggggactgctgcagtgcatgatgcgtcaagtggccaaggtggaaaagtttaagcatacccaatctactaaagattcgcttcacgccaagtacaacaccgcaacctgtgggacggtcgtgggtgatgatcaatggggacatttgcaggtggatgctacttcgcttttcctgttgtttctggcccaaatgaccgcctccggacttaggatcattttcactcttgacgaagtcgccttcatacaaaatcttgtgttctacattgaggcagcgtataaggtcgcagattacggtatgtgggaacggggcgataaaactaatcagggaattccggagctgaacgcgtcgtccgtggggatggccaaagcggcgcttgaagcgatagacgagttggacctgtttggggcacacggtggccgtaaaagcgtgatccatgtgcttcctgatgaggtggagcactgccagtcaattttgttttccatgcttcctagggccagcacgtcgaaggagattgacgcaggtctgctttccattatcagctttcccgccttcgcagttgaggacgtcaatcttgtgaatgtgactaaaaacgaaatcataagcaagctgcagggaagatatggctgctgtcgctttctccgcgatggctataagacccctcgggaagatcctaatcggcttcattatgatcctgcagaattgaagctcttcgagaacattgaatgtgaatggcctgtgttctggacctactttatcattgatggagtgttttctggtgatgccgtccaggtgcaagaatacagggaggctcttgaaggaattctgataagggggaaaaatggaatccgcctggtgccagaactctacgcagtccctccaaataaggtggatgaagagtacaagaaccctcatacggtggatagagtgcctatgggtaaagtgccccacctctggggacaatccctgtacatcctgtcctcgcttctcgcagaaggatttcttgccgcaggggaaatcgatcctctgaaccggcggttttcgaccagcgtgaagccagatgtggtcgtgcaagtgaccgtcctcgccgaaaacaatcatatcaaggatctgcttcgcaagcatggagtcaatgtccaaagcatcgcggatattcatcctatccaggtgcaacccggacggatcctctcccacatctacgcgaagctcggaagaaacaaaaacatgaacctttccggtagaccctaccggcatattggagtcctgggaacctccaaactgtacgtcatccgtaaccaaatctttacttttacccctcaatttacggatcaacatcatttctacctcgcattggataacgaaatgatcgttgaaatgttgagaatagaactggcatacctttgcacttgttggcggatgaccggtcgtccaaccctgacgttccccatttcacgaactatgctgacgaacgatggttccgacattcattcggcagtgcttagcaccattagaaagctcgaggatggatactttgggggtgcaagagtgaagctcggtaacctgagcgaattcctgaccacgtccttttacacctatcttacctttctggaccccgactgtgacgaaaaactctttgataacgcatcagaaggcaccttcagccctgacagcgattccgacctggtggggtacctggaggacacttgtaaccaagaatcgcaggatgaactcgatcattacattaatcacctccttcagtcgacctcgctcagatcctacctcccgcctctttgcaagaacactgaggaccgtcatgtgttctcagcgatacactcgaccagagacattctgtccgtcatggcgaaggcaaagggcctggaagttcctttcgtgccaatgactctgcctaccaaggtgctgtcagcgcatagaaagtcactgaatctcgtcgattctccacaaccacttcttgaaaaggtgcctgagagcgattttcaatggccgagagacgatcacggagacgtggactgtgaaaagttggtggaacagctgaaggattgctcaaaccttcaagatcaggcagatatactttacatcttgtacgtcattaagggaccgtcttgggacacgaacctcagcggacagcacggcgtcaccgtgcagaacttgcttggagagctctacggaaaggcaggtcttaatcaggagtggggcctcatccggtacatttcaggactccttaggaagaaggtggaggtgcttgcggaagcatgcactgacctgctcagccatcaaaagcaactgactgtgggactcccacctgagccgcgagaaaagattatcagcgcacctctgccgcccgaagaactcaccaagctgatttacgaggcatcaggacaagatattagcatagcagtcctgacccaggagatcgtggtgtaccttgctatgtatgtgagagcacaacctagcttgtttgtggaaatgctgcggcttagaattggcctgattatccaggtgatggcgactgagctggcaaggtccctgaactgttcgggcgaagaagcatccgagtccctgatgaacctgtcccccttcgatatgaagaaccttctccatcatattctgtccggcaaggagtttggagtggaacggtcagtgcggccaattcacagctccacctcgtcgcctaccatttctattcacgaagtgggacataccggcgtgactaagactgaaagatccgggattaatcgccttagaagcgagatgaagcaaatgacccgtagattctctgcagacgagcagttctttagtgttggacaggcggcctcctcctccgcacattcgagcaaatccgcgcggagcagcaccccttcctcgccaactggtacctcatcatcggattcgggaggacatcatatcggctggggtgaaagacaggggcagtggctgaggcgccggcggctggatggggcaatcaatagagtcccagtgggtttctaccaaagagtctggaagatcctccagaagtgtcacggcctgtcaattgatggatatgtgttgccatcgagcacgactagagaaatgactccccatgaaatcaagttcgccgtgcatgtcgaaagcgtcctgaatagagtgccacaacctgaataccgccaattgcttgtggaagccatcatggtgcttaccctcctctccgacaccgagatgaccagcatcggaggaatcattcacgtcgatcagatcgtgcagatggcatcgcaactctttctccaggaccaagtgagcattggagcaatggacaccctcgaaaaggatcaggcaactggtatctgtcactttttctacgattcggcaccttcgggcgcatacggaactatgacctatctgacccgggccgtggcgtcgtacctgcaagagctcctccctaattctggatgtcaaatgcag

SEQ ID NO: 18071 - DNA, 3705 bp, Artificial Sequence
  Description of Artificial Sequence: Synthetic coding sequence
atgagatccaggtccaacagcggcgtacgacttgatggttatgcaagactcgtccagcagacaatactgtgctatcagaacccagtaactggattgttgtcagcgtcgcatgaacagaaagacgcctgggtgagggacaatatctattccatcttagctgtatgggggctgggcatggcataccgaaagaatgccgaccgggacgaagacaaagccaaggcctatgagctcgaacagaatgtggtcaaactcatgagggggctgctgcaatgtatgatgagacaggtcgccaaggtagaaaaatttaagcacacccaatctactaaggatagccttcacgctaaatataacaccgcaacttgcggaactgttgtgggtgacgatcagtggggtcatctgcaggtggatgccacatcgctgttcctccttttcctggcccagatgaccgcctcaggcctccgtattatcttcaccctcgatgaggtcgcctttatccagaatctggtcttttacatagaagcagcctacaaggtggcggattatggcatgtgggagagaggtgacaaaacaaatcaaggcattcccgagctcaatgcgagcagcgttggcatggcgaaggccgcactggaagccatcgacgaattagatcttttcggagcgcacggcggccgcaagtctgtcatccatgttctgccggatgaagtggagcactgtcagtctatactgttctccatgctgccacgggcatccacttccaaagagattgatgctggcttgctctcaattatttcatttccagcgtttgccgtggaggacgtgaacttggtaaacgttaccaagaatgaaatcatttccaagctgcagggacgttatgggtgttgtagatttcttcgagatggttataagacgccccgcgaagatcccaatcgacttcactatgatcctgcagaactaaaactctttgaaaatattgagtgtgagtggccggtgttctggacctacttcatcatcgacggagttttcagcggcgacgccgtgcaggtgcaggagtatcgggaagctttggaggggattttaatcaggggcaagaatggcattagacttgtcccggagctctacgctgtgccacctaacaaagtggatgaggagtataagaacccacacaccgtcgaccgcgtgcccatggggaaagtgccacatctatggggacagtccctgtatattctgagttcactcttggctgagggctttcttgctgctggagaaatcgatccgttaaaccgtcgcttctctacaagtgtgaagcccgatgtggtcgtccaggtcaccgtgcttgcagaaaacaaccacatcaaggatctgttaaggaaacacggagtgaatgtgcagagcatagcagacatccaccccattcaagtacagccgggacggattctgagccacatatacgcaaagcttggacggaataagaacatgaacctgagtggcagaccctataggcacataggcgtgctgggcacaagtaaactgtatgttatacgcaatcaaatttttacttttactccccaattcacggatcagcatcatttctatctggctttagataacgagatgattgtagaaatgctgaggatcgagctggcatacttatgtacatgctggcgcatgacagggcgccccactctaacatttccaatcagcaggacaatgctgactaacgacgggtcggacatacactcggctgtactcagtactataagaaagttggaagacggctattttggaggagcgcgcgtgaagttgggaaaccttagtgagtttctgaccactagtttttatacatacctgacattcctcgatccagactgtgatgaaaaactctttgataatgcctctgaggggaccttttcccctgattctgacagtgatctggtcggatacctagaggatacttgtaatcaggagtcccaggacgaactggaccactacatcaaccacttactgcaaagcactagcctgaggtcctatctcccgcctttatgtaagaacacggaggatcgacacgtctttagcgcaatccacagcacacgggatatcctgtcagtgatggccaaggcaaaaggcctggaggtgccgttcgtgccaatgaccctgcctactaaagtattaagtgcccatcggaagagcctcaaccttgtggactcccctcagccactcttggagaaggtacctgaaagcgatttccagtggccacgggacgatcatggggatgtagattgtgaaaaacttgtggaacagctcaaggactgttccaatttgcaagatcaggctgacattttgtacatactgtacgtaattaagggcccatcttgggatacgaaccttagcggccagcacggcgtaaccgtacagaatttgttgggagagctttacggaaaggccggactaaaccaggaatggggtttgatccgctacatatcaggactgctccggaaaaaggttgaggttctcgcagaagcctgtacagatctgctgagtcaccagaagcagttgaccgtcggcctgccccctgaacctcgggaaaagatcattagtgcaccactcccccctgaagagctcaccaagctcatctacgaggcctctgggcaggacatttccatcgctgtgctaacccaagagattgtggtctacctggcaatgtacgtgagggctcagccctccctgtttgtggagatgttgaggttgcggatcggcctcataatccaggttatggccactgaattagcacgttccctcaattgttcaggcgaggaagcctccgagtccctaatgaaccttagccccttcgacatgaagaatctactgcatcatattctgtcaggaaaagagtttggcgtcgaaagatccgttcggcccatccactcttcaacatcaagtcccacaatctccatccacgaggttggccacactggcgtcaccaaaacggagcgtagcgggataaatcggttgagaagcgaaatgaaacagatgacacggaggttctcagccgatgagcaattcttttctgtgggacaggcagctagtagctccgcccactctagtaagtccgcaagaagtagtactccaagcagcccgacaggcacgagctccagtgacagcggaggccaccacatcggctggggcgagcgtcaggggcagtggctccggaggcgccggctggatggcgccattaaccgggtcccagtgggcttctaccagcgcgtgtggaagattctacaaaaatgccacgggctcagcatagatggctatgtactgcccagttccacaactcgagaaatgactccacatgagatcaaattcgcagtgcatgtggagtcagtgctgaaccgtgtaccacagccagagtatcgccagctcctggtcgaggccatcatggtgctgacactgctcagcgacacggagatgacctccataggcggtatcatccacgttgaccagattgtccagatggcctcacagctgttcctgcaagaccaggtgagcatcggcgcgatggacacgctggagaaggaccaggccacggggatatgccactttttttacgactctgctccctcaggggcctatggaacaatgacctaccttacccgggcggtcgccagctatctgcaggaactgcttccaaattctggctgccagatgcag

SEQ ID NO: 18072 - DNA, 3705 bp, Artificial Sequence
  Description of Artificial Sequence: Synthetic coding sequence
atgaggtcacgttctaactcaggcgtacgcctggatgggtatgccagactggtacaacagaccatcctgtgttatcagaatcctgtaacaggccttctttctgcctcccacgagcagaaggatgcttgggtgcgggacaacatatatagtattctggccgtctggggcctcggtatggcctataggaaaaatgccgaccgtgacgaggataaagcgaaggcctacgaattggaacagaatgtcgtgaagttaatgcgtggcctgctacaatgcatgatgcggcaggtggctaaagtggagaagttcaagcacacgcagagcaccaaagactctcttcacgcgaagtataataccgcaacctgcgggaccgtggtgggcgatgatcagtggggccaccttcaggttgatgctacttccctgtttttgctctttcttgcacagatgacagccagcggacttagaattatctttacgctggacgaggtcgctttcatccagaatctggttttttacatagaggccgcgtacaaggttgctgactatggtatgtgggaaaggggcgataaaaccaaccaaggtattcctgaacttaacgcgagctctgtgggtatggcaaaggcagccctcgaagctatcgacgaattggatctgtttggcgcacatggaggcagaaagtccgtcatccatgtgctacccgacgaggtggagcactgccaaagcatcctatttagcatgctgccaagggcaagtacgagtaaagagatcgacgcgggactgctttccattatttcatttccagcctttgctgtggaggatgttaacctcgtaaacgtaaccaaaaatgagataatcagcaaactacagggaagatacgggtgctgtcgatttctacgggatgggtataagaccccccgcgaggacccaaatcgcttacactatgatccagcagaactgaagctgttcgagaacattgagtgcgagtggcctgtgttctggacatactttatcatcgacggcgtgttttccggcgatgccgtccaggtgcaagagtacagggaagccctggaggggatcctgatccgcggaaagaacggaatccgccttgtgccagagctgtatgctgtcccaccgaacaaggtggacgaagagtacaaaaatccgcacactgtggaccgggtcccaatgggcaaagtgccacacctatggggtcaatcactctacatcctaagtagcttgttggccgaaggtttcctggccgctggggagatcgaccctctgaaccgacgtttttcaacaagcgttaagcccgatgtcgtcgtgcaagtgaccgtgctggcagagaataatcatattaaagacctgcttagaaaacatggtgttaatgtacagagcatcgctgatatacaccccatccaagtccagccagggcggatcctgtcccatatatacgccaaattggggcgaaacaaaaatatgaatctgtcagggaggccatacaggcacatcggcgtgctgggcacctctaaactgtacgtcatccgaaaccagattttcacctttaccccacagtttacagatcagcaccatttttatctggctctcgacaacgaaatgatcgtggagatgcttcggatagaactggcatatctatgcacttgttggcgcatgacaggacggccaaccctgacttttcccattagcagaactatgctgacaaacgacggctcagatatccacagcgctgtcctttccacgattaggaaacttgaagacggctacttcggcggcgcccgggttaagctggggaatttgtcggagttccttacgacatctttttatacttacttgacctttctcgacccagactgtgatgagaagcttttcgacaatgcgtctgaggggacgttttccccagacagcgactcagacctagtgggttacctagaagacacatgcaaccaggagtctcaggacgaattggatcactacatcaatcatcttttgcaatctacatcattgcggagctatcttccacccctctgcaagaataccgaggaccggcatgtgttcagcgccattcacagcacccgagacatcctctccgtcatggccaaggctaagggcctggaggtgcctttcgttcccatgaccctgccgactaaggttctgtcagcccaccggaagagtcttaatcttgtggactccccacagcctctcctggagaaagtgccagaatcggactttcagtggcccagagacgatcatggggacgtggattgcgaaaagctggtggagcagctaaaggattgttccaacctacaggatcaggcagatattctatatatcctttatgtgattaaaggtccgtcctgggacacgaacctatcaggacagcacggggtgacggttcagaacctcctgggagagctgtatgggaaggcggggctcaatcaggagtggggcctcatacggtatatctccggtctgctgaggaaaaaggtagaagtactggctgaagcctgtactgacctattgtcacatcagaagcagcttacagtcggattgccgccagagccacgtgagaagattatctctgcccctctacctccagaggaactgaccaaactgatctatgaggcttctgggcaggatatttctatcgcagtgcttacccaggagatcgttgtgtatctggctatgtacgttagggctcagccaagtctgtttgtcgaaatgcttcgcctgcgcattgggcttataatccaggtgatggccacagagctcgcaagatccctgaattgctctggcgaagaggcctccgagagcttaatgaatctgagtccatttgatatgaaaaacctcttgcatcatattctgagtggcaaggagttcggcgtcgagcggtcagtaagacctatccattccagtacatcttcaccgaccatcagtatccacgaggtcgggcatactggagtcactaagacagagcgttcaggcatcaataggctccgaagtgagatgaagcagatgacgaggcggtttagcgccgacgagcagttctttagtgtggggcaggctgcgagcagctccgcccattcctcaaagtcagcacgctctagcacaccatcctcccctacgggcacgagttcctccgactccggtggacaccacatcgggtggggagaaagacaggggcagtggctgaggagacgcagactcgacggagcaattaatcgcgtcccggtggggttctatcagcgcgtgtggaaaattctacaaaaatgccacgggctgtcaattgacggctacgtgcttccctctagtacgactcgagagatgacgccacatgagatcaagttcgccgttcacgtcgaatctgtgctaaacagagttccccaacccgagtacagacagctgttggtggaagcaataatggtgttgacactcctgtcagacacagagatgacaagtattggaggaatcattcacgttgatcaaattgtacagatggcgagccagcttttcctccaggatcaagttagcataggggcaatggacacacttgaaaaggatcaggccacaggtatttgtcactttttctatgactccgcacccagtggggcgtacggaacgatgacatatctgaccagagccgtggcatcttatctgcaggaactcttgcccaattcaggttgccagatgcag

SEQ ID NO: 18073 - DNA, 3705 bp, Artificial Sequence
  Description of Artificial Sequence: Synthetic coding sequence
atgcgttcgcgttcgaattcgggtgtacgtctagatggttatgcgcgattagtacaacaaacgatattatgttatcaaaatccggttacgggtttactatcggcgtcgcatgaacaaaaagatgcgtgggtacgtgataatatatattcgatattagcggtatggggtctaggtatggcgtatcgaaaaaatgcggatcgagatgaagataaagcgaaagcgtatgaattagaacaaaatgttgtaaaattaatgcgaggtttactacaatgtatgatgcgacaagttgcgaaagttgaaaaatttaaacatacgcaatcgacgaaagattcgctacatgcgaaatataatacggcgacgtgtggtacggtagtaggtgatgatcaatggggtcatttacaagtagatgcgacgtcgctatttctactatttttagcgcaaatgacggcgtcgggtttacgtataatatttacgttagatgaagttgcgtttatacaaaatctagtattttatatagaagcggcgtataaagtagcggattatggtatgtgggaacgaggtgataaaacgaatcaaggtataccggaattaaatgcgtcgtcggttggtatggcgaaagcggcgttagaagcgatagatgaattagatttatttggtgcgcatggtggtcgtaaatcggtaatacatgtattaccggatgaagtagaacattgtcaatcgatattattttcgatgctaccgcgtgcgtcgacgtcgaaagaaatagatgcgggtctattatcgataatatcgtttccggcgtttgcggtagaagatgtaaatctagttaatgtaacgaaaaatgaaataatatcgaaactacaaggtcgttatggttgttgtcgatttttacgagatggttataaaacgccgcgtgaagatccgaatcgtttacattatgatccggcggaattaaaactatttgaaaatatagaatgtgaatggccggtattttggacgtattttataatagatggtgtattttcgggtgatgcggtacaagtacaagaatatcgtgaagcgctagaaggtatactaatacgtggtaaaaatggtatacgactagttccggaattatatgcggtaccgccgaataaagtagatgaagaatataaaaatccgcatacggtagatcgagtaccgatgggtaaagtaccgcatttatggggtcaatcgctatatatactatcgtcgttattagcggaaggttttctagcggcgggtgaaatagatccgctaaatcgtcgattttcgacgtcggttaaaccggatgtagtagtacaagttacggttctagcggaaaataatcatataaaagatttattacgaaaacatggtgttaatgttcaatcgatagcggatatacatccgatacaagtacaaccgggtcgaatactatcgcatatatatgcgaaactaggtcgaaataaaaatatgaatttatcgggtcgtccgtatcgtcatataggtgttctaggtacgtcgaaattatatgtaatacgaaatcaaatatttacgtttacgccgcaatttacggatcaacatcatttttatctagcgttagataatgaaatgatagttgaaatgctacgtatagaattagcgtatctatgtacgtgttggcgaatgacgggtcgaccgacgctaacgtttccgatatcgcgtacgatgttaacgaatgatggttcggatatacattcggcggtattatcgacgatacgtaaattagaagatggttattttggtggtgcgcgtgttaaattaggtaatctatcggaatttttaacgacgtcgttttatacgtatctaacgtttttagatccggattgtgatgaaaaattatttgataatgcgtcggaaggtacgttttcgccggattcggattcggatctagttggttatctagaagatacgtgtaatcaagaatcgcaagatgaattagatcattatataaatcatctattacaatcgacgtcgctacgatcgtatttaccgccgctatgtaaaaatacggaagatcgtcatgttttttcggcgatacattcgacgcgtgatatactatcggtaatggcgaaagcgaaaggtctagaagtaccgtttgtaccgatgacgctaccgacgaaagttctatcggcgcatcgtaaatcgctaaatttagtagattcgccgcaaccgttattagaaaaagttccggaatcggattttcaatggccgcgtgatgatcatggtgatgtagattgtgaaaaactagttgaacaactaaaagattgttcgaatttacaagatcaagcggatatattatatatattatatgtaataaaaggtccgtcgtgggatacgaatctatcgggtcaacatggtgtaacggttcaaaatctactaggtgaattatatggtaaagcgggtttaaatcaagaatggggtttaatacgatatatatcgggtttattacgtaaaaaagtagaagtactagcggaagcgtgtacggatctattatcgcatcaaaaacaactaacggtaggtctaccgccggaaccgcgagaaaaaataatatcggcgccgttaccgccggaagaattaacgaaattaatatatgaagcgtcgggtcaagatatatcgatagcggtactaacgcaagaaatagtagtatatctagcgatgtatgtacgagcgcaaccgtcgctatttgtagaaatgctacgtttacgtataggtctaataatacaagtaatggcgacggaattagcgcgatcgctaaattgttcgggtgaagaagcgtcggaatcgttaatgaatttatcgccgtttgatatgaaaaatctactacatcatatattatcgggtaaagaatttggtgtagaacgatcggtacgtccgatacattcgtcgacgtcgtcgccgacgatatcgatacatgaagttggtcatacgggtgttacgaaaacggaacgatcgggtataaatcgtttacgatcggaaatgaaacaaatgacgcgtcgtttttcggcggatgaacaatttttttcggtaggtcaagcggcgtcgtcgtcggcgcattcgtcgaaatcggcgcgatcgtcgacgccgtcgtcgccgacgggtacgtcgtcgtcggattcgggtggtcatcatataggttggggtgaacgtcaaggtcaatggttacgtcgacgacgtttagatggtgcgataaatcgtgtaccggtaggtttttatcaacgtgtatggaaaatactacaaaaatgtcatggtctatcgatagatggttatgttctaccgtcgtcgacgacgcgagaaatgacgccgcatgaaataaaatttgcggtacatgtagaatcggtactaaatcgagttccgcaaccggaatatcgacaattactagtagaagcgataatggtattaacgctattatcggatacggaaatgacgtcgataggtggtataatacatgtagatcaaatagtacaaatggcgtcgcaattatttttacaagatcaagtatcgataggtgcgatggatacgttagaaaaagatcaagcgacgggtatatgtcattttttttatgattcggcgccgtcgggtgcgtatggtacgatgacgtatctaacgcgtgcggtagcgtcgtatttacaagaattattaccgaattcgggttgtcaaatgcaa

SEQ ID NO: 18074 - DNA, 3705 bp, Artificial Sequence; identical to SEQ ID NO: 18065
  Description of Artificial Sequence: Synthetic coding sequence

SEQ ID NO: 18075 - DNA, 3705 bp, Artificial Sequence
  Description of Artificial Sequence: Synthetic coding sequence
atgcgctcccggtccaactctggcgtcaggttggacggatacgcgcgccttgtccagcaaaccatcttgtgctatcaaaacccggtgaccggccttctgtcggccagccatgagcagaaagacgcctgggtcagagacaatatctactcaatcctggcggtgtggggccttggaatggcctaccgcaagaacgccgacagagacgaggacaaggccaaggcttacgaacttgagcagaacgttgtgaagctgatgaggggactgttgcagtgcatgatgcgccaagtcgcaaaggtggaaaagttcaaacacacccagtcgaccaaggattcgctgcatgccaaatacaacaccgcgacttgcggaactgtggtgggggatgaccaatggggtcatttgcaagtcgacgccacctcactgtttctgcttttcctcgcccagatgaccgcgtccggcctccgcatcatctttactctcgatgaagtcgcctttatccagaatctggtgttctacatcgaggcagcctacaaggtggcagattacggtatgtgggaaaggggagataaaacgaaccaaggtatcccggaactgaacgcttcatccgtgggcatggcgaaggcagccctcgaagcaatcgacgaactggatctctttggcgctcatggagggcgcaagagcgtgatccatgttctgcctgatgaagttgagcactgccagtcaattctcttttcgatgctgccgcgggcatcaacctcaaaggaaatcgacgccggcctcttgtcgatcatttcgttccctgccttcgccgtcgaggacgtgaacctcgtgaatgtcacgaagaacgagatcatcagcaaactccagggtcgctacggatgctgcagatttctgagagatggatacaagacccctcgcgaagatcctaatcggctgcattacgatccggcagaacttaagctgttcgaaaacatcgagtgtgaatggccggtgttctggacctacttcataatcgatggagtgttctccggcgatgctgtgcaggtgcaggaataccgggaagctctcgaaggaatcctgattcgcggtaaaaacggtatccgcttggtgccagagctgtacgccgtgccgccgaataaggtggatgaggagtacaaaaacccgcacaccgtggaccgcgtgcctatgggaaaggtcccgcacctctggggacaatcgctgtacattctgtcatctctgctggccgagggattcctcgccgccggagagatcgacccactgaaccgccggttctccacgtccgttaagcccgacgtggtcgtgcaagtgaccgtgctggccgaaaacaaccatatcaaggatctccttaggaaacacggtgttaatgtgcaaagcatcgcagatattcacccgatccaggtccaaccggggcgcatcttgtcgcacatctacgcgaagctgggacgcaacaagaatatgaatctctctggacgcccgtacagacatatcggagtgctcggaacgtcgaagctgtatgtgatccgcaatcaaatcttcaccttcaccccccagttcaccgatcagcaccacttctacctggcgcttgacaacgagatgatcgtggaaatgttgcggatcgaactggcctacctgtgtacgtgctggagaatgactggccggccgactctgactttcccaattagcaggaccatgctgaccaatgatgggtccgacatccactcggcggtcttgtccactatccggaagctcgaggacggctacttcggaggtgccagagtcaagctgggcaatctcagcgaattcctcaccacgagcttctacacctatctgacgtttctcgacccggactgcgatgagaagctgttcgacaatgcctctgagggcaccttctcgcccgactcggacagcgacctcgtcgggtacctcgaggacacttgcaaccaggaaagccaagatgagcttgaccactacatcaaccacttgctgcagtcgacttcgcttcgctcctacttgccacccctgtgcaagaatactgaagatcgccacgtcttttccgccatccactccactcgggacattttgtcggtcatggccaaggcaaaaggacttgaagtcccatttgtgcctatgactctcccgaccaaggtgctgtcggcgcacagaaagtcactgaacctggtggactcgccccagccattgctggaaaaggttccagaatctgactttcagtggcctcgggatgatcacggagatgttgactgtgagaaacttgtggagcagcttaaagactgttccaatctccaagatcaagctgacatcctgtatatcttgtacgtgatcaaaggaccatcctgggatacgaacctctcgggacaacacggagtgactgtgcagaacctgctcggcgagctctacgggaaggccggactgaatcaagagtgggggcttatccgctacatctcgggcctgctccggaaaaaagtggaagtcctggctgaagcctgcactgacctcctgtcacaccagaagcaactgactgtcgggctgccaccggaacctagagaaaagatcatctcagcacctctgccgccagaggaattgactaaactgatatacgaggcgtcggggcaagacatctccatcgcggtgctgacccaggagatagtcgtgtacctcgcaatgtacgtccgagctcaaccatcccttttcgtggaaatgctgcggctcagaattggcctcatcatccaggtgatggccacggaactggcacgatcacttaattgctccggagaagaggcatccgaatccctgatgaacctcagcccattcgatatgaagaatctgctccatcatattctgagcgggaaggagttcggtgtggagcggagcgtgcgaccaattcactccagcacttcgtcgcccactatttcgatccatgaggtgggtcatacgggagtcaccaagaccgagagatcgggcattaacaggctgcggtccgagatgaaacaaatgactaggcgcttctccgcggacgaacagttcttcagcgtcggacaggctgcatcatcatcggctcattcgtcgaagagcgctcggtcctcgactccaagctcacctacgggaaccagctcctcagattccgggggccaccacatcggatggggagagagacagggacagtggctccgacgccgccggttggacggggcgatcaaccgcgtgcctgttggattctaccagcgggtgtggaaaatcctccagaagtgccacggactgtcaatcgatggatacgtgttgccctcatccacgacccgggaaatgactccgcacgaaatcaaatttgcggtccacgtggaaagcgtcctcaatagggtgccgcagcccgagtaccgacagctgttggtggaagcgattatggtcctgactctgctgtcagacactgaaatgacttcaatcggaggcatcatacatgtggaccagatcgtccagatggcctctcagttgtttctgcaagaccaggtgtccatcggggctatggatactctggagaaggaccaggcgaccggaatttgtcatttcttctatgactccgccccgagcggagcttatggcactatgacctacctgacccgggctgtcgcatcttatctgcaagaactgctccccaacagcggttgccagatgcag

SEQ ID NO: 18076 - DNA, 3705 bp, Artificial Sequence
  Description of Artificial Sequence: Synthetic coding sequence
atgaggagtaggtctaactcaggggtccgacttgatggctatgcgcgactggtgcagcagactattctttgttaccaaaacccagtcaccggtttgctaagcgcctctcacgaacagaaggatgcctgggtgcgagacaatatctatagtatcttggctgtctggggtctaggaatggcatatcgaaagaatgcagacagagacgaggacaaggcgaaggcttatgaacttgaacaaaatgtcgtcaagctgatgcgaggccttttgcagtgtatgatgaggcaagtggccaaagtagaaaagttcaagcatacccagtctaccaaagacagcttacatgcaaaatacaacactgcaacatgcggaacagtcgtgggggacgatcagtggggtcaccttcaggtggacgcaacctcactcttcctcctgtttctcgcccaaatgacagctagcggtctcagaattatttttacactggacgaagtggcgttcattcagaacctcgtgttctacattgaggcggcttacaaggttgcagactacgggatgtgggaaaggggggacaaaaccaaccagggcatccctgagctgaatgcaagctcagttggcatggccaaagccgctttagaagctattgacgagctcgatcttttcggagcgcatggaggccggaagtccgtgatccacgtactgcctgatgaggtggagcactgccagtcaatattattcagtatgctgccacgtgccagcacctctaaggaaatcgacgctggtctcctgtctattataagctttcccgcatttgcggtggaggatgttaacttggtgaacgtgacgaaaaacgaaattatatcaaaattacagggcagatacggctgttgtcgatttctgcgagatggatacaaaacaccgagggaggatcccaataggctgcactatgacccagcagaactgaagttatttgaaaatattgagtgcgaatggcccgttttctggacatatttcattattgatggcgtattctccggcgatgctgtgcaagtacaagaatatagggaagcacttgaaggtattctgatccgaggaaagaatgggattcgactggtccccgagctctacgcagtgccccccaataaggtcgacgaagaatataaaaatccccataccgtcgatcgtgtgccgatgggtaaggtccctcatctctggggacagagcctttacatcctgtcttcacttctagctgagggcttcctggccgctggagagatcgatccactgaatcggagattttccactagtgtgaagcctgatgtggtcgtgcaggtcacagtcctggccgagaacaatcacattaaagacttgttgcgaaaacacggggtgaacgtccagagcattgcagatatccaccccatccaggtacagcccggcaggatactgtcccatatttacgccaaactggggcgaaataaaaatatgaatctgagtggacggccctataggcatattggggtgttgggcaccagtaagttgtatgtgattaggaaccagatatttacatttaccccacagtttacagatcagcatcacttttacctggcactggataatgagatgattgttgaaatgcttagaatcgaactggcctacttgtgcacatgttggcgtatgacaggcaggccaactctgactttccctatttctagaaccatgctgaccaacgacggttctgatatccactctgctgtcttgagcacaatcaggaagctggaagacggttactttggtggcgcacgagtgaaactgggcaatctgagtgaattcctgactacatccttttacacatacctgacgtttttagaccctgattgtgacgaaaagctgttcgacaatgcatccgaaggcacctttagtcctgacagcgatagtgatcttgtcggatacttggaggacacctgtaaccaagaatcccaggacgagctcgatcactacattaatcacctgctgcagtcaacctctctgcgatcgtatttgccacctctctgcaagaacactgaagacagacacgtgtttagtgccattcattccacccgtgacattctctcagttatggctaaggcgaagggcctcgaagtgccctttgttccaatgacactacccacgaaagttctgtctgcccatagaaagagcctcaacctagtggactccccccagccgctcctcgaaaaagtacctgagtccgactttcagtggccccgggacgatcacggagacgtggactgcgagaagcttgtggagcagctgaaggattgttcaaacttgcaagatcaagcagatatcctgtatattctctatgtgatcaagggccctagttgggacactaatctgtctggtcagcacggagttactgtgcagaatttgcttggtgaactgtacggcaaagcagggttgaaccaggaatggggcctcattaggtatatctctggtcttctaaggaagaaagtggaggtgctagctgaggcttgtaccgatctgctatcccaccagaaacagctcacagtcggcctgcccccagaaccaagagagaaaattatcagcgcccccctgccgcctgaagagctaacaaagttaatatatgaagcaagcggacaggatatttccatagcagtgttaacacaggaaattgtagtttatttagctatgtatgtacgcgcccagccaagcctgtttgtggagatgctgcgtcttcgaattggtcttataattcaggtgatggccactgagttagccagaagtctgaattgttccggtgaagaggcctctgaaagcttaatgaacctttctccatttgacatgaagaatctgctgcaccacatcctcagcgggaaagagtttggggttgagcgtagtgtaagacctattcactcctccacatccagcccgacaatcagtatccacgaagtgggccatactggggtcacaaaaaccgaacgatccgggatcaatagactgcgcagcgaaatgaagcagatgactaggaggttctctgccgatgagcagttctttagcgtgggacaagctgccagcagctctgctcactcgtcaaagtccgccagaagctccaccccctcgtcccctaccgggacttcgagctccgattctggcgggcaccatattggatggggcgagagacaaggccagtggctgcgaaggagacgattggatggcgctatcaaccgagtaccagtgggcttctaccagagggtgtggaaaattcttcagaagtgccatggcttatctattgacgggtacgtgctgcctagctccaccacccgagaaatgaccccacacgagatcaagttcgctgtccatgttgaatccgtgctcaacagagtgccgcagcccgagtacaggcaactgctcgttgaggcgattatggtgcttacactcctcagtgacacagaaatgacctctattgggggcattattcacgtagaccaaatcgtgcagatggcatcccaacttttcctacaggaccaggtgagtatcggagcgatggacacacttgagaaagaccaagcgactggtatttgccatttcttttatgattcagcaccatcgggggcatatggtacaatgacctacctgacccgcgccgtggcctcataccttcaggaactgctccccaacagtggctgtcaaatgcaa

SEQ ID NO: 18077 - DNA, 3705 bp, Artificial Sequence
  Description of Artificial Sequence: Synthetic coding sequence
atgaggtccaggtctaattctggcgtcagattagatgggtacgcccggttggtgcagcagactattctttgctatcaaaatcctgtgacaggccttctgagcgccagccacgaacagaaggacgcgtgggtccgtgataatatttatagcatattggcagtctggggactgggtatggcatacagaaagaatgccgatcgcgatgaagataaggccaaggcatatgagttggagcaaaatgtagtgaagcttatgagagggttgttgcaatgcatgatgcgacaagttgcgaaagtggagaaattcaaacacacccagagtacaaaggatagcctccatgccaaatataataccgcgacatgcggcacagtggtcggcgatgatcaatgggggcacctccaggttgacgccacttcgctgtttctgctctttctggcccaaatgacggcgagtgggttgaggattattttcactctggacgaggtggcatttatccagaacttggtcttttatatcgaggccgcctataaggttgcggactatggcatgtgggagagaggggacaagacaaatcagggcatcccagagctgaacgccagttcggtggggatggcgaaggctgccctggaggccatagacgagctggaccttttcggggcacatggggggaggaaatccgttatacatgtgctcccagacgaggtagaacactgtcagtccatcctgtttagtatgctaccacgcgcatcaacaagtaaagagatagacgctggattactgagtattatcagttttcctgccttcgccgtcgaagatgtaaatctggttaatgtaacaaagaacgagattatcagtaaactacaaggccgatacgggtgttgcaggtttctgcgggacggctacaagaccccgcgggaggaccccaatagactccattacgatccggccgagctcaaactctttgaaaacattgagtgtgagtggcccgtattctggacatactttatcattgacggcgtgttctctggcgacgctgtgcaagtccaggagtacagagaggcactggaaggtatattgatccggggaaaaaacgggatcaggctcgtgcccgagctgtatgccgtgcctccgaacaaggtcgatgaagagtacaaaaacccacatacagtggatagggttccaatgggcaaggtgcctcacctctggggtcagtccctgtatatcctgtcctccctcttagctgaggggttcctagcagcgggcgagatcgatcctctcaaccggagattttctacaagcgtaaaacctgatgtcgtggtccaagtcacagtacttgccgagaacaatcacattaaagacctgttgaggaagcacggggtgaacgtgcagtctatcgccgacatacatcccatccaagtccaacccggtcggattctaagtcatatctacgcgaagttgggacgtaacaagaatatgaatttatcaggtcggccctaccgccatatcggggtcctgggaacatccaagctgtacgtgatccgcaaccagattttcacattcacacctcagttcaccgaccaacatcacttttatttggccctcgacaatgaaatgattgtggaaatgctgaggattgagctagcctacctatgcacatgctggcgaatgacagggcgaccaactctcacgtttccaatctcccgcacaatgttgactaacgatggatcagacatccattcagctgtgctgagcactatcagaaaattggaagacggatactttggcggggccagagtgaagctcgggaatctaagcgagttcctcacgacaagcttctatacgtatttgacctttctcgaccccgattgtgacgagaagctgtttgataacgctagtgaagggactttttctcccgactccgactccgacttggtcggctatcttgaggatacatgtaaccaagagtcacaagacgaattggaccattacatcaatcatctcctccagtccacatctctgaggtcctacctgccacctctgtgcaagaacacagaggaccggcacgtatttagcgcaatccatagtactcgggacatccttagcgtaatggcaaaggctaagggactggaggtgcccttcgttccaatgacgttaccaacaaaggtgctctcagctcacaggaagagcctgaacctggtggactccccccagccattgctggagaaagtgccggagtcggattttcagtggcctcgtgacgatcatggggacgtggactgcgaaaagcttgtggaacagttgaaggactgttcaaacctgcaggaccaggctgatattctctatatcctctacgttattaaggggccttcatgggatacaaacttgagcggccaacacggcgtcaccgtccaaaacctactcggggagctatacggaaaggccgggcttaaccaggagtgggggttgatcagatatatttcaggacttttgcggaaaaaagtagaagtgctggccgaagcatgcaccgacctcttgagtcaccagaagcagctaaccgtgggcctgccaccagagccaagggagaagattatcagtgcccctctgccacctgaggagctgacaaaattgatctatgaggccagtggccaagacataagtatcgctgtcctgacacaggagattgtcgtctatctagcaatgtacgttagagcacaaccgagcctattcgtagagatgctgagactccgaatcggactgattatccaggtgatggccactgagctcgccagatcccttaattgcagcggcgaggaagctagcgagagtctgatgaatctctcaccatttgatatgaaaaaccttcttcaccatatccttagcggaaaggagttcggagttgagcgatctgttcgacctatacatagttcaacgagctctccaactatttctatccacgaggtcgggcatacgggggtgactaaaaccgagagatccggaattaatagactgaggtccgaaatgaagcagatgacaagaaggttcagcgcggacgaacagttcttcagcgttggccaggcagcttcctcctctgctcattccagcaaaagtgcccggtcatccaccccctccagtccaaccgggacatctagttcagattcaggaggccatcacatcgggtggggtgaacgtcaaggacaatggttaaggagaagaaggctggacggggcaatcaatagggtaccggtggggttttatcagcgcgtttggaaaatcctgcagaagtgccacggactcagtattgacgggtatgtcctcccgtccagcacaacccgggaaatgacaccacacgagattaagttcgctgtgcacgtggagagcgttctgaaccgagtgcctcagcctgaatatcggcagctcctggtggaggcgatcatggtccttactctgttgtccgatacagagatgacctccattggtggcataatccatgtggaccagatcgtacagatggcttcacagctgtttctccaggaccaggtaagtattggcgctatggacactctggagaaagaccaggctactggaatctgccacttcttttacgactccgccccgtctggcgcttacggcactatgacatatctgacccgggcagtagcgtcgtacctgcaggaactccttccaaattcggggtgtcagatgcag

SEQ ID NO: 18078 - DNA, 3705 bp, Artificial Sequence
  Description of Artificial Sequence: Synthetic coding sequence
atgcggagccgatccaattccggtgtccggctggatggctatgcccgccttgtgcaacagacaatcttatgctaccaaaatccagtcactgggctattaagcgcttctcatgaacaaaaagacgcatgggtccgcgataatatatacagcatcctggcggtttgggggctgggtatggcctacaggaaaaatgccgatagagatgaagataaggcaaaggcatatgagctggagcagaatgttgttaagctgatgagagggcttctgcagtgtatgatgcgccaggttgcaaaggtggaaaagttcaagcacactcagtccactaaggactcactccacgcaaagtataacactgccacatgtggtacagtggtaggggacgaccagtgggggcacctgcaggtggacgcgacatcgctcttcctcctgttcttggcccaaatgaccgcctccgggcttagaataattttcacgctggacgaggtggcctttattcagaacctggtgttttatatcgaggccgcatacaaggtcgcagactatggcatgtgggagagaggagataagacaaaccagggtatcccagagctgaacgcctcatccgtggggatggcgaaggccgctctggaagcaatagatgaactggatctgtttggtgcacacggaggccgcaagagcgtcatacatgtcctgccagacgaggtggagcactgccagtctattctcttcagcatgttaccaagagccagtacctcaaaggagatcgacgccggattgttgtctattattagtttccccgcttttgccgtggaagatgtcaaccttgttaatgtaaccaagaacgagattattagcaaacttcagggccggtacggttgctgtaggttcctcagggacgggtataaaacccctagagaagaccccaaccgactgcattacgatcccgcggagctgaaactcttcgagaatatcgagtgtgaatggccagtgttttggacctactttattatagacggagtcttcagtggtgatgccgtgcaggtccaggaatatagggaagcactggaaggaatcctgataagggggaagaacggtatcaggctcgtgcctgagctttatgccgtgcctccaaataaggtagatgaggagtacaaaaaccctcacacggtggacagagtgcccatgggaaaggttccacacctgtggggacagtccctctacattcttagcagtctgctagccgaaggcttccttgccgccggggagattgatccgctaaatcgacgattcagtacctctgtgaagcctgacgtggtcgtccaggtaactgtcctggccgagaacaatcacataaaggaccttctgaggaaacacggcgttaacgttcagtctattgccgatattcacccaatccaggtccagccaggaagaattcttagccacatctatgctaagctgggtaggaacaagaacatgaatctttccggtcgaccttacagacatataggtgtccttggcacaagtaagctgtatgtcattcgcaaccagatattcacttttaccccccagttcacagatcaacatcatttctacctggcactggataacgaaatgatcgttgaaatgttgcggatcgagctggcatatctatgtacatgttggcgaatgactggtaggcctaccctcacattcccgatcagccggaccatgttgaccaatgatgggtcagatattcatagcgccgtgctctcaacaataaggaaactggaggacggctactttgggggtgcaagagtgaagctcgggaatctgtcagagttcctgactacaagcttctacacctacctgaccttcctcgaccccgattgtgacgaaaaactcttcgataacgcctccgagggaactttctcccctgactccgactctgatctcgtggggtaccttgaggacacgtgcaatcaggagtcccaggacgagctggatcattacattaatcacctactacaaagcacctccctcaggagctatcttcccccgctgtgtaagaatacggaagacagacatgtcttttccgcgattcatagtacccgggatattctgtcggtgatggccaaagcgaaaggcttggaggtccctttcgtacctatgactcttccgaccaaagtcctgagcgctcacaggaagagcctgaacttggttgatagtcctcagccgttgctcgaaaaagtgccagagtccgatttccagtggcccagagacgatcacggcgacgtcgattgcgagaaattggttgaacagctcaaggactgctcaaacttacaggaccaggcggacatactctatattctctatgtcatcaagggtcctagctgggatacaaacttgagcggccagcatggggtgaccgtgcagaatttgcttggcgaattgtatggcaaggcgggtctgaatcaggaatggggcttaatcagatacatttccggcttgctccgaaaaaaggtagaagtgcttgcagaagcttgcacagatctgctctctcaccagaagcaattaacagtagggctcccgccagagcctagagagaaaattatctctgcccctctgccccctgaggaacttactaagctgatatatgaggcttctggtcaggacatctccatcgctgtgttaacacaggagatcgtggtttatcttgccatgtacgtgcgggctcagcctagcctattcgtggaaatgctgcggctccgtatcggtctgatcattcaagtgatggctactgaattggctcggtccctaaactgtagcggagaagaggcgtcagagtccctgatgaatctctccccatttgacatgaaaaacttgctacaccacatcctttcaggaaaagaatttggggtggagcgaagtgtgcggcccattcattctagcaccagctcgcctacaatttcaatccacgaagtgggacacactggtgttaccaaaacagagagaagcggtatcaataggctcaggtcggaaatgaaacaaatgacacgccgtttttctgcggacgaacagttcttttctgtcggccaagccgccagttctagtgctcacagttctaaatccgctcgtagctcgaccccatcaagcccgactggcacatcaagctctgatagcggcggccaccatattggctggggggaacgacagggccagtggttacgtcgcaggcgcctggacggagccattaatcgcgtcccagtaggcttttatcagcgggtgtggaagattctgcaaaagtgccacggcttgtccatcgacggttacgtcctccctagctccactactcgggagatgacacctcacgaaatcaagttcgccgtgcacgttgagtcagttctgaacagggtgccacaacccgagtacagacagcttctggttgaagcaataatggttcttactctcctcagcgataccgaaatgacaagcatcggtggcattatccacgtggaccagatcgtgcagatggcgagtcaacttttcctgcaagaccaggtaagcataggggccatggacactctcgagaaagaccaggccacaggcatatgccattttttctacgacagcgccccaagcggtgcctacggaacgatgacctatctcacccgagcggtcgcatcctacctccaggagttactgcccaactctggatgccagatgcag

SEQ ID NO: 18079 - DNA, 3705 bp, Artificial Sequence
  Description of Artificial Sequence: Synthetic coding sequence
atgagatcaagaagcaattccggagtgcggctggatggctacgcccgcctggtccagcagaccatcctctgctaccaaaacccggtgaccggactgctgtcagcatcgcatgagcaaaaggatgcgtgggtgagggacaatatctattccatcctcgcagtctgggggctgggaatggcctatcggaagaacgcagaccgggatgaggacaaggcgaaggcctacgaactggaacaaaacgtggtgaagctgatgcgcggcctgctgcagtgcatgatgaggcaggtcgctaaggttgaaaagttcaaacatacccagagcactaaagacagcctgcacgcgaaatacaacacggcgacttgtgggactgtggtcggagatgaccaatgggggcaccttcaagttgacgcgacctcgctcttcctcctgttcctcgctcaaatgaccgcttccggtcttagaatcattttcactctggacgaagttgcgttcatccaaaacctcgtgttctacatcgaagctgcctacaaagtggcagactacggcatgtgggaaaggggagataagactaaccagggaattccggagctgaacgcgtccagcgtagggatggccaaggctgccctcgaagcgatcgatgagctggaccttttcggagctcatggcggaagaaaaagcgtgatccacgtccttccggacgaggtggaacattgccagagcatcctgttcagcatgctccctcgggcatcgacttcgaaagaaatcgatgccgggcttcttagcatcatctcatttcctgccttcgccgtcgaggatgtgaaccttgtgaacgtgactaagaacgaaatcatctccaagctgcagggacgctacggttgctgcagattcctgcgcgacggttacaagactcctcgggaggacccaaaccgcctgcactacgatcctgccgagctcaaactcttcgagaatattgagtgtgaatggcccgtgttctggacttacttcattatcgacggcgtgttttcgggcgacgccgtgcaggtgcaggagtaccgagaagctctggaaggaatcctgatccgcggaaagaacgggatccggctggtcccggaactgtacgccgtgccgccaaacaaagtcgatgaggagtacaaaaacccgcatacggtggatagggtcccaatgggaaaagtgccacacctgtggggtcagtccctgtacatcctctcaagcctgctggccgaaggattcctggccgccggcgagatcgatccgctgaatcgtaggttctccactagcgtgaagcccgacgtggtggtgcaagtgaccgtcctggccgaaaacaaccatatcaaagaccttcttagaaagcatggagtgaatgtgcagagcattgccgacatccatccgattcaggtccaaccgggacggatcctctcgcatatctacgctaagctcggacgcaacaagaacatgaatctctcaggtcgcccctacagacacatcggtgtgctggggacttccaaactttacgtgattcggaatcaaatcttcactttcacgccacagttcactgatcaacatcacttctacctcgcactggataacgagatgatcgtcgagatgttgcgcattgaattggcgtacctttgcacttgctggagaatgactggccgcccgaccctgacgttccctatctcaagaaccatgctgactaacgacgggtccgacatccattcagccgtgttgtccactattcgcaagctggaggacggctacttcgggggcgcccgggtcaagctcggaaacctttcagaattcctgaccactagcttctacacgtacctgactttcctggacccagattgcgacgaaaagctgttcgacaacgcctccgagggaactttcagccccgactctgattccgatctggtgggctaccttgaagatacttgcaaccaggagtctcaggacgagctcgatcactacataaaccatctgctgcagtcgacttcactcagatcgtaccttcctccactctgcaaaaacactgaggatcggcacgttttctccgccatccactccactcgcgatattctgtctgttatggctaaagctaagggactggaggtaccgtttgtcccaatgactctgccgactaaagtcctttcggcccaccgcaaatcgctgaatctcgtcgattcgccacagccgctcctcgagaaggtgcctgagtcagactttcagtggccacgcgacgatcacggagacgtcgactgtgaaaagctggtcgaacagctcaaggattgtagcaacctgcaagaccaggccgacatcctctacatcctgtacgtgatcaagggtccttcctgggataccaacctctccggacaacacggagtcactgtgcagaacctgctgggtgaactctacggaaaagccggactcaatcaggagtggggacttatccgatacatctcgggactgctgcgaaagaaggtggaagtcctcgccgaagcctgcaccgatctcctctctcaccagaagcagctgaccgtgggactccctccagagcctagagagaagatcatctccgcacccctcccaccagaagaactgactaaactcatctacgaggcttcagggcaagatatctccatcgccgtgttgacccaagaaatcgtcgtgtacctggctatgtacgtccgcgcacaaccctcattgttcgtcgagatgctgcgcctgcggatcggactgattatccaggttatggcaaccgagctggccagatcgctcaactgctcgggcgaggaagcctcggaatctctcatgaatctgagccctttcgatatgaagaacctgctccaccacattctgtcaggaaaggaattcggtgtggaaaggagcgtccggccaatccactcctcaacttcatcgccaactatctcaattcatgaagtgggccacacgggggtgacgaaaaccgaaaggtctggcatcaatcggctgaggagcgaaatgaagcagatgacgcggaggttttcagcagacgaacagtttttctcagtgggtcaagccgcgtcctcgtccgctcactcaagcaagtcggcgcgcagcagcacgccttcgtcccctactggaaccagcagctccgacagcggggggcaccatatcggatggggcgaaagacaaggacagtggctgagacgccgccggctcgacggcgccattaacagagtgccagtggggttctaccaacgagtgtggaaaatcctgcagaagtgccatggactcagcatcgacggatacgtccttccgtcgtccactacccgagaaatgaccccgcacgagataaagtttgccgtccacgtggagagcgtgttgaatcgcgtgccgcagccagaatacagacaactgttggtcgaggccatcatggtgctgactctcctcagcgacaccgagatgacttccattggggggattatccatgtcgaccagatcgtccagatggcctcgcagttgttcttgcaggaccaggtgagcatcggagctatggataccctcgaaaaggaccaggcgaccgggatctgtcatttcttttatgacagcgcaccttccggtgcctacggtaccatgacctatctgactcgcgctgtggcctcatacttgcaagaacttctgccaaactcgggatgtcagatgcag

SEQ ID NO: 18080 - DNA, 3705 bp, Artificial Sequence
  Description of Artificial Sequence: Synthetic coding sequence
atgagatctagatcaaattcaggagtcaggctagatggatatgctagattggttcaacaaacaatcttatgttatcagaatccggtgactggcttgctttccgccagtcatgaacaaaaagatgcatgggttagagataatatttattcgatcctcgcagtttggggtttgggaatggcctaccgaaagaatgcggatagagatgaagataaggcaaaggcttacgaactcgagcaaaacgttgttaaacttatgcgaggtctcctccaatgtatgatgcgacaggttgctaaagtagagaaattcaaacatactcaatctacaaaagattctcttcatgcaaagtataatactgcaacatgtggcacggtggtgggagatgaccaatggggacacctacaagtggatgcgacatcgctgttcttattgtttctggcccaaatgaccgctagtggactgcgaattatattcacactggatgaggtcgccttcattcaaaacttggtcttttacatagaagctgcttataaggttgctgattacggaatgtgggaacgaggagataaaactaatcaaggaatcccagaactgaatgcttcaagtgtcggaatggccaaagcagctctagaagcgatcgacgaattggatctctttggagctcatggaggacgaaaaagtgtgattcacgtcttaccagatgaagtcgagcattgccagtcaattttgttttctatgctaccaagagcatcaactagcaaggaaattgacgcaggtctactttcgatcatttcttttccagcttttgctgtggaggacgttaatttggtgaatgtgacgaagaatgaaatcatctcaaagttgcaaggacgatacggttgttgtagatttttacgagatggatataaaactccaagagaggatccgaaccgcttgcactatgatccagctgaacttaaattatttgagaatattgaatgcgagtggccagtgttttggacatactttattatagatggggtgttctctggagatgctgttcaagttcaggagtaccgagaagcacttgagggaattttaatcagaggaaaaaatggaatccgtctcgttccggaattatacgccgtgccgccaaataaggtggatgaggaatacaaaaatccacatacggtagatagagtgccaatgggaaaggtcccccatctatggggacaatcactgtacattttatcttctcttcttgccgaaggattccttgctgccggggaaatagacccattgaatcggagattctcaacgagtgttaagccagatgttgtcgtgcaggtcacagtgcttgctgaaaacaaccacatcaaagatcttttgagaaaacatggagttaacgtgcaatccatagctgacatccacccaattcaagtccagccaggtcgcattttgtcgcacatttacgcgaagctggggcgcaacaagaatatgaatttgtcgggaagaccttataggcacatcggagttttgggaacctctaaactgtatgtcataagaaaccaaatcttcacatttactccgcaattcacggatcagcaccacttttacttggctctagataacgaaatgattgttgagatgcttcgtattgagttggcatatttgtgtacttgctggcgtatgaccggtcgtcctactctcacctttcctatttcgagaacgatgttgaccaacgatggatcggatattcattcagctgtattgtcaaccattagaaagctcgaagatggctactttggaggggcgagggttaaactcggtaatttgtctgagtttcttaccacctctttctatacgtatctaacgtttttagatccggactgcgatgaaaaacttttcgataatgcttcggaaggcacgtttagtccagattctgattcggatcttgtgggatatttggaggatacctgcaaccaggagtcgcaggacgagcttgatcattatataaatcacttgttacaaagtacgtctctaagatcttacctgccaccgctctgcaagaatacagaagaccggcacgtctttagtgccatccattcaacccgtgatatactctcagttatggctaaagcaaaaggacttgaagttccattcgtgccaatgacactaccgactaaggttctatcagctcatcgaaaatcacttaatttggtagatagtccacaaccactacttgaaaaagttccagaaagcgattttcaatggccacgtgacgatcatggagatgttgactgcgagaaacttgtggaacaactcaaggattgctccaatctgcaggaccaagcggacatactatatattttatacgtaatcaagggcccgagttgggacactaatttgtcaggacagcacggagttacagtccagaatttgcttggtgaactctacggaaaggcaggattgaatcaagagtggggactcatacgttatatctccggtctcctcagaaaaaaagtagaggttttggctgaagcgtgtacggacctactttcccatcagaaacaattgacggtaggactaccaccagagccaagggaaaaaatcatctctgcaccattgccaccggaagagctcacgaaactgatctatgaagcatcgggacaagatatttcgattgctgtactcacacaggaaatcgtcgtctatcttgcaatgtacgttcgcgcacagccaagtttattcgtcgagatgctaaggctgagaattggcctgattattcaagtcatggctacggagcttgctcgatctttgaattgttcaggagaagaggcaagtgagtcccttatgaacctaagcccttttgatatgaagaatctgttacaccatattctttcaggaaaagagttcggagtagagagaagtgtccgtccaattcattccagtacttcctcgcctacgatctcgatacacgaagtcgggcacaccggagtaacgaaaactgagaggtctggaattaatcgacttaggtcggaaatgaagcaaatgacgcgaaggttctcagctgatgagcaattcttcagtgtgggacaggccgcgtcgtctagtgctcactcatcaaagtcagcccgttcatcgacgccaagctcgccaactggcacctcttcatcagattcaggtggacatcatattggatggggagagagacaaggacaatggctaaggcggagacgactcgacggcgctattaatagagtgccagtaggtttttatcagcgtgtatggaaaattttgcaaaagtgtcacggacttagtatcgacggctacgtattaccatcgagtacaacgcgtgaaatgactccacacgagattaagttcgctgtacacgttgaatcagttcttaatagagtaccgcaacctgaatatcgtcaactgctggtcgaagcaataatggtattgaccttactttcagatacggaaatgaccagtattggaggaattatacatgtggatcaaattgtgcagatggctagccagctttttttgcaggatcaagtgtcaattggcgcgatggatactttggagaaggatcaggccacaggcatttgtcattttttttatgattcagcaccaagtggtgcctatggaacaatgacttacctaacacgcgctgttgcatcttaccttcaggaacttttaccaaacagtggatgtcaaatgcaa

SEQ ID NO: 18081 - DNA, 3705 bp, Artificial Sequence
  Description of Artificial Sequence: Synthetic coding sequence
atgcgctccagaagtaattctggggttaggctggacggttacgccagattggtacagcagaccattctgtgctatcagaacccggtgacaggtctactgagcgcatcacacgagcagaaggatgcttgggttagagataacatatattctattctcgccgtgtggggcctcgggatggcctatcgtaaaaacgccgatcgcgacgaggataaagccaaagcctacgaactcgagcagaacgtggtgaaacttatgcgaggactactacaatgcatgatgcgccaggtggccaaggttgagaaattcaagcatacccagagcaccaaggatagccttcacgcgaaatacaatacagccacctgtggcacggtggtaggggacgatcagtggggtcaccttcaggtggacgctaccagcttatttcttctgtttctggctcagatgacagccagcggcctccgaattatattcacattagacgaggttgcctttatccagaacctggtgttttatattgaggccgcctataaggtagccgactacgggatgtgggagcgcggcgacaagacaaaccaggggatccctgagttgaatgcctcatcagtaggaatggccaaggccgccctggaagcaatagatgagctggacctcttcggagcccacggaggtcgaaaatccgtgattcacgttttaccggacgaggttgaacattgtcaaagcatcctgttttccatgttgccgcgagcatcaacaagtaaggaaatagatgctggcctactgtccataattagcttccccgcctttgcagtggaggatgtaaatttagttaatgtgaccaaaaatgagataattagtaagttgcagggccgatacggttgctgcagattcctgcgcgacggctataaaacccctagggaagatcccaaccgtttacactacgaccccgcagaactcaaactgttcgaaaatatcgaatgtgaatggccggtgttttggacatactttataatcgacggcgtcttttctggcgatgctgtccaggtccaggaatatagagaagcactggaaggtatcctaatccgaggcaagaatggcatccggcttgttcctgaactctatgcagtcccaccaaacaaggtggatgaagaatacaaaaatcctcatactgtcgatcgagtccctatgggcaaggtcccccacttatggggtcaatctttatacatactatctagcttgttagcggaaggctttctggctgccggggaaatagaccctctcaataggcgatttagtacctccgttaagcccgatgtggtcgtccaagttactgtacttgcagaaaacaatcacatcaaagatttacttcggaaacacggagtcaacgtgcaatccattgccgatattcaccctatccaggttcagcccggtcgaattctctctcatatttacgctaagctaggaaggaataagaacatgaacctgagcggaaggccctaccggcatattggtgtgctgggaacaagtaagctctacgttataagaaaccagatttttactttcacacctcagttcactgaccaacaccatttttatctggctctggacaatgagatgattgtggagatgttaaggatcgaactggcttacttatgtacatgttggcgaatgacaggtcggccaacgcttacgttccccatctcacggaccatgctgactaacgacgggtctgatattcatagtgctgtgctctcaaccattcgaaaattggaagatggatactttggcggggcaagagtcaaactggggaatctgagtgagtttctgactacatccttttacacttacctgacattccttgaccccgattgtgatgaaaagttatttgacaatgcatccgaaggcaccttctctcccgattctgattcagaccttgtgggttatttggaggatacctgcaaccaagagtcgcaggatgaactagaccattatatcaaccatctcttgcagagcacttccctccgtagctatctgcctcccttgtgcaagaatacagaggaccgccatgtgttcagtgccatccattccactcgcgatattctgagtgtaatggccaaagccaagggtctagaggttccattcgtgcccatgacgttgcccaccaaggtcctcagtgcccacagaaagagtctcaatctggtggacagtccacaacccctattggagaaagtgccagagtccgatttccagtggcccagggatgaccatggcgatgtggattgcgaaaagctggtagagcagcttaaggactgtagcaacttgcaggaccaggctgacattctttatatcctatacgtgatcaaggggccctcatgggatactaatctctccgggcagcacggcgtgacagtgcagaacctgctgggggagctatatggcaaggcgggattgaaccaagaatggggactcatacgttacatctcaggactcctgcggaaaaaagtcgaggtgctggcagaggcctgtaccgaccttctatctcatcagaaacagctcacagtcggactgccgccggaaccccgcgaaaaaatcatctctgctccattgccacccgaggaacttaccaagctgatctatgaggcctcaggccaggatatttccatagccgtgttaacacaggagatcgttgtgtacctggccatgtacgtgcgcgcccaaccaagcctgttcgtggaaatgctgcgtctgagaattggcctgattattcaggtgatggcaacggagttagcccggtccttgaattgtagtggagaggaggcatctgaatctttgatgaacctcagtccctttgatatgaaaaacctattgcatcatattctgtcggggaaagaatttggtgtggagcgcagcgtgcggccgatccactcatctacaagctctcccaccatcagcattcacgaggtcggccacaccggcgtgaccaaaaccgagaggtcgggtatcaataggctgcgcagcgagatgaagcagatgactaggcgctttagcgccgatgagcagttcttcagtgtcggacaggccgcctcgtccagtgcccattccagtaagagcgcccgttcaagtacaccctcctcgccaactggtacatcttcatccgatagtggaggtcaccatattggttggggagagcgacaagggcagtggctgagaaggcgtcgcctggatggagccatcaaccgcgtgcccgtgggcttttaccagcgggtctggaagatcctccaaaagtgccacggattgagtattgacggctatgttctaccatccagtacaactagggagatgacgccgcatgaaattaaattcgcagttcacgtggagtccgtactgaatcgggtacctcagcccgagtaccggcagttgcttgtcgaagcaattatggttctgactctcctgtccgataccgaaatgacatcaatcggcgggattatccatgtcgatcaaatcgtccagatggcctctcagctgttcctgcaggatcaggtgtcaataggagccatggacacactggagaaagaccaggcgacagggatctgtcactttttttacgactccgcaccctctggcgcttatggaactatgacctatcttacacgtgccgttgcttcctacctccaggaactcctgcccaatagtggatgccagatgcag

SEQ ID NO: 18082 - DNA, 3705 bp, Artificial Sequence
  Description of Artificial Sequence: Synthetic coding sequence
atgcgcagcagaagtaacagcggcgtgagactggacggatatgctcgcctggtccagcaaacaattctgtgctaccagaatcccgtgaccggcttattgagcgcatctcacgaacagaaagatgcatgggttagggacaacatttacagcatcctcgcagtatggggacttggaatggcctacaggaaaaacgccgaccgggatgaagacaaagcaaaggcctatgagctagagcagaacgtagtcaagctcatgcgcggactgctgcagtgcatgatgcgccaagtcgctaaagtggaaaagtttaaacatacacagtcgaccaaggattcactgcatgccaaatacaataccgcaacctgcgggacggtggtgggagatgatcaatggggccatctccaagttgatgccacaagcctgttcttgttattccttgctcagatgactgcaagcggcctcaggatcatcttcactctggatgaggtcgcatttatccaaaacctcgtgttttatatcgaagcagcatataaagtagctgattatggaatgtgggaacgtggggacaaaactaaccaaggaatcccagagctgaacgcttccagcgtaggaatggctaaagcagctctcgaggcaattgacgagttggatctgttcggggctcacggaggcagaaaatccgtcatccatgtgttgccagatgaagtcgagcattgccaatctatcttgttcagtatgcttcctcgggccagcacttcgaaggaaatcgatgctggtctgctcagtattatatcattcccggcctttgccgttgaagacgttaatcttgtcaatgtcaccaagaacgagattatctcgaagttacaggggaggtacgggtgttgccgctttctcagggacggatataaaaccccaagggaggatcccaacaggctccactatgaccctgctgaactcaagctgtttgagaacatcgagtgtgaatggcccgttttctggacctatttcatcattgacggagtttttagcggagacgcggtccaggtgcaagaatacagggaagctctggaaggcatccttatccgggggaagaatggcatccgtttggtgccggaactgtacgccgtgccccccaataaagtggacgaagagtacaaaaacccacacacagtggatagagtccctatggggaaggtcccacatctgtggggccagtcactctatatcctttcgagtctcctggcagagggcttcctggccgcaggggagatcgatcccctgaacaggagattctcaaccagtgtgaaaccagacgtggtggtccaagtgaccgtattagcagaaaacaatcatatcaaggatctgctccgaaagcacggggtgaacgttcagtctattgccgacattcacccaattcaggtccaacccggccgaatcctttctcacatctacgccaaacttgggaggaataaaaacatgaacctgtccgggagaccttacagacacattggcgtgctggggacttccaaactgtacgtgatccgtaaccagatatttacgtttacccctcagttcaccgaccaacaccacttctatttagctctcgacaacgagatgatcgtggaaatgctccgcatcgaattggcgtacttatgtacatgctggagaatgacaggtaggccgacactgacatttccaattagcagaaccatgcttaccaatgacggctcagacatacacagtgcggtgttgtccactatcaggaaactggaggacggctactttggtggcgcaagagtgaaactcgggaaccttagtgaattccttaccacttctttctacacataccttacatttctggatccggactgcgacgagaaactcttcgacaatgcttctgaaggaacatttagtcctgatagcgacagcgacctggtgggctatttagaagatacctgcaaccaggaatcacaagatgagctagatcattatataaatcatctgctgcaaagtaccagcctgcgaagctacctcccacctctgtgcaaaaataccgaggacagacacgtattttccgcaatccattctacccgagatatcctgagcgtaatggctaaggcaaaaggactggaggtgccattcgtacccatgacgctgcctactaaagtcctttccgcccacagaaagtcactcaaccttgtggatagcccccagccactgctggaaaaggtgccagagtccgactttcagtggcctcgcgacgaccacggagatgtagattgcgaaaagcttgttgaacagttaaaagactgctccaacctccaggatcaagctgacattctgtacatcttgtatgtgataaagggaccctcttgggataccaatctctcaggccaacacggcgtgacagtgcagaatctgctcggggagttgtatggcaaagccgggcttaaccaagaatggggattgattaggtatatcagcggactcctccgcaaaaaggtagaagtactggccgaagcttgcacagatctgctcagtcaccaaaaacagcttaccgtcgggctgccccccgagcccagggaaaaaatcattagcgcaccgctcccacccgaggagctgactaaactgatctacgaggcctccggccaggatatctcgattgcagtgttgacccaggagatcgtggtatacctggctatgtacgtgagagcccagccaagcctgttcgtggagatgcttagactgaggattgggcttatcatacaagttatggccactgagttggctaggagtctgaactgttccggtgaagaagctagcgagtctcttatgaacttgtcaccctttgatatgaagaatttgctgcaccacatcttgagcggaaaagaattcggagtcgagcggagtgtccggccaatccattcaagtacaagcagccctacaatctctatccacgaggtgggtcacaccggcgtgaccaagacagaaagatcgggaatcaacaggttgcgttctgagatgaaacagatgacacggcggtttagtgctgatgagcagtttttttctgtaggccaggccgcttccagttctgcccactcaagtaagtcggccaggtcatctacgccaagctcaccgaccgggactagctcgtcagattcaggcggacaccatattggatggggggaacgccaaggacagtggcttaggagaagacgcctggatggagctatcaatcgcgtccccgtcggattctaccagcgcgtctggaaaatccttcaaaaatgccatggccttagcatcgacgggtatgtactgcccagttccaccacccgcgagatgaccccacacgagatcaaatttgcagtccacgtggagtccgtgttgaatagagttccacagccagaataccgtcaacttcttgttgaggccattatggtgcttacccttctgtctgacaccgaaatgacctctattggaggaattatccacgttgatcaaattgtgcagatggcttcacaactgttcctgcaagatcaggttagtatcggagccatggatactcttgaaaaggatcaggcgactgggatctgccacttcttttacgattcagcgcctagtggggcttacggcactatgacatacttgactcgcgcagttgcgtcttatctgcaggaattgttgccaaacagcggatgtcagatgcag

SEQ ID NO: 18083 - DNA, 3705 bp, Artificial Sequence
  Description of Artificial Sequence: Synthetic coding sequence
atgcggagccggagtaactccggtgtcagactcgacggttacgcccgccttgtccaacaaaccatcctgtgttaccagaaccctgtcactggactcctgagcgcatcgcacgaacaaaaggatgcatgggtccgagacaacatttactcaattctggctgtgtgggggctgggtatggcgtaccgcaagaacgccgaccgggatgaggataaggcaaaggcctatgaactggaacaaaatgtcgttaaactgatgcgaggtcttttgcagtgtatgatgcgacaggtggctaaagtggagaaattcaagcatactcagtccaccaaggacagcctgcatgcaaagtacaacactgcaacgtgtggtactgtggtcggagatgatcagtggggtcacctccaggttgatgcaacgtccctttttcttctgtttctggcgcaaatgacggcttccggcctccggatcatctttacccttgacgaagtggcatttatccaaaacctcgtattctacattgaagcagcctacaaggtggcagactacggtatgtgggagagaggtgacaagaccaaccagggcatccctgagctgaacgccagctccgtcggaatggcaaaggcagcgcttgaggcaattgatgaacttgatctctttggggcacacggtggacgtaagtccgtgatacatgtcctgcctgatgaggtggagcactgccaatcgattcttttttcgatgcttccaagagcgagcacctcaaaggaaatagacgccggcctgctgtccatcattagctttccagcgttcgcggtcgaagatgttaatctcgtcaacgtcacgaagaatgagatcatatcaaaacttcagggccggtacggttgctgccgtttcctcagagatgggtacaagactccaagagaagatccgaaccgccttcactacgacccggctgaactcaagttgttcgagaatatcgaatgtgaatggcccgtgttttggacttacttcattatagatggcgtttttagtggagatgccgttcaagtgcaagagtacagagaagcacttgaaggtatcctcatacgcggcaaaaatggcataaggcttgtgcctgagttgtacgcagtgccccccaacaaggtcgatgaagaatacaaaaaccctcataccgtcgatagggtccctatgggcaaggtgccccatctgtgggggcagtcgttgtacatcctgtcctcacttctggccgaaggatttttggcggccggtgaaattgacccccttaatcgcaggttctcaacttcggtgaagcctgacgtggtcgtgcaggtgacggtgcttgcagagaataaccacattaaggatcttctgaggaagcatggagttaacgtccagtcaatcgcagacatacaccctattcaggtgcaaccgggcagaatcctgtcacatatctacgcaaagctgggcagaaataagaacatgaatctgagcggaaggccttaccgccatattggagtgctggggacttcgaaactgtatgtgattagaaatcagattttcacttttactccccagtttaccgatcaacatcatttctacctcgcgctggataatgaaatgatcgtggaaatgcttcgcattgaactggcttacctttgtacctgctggcggatgactggtcgacctactctcactttccctatttcccgtaccatgttgaccaatgatggatccgatatccactccgcagtgctgtccactattaggaagctggaggacggttactttggtggggcccgggttaaactcgggaatctgtcagaatttcttaccacctccttctacacctacctcacttttctggatccggattgcgatgagaaactctttgataacgcgtccgagggtaccttttcccctgattccgactcagatctggtgggataccttgaggacacctgtaaccaagaaagccaagacgagctggatcattacatcaaccacttgcttcaatcgaccagcctcagaagctatttgccacccctttgcaaaaacaccgaggatcgacatgtgttttcagcaattcatagcacgcgcgacatcttgtctgtcatggcaaaagcaaaggggctggaagttccatttgtcccaatgactctgccaactaaggtgttgtcggcacatcgcaaatcactgaatcttgtggattcgcctcaacctcttctggaaaaggtccctgaatccgatttccagtggcctcgggatgatcacggagacgtggactgtgagaaacttgttgaacaacttaaggattgcagcaaccttcaagatcaagctgatatcctgtatattctgtacgtcatcaaaggccctagctgggacaccaacctcagtggtcagcacggagtgacggtgcaaaacctcttgggggaactttacggaaaggccggtctgaaccaggagtgggggcttattcgatacataagcggattgcttcgcaagaaagtggaagtgttggcagaagcatgtactgaccttctgtcacatcagaagcaactgactgtgggactgcctcctgagcctcgcgagaagatcatttcggcgcctcttccaccggaggagcttactaaactcatttatgaggcctcaggacaggacattagcatcgccgtgctcacccaagaaatcgtggtctacctcgcaatgtatgtccgggcacaaccttccctctttgtcgaaatgctgcggctccgtattgggctcattatccaagtgatggccaccgaactcgcgagatccctgaattgttcgggtgaagaagctagtgaatcattgatgaacctgtcgccgtttgatatgaaaaacctgctccatcatattctttcggggaaggaatttggagtggaaaggagtgtcaggcctattcacagcagcacctcgagccccaccatttcaatacatgaagtggggcacactggggtgactaagactgagaggtctggcattaacagactcagaagcgaaatgaaacaaatgaccaggcgctttagcgctgatgagcagttcttttccgtggggcaagcagcatcctcgtccgcgcatagctccaaatccgcccgatcgtcaacgcctagctcccctaccggcacctcgtcctccgactcggggggccaccatattggatggggcgaaagacaaggacagtggctgcgaagaaggagacttgatggagccataaaccgtgtgcctgtcggcttctaccagcgagtgtggaagatcctgcaaaagtgtcatggactttcgatagatggatacgtgctgccaagctccaccaccagggaaatgaccccgcacgaaatcaagttcgcagtacatgtggaaagcgtgctgaaccgggtccctcagcctgaatacagacaacttttggtcgaggctatcatggtgctgactcttctctccgacaccgaaatgacctcgattggaggaataatccacgtcgatcagattgtgcagatggcctcacagttgtttcttcaggatcaagtcagcattggtgcaatggacactcttgagaaggatcaggcaacggggatttgtcatttcttttacgattctgcaccatcgggcgcgtacgggactatgacttacctcaccagggccgtggcatcttacctgcaagaactgcttcctaattcaggttgtcaaatgcag

SEQ ID NO: 18084 - DNA, 3705 bp, Artificial Sequence
  Description of Artificial Sequence: Synthetic coding sequence
atgaggtccagaagcaacagcggagtgaggctggacgggtacgcgaggttggtgcagcaaaccatcctatgttaccagaatccagtcaccggccttcttagcgctagtcatgagcaaaaagacgcttgggtgagggataatatttattcgatccttgcagtctgggggttagggatggcatatcgtaaaaacgctgatcgagatgaggataaggccaaagcatacgaacttgaacaaaatgtcgtcaaactaatgagaggacttcttcagtgtatgatgcgccaagttgcaaaggttgagaaattcaaacatacccagtcaactaaggatagcctgcacgccaaatataacacagcaacctgtggcactgtggttggagacgaccaatgggggcatctacaagtggacgcaacctccctgttccttcttttcctggcccagatgaccgcgtctggacttaggattatctttaccttggatgaagtcgcctttatccagaaccttgtcttctatattgaagctgcttacaaggttgccgattacggaatgtgggagagaggagacaaaaccaatcaagggattcctgaactgaacgcctctagcgttggaatggctaaagccgctctggaggcaatcgacgagctggatctctttggcgctcacggcgggaggaagtctgtgatacacgtcctcccggacgaggtcgagcattgtcagagcatactttttagtatgctgcctagggcgagcacatctaaagagattgacgccggcctgctttctatcattagctttccagcattcgccgtggaggacgtaaacctcgtcaacgtgaccaaaaacgagataatcagcaaactgcagggacggtacggatgttgcagatttctgcgcgatgggtacaagacccctcgcgaagacccaaacaggctgcactacgacccagccgagctgaaactctttgagaacatcgagtgcgagtggcctgtgttttggacatattttatcatcgatggcgttttcagcggcgacgctgtgcaggtccaggaatatagagaggctctcgaaggaattttgatcagagggaagaatggaatcagacttgtgcccgagctgtatgctgtgcctccaaacaaagtcgacgaagagtacaaaaacccccatactgtggatagagtgccaatggggaaagttcctcatctctggggacagagcctgtacatcctgtcttctctcctggcagagggcttccttgctgcaggcgaaatcgaccctcttaataggaggttctccacttctgtgaaacccgacgttgttgtccaggttactgtgcttgctgaaaacaatcatatcaaagatctcctgagaaagcacggcgtcaacgtacaatctatcgctgatattcaccctatacaagtccagcctggacggatactcagtcacatctacgcgaagttgggtcgaaataagaacatgaacctgagcggtcgtccgtacaggcatattggcgtcttgggaacatcaaagctgtacgtgattcgcaatcaaatcttcactttcacgccacaattcaccgatcagcaccatttctacctggctcttgataacgagatgatagtggagatgctccgcatcgagcttgcgtacttatgcacctgttggcgcatgaccggcaggcctacattgacctttcctatctctcggactatgctgacaaacgacggaagcgacatacacagcgccgttctgagcaccattcgcaagctggaggacgggtactttgggggggctagagttaagctggggaatcttagcgaatttctgactacatccttttacacctacctcacctttctggacccagattgcgacgaaaagctgtttgataatgctagcgagggcacattcagcccagatagtgacagcgaccttgtgggttatcttgaagacacgtgtaaccaagagtcccaagacgaacttgatcactacatcaatcatcttctccagtccacgtcccttcgcagttaccttcctccgctgtgcaagaataccgaggataggcatgtttttagcgcaatccacagcaccagggacatattgtccgtcatggcgaaagctaaaggcctggaggtgccatttgtgcctatgacccttcccactaaagttttgtcagcccatcgcaagagtcttaacctcgttgactctccccagccactcctagagaaggtcccggaatcggactttcagtggccacgtgatgatcatggcgatgtggattgcgagaaactcgttgagcagctcaaggactgctctaacttgcaagaccaggctgatatactatacatcctctacgtgattaaaggcccctcctgggacaccaacttgagtggacaacacggggtcaccgtccaaaacttgctcggtgaactctacggaaaagctggcctgaaccaggaatggggacttatcaggtatatctctggtcttctgaggaagaaggtcgaggtgctcgccgaagcctgcaccgatctactgtcacatcaaaagcagcttacagtgggactgccccccgaaccacgcgaaaaaataatttccgccccattgcctcctgaagaattgaccaaactcatctacgaggcatcgggtcaggacatttctatcgctgtactgacccaagaaatcgtagtatacctggctatgtacgtgcgtgcacagcctagcctgttcgtggagatgctccgtctcagaatcgggctgatcatacaagtaatggcaactgagctggccaggagcctcaattgctctggcgaggaggcaagtgagagtttgatgaatctttcacctttcgacatgaagaatctgctccatcatattttgtcaggtaaggagttcggagtggaaagatctgtgagacccattcacagcagtactagctcaccaacaatcagcatccatgaagtaggacatacaggagtgaccaaaaccgagaggagcggaatcaaccgcctgcgcagtgagatgaagcagatgaccaggaggttcagcgctgatgagcaatttttttctgtgggacaagctgcatcatctagtgcccatagcagcaagagcgcacgcagcagcacaccctcctccccgaccggcactagttccagcgacagtggaggtcaccatatcggatggggcgagcgccagggccagtggctgagaagaaggcggcttgacggggccatcaaccgagtaccagtcgggttctatcagcgagtctggaaaattcttcaaaagtgtcatggcctgagtatcgacggctacgtgcttcctagctctacgactagggagatgactccacacgaaattaaatttgctgtgcacgtggaatcagttttgaacagagtcccgcagcctgaatacagacagctgcttgtggaggctattatggtgttgactcttctgagtgacaccgaaatgacgtctattggcggaatcatccatgtggatcagatcgtgcagatggcatcccagctgtttctgcaagaccaggtttccattggagcaatggacaccttagagaaagaccaggcaactggaatatgtcactttttttatgatagtgctccgtccggcgcttacggcacaatgacctaccttacgcgggctgttgcttcctatctccaagagctgcttccgaactccgggtgtcaaatgcaa

SEQ ID NO: 18085 - DNA, 3705 bp, Artificial Sequence
  Description of Artificial Sequence: Synthetic coding sequence
atgcgcagcagaagcaactccggagtccggcttgatggatacgctagacttgtgcaacaaactatactttgctaccaaaacccagtcaccggtttgctgtcggcctctcatgagcagaaggacgcatgggtccgcgacaacatttacagcatactcgcagtgtggggtctgggcatggcatacagaaagaacgccgaccgcgatgaggacaaggcgaaggcatacgaactcgaacaaaatgtggtgaaactgatgagaggtttgctgcaatgcatgatgagacaagtggcaaaggtggagaaattcaaacatacccagtcaaccaaggacagccttcatgcaaagtacaacaccgcaacgtgtgggactgtggtgggagatgatcaatggggtcacctgcaagtggatgcgacgtccctctttctcttgttcttggctcaaatgactgcatcggggctcagaatcattttcactcttgacgaagtcgcgtttatccaaaaccttgtgttctacatcgaggcagcatataaggtcgcggactacggtatgtgggaacgtggtgataaaaccaaccagggaattccagagttgaacgcctcgagcgttggcatggccaaggctgcccttgaagctattgatgagctcgatctttttggtgctcacggaggtcggaagagcgtgattcatgtcttgcctgacgaagtcgaacattgtcagagcatcctcttcagcatgctgccacgtgcatcgacctcgaaggaaatagacgctggattgctttcgattatctcgtttccagcatttgcggtggaagatgtcaaccttgtgaacgtcaccaaaaatgaaatcatttcgaagttgcaaggaagatatggatgctgtcgattcctcagggatggatacaagacccctcgggaagatcctaatcgactccattacgaccctgccgaactcaagctgtttgaaaacattgagtgcgaatggcccgtgttctggacttacttcatcatcgatggagtcttttcgggagatgccgtgcaagtgcaggaataccgcgaagcactggagggcattcttatcagaggtaagaatggaattagactcgtgccggaactgtatgccgtcccaccaaacaaggtcgatgaagagtacaaaaatccacataccgttgaccgcgtcccaatgggtaaagtcccacatctgtggggtcaatccctgtacatcctgtcctcgcttctggcagaaggctttctggccgcaggcgaaattgatcctcttaatagacggttctcgacttccgtgaagcctgatgttgtcgtgcaggtcactgtgctggcagaaaacaatcacatcaaagacctgcttaggaagcacggtgtcaacgtgcaaagcattgctgatatccatccgattcaggtgcagcccgggcggatcctttcgcacatctacgcaaagctgggccgtaataagaatatgaacctgtccggaaggccctacagacacattggtgtgctcggtaccagcaaactctacgtgatccgcaaccagatattcacgtttacgccgcaatttactgaccagcatcacttttacctggcattggataatgaaatgattgtggagatgcttaggattgaacttgcgtacctttgtacttgttggcgaatgaccggacggccgaccctgacgtttcccatctcgcgtaccatgctgactaacgatggctcggatatacattcggcggtcctttctactattagaaagttggaggatgggtacttcggtggcgccagagtcaaacttggtaatctgagcgagtttttgactaccagcttttacacttatctcaccttcctggaccccgattgtgatgaaaagttgtttgataacgcctccgaaggaacctttagccctgactcggactcagacctcgtcggatacctggaggatacctgtaaccaggagtcacaggatgaacttgaccattacattaaccacttgctgcagagcacgtcgctgcgctcctacctcccacccctctgtaaaaacacggaggacagacacgttttctcggcaattcactctactcgggatattctgagcgtaatggcaaaggccaagggacttgaggtgccgtttgtgcctatgacgctgccaaccaaggtcttgagcgcacataggaagtccctcaatcttgtggattcgcctcaacctctgcttgaaaaggtgccagaatccgattttcagtggccacgcgatgatcacggagatgtggactgtgagaaacttgtggaacaacttaaggattgctcaaaccttcaagatcaagccgatatactctacatcctgtacgtgattaagggcccttcatgggatactaacctcagcggccaacacggagtcacggtccagaatcttctgggagagctgtacggtaaggcgggactgaaccaggagtggggccttatccggtacatctccggattgcttagaaagaaagtagaagtcctggctgaggcctgtacggacctcctttcacaccaaaagcaactcaccgtgggactcccgcccgagcctcgggagaaaatcataagcgctcctttgcctccagaggaactgacgaagctgatctatgaagcatcgggacaggatatatccatagcagtgctgacccaagaaatcgtggtctacctcgccatgtacgtgcgcgcacagccttctctttttgtggaaatgttgcgactgcggatcggattgattattcaagtgatggccactgagcttgccagatcacttaactgctctggtgaagaagcatcagaatcgttgatgaacctttcccctttcgatatgaaaaatctgcttcatcatatcctttctgggaaggaatttggcgtggagcgatccgtgcggcctattcattcatcaacctcgtcccctactatcagcattcatgaagtcggccataccggtgtcaccaaaactgagcgttcgggaatcaatcgcctgcgttccgagatgaaacagatgactcggcggtttagcgcggatgagcagttcttttccgtcggtcaagcggcaagctcctccgcacattcatccaagtcagcacgctcctctaccccatcgagccctactggaacttccagctccgactccgggggacaccatatcgggtggggagaacgccagggccaatggctgcgtcgcagacgcttggacggtgccataaaccgggtgcccgtgggattttaccagcgagtctggaaaattctccagaagtgccatggcctttccattgacggatacgtgttgccctcgtcgactaccagagaaatgactcctcatgagattaagtttgccgtgcacgtggaatcggtgctgaatagagtgccgcagcccgaataccggcaactcctggttgaggcaattatggtgctgacccttttgtctgatactgaaatgacttcgattggcggcattatacatgttgatcagatcgttcagatggcgagccaattgtttctgcaggatcaggtgtcgattggcgccatggacaccctggaaaaggatcaagcaaccggaatttgtcatttcttctacgactcagctccatccggtgcctacggcactatgacttacctcacccgggctgtggcatcttacctgcaggagctgctgcccaacagcggatgtcaaatgcag

SEQ ID NO: 18086 - DNA, 3705 bp, Artificial Sequence
  Description of Artificial Sequence: Synthetic coding sequence
atgcgctcacggagcaactccggagtgcgtttggacggttacgcgagactcgtgcaacaaactattctttgttaccaaaaccctgtgacgggtctgctctctgcgtcgcacgaacaaaaagacgcctgggtccgcgacaacatttactccattcttgcagtgtggggacttggaatggcctaccgcaaaaacgccgatcgggacgaagataaggcaaaggcatacgaactggaacaaaatgttgtgaagctgatgcgtggactgcttcagtgcatgatgagacaggtggcaaaagtggaaaagttcaagcatacccagtcaactaaagatagccttcacgcaaagtacaacaccgcaacctgtgggactgtcgtcggggacgaccagtggggacatctccaggtggatgcaacctcattgtttctgctctttcttgcgcagatgaccgcttccgggctgaggataatctttactctggatgaggtggccttcattcagaacctggtgttctacatcgaggccgcttataaggtggcagactacggtatgtgggagagaggcgacaagaccaatcaaggcattcccgaacttaacgcgagctcagtgggaatggcaaaggccgcacttgaagctattgatgaacttgacctttttggcgctcatggcggccggaaatcagtgatccatgtccttccagacgaggtcgaacactgccaatccatccttttctcgatgctgcctagagcgagcacttcaaaggaaattgacgcaggcctgctgagtatcatttcatttcccgcctttgcagttgaagatgtgaaccttgtcaatgtgacgaagaatgaaatcatttcgaaactgcaggggagatacggctgctgccgtttccttcgggatggctacaaaaccccacgggaagatccgaatcgccttcattacgatccagcagagctgaaacttttcgaaaacattgagtgcgagtggccggtcttttggacctactttatcatcgacggtgtgttttccggagatgccgtccaggtgcaggaatacagagaagcactggagggaatcctcataagaggtaaaaacggtattaggctggtgcctgaattgtacgcagtccctcctaataaggtggatgaggaatacaagaacccccacaccgtggacagagtgcccatgggaaaggtcccgcatctctggggacaatccttgtacatcctcagctcccttctggcagagggatttcttgctgccggtgagatcgaccctctgaatcgacgattttcaacctccgtcaagcctgacgtggtggtgcaagtcactgtccttgcagagaacaatcacattaaggacctgttgcgcaagcatggcgtgaacgtgcagtctattgcagatatccatccaatccaagtgcaacccggcagaattctttcgcacatatacgcaaaacttggacgaaacaagaatatgaatctttcaggcagaccttaccggcacatcggagtgctcggcaccagcaagctgtacgtcatccgcaatcagattttcacttttacgccccagtttactgatcaacatcacttttacctcgcacttgataacgagatgattgtcgagatgttgcgcatcgaactggcctatctttgtacctgctggcgaatgaccgggcgtcctactctgacctttcctatctcaaggactatgctcaccaacgacggatccgatatacactcggccgtcctgtccaccattcggaagctggaagatggttactttggaggagcgagagtgaagctcggaaacctgtccgaattccttactacttcgttttacacctaccttacttttctcgacccagattgtgacgagaagctctttgataacgcatcggaaggaactttctccccggattcagactcagacctggtgggctaccttgaggacacctgtaatcaagagagccaagatgagttggatcactacattaaccatttgctgcaatcaacctcacttagatcgtacctcccacctctttgcaagaataccgaagatcgtcatgtgttcagcgcaatacattcaacgagagacattctctccgtcatggcaaaggcaaaaggactggaggtcccattcgtgccaatgactttgcctaccaaggttctttcagctcatagaaaatcactgaacctcgtggactcgcctcagccactgctcgaaaaggtgcctgaaagcgattttcagtggccacgtgatgatcatggagacgtggattgcgagaagctcgttgaacagcttaaagattgcagcaatcttcaagatcaagcagatatactctacatcctgtacgtgattaagggaccatcctgggatactaacttgagcggccaacatggagtgactgtccagaatctgctgggggaactctatgggaaggcgggacttaatcaggaatggggattgattcgatacatttcaggacttctccggaagaaggtggaggtgctggcggaagcatgtactgatctcctttcgcaccaaaaacagcttaccgtgggtctgccaccagagcctagggagaagatcatttccgctccactccctcctgaggaattgaccaagttgatttacgaagcatccggtcaggatatttctattgctgtcctgactcaggaaattgtggtctacctggcgatgtacgtgcgggcacagccgagcctctttgtcgagatgctgcgtcttagaattgggctgattatccaggtcatggcaactgaattggctcggtcgctgaactgttcaggagaagaagcgtcagaatcgctgatgaatttgagcccttttgatatgaagaacttgctccatcacattcttagcgggaaagaatttggagtcgaaaggtcagtgcggccaattcatagcagtacctcgtcacccactatatcaattcacgaagtgggacacactggcgttactaaaaccgaaagatcgggaataaaccgtctgaggtcagagatgaagcagatgacccgccggttttcagcagatgaacagtttttctccgttggtcaagcagcctcgtcatctgcacactcctcaaaatcggcacgaagctccactccatcatcgcccaccggaacttcatcgtcggattcaggcggacatcatataggttggggcgaaaggcaaggtcagtggcttcggagacgacgcctggatggtgcgataaacagagttcctgtgggattctaccaacgtgtttggaaaattctgcagaaatgtcatgggttgagcatcgatggatacgtccttcccagctcgaccactcgcgagatgactccccacgagattaagtttgccgtgcatgtggagagcgtgcttaatagagtgccacagcctgaataccggcagctgctcgtcgaggcaattatggtgctgactttgctttccgatactgagatgaccagcattggaggcattatccatgtcgatcaaattgtgcagatggccagccagctgttccttcaggatcaagtgtccattggagcaatggacaccctggaaaaggaccaagcaaccggaatctgtcacttcttttacgactccgcaccatcgggagcatacgggaccatgacctatctcaccagagcagtggcgtcttacctccaggagctccttcccaactcgggatgccaaatgcaa

SEQ ID NO: 18087 - DNA, 3705 bp, Artificial Sequence
  Description of Artificial Sequence: Synthetic coding sequence
atgagatcccgcagcaacagcggagtgcggctggatggctacgcacgcctcgtacaacagactatcctgtgctaccaaaaccccgtcacaggactcctctccgccagccacgagcagaaggatgcatgggttcgcgacaatatttattctatcttggccgtttggggtctgggaatggcataccgcaaaaacgccgacagggacgaggataaggctaaggcctatgagcttgaacagaatgtagtaaaactcatgcgaggactgcttcaatgtatgatgcgccaggtcgctaaggttgaaaagtttaagcatactcagtcaacaaaagactctcttcacgccaagtataatactgccacatgcggcaccgtggtcggagacgaccagtggggtcacctccaagtggacgctacatcactgttcctcctgttcctggcccagatgaccgccagcggcctgagaattatttttacacttgatgaggtggccttcatccagaatctcgtgttttatattgaggctgcttacaaagtggctgattacgggatgtgggaacggggggataagacgaatcagggtattccggaactcaatgcctcttccgtgggaatggccaaggctgctctcgaagccattgatgagttggacttgttcggagctcatggtggacggaaatcagtcatccacgtgcttccagacgaagtggaacactgccagtcaatactcttttctatgctgccacgcgccagtacaagcaaagagatcgacgcgggcctcttgtccattatcagcttcccagcttttgccgttgaagacgtgaatctggttaacgtgactaagaacgagattatctcaaaactgcagggccggtacggctgttgtcgctttcttagagacggatataagacgccacgggaagatcccaataggctgcattatgacccagctgagctgaagcttttcgagaacattgaatgcgaatggcctgttttctggacttacttcatcatcgacggagtcttcagtggcgatgcggtgcaggttcaggaataccgagaggcactcgaaggtatattgattagaggaaagaatggaatccggctggtcccagagctttatgctgtcccgcccaataaagttgatgaggagtacaaaaatcctcacacggtagatagagttccgatgggaaaagtgccccacctgtggggtcaaagcctctacatactgagtagtcttctggcagaaggcttcctggctgccggggagattgaccccctgaatcgcagattttccacatccgtcaaaccagacgtggttgtccaggtgactgtgctggccgagaataaccacatcaaggatctcctgagaaagcatggggtcaacgtccaaagcattgccgatatccacccgatccaggtgcagcccggcagaatcctctcacacatctatgccaaactcggcagaaacaagaacatgaacctctccggcaggccatacaggcatattggagtactgggtactagtaagctgtatgtaatccgcaaccagatatttacgtttaccccacagtttaccgaccagcatcacttttacctggcactggacaacgaaatgatcgtggagatgcttaggattgaactcgcctacctgtgcacttgctggcgcatgaccggcagaccgaccctgacattccccattagtaggacgatgctcactaatgatggaagcgacatacattctgcggttctgtcaactatccggaagctggaggacgggtactttgggggggctcgagtaaagctggggaatctgagtgaattcctgacaactagtttctatacatatctgactttcttggaccccgattgtgacgaaaagctgtttgacaatgcttctgagggcacatttagtcctgattccgacagcgatctcgtcggctacctggaggatacatgcaaccaggaatctcaagacgagttggaccattatataaatcatcttttgcagtccactagcctcaggtcttacttgccccccctctgcaagaacacagaagacaggcacgtgttttcagcaatccactctacgcgcgacattctgtctgtcatggcaaaggctaagggacttgaggtgcctttcgtccccatgacgcttcctacgaaggttctgtccgcgcaccggaagagtcttaacctggtagattctccccagcccctcctggagaaagtccccgagtctgactttcagtggccacgggatgatcacggggacgttgactgcgagaagctggtcgaacagttgaaggactgttcaaatctccaggatcaggccgatatcctgtacatactctacgtgattaagggccccagctgggatacaaacttgagcgggcagcacggtgtgaccgtgcaaaacttgttgggcgaactctatggcaaggccgggctgaatcaggaatggggcctcatcagatacatatccggcttgcttcgcaagaaggttgaagtgctggctgaggcctgtaccgatctcctgagtcaccagaagcaattgactgtgggacttcctcccgagccaagggagaagattatcagtgcaccactgccacccgaagagctgacgaagttgatctacgaggcctccggacaagacatatcaatagccgtcctgacacaagaaattgtggtgtatctggcaatgtacgtgcgggcccagccatctctctttgtggagatgctccggctgagaattggtctcattatccaggtgatggctaccgagctcgcaagatcattgaactgttctggggaggaagctagtgagtccctgatgaatctgagtccgtttgatatgaaaaatctgctccaccatatactgagcggcaaggaattcggagtggagagatctgttcgaccgatacacagctctacatcttcccccacaattagcatccatgaagtcggacatacaggagtgacaaagacagagcgctccggtatcaacagactgaggtccgagatgaaacaaatgacccggcgattcagcgcagatgaacagtttttttccgtgggccaggccgcatcatcaagtgcacacagcagtaaaagcgctagaagcagcactccaagctctcctaccgggacctcaagcagtgattcaggaggacatcacattggatggggcgaaagacaaggccagtggttgagacggcgaaggctggacggcgctattaaccgagtgcctgtggggttttaccagagggtgtggaagatccttcagaagtgccatgggttgtccatcgatgggtatgtcctgcccagctcaaccaccagggaaatgactccgcacgaaatcaagttcgctgtacatgtcgagtcagtcctgaaccgcgtgccgcagcctgagtaccgccagcttctggtggaagcaattatggtgctcaccctcctgagcgacaccgaaatgacttctatcggcggcataatacacgtcgaccagattgtgcagatggcatctcagctctttctgcaggaccaggtctccatcggggctatggataccctcgaaaaggaccaggcaacaggcatttgccactttttctatgactcagcgccgtctggggcatacggtaccatgacctatctgacgcgggccgttgccagttacctgcaagagctgctgcccaacagtggatgccagatgcag

SEQ ID NO: 18088 - DNA, 3705 bp, Artificial Sequence
  Description of Artificial Sequence: Synthetic coding sequence
atgcggagtagatcaaattccggtgtccgattggatggatatgcccgactggttcaacaaaccatcctatgttatcagaatcctgtgacaggtcttttgtcagcctctcatgagcagaaggatgcctgggtcagggacaatatctatagtattcttgcagtgtggggattggggatggcttatcgtaaaaacgctgatagagacgaagacaaagcaaaagcatacgaattggagcagaacgtggtgaagctcatgagaggacttttgcagtgtatgatgcgtcaagtagctaaagttgagaagtttaagcatacacaaagcaccaaggatagtctccacgctaaatataataccgctacttgcgggacggtggtaggagatgatcagtggggccatttacaagttgatgctactagcctctttcttttgttcctcgcacaaatgacggcttccggccttagaataatctttaccctcgacgaagttgcctttatacagaacttggttttctacatagaagctgcttacaaggtcgcggactatggtatgtgggaacgtggtgataagaccaatcaggggattcctgaattgaacgctagctcagttggaatggcaaaggcagcacttgaagccatcgatgaactcgatctctttggggctcacggtggaagaaaatctgttattcacgtccttcctgacgaagttgagcattgccagtctattctcttcagcatgcttcctagagcatcaacctccaaggaaattgatgcgggattgctatcaattatttctttccctgctttcgctgtcgaagatgtgaacttggtaaacgttaccaaaaatgagatcattagcaaacttcagggtcgatacggctgttgtcgttttcttagggatggatataaaaccccaagagaagaccctaatcgcttgcactatgatccggcagagttgaagttatttgagaatatcgagtgtgaatggcccgttttctggacgtacttcattattgatggtgtcttttccggcgacgcggtccaagtacaagagtacagggaagctcttgagggtattttgatcaggggtaagaatggtattaggcttgtcccggaactctatgctgtccccccgaacaaggtggatgaagaatataaaaatcctcatacggttgatcgggttcccatgggaaaggtccctcatctgtgggggcagtctctctatattttgagttcactgctggccgagggtttcctggccgctggggaaattgatcctttgaatcgtaggttctccacttctgttaagcccgacgtggtcgttcaagtaactgtccttgctgagaacaaccatattaaagatctcctcaggaaacacggagttaacgtacaaagcatcgcagatattcatcctattcaggttcaacctgggcgtattttgtctcatatatatgcaaagctcggacgcaataaaaacatgaaccttagcggaagaccatacaggcatattggtgttttaggtacaagtaagttatatgtgatccgaaatcaaatatttacttttactccgcagtttacagatcagcatcatttttatttggctttggataatgagatgatcgtggaaatgctcaggatcgaacttgcgtacttgtgcacctgttggcgtatgaccggtcgaccaactcttacctttcccatctcccgtacaatgttgactaatgatggctctgatattcattcggctgtactttccacaattcgaaagttggaggatgggtattttggtggagccagagttaagctcgggaacttgtctgaattcctcacgaccagtttctacacttacctgaccttcctggatcctgattgcgacgagaagctttttgataatgcctctgaggggacatttagcccagactctgactccgacctagttggttatctagaggacacatgcaatcaggaaagtcaggatgaactcgatcattatattaaccatcttctacaaagcacatcactcaggtcttacttaccaccgctctgcaagaatactgaagatagacacgttttctcagcaatacattctacacgggatatactgtctgttatggccaaagctaagggcttagaagtcccttttgttcctatgactcttccgactaaagtactctctgctcatcgcaagtcacttaacttggtggatagtcctcaacctttgcttgaaaaggttcctgagtccgattttcagtggccaagggatgaccatggggatgtcgattgcgagaagttggttgagcagctgaaggattgttcgaatttacaggatcaggctgacattctctacatactttacgtgataaagggcccaagttgggacactaacttgagcggacagcatggtgttaccgttcagaaccttcttggagagttgtatgggaaggcaggactcaaccaagaatggggtttgattcgttacattagtggcctcctgagaaagaaagttgaagttctagccgaggcatgcactgacttgctttcccatcaaaagcaactcacagtggggttgcctcctgaacctcgggaaaaaattatttctgccccactacctcctgaggagttgaccaagctgatctacgaagcttccgggcaagacatctctattgcagtcttgacccaagagatcgtggtatacttagctatgtatgttagggctcagccaagcctgttcgttgaaatgttgcgccttcgcataggtcttatcatacaggtgatggccacagaacttgctcggtccctcaactgctcaggagaggaagccagcgaatctctaatgaacctcagccccttcgatatgaaaaaccttcttcaccatattctttcaggtaaggaatttggagttgagcgatcagttaggcccatccactcatctacaagttctcctactattagcattcatgaagtaggtcatactggagtaacaaagactgaacgtagtgggatcaaccgtcttcgttccgagatgaaacaaatgaccaggaggttttctgctgacgaacaattcttcagcgttggccaagcggcatcctcctctgcacatagcagtaagtctgccagaagttcaacgccttcttctcccacaggtacttctagtagcgattccggagggcatcacattggctggggagagaggcaaggacaatggttgcgcagaagaaggcttgatggggcgataaaccgagtacccgtaggtttttaccaacgtgtttggaagattctacaaaagtgtcacggactgagcattgatgggtacgtgcttccaagctctactactcgcgaaatgactccccatgagataaagttcgctgttcatgttgagtccgttcttaatcgggtccctcaacctgaatacagacaactcttggtggaagcgattatggttttgactctgttatcagatactgagatgactagcatcggcggcatcattcacgtagatcagattgttcagatggcttcccaacttttcctgcaagatcaagtttctatcggggcaatggacacccttgagaaggatcaagccacaggaatctgtcatttcttctacgattcggccccttcaggtgcatacggaactatgacttatctcactagggctgttgcatcatacttacaggagctattacctaacagcgggtgccaaatgcaa

SEQ ID NO: 18089 - DNA, 3705 bp, Artificial Sequence
  Description of Artificial Sequence: Synthetic coding sequence
atgagaagccgttccaatagcggagtgaggttggacgggtatgcccgtctggttcaacaaacaatcctctgctaccagaatcccgtcaccggactgctttccgctagtcatgaacagaaagacgcatgggtcagggacaacatctattccatcctggcagtctggggcctggggatggcgtatcgcaagaatgcagatcgggatgaggacaaggcaaaagcttatgagctagaacaaaacgtcgtcaaacttatgcgcggactactccagtgcatgatgcgacaggtggcgaaagtcgagaagttcaaacatactcagtctacaaaagacagcctgcatgctaaatataacacagccacatgcggaaccgtggttggtgacgatcagtgggggcatctccaagtcgatgccacatctctattcctcttgttcctcgcacagatgacagcgagcggactgagaatcattttcacactggatgaagttgcattcattcagaatctcgtgttttatatcgaggcagcttacaaggtcgcagactacggcatgtgggagaggggcgataagacaaaccagggtattcccgagttgaatgcgagtagtgtggggatggcgaaggccgctctggaggccatcgatgagctggacctcttcggggctcatgggggacggaaaagcgtcatacatgtgctcccagatgaggttgaacactgtcaatccatcctcttctctatgctgccacgggcttcaacttctaaagaaattgacgcaggtctgctatccataatttccttcccggccttcgcagtggaagacgtaaatctggtaaacgtgacaaaaaatgaaatcatcagcaaattgcaggggcgctatggctgttgccggtttttgagagatgggtacaaaacacctcgcgaggatcctaatcgattgcattatgatccagccgagctaaaacttttcgagaatattgagtgtgagtggcctgtcttttggacctattttattattgatggcgtgttttcaggcgacgcagtgcaggtacaggagtaccgcgaagctttagaaggtatcctgatacgaggtaaaaacggtattcgtctggtacccgagttatacgcagtaccccccaacaaggttgacgaggagtataagaatcctcacactgtcgacagggtcccaatgggtaaggtgccccatctgtggggtcagagcctctatattctgagcagcctgctggccgagggcttccttgctgctggcgagatcgacccgctgaataggcgattttccacctccgtcaagccagacgtggttgtgcaggtcaccgtgctcgccgaaaataatcacattaaagatttgctgcgtaagcacggtgttaacgtacaatccatcgcagatatccaccccattcaagtacagccgggacggatactgagccatatttacgccaaactgggcaggaacaaaaacatgaacttaagtggacgaccttaccgccacattggcgtgctgggaaccagcaagctgtatgtcatcagaaaccagatattcacattcaccccgcagtttaccgatcagcaccacttctatctggcccttgataatgaaatgattgtggagatgctaagaattgagctcgcttacctatgcacatgttggcggatgaccggtcgccccactttgacctttccaatatctcgaactatgctgaccaatgacggatcagatatccattccgccgttctctctaccattcggaagctggaggacggttattttggcggagctagagttaagctggggaacctaagtgagttcctaacaacctctttctacacataccttaccttcctggatccagattgcgacgagaaactgttcgacaatgcttctgaggggacattttcacccgattccgattctgatctggtgggctatttggaggacacctgtaaccaagaatctcaagatgagcttgatcactatatcaatcatctcctgcagagtacctccttgcggtcataccttccccccctctgtaagaacacagaggatcgacacgtgttctcagccatccacagcacacgagatatactttccgtgatggccaaggcaaagggcctggaagtgcccttcgtgcctatgacgctgcctacgaaagtgctgagtgcccataggaagtctttaaacctggtggacagtccacaaccgcttctggaaaaggtgcccgagagtgacttccagtggcccagagacgaccacggtgatgtcgactgtgaaaagctggtcgaacagctgaaggactgctctaatctgcaggaccaggccgacattctctatatcctgtacgtaatcaaggggccctcttgggacacgaatctgagtggtcagcatggcgttacagtgcagaacttattgggagaattgtacgggaaagcagggctaaatcaggaatggggtttaatacggtacatctctgggctgctgcggaagaaggtagaggtgttagccgaggcttgtacagacttgctttcccatcagaagcaattgaccgttggtctgccccccgagcctcgggagaaaatcatctccgctcccctgcccccggaggaattgaccaaactcatctacgaagcctccggacaggatatctcaatcgccgtgttgacacaggaaatcgttgtctatctcgcaatgtacgtacgcgcgcagccctccctttttgtggagatgttgcggttacgcatcggattaatcattcaggttatggcaaccgagctggcgaggagccttaactgttccggggaagaagcttccgagtcactgatgaatctgtccccttttgacatgaaaaacctgctacatcatattctgtcaggcaaggagtttggcgtcgaacggtcagtaagaccaatccacagttccacgagttcgcccaccatcagtatccacgaggttggacacacaggagtgacgaagactgagcgtagcgggataaacagattgcgctctgaaatgaagcagatgactagacggttctccgcggacgaacagttcttctcagtagggcaggccgcttccagctccgcccattcctccaaatccgccagatcctctactccttcctcccctactgggacatccagctcagatagcggggggcaccacatcggatggggggaaaggcaggggcagtggcttcgccgtaggcgcctggatggcgctattaatcgggtcccagtcggattctatcagagggtctggaagattctgcagaagtgtcacggcttatcgattgatgggtatgtgctgccgagctcaaccactagagaaatgactccccacgagattaagttcgccgtgcacgtcgagtccgtgctcaacagggtcccccagccagaatataggcagttgctagtggaggccataatggtgctgaccttgctctccgacacggagatgactagcattggcggaatcattcacgtggaccagatcgtccagatggcttcacagctctttctgcaggaccaggtcagcattggagccatggatacattagagaaagaccaagcaacggggatctgtcattttttctatgacagtgctccctcaggcgcttatggaaccatgacctacttgactagggcagtcgctagctacctgcaagagctcctgccaaatagcggatgtcagatgcaa

SEQ ID NO: 18090 - DNA, 3705 bp, Artificial Sequence
  Description of Artificial Sequence: Synthetic coding sequence
atgcgctcccggtcgaattcgggagtgaggttggatggatacgcgaggcttgttcaacagactattttgtgctaccaaaaccccgtcactggtctgctgtctgcatcccatgaacagaaggatgcatgggtgagggacaacatttacagcattctggcagtgtggggactgggtatggcataccggaaaaacgctgacagggacgaggataaggcaaaagcctacgaactggaacagaatgtggtgaagctgatgcgcgggcttctccagtgcatgatgagacaagtggcaaaggtcgaaaagttcaagcacacccaatccaccaaagacagcttgcacgcaaagtataacacggcaacctgcgggactgtcgtcggtgacgatcaatggggccatctccaggtggatgcgacctccctttttctgctttttcttgcgcaaatgactgcatcaggacttagaatcatctttactctcgatgaggtggctttcattcaaaacttggtcttttacatcgaagcagcctacaaggtggcagattacggcatgtgggaacgcggagataagacgaaccaagggattcccgaacttaacgcatccagcgtgggaatggcaaaggcggcactggaagcgattgacgaactggatttgttcggtgcacatggcggacgcaagtcagtgatacacgtgctgcctgatgaagtagagcattgccaaagcatccttttttccatgcttcctcgggcctccacttcaaaggagatcgatgctggactgctgagcataatcagctttcctgcattcgcagtggaagatgtcaacctggtgaacgttactaaaaacgaaatcatctccaaacttcaaggacgttacggatgttgtcgctttctgcgggatggatacaaaacccctagagaggacccaaacaggctgcattacgacccagccgaactcaagctctttgagaatattgagtgtgagtggcccgtgttctggacttacttcataatcgacggcgtgtttagcggcgacgcagtccaggtgcaggaatacagggaggcactggaaggaattctcattcggggaaagaacggtattcgtcttgtccccgaattgtacgcagttccccccaataaggtggatgaagaatacaaaaaccctcataccgtggatagagtcccaatgggaaaagtgccgcatctctggggccagtccttgtatattctttcaagcctgctggccgagggatttttggcagccggtgaaattgatcctctcaatagaagattttcaaccagtgttaaaccagacgtcgtcgtgcaggtgaccgtccttgccgaaaacaatcacatcaaggacctgctccggaagcatggcgtgaacgtgcaatccattgcagatatacatccaattcaggtccaacctggacgtatcctttcccacatctacgcgaaacttgggcggaataagaacatgaatctgtcgggacgcccatacaggcatattggcgtgcttggaacttccaagctctacgtgatcagaaaccagatctttacgtttacccctcaattcaccgaccaacatcacttttatctggctttggacaacgaaatgattgtggaaatgcttagaatcgagctcgcctacctgtgtacgtgttggcgaatgactggacgccccactctgactttccctatttcaagaactatgctgactaacgacggttcagatattcactccgcagttctttctactatcagaaaattggaggatggttactttggtggcgctagagtcaaactcgggaatctttccgagtttctcaccaccagcttttacacctacctcacctttttggaccctgattgtgatgaaaagctcttcgataacgcatccgaaggaacttttagccctgattccgacagcgacctcgtgggctaccttgaggacacctgcaaccaagaatcgcaggacgaacttgatcattacatcaatcacctgcttcaatctaccagcctgaggtcttaccttccaccattgtgtaagaatactgaagatcgccatgtctttagcgccattcattccactcgggatattctctccgtgatggcaaaggcaaagggattggaggtgccatttgtccctatgacccttcctaccaaggtgctttccgcacatcggaagtcactcaacctcgtggactcaccacagccactcctggaaaaggtgcctgaaagcgacttccaatggccaagggacgaccatggagatgtggattgcgaaaaactggtggagcaactgaaggactgctccaaccttcaggatcaagccgatatcctgtacattttgtacgtcattaagggcccttcgtgggatactaacctgagcgggcaacatggagtgaccgtccagaacctgcttggagagctctacgggaaggcaggacttaatcaagagtgggggctcattaggtacatatccggtctgcttaggaagaaggtggaagtgctcgctgaagcgtgtaccgacctgcttagccaccaaaagcagctgaccgtgggattgccgcctgaacctagggaaaagatcatttcggcacctctcccacctgaagaacttacgaagctcatctatgaagcatcgggtcaagatatttccattgctgtgcttacccaggaaatcgtcgtctaccttgcaatgtacgtgagagcacaaccatccctctttgtcgagatgctccgccttagaatcggtcttatcatacaggtgatggcgactgagctggccaggtccctgaattgttcaggtgaggaagcctcagagtcgcttatgaatctttcaccatttgatatgaagaacctgcttcatcacatccttagcggaaaggaatttggagtggagagatccgtccggcctatccattcctccacctcaagccctactattagcatccacgaagtcggtcacacgggagtcaccaagacggaaagaagcggcattaacagactcagaagcgaaatgaagcagatgactagaaggttttcagcagatgagcaattcttctcagtcggacaagccgcgagcagctccgcccattcatcgaagagtgcaaggtcatccaccccgagctcaccaaccggcacgtcatcgagcgattcgggaggccatcacattggctggggagagaggcagggtcagtggcttcggaggagacgtctggacggtgccattaatcgcgtgcccgtgggtttttaccaaagagtgtggaagatactccaaaagtgtcacggactctccatcgacggatacgtgctgccatcgtccaccactagagaaatgaccccacatgaaatcaagtttgcagtgcatgttgagtccgtgctgaacagggtgcctcaaccggaatacagacaactccttgtcgaagcaatcatggttctgactctcctgtcggatactgaaatgacctcgatcgggggcatcattcacgtggaccagattgtgcaaatggcatcccaactctttcttcaggaccaagtgtcaatcggtgctatggacactctggaaaaggatcaagccaccgggatctgccatttcttctacgactccgccccgtccggtgcatacggcacgatgacttatcttactcgagccgtcgcgtcatacctgcaggaactgcttcctaacagcgggtgccagatgcaa

SEQ ID NO: 18091 - DNA, 3705 bp, Artificial Sequence
  Description of Artificial Sequence: Synthetic coding sequence
atgcgcagcagatctaattcgggagtcaggttagatggctatgctagactggtccagcaaaccatactttgttaccagaatcctgtcacaggattgttgtcagcttcccacgaacaaaaggacgcatgggtcagagacaatatttactcaatcttagccgtatggggattaggcatggcttatcgcaagaacgcagatcgcgacgaagataaagcgaaagcgtatgagttagagcaaaacgtcgtgaaactaatgaggggtctgctccagtgcatgatgagacaggtagccaaagttgaaaagtttaaacatacccagtctacgaaggattcacttcacgcaaaatacaatacggccacgtgcggtacggttgtcggcgatgaccagtggggacatcttcaggtcgatgccacgtcactgtttctcttgtttctggcgcaaatgaccgcttcaggattaaggattatctttaccttggatgaggttgcttttattcagaatttagtgttttatattgaggcagcgtataaagttgctgattacggaatgtgggaaagaggcgataagactaatcaaggcatcccggagttaaatgcgtcgtccgtgggcatggcgaaagcagcccttgaagcaattgatgaactcgacttattcggggctcatgggggccgtaagtctgttatccacgtgctaccagatgaagtagaacactgccaatcaattttattttccatgcttcccagagcttctacgagcaaagaaatcgatgctggcctgctttcaattatatcctttcctgcattcgctgtagaggatgttaaccttgtaaacgtgacaaaaaacgaaatcatttccaagttacagggaagatatggatgttgcaggtttctcagagacgggtacaagacgccgcgcgaagacccgaatcgtttacattatgacccagcggaacttaaattatttgaaaatattgaatgtgagtggccagttttctggacatatttcatcattgatggcgtgttttcgggagatgccgtccaagttcaggaatatagggaagcactcgaaggaattcttatcaggggcaagaacgggatacgcttagtgccggaactttatgccgtccctccaaataaagttgatgaggaatataagaatccacacacagtagatcgcgtgcctatgggaaaggttccgcatctctggggacagagcctgtatattttgagctccttactcgcggaaggttttcttgccgcgggcgaaattgatcccctgaatagaagattttcgacgtcagtaaagcctgatgttgtggttcaagtgactgtcttggctgagaacaatcacattaaagatcttctgcgtaaacatggagtcaatgtacaatccatcgccgatattcatccgatccaagtgcaaccaggccgtatccttagccatatttatgcaaagttagggaggaacaaaaatatgaacttaagcggccggccgtatcgtcacatcggtgtgctaggcacgtctaaattgtacgttattagaaatcagatattcacatttactccgcaatttacagatcaacatcatttttatcttgctttggacaacgaaatgattgttgaaatgttacgtatcgaattggcctacctttgcacatgctggcgcatgacggggcgtcctacacttacttttccgattagccggacaatgcttacaaacgacggttctgatatccactccgcggtcttgtcaaccattcgaaaacttgaagatggatattttgggggagccagggtcaaactgggaaacctgtctgagtttttaacaacatctttttacacatatctgacatttcttgatccggactgcgatgagaaactttttgataatgcttccgaaggaacatttagcccggacagcgatagtgatttggttggctacctggaagacacttgcaatcaggaaagtcaagacgaattggatcactatatcaatcatctgcttcaatcaacgtccttacgttcatatttgccgccactctgtaagaatactgaagatcgtcacgtgttttcggcgatccatagcaccagagatattctttcggtcatggcaaaagcgaaagggcttgaggtccctttcgttcctatgacgctacctactaaagttcttagcgctcaccgtaagagcttaaatctcgtcgatagccctcagccattgttagaaaaagtacctgagtcagactttcaatggcctcgcgacgatcacggagatgtggactgtgaaaaattggttgagcaactgaaagattgcagcaatcttcaagatcaagcggatattctttatattctgtatgttattaaaggaccatcgtgggacacaaacctgtccgggcagcatggggttactgtgcagaacctgcttggggaactttatggcaaagcgggattgaatcaggaatggggcttgattaggtatatctctggactgttaagaaaaaaagttgaggtgctggctgaagcctgtacggatctgttgtcccatcaaaaacaactgacggttgggttaccaccggaaccaagagaaaaaatcatctcggcgccactgccgccagaggaactgactaaacttatctatgaggcgtcagggcaagatatctctatcgcagtattaacacaggagattgtagtctatttggctatgtatgttcgcgctcaaccgtctctgtttgtcgaaatgctgcgcttaagaataggccttattatccaagtgatggcaaccgaacttgcacgttctcttaactgctcaggggaagaagcgtctgagtcactgatgaacctgtcaccattcgatatgaagaacttacttcaccacattctttctgggaaggaatttggtgttgaaaggtccgtccggcctattcattctagcacaagcagccctacaataagtatacatgaggtgggacatacgggcgtaacgaaaacggaacggagcggcatcaaccgtctgagatcagaaatgaaacagatgacaagaaggttttccgcagatgaacagttttttagcgtaggtcaagctgccagtagcagcgcacattcttccaagtctgctagatccagtacgccatcctcccctacgggaacgagcagcagcgattcaggcgggcaccatattggctggggagaacggcaaggtcaatggcttcgccggagacgcctagatggcgccatcaatagggttcctgtgggtttttatcagcgggtatggaaaattcttcaaaagtgtcacggtctgtctattgatggatatgtgctcccgagctccacaacacgagaaatgacgccacatgaaatcaaatttgccgtccatgtagaaagcgtgcttaatcgggttccgcaaccagaataccggcagctacttgtcgaagcaattatggtgctcacactgctgtcagacacagaaatgacttctattggcggcattatccacgttgatcagattgttcagatggcatcacagttatttcttcaggatcaggtgtccattggagcaatggacacactggaaaaggaccaagcaactggtatctgccattttttctatgactcagcaccgtctggtgcgtatggcacaatgacatacttaacacgagcggtcgcctcttatctgcaagaattactgccgaattccgggtgccaaatgcaa

SEQ ID NO: 18092 - DNA, 3705 bp, Artificial Sequence
  Description of Artificial Sequence: Synthetic coding sequence
atgaggtctcgctctaatagcggtgtgcggctggatggctacgcacggttggtgcagcagaccatcctgtgctatcaaaaccccgtcactgggctgttgtctgcctctcacgagcaaaaagatgcctgggtgagggataatatttacagcatactggcagtctgggggttgggcatggcctataggaaaaatgccgatcgcgacgaggataaggcgaaggcgtacgaactggaacagaacgtagtcaagctgatgcggggtctgctgcagtgcatgatgaggcaagttgcaaaggttgaaaagtttaaacatacacagtccacaaaggatagtttgcacgccaaatacaacacagcgacgtgcggtacagtcgtgggagatgatcaatggggccacctccaggtcgacgcaacatctctttttttgcttttcctcgcgcagatgaccgccagtggcttgcggattatctttactttagacgaagtcgccttcattcagaacctcgtgttctatattgaggccgcctacaaggtggcagattatgggatgtgggaacgcggagataaaaccaatcagggtatccccgaattaaacgcaagctccgtaggtatggctaaggccgccttggaggccatcgatgaacttgatctgttcggcgcacatgggggaaggaaatcagtgatacacgtgttacccgatgaagtggagcattgtcagtcgatcttattctcaatgctgccaagggcgagcaccagcaaagagatagacgccgggttgctgtcgataattagctttcccgcgttcgcggttgaggacgtgaatctggtgaatgtgacgaagaatgagattatctctaagctccaaggacggtatggctgctgccgctttctgagggacgggtataaaacaccacgagaagatccaaaccgtctgcattacgaccctgctgagttgaagctctttgaaaacattgagtgcgagtggccggttttttggacctactttatcatcgatggcgtgttcagcggagatgccgtgcaggtacaggaataccgggaggctcttgaagggatactaatcagagggaaaaacggtattaggctggtccctgagttatacgcagttccgcctaataaggttgacgaggagtataagaaccctcacactgtagaccgcgtgccaatgggcaaggtgccacacttatggggtcagtcactttacattctcagcagcctgctggcagaaggttttctcgctgctggtgagatagacccgctgaaccgccgtttttccacttcagtgaagcctgacgtggtcgtacaggtgaccgttctcgcagagaataaccatatcaaggacttgctgcggaagcatggagtgaatgtccagagcatagccgatatacacccgattcaggtccagccaggaagaatccttagtcacatttatgcaaagctggggcgcaacaagaacatgaatttatcgggccgcccgtaccgccatataggagtgctcggcacatcaaaactatatgtcatcagaaaccagatattcacattcactccccagtttacagaccaacatcatttttacctagcacttgataacgagatgattgttgagatgctccgcatagagctagcttacttatgcacttgctggcggatgacggggagaccaacattgacatttcccatttccagaacaatgttaactaacgacggctcggacattcactcggccgtactgtcaacaatccgcaaactggaggatggatacttcgggggcgcaagggtgaaattgggaaatctgtccgaatttttgactacatcattctatacctatttaaccttcctggacccagattgtgatgagaaattgttcgacaatgcatcagagggtacgttctctcctgacagtgatagcgacttagtgggctatttggaagatacttgcaatcaggagtcacaagacgagttggatcactatataaaccatctgctgcagtccactagtctccgcagttatctgccacccctatgtaaaaataccgaagatcggcacgtgttctccgcaattcactcaactcgcgatattctcagcgttatggcgaaagccaaaggccttgaggttcctttcgtgcctatgacactgcctactaaggttctctccgcccatagaaaatcactcaatcttgtggacagtccacagccactcctggagaaggtgcctgaaagtgattttcagtggccacgcgatgaccatggggatgttgattgcgagaagctcgtagaacagctcaaggactgtagcaacttacaggaccaagcagatatcctgtacatcctttacgtgatcaagggacccagctgggatactaacctgtcaggtcagcatggcgtgactgtgcagaacctcctgggagaattgtacggaaaggcaggcctaaaccaggaatggggtctcattcggtatatctcgggactccttcgtaaaaaggtagaggttttggccgaagcctgcaccgatctgctgagccaccaaaaacagctgaccgtcggactgccaccggaaccacgcgaaaaaattatctcagcccccttgcctcccgaggaactgaccaaattgatatacgaagcgtcaggccaggatatttctatcgccgtcctgacacaagaaattgttgtctaccttgcaatgtatgttagagcccagccatctctgttcgtggagatgctgcgtttgaggataggactgataatccaggtgatggcaactgagctcgctcgctctttaaattgttccggggaagaggcctctgaatctcttatgaacctcagtccatttgacatgaagaatctcctgcaccacattctctctggcaaggagtttggagtcgaaaggtccgttcgcccgatccattctagcacttcctccccgacaattagcatacatgaggtcggtcataccggcgtaaccaagaccgaaagatcaggaatcaatcgtctgaggtctgaaatgaaacagatgactcggcgctttagcgctgacgagcaatttttctcagtaggtcaggctgcttcttcttctgcccacagttctaagtctgccaggtcctctacaccttctagtccaactggcacctcttcatctgactcggggggccatcacatcgggtggggcgaacggcagggccagtggttgagacggagacgactcgacggtgcaattaatcgggtcccggttggtttttaccagcgcgtgtggaaaatcctacagaaatgtcatggtctgtctatcgacggctatgttcttccctccagtaccacaagggagatgacgccccacgagatcaaattcgccgtccacgtcgagtccgttttgaaccgcgtaccgcagcctgagtaccgtcaattgcttgttgaagcaatcatggtgttaactcttctctctgatactgagatgaccagcataggcggaatcatccacgtggatcagatagtccagatggcctcacagcttttccttcaggaccaggtctccatcggagccatggatacgctggaaaaagaccaggcgaccggaatctgccactttttctacgactctgctcctagtggggcttatggtaccatgacgtatctgacccgcgcggtggccagctatctccaggaactgcttcctaacagcggctgccaaatgcag

SEQ ID NO: 18093 - DNA, 3705 bp, Artificial Sequence
  Description of Artificial Sequence: Synthetic coding sequence
atgagatccaggtccaactccggcgtgcgccttgacggatacgccaggctcgtgcagcagaccatcctgtgctatcaaaaccctgtgactggactcctctcggcatcccatgaacagaaagatgcttgggttcgcgacaacatctatagtattctggctgtctggggactgggcatggcctaccggaagaatgcagatcgcgacgaagataaggcaaaggcgtacgaactcgaacaaaatgtcgtgaagttgatgagaggacttctgcaatgcatgatgcgccaagtggccaaggtggagaagttcaagcacacccagtccaccaaggatagcctgcacgctaaatacaacaccgccacttgtggtactgtggtcggcgacgaccagtgggggcacctgcaggtcgatgccaccagcctcttcctgctgttcctggcgcagatgactgcgagcggactgagaatcatcttcactcttgatgaagtggcctttattcagaacctcgtcttttacatcgaagccgcttacaaggtggctgattacggaatgtgggaacgcggggacaaaactaaccagggaatcccggaactgaacgcctcctcggtgggaatggcaaaagccgcactcgaagccatcgacgaactggacctgttcggagcgcatggcgggaggaaatccgttatccatgtgctgccggatgaggtggaacattgccagtcgatcctcttttcgatgctgccgcgggcgtccacgtcaaaggaaatcgacgcgggcttgctctcaatcatctccttccccgccttcgcagtggaggacgtcaacctggttaacgtgacgaagaatgaaatcatctccaaactccagggacggtacggatgctgccggtttctgagggatggatacaaaactccgagggaagatcctaaccgcctgcactatgaccccgccgagctcaaattgtttgagaacattgaatgtgaatggccagttttctggacttacttcatcatcgacggcgtgtttagcggagacgctgttcaggtgcaagagtaccgcgaggcgcttgaagggatcctcatcaggggaaagaatggcatcagactcgtgccggagctgtatgcggtgccaccgaacaaggtcgatgaggaatacaaaaacccccacaccgtggatagagtccctatgggaaaggtgccacacctgtggggacagtcactgtacatcttgagcagcctgcttgccgagggtttcctggcagcgggagaaattgacccgctgaataggcgcttctcaacctcggtgaagccagacgtggtggtgcaggtcaccgtccttgcagaaaacaatcatatcaaggacctgctccgcaagcacggagtgaatgtgcaatccatcgcagacatccatccgatccaggtgcagccggggcgaatcctcagccatatctacgccaagctgggacgcaacaagaacatgaacctgtccggccgcccataccgccacatcggcgtcttgggaactagcaaactttacgtcatccgcaatcagatctttactttcaccccgcagtttacggatcaacatcatttctacttggcgctggataacgaaatgatcgtggaaatgctcagaatcgaactcgcctacctgtgcacgtgctggcgcatgaccggcagaccgaccctgaccttcccaatcagccggaccatgctgactaacgatggctcggacattcatagcgccgtgctgtccaccatcagaaaattggaggacggatacttcggcggagccagagtgaagctgggaaacctctcggagttcctcactacctccttttacacttatctgactttcctggaccctgactgtgacgaaaagctctttgacaacgctagtgaaggaaccttctcccctgactcggactccgatttggtggggtacctggaagatacgtgcaatcaagagagccaggatgaacttgaccattacatcaatcacttgctgcagtccaccagcctgcggtcgtatctgccacctctctgcaagaacactgaagatagacacgtgttcagcgcaatccactcgactcgggatatcctcagcgttatggccaaagccaaaggacttgaagtgccgttcgtcccaatgaccctgccaactaaggtgttgtcagcccatagaaaatccctgaaccttgtggatagcccgcaacctctcctcgaaaaagtgcctgaaagcgactttcagtggcctcgcgacgaccatggcgatgtggactgtgaaaaactggtggaacagctgaaagattgctcgaacctccaggaccaagccgacattctctacatcctttacgtgatcaaaggaccatcctgggacacgaatttgtcagggcagcacggcgtcaccgtgcagaatctgctgggagagctttacggaaaagctggtctgaaccaggaatggggacttatcaggtacatttcaggcctcctgcggaagaaggtggaggtcctggccgaagcgtgcactgaccttttgtcgcaccaaaagcagctgaccgtgggtttgccgcccgagccacgtgagaaaatcatctcagcccctctcccaccggaggaactcacgaaacttatctacgaagcctcgggacaagacatctccatcgccgtgctcacccaggagatcgttgtctacctggccatgtacgtgcgagcacagccgagcctcttcgtggagatgctgcggctgaggatcggactcatcatccaagtgatggcgactgaactggcacgcagcctgaattgctcaggagaagaggcctcggaatcgctgatgaacttgtcgcccttcgatatgaagaatctgctgcatcacattctgagtggaaaggagttcggggtcgaaaggtccgtgcggccgatccactcatcgactagctcccctacgattagcatccacgaagttggacacactggagtgaccaagaccgaacgctcaggaatcaataggctccggtcagaaatgaaacaaatgactcggagattctcggccgatgaacaattcttctcggtgggacaagcggcctcgtccagcgcccattcatcaaagtcagcccgatcctcaacccctagctcacctaccggcacgtccagctccgattcggggggccaccacatcggctggggcgaacgccaggggcagtggcttcgtagacgacggctggatggcgcaatcaaccgggtgccggtgggattctaccaacgggtgtggaagatcctgcagaagtgccatggtctgagcatcgacggctatgtcctcccgtcgtccaccactagagagatgactccacatgaaatcaaattcgcggtgcacgtcgagtccgtgctgaaccgggtgcctcagccggagtaccgtcagctcttggtggaggcaatcatggtgctgaccctgctgagcgataccgagatgaccagcatcggggggattatccacgtggaccagatcgtccagatggccagccaactgttccttcaagatcaagtgtccattggagccatggatactctggaaaaggaccaggctaccgggatctgccactttttctacgatagcgcaccgtcgggcgcgtacgggaccatgacctaccttacccgcgccgtggcgtcttacctgcaggagttgcttccgaattccggatgccagatgcaa

SEQ ID NO: 18094 - DNA, 3705 bp, Artificial Sequence
  Description of Artificial Sequence: Synthetic coding sequence
atgaggagtcggtctaactcaggagtacgactggacggctatgcccgtctggtacaacaaaccattctgtgttatcagaatcccgtgacaggtctcctttcagcctcgcatgagcagaaggacgcctgggtgcgggataatatttacagcattttggctgtctgggggctgggaatggcttatcgtaaaaatgcagatcgggacgaagacaaggcgaaggcttatgaactggagcagaacgtggtgaagcttatgcgcgggctgttacaatgtatgatgaggcaggtggcgaaagtggagaaattcaaacatacgcagtcgaccaaagacagcctccatgcgaaatataacacggccacttgtggtacagtggtcggggatgaccaatggggccacttgcaggtggatgccacctccctgtttctactattcctcgcccagatgaccgccagcggcctgcgtattatcttcacactggacgaggttgcctttattcagaaccttgttttctacatcgaagccgcttataaggtggccgattacggaatgtgggaacggggcgataagacaaatcaggggattccagaattaaacgcatcctcagtaggtatggcgaaggcggccctggaagccattgatgagttggaccttttcggcgcgcatggcggtcgcaagtctgtgatccatgtgttgccagacgaagtggagcactgccagagcatattgttcagtatgctccctagagcctctacgtccaaggaaatcgatgcaggtttgttatccatcatctcatttccagcgtttgcggtcgaggacgtgaatctcgttaatgtgactaagaatgagatcatcagtaaacttcaaggacgctacggttgctgtcgctttctgagggatggctataagacccctcgggaggaccccaacaggctgcattacgaccccgcggaactgaagctgttcgagaacatcgaatgcgaatggccagttttttggacgtacttcatcatcgacggagtcttctctggggacgccgtgcaggtgcaggaatatcgcgaggccctggaagggattctgatccgcggtaagaatggaataaggcttgtacctgagctgtacgcagtgccccctaacaaggttgacgaagagtacaaaaatcctcacacagtggaccgcgtcccgatggggaaagtcccacacttgtggggacagagtctgtacatcctaagcagcctcctcgccgaaggcttcctcgcagctggggagattgaccccttgaatcggcgattttcaacgagcgtgaaacctgacgtcgtggtacaggtgaccgtgctggccgagaacaatcatataaaagacctgcttcggaagcatggagtaaatgtgcaaagcatcgccgatatccatcccatccaagtgcagcctggaagaatcctcagccacatttatgcaaaactcgggaggaacaaaaacatgaacctgtctggtcggccctaccgacatatcggtgttctcgggacatccaagctgtacgtgatcaggaatcaaatctttaccttcacacctcagttcaccgaccagcaccacttctatcttgccctggacaatgagatgattgtggaaatgctgcgcattgagctcgcatacttatgtacctgctggcgtatgaccgggcggcccaccctgacgtttcccatcagccgcaccatgcttaccaatgatggttctgatattcatagcgccgtcctctctacaatccggaaacttgaggacggttacttcggcggagcccgggtcaaactcgggaacctcagcgagttcctgaccactagcttctacacatatcttaccttcctggaccctgattgcgatgagaagttgttcgacaacgccagcgaaggcactttctcccctgactccgactctgacctggtggggtaccttgaagacacatgtaatcaggagagccaggacgaactggaccattatataaatcatcttctgcaaagtacctccttgagaagctatttgccccccttatgtaagaatactgaagaccgtcacgtgttctctgccatccacagcactagagacatcctctccgttatggctaaggccaaaggcctagaagtcccctttgttcctatgactctgccaactaaggtgctttccgcgcaccgaaagtctctgaatttagtggatagcccccagcctttgctcgagaaggtgccggaatctgacttccagtggcctagggacgatcacggcgatgtcgattgtgaaaaactcgtcgaacagctgaaagactgcagcaatctccaggaccaggctgacatcctgtatatcttatatgttataaaggggcctagctgggataccaatctcagcgggcagcacggtgtgacggtccagaatttattgggtgagctttatggaaaggccggccttaaccaagagtggggtctcataagatacatctctggattgttacggaagaaggttgaggtccttgccgaggcctgtaccgacttgcttagccatcagaagcagttaactgtggggctgccccccgagccgcgggaaaaaatcatttccgcaccactgcctccagaggagttgacaaagctgatttatgaagcaagtggccaagacatcagcattgccgtgctgacccaggagattgtggtgtatctggccatgtacgtgcgggcgcaaccgagcctgtttgtcgagatgctgaggcttcgcatcggtcttatcatacaggtgatggctaccgagcttgctcgatcgctgaactgttcaggcgaggaagcttctgaaagcctgatgaacctgagtccattcgatatgaagaatctactccaccatatcctgagtggaaaagaatttggggtggaacggtcggtgcgtcccatccacagctctacttcctcccccactatctccatccacgaggtggggcacacaggagttacgaagacagaacggtccggtatcaaccgcttgcggtctgaaatgaagcagatgaccagacgcttcagcgcggatgaacaattttttagtgtagggcaggcagcttctagctccgcccactcctccaagagcgctagaagctccacccccagctcacctacaggcacctccagtagcgacagcgggggccaccatatcggatggggcgagaggcaggggcagtggcttcgtcgtcggcgactggatggcgccataaatcgggtgccagttggcttttatcagagagtttggaaaattctgcagaagtgtcacggcctttccattgacggttatgtcctgccatcttctactacaagagaaatgacaccacacgagattaaattcgcggtgcacgtggagagcgtgctaaatcgcgtgccccaacccgagtaccggcagcttctggtggaggccattatggtgctgacacttctatcagacactgaaatgacctctatcggcggaatcatacatgtggatcagatcgtgcagatggcgagccaactgttcctgcaggaccaagtgagtatcggagcaatggacaccttggagaaggatcaggctactgggatctgccacttcttttatgactccgcccctagcggggcgtatggaactatgacatacctcactagagccgtggcatcctacctgcaggagttactgccaaattcaggctgccagatgcag

SEQ ID NO: 18095 - DNA, 3705 bp, Artificial Sequence
  Description of Artificial Sequence: Synthetic coding sequence
atgcgctcgcggtcgaattcaggagtgcgcctggacggctacgcacgacttgtgcaacaaaccattctttgttaccaaaatccagtgaccggacttctttcagcaagccatgagcagaaggacgcatgggtgagagataacatttactccatactggccgtctgggggctgggcatggcttaccgcaagaatgcagatcgcgacgaagataaggcaaaggcatacgaacttgagcagaacgtggtgaaacttatgcgaggccttttgcagtgtatgatgcggcaggtggcaaaggttgaaaagtttaagcatacccagtcgaccaaagatagcctgcatgctaagtacaatactgcaacctgtggaactgtggtgggtgatgaccaatggggacatcttcaggtcgacgctactagcctcttcctgcttttcctggcacaaatgacggcttccggccttcggattatcttcaccctggacgaagtggcgtttattcaaaaccttgtcttttacatagaagcagcgtacaaggtcgcagattacggaatgtgggaacgaggagacaagactaatcagggaatcccggaacttaatgcaagctcggtgggtatggcgaaagccgcactggaagccattgacgagctggatctgttcggggctcatggaggccggaagtccgtaattcacgtgttgccggacgaagtggagcattgtcagtcgatcctcttcagcatgctgcccagagcatcaacgtcaaaagagattgacgcgggactgctttcaatcatttcctttcctgcatttgctgtggaagatgtcaacttggtcaacgtcaccaagaacgagattatctctaagctgcaaggtagatacggctgttgtcgtttccttcgcgatggatataagaccccccgtgaggatcctaaccgactgcattacgatccagcggagcttaagttgttcgaaaacattgaatgtgagtggccagttttttggacctacttcatcatagatggggtgttttccggcgatgccgttcaggtgcaggagtatagggaagcactggaagggattctgattagaggtaagaacggaattcgccttgtcccagagctttacgccgtgcccccaaataaggttgatgaggaatacaagaacccccacactgtggatagagttccaatgggaaaggtccctcatctgtggggacaatcgctgtacatcctgtcatcccttcttgcagaaggattcctcgctgcaggggaaatcgatccacttaatagacggtttagcacctcggtgaagcctgatgtggtcgtccaggtgactgtcctcgcggagaataatcatatcaaagatctgctgcgtaaacatggtgtcaacgtccagagtatagcggatatccaccccatccaagtgcaaccgggccgtattttgtcgcacatctacgccaaactcggtagaaacaaaaacatgaacttgtctggtcggccttaccgccatattggtgtgctcgggacttccaagttgtacgtgataaggaaccagatcttcacctttaccccacaatttactgatcagcatcacttttacctggcgcttgacaacgaaatgatagtggaaatgctcaggattgagttggcctacctttgtacttgctggagaatgaccggtagacctaccctcacttttcccattagcagaactatgctcactaatgacggttccgacatccattcggccgtcctgtccaccataagaaaattggaggacggctactttggtggggcacgcgtgaagctcgggaacctgtcggaattccttacgactagcttttacacctacctcacttttctcgacccggattgtgatgagaaattgttcgacaatgcatcggaaggtacttttagccctgatagcgatagtgatcttgtgggataccttgaggacacgtgcaaccaagaatcccaagatgaacttgatcactacatcaaccatcttctgcaatcaacctcgctccgaagttatctgcctcctctgtgcaagaacactgaagatagacatgtatttagtgccattcactctactagggacattctgtccgtcatggcaaaggcgaaggggctggaagtgcctttcgtgcctatgaccctcccaacgaaggtgctttcggcacatcgcaagagcctgaatctggtcgattcgcctcaacctcttctggaaaaagtgcccgaatctgacttccaatggccaagagatgaccacggagatgtcgattgtgagaaacttgtagaacagcttaaagattgctcgaatctgcaagatcaggcagatatcctctatattctctatgtgataaaggggccgtcctgggatacgaacttgtcgggacagcatggcgtgactgtgcaaaacctcctgggagaactctacggtaaggctggccttaaccaagagtggggactgatacgatacatatcaggtctgttgaggaaaaaagtggaagtgctcgcagaggcttgcaccgatctgttgtcccaccagaaacagcttaccgtgggcctgccacctgaacccagagagaagatcatttctgcacctttgccgcccgaagagctgaccaagctcatttacgaagcatcgggacaagatatttccatagcagtgctgactcaagaaatcgtcgtctaccttgcaatgtacgtgcgagcgcagccatcactttttgtcgaaatgctgaggctgaggatcggcctcattatccaagtgatggcaaccgaacttgcacggtcactgaactgctcaggtgaagaagcctccgagtccctcatgaatctgtccccttttgacatgaagaatcttcttcaccacatcctctccggaaaggaatttggtgtggagcggtccgtgaggccaattcacagcagcacttcatcaccaactattagcatccatgaagtgggccacaccggggtgactaagaccgaacgctccgggatcaaccgtctcagaagcgaaatgaaacaaatgactcggagatttagcgcagatgagcaattcttctctgtcgggcaagcggcctcgtcatcagcacactcgtccaagtccgctcggtcctcgactccatcatcgccaaccggaactagctcgtcggacagcggaggtcatcatattgggtggggtgaacgtcaaggtcagtggctgcgtcgcagacggcttgatggtgcaattaaccgggtccctgtcggattttaccaaagggtgtggaagatacttcagaagtgtcatggtttgtcgatcgacggatacgtcctcccctcttcgaccacccgggagatgaccccgcatgagatcaagtttgccgtgcatgtcgaatcggtgctgaacagagtgccccaacctgaatacagacaactgctggtggaggcaattatggtactgaccctcctgagcgatactgaaatgacgtccattggtgggatcattcatgtagaccagattgtgcaaatggcgtcacagctttttctgcaagaccaggtttctatcggcgccatggacacgctggaaaaggaccaggcaaccggaatttgtcactttttctacgatagtgccccttccggggcctacgggactatgacctatctcaccagagcagtggcaagctacttgcaggagctgctgcctaactcaggatgccagatgcaa

SEQ ID NO: 18096 - DNA, 3705 bp, Artificial Sequence
  Description of Artificial Sequence: Synthetic coding sequence
atgcgcagccggtcaaattcaggagtgagactcgatgggtacgcgcgcctggtgcaacaaacgattctgtgctaccaaaaccccgtcaccgggctcctgtccgcctcccacgaacagaaagacgcatgggtgcgcgacaatatctactcgatcctggctgtgtggggcctgggcatggcctaccgcaaaaacgcggatcgggatgaggataaggccaaggcctacgagctggagcagaacgtggttaaactgatgcggggactcctgcagtgcatgatgaggcaggtcgctaaggtcgaaaagtttaaacatacccaatctactaaagactcactgcatgcgaaatacaatactgccacctgcggtaccgtggtgggagatgaccaatggggtcatctgcaggttgacgccacctcgctgttcctgctctttctggcccaaatgaccgcgtccggtctgcgaatcatcttcaccctggacgaagtggctttcatccagaacctggtgttctacatcgaggccgcttacaaggtggccgactacggaatgtgggaacgcggagataagactaatcaaggaatcccggagctcaacgcttccagcgtgggaatggctaaggccgcactcgaagcaatagatgagctggacttgttcggggcacatggaggaagaaagtccgtgatccatgtgctccccgacgaggtggaacactgccaatccattcttttctcgatgctgcctcgggcctcaaccagcaaggagatcgacgccggactgctgtccattatctccttcccggccttcgcggtggaggacgtcaatctcgtgaacgtgaccaagaacgaaatcatctcgaaacttcagggaagatacggatgctgcagattcttgcgcgacggatacaagacgcccagagaggacccgaaccggttgcattacgacccggccgaactcaaactgttcgaaaacatcgagtgtgagtggccagtgttctggacttacttcatcatcgacggcgtgttttccggagacgcggtgcaggtgcaggaatacagggaagcgctggaaggaatccttatcagaggcaagaacgggatcagactcgtgccggaactgtacgccgtcccacccaacaaggtcgatgaagagtacaagaatcctcatacggtggaccgcgtgccaatgggaaaagtgccgcacctgtggggacagtcactgtacatcctgtcgtcactgctggccgagggattcctcgccgcaggtgagattgacccattgaaccggcgcttttcgacttcggtcaaaccggacgtcgtcgtgcaggtgaccgtgcttgcagaaaacaatcacattaaggatctgctgcgcaaacacggagtcaatgtgcaatctatcgcagacattcacccaatccaggtccagccaggacgtatcctttcgcacatctatgcgaagttggggaggaataagaacatgaatttgtccggcagaccataccggcatatcggagtgctggggacttcgaagctgtacgtgattcgcaaccaaatcttcacctttaccccccagttcaccgaccagcaccacttctacctggccctggacaacgaaatgattgtggagatgctccgcatcgagctggcttacctgtgcacttgctggcggatgaccggacggccaactctgacttttcccatctcgcgcacgatgctgactaatgacggatccgacatccacagcgcagtgctctcgactatcaggaaactcgaggacggatacttcggaggagcgcgcgtgaagctgggaaacttgtcagaattcctgaccacttccttctacacctacctgaccttcctggatccagactgcgacgagaaattgtttgacaatgcatcggagggaacctttagccccgattctgattcagatctggtcggatacctcgaagatacctgcaaccaagaatcgcaggatgagcttgaccactatatcaatcacctgctccagtccacttcattgaggtcatacctccctccactctgcaagaacaccgaggatcggcacgtctttagcgccatccattcgacccgcgacatcctgtccgtgatggctaaagccaaaggactggaggtgccattcgtgcctatgacgctgcctactaaggtgcttagcgcccaccggaaaagcctgaacctggtggactcgccgcaaccgctgctcgaaaaggtgccggagtccgatttccagtggccacgcgacgatcacggcgacgtggactgtgaaaagctggtggaacagctcaaagactgcagcaatttgcaggatcaggctgacatcctgtatatcctgtacgtgatcaagggaccttcatgggatacgaacctttcgggtcaacacggcgtcaccgtgcaaaatctgttgggggaactttacggcaaagccgggctcaaccaggagtggggactgatccgctacatttcaggcctcctccgaaaaaaggtggaggtgctcgcggaggcatgcactgacctcctgtcgcaccaaaagcagctgaccgtggggttgccgccggagccgcgcgaaaagatcatttcggcccctctgccgccagaagagctgactaagctgatctacgaggcaagcggccaagatatctctatcgcggtgctcacccaggaaatcgtggtgtacctggcaatgtatgtgcgcgcccaaccttcactcttcgtggaaatgctccgcctgcgcatcggtctgatcatccaagtgatggccaccgagttggctaggtcattgaactgctcaggagaggaggcgtccgagtcgctgatgaacctgagcccttttgatatgaagaacctgctgcatcacatcctgtcaggcaaggagtttggagtggaacggtcggtgcgcccgatccatagctccacctccagccctaccatctcgatccacgaagtcggacacactggggttaccaaaactgagaggtccgggattaatcggttgcgctccgagatgaagcaaatgactcggagattctccgccgatgaacaattcttctcggtgggacaggccgcttcctcgtccgcacacagctcgaaatccgcgcggtcctcaactccatcgtcgccgaccggaacttcgtcgtctgattcgggaggacaccacattggatggggcgaacgtcagggccagtggctgcgccgcagacgattggacggggctatcaacagagtgccggtgggattttaccagagggtgtggaagatcctgcaaaagtgccacggactgtccattgacggctacgtgctgccgtcctcgaccacccgcgaaatgactccgcacgaaatcaaattcgcggtgcatgtcgaatcggtgctgaaccgcgtgccgcagcctgagtaccggcagctcttggtggaagctatcatggttcttacgcttctctcagataccgagatgactagcatcggcggaatcatccatgtggatcagatcgtccagatggcctcgcagttgttccttcaggatcaggtcagtattggagccatggatacccttgaaaaggaccaggcgactggaatatgccatttcttctacgactccgcccctagcggagcctacgggacgatgacctaccttacgcgggcagtggcaagctaccttcaggagctgctgcccaacagcggctgtcagatgcaa

SEQ ID NO: 18097 - DNA, 3705 bp, Artificial Sequence
  Description of Artificial Sequence: Synthetic coding sequence
atgcggagtcgaagcaactccggcgtccggctcgacggttacgccaggctggtacagcaaaccatcctgtgctatcagaatccagttactggactgctgtcagctagtcatgagcagaaggacgcttgggtccgggacaatatatattcaatcctggccgtttggggcctcgggatggcctatcgtaagaatgcggatcgtgacgaagataaggctaaggcctacgagctggaacagaacgtggtgaagctgatgaggggtttgctacaatgtatgatgcggcaagtggctaaagttgagaagtttaagcatacccagtccaccaaggatagcttgcacgctaaatacaataccgctacctgtggaactgtcgtgggcgacgatcagtgggggcatctgcaggtcgatgctaccagcctgttcctgttgtttcttgctcagatgacagcctccggactgaggatcatcttcacgctcgatgaggtggcattcattcagaatctggttttctacattgaagcggcgtacaaagtcgcggattacggcatgtgggaaagaggagataagacaaatcagggtatacccgagcttaatgcatcttccgtgggcatggccaaagcagccttggaagccatcgatgagctcgatttgtttggagctcatggaggcagaaaaagtgtgattcacgtcttacccgacgaggtggagcattgtcagtccatcctgttcagcatgctgcctcgcgcatcaacgagtaaggagattgacgcaggcctgttgtctatcatctccttccccgcctttgctgtggaggatgtgaatctggtgaatgtaacgaagaacgagattatctctaagcttcagggtaggtacggctgttgccgcttcctgcgggacggctacaagacaccccgagaagatcccaaccgtctgcattatgatcccgcggagcttaaattgttcgaaaatatagagtgcgaatggcctgtgttttggacttacttcatcattgacggagtcttctctggcgatgctgtgcaggtccaggagtacagggaggctctcgaaggcatcctgattcgtggaaagaatggaatcagacttgtgccagagctttacgctgtcccccccaacaaggttgacgaagagtacaaaaatccacacacagttgaccgggtacctatgggcaaggtgccccatctgtggggacagagcctttatatcctgtcctcactgctggcggaagggtttttggccgccggcgagatagatcctctaaatcgccgattctccacttctgtgaagccggatgtagtagtccaggtcacagtcttagcagagaataatcatatcaaggacttgctgcggaagcatggtgtcaacgtccagtctatcgccgatatacaccctattcaggtgcaaccaggccgcatcctctcccatatctacgccaaactgggccgtaataagaacatgaacctgagcggcagaccctatagacacattggcgtcctgggaactagcaagctgtacgttatacgaaatcaaatctttaccttcactcctcaattcacagatcagcaccacttttatctcgcgttagacaatgaaatgatcgtagaaatgctgaggatcgagttggcttatctgtgcacgtgttggcgaatgaccggtcgccccacgctgacctttcctatctccaggactatgttaaccaacgacggaagtgatatccactccgctgtactgtccacaattaggaagttagaggatggatattttggtggagccagggttaaacttgggaacttgtctgagtttcttactacaagcttttacacctatttgacattccttgaccccgactgtgatgaaaagttatttgacaacgcttccgagggcacattcagtcccgattcagacagcgatctcgtggggtaccttgaggatacgtgtaatcaagaaagccaggacgagctggaccattacataaatcatcttctccagagtacatcgctgcgcagctatctacccccactatgcaagaataccgaggaccgacacgttttcagtgccatacactctaccagggatatcctaagtgtgatggccaaagctaaaggcttggaagtaccattcgtgcctatgaccctcccgaccaaagtgctgagcgcccatagaaagtcacttaacctggtggatagcccacaacctcttctagaaaaagtccctgaatctgattttcagtggcccagggatgatcacggagatgtcgattgcgagaagctggtcgaacagcttaaggattgctctaacctgcaggatcaggcagatatcctgtacatcctctatgtgatcaaggggccaagctgggacaccaatctgagcggccaacatggcgtgactgtgcagaacttacttggagagctgtatggcaaggccgggctaaaccaggaatggggattgatccgatatataagcggcctgcttagaaaaaaggtagaggtcctggccgaggcttgcaccgacctgctgtcccaccaaaaacagttgactgtcggcctcccaccagagccgagggaaaaaataatatccgcacctctacctccagaagagttgaccaaactcatctacgaggcctctgggcaggatatttcaattgctgtgcttactcaagaaattgttgtttatctggccatgtacgtgcgggcacagccaagcctgtttgtagaaatgcttcggctgcggattggcctgatcatccaggttatggctaccgagctcgccagatcactgaactgttcaggggaggaggccagcgagtctttgatgaacctaagtccatttgatatgaagaatttattgcatcacatactgtctggcaaggaatttggggtcgagcgcagtgtaagacccatccacagctcaacctcttccccaacgatcagtattcatgaggtggggcacactggagtgaccaaaacagagcgcagcggaatcaataggctgagaagtgagatgaagcagatgacgaggcgcttctccgccgacgagcagttcttcagtgtcggccaggctgccagcagcagcgctcattcctccaagtctgccaggagtagcaccccctcttccccaactggcacttcctcaagcgatagtgggggacaccatatcggatggggagaacgccagggtcagtggctgcgccgccggagattagacggcgccataaatcgggtgcctgtcgggttctatcagcgggtgtggaagattttacaaaagtgccatgggctatcaatcgacgggtatgtcctccctagtagcaccactcgagagatgactccccatgagattaaatttgccgtgcatgtggagagcgtgctcaatagggtgccgcagccggagtatcggcagctgctggtggaagctattatggttctgacattgctcagcgacaccgagatgacctccatcggcggaattatccatgtcgaccagatagtccaaatggcctctcagctgttcctacaggaccaggtttccatcggtgcgatggacacactggaaaaagaccaggcgacagggatttgtcattttttttacgactcagcgccatccggagcttacggtacaatgacctacctcactcgggcagtagcctcttacctgcaggagctcctcccaaatagcgggtgtcaaatgcaa

SEQ ID NO: 18098 - DNA, 3705 bp, Artificial Sequence
  Description of Artificial Sequence: Synthetic coding sequence
atgagatccagatcgaactcaggcgtgcggttggacgggtacgcgcgtttggtgcagcaaaccatcttgtgttaccagaacccggtgacgggacttctgtcagcctcgcatgaacaaaaggatgcatgggtgagagataacatttactccattctggcagtgtggggcctgggtatggcgtacagaaagaatgcggatagagacgaagataaagcaaaggcctatgaactggagcagaacgtggttaagctgatgagaggattgctgcagtgcatgatgcgacaagtcgccaaagtggaaaagtttaaacatacccagtccaccaaggattcactgcacgcaaagtacaacaccgcaacctgtggcactgtagtgggggacgaccagtggggacatctgcaggtggatgcgacttcgctcttcctcctgtttcttgcacagatgaccgcatccggtttgagaatcatctttactctggatgaagttgcattcatccagaaccttgtgttctacattgaggcagcatacaaggtggcggattacgggatgtgggagcgtggagataagaccaaccaggggattcctgagctgaacgcctcctcagtgggtatggcaaaggctgcactggaggcgatcgacgaactcgatctttttggtgcccatggtgggcgaaagtccgtcattcacgtccttccggatgaggtggagcattgccaatcgatcctgttcagcatgctgcctcgagcgtcaacctccaaagaaattgatgccggcctcctttcgataatctcttttcctgcctttgcagtcgaagatgtcaacctggtgaacgtgaccaaaaatgagatcatatcaaaacttcaaggcaggtacgggtgctgtaggttcctgagagacggatacaagactcctcgagaggatcctaacaggctgcattatgatcctgcagagctgaagctcttcgaaaacattgaatgtgagtggccggtcttttggacctacttcatcattgacggcgtcttttcaggtgacgcagtgcaagtacaagaataccgcgaagccctcgaaggtatactgatcagaggtaagaacgggattaggctcgtgccagagctgtacgcagtcccgcccaacaaggtcgatgaagaatacaagaacccacatactgtcgacagggtccccatgggtaaggtccctcatctttggggtcagtcgctctacatattgtcctcgcttctggcagagggcttcctcgctgctggagaaatagatccactgaaccgaaggtttagcactagcgtgaagccagatgtggtcgtgcaggtgaccgtcctggccgaaaacaaccacattaaggatcttcttagaaaacacggtgtgaatgtccaaagcattgcggatattcatccaatccaggtgcaaccaggaagaattctttcccatatctacgctaaacttggtcgtaataagaatatgaacctgtcgggacgaccttacagacacattggtgtccttggaacctcgaagctgtacgtgatacggaaccagattttcactttcaccccccagtttacggaccagcatcacttctatttggcacttgataacgagatgatcgtggaaatgctgagaatcgaactggcatacctctgcacttgttggcgaatgacgggtaggccaactctcacttttccgatttcacgcaccatgttgactaatgatggttcggatattcactcggcagtgctcagcaccattcggaaacttgaagatggttactttggaggtgcacgcgtcaagctcggtaacctgtccgaatttctgaccacctccttttacacttacctcacttttctcgaccccgattgtgacgaaaaacttttcgataatgcatccgaagggacctttagcccggatagcgattccgatttggttggataccttgaggatacctgcaaccaggagtcccaagatgaactcgatcattacattaaccacctcctccaatccacctcactgagaagctatttgcctcccttgtgtaagaatactgaagatcgacatgtgttcagcgccattcactcgacccgcgatatactttccgtgatggcaaaagcgaagggactggaagtccctttcgtgccaatgacccttccaactaaggtgctgtctgctcacagaaaatcgcttaacctcgtggattcgcctcagcctctcctggaaaaggtgcctgagagcgacttccagtggccaagagatgaccacggtgacgtggactgtgaaaaacttgtggaacagctgaaggattgttccaacctccaagaccaagcagacattctgtacatcttgtatgttatcaaaggacctagctgggatactaacttgtcaggccagcatggcgtgaccgtgcaaaaccttcttggagagctgtacggaaaggccggtttgaaccaagaatggggacttattcggtacatttcaggcctcctcaggaaaaaggtggaagtgctggcagaagcgtgcacggacctcctttcgcatcagaagcagctgactgtcggactccctccagagcctagggaaaagattatctcggcccctctgcccccagaggaactgacgaagctgatatacgaagcatcgggacaggatatctcaatagccgtgcttactcaggaaattgtggtttacctcgcaatgtacgtaagagcacagccttcgctgtttgtggaaatgctcaggctgagaattggtctgataatccaagtcatggcaaccgaattggcaaggtcactgaactgttcgggagaggaagcaagcgaatccctgatgaatctgtcgccgtttgacatgaagaatctcctccaccacattctgtcagggaaggagtttggagtggaacgctcagttagaccgattcattcctctacgtcgtcgccaaccatttctatacacgaggtgggtcacaccggggtgactaagaccgagagatcgggcatcaatcggcttaggtcggaaatgaagcaaatgactcgtcgtttttcggcagacgaacagtttttcagtgtggggcaagcagcgtcgtcgtccgcccactcgtcgaaaagcgcccgaagctcaaccccttcgagtcccactggcacgagctcgtccgacagcggcggtcaccatatcgggtggggggaacggcagggacaatggctgcggaggcgtagattggacggagccattaatcgcgtgcctgtgggattttaccaaagagtgtggaagattctgcagaagtgtcatggactttcgatcgacggatacgtgcttccatcatccaccactcgtgaaatgaccccacacgagattaagttcgctgtccatgtggagtcggtcctgaacagggtgccgcaacccgaatacagacagctccttgtggaagcaataatggtgctgactctgctgagcgatactgaaatgacttcgatcggcgggattatacacgtggaccaaatcgtgcaaatggcatcccaactttttcttcaggaccaagtgtccattggcgcaatggacaccctggagaaagatcaggccactggaatttgtcatttcttctatgattcggcaccaagcggagcatacggcaccatgacctacctgactcgcgccgtggcgtcgtaccttcaggagctccttccaaactccggttgtcagatgcag

SEQ ID NO: 18099 - DNA, 3705 bp, Artificial Sequence
  Description of Artificial Sequence: Synthetic coding sequence
atgcgctcccggtcaaattccggggtccggctcgatggctatgcccggcttgttcagcaaaccatcttgtgctatcaaaatccggttaccggactgctctcggcctcgcacgagcaaaaggacgcttgggtccgggataacatctatagcatcctggcagtttgggggctggggatggcgtacagaaaaaatgctgatcgggatgaagacaaggctaaagcctacgaactggagcagaatgtggttaagctgatgcggggactgctgcagtgtatgatgcggcaggtggccaaggtggagaagttcaagcacacccaatccaccaaggactccctgcatgcgaagtacaacacggctacctgcggaacggtggtgggagacgatcagtggggtcacctgcaagttgatgcgacctccttgttcttgctgttcctggcccaaatgactgcctcgggactcaggatcatcttcactctcgacgaggtggccttcatccagaaccttgtattttacatcgaggcagcctacaaggtggccgactacggcatgtgggagcgcggtgataagacgaatcagggtatccctgagctgaatgcaagctcggtgggtatggcaaaagccgcactcgaagctatcgacgaactggacctgtttggagctcacggaggtcgcaaatcggtgatccacgtcctccctgatgaggtcgagcactgccaatccattctgttctcgatgctgccgagggcgtcgacctccaaagagatcgatgctggactgctgagcatcatctccttcccggcattcgccgtggaagacgtgaacctggtgaacgttacgaaaaatgagataatctccaagctgcagggccggtacggatgctgtcggttcctgcgagacggctacaagaccccgcgcgaagacccgaacaggctgcattacgaccctgctgagctgaagttgttcgaaaacatcgaatgcgaatggcccgtgttctggacttactttatcattgatggcgtgttctccggcgacgcagtccaagtccaagaatacagagaggcactcgaaggaattctgatccgcgggaagaacgggatccgcctggtgccggagctttacgccgtgccaccaaataaagtggatgaagagtataagaacccgcacactgtggatcgggtgccaatgggcaaggtgccgcacctgtggggccagtcgctgtatatactcagctcgctgctggccgaaggattcctggcagctggcgaaatcgatccgctcaaccgccgcttcagcacttcggtgaagccagacgtggtggtgcaggtcactgtgctggcggagaacaaccatatcaaagacctgcttcgaaaacacggagtcaacgtgcaatcgatcgcggatatccatccgattcaggtgcagccgggacgcatcctgtctcacatttacgctaaactcgggcggaacaagaacatgaacctttcgggcagaccataccggcacatcggtgtgctgggaacttcgaagctgtacgtaatccggaatcaaatcttcacctttactcctcagtttactgaccagcaccatttttacttggcactcgataacgaaatgatcgtggaaatgctgcgcattgaactggcgtacctgtgcacttgctggcggatgaccggacgtccaaccctgactttcccgatatcccgcaccatgctgaccaacgatggatcagacatccactcggcagtcctcagcaccatccgcaaactggaggatgggtactttggtggcgcccgggtgaagctgggcaacctctcggagtttctgactacttctttctatacctacctgaccttccttgaccccgactgtgatgaaaagctctttgacaatgcatcggaaggcaccttctcacctgactcggactccgaccttgtgggatacctggaggacacctgtaaccaagaaagccaagacgaactggatcattacatcaatcatttgctgcagtcgacttccctgcggagctacctgccgcctttgtgcaaaaataccgaggaccgccatgtcttctcggcaattcactcgactcgggatattctgtccgtaatggccaaggccaagggtctggaggtgccattcgtcccgatgactctccctactaaggtgctgagcgcgcatagaaagtctctgaatttggtcgacagtccacagccgctgctggagaaagtgccagaatcagacttccaatggccgcgcgatgatcatggggacgtggactgcgagaagttggtggaacagctcaaagactgctcaaacttgcaggaccaagcggacatcctgtacattttgtacgtgatcaagggtccatcgtgggacacgaacctctccggccagcacggagtgaccgtgcagaatctgcttggagaactttacggtaaggcgggattgaaccaggagtggggattgatcagatacatcagcggactgctcagaaagaaggtcgaggtgctcgctgaagcctgcaccgacctcttgtcgcatcagaagcaactcactgtcggactgccgcccgagccgcgggagaagatcatctccgcacctctcccgccagaagagctcaccaagctgatttacgaagcctcgggacaggatatctcgatcgccgtcctcacgcaggaaatcgtggtctacttggcaatgtacgtcagagcacagccgagcctgtttgtggagatgctgcgtctcagaatcggtctgatcatccaagtgatggccaccgaactggcacgatcgctcaactgttcaggagaagaggcttcagaatcgctgatgaacctctcgccattcgacatgaaaaatctgttgcaccacattctgtcgggtaaagagttcggagtggagcgctcagtcaggccgattcattcatcaacctcatcccccacgatctcgatccacgaagtgggacatacgggcgttaccaagaccgagcggtcgggaatcaaccgcctgcgttcggagatgaaacagatgactagacggttctccgcggacgaacaattcttctcggtcgggcaagcagccagctcctccgcccattcttccaagtcagcgcggtcaagcactccttcgtcgcctaccggaacctcatcatcggactcaggagggcaccatatcggatggggagaaagacagggccaatggctccgccgccggcgcctcgacggagcgatcaacagggtcccggtgggtttctaccaacgcgtctggaaaatcttgcagaaatgccatggactctctatcgatggttacgtgctgccttcttcaaccacgcgggagatgacgccacacgaaatcaagttcgcagtgcacgtcgaatccgtcttgaaccgcgtgccgcaacccgaataccgccaacttctcgtggaggccatcatggtgctgactctcctctcagacaccgaaatgacgtccatcggaggcatcatccacgtcgaccagatcgtccagatggcctcgcagttgtttcttcaagaccaagtttccatcggagccatggatacgctggaaaaggatcaggcgacggggatctgccacttcttttacgatagcgccccctcgggagcttacggaactatgacctacctgacgcgcgcggtggcctcctacctgcaagaactccttccgaattcgggttgccagatgcag

SEQ ID NO: 18100 - DNA, 3705 bp, Artificial Sequence
  Description of Artificial Sequence: Synthetic coding sequence
atgagatctcgcagcaacagtggagtaagactggatggatatgcccggttggtccaacagaccatcctgtgctaccagaaccccgtaactggactcttgtccgctagccacgaacagaaggatgcttgggtcagagataatatctattccatcctggcagtttggggtctgggtatggcttataggaaaaacgccgaccgagatgaagataaagcaaaagcgtatgaactggagcagaacgtggtcaagcttatgcggggcctgctgcagtgtatgatgaggcaggtcgccaaggttgagaaattcaaacacacccaaagtacgaaggatagcctacacgccaagtacaacaccgcgacatgcgggacagtggtgggtgacgaccagtggggccacctacaggtggacgcaaccagtttatttctgctgttcttagctcagatgacagccagtggccttcggatcatcttcacgctggatgaggttgctttcatccagaacttggtgttctacatcgaagccgcttacaaggtggccgattacggcatgtgggaacggggtgacaagacgaaccagggcattccagagctgaacgcgtcctccgtgggcatggccaaagccgctctcgaggcgatcgacgagctcgatttgtttggcgctcatggagggcgaaaatccgtgattcatgtgctcccggacgaagtggagcactgtcagagtatccttttctcgatgttgccaagggctagcacgtctaaagaaattgacgctggcctccttagtatcatttctttcccagccttcgcagtggaagacgtgaacctcgtcaatgtgacgaagaacgaaatcatttccaagctgcaaggcaggtatggttgttgcaggttccttcgcgatggatataaaaccccacgagaggatcccaaccgacttcactatgaccctgccgaactgaagctcttcgagaacatcgagtgtgagtggcccgttttctggacctatttcattattgatggcgtgttctctggcgacgcagtccaggttcaggaataccgcgaagcgctggagggaattttgatccgcgggaagaacggcatccggttggtccccgagttgtacgccgtgccgcccaataaggtcgacgaagaatataaaaacccacacactgtcgatcgagtccccatgggcaaagtccctcatctgtgggggcaaagcctgtacattctgtccagtctgctcgccgaggggttcctggcagccggagaaatcgaccccctgaatcggcgattctctactagcgtgaagcccgacgtggtcgtgcaggtaaccgtgcttgcagagaataaccatattaaggatctgctgcgcaaacacggagttaacgtacagtccattgctgatatccatcccatccaagtccagccagggcgcatcctgagccatatctatgctaagcttgggaggaataaaaacatgaacctgagtggccgaccctacaggcacataggggtgttaggaacctccaaactgtatgttattcgcaatcaaatatttaccttcactccacagtttaccgaccagcaccacttttacctggccctcgataatgagatgatcgtggaaatgctacgcattgagctggcgtacctgtgcacctgttggcggatgacaggccgccctacactcacctttcccattagtcggactatgctgacaaatgacgggtcagacatccacagtgctgtgctgtccacaatccgcaagctggaagatggatactttgggggcgcccgcgtgaaactcggcaacttaagtgaatttctgacgaccagcttttacacatatctgacctttttggatccggactgcgatgaaaaactgtttgataacgcctctgagggaactttcagcccagactcggattcagatctagttggatatctggaagacacctgtaaccaagaatctcaagacgagctggatcattacatcaaccacctcctgcagagcacatctttacgcagttatctcccacctctgtgcaagaacactgaggatcgccacgtgttttcggcgatccacagcacccgcgacatcctgtccgtgatggctaaggccaagggcctggaagtgcccttcgtccccatgacgctccctacgaaggtcctttccgctcaccgtaagagtctcaatctggtcgattctccccagcctcttttggagaaagtgcctgagtccgattttcaatggcccagagatgatcatggtgacgtggactgcgaaaaactggtggagcaattgaaagattgttcgaacctgcaagatcaagcagatatcctttacatcctgtatgtgattaagggtccttcatgggacactaacctctccggccagcatggggtcacagtgcagaatcttctgggcgagttatacggcaaagcaggcctcaatcaggagtggggcttgattcgttacatcagtgggttgctcaggaagaaggtggaggtgcttgcagaggcctgcactgacctgctatcccaccaaaaacagctcaccgtcggattacccccagagcccagagagaagatcatttccgcccctctccccccggaggagttaacaaagctgatttacgaggcatcggggcaggacattagcattgccgtgctaacccaggaaatcgtagtgtatttggcaatgtacgtgcgagctcagccttctttgttcgtagaaatgctgagattacgtattggactaattatccaggtcatggccactgaactggcccggtccctgaactgctccggagaggaagcatctgaatctctgatgaacctgagcccttttgatatgaaaaatctgctgcatcacatcctctccggcaaggagtttggcgtcgagagatcagtgcgccctatccattcatcgacctcttcccccaccataagtattcatgaggttggacataccggggtcaccaagaccgaacgcagtgggatcaacaggttaaggagcgaaatgaaacagatgacacgccggttttctgctgatgagcagttcttttcggttggacaggccgccagctcaagtgctcattctagcaaatcagccaggtcaagtacaccatctagtccaacgggtacctccagctccgatagcgggggacaccatattggctggggagagcggcagggtcagtggcttcgcaggcggagattggacggcgctatcaatagagtccccgtgggcttttaccagcgggtgtggaagattttacaaaaatgtcacgggctctccattgatggctacgtcttgccctcttcaacgaccagggagatgaccccccatgagatcaagttcgctgtgcacgtagagtcggtgctgaaccgggtaccacagcctgagtatcggcagcttctggtggaagcgatcatggtgctgactctcctctctgacactgaaatgaccagcatcgggggcatcatccacgtggaccaaatagttcaaatggccagtcagttgtttttgcaggatcaggtctccatcggagctatggacacattggaaaaggaccaggcgacaggtatctgccacttcttctacgatagtgccccctccggagcttacgggaccatgacatatctcactcgggccgtggcgtcctatctgcaggagcttctacccaatagcggatgtcagatgcag

SEQ ID NO: 18101 - DNA, 3705 bp, Artificial Sequence
  Description of Artificial Sequence: Synthetic coding sequence
atgcggtcccggagcaattccggcgtgagacttgatggttacgctcggctggtccagcagacaatactttgttaccagaaccccgtgaccggactgctttctgccagccacgagcaaaaagacgcatgggttcgagataacatttactctattttagccgtgtggggcttgggaatggcatatcgaaaaaacgccgatcgcgatgaggataaggccaaagcctacgaactggagcagaatgtggtgaagttgatgcgcggactacttcagtgcatgatgcgccaggtggcgaaggtcgagaaattcaagcacacgcagagcactaaagatagcctgcacgcaaaatacaatacagcgacgtgcggcaccgtagtgggtgatgatcagtggggccacttgcaagtcgatgccactagcctattcctgctgtttctggcccagatgacggctagtgggctacggattatcttcacgttagatgaggtggcattcatccaaaacctggtattttacatcgaggcagcctacaaggtggcggactatggcatgtgggaacgtggcgataagacgaatcaaggaatcccagaactcaatgcttcctccgtcggcatggcgaaagccgcactggaggccattgatgagcttgatctgttcggtgcccacggaggcagaaagtctgtaattcacgtgcttccggacgaggttgagcattgccagtcgatcctgttctccatgctgccacgcgcctctacgtcgaaggagatcgacgccggcctcctttcgatcatatcgttccccgcgttcgctgtggaggacgtgaatctggtgaatgtgacgaagaatgaaataatctccaagctgcaggggcggtacggatgctgtaggtttttacgtgatgggtataagacgccgcgagaggatccaaatcgtctgcactatgatcccgctgagctgaagctgttcgagaatattgagtgcgaatggcccgtgttttggacctacttcatcattgatggcgtcttcagtggcgatgcagtccaggtgcaggagtaccgcgaggccttggagggaatactgatcaggggaaagaacggaatccggctggtaccggagctgtacgcggtacccccaaacaaggttgacgaagagtacaagaaccctcacaccgtggatcgtgttcctatgggtaaagttccgcatctttgggggcaatccttgtatatcctgtccagtctactggccgaaggattcctggcggccggagagattgacccgctgaaccgtcggttctcgacaagtgtgaaacctgacgtcgtggtgcaggtcacagtcttagccgagaacaaccacatcaaggacctgttgcgcaagcacggcgtgaacgttcagtctatagcggatattcatccaatccaggtccaacccggcagaattctgagtcacatctacgccaaactgggtcgcaataagaacatgaacctgagcggccgtccctaccgccatattggcgttttggggacaagcaagctttatgttattcggaaccagatcttcacttttacaccccagtttacggaccagcatcacttctatttagctctggacaacgagatgatcgtggagatgcttcgcattgagctggcctacctgtgcacctgctggcgtatgacgggcaggccgacactgacctttccgatctcccgcaccatgcttaccaacgacgggtccgacatccacagcgcggtgctttctaccatccgcaagctggaagacggctactttggcggcgcacgcgtcaaattggggaacctgtccgagtttctcacaacatccttctatacctacctgaccttcctagacccggattgcgatgagaagctttttgacaatgcttcggagggaacgtttagcccagactcggacagtgatctggtgggctacctggaggacacgtgcaatcaagagagccaggatgagttggatcactacataaatcacctactccagtctaccagcctgcgtagctaccttcctccgctgtgtaagaacactgaagatagacatgtgtttagcgcgattcatagtacaagggatattctgtcagtgatggccaaggcaaagggtttggaggtgccctttgttccgatgactcttcccactaaggttttgtcagcccaccgcaagtcgcttaacctagtggatagtccgcagccgctcctagagaaggtccccgagtccgatttccaatggccacgggatgatcatggagatgttgattgtgagaagctagtggagcaactcaaggattgctccaacctgcaggatcaagcggatattctgtacatcctttacgtaattaagggcccaagctgggacaccaacctgtctggacagcatggcgtgacggtccagaatctgcttggtgagctgtacggtaaggccggcctgaatcaggagtggggtctaatacggtatatctctggtctgctacgtaagaaagtagaggtgttagccgaagcctgcacagacctgctgtcgcatcagaaacagctcactgttggactgccgccagagcccagggagaaaattattagcgcaccactgccacccgaggagcttaccaagctgatctacgaggcctccggccaagatatctccattgccgttctgactcaagagatcgtcgtgtatttagccatgtacgtgcgggcccagccctcactcttcgtagaaatgctgcgactgcgtattggactgatcatccaagtgatggccacggagttggcgcgctcgctaaattgctcaggcgaggaggcttctgagtcgctgatgaatctctctcctttcgacatgaagaacctgttgcatcacattttaagcggtaaggagtttggcgtagaacggtcggtgcgaccgatacacagctccacgagcagtccgaccatctcgatccacgaggtgggccacactggagtcactaagacggagcgcagcggcatcaacagactgcgctccgagatgaagcagatgacgcgacgcttctcggcagacgagcagtttttttcggtggggcaggctgcatcctcctcggcgcacagtagcaaatcggctcggtcatctacgccgtccagtccaactggaacatcgagctctgacagcggtggccatcacattggctggggcgaaaggcagggccagtggctccgtcgccggcgcctcgacggcgccattaatcgcgttccagtgggattctatcagcgagtatggaagattctgcaaaagtgtcacgggctatccatcgatgggtacgttctacctagctcgacaacaagggagatgacgccacacgagataaagttcgcggtgcacgtggaatccgttctgaaccgggtcccacagccagagtaccgccaacttctggtcgaagccatcatggttctgacgcttctgagtgacacggagatgaccagcatcggtggcatcattcatgtggaccagattgtccagatggcgtcccaactgttcctgcaagaccaggtgagtatcggagccatggatactctggaaaaggatcaagcaaccggaatctgccacttcttttacgactcggcaccgagtggtgcatacggcactatgacctacctcactagggcagtcgcttcttacctccaggaattgctgccaaactcaggttgccagatgcaa

SEQ ID NO: 18102 - DNA, 3705 bp, Artificial Sequence
  Description of Artificial Sequence: Synthetic coding sequence
atgaggtcccgcagtaactctggcgtgcgactcgacggatatgcaaggttggtgcagcagacaattctttgctaccaaaaccccgtgaccggtcttctgtccgccagccacgaacaaaaagacgcctgggttagagataacatttattctatcctggctgtgtggggcctgggaatggcctatcgaaagaatgctgaccgggacgaagacaaagccaaggcttacgaactggaacagaatgttgtgaagctgatgagaggactgctgcagtgtatgatgagacaagtggcgaaggttgaaaaatttaagcatacccagagtactaaggatagcttgcacgcaaaatataacaccgctacatgtggcaccgtggtgggtgatgaccagtggggacacctgcaggtcgacgctacctccctgtttctgctgtttcttgcccagatgaccgcaagcggacttaggatcatcttcactctcgatgaagtggccttcattcaaaacctggtgttctatattgaggccgcctataaggtcgctgattatggaatgtgggagaggggcgataagaccaatcagggaatccccgaactgaatgcatcttcagtgggaatggccaaagccgcactcgaggcgatagatgagctcgatctgttcggggcccacggtggtcgaaagagtgtcatccacgttctccccgatgaggtagaacactgccagagcatcctcttcagcatgctgcctcgcgcatctacatccaaggagatcgacgccggtctcctcagtatcatctccttccccgccttcgcggtagaagatgtgaatctggtgaacgtcaccaagaatgaaattataagcaagttgcaggggcggtacggttgttgtcgcttcctgagggatgggtacaaaacgcccagggaagaccccaacaggctgcattacgaccccgctgagctgaagctgttcgagaacatagaatgtgagtggcccgtgttctggacatactttatcatcgatggcgtgtttagtggcgatgccgttcaggtgcaagagtaccgcgaggcactcgaaggtattctgatccgaggaaaaaacggaatcaggttggtccctgagctttacgcagttccccccaacaaggtggatgaagagtataagaacccgcacaccgtcgatagagtgcccatgggcaaggttcctcacctgtggggacagtctctgtatatcctgtcttcattgctggctgaggggttcctcgcagctggtgaaatagatcctctgaatcgccggttttctacatctgtgaaaccagacgtagttgttcaggtaactgtgctggccgaaaataaccatattaaagatctgctgcgcaaacacggggtgaacgtgcagtctatcgccgacatccatcctattcaggtacagcctggcagaatattgtctcacatttatgcaaagctggggcggaacaagaacatgaatctgtccggacggccgtacaggcacatcggagtactcggtacatcaaaactgtacgtgattcgcaaccagatctttaccttcaccccacaattcaccgatcaacaccatttctacctggctctggataacgaaatgatcgttgagatgcttaggatcgagctggcctatctctgcacatgctggagaatgacaggccgccctactctgacatttcctatctcccgaaccatgctgacaaacgatggtagcgacatccacagtgcagtactgtccactatccgaaagctggaggacgggtatttcggaggcgcaagggtaaagcttggaaatctctcagagttcctgactacctcattttacacttacctcacatttctcgaccctgactgtgatgaaaaacttttcgataatgcttccgaaggaaccttctctcctgactccgactcagacctcgtaggctacctggaggatacttgcaaccaggagagccaggacgagctggatcattatattaatcacctcctccaaagtacaagcctcagatcctacctgcctccattgtgcaagaatactgaggatcgccacgtgttctctgccatccactccactagagatatccttagtgttatggcaaaggctaaaggcctggaggtcccttttgttcctatgacactgcctaccaaagtcctctccgctcaccgcaaatctctgaatcttgtcgacagcccgcagccactgctggaaaaggtgcccgaatccgatttccagtggcctagagatgaccatggggacgtagactgcgaaaaacttgtggagcagctgaaggattgcagtaatttgcaagaccaggccgacatcctgtacatactgtacgtgattaaaggtccaagttgggatacaaacctgtcaggtcagcacggcgtgaccgtgcaaaacttgctgggcgaactttatgggaaagccggactgaatcaggaatggggccttatcaggtacatctccggactgctccggaagaaagtcgaggtgctcgccgaggcctgcaccgacttgctgtcacaccagaagcagctgaccgtcggacttccgccagaacctagggagaagatcattagcgctccattgccccccgaggagctgaccaagcttatttatgaggcatcaggacaagacatctctatagccgtgctcactcaggaaatcgtagtgtacctcgccatgtacgtcagagcgcagccatcactgttcgttgaaatgctgagactccgaatcgggcttatcattcaggtgatggcaaccgagctggccagatccctgaactgttccggtgaagaggcatctgaatccctcatgaacttgtctcccttcgacatgaagaatctgcttcaccacatcctgtctggtaaggagtttggcgtggagcggagtgtgaggcccatccactcttctactagcagccccacgatctcaatacacgaggtgggacacaccggcgtgaccaagaccgagagatccggcattaatcggcttaggagcgaaatgaagcagatgaccagacggttcagtgccgatgagcagttttttagcgttggccaggctgcctcttcttccgcacatagcagcaaatccgccaggagcagtacaccatctagcccgaccggcacgagcagcagtgactccggcgggcaccacatagggtggggcgagcgccaggggcaatggctgaggaggagacgcctggacggagccataaatcgcgtgcctgtgggcttttatcagcgggtctggaaaatactgcagaagtgccacggactgagtattgacggctatgttctcccctcttctacaacgagggagatgaccccccatgaaataaaattcgcagttcacgtggaatcagtcttgaacagggtgcctcaaccagagtaccgccagctgctggtggaagcaattatggtgctgaccttgctgtctgataccgagatgacaagcatcggcggaattatccacgtagatcaaattgtccagatggcgtctcagctgttccttcaggaccaggtgagtatcggcgctatggataccttggagaaagatcaggccacgggaatctgtcacttcttctatgacagcgctccaagcggtgcttatgggactatgacctacctgacccgcgctgtagcctcatacctccaggagctgcttcccaatagcggatgccaaatgcag

SEQ ID NO: 18103 - DNA, 3705 bp, Artificial Sequence
  Description of Artificial Sequence: Synthetic coding sequence
atgagatcgaggagcaattccggtgtgcggctggatggctatgctcgcctggtccagcagacaatcctgtgctaccaaaaccccgtgacaggtctgctgtccgcgagccatgagcagaaggatgcttgggtccgcgacaacatctactccatcctggctgtatggggactgggtatggcatatcgcaaaaacgccgaccgagacgaggacaaggcgaaggcctacgaattggagcagaacgtggtcaagctgatgagaggtttgcttcagtgcatgatgcgccaagtggctaaggttgagaagtttaaacatacccaatcaaccaaagattccttgcatgccaagtacaatactgccacgtgtgggacagtcgtgggggacgatcagtggggtcacctgcaggtggacgctacctctctttttctcttatttctagcccagatgacagcatcagggcttcggattatattcacactggacgaagtggcttttattcagaatctcgtgttctacatagaagcagcttacaaagtggccgattacggcatgtgggaacgcggagataagaccaaccaagggatcccagaattgaacgccagctccgtagggatggcgaaagccgctctggaggcaatcgatgagctggacctgttcggtgctcacgggggacggaagtccgtaattcatgtcctgcccgacgaggtcgagcattgccaatcaatactgttctcgatgctgccacgggcttccacatctaaagagatcgacgccggcctgctgagtattatctcctttcctgccttcgctgtggaggatgtcaacctggtgaatgtaacaaaaaacgagattatttcaaagctgcagggccgctacgggtgttgtcgattccttcgcgacgggtacaaaactccccgggaagacccaaatagactgcactacgatcctgccgagctcaagcttttcgagaacatcgagtgtgagtggccagtgttctggacatacttcatcatagatggggtgttttcaggagacgccgtgcaggtacaggaatatagagaggcgctagaggggatcctgattcgtggtaagaatgggatccggctggtgcccgagctgtatgcagtgccaccaaataaagtagatgaggaatataagaatccgcacactgtcgatcgggtccccatgggcaaggtaccccatctctgggggcagtctctgtacattctgtcttccttgctggcagagggctttttggcagccggggagattgaccccctcaaccggcgctttagtacgagtgtcaagccggacgtagttgtgcaggtgacggtcttagccgaaaacaaccacatcaaagacctgttgcggaagcatggtgtcaatgtacagtcaattgcagacatccatccaatccaggtgcagcctggacggatcctgagccacatttatgccaagctgggtaggaacaaaaatatgaatctgtctggaagaccatatcggcatatcggggtgctggggacctccaaactctacgtgattcgcaatcagattttcacattcacgcctcagttcactgatcagcaccacttttacttggccctcgataacgagatgattgtggaaatgctcaggatcgaactggcttacctgtgcacgtgttggcgtatgactgggagaccaactctcacgttcccaatcagcaggaccatgctgacgaacgacggttccgatatccattccgcggtgttgtcaacaatcagaaaactagaagatggctacttcggcggtgccagagtcaaacttggcaacctcagcgaatttctgacgacgtctttctatacataccttacttttctcgatccagactgcgatgagaaactgtttgacaatgctagtgaaggaacctttagtcctgattctgacagtgatcttgtcggttacttggaagatacatgtaatcaggaatcgcaggacgagcttgatcactacatcaatcaccttctacagtcaacctctctgcgttcgtatcttcctccgctgtgcaaaaacactgaggaccgccatgtgttctcagctatacattccactcgcgatatcctgtcagttatggcaaaagctaagggtcttgaagtgccttttgtgcctatgacgttgcccacaaaagtactgtcagctcaccgcaagagcttaaatctggtggacagcccccaaccccttctggaaaaagttcctgaaagcgatttccagtggcccagggacgatcatggcgatgtggattgcgagaagctggtggagcagctgaaagattgttcgaatctccaagatcaggctgatatcttgtacattctgtatgtcatcaagggaccttcttgggacaccaatctgtctggccagcacggcgttactgtgcagaaccttttaggggagctgtacgggaaagcagggctcaaccaggagtggggcctgatccgatatatttctggtctcctgcgcaagaaagttgaggtgctggcagaggcatgcacagatctcctctcccaccaaaaacagctgactgtgggtctcccacccgagcctcgagagaagatcatctctgcgccattgcccccagaggagttgaccaagctaatctacgaggctagcggccaagacatatctattgccgtgctgactcaagaaatcgtcgtgtatcttgcaatgtatgtgcgcgcccagccctccctttttgtagagatgctcagacttcggattggccttattatccaggtaatggccaccgagttggctcgctcactcaattgttccggggaggaagcctccgagagcttgatgaacctcagcccttttgatatgaagaaccttttgcaccacatcctgtccggcaaagagttcggcgtagaacgaagcgttcgcccaattcatagtagtacctcctctcctaccatttctatccatgaagtgggacacaccggggttacaaagaccgagagatcgggaatcaatcgtctaaggtccgagatgaagcagatgactagacgattttccgctgacgagcagtttttctctgtgggacaggcagccagttccagcgcgcactcttccaagtctgccaggagctcaactccgtcctctccgaccggcacctccagtagtgatagtggaggacaccacatcgggtggggggagcgtcagggccagtggcttcggcgacggcgcctagacggcgccatcaaccgcgttccagttggcttttatcaaagagtgtggaagatcctgcagaagtgccacggcttgagtattgacggctatgtcctcccatcttcgacaacacgggagatgacacctcacgaaatcaagtttgctgtgcacgtggagtccgtgctaaatagggttcctcagcctgagtatcgtcaactgctggtggaagcgataatggtcctcacactgctgtccgatacggaaatgacatccatcgggggcattatccatgtcgatcaaatcgtccagatggcctctcagcttttcctccaagatcaggtctcaataggtgctatggacacactcgagaaggaccaggccactgggatttgccatttcttttacgactctgcccccagtggcgcttacggaacaatgacttatctaacccgcgccgtggcttcctatctgcaggaacttctgcccaattctgggtgccagatgcag

SEQ ID NO: 18104 - DNA, 3705 bp, Artificial Sequence
  Description of Artificial Sequence: Synthetic coding sequence
atgcgatcccggagtaacagtggggtacggctcgacggctacgcccgcctcgtgcagcagacaatcctgtgctaccagaacccggtaaccggactgctatcagcctctcacgaacaaaaagatgcgtgggtgagagacaacatttatagcatactggcagtatggggtctggggatggcatacagaaaaaatgcagacagggatgaagacaaagcaaaagcgtacgaactggagcagaacgtggtgaagctgatgcgcggtctgctgcagtgcatgatgcgtcaggtggccaaagtggagaagttcaaacacacccaatctaccaaagactctttgcatgctaagtacaacacagccacttgtgggactgttgtgggagacgaccagtggggccaccttcaagtggatgcaacatcgttgttcctgctctttcttgcgcaaatgaccgcatcaggtctgcggatcatttttaccctcgacgaggtcgccttcattcaaaatttagtattctatattgaggccgcgtataaggtagccgactatgggatgtgggaaagaggggacaagacaaaccaaggcatccctgagctcaacgcatcctcggtgggcatggctaaggctgctctcgaggccatcgacgagctggacctattcggagctcacggaggacgtaagtctgttatccatgtgctgcccgatgaggtggagcactgtcagtctattctgttttccatgctgcccagggccagcacaagtaaggaaatcgatgcaggcctgctgtctatcatctcttttcctgcctttgccgttgaggatgttaatctcgtgaatgttactaagaacgagattatctctaaactgcagggccgatatggctgctgcagattcctgagggatggctataaaacaccacgcgaggaccccaaccggctgcattatgacccagctgaactcaaactgttcgagaatattgaatgtgagtggcccgttttttggacctattttatcatcgatggggtgttttctggtgatgcggtacaagtgcaagagtaccgcgaggccctagaagggatcctgatcagagggaaaaatggcatccgcctggtgcctgagctgtatgctgtgcctcccaacaaagtggatgaggaatacaagaacccccatacggtagaccgggtgccaatgggaaaagtgccccatttgtggggacagtcactgtacattctgtcgtccctactagcagagggtttcctggctgctggtgagatagacccgctcaatcggcggttctcaacgagtgtgaagcccgatgttgtagtccaggttacggtcctggccgagaataaccatataaaggatcttttgagaaagcatggagtgaacgtgcagtcaatcgccgacatacatccaattcaggtgcagccaggtaggatcctttctcatatttacgccaaactcggccgtaataagaacatgaacctgagtgggaggccctatcgccatatcggtgtgctgggcacctccaaattgtacgtaatccgcaaccagatttttacattcacaccacagttcacagaccagcatcatttttacctagcgctggataacgagatgatcgtagaaatgttgcgcatcgaactggcttacctctgcacatgctggaggatgacaggacgccccacattgaccttccccatctcacgtacgatgctgaccaacgacgggtccgatatccacagcgctgtcctttctaccattcgcaaactggaggacggctactttggcggggctcgagtgaagctgggcaacctgagcgaattcctgactacaagtttttacacatacctgacttttttggatccagattgcgatgaaaaactcttcgataacgcgagtgagggcacatttagtccagatagtgacagcgatctcgtgggctaccttgaggacacctgtaatcaagagtcccaggacgaactggatcactatattaaccatctcttacagagcacgagcctgcggtcttatttgccacccttatgtaaaaataccgaggatagacacgtgttcagtgctatccattctacacgagatatcctctctgtcatggccaaagcgaagggcctggaagtcccgttcgtgcccatgaccctgcccaccaaggtactgtccgcccaccgcaaatccctaaatctggtcgacagcccgcagcctctcctagagaaggttcccgagagtgacttccagtggccacgcgacgaccacggggacgtggactgcgaaaagctggtggagcagctgaaagattgctccaaccttcaggatcaggcggacatcctctacattctatatgtgattaagggccccagttgggatactaatctctctgggcagcacggtgttacagtgcagaatctgttaggagagctttacgggaaagccggactcaaccaagagtggggactcatccggtatatcagcgggctgttgaggaagaaggtggaggttctggccgaggcgtgcacagatctcctcagtcatcagaaacaactcacggttggcctgccacctgagcctagagaaaagatcatctccgccccacttcccccagaagaactgacaaaactgatctacgaagccagtggccaggacatctcaatcgcagtgctgacccaagaaatcgtcgtctatctggccatgtacgtaagggctcagccgtcactgttcgttgaaatgcttcgactgagaatcggtctcataattcaggtgatggccacagaactggctcgctcactcaactgtagtggagaggaggcatctgagagcctgatgaaccttagtccattcgacatgaagaatttgcttcaccacattctgtctggcaaggagtttggcgtggaaaggagcgtcaggcccattcattcgtcaacctcctcgcccaccatcagcatacatgaggtgggccacacaggtgtgactaagacagaacgatccggaataaaccgtttaagaagcgagatgaaacagatgacgcgacgcttctccgccgatgagcagttcttcagcgtggggcaagcagcgtcaagcagcgctcatagcagtaaatcggccagaagcagtacccctagctcacccacagggacctcatcttctgattcaggtgggcaccatattggctggggtgagcgacagggccagtggctgaggcgcaggcgtcttgatggtgcaattaacagagttcccgtggggttctatcaaagggtttggaaaatccttcagaaatgtcatggactgagtatcgatggctacgtgctaccctcttctacgacccgagagatgactccccacgagatcaaattcgccgtgcacgtcgaatccgtcctgaaccgcgtcccacagccggagtaccgacagctcctggtggaggccatcatggttttaacattgctcagcgataccgaaatgacaagcatcggcggcatcatccacgtcgaccagatcgtccagatggccagccaactgttcctgcaagatcaggtgtccattggtgctatggacacattggagaaggatcaggcgacagggatctgtcacttcttttatgactccgcaccgagcggcgcttatgggacgatgacttatctcacccgcgcggtcgccagctatctccaggaactactgcccaattcaggttgccaaatgcaa

SEQ ID NO: 18105 - DNA, 3705 bp, Artificial Sequence
  Description of Artificial Sequence: Synthetic coding sequence
atgagatcacggagcaactccggagtccggctggatgggtacgccagactggtacaacagactattttgtgctaccagaaccctgtgaccggactactctccgcctctcacgaacagaaggatgcctgggtgcgtgacaatatatattccatcctggccgtgtggggtcttggaatggcttaccgcaaaaatgccgaccgggatgaagataaggcaaaagcttacgaattagagcaaaacgtggtgaaattaatgcgaggattactacagtgcatgatgcgacaggtggccaaggtggagaagttcaaacatacacagtctacaaaagatagcctgcacgctaagtataataccgctacatgcggcaccgttgtgggcgatgatcagtggggccacctgcaggtggacgctacaagcttattcttactctttcttgcccagatgaccgcctccggacttcggattatctttacactggacgaggtggcttttatccagaacctggtcttctatatcgaggccgcctataaggttgctgattacggcatgtgggagcgtggggataagactaatcagggaattcccgaactaaacgcctctagtgtgggaatggctaaagctgctctggaagcaattgacgagctggacctgtttggtgcccacggagggagaaagtcagtgattcacgtgctgcccgatgaagtggaacattgccaatctatcctgttcagcatgctgcccagggcctccaccagtaaggaaattgacgcaggtctgctgtcaataatctccttcccagcttttgctgtggaggacgtgaacctggtgaatgtcaccaagaacgaaatcattagcaaactgcagggaagatacgggtgttgtcggttcctgcgcgacggttataagacccctagagaggacccaaatagactgcattacgatcccgctgagctgaagctcttcgagaatatagaatgcgaatggcctgtgttctggacctactttatcattgacggcgtgttcagtggcgatgccgtccaggtacaggagtacagggaggccttagagggaatactgatccggggaaagaacggcatcagattagtgcccgagctgtacgccgtgccacctaacaaggtcgacgaagaatacaagaatcctcatacagttgaccgcgtgcccatgggcaaggtacctcacctttggggacagtccctgtacatcctgtcttcactactggccgaaggattcctagccgccggggagatagatcctctcaatagacggttctctacatctgtaaaaccagacgtggtggtgcaagtcactgtgctggccgagaataaccatatcaaagatctgctaagaaagcatggtgtgaatgtgcagtcaatcgctgatatacatcccatacaggtgcagccaggccggatcctcagccacatttacgccaaactggggcggaacaagaacatgaacctgagcggccgcccatacaggcatataggagttctcggaacctctaagctgtatgtgattaggaaccagatcttcacatttactccacagttcaccgatcagcaccacttttacctggccttagataacgagatgattgtggaaatgctgaggattgaactcgcatacttatgcacctgttggagaatgaccggccggcctacactgacctttcctatcagccggacaatgctgaccaatgatggaagtgacatccattcagctgtgctgtccacaatcagaaaactggaggacgggtatttcgggggcgccagagtgaaactgggcaacctgtcagaatttttaaccaccagtttttatacctaccttactttcctagacccagattgtgacgaaaagctgtttgacaacgctagtgaaggcactttctctcctgactccgatagcgatctagtggggtatctcgaagatacatgcaatcaggagtctcaagacgaactggaccattatattaatcacttgttacaatcaacttccctgaggtcctacctacctcccctatgtaagaacacagaagatcggcacgtgttcagtgccatccacagtactagagatatcctgagcgtgatggccaaggctaagggcttagaagtcccattcgttcccatgactctgcctacaaaggtgctgagcgcacacaggaagagtctcaatttagtcgattccccccaacctcttctggagaaggtgccagaaagcgattttcaatggccaagagatgatcacggcgacgtcgactgtgagaaacttgtagagcaactgaaagactgctctaatctgcaggaccaagccgacattctgtatatattgtacgtgattaaaggcccttcttgggatacaaatttatctggccagcatggtgtgactgtgcaaaatctactcggcgagctttacggcaaagccggccttaatcaggagtggggactgatccggtacatctctggcctgctgaggaagaaggtcgaggtgctggcagaggcatgtacagatttactgagccatcagaaacaactgacagtggggctgccacccgagccaagagagaaaattattagcgcaccactgccaccagaggaacttactaagttaatatacgaagcttccgggcaggatatctccattgccgtgttaacacaggaaatcgtggtttacctggctatgtatgttcgggcccaaccttctctctttgtggaaatgttacgcctacgtataggccttataattcaggtgatggctacagaactggctcgcagtctgaactgctctggggaggaagccagtgagtcattaatgaatctgtctcctttcgacatgaaaaatctgttacaccacatactgtccggcaaagagttcggcgttgaacgtagcgtgaggccaattcactcctccactagcagtcccaccatatcaatacacgaggtgggacacacaggcgtaacaaaaaccgaaaggagcggaataaatagactgcggtcagagatgaaacagatgactaggcgtttctccgctgatgagcagtttttcagcgtcggccaggcagcatcttcctctgcccattcttccaagtccgcccgcagctctacccctagcagccccactgggacttctagttctgactcaggcggtcatcacattggttggggcgagcgtcaaggtcagtggttgcggaggcggagattagatggtgccattaaccgggtgccagtcgggttttaccagcgtgtctggaaaatcctacagaaatgccatggtttatctattgacggatacgttctgccctcaagcacaaccagggaaatgactccacacgagataaagtttgcagtgcatgtcgagtcagtactcaatagggttcctcagcccgagtatcggcaactcctcgtcgaggccatcatggttctgacactactgagcgacactgagatgacaagcattggcggtatcatccatgtggaccagatcgttcaaatggcaagtcagctgtttcttcaggaccaggtttccataggggccatggacaccctggagaaagaccaggccactggcatctgccattttttctacgattccgccccaagcggcgcatatggaacaatgacctacctaaccagggcagtggcatcctatctgcaggagttattacctaattctggatgccaaatgcag

SEQ ID NO: 18106 - DNA, 3705 bp, Artificial Sequence
  Description of Artificial Sequence: Synthetic coding sequence
atgcggagccggagcaattctggtgtgcgcctcgacggttacgcgcggctagtgcagcaaactatcctgtgctaccagaacccggtcacgggactgctgtctgctagccatgaacagaaggacgcttgggtcagagacaatatctattcaattcttgctgtgtggggcctggggatggcatacagaaagaacgcagaccgggatgaggacaaggcgaaggcgtacgaactggaacaaaacgtcgtcaagctaatgcgaggactcctgcagtgtatgatgcggcaggtcgctaaggtggagaagttcaagcacacccagtcgacaaaagacagtctgcacgccaagtataacacggccacatgcggaaccgtcgtgggtgacgatcagtgggggcacttgcaggtggacgccactagcttatttctgctctttctggcccagatgactgctagtggcctgcggattatcttcaccctcgatgaggtcgccttcattcagaatttggttttctatatagaagcggcgtacaaagtcgcagactatggaatgtgggaaagaggggataagacaaatcaaggcatcccagaactgaatgcctcttctgtaggaatggccaaggccgcccttgaggctatcgatgaattggatctgtttggggcgcacggtgggagaaagagcgtgatccatgtgttgcccgacgaggtagagcattgccagagcattctgttctctatgctcccccgagcatcaaccagcaaggagatcgacgccgggcttttgagtatcattagcttccccgccttcgccgtggaggatgtgaatctggtaaacgttacaaagaatgaaataatttccaaattgcaggggcggtacggctgctgccgctttttgcgggacggctataaaactcccagagaagatcccaatagactgcattatgatccggcggagttaaagctgttcgaaaacattgagtgtgagtggccagtgttttggacgtatttcattatcgacggggttttttcaggcgacgccgtgcaggtgcaggagtaccgcgaggctctggaaggcatactgatacgcggcaagaatgggattcgcctagtccctgagttgtatgctgtacctcctaacaaggttgacgaggagtacaaaaacccgcacactgtggatcgagttccaatgggcaaggttcctcacctgtggggacagtctttatatatcctgtcaagtcttttagctgagggatttttagccgctggagagattgaccccctgaaccggcgcttttccacgtctgtcaaaccagacgttgtggtgcaggtgactgttttagctgagaataaccatatcaaagatcttcttcgaaagcatggcgtgaatgtgcaaagtatcgcggatattcatccaattcaggttcagccaggccggattctatcacatatttacgccaagctgggccggaataagaacatgaatttatcgggcaggccctataggcacatcggtgtgctagggacctccaaactgtacgttatcagaaaccagatcttcacgttcacaccccagttcaccgatcagcaccatttttatttggctctcgacaatgaaatgatcgtggaaatgctgaggattgagctagcttatctctgcacttgctggcgcatgaccggtcgccctacattgacttttcctatctcacggactatgcttaccaatgacgggtctgacatccactccgcagtactgtccactattcgaaaattagaggatggttacttcgggggggcgcgcgtaaaactgggcaacttgagcgaatttctgacaacttctttttacacgtacctgacctttctggaccccgactgcgacgagaagctcttcgacaacgcttcggaagggaccttctctcctgacagcgacagtgatctggttgggtatctagaggacacgtgtaaccaagagtcacaagatgagctcgatcactacatcaatcatcttctccagtccacttccctccgatcttatctacctccactgtgcaaaaatacagaagataggcatgtgttctccgctatccattcgacccgagacattctatcggtcatggcaaaagcaaagggactggaagtgcctttcgttccgatgacactgccaaccaaggtgctctcagcccaccggaagagtctcaatttagtcgactccccacaacccctactcgagaaggtgccagagtctgatttccagtggccacgggacgaccatggcgacgtcgattgtgaaaagctggtagagcagcttaaagactgctctaacctccaggaccaagccgacatcttgtatattctttacgtaattaagggaccgtcttgggacaccaacctcagcggccagcatggcgtgacagtgcagaacctgctaggcgaactttacgggaaagccgggctcaatcaggagtggggactgatcaggtacatctctggccttcttcgcaaaaaggtggaggtcctcgcggaggcgtgcactgaccttttgtctcaccagaaacaactaactgtgggcttgccccccgaaccacgcgagaagattatttcagcccctttgccacccgaagaactgactaagcttatttacgaggccagtgggcaggacatcagcatagccgtacttacccaggagatcgtggtttatctggctatgtatgttagggcacagccatccctgtttgttgagatgctccgtcttcgcatcggcttaattattcaggttatggcaactgagttagcccgcagcctcaattgttccggtgaggaagcctccgagtcgttgatgaatctttctccattcgatatgaaaaatctgttacaccatatccttagcggcaaggaattcggggtggaaaggtcagtcaggccgatccacagtagtacaagtagtcccactatttccatccacgaggttgggcatactggtgtaacaaaaaccgagaggtcgggcatcaatagactgagaagtgaaatgaagcagatgacacgacgcttttccgctgacgagcaattcttctccgtgggccaagcagcgagttctagtgcgcactcatctaagtccgccagaagcagcacaccttctagcccaaccggaacaagtagttccgattccggcggacatcacatcggatggggtgagaggcaggggcagtggcttaggcgacgacgactggacggagccattaatagagtccctgtcggattctatcagcgtgtgtggaaaatactgcagaaatgccacggactgagcatcgatgggtatgtgctgccaagttccaccacacgggagatgaccccccatgagatcaaattcgcagtccatgttgagtcggtacttaatcgggtgcctcagcctgagtataggcagctgctggtggaagctatcatggtgctgacactgctgtctgatactgagatgaccagtatcggcgggatcattcatgtcgaccaaatagtgcagatggcatcccagctttttctgcaggatcaggtctccatcggtgccatggacacactcgaaaaggaccaggccacaggaatatgtcatttcttttatgattccgctcccagtggcgcttacggcactatgacatatttgacgcgggcagtggcttcgtacctgcaggagctgctgccaaactctggatgtcaaatgcaa

SEQ ID NO: 18107 - DNA, 3705 bp, Artificial Sequence
  Description of Artificial Sequence: Synthetic coding sequence
atgcgcagtcgcagcaacagcggggtacgactggatggatacgctaggttggtccagcagaccatactttgttatcaaaaccctgtgaccggactgctgagtgctagccacgagcaaaaggacgcctgggtgagagataatatttacagcattttagctgtttggggactgggcatggcctatcggaagaatgccgaccgcgatgaggataaggcaaaagcatatgaactcgagcaaaatgtagtaaaacttatgagaggattactgcaatgcatgatgcggcaggtcgcgaaggttgagaagtttaagcatactcagtcaaccaaagactcactccatgctaagtataatactgcgacatgcgggaccgtggttggggacgatcagtggggtcacctgcaggtggatgccacttcattgttcctcttgtttctagctcaaatgaccgccagtgggctgcggattatcttcactctcgacgaagtagctttcatccagaatctcgttttttatatcgaagcagcctacaaggtggccgactatggaatgtgggagcgcggcgacaaaacaaaccaaggtatccccgaactgaacgcttcttctgtagggatggcaaaagctgcattggaggccatagatgaattagatctgttcggtgcccacggcggaagaaagagtgtcatccatgtgctgccagacgaggtggagcactgtcagtccatcctgttctcaatgctgccacgagcctccacctcaaaggagatagatgctgggctcctgagtatcatcagctttcctgcctttgcggtggaagatgtgaacctggttaacgttaccaaaaacgagattatttccaagcttcaaggccgttatggttgctgccggtttctgagggacgggtacaaaaccccccgagaagatccaaatagattacactatgacccagcggagctgaagctgtttgagaacatcgaatgtgagtggcccgtgttctggacgtactttatcatagacggcgtctttagcggagatgcagtacaggtccaggaataccgagaagcacttgaggggatcttgattagaggcaaaaacggcatacgtctggtgcctgaactgtatgccgtgccacccaacaaggttgacgaggagtataagaatccccacacggtggaccgggtgccgatgggcaaggtgccccacctgtggggtcagtccctatacatcctgtcgagtttgctggcagaaggctttctggcagcgggagagattgatcccctgaatagaagatttagtacttcagtgaagccagatgtggtggtgcaggtgacagtactagctgaaaataaccatataaaggatctccttaggaagcacggagttaacgtccagtccatcgccgatatacatccaattcaggtgcagcctggacgtatcctcagtcacatttacgccaaattgggcaggaataagaatatgaacctgtccggcaggccttatcggcacattggggtgctaggcacatccaagctgtacgtgatcagaaatcagatctttactttcaccccacaatttactgaccaacatcacttctacctcgcgctcgacaacgagatgatagttgaaatgcttcggatcgagctcgcatacctttgtacctgttggaggatgaccgggaggcccaccttaacgttccctatttctaggactatgctgaccaatgacgggtccgatatccactcagctgtgctgagcacaatcagaaaattggaggacggatactttggcggtgccagagttaagctcggtaatctatcagaattcctgaccacatccttctacacctacctgacctttctggacccagactgtgacgagaaactcttcgataatgctagcgaagggaccttctcacctgattcagattccgatctcgtgggctacttggaggacacatgcaaccaggagtcccaggacgaattggatcattacattaaccacctgctccagagcacctccctgcggagctacctaccgcctctgtgtaagaatactgaggacaggcacgtcttcagtgctatccactccaccagggatatactgagtgtgatggcaaaggctaaaggactagaggttccctttgttcctatgacacttccaactaaggtactctctgcacatcgaaagagtctcaatctagtggactctccccagcctctgctcgaaaaagtccccgaatctgacttccaatggccgagggacgaccatggtgatgtggactgcgaaaaattggttgaacaactgaaagactgttctaacttacaggaccaagccgatatcctgtacatcctgtacgtaatcaagggaccgtcctgggacactaacctttccggccagcatggggtgactgtgcagaacttgcttggtgagctctacgggaaggcaggattaaaccaagaatggggtctgattcgttatataagtggcctactgcggaaaaaagtcgaagtcctcgcagaggcttgcacggacctactgagccaccagaaacagttgaccgtcggactgcccccagaacctcgcgaaaaaatcatcagcgctccactgcctccggaggagctgactaaattgatatatgaggcatctgggcaagatatatctattgccgtgttgacacaggaaatcgttgtctacctggcaatgtacgtgcgtgcccaaccctctctttttgtggaaatgctgcgcctgagaatcggtctgatcattcaggtcatggccaccgagctcgcccggagcttgaattgctcgggagaagaagccagcgaaagcctgatgaacctctctccatttgatatgaagaatctgctacatcacattctatccgggaaggagttcggcgtggagcgaagcgtgcgaccaatacacagttcaacgtcgagcccgaccattagcatccacgaggtaggtcatactggagtgaccaagacggaacgcagtggcatcaacagacttcggtcagagatgaaacagatgacacggcgcttttccgccgatgagcagtttttcagcgtgggacaagctgccagctcctcagcccacagctccaaatcggctcggagtagcacccctagctcaccaactgggacgtcaagcagcgactccgggggccaccatatcggatggggggagcggcagggacagtggctgaggcggaggagactggatggagccattaatagggtgcccgtaggattctatcagcgagtctggaaaatcttacagaagtgtcacgggttaagcatcgatgggtacgtgcttccgtctagtacgaccagagaaatgaccccccacgagattaaattcgccgtgcacgtcgaatcggtgctcaaccgtgtgccccaaccggagtacaggcagttgctggtggaagccatcatggtgctgactctgcttagtgatacggaaatgacttccatcggcgggatcattcacgtggaccaaatagttcagatggccagccaattgttcttgcaggaccaggtttccatcggtgccatggatactctggaaaaggatcaggcgacgggaatctgccacttcttctacgattcagccccctccggagcctacggcacgatgacatatcttactcgcgccgttgcttcttatctccaggagctcctgccaaattcgggatgtcaaatgcag

SEQ ID NO: 18108 - DNA, 3705 bp, Artificial Sequence
  Description of Artificial Sequence: Synthetic coding sequence
atgagatcgcgatccaactcaggagtccgactggatggttacgccagactcgttcagcagaccattctttgctaccagaatcccgtgactggtctgctttccgcatcgcatgaacaaaaagatgcatgggtcagagacaatatctattcaattctggcggtgtggggacttggtatggcttataggaagaatgcagatcgcgatgaagataaggcaaaggcctacgaattggaacaaaacgtggtcaagctgatgcgcggacttctgcagtgtatgatgaggcaagtggcaaaggtcgaaaagttcaagcatacccaatcgacgaaggattcgctgcacgccaagtacaacactgcaacctgtggtactgtggtgggagacgaccaatggggccatcttcaagtcgatgccacctccctcttccttctctttcttgctcagatgaccgcttcgggacttcggattatcttcactctggacgaggtcgcgtttatccagaacttggtcttttacatcgaggcagcatacaaggtggccgattacggaatgtgggaacgcggagataaaactaaccaaggtattcctgaactcaacgcatcgtcggtgggaatggccaaggcagctctggaggccatagatgaattggatctgtttggagctcacggtggtcggaagagcgtgattcatgtgctgcccgatgaagtggagcattgtcaatccatccttttttccatgctgccaagggcgagcacctcgaaggaaatcgatgcaggacttttgtcgattatctcttttccagcttttgcggtggaagatgtgaatcttgttaacgtgaccaagaacgagatcatttcaaagctccagggaagatacgggtgttgccggtttctgcgggacggatacaaaaccccacgggaggaccctaataggctccattatgatcccgcagagctgaaattgttcgagaacattgagtgcgaatggcccgtgttttggacctacttcatcatcgacggcgtgtttagcggtgacgccgtgcaggtgcaggaataccgtgaagctctggaaggaattctgatacgtgggaagaacggtatccgtcttgtcccagagctctacgctgtcccacctaataaggtcgatgaagaatacaaaaatccacataccgtggatagagtgccaatgggcaaggtgcctcatctttgggggcagtccctgtacatactttcttcactgctcgcagaaggatttttggccgctggagaaattgatcctctgaatcggagattctcaacctctgtgaagcccgacgtcgtcgtccaagtgactgtgcttgcagaaaacaatcacattaaagacctgcttcgaaagcacggggtgaacgtccaatccatcgccgatatccatcctattcaggtccaacctggtcggatcctgtcccacatctacgcaaagctcggcagaaacaaaaacatgaacctgtccggacgcccttacagacatataggtgtgctcgggacctcgaagctctacgtgattcgcaaccagatctttacctttacgccacaattcaccgaccagcaccacttctaccttgcactggacaacgagatgatcgtggaaatgctcagaatcgaactggcatacctttgcacttgttggcggatgactggccgcccaacccttacttttcccatatcgcgcactatgcttacgaacgatggaagcgatatccatagcgcggtcctttcgacgattcgcaagctggaagatggatactttggaggcgcacgcgtgaagctcggcaatctctccgaattccttactacttcgttttacacgtatcttacgttcctggatccagattgtgatgaaaagctctttgataacgcatcggagggtactttttctccagacagcgactctgatctcgtcgggtacttggaagatacctgtaaccaagagagccaagatgaacttgatcattacattaaccaccttctgcagagcacttcactcagatcataccttccccctctttgcaaaaacaccgaggatcgacatgtgttttcggcaattcactccacccgcgatattctttcggtgatggcgaaagcgaaaggacttgaggtcccttttgtccctatgacgctcccaactaaggtcctgtcagcacatagaaagtcgcttaatctcgtcgattcccctcagccccttttggaaaaggtccctgaatctgattttcagtggccgagagatgatcatggagatgttgactgcgaaaagctggtcgaacaactgaaggattgctccaatctgcaagaccaggcagacatactgtacattctgtacgtcattaaggggccctcatgggataccaacctctcggggcagcacggagtcaccgtgcagaacctgctgggagaactgtacggtaaggcagggttgaaccaagagtggggccttatcaggtacatttcggggctcctccggaaaaaagtggaggtgctggcagaagcatgtactgacctcctttcccatcaaaagcagttgaccgtgggtctgcccccggaaccacgtgaaaagataatctcggctccacttcccccagaagaactgactaagttgatatacgaagcatcaggacaagatatctcaattgcagtgcttactcaagaaattgtggtgtacctggcaatgtatgtgagggcccaaccaagcctttttgttgagatgttgcggctgcgtatcggcctcatcatccaggtgatggcaacggaacttgcccgttccttgaattgtagcggtgaagaagcctcggagtcactgatgaacctttcccctttcgatatgaaaaatcttctgcatcatattctttccggaaaagaatttggggtggaacgttcggtgcggccaatccattcctccacctcctccccaactatttctatccacgaagtgggacacaccggagtgaccaagaccgaacgatcgggaattaacaggcttcggtccgagatgaagcaaatgaccagaaggttttcggcagatgagcagttcttctcagtgggtcaggcggcatcgtcctccgcccattcgagcaaatcggcacggtcgtcgactccatccagcccgaccggcacctcttcatcggatagcggtggtcatcacatcgggtggggtgaacggcaaggccagtggcttaggagacggaggctggatggggcaatcaacagagtgccggtgggcttctaccaaagagtgtggaagatacttcagaagtgtcatggactctccattgatggatatgtgctgccttcctcgaccaccagagagatgacccctcatgagattaagtttgctgtgcacgtggagtcagttcttaacagggtgcctcaacccgaataccgccaactgctcgtggaagccataatggtgcttactctgctcagcgataccgaaatgacttcaattggcggtatcattcacgtggatcaaatagtgcagatggcatcgcagctttttctgcaagatcaggtgtcgattggagcgatggatactctggaaaaggaccaagcaacgggaatttgtcatttcttctacgactcggcaccatctggtgcatacggcactatgacctaccttactcgggccgtcgcaagctatctgcaagagcttttgcctaacagcggttgtcaaatgcag

SEQ ID NO: 18109 - DNA, 3705 bp, Artificial Sequence
  Description of Artificial Sequence: Synthetic coding sequence
atgcggtcgcgctctaattcaggagtgcggctcgatgggtacgcacgcctggtccagcagaccattctctgctatcagaaccccgtgactggcttgctgtccgcctctcacgaacaaaaggacgcctgggtgagagacaatatctactcgatcctggctgtgtggggcctgggaatggcataccggaagaacgctgaccgggacgaagataaggctaaggcatacgagctcgagcaaaacgtggtcaaactcatgcggggtctgctgcagtgcatgatgcgtcaggtggcaaaggtcgaaaagttcaagcatacccagtcgactaaggatagcttgcacgcgaaatacaacaccgctacctgcggtacggtcgtgggcgatgaccagtggggacatctgcaagtggacgcgacttccctgttcctgctctttcttgctcagatgaccgcctcgggcctgcgcatcatcttcacgctggacgaggtcgcgtttatacagaaccttgtgttctacatcgaagcagcctacaaagtcgccgattacggaatgtgggagcggggagacaaaaccaatcaggggatcccggaactcaatgctagcagcgtgggaatggcgaaggccgccctggaagccatcgacgaactcgacctgtttggcgctcacggcggaaggaagtcggtcatccacgtgctccctgacgaggtcgaacattgtcaatcgattttgttctccatgcttccacgcgcctccacttccaaggagatcgatgcaggactgctgagcatcatctcattcccggccttcgccgtggaggatgtgaatctggtcaacgtgactaagaatgaaatcatctcgaaacttcaaggtcggtacggatgctgtcgcttcctcagagatggatacaaaactccgagagaggatccaaatcggctgcactacgatcccgcggagttgaagctcttcgaaaacattgagtgcgaatggccggtgttctggacttactttatcatcgatggagtgttctcgggggatgcagtgcaggtacaggagtaccgggaagcactggagggcatcctgattcggggcaaaaatggaatcaggttggtaccggaactgtacgcagtgcctcccaacaaagtggatgaagagtacaaaaacccccacaccgtggatagagtccctatgggcaaggtgcctcatctgtggggacaaagcctgtacatcctctcgtcgttgctggcggagggattcctcgcggccggcgagatcgaccctctgaaccgccgcttctcaacctcggtcaagccagacgttgtggtccaggtgactgtgctggcggaaaacaaccacataaaagacctgctccgcaagcacggagtgaatgtgcagtccatcgctgacatccacccaatccaagtgcaaccaggaagaatactcagtcacatctatgccaagctgggaagaaacaagaacatgaacctgtccggcaggccataccggcatatcggtgtcctcggtacttcgaagctgtatgtgatcaggaaccagatctttaccttcactccgcagtttactgatcagcatcacttctacctcgccctcgataacgaaatgattgtggagatgctgcgaatcgaattggcatacctgtgcacttgctggagaatgacgggccgaccgactcttacttttccgatcagccggacgatgctgaccaacgatggctcggacatccacagcgcagtgctctcgaccatcagaaagctcgaggacggctacttcggtggggcaagggtcaaactgggcaacctgtccgagtttctcaccacctccttttacacgtacctgactttcctggatcctgattgcgatgaaaagctcttcgataatgcatccgaagggaccttctcgccggatagcgacagcgacctggtgggatacctcgaagatacctgcaatcaggaatcgcaggatgaactggatcattacatcaatcacttgctgcagagcactagcctccggtcctacctgccgccgctttgcaagaacactgaggaccgccacgtgttctctgccatccattccacccgggacatcctctccgtgatggccaaggcgaaagggttggaagtcccattcgtgcccatgaccttgcctactaaggtgctttcggcacataggaaatcgctgaatctcgtggacagcccgcagccgctgctcgaaaaggtaccagaatcggactttcagtggccgagagacgaccatggagatgtcgactgtgagaaattggtggaacaactgaaggactgtagcaacttgcaagaccaggcggacattctgtatatcctttacgtgattaagggcccatcctgggataccaatctcagcggacaacacggcgtcacggtgcagaacctgctgggggaactgtacggaaaggcaggtctgaaccaagagtggggactgatcagatacatttccgggctgctgcgaaaaaaggtcgaggtgcttgccgaggcgtgtaccgaccttcttagccaccaaaagcagttgaccgtcgggcttccccctgagccacgtgagaaaatcattagcgctccgctcccaccggaagaactcaccaaactgatctacgaagcctctggccaggacatcagcatcgcggtgctgacccaagagattgtggtctatctggccatgtacgtgcgtgcccaaccgtccctcttcgttgaaatgctgagacttcgcatagggctcattatacaggtgatggccactgagttggctcgatctctcaactgcagcggagaagaggctagcgagtcgttgatgaacctctcgccgttcgacatgaagaatctgctgcatcacatcctgtcaggaaaggaattcggagtggaaaggtcagttaggcctatccattcatcaacctcctcaccaaccatctccatccacgaggtgggacacaccggcgttactaagaccgagcgctccggtatcaacagactgcggtccgaaatgaagcaaatgacccgccggttctctgccgacgaacagttcttctccgttggacaggccgcgtcgtcatcggcccattcttccaagtcagcacgctcctctactccgtcgagtcccactggtacttcgtcatcggattcgggcgggcaccacatcggatggggggagcgccaggggcagtggttgcggaggcgccgcctcgacggggctatcaaccgcgtgcctgtgggcttttaccagagggtctggaaaatcctccagaagtgccatggactctccattgacggctacgtcctgccgtcatccactacgcgcgaaatgacgccgcacgagattaagttcgctgtccatgtggaatcagtcctcaaccgggtcccacaaccggaatataggcagctcctcgtggaggctatcatggtgctcaccctgctctccgacactgagatgacgagcatcgggggaatcatccacgtggaccagatcgtgcaaatggcctcacagctcttcctccaagaccaagtgagcataggagcgatggacaccttggagaaggaccaagcgactggaatctgccacttcttttacgactcagccccgtccggagcctacggaaccatgacctacctgactcgggctgtcgcgagctacctgcaagaactgctccccaattcgggatgtcagatgcag

SEQ ID NO: 18110 - DNA, 3705 bp, Artificial Sequence
  Description of Artificial Sequence: Synthetic coding sequence
atgagatcgcgtagcaattccggagtgcggctggatgggtacgcacggctcgtccaacagaccatcctttgttaccaaaacccagtgaccggcctcctttccgcgtcgcatgagcaaaaggacgcgtgggtcagagataacatatactcgatactggccgtctggggtcttggaatggcttaccgcaagaacgcggaccgagatgaggataaggctaaggcctacgaacttgagcagaatgtcgtcaagctgatgcggggcctgctccaatgcatgatgagacaggtggctaaggtggaaaagttcaagcacacccaatccaccaaggactcgctgcatgcgaagtacaacaccgcaacgtgtggaaccgtggtgggcgacgaccagtggggacacctccaagtggatgccaccagcctctttcttctctttctcgctcaaatgaccgcgtccggactgagaatcattttcactcttgacgaggtggcattcatacagaaccttgtgttctatattgaagcggcttacaaagttgcggactacggaatgtgggaaagaggtgacaagactaatcagggtattcctgaacttaatgcgtcatccgtgggcatggccaaggccgccctcgaggcaattgatgagctggatctgttcggcgcccatggaggacgcaagtccgtgattcatgtcctgccagatgaagtcgagcattgccagtcaattctgttttcaatgttgccacgtgcatcgacttctaaagaaattgatgcaggactcctctcgattatctccttcccagcatttgcagtcgaggacgtgaatctcgtcaacgtgactaaaaacgaaatcataagcaaactgcaggggcggtacggatgttgccgctttcttagagacggttacaagaccccaagagaggatccaaataggctccattacgatcctgccgaacttaagctctttgaaaacattgagtgtgagtggcccgtcttttggacgtacttcatcattgacggcgtgttttctggtgatgcagtgcaggtgcaagaatacagggaagcgctcgaaggtatcctgattcgaggaaagaatgggattagactcgtgccagaattgtacgccgtgccgccgaataaggtggatgaagagtacaagaacccgcataccgtcgaccgcgtgccaatgggtaaagtgccccacctctgggggcaatcactttacatcctctcgtcactgctggctgaaggttttcttgcagccggtgagattgatccactcaaccgacggttcagcacctctgtgaaaccggatgtagtggtgcaagtgacggtgcttgcagaaaacaaccatatcaaggacttgctgcggaaacacggggtcaacgtgcaatcgatcgcagacattcatcctatccaagtgcaacctggaagaatcttgtcccacatttatgcaaaacttggccgaaacaagaatatgaacttgagcggtagaccttaccgtcatatcggtgttcttggtacgtcaaaactttatgtgattaggaatcagatctttaccttcacccctcagtttacggatcagcaccacttttacctcgcacttgacaacgaaatgatcgtcgagatgctgaggatagaacttgcctacctgtgtacctgttggaggatgactggacgtcctacccttaccttcccgattagcaggactatgcttactaatgacggaagcgacatccattccgcagtgttgtcaactatccgtaaacttgaggacggttacttcggtggcgcacgggtgaagctgggcaacttgtcggagtttcttaccacttcattttacacgtacctcacttttcttgatccagactgtgacgagaagctgtttgataatgcaagcgagggaactttttccccagattccgattcggatctggtgggatatctggaagatacctgtaatcaggagtcgcaggatgaactggaccattacattaatcacttgctccaatctaccagcctgagatcgtacctcccgccactgtgcaagaacactgaagatagacacgtgttttccgcaatacactcgaccagagatatcctgtccgtgatggcaaaagcaaagggactggaagtgccctttgtgcctatgaccctgcctactaaggtcctgtcagcgcaccgcaaatctctcaatctcgtcgattcacctcagcctcttcttgagaaggtgcctgaatcagattttcagtggcctcgcgatgatcacggtgatgtggactgtgagaagctggtcgagcaattgaaagactgtagcaacctgcaggaccaggccgacattctttacattctctacgtgattaagggaccctcgtgggataccaacctcagcggacagcatggcgtgaccgtgcaaaatctgctgggcgagctgtacggtaaggcaggcctgaatcaggaatggggacttattcgctacatatcagggttgctccggaaaaaggtcgaggtgttggccgaagcctgtacggacctgctttcgcaccagaagcaactgactgtgggcctgccgccggaacctcgggaaaagattatcagcgctccgctgccaccggaggagctgactaagctcatctacgaggcatcaggtcaggatatttctattgcggtgcttacccaagaaatcgtcgtctaccttgccatgtatgttagagcccaaccttcgctcttcgtggaaatgcttagattgcgaatcggcctcattatccaagtgatggcaaccgaactggcgcggtcgctgaattgctccggtgaagaggcgagcgaatcacttatgaatctctctcctttcgacatgaaaaaccttctgcaccacattctgagcggcaaggaattcggcgtggaacgctcggtgcggcctatccatagctcaacttcgagccccaccatttccattcacgaagtcggacataccggcgtcactaagaccgagagaagcggtattaaccggctgagatcagagatgaagcaaatgaccagaagattttccgcagatgaacagtttttctcggtcggacaagctgcatcctcatcggcacactcttccaaatcggcacgtagctctaccccgtcctcgcctaccggaaccagctcaagtgattctggaggtcaccatatcggatggggagaacggcaaggacagtggctgagacgtcgtagactcgatggagcaatcaatcgcgtgcctgtggggttttaccagcgcgtgtggaagatcctgcaaaaatgtcatggactgagtatcgatggttacgttctgccatcctcaaccactcgtgaaatgactccacatgaaatcaagtttgcagtgcatgtcgaatcagttcttaatcgggtccctcaacccgaatacagacagctgctggtggaagcaattatggtgctcactttgctgagcgacaccgaaatgacctcgattggtgggataattcatgttgatcagattgtgcaaatggcatcacaactttttcttcaggatcaagtcagtatcggagcaatggacacccttgagaaagatcaagctaccgggatttgccatttcttctacgacagcgccccctcgggtgcctacgggaccatgacctaccttacccgcgccgtcgcttcgtacctccaggaacttctccctaattccggctgccaaatgcag

SEQ ID NO: 18111 - DNA, 3705 bp, Artificial Sequence
  Description of Artificial Sequence: Synthetic coding sequence
atgcgtagcagatctaattcgggagtgagactggacggctacgcccgcctcgtccagcaaaccatactctgctaccaaaacccggtcaccggactcctctctgcgagccacgaacaaaaggacgcgtgggtcagagataacatctactccatcctggctgtgtggggtcttgggatggcgtaccgcaaaaacgccgatcgcgatgaggacaaggcaaaagcctacgagctggagcagaatgtggtgaaactcatgcggggactcctccaatgcatgatgcggcaggtggctaaagtggaaaagtttaagcacactcagtcgaccaaggactccctccatgcaaagtacaacaccgccacttgcggtacggtagtcggtgacgaccagtggggacatctccaggtagatgctacgtcgctcttcctgctgttcttggctcagatgacggcatccggtttgcggattatctttactctcgatgaggtggccttcattcagaacctggtgttctacattgaggctgcttacaaggtggcagactacggaatgtgggaaagaggggacaagactaatcagggcatcccggagctgaacgcctcctctgtgggaatggccaaggcggccctggaggcgatcgacgaactcgacctgttcggagcgcatggcggacggaagtccgtgatccatgttctgccggacgaggtggaacactgtcaatccatcctcttctccatgctgcctcgggcatcgacctctaaagaaatcgacgccggacttctctcaatcatctcgttccctgcgttcgccgtggaagatgtcaatctggtgaacgtgaccaaaaacgagatcatttcgaagctgcagggacgctacggctgctgtcggtttcttcgcgacggctacaagactccgcgcgaagatcctaaccgcctccactacgacccggcggagctgaagctgttcgaaaacatcgagtgcgagtggccggtgttttggacttacttcattatcgacggggtcttttcaggcgacgctgtgcaggtgcaggaataccgcgaggccctggagggtattcttatcaggggtaaaaacggcatccgcctggtgccggaactctacgcagtgccgccgaacaaagtggatgaagaatacaaaaacccccacactgtagatagagtgccaatgggaaaggtgccgcatctttggggacagtccttgtatatcctgtcaagccttctggccgaaggattccttgcagccggagagatcgatccgctgaaccgcagattttcaacttccgtgaagccggatgtcgtggtgcaagttaccgtgcttgcggagaacaaccacatcaaggacttgctgagaaaacacggagtcaacgtccaatcaatcgcagacatccacccgatccaggtccagccaggccgcatcctgtcccacatctacgcaaaactgggacggaataagaacatgaatctgtcgggacggccatatcggcatatcggcgtcctgggaacctcaaagttgtacgtcatcagaaaccagatcttcaccttcactccacagttcaccgaccagcaccacttctacctcgcgctggacaacgagatgatcgtagagatgctccggatcgaactggcttacctgtgcacgtgctggcgtatgactggcaggcctaccttgactttccctatcagcagaacgatgctgactaacgatggaagcgatatccacagcgctgtcctttcgactattcggaagctggaggacgggtactttgggggtgcccgtgttaaactgggaaatttgagcgaattcctgaccaccagcttctacacttacctcacttttctcgacccggattgtgatgaaaagttgttcgacaatgcatccgaaggcactttctcccccgattccgactcagacctggtggggtacctggaagatacctgcaatcaagagtcccaggacgaactggaccattacatcaaccaccttctgcagagcacgtccctgcggtcctacctcccgcccctttgtaagaataccgaggaccgccacgtgttttcggcgatccattcgactagagatatcctgtccgtcatggcgaaggcaaagggcctggaagtgccgtttgtgccaatgacccttccaaccaaggtcctgtcggctcataggaagagccttaaccttgtggattccccgcaaccgctgctcgagaaggtcccagaaagcgatttccaatggccacgcgatgatcacggtgacgtggactgcgagaagctcgtggaacagctgaaagattgctctaacttgcaggatcaagccgacattctctatatcctgtatgtgatcaaaggaccctcgtgggacaccaatttgagcggacagcatggagtgactgtgcagaacctcctgggagaactgtatgggaaagccggattgaaccaagagtggggattgattcgctacatctccggactcctgagaaagaaggtggaagtgctcgccgaagcatgcaccgatcttcttagccaccaaaagcagttgactgtgggcttgccaccggaaccgcgggaaaagatcatctcggcccccctgccgcctgaggagctgactaagctcatctacgaagcatccggacaagacatctcgatcgccgttctcacccaggaaatcgtcgtgtacctcgccatgtacgtgcgggcgcagccttcactgtttgtagagatgctgcgtctcaggatcggccttatcattcaggtgatggctaccgaactggcgagatcactcaactgctccggggaagaggcgtccgaatcactgatgaacctgtcgccattcgacatgaaaaatctgctccaccatattctgtcgggaaaggaattcggtgtggaacgcagcgtgcgaccaatccactcgtccacctcgtcgcctacgatttcaatccatgaggtcggtcacactggcgtgaccaagaccgaacgcagcggtatcaataggttgcggagtgagatgaagcaaatgactagacgattctcggcggacgagcaattctttagcgtcggccaggccgcctcatcctcggcgcacagtagcaagtccgcccgcagttctaccccgtcatcgcccaccggaacctcatcgagtgacagcggtggacatcatatcggatggggggaacgccaggggcagtggctgcggaggcggcggctcgatggagcgataaatcgggttcctgtcgggttctaccaaagggtgtggaaaattctgcaaaaatgtcacggcttgtccatcgacggatacgtgctcccttcaagcaccactcgcgagatgaccccccatgaaatcaagttcgccgtccacgttgagagcgtcttgaatcgggttccacagccagagtacaggcaacttctggtcgaagcaatcatggtgctgactctcctgtcggatacggaaatgacctcgatcggcggcatcatccatgtcgaccaaattgtgcagatggccagccagcttttcctgcaagatcaagtgtcgattggagcgatggacaccctcgaaaaggaccaggcaaccggaatctgccacttcttctacgattcagctccgtcgggggcctacggaactatgacttatctgacccgcgccgtcgccagctacctgcaggaactgctgccaaatagtggatgccagatgcag

SEQ ID NO: 18112 - DNA, 3705 bp, Artificial Sequence
  Description of Artificial Sequence: Synthetic coding sequence
atgcggagccgatctaactccggcgtgagactggatggatacgctaggcttgtccaacaaacaattctgtgttaccagaatccggtgacgggactgctgtcagcttcacacgaacagaaggacgcatgggtgagggacaacatatattcaatcctcgccgtgtgggggctgggcatggcgtacagaaagaacgcggacagagacgaggacaaagcaaaggcctatgaacttgagcagaacgttgtgaagttgatgcgcggtctactccaatgcatgatgcgacaggtagccaaagtagaaaagttcaagcacacacagagcactaaggactcattacatgccaagtataacaccgccacttgcggcactgtggttggagatgatcagtgggggcacctgcaggtcgacgccacttccctcttcctgctttttctggcccagatgaccgcctctggactcaggatcatatttaccctcgatgaggtggcgtttatacagaacctggttttttatattgaggccgcatacaaggtagctgattacggcatgtgggaacgcggagacaaaaccaatcaaggcatcccagaactcaacgcctccagcgtcggtatggccaaagctgcgttggaggctatagacgagctggacctgttcggagcacatggcgggcggaaaagcgtgatccacgtcctgccagatgaggtagagcactgccagtccatcttattttccatgctccccagggcctccactagcaaagagatcgatgctggcctcctctctatcatcagcttcccggcctttgctgtggaggatgttaatttagtgaacgtgaccaagaacgagatcatatcgaagctccagggccgatatgggtgctgccgtttcctcagggacggctacaagacgccccgagaagaccccaatcggctccattacgaccctgcggagctgaaactcttcgagaatatcgaatgtgagtggccagtcttttggacctacttcataattgacggcgtttttagtggcgacgccgttcaggtgcaagaatatagggaagccctggagggaatacttatccgggggaaaaacggaattcgcctggtccccgagctgtatgcagttccccccaacaaggtcgatgaagagtataagaacccccacaccgtggatcgcgtacctatgggcaaggtgcctcacctctggggtcagagtttgtacatcctttccagcctgctcgctgaaggattcctggctgcaggtgaaatcgacccactgaacaggcgcttctccacaagcgtaaagcctgatgtggtcgtgcaggttacggtcctggcggagaataaccatataaaggacctgctgcgtaaacacggtgttaacgttcagagtatagctgacattcaccccatacaggtgcagcctggacgcatcttgtctcacatttatgcgaaactggggcgcaataaaaatatgaacctctctgggaggccctaccggcatattggagtacttgggacatccaaactgtatgtcatacggaaccaaatctttacattcaccccccagttcacagatcagcaccacttctatctggccctagacaacgaaatgattgtggagatgttgcggatcgagctggcctacctgtgcacctgttggcggatgaccggtcgcccgacattgacattcccaataagccggaccatgcttaccaacgatggtagcgacattcattcagctgtgctgtccaccatcagaaagctggaggatgggtattttggaggtgcccgggttaaactgggcaaccttagtgaattccttactacgtccttctacacatatttaacctttctagaccccgattgtgacgagaagttgttcgataacgcaagcgagggcactttctctccagactctgactccgatctcgtgggctatctcgaggatacatgcaaccaggaatcgcaggatgagctggatcactacataaatcatttgttgcagtccacatcgctccggtcttatttaccacccctgtgtaagaacacagaggataggcatgtgtttagcgccatccactcaaccagggatatcttgtcagtaatggctaaggccaagggtctggaagtcccgttcgtgcctatgactttacccacaaaagtcctgtccgcgcaccgaaagtctctgaatttagtggatagtcctcaacctttgttagagaaggtgccagagagtgactttcaatggccccgcgatgaccacggagatgttgattgcgaaaagctggtggagcagcttaaggattgttctaacctgcaggaccaggccgatatactgtatattctctacgtgataaaaggcccatcatgggacacaaacctgtcgggccagcatggcgtgaccgtgcagaacctcctaggggagctgtatggcaaggcaggtctgaatcaggaatggggactgattcgatacatatcaggattgctccgtaagaaggtggaggtcctggctgaagcatgcactgatcttctgtcgcatcaaaaacaacttaccgtggggctgccccctgagccaagggagaagatcatcagcgctcctctccccccagaggagttaactaaattaatttacgaagctagtggtcaggacatcagcattgctgttctcacacaggaaatcgtcgtgtacctcgcaatgtacgtcagggcccagcctagcctgttcgtcgagatgctgcgtcttcgtatcggcctgatcattcaggtgatggctacggagttggcacggagcctgaactgctccggagaagaggcatcagagagcctcatgaacctttcacccttcgacatgaagaatctgcttcaccacatcctatcaggcaaagagttcggggtggaaagatcagttagaccaatccactcatccaccagttcacctactatttcaattcacgaagtggggcatactggagttacaaagaccgagagaagtggaattaaccggctcaggagtgaaatgaagcagatgacacggaggtttagcgccgatgaacagttcttctctgttgggcaggctgcctcaagttccgctcacagcagcaaatcagcacgttcttcgacaccgtcatctcctacaggaacatcaagctctgactctggagggcaccacataggctggggagagaggcagggccagtggcttcgccgtcgacggctcgacggagccataaatcgcgtccccgttggcttttaccagcgggtctggaaaatcctgcagaaatgccacggcttgtccattgatggttatgtgcttccatcaagcacaactcgagagatgactcctcacgaaatcaagttcgccgtccatgtggaaagtgttctgaatagggtgccccagcctgaatatcgacaactgctagttgaggcaatcatggttctgacattactgtcagacactgagatgacaagcataggtggaatcattcatgtagaccagatcgtccagatggcctcccagctctttctgcaggatcaagtcagcatcggggctatggatactctagagaaggaccaggcgaccggaatatgtcacttcttctacgacagtgccccttctggggcttacgggaccatgacctatcttaccagggcggtcgcttcatatttacaagaacttctgccaaactctggctgtcaaatgcag

SEQ ID NO: 18113 - DNA, 3705 bp, Artificial Sequence
  Description of Artificial Sequence: Synthetic coding sequence
atgcgctcacgatcaaactccggggttcggttggacggttatgctagactggtgcaacaaactattctgtgctatcagaaccctgtgactgggctcctgtccgcgtcccacgaacaaaaggatgcatgggtcagggacaatatttactccatactcgcggtttggggcctgggtatggcataccggaagaacgccgaccgcgacgaggataaggccaaagcctatgaactcgaacaaaacgtcgttaagctcatgcgaggacttctgcagtgtatgatgcgccaggtggcaaaagtggagaagttcaaacacacgcagagcactaaggactctctccatgcgaaatacaatactgctacctgcggcactgtcgtgggtgacgaccagtggggccacctgcaggtggatgctacctccctgttcctgctctttctcgctcagatgacggccagtggactgaggattatattcacactggatgaagtagccttcattcagaacctggttttctacattgaggccgcctataaggtcgcagactacggcatgtgggaaagaggagataagaccaatcagggtatccccgaactgaacgcatcaagcgtcggaatggccaaggctgcgctcgaggctatcgatgaacttgatttgttcggagcccatggcggcagaaagagcgtcatacacgtgttgcccgacgaggtcgaacactgtcagtccattctgttttctatgctgcccagggccagcacatctaaggagatcgacgcagggctgcttagcataatttctttcccagccttcgctgtagaagacgtcaacctggtgaatgtgaccaagaatgagataatctcaaagctccaaggtcgatacggctgttgtcgcttcttgcgcgacggatataagactcccagagaggatccaaacaggttgcactatgacccagcagagcttaagctctttgagaacatcgagtgcgaatggccggttttttggacctacttcattatcgacggcgtattctccggggacgctgtccaggtgcaggaatacagagaggccttggaggggattttgatccggggcaaaaatggaattcgccttgtgcctgaactctacgctgttccacctaataaagtcgacgaagaatataaaaatccacataccgtggacagagtgcctatgggaaaggtgccccacctctggggtcagtccctgtacatcctgtcctccctgttggctgagggctttctcgcagctggtgagattgaccctctcaaccgacggttctccaccagcgtgaagcccgatgttgttgtccaggtgaccgttttggccgagaataatcacatcaaggacctcctgcgaaagcacggagtgaacgtccagtcaattgccgacatccatcctattcaggtccagcccggcagaatcctttctcacatttatgctaagctgggtcgaaacaagaacatgaacctgtctggcaggccctatagacatattggagtattgggcaccagcaaactctacgtgatccgcaaccagatattcactttcaccccacaattcacagaccagcaccacttctacttggccctcgataatgaaatgatagtggaaatgcttcgaatcgagctggcttatctctgcacgtgttggcggatgaccggtagacctacgctgacatttcctatctctcgcaccatgcttacaaatgacgggagcgatatccatagcgccgtgctgtccactatacgaaagctcgaagacggctactttggcggtgcacgagtcaagcttgggaatttgagcgagttcctgacgacatccttctacacctatctgaccttcctcgatcccgattgtgatgaaaagctctttgataacgcctccgagggcacattttctccagatagcgacagcgacctcgtcgggtaccttgaggacacctgtaaccaagagagtcaggatgagctcgatcactacatcaaccacctcctgcaaagcaccagcctgcgctcttacctgcccccgctctgcaagaatactgaagaccggcacgtgttcagcgcaattcactctaccagagacattctttcagtgatggctaaggccaaaggactggaggtcccttttgtgccaatgacactcccaactaaagtgctgagtgcacacaggaagtctctcaacctggttgatagtcctcagccacttctggagaaggtgcccgagtctgatttccaatggccacgagatgaccacggagatgtggattgcgagaaactggtggagcaactcaaggactgtagcaatctccaggaccaggccgacattctgtatatactttatgtgataaagggacccagttgggataccaacctcagcggacagcatggtgtgacagtgcagaaccttctgggggagctctacggcaaagctggcctgaatcaggagtggggattgatacggtacatatccggcctgctgcgcaaaaaggtggaggtcctggccgaagcttgcacggatctgctcagccaccagaagcagctcacagtgggacttcccccagagcctagagagaagattatctctgcaccactccccccagaggagttgacgaaactcatttacgaggcctcaggtcaggacatctccatcgcggtgctcacacaagaaattgtagtatatcttgccatgtatgtgagagcccagcccagtcttttcgttgaaatgctgcgactgcgcatcgggctcattattcaggtgatggcaactgagctggcccgaagccttaactgctctggcgaagaggcaagtgagtcactgatgaatctctctccattcgatatgaagaacctcctccaccacatcctcagcgggaaagagtttggagtggagaggtccgttcgcccaatccatagctctacatcaagccccaccatttcaatacacgaggtcgggcatactggggtcacaaaaactgagaggtctggcattaaccgcttgaggagcgaaatgaaacagatgaccagaaggtttagcgccgatgaacaattcttctccgtgggtcaggcagcgtcaagttcagctcacagcagcaaatcagcaagaagcagcacgccgtcttcccccaccggtacaagttctagcgacagcggtggccatcacatcggttggggtgaaaggcaggggcaatggcttagacgcagaagactcgacggggccatcaaccgggttcctgttggattttaccagagagtctggaagatcctccagaaatgccatggactctctattgacggctatgttttgccttctagtacaaccagagagatgacacctcatgagatcaaattcgccgtccacgttgagtctgtcctgaatagagtaccccagcctgaataccggcaactcttggtcgaggctatcatggtgctgactctcctctctgataccgaaatgacgtctatcggcggcatcatccatgttgaccagatcgtacagatggcaagccaacttttcttgcaggaccaagtgagcatcggtgccatggacactctggagaaggaccaggccactgggatctgccacttcttctatgactccgcccccagtggcgcctacgggactatgacctacttgactagagctgttgctagctacctgcaagaactgcttcccaactctgggtgccagatgcag

SEQ ID NO: 18114 - DNA, 3705 bp, Artificial Sequence
  Description of Artificial Sequence: Synthetic coding sequence
atgagatcaagatcaaattctggagtacgtttagacggatatgcaagattagttcaacaaacaattttgtgttatcaaaatccagtaacaggtttattatcagcttctcatgaacaaaaagacgcatgggttcgagataatatttattcaatcttagccgtttggggtcttggaatggcttatagaaagaatgctgatagagatgaggataaagctaaagcctatgaattagaacaaaacgttgttaagttaatgcgaggattacttcaatgtatgatgagacaagttgcaaaagttgaaaaatttaaacatacacaatctactaaagattcattacatgctaaatataatactgcaacatgtggaacagttgttggtgatgatcaatggggtcatttacaagttgatgcaacttctctttttcttttgtttcttgctcaaatgacggcttctggattacgtatcatttttactcttgatgaagttgctttcatacagaatcttgttttttatattgaagctgcatataaagttgcagattatggaatgtgggaaagaggagataaaacaaatcagggtattccagaattaaatgcttcaagtgttggaatggcaaaagctgctttagaagctatagatgaacttgatttatttggagctcatggaggaagaaagagtgttatacatgttctcccagatgaagttgaacattgtcaatcaattctttttagtatgttaccaagagcttctacatctaaagaaattgatgctggtttattatcaataataagtttcccagcttttgcagttgaagatgttaatttggtaaacgttactaaaaatgaaattattagtaaattacaaggaagatatggttgttgtagatttttaagagatggatataaaacaccaagagaggatccaaatagattacattatgatcctgctgaattaaaactattcgaaaatattgaatgtgaatggccagtattttggacttatttcattattgacggagtattctcaggagatgctgttcaagttcaagaatacagagaagcccttgaaggtattttaataagaggaaaaaacggtattagattagttccagaattatatgctgttccaccaaataaagttgacgaagaatacaaaaacccacacacagtagatagagttccaatgggtaaagtacctcatttatggggacaatcactttatattttaagttctcttttagctgaaggattccttgctgctggagaaatagatccattaaatagaagattctctacttctgtcaagccagatgttgtagttcaagtcactgttttggctgaaaataatcatattaaagatcttcttagaaaacatggtgttaatgttcaatcaattgctgatattcatcctattcaagttcaaccaggaagaatattgagtcatatttatgcaaaactaggacgtaataaaaatatgaatttatcaggacgaccatatagacatattggagtattagggacatcaaaattgtatgttattagaaatcaaatttttacatttacaccacaattcactgaccaacaccacttttatcttgcattagataatgaaatgatagttgagatgttacgaattgaattagcttatctttgtacttgttggagaatgacaggaagaccaacattaacattcccaatttcaagaactatgttaactaatgatggatctgatattcactcagcagttttatcaacaattagaaaattagaagatggttatttcggtggagcaagagttaaattaggaaatttgagtgaatttcttactacatcattttatacttatcttactttcttagatccagattgtgatgaaaaattatttgataatgcttcagaaggtactttttctccagattctgattctgatcttgtaggatatttagaggatacatgtaatcaagaatcacaagatgaattagatcattatattaatcatcttttacaatcgacttctcttcgttcttatctcccaccactttgtaaaaacacagaagatcgacatgtttttagtgctatacattccactagagatatactttcagttatggcaaaagcaaaaggacttgaagttccattcgtaccaatgacacttcctactaaggttttaagcgctcatagaaaatctttaaatttagttgattctccacaaccacttcttgaaaaggttcctgaaagtgattttcaatggccaagagatgatcatggagatgttgactgtgagaaactagttgaacaattaaaggattgttcaaatttacaagatcaggctgatattctttatattttatatgtcattaaagggccaagttgggatacaaatttatcaggacaacatggagtaacagttcaaaatcttttaggagaattatatggaaaagcaggacttaatcaagaatggggattgattagatatatttcaggattacttagaaaaaaagttgaagttttagcagaagcatgtacagatttactttcacatcaaaagcaacttacagttggacttccacctgagccaagagaaaagataatttcagctccattacctccagaagaattaactaagttaatttatgaagctagtggacaagatatttctattgctgttttaacacaagaaattgttgtgtatttagctatgtatgttagggcacaaccatctttgtttgttgaaatgttaagattaagaattggtcttataattcaagttatggctacagaacttgcacgaagtttaaattgttctggtgaagaagctagtgaaagtttaatgaatctttcaccatttgatatgaaaaatttacttcatcatattctttctggaaaagaatttggtgtggaaagatcagttagaccaatacatagtagtacttcatctccaactatttccattcatgaagttggtcatacaggtgttactaaaactgaaagatcaggaattaatagacttagatcagaaatgaaacaaatgacaagaagattttcagcagatgaacaatttttttcagttggacaagcagcatcttctagtgcacattcatccaagagtgcaaggtcatcaacaccttcatcgccaactggaacttcatcttcagattctggtggacatcatattggatggggtgaaaggcaaggacaatggttacgaagaagaagacttgatggagctattaatagggttccagttggattttatcaaagagtttggaagattttacaaaaatgtcatggactttcaattgatggttatgttcttcctagttctacaacaagagaaatgactcctcatgaaattaagtttgcagttcatgtagaatcagttttgaatagagttcctcaaccagaatatcgtcagctattagtagaagcaattatggttttaactctattatcagatactgaaatgacttcaattggaggaattattcatgtagaccaaattgttcaaatggcaagtcaattatttttacaagaccaagtttctattggtgcaatggatacactagaaaaggatcaagcaacaggaatttgtcattttttttatgattcagcaccttcaggagcatatggaactatgacatatttaacaagagctgttgcatcatatttacaagaattgcttcctaactctggttgtcaaatgcaa

SEQ ID NO: 18115 - DNA, 3705 bp, Artificial Sequence
  Description of Artificial Sequence: Synthetic coding sequence
atgaggtcgagatcaaattccggagtccgcctcgacggatacgcccggctcgtgcagcaaaccatcctgtgctaccagaaccccgtgactggactcctgtccgccagccatgagcagaaggacgcctgggtgcgggacaacatttactcgatccttgcagtgtggggactgggaatggcctatagaaagaatgccgaccgcgacgaagataaggctaaggcctatgagttggagcagaacgtcgtcaaactgatgagaggactgctgcaatgcatgatgcggcaagtggctaaagtggagaagtttaagcatacgcagtccacgaaggactccctgcacgccaaatacaacacggccacgtgcggaaccgtcgtgggggatgatcagtggggccacctgcaggttgatgcgacctcgctgttccttcttttcctcgctcagatgactgcgagcggacttcgaatcatcttcaccctggacgaggtggccttcatccaaaatctcgttttctacatcgaggcagcgtacaaggtcgccgactatgggatgtgggaacggggtgacaagactaaccaaggaattccagagctgaacgctagcagcgtggggatggccaaagcggcattggaggcgatcgatgaactggatctgttcggcgcccacggaggacgtaagtcagtgatccacgtccttccggatgaagttgaacactgtcagtcgatactgttctcgatgctgccccgcgcgtccacctcgaaggagattgatgcgggattgttgagcatcatctcattcccggcttttgcggtcgaggatgtcaatctggtgaatgtcacgaaaaacgagatcatctctaagttgcagggccgctacggatgttgccgcttcctcagggatgggtacaagaccccgcgggaagatcctaaccgcttgcactatgatcctgcggaactgaagttgttcgaaaacatcgagtgcgaatggccagtgttttggacctacttcatcatcgacggggtgttctcgggagacgccgtgcaggtgcaggaatacagagaagccctggagggcatccttattcggggcaagaatggcatccgattggtccctgagctgtacgccgtcccgccgaataaagtcgatgaagagtataagaaccctcacaccgttgatcgcgtgccgatgggaaaagtgccccacctctggggccaaagcctgtacatcctgtcgtcactgttggctgaaggattcctggcggccggggaaatcgacccgctgaatagacggttttccacttccgtgaaaccggatgtggtggtgcaggtgaccgtgctggccgagaataaccatatcaaggaccttttgagaaagcatggagtgaatgtccaatccattgcagacatccacccaatccaggtgcaaccaggacggatcctcagccacatttacgcgaaacttggacggaacaagaacatgaacctctcaggacgcccataccgccacattggggtgctcgggacctcgaagctctacgtcatccgaaatcagatcttcaccttcactccgcagtttaccgatcagcatcatttctacctcgccctggacaacgagatgatcgtcgaaatgttgagaatcgaactggcctacctgtgcacctgctggagaatgactggaaggcctactctcaccttcccaatctcacgcactatgttgactaacgacggatcggacatccattcggctgtgctgtcgaccatccgcaaacttgaggatggttacttcggcggtgcccgcgtgaagctgggcaacttgtcagaattcctgaccacctcgttctacacttacctcacgttccttgatccggactgcgacgagaaattgtttgataatgcctcggaaggaacgttctcgcctgacagcgactcggacttggtcggatatcttgaagatacctgcaaccaggaatcgcaagatgagttggaccactacatcaaccatctgctgcagtcgaccagccttcgttcatacctgcccccgctgtgtaagaacactgaagatcgccacgtcttttcagcgattcacagcacgagagatatcctgtcggtgatggcgaaggccaagggcctggaagtcccattcgtgccgatgactctcccaaccaaagtcctgagtgcgcaccgcaagtcactcaacctggtggattccccacagccactgttggagaaggtccctgagtcggacttccaatggcctagggatgatcacggcgacgtggactgcgaaaagctggtcgagcagcttaaagactgttcgaacctccaggaccaggcggacatcctttacatcctgtacgtgatcaaaggaccgtcgtgggacactaacctgagcggacaacacggagtgacggtccagaaccttctcggagaactctatggcaaagcgggactgaaccaggagtggggactgataaggtacatctcgggactgctgcgcaaaaaggtggaagtccttgctgaagcctgcaccgacctcctctcccaccagaagcagctgaccgttggccttcccccggagccgagggaaaagatcatttccgcccctctgccgcctgaagaactgactaaactgatctacgaggcgagcggacaggacatctccatcgccgtcttgacccaagagatcgtggtctacctcgctatgtacgtgcgcgcgcaaccgtccctgttcgtggaaatgctgaggctccggattggactcatcatccaagtgatggcaaccgaactggcccgctcactgaactgctccggagaggaagcatcagagagcctgatgaatctgtcacctttcgacatgaagaacctgctgcaccacatactgtccggaaaggaattcggagtggagcgatcggtgcggcccatccacagctccactagctcccctaccatctcgatccatgaggtgggtcataccggagttaccaagaccgagcggtcaggaatcaacagactgagatcagagatgaagcaaatgaccagaaggttttcggcggacgaacagtttttcagcgtggggcaagccgccagctcctccgcgcattcgtctaagtcggcccggtcgagcaccccctcttcgccgactggtacttcgagctcagattccgggggacaccatatcggatggggtgagcgccagggtcagtggttgcggagaaggcggctcgacggcgcaatcaatcgggtgcccgttgggttctaccagagagtttggaaaatactgcagaagtgccacggactttcaatcgacggatatgtgctgcctagctcgaccaccagggagatgaccccgcacgagatcaagttcgcggtgcacgtggagtccgtgctcaatcgcgtgccacaaccggaataccggcaactgctggtggaggcaattatggtccttaccctgctctctgacaccgagatgacctccatcggaggaatcatccacgtggaccaaatcgtgcagatggcatcccagctgtttctccaagatcaggtttccatcggcgcgatggacactctggagaaggaccaggccactggaatctgtcacttcttttacgactcggcgccaagcggcgcatacggcaccatgacctaccttacgagagccgtggccagctacctgcaagaattgctgccgaacagcggctgtcaaatgcag

SEQ ID NO: 18116 - DNA, 3705 bp, Artificial Sequence
  Description of Artificial Sequence: Synthetic coding sequence
atgcggtcgcggtcgaattcaggtgtccgcctcgatggatacgcgagactggtgcagcaaactatcctgtgctaccagaacccggtcactggcctgctctcggcatcgcacgagcagaaggatgcgtgggtgcgggataacatctattcgatcttggcagtgtggggactcggcatggcataccggaagaacgcggacagggatgaggacaaggccaaagcatacgaactggaacagaacgtggtgaaacttatgagaggcttgctgcagtgtatgatgcggcaggttgcaaaagtggagaagttcaagcacactcaatccactaaggacagcctgcatgctaaatacaatactgccacttgtggaactgtggtgggggacgaccagtggggacatctgcaggtggacgccacctccctgtttctgcttttcctcgcccagatgaccgcttccggactgcggatcattttcaccctggacgaagtggctttcatccagaatctcgttttctacatcgaagccgcttacaaggtcgctgactatggcatgtgggaacgaggagataagactaatcagggaattccagagttgaacgcgtcctcggtcgggatggctaaagctgcactcgaggcaatcgacgagctggacctgtttggggcacatggtggtcgcaagtcggtgattcacgtactgccagatgaagtggagcattgccaatccatcctcttctcgatgctccctcgcgcctcgacttccaaagaaattgacgctggcctgctgtcaatcatctccttcccggccttcgcggtggaagatgtgaacctggtcaacgtcactaagaatgagatcatctcaaagctgcaaggccggtatggctgctgcagattcctgagagatgggtacaagactccgagagaagatccgaatcgcctccactacgacccggccgaactcaagctgttcgagaatatagagtgcgaatggccggtgttttggacttatttcatcatcgatggggtcttttctggggatgccgtgcaagtccaggaatatcgcgaagccttggaggggatcctgatccgggggaagaatggaatcaggctcgtgcctgaactctacgccgtgccaccgaacaaggtggacgaggagtacaagaacccacacactgtcgaccgggtgccaatggggaaggtgccccatctctgggggcaatcgctctacatcctttcctccctgctggcagagggattcctcgcagccggagagatcgatccactgaatcggcgcttctccaccagcgtcaagccggacgtggtggtgcaagtcaccgtgcttgcagagaataaccacatcaaggacctcctccgcaagcacggcgtcaatgtgcaatccatcgctgacatccacccgatccaggtccagccaggtcgcattctgtcgcatatctacgccaagttgggacggaacaagaacatgaatctttccggtcgtccatacagacacattggagtgttggggacctccaaactctatgtcatcagaaatcaaatcttcacttttaccccgcagtttacggaccagcaccacttctacctcgcactggataacgagatgattgtcgaaatgctgagaatcgagttggcatacctgtgcacttgttggaggatgactggcagaccgaccctgacgttcccgatctcgcgcaccatgctgaccaacgatggatcagatatccactcagccgtgctgtcaaccatcagaaaactggaagatggctattttggaggcgctcgggtgaaactcggaaacctctcggagttcctcactaccagcttctacacttacttgacctttctggacccagactgcgacgagaaattgttcgataacgcatctgaaggaaccttcagcccggactcggattcagacctggtggggtacctggaggatacgtgtaaccaagaatcccaggacgagttggatcactacatcaatcacctgctgcagagcacttccctgcggagctatctgccgcccctttgcaaaaacacggaagatagacacgtgttctcggccatccattcaactagagatattctgagtgtgatggcgaaagcgaaaggactggaagtgccgttcgtgcctatgaccctcccaactaaagtcctctcggctcacagaaagtcgctgaaccttgtggactccccgcaacctctgctggaaaaggtgccggaaagcgactttcaatggccacgggacgatcacggagatgtcgactgtgagaaactggtcgaacaactcaaagactgctcgaacctccaagaccaggccgacatcttgtacatcctttacgtgattaagggaccctcctgggataccaatctgtcggggcagcacggagtgactgtgcagaatctcctcggagagttgtacggaaaggccggcctgaatcaagagtgggggctcatcaggtacatctcgggactgctgagaaagaaggtggaggttctggccgaggcatgtaccgatctgcttagccaccaaaaacaactcactgtcggactgccgccagaaccgcgcgaaaagatcatttcggccccgctgccgcctgaggaactgactaagctcatctacgaagcctcaggacaggacatttcaattgccgtgctgacgcaagagattgtggtgtacctggcgatgtacgtgcgcgctcaaccgtcgctctttgtggagatgctgcggctgcgcatcggcctcattattcaagtgatggcaacggagttggcccgctcgctgaactgttctggagaggaagcatcagagtccctgatgaacctgagccccttcgatatgaaaaatctgctccatcacatccttagcgggaaagaattcggcgtggaaagatccgttcggccaatccattcatcaaccagctcccctaccatctcaatccacgaggtgggccacactggtgtgactaaaactgagcgcagcggtatcaacaggctgaggtcagaaatgaagcagatgaccaggcggttctcagctgatgaacagttcttctcagtcggacaggcagctagcagctccgcgcactcaagcaaatcggcccgctccagcactccttccagccccaccggtacgagcagcagtgattctggtggacaccatatcggatggggagagcgccagggacaatggcttcgcagaaggagactggacggcgctatcaaccgggtgccggtcggattctaccagcgggtgtggaaaattctgcagaagtgccacggactttccatcgacggatacgtcctgccatcatcaaccacgagggaaatgactcctcatgaaatcaagttcgcagtgcatgtcgaaagcgtcctgaatcgggtcccccaaccggagtaccggcagctcctcgtggaagctattatggtgctgaccctgctctctgacaccgaaatgacctccatcgggggtatcatccacgttgaccagatcgtgcaaatggcttcccagctgttcctgcaggaccaagtcagcatcggtgccatggacactctggaaaaggatcaggcaaccgggatttgccactttttctacgattcagctccatcaggcgcctacggcaccatgacgtaccttactcgcgcggtggcgtcatatttgcaggagttgctgcctaactccgggtgccaaatgcaa

SEQ ID NO: 18117 - DNA, 3705 bp, Artificial Sequence
  Description of Artificial Sequence: Synthetic coding sequence
atgcgctccagatcaaacagcggtgtgaggctggacggttacgccagattggtccagcagactattctgtgctaccagaacccagtgaccggtttgctttcagcgagccatgagcaaaaggacgcatgggtccgagataacatttactcgatactcgcagtgtggggtcttggaatggcttatcggaagaatgcagatagagatgaggacaaggccaaagcgtacgaactcgaacaaaacgtggtcaagctcatgagaggtttgctgcaatgtatgatgcgccaggtggccaaagtggaaaagtttaaacatactcagtcgactaaggatagccttcatgcgaaatacaacactgcaacttgtgggaccgtggtgggagatgaccagtggggacatctgcaagtggatgccacgagcctgtttctcctttttctcgcacaaatgaccgcgtcaggacttcggatcatattcaccctggatgaagtggccttcatccaaaacctggtcttttacatcgaagccgcctacaaagtggccgattacgggatgtgggagaggggggacaaaactaaccaaggcatacctgaattgaacgcttcctccgtgggcatggcgaaggccgctctggaagcaatcgatgagctggatctttttggagcgcacggaggaagaaaatcggtgatccacgtccttccagacgaagtcgaacattgccaatcaattctgttcagcatgcttcctcgtgcatcgacttccaaggagattgacgcgggactgctttcaatcatttcctttccggcattcgcagtggaagatgtgaatctggtgaacgtgactaagaatgagattatctccaaacttcagggtaggtacggttgttgccgtttcctgcgcgatggctacaagacccctagagaggatcccaaccgccttcactacgacccggcagaactcaagctgtttgagaatatagaatgtgaatggcctgtgttttggacgtacttcatcatagacggagtgttctccggtgacgcagtgcaggtgcaagagtatcgggaagcactcgaaggcattctgattcggggtaagaacgggatccggctcgttccagaactctacgcagtcccacccaacaaggtggacgaagaatacaaaaatccacatacggtggaccgggtgccaatgggaaaggtcccacatctgtggggccagtccctttacatactttcgagcctcctggctgagggatttcttgcggcaggagagatcgaccccctgaaccgtagattttcgacgtcagtcaaacccgatgtcgtggtccaagtgacggtgcttgctgagaataaccacattaaggatttgctgcgaaaacacggggtgaacgtccaatcaattgccgacattcatcctattcaggtccaacccgggagaattctgtcccacatttatgccaagctcggacgaaataagaatatgaaccttagcgggcggccttacagacacattggtgtcctcggtacctcgaagctgtacgtgatcaggaaccagatctttacttttactcctcaattcactgaccagcatcatttctaccttgcattggataacgaaatgattgtcgaaatgctgagaattgagttggcttacctttgcacctgttggcgcatgacgggaaggccaaccctgacttttcctatttcgagaaccatgctgaccaatgatggctccgatatacattcggcagtcctctcaactatccgtaaacttgaagatggttactttgggggcgcacgtgtcaaattgggaaatctgtccgagtttctgacgaccagcttttacacttatcttaccttccttgatccagattgcgacgaaaagctgtttgacaacgcatcggaaggcaccttttccccagattccgacagcgaccttgtgggttacctcgaagatacgtgtaaccaagagagccaggatgaactggatcattacatcaatcacctgctgcaatccacttcactcagaagctaccttccacctctgtgcaagaacactgaggatcggcatgtcttttcggcaatccactcgactcgagatatactcagcgttatggccaaagcaaagggactggaggtgcccttcgtgcccatgacgctccccactaaggtcctgtctgcccacagaaagtccctgaaccttgttgattcaccgcagcccctcctcgaaaaggtccctgagtcggactttcaatggcccagagatgatcatggcgacgtcgactgcgagaaattggtggaacagcttaaggattgttcaaacttgcaagatcaggccgatattctgtacattctttacgtgattaagggtccgtcgtgggataccaatttgtcgggacagcatggggtgactgtgcagaatcttctcggagaactttacggaaaggcaggactcaatcaggaatggggacttatacgctatatctcaggacttctcagaaaaaaggtcgaagtgctggcagaggcctgtactgatctgctgtcacatcagaagcaattgaccgtggggttgcccccagaacctagggagaagatcatcagcgcaccactcccaccagaagaactgacgaaacttatctacgaagcgtcggggcaagatatatcaattgctgtgcttactcaggagattgtcgtgtacctggcgatgtacgtccgagcacaaccatcgttgtttgttgaaatgctcagacttcgtataggtttgataattcaggtgatggcaaccgaacttgctagatcgttgaattgttctggcgaagaggcttcagaatccttgatgaacctgagccctttcgacatgaagaatttgcttcaccacattctgtccggtaaggaatttggcgtggaacgctcagtccgtcctattcactcctcgacttcaagcccaaccatttcgattcatgaagtgggtcataccggtgtgaccaagacggagcggagcgggattaaccgcctgagatccgagatgaagcaaatgacccgacgcttttcggcagatgagcagttctttagcgtgggccaagcggcatcatcgtccgcacatagcagcaagtcggcccggtcctcgactcctagctcgccgaccggtacttcctcatcggactccggggggcaccatatcggatggggcgaaaggcagggacagtggcttcggcggagaaggctcgacggggccataaaccgcgtgccggttggattctaccagcgggtctggaaaattctgcaaaaatgtcatggcctgtccatagatggatacgtccttccctcgtcaacgactcgtgaaatgacgcctcacgagataaagtttgctgtccatgtggagtctgtgctgaatagagtgccccaaccagaataccgacaacttcttgtggaagcgattatggtcctgaccctcctttcggataccgaaatgacctccatcggtggcataatccacgtcgaccaaatcgtccaaatggcctcgcaacttttcctccaagatcaagtgtccattggtgcaatggatactctggaaaaggaccaagcaaccggtatttgtcatttcttctatgattccgcaccgagcggggcatacggaactatgacctacctcactcgcgcagtggcttcctacttgcaagaacttcttccaaactcgggatgtcagatgcaa

SEQ ID NO: 18118 - DNA, 3705 bp, Artificial Sequence
  Description of Artificial Sequence: Synthetic coding sequence
atgaggagtcgcagcaacagtggcgtgcgtctcgatggttacgccagactcgttcaacaaactatcctgtgttatcagaacccggtcaccgggctcctctcggcctcacacgaacagaaagatgcttgggtaagggataatatttatagtattctggccgtatggggattaggcatggcatatcgtaaaaacgcagacagggatgaggacaaggccaaggcttacgagttagagcaaaacgtggtgaagctaatgcgaggcctccttcagtgcatgatgcgtcaagttgcaaaggtggaaaaatttaaacatacccagtctactaaggattcgcttcacgcgaaatataacactgcaacctgtggcaccgtggtgggcgatgatcagtggggccacttacaagtggacgcgactagcctgttcctcctcttccttgcgcaaatgaccgcctctggtctgaggattatttttactttagacgaagtagctttcatccagaacctggtattttacatcgaagccgcctacaaggtggccgattatggtatgtgggagagaggtgacaaaactaaccagggaatcccagagctaaacgcatcctccgtgggtatggcgaaagctgcgctggaagcaatagatgagctggacctgttcggagctcacgggggccgtaagtctgtgatccatgtgctgccagatgaagtcgagcactgccagtctattctgttctctatgttgccccgcgcatctactagcaaggagatcgacgctggcctgctctctatcatttcgttcccggcctttgctgtggaggatgtcaacctagttaatgttacaaaaaatgagattataagtaagctgcaggggaggtatgggtgctgtagatttttacgggatggatataagaccccgagggaagatcctaaccgcttacactacgaccccgcggagttaaaattgttcgaaaatatcgaatgcgaatggcccgttttttggacctacttcattatagacggggtcttctccggagatgccgtccaggtgcaggaatatagggaggctcttgagggaatcttgatccgtggtaagaatgggattcgtctggtccccgagctttacgccgttcccccaaataaggtggatgaggaatacaaaaatccacatacagtagacagagtgcctatgggcaaggtgccccatctgtgggggcagtcactctacattctgtcttccctcctggcagaggggttcctggccgccggggagatcgaccctttaaaccggaggttctcaaccagtgtcaagccagacgtggtcgtgcaggtgacagtgctagcagaaaataatcacattaaagacttactacgtaaacatggtgtgaacgtgcaatcgattgccgatattcacccgatccaggttcagccaggtaggatcctgagtcacatttatgcaaaactagggaggaacaagaacatgaacctttcaggaagaccctataggcatattggggtgttgggcacaagcaagttgtatgtgatacgcaaccagatttttacattcacaccccaatttactgatcagcaccatttctacctggccctggataacgagatgatcgtggaaatgctacgaattgagttggcctacctgtgtacctgttggaggatgacaggcagaccgactctcacgtttcccatctctcgaactatgctcacgaacgacgggagtgatattcacagcgccgttctgtcgacaattagaaagctggaagatggttattttggaggagctcgggtgaaactgggaaacctatccgagtttttaacgacttccttctatacttatctgactttcttggaccctgactgcgacgaaaaattgttcgataacgcgtcagagggcactttcagcccagatagcgactctgacctggtgggctatttagaagacacttgcaaccaggaatcgcaggatgagctcgaccactacattaatcacctcctgcagagcacatctctgcgctcatatctgcctcctctttgtaaaaacaccgaagatcggcacgtgttttctgctatacattcgacccgggatatcctgagcgtaatggctaaagcgaaaggccttgaagtcccgttcgttccaatgacccttccgacaaaagttctgagtgcccatagaaagagccttaatttggtcgactcgccccagcccctgctcgagaaggtgcctgaaagtgacttccagtggccaagggacgaccatggggatgttgactgtgaaaagctcgttgagcaactgaaggactgctccaatttgcaggaccaggccgatattctttacatcctctacgtaataaagggcccatcctgggacactaacctgagcgggcagcacggcgtaactgtacaaaatttattgggggagctctacggcaaagcaggactgaatcaagagtggggattaatacgctacatttctgggctgcttagaaagaaagtcgaggtgcttgcagaggcctgtacagatctgctgtcgcaccaaaagcagctaaccgtgggcctgccacctgagccacgcgaaaagatcatatccgcacctctcccccctgaggagctcactaaattaatctatgaagcaagcggacaggacatctcaatcgccgttctgactcaggaaatcgtggtatatcttgccatgtacgtgagagcacaaccaagcctgtttgtggagatgctgcgcttgagaatcggcctgatcatccaggtgatggcaaccgaacttgccaggagcctgaactgctctggtgaggaagcctcagagtctcttatgaatctgagtccgtttgacatgaagaaccttcttcaccatatcttaagcggcaaggaattcggggtggaaaggagcgtcagaccgattcacagctcaacttctagtccaacaatcagtatacacgaggttggccataccggcgtgaccaaaacagaacggtcagggatcaataggttgcgcagcgaaatgaaacagatgacgagaagatttagcgccgacgaacaattcttctctgtggggcaagccgcatcaagttcagcccacagcagcaaatctgctagaagcagtacccccagttctcccactgggaccagcagctccgactcaggaggccaccatatcggttggggagaaagacaggggcagtggctccgtagaaggcgtctcgatggcgcaatcaaccgcgtgcccgtcggcttttaccagcgagtctggaaaatcttgcagaagtgtcacgggctttcaatagatggctatgtgctgccgtcttctacaactcgtgagatgaccccccacgagattaagtttgccgtgcacgtggagtctgtgctgaatagggtcccgcagccagaataccggcagctgctggtcgaagctatcatggttctgaccctgttgagcgatactgaaatgaccagcatcggaggaatcattcacgtcgaccagatcgtccaaatggctagtcagctgtttctccaggatcaagtctctataggagctatggacaccctggagaaggaccaagccactggaatttgccattttttttacgatagcgccccttcgggggcatacggtacgatgacatacctcactcgtgcggttgcaagctacctgcaagaacttctacccaacagcggttgtcaaatgcag

SEQ ID NO: 18119 - DNA, 3705 bp, Artificial Sequence
  Description of Artificial Sequence: Synthetic coding sequence
atgcgctctcgatctaacagtggggttcggttagatgggtacgcgcggcttgtgcagcagactatcctgtgctatcagaaccccgttacaggcctcctgagcgctagccatgagcagaaggacgcctgggtgagggacaatatttactcaatcctggcagtgtggggtttgggcatggcttacaggaaaaacgctgacagagacgaagacaaagccaaggcgtacgagttggagcagaacgtggtgaagctcatgaggggcctgctgcagtgtatgatgagacaggtcgcaaaggtcgaaaaatttaagcacacccaatccaccaaggactcactacacgctaaatacaacacagctacatgcggtacagtagttggggacgatcagtggggtcatctgcaggtggatgccacaagcctcttcctactcttccttgctcaaatgactgcaagtggcctaagaattatcttcacactggatgaggtagcattcattcagaaccttgttttctatatagaagctgcctacaaggtggccgattatggaatgtgggagagaggggacaaaaccaaccagggaatcccagaactgaatgccagctcagtgggcatggccaaggccgccctggaagctatcgacgaactcgacctatttggcgcccatgggggacggaaatctgtgatccatgttctccctgacgaggttgagcattgccagtccattctattttccatgctgccccgagcatccacgagcaaggagattgatgccgggctcctttctattataagctttccagcgttcgcagttgaggacgtaaacttggtgaatgtcacaaagaacgaaattatcagtaagcttcaagggaggtatggttgttgcagattccttagggacggatacaagacgccacgagaggacccaaatcgcctgcactacgaccctgccgagttgaagttgtttgagaacattgaatgcgagtggcccgtgttctggacttatttcataattgacggagtgttttctggagacgccgttcaggtgcaggagtacagagaggccctagaggggattttgatccgcggtaaaaatgggatacggctggtccccgagttgtacgccgtcccacccaataaagtcgatgaggagtataagaacccacacactgttgacagagttcctatggggaaggtcccccacttgtgggggcaatctctgtacattctgtctagtctacttgccgaaggcttcttggctgcaggagaaattgaccctctgaaccggcggttttctacatcagtgaaacctgacgttgtggtccaggtgactgtgctcgccgagaacaatcacatcaaagatcttctgcgcaagcacggagtgaacgtccagagtatcgccgacatccaccccatacaggtgcagcctgggcgcattctcagccatatctacgctaagctcggtcgcaataaaaacatgaatctttcggggcggccctatagacacatcggagtcctgggaacatccaagctgtatgtgatccgcaaccagattttcaccttcacccctcaattcaccgaccagcatcatttttacctggcgctggataatgagatgattgtggagatgctgcgcatcgaactggcctacttgtgtacttgttggcgaatgaccggtagaccaacactcaccttccccatttcacggactatgcttacgaacgatggtagcgacatccactcagctgtactgagtaccattaggaaactggaggatgggtatttcgggggggcacgtgtcaagctgggcaacctgagcgaattcttaaccacgtcattctacacctaccttacctttctagaccctgattgtgatgagaagctctttgacaatgccagtgaaggcactttcagccctgatagcgacagtgatctcgtaggctacctagaagatacctgcaatcaggaaagtcaggacgagttggaccactacatcaaccacttactgcagtccaccagtttaagaagctacttaccgcctctgtgtaagaataccgaggacagacacgttttctctgcaatccactccacaagggacatcctgtccgtgatggccaaggcaaaaggcctggaagttccattcgtccccatgacattgcccaccaaagtgctgtctgcacatcgtaagagcctgaacctggtggatagcccacagccattactggagaaggtgccggaaagcgacttccagtggcctcgagacgatcacggagacgtcgattgtgaaaagctagtagagcagctcaaagattgttctaatctccaggaccaggccgacatattgtacatcctatacgtgatcaaaggaccatcctgggacaccaatctgtctggccagcacggtgtcaccgtacagaatctgctcggcgagctgtatggcaaagcaggcctgaatcaagaatggggtctcataaggtatattagtggactgctgcgaaaaaaggtggaagtcctagctgaggcatgcacagacctgctctcccaccaaaaacaactcaccgttggtttgccacccgagccccgggaaaagattatcagcgctcccctgccccccgaagagctcacgaaactgatctacgaggctagtggacaggacatttccattgccgtgctgacacaggaaatcgtggtgtacctcgcaatgtacgtgcgtgctcaaccgagcctgttcgttgagatgctcaggcttagaatcgggctgatcatccaagtgatggctaccgagctagcccggtctctcaactgtagcggagaagaagcctcagaatcactcatgaacctgagtcccttcgacatgaagaacttactgcatcacattctttcggggaaagaatttggcgtcgagcgctccgtgagaccaattcacagctcaacctctagccctaccatatccatacacgaggtgggacacacgggtgtaacaaaaaccgaacgcagtggaattaaccgcttgagatcagagatgaaacagatgacacgccggttttctgctgacgagcagttcttcagtgtcggacaggcggcttcctcatccgctcactcctcaaagtccgcacgatcctccaccccaagttcaccaactggcaccagctcctcagactctggagggcatcacattggctggggcgagaggcaggggcagtggctccggcggaggcggctggatggggccatcaacagggtgccggtgggtttttaccaaagagtttggaagattttacagaagtgccatggactttccattgacgggtacgtcctaccaagcagtaccaccagagagatgactccacatgagattaagtttgcagtgcacgtagagagtgtcctgaaccgggtcccccagccagagtacaggcagctactagttgaagccatcatggtcttgactttactatcagataccgaaatgacttctataggtggcattatccatgtagatcaaatcgttcaaatggcctctcagttatttctccaagatcaagtgagcatcggggcgatggacactctcgaaaaggatcaggcgacggggatctgccactttttctatgattccgctccatcaggtgcatacggaactatgacctatctaacacgggcagtggcctcgtacctgcaggaactcctacccaactctggatgtcagatgcag

SEQ ID NO: 18120 - DNA, 3705 bp, Artificial Sequence
  Description of Artificial Sequence: Synthetic coding sequence
atgagaagccggagcaatagcggcgtgaggttggatggttatgccaggctggtgcagcagactattctttgctatcagaaccccgtcaccggactgctgtcagcgagtcacgaacaaaaggatgcttgggttcgggataacatctattcaattctggccgtttggggcttgggcatggcttaccgcaaaaatgcggatagggacgaagataaagcaaaggcgtacgagctcgagcagaacgtggtcaagctgatgcgcgggctgctgcaatgcatgatgcgtcaagttgctaaggtggaaaaattcaaacatactcagtcaactaaggactccctccatgcaaagtacaacaccgcaacatgcgggacggtggtcggggatgatcaatggggacatctccaagtggacgcgactagtttgtttctcctgtttctggctcagatgactgcgagcgggctgcgcatcatctttacgctcgatgaggtagcttttattcagaacctagtgttctatattgaggccgcctacaaagtggcggactacggtatgtgggagagaggggacaaaactaatcaaggaattccggagctgaatgcctccagtgtgggaatggcgaaggctgcactcgaggccatcgatgagctcgacctctttggggcacacggaggacgaaaatccgtcatccacgttctccctgacgaggttgagcattgccagagcatcttattctcaatgctcccccgggcctcgacatccaaagaaatagatgctggccttctgtctatcatatctttcccagcgttcgcggtggaggacgtcaacctggttaacgtgacgaagaatgaaatcatatctaagcttcagggcagatacggatgctgcaggtttctccgggatggttataagaccccacgagaggatccaaaccggctccattatgatccagctgagctgaagcttttcgaaaatattgaatgcgagtggccggtgttctggacatactttatcatagatggggtattttcaggggacgctgtgcaggtgcaagagtatcgggaggctctcgagggaatcctgattcgcgggaagaatggtatccgattggtgcctgagctgtacgcggtgccacctaacaaagttgacgaagagtacaagaacccacacacagtggatcgcgtacctatggggaaggtaccacatctgtggggccagtccctgtacattttaagcagccttttagcagaggggttcttggccgccggagagatcgatcccctgaaccgacgtttcagcacctcggtgaagccagatgtggtggtacaagtcactgtgctcgccgagaataaccatattaaagacctactccgtaaacacggtgtaaatgtgcagagtatcgccgatatacatcctattcaagtgcaacctggaagaatcttgagtcacatatatgcaaaactggggcggaataaaaacatgaatctctccggcaggccataccgccacatcggggtactggggacctccaaactctacgtcatcaggaaccagatcttcaccttcacccctcagttcactgatcaacaccacttctatctggctctggataatgagatgatcgtggaaatgctgcgtatcgagttagcctacctttgtacatgctggcggatgactggtcggccaactctgacctttcctatttccagaactatgctcaccaacgatggctctgacattcactcagccgttctaagtaccattaggaagctcgaggacggctactttggcggggcccgagttaagctagggaacttatcagaattcttaacaacctcattctatacctacctcacgtttcttgacccggattgcgacgaaaagctttttgacaacgcgtccgaaggcacattctccccagatagtgattcagacttggtgggatacctcgaggatacgtgcaatcaggaaagtcaagatgagcttgaccattacattaaccacctgcttcaatccacttcgctgcgatcttatctgcccccactgtgcaaaaacactgaggaccgacatgttttctcagccattcactccacgcgagatatcctgagtgttatggcaaaggccaagggattggaagtgccctttgtccccatgactctcccaacgaaggtgctgtcagcccaccgcaagtccttgaacctggtggatagtccccaacccttactagagaaggttccggagagcgactttcagtggcctcgggatgaccacggggacgtagactgtgagaaactcgttgagcagttgaaggactgtagcaacttgcaagaccaagcagacatactgtatatattgtatgtgataaaaggaccctcgtgggacaccaatctgagcggccagcatggtgtgacagtgcagaatttgctcggtgagctttatgggaaagctggcctgaaccaggagtggggcttgattcgttatatctcagggttgcttcggaaaaaggtcgaggtgctggcggaagcatgtaccgacctactcagccaccagaaacagcttacagtgggactgcctccagagcctcgggagaaaataataagtgcccctcttccacctgaagaattaacaaaactgatctatgaagcctcgggacaagacataagtatcgccgttctaacccaggagatcgttgtataccttgcaatgtatgttagggcccagccctctctgtttgtcgagatgctgcgcctgcgaatcgggctgatcatccaggtaatggccacggaactggcgaggagtctaaactgcagcggagaggaggccagcgaatcattgatgaacttgtccccattcgacatgaaaaatctcctgcaccacatcctgtccggcaaggagttcggggtggagagatctgtccggcctattcatagtagcacgtcttccccaactatctccatccatgaggtcggccacaccggagttactaagacagaacgctccggtatcaaccggttgcgcagcgagatgaagcaaatgaccagacgctttagtgccgacgagcagtttttttcagttgggcaggctgcctctagctccgcccactctagtaagagcgctcgctcaagcactccttcatcgccaaccggtactagctcgagtgactccggaggtcatcatatagggtggggggagaggcagggccagtggctgagaaggcgaagactggacggggctattaatcgggtgccagtgggattttaccagcgggtgtggaaaattctgcagaagtgtcatggtctgagtatagatgggtatgtattgccgtcatcaaccacccgggaaatgaccccccacgaaattaagtttgctgtgcacgtggaatcagtgctgaaccgggtgcctcagcccgagtaccgccagctgttggttgaggccatcatggtgctgacccttctgagtgataccgaaatgacgtcaattgggggaataatccacgtcgaccagatcgtgcaaatggccagccagctctttctccaggaccaggtctcaattggagcgatggacactctcgaaaaggaccaggcaaccggaatctgccattttttttatgactctgccccatccggggcctatggcactatgacgtacctgacccgcgctgtagccagctatttacaagaactgctccccaatagtgggtgccagatgcaa

SEQ ID NO: 18121 - DNA, 3705 bp, Artificial Sequence
  Description of Artificial Sequence: Synthetic coding sequence
atgcgctccaggagcaattccggggtaaggctggacgggtacgcacggttggtacagcagacgatcctttgttaccagaatccggtcactggtttgctgagtgctagccacgagcaaaaggatgcgtgggtgagagacaacatttatagtatcttggccgtctggggcctggggatggcctaccgaaagaacgctgacagagatgaagacaaggccaaagcatacgagctcgagcagaatgtggttaagttgatgcgtggactgctccagtgtatgatgcgccaggtggccaaggtggagaagttcaagcacacccagagcaccaaagacagcttgcacgccaagtacaatactgccacctgcggcactgtggtcggcgatgaccagtggggtcatctgcaggtggacgctacctccctttttttgctgtttctcgctcaaatgaccgcgagtggactgcggattatctttaccctagatgaagtggccttcatccaaaacctggtcttctatattgaagccgcctataaagtggcagattacggtatgtgggagagaggagacaagaccaaccaaggcatacctgagctgaatgcctcctcagtcggcatggctaaagccgctctggaagccatagacgagctggatctttttggcgcacatggaggccggaaatctgtaattcacgtgttacccgatgaggtggagcactgccaatccatcctgttctctatgctgccaagagcttctacaagtaaagagattgacgccgggctgctgtccattattagtttcccagccttcgctgtagaggatgtgaacctggtcaacgtgaccaaaaatgagataatcagcaagctccagggtaggtatgggtgctgtagattccttagggatgggtacaagactccacgggaggatcccaatcgtttgcattatgaccctgccgagctcaaactcttcgagaacatcgagtgcgagtggcctgtattctggacttattttattattgacggggtattctctggcgatgctgtccaggttcaggagtacagagaggcactggaaggaatcctgatccgcggaaagaacggtatcaggcttgttcccgagttatacgccgtacccccaaacaaggtggatgaagaatacaagaacccccatactgtggacagggtaccgatgggaaaggtaccacatttatggggtcagtcgctgtacatcctctccagtctcctggcagaggggtttttggctgcgggagagatcgacccactgaacaggcggttcagcacgtccgtcaaacccgacgtcgtggtgcaggtgaccgtgttggccgaaaacaaccatatcaaggaccttctaagaaagcatggggtgaatgtccaatccatagctgacattcatcccatccaggtccagccaggacgaattctcagccatatctacgctaaacttggcagaaataagaacatgaatctgtcaggtagaccatatcggcacattggcgtgctcgggaccagcaagttgtatgttatccgtaaccagatctttacattcaccccgcaattcaccgaccagcatcacttctacctggccctggataacgaaatgatcgttgaaatgttgcggatcgagctcgcctacctgtgtacctgttggagaatgacgggacgtccgactcttacctttcctattagccgcaccatgctcacaaatgatggttccgacattcatagcgctgtcttgtccactattcgcaagcttgaggacgggtactttggcggcgcccgcgtcaagctaggaaacctgagtgagttcctgacaacttccttctacacctacttgacattcctggatcctgactgtgatgagaaactgttcgacaacgcctcagaggggacattcagcccagattcagacagcgacctggtgggatatctggaggacacctgtaaccaggagtcccaggacgagctggaccactatatcaatcacctgcttcagagtacaagcctgcgctcctacttgccccccttatgcaagaatacagaggatcgacatgtattttccgcgattcactccacacgcgacatactgtcagtgatggctaaagcgaagggtttggaagttccatttgttcccatgacacttcccacgaaggtcttatctgcccaccggaagagccttaatttggtggactcgccccagcccttgttggagaaggtccctgaatcggactttcagtggccacgggacgaccacggagatgtcgattgtgaaaaacttgtggagcagttgaaggattgttcaaatttacaggaccaggccgatatcttatacatcctatatgtgataaaagggcctagctgggatactaatttatcaggacaacacggcgtcaccgtgcagaatctgctgggagaactgtacggcaaggcaggcctcaaccaggaatggggactaatccgctatatatccggcctcctgaggaagaaggtggaggtgttggccgaggcttgcactgacctcctgagtcatcaaaagcaattaacagttgggctgccacccgagccccgggaaaagattatatctgctccgctgccaccggaggaattaacaaagttgatttacgaagctagcggccaggatattagcatagccgtactgacacaggaaattgttgtgtacttggccatgtacgtgagagcccagccttctttgttcgtggagatgctgaggctgagaatcggattgattatccaggtaatggccacggaactcgctaggagtctcaactgctccggcgaggaggcctccgagagcctgatgaacctatcacctttcgacatgaagaacttgttgcaccatattctgagtggtaaggaattcggcgtggagcgcagtgtgcgacccatccatagtagtacgtcttcccctactatatcaatacatgaggtgggccatactggggttaccaaaacagaaagaagcggcataaaccggctaagaagcgagatgaagcagatgactcgccgcttcagcgcagacgagcagttttttagtgtagggcaggctgcctccagctccgcccacagctccaagtcagctagaagctccaccccaagtagtccaacaggcaccagtagcagcgattccggaggacaccatatcggatggggggagcgtcaggggcagtggctgagaagaaggcgcctagatggcgctataaatcgtgtgcccgtcggcttctaccagcgagtttggaagatactgcagaaatgtcatggcctgtcaattgacggctatgtactgcccagtagcactactagagagatgacaccccacgagataaaatttgctgttcacgtggagtccgtcctcaacagagtcccccaaccagagtatcggcagttactcgtggaggctatcatggtgttgacccttttgagcgacacagagatgacctctatcgggggtataattcatgtggaccagatagtgcagatggcgagccagttattcctgcaggaccaggtgtccataggggcgatggacaccctggaaaaagatcaagcaactgggatctgtcacttcttttatgacagcgcacccagtggcgcctacgggaccatgacttatctaacccgcgcagtggcgtcctatctacaagagctgttgccaaatagcggttgtcagatgcag

SEQ ID NO: 18122 - DNA, 3705 bp, Artificial Sequence
  Description of Artificial Sequence: Synthetic coding sequence
atgaggagccgaagtaattccggcgttagactcgacgggtatgccaggctggtccagcagacgattctgtgctaccagaatccagttacaggactcttgtccgcttcacatgaacaaaaagatgcatgggtaagagacaacatttattccattcttgcagtatgggggttgggaatggcctacagaaaaaacgctgatagagacgaggataaggccaaggcctatgagctggagcaaaatgttgtgaagctgatgcgcggcttgttgcagtgcatgatgaggcaggtcgcaaaggtcgagaaattcaagcatactcagagtaccaaagactccctgcacgctaaatacaatactgctacttgcggtaccgttgttggagatgatcagtgggggcacttgcaggtcgatgcaactagtttgtttctgctcttcctggcccagatgactgcgtcaggtctcagaattatcttcactctggatgaggtggcctttatccagaacttggttttctacatcgaggccgcttataaggtggccgattatggaatgtgggagaggggggataaaacaaatcaaggcatccccgaactgaatgctagctcggttgggatggccaaggctgccctggaggcgattgacgagttggatctctttggagcacatggcggcaggaaatccgtgatccacgtgcttcctgatgaagtggagcactgccagagtatcttgttctctatgctgcctagggcctccacatcaaaagagattgacgctggactacttagtatcatctctttccctgctttcgcggtggaagatgtcaatctcgtgaatgtgactaaaaacgaaatcatcagcaagctccaggggcgatacggatgttgcaggttcctaagggacgggtacaaaacaccccgcgaagaccctaaccgcttgcactacgatcccgctgagctaaagttgtttgagaatatcgagtgcgaatggcctgtattttggacgtattttatcatcgatggggtcttcagtggggatgcagttcaagtgcaggagtacagggaggcactggaaggcatcttaatcaggggaaaaaacggcatacgactggtgcctgaactctatgccgttcctcctaacaaggtggatgaggaatataagaacccacataccgtggatcgagtgccgatgggaaaagtgccacacctctggggtcagtctctgtacattctgagttccctgctggctgaaggttttctggctgctggagaaatcgatcccctcaacaggagatttagtacctctgtcaagcctgatgtggtggtgcaggtaacagtgctggcggaaaataaccacatcaaagacttgctgagaaagcatggcgtaaatgttcagtctatcgctgacattcaccccattcaggtccagccaggaagaattctgtctcatatttatgccaaactaggccgaaacaagaacatgaatttgagtggccgtccataccgacatattggcgtgctggggacatctaaactttacgtgatcagaaaccaaatatttacattcactccccaattcaccgaccaacatcatttctatctggccctggacaacgaaatgatcgtggagatgctgcgtatagaacttgcatatctgtgtacttgttggagaatgacgggtcgacccactttgactttcccaatatccaggaccatgctaaccaatgacggctcggatatccacagtgcagtactgtcgaccataagaaagctcgaggacggctactttggaggagcacgtgttaagctggggaacctgtcggaatttctgacaacaagtttctatacctatctgacgtttcttgaccccgattgtgacgagaagctgtttgataatgccagcgaaggtacgttctcgccagactctgactctgaccttgtgggctacctggaggatacatgtaaccaggaatctcaggatgaattagaccattatattaaccacttattgcagtcgacgagccttcgctcttatctgcctcctctttgcaagaacactgaagacaggcacgtgttctctgctattcattcaaccagggatatactatcagtgatggccaaagcgaagggactggaagttccattcgtccctatgaccctgccaaccaaagtgctgtcggcacacagaaaatccctgaaccttgtggactcgccacagcccctgttagagaaagtgccggaatccgactttcagtggccacgcgacgatcacggggacgtcgactgcgagaagcttgtagagcagctaaaggactgcagtaacctccaggatcaggctgatatcttatacatactgtacgttatcaaaggcccctcgtgggatactaatctttcaggacagcatggcgtcaccgttcagaacttattgggggagctgtacggaaaggcaggcctgaaccaggaatgggggctaatacgatatatcagcggtctattgcgtaagaaagtggaggtgctagcagaggcatgtaccgatctgctctctcatcagaaacagctgactgtggggttgccccccgaaccccgtgagaagattatttcagcccctctgcctccggaagagcttactaagctgatttacgaggcgtctggacaggacatctctatcgcagttctcacacaggagatcgtcgtgtatctagcgatgtacgtaagggcccaaccctccctgttcgttgagatgctgcgcctcagaatcggacttataatccaggtgatggcgactgaactggcgagatctttaaattgctcaggggaagaggcttccgagtcactgatgaatctgtcacctttcgatatgaaaaacctccttcatcacattctcagcggcaaggagtttggtgttgaaagatccgttagaccaatccattcatcaacctcctctccaaccatctcaatccacgaagtgggacacacgggtgtaactaagacagagcggtccggcattaatcgattacgatccgagatgaagcagatgacccgacgattttcagccgatgaacagttcttttccgtagggcaggcggcttcatcttccgcccacagcagcaagtctgctcgatcctcaaccccatctagccccacgggaacgagtagctcagattctggtggccatcatatcggctggggcgagagacagggccaatggttgcgccgtcgaaggctcgatggagccattaaccgagtcccagttggattctatcagcgagtctggaaaatcctgcagaagtgtcatggcctgagcatcgacggatacgtgctgccaagctcgaccacaagagagatgactcctcacgagatcaagtttgcagttcatgtggaatcggtgttgaatcgagtgccccagcccgagtacagacagctgctcgttgaagccatcatggtgctcaccctccttagcgatactgagatgacaagtatcggtggcataattcacgttgatcagatcgtacagatggcgagtcagctcttcttacaggatcaggtttcaatcggcgctatggataccctggaaaaggatcaagcaacaggaatttgccattttttttatgactctgcgcctagcggggcgtatggcaccatgacctatttaacccgagcggtcgcctcctacctccaggaactcctcccaaattctgggtgccagatgcag

SEQ ID NO: 18123 - DNA, 3705 bp, Artificial Sequence
  Description of Artificial Sequence: Synthetic coding sequence
atgcgcagcagatccaactcaggagtgagacttgatggctacgctaggcttgtgcaacaaacgattctgtgttaccaaaacccggtgactgggcttctgtcagccagccatgaacagaaggacgcctgggtgagggataacatttactcgatacttgcagtgtggggacttgggatggcttaccgtaagaatgcagaccgagatgaggataaggcgaaggcatacgagctggaacagaacgtggtcaaacttatgagaggactgctccaatgcatgatgaggcaagtggccaaggtggaaaagtttaagcacactcaaagcaccaaggactcgctgcatgctaagtacaacactgcgacgtgtggcactgtcgtgggagacgatcaatggggacacctgcaggtcgacgcaacttcactgttcctcctcttcctggcacaaatgacggcatccggacttagaatcatattcacgctggacgaggtggctttcatccaaaatctcgtgttttacattgaggcagcatacaaggttgccgattacggtatgtgggagcgaggggacaaaaccaatcagggcattccggagcttaatgcatcaagcgtcggaatggcgaaggccgcacttgaggcaatcgatgagctggacctttttggagcacatggcggtcggaaatcggtgattcatgtgctcccagatgaggtcgagcactgccaatccattctcttttccatgctcccgagggcaagcacctcgaaggagattgacgcaggacttctgtcaatcattagttttcctgcattcgcggtcgaggatgtcaacttggtgaatgtgaccaagaacgagatcatctctaagttgcagggaagatacggttgttgccgctttctgagggatggatacaagacgccacgggaggaccctaacagacttcattacgaccctgccgagctgaaactttttgaaaacattgagtgtgagtggccagtgttctggacttacttcattattgatggagtgttctccggcgacgcagtgcaggtgcaggaatacagagaagcactggaaggaatcctcataaggggtaagaacggaatcagattggtgccggaactttacgcggtgccccccaacaaggtggatgaagaatacaagaaccctcatactgtggacagagtgcccatgggtaaggtacctcatctgtggggccaatcgctgtacatcctttcgtcgctgcttgccgagggctttctggccgcgggagaaattgatccactgaaccgcaggttttccacttccgtcaagcctgacgtggtcgtccaggtgaccgtgctcgcagagaacaaccatatcaaggacctgcttagaaagcacggagtgaacgtccaatctatcgcagatatccatccaatccaagtgcagccgggaagaattctgagccacatatatgcaaaactgggaaggaacaagaacatgaacctctcgggtcgaccatacagacatataggggttctgggtactagtaagctgtacgtgatcaggaaccaaatctttaccttcactcctcagtttacggatcaacaccatttctacctggcactggacaacgagatgatcgtcgagatgcttaggattgagcttgcctacctctgcacctgctggcggatgactggtagacctactcttactttccccatctcgaggacgatgctcaccaatgacggatccgatatccattccgcggtcttgagcactatcaggaagttggaagatggctattttggaggcgcaagagttaaacttggaaacctctcagagtttctgactacttcgttttacacttacctcacgtttctggatccggattgtgacgaaaaactctttgataacgcatccgaaggaacctttagccccgactctgactcggacttggtgggatacctggaagatacctgcaaccaggaatcgcaggatgaacttgaccactacatcaaccatttgcttcagtcgactagcctgagatcatacctcccacctctgtgcaaaaacactgaggatcggcacgtctttagcgcgattcactcgacccgtgatatactgtccgtgatggctaaggcaaagggccttgaagtgccatttgtgcccatgacgctccctactaaagtcctgtcggcacatcgaaagagcttgaatctggtggactcgccacaacccctgctggaaaaggtccctgaatcggacttccaatggcctcgggatgaccatggcgacgtggattgtgaaaaactcgtcgaacaacttaaggattgttcgaatttgcaagatcaggccgatatactttacatcctttacgtgattaaaggtccgtcgtgggataccaacctgagcggacaacacggagtgactgtccagaaccttctcggagaattgtacggaaaggctggtttgaaccaagaatggggcctgattcgctacatatccgggcttctccggaaaaaggtggaggtcctggccgaagcgtgtaccgaccttctctcccaccaaaaacaactgacggtgggacttccacccgagcctagggaaaagatcatctccgcacctcttccacccgaagaactcaccaagctcatttacgaagcatcagggcaggacattagcattgccgtgctcacccaagaaatagtggtgtatctcgcgatgtacgtgagagcacagccatccctctttgtcgaaatgcttcgcctgcgcatcggactgattatccaggtcatggcaacggagctggcacgctcactcaactgctctggggaggaagcctccgaatccttgatgaacctgagccctttcgacatgaaaaacctgcttcatcacattctgtcaggtaaagaatttggagtcgaacgctcagtgcggcctatccattcctccaccagctcgccaaccatatcgatccatgaggtcggtcacactggagtcactaaaacggaaaggtcagggatcaacaggctgaggtcggagatgaagcagatgacccgtagatttagtgcagatgaacaattcttttctgtgggccaggcggcctcaagctccgcacactcctccaagtccgcacgttcatccactccttcatcacccactggaacctcgtcgtcggatagcggagggcaccatattggctggggggaacggcagggtcaatggctgcgccgtcgacgcctggacggagccattaaccgggtgcctgtgggtttctatcaaagagtgtggaagattcttcagaaatgtcacggactgtctattgatggttatgtcctccccagctcgactacccgcgagatgaccccccatgagattaagtttgctgtgcacgtggagagcgtcttgaaccgcgtcccacagcctgaatataggcaattgctcgtggaagctatcatggtgctgacccttctgagcgataccgaaatgaccagcattggagggattatccatgtcgaccagattgtgcaaatggcttcccaactttttcttcaagaccaggtgagcattggtgcaatggatacccttgaaaaagaccaggccaccggaatctgtcacttcttttatgattccgcaccttcaggtgcatacggaacgatgacctacctcacccgggcagtggcatcatacctgcaggaactgcttccaaacagcggatgtcaaatgcag

SEQ ID NO: 18124 - DNA, 3705 bp, Artificial Sequence
  Description of Artificial Sequence: Synthetic coding sequence
atgaggagtcgttcgaacagtggggtgaggctggacggctacgcacgtctggtgcagcagacgatactctgttatcagaacccagtgaccggcctgctcagtgcctctcacgagcaaaaggacgcttgggtcagggacaatatatatagcatccttgccgtctggggtctaggtatggcttaccgcaagaatgcagatagggacgaagataaggcgaaagcctacgagttggaacagaacgtagtcaagttgatgaggggacttctccagtgcatgatgcgccaggttgcaaaagtggaaaagtttaagcatacgcagagcaccaaagattccctacacgcaaaatataatacagcgacatgcggtactgtggtcggtgatgatcaatggggccatctgcaggttgacgctacatcgctattccttctttttctcgcgcagatgaccgctagtggactgcggattattttcacgttggacgaggtcgcattcatccagaatttggttttctacatcgaggccgcttacaaggttgccgactacggcatgtgggaaaggggagacaaaactaatcagggcattcccgagctgaatgcttcctctgtgggcatggccaaagctgcgctggaggcgatcgacgagctggatctgtttggcgctcacggcggacggaaatccgtgattcacgtgctgccggatgaggtggaacattgccagtccatcctctttagcatgcttccaagagcctctacgtcaaaggagatcgatgctgggcttctgtccattatctcctttcccgccttcgctgtagaggatgttaacttggtgaatgtgaccaaaaatgagatcatatccaagcttcaggggcggtatggttgttgccggtttctgcgggatggatacaagaccccaagggaggacccaaataggctccattacgatcctgctgagctgaagctattcgaaaacattgagtgtgagtggcccgtcttttggacctacttcatcattgatggggtctttagtggcgacgccgtgcaagtgcaggagtaccgtgaagcattggaaggtatattgattaggggaaagaacggcataaggctggtccccgagctgtatgcggttccacctaataaagtcgatgaggagtacaagaacccacacactgtggatcgcgtccccatgggaaaggtaccccacctgtgggggcagagcctttacattttgtccagtctgctcgccgaggggttcttggccgccggggagatcgacccactgaatcggaggttttccacaagcgtgaagccggacgtcgtggttcaggtaacagtgctcgctgagaataaccacatcaaagatctcttaaggaaacatggggtgaacgtgcagtctattgctgacatacatcctatccaagtacaacccggtcgcattctgagccacatctacgcaaaactcggccggaacaaaaacatgaatttgagtggcaggccgtacagacatatcggagtgctgggcaccagcaaattatacgtgatacgaaatcagatcttcactttcaccccccagtttacggaccagcaccatttttacctcgcacttgataatgaaatgatcgtcgaaatgcttcgcatagagctggcctacctatgtacatgctggcgcatgactgggcgccctacactgacctttcccatctcaaggacaatgctcaccaacgatggtagcgatattcattctgcagtactctccactattagaaagctcgaagacggttactttgggggtgcaagagtaaaattgggtaacctgtctgagtttctgacaacatcattttatacctacctcacatttctcgacccagactgcgatgaaaagctgtttgataacgcttcagaggggactttcagccctgatagtgattccgatctagtaggatatctggaggacacctgcaaccaagagtcccaggatgagctagatcactatatcaatcatctccttcagtccactagcctgcgaagctacctgccccccctgtgcaagaataccgaagaccgtcacgttttctctgccattcactccacccgcgacatactgtccgtaatggctaaggctaaaggtttggaggtgcccttcgtgccaatgactctgccaactaaggtgctgagtgcccatcggaagagcctgaacctggtagattctccacagccactcttggaaaaggtaccagagagtgatttccagtggcctagagacgaccatggagatgtagactgcgagaagctcgtggagcagctgaaggactgctccaatctccaggaccaggctgacattctctatatactgtacgtgatcaaaggtccctcctgggatacaaacctttcaggccaacatggggtgactgtccagaatttgctaggcgagctgtacgggaaggccggtcttaatcaggaatggggactcatccgttatatcagcggtctcctaaggaaaaaagtggaagttttggctgaggcctgtactgatctgctcagccatcagaagcaactgaccgtgggcctcccacccgagccccgcgagaagattatcagtgcaccgcttccaccggaagaactcactaagctgatctatgaggcctctggtcaggatattagcatcgccgttttgacacaggagattgttgtgtatctagctatgtatgtgcgtgcacagccgtccttgtttgtggaaatgcttcgcttgagaatcggtctgattattcaggtgatggcaaccgaactggctcgctccctgaattgttccggagaagaggcctccgagtccctgatgaatctgagtcccttcgacatgaagaacctgctccaccacatcctcagcggtaaggagttcggcgtagagcggtccgtgaggccaatacacagcagtaccagctcccccacaatcagtatccatgaagtcggccacaccggggttacaaagacagagcgtagtgggatcaatcgattaaggtcagagatgaaacagatgactcggagattctcagctgacgagcaattttttagtgtggggcaggccgcgtcatccagtgctcactcaagcaagtccgcccggagtagtacgccatcttcacctactgggacatcatcttctgatagcggtggccatcacatcggctggggggagaggcaaggacagtggctgaggcgcaggcggctcgacggtgctattaacagggtaccagtgggcttttaccagagggtatggaagattttgcaaaagtgccacgggctctcgatcgacggatatgttttaccgtcaagcacaactcgcgaaatgacaccccatgaaattaagttcgctgtccacgtggagagcgtgctaaatcgggtgccacagcccgaataccgccaactgcttgtcgaggcgattatggtactgaccctcctatcggacactgagatgacctcaatcggaggaataatccatgtagatcagatcgtacaaatggcgagccagctgttcctgcaggatcaggtgtctattggcgcgatggatacactggagaaggaccaagcaaccggaatctgtcacttcttctacgacagcgctccaagcggtgcatatggaacgatgacctatttgacacgtgcggtggcgtcctatctgcaggagctcctgcctaactctggctgtcagatgcag

SEQ ID NO: 18125 - DNA, 3705 bp, Artificial Sequence
  Description of Artificial Sequence: Synthetic coding sequence
atgcggtcccgcagtaacagtggcgtcagactagacggatacgctaggttggtccagcagaccatactctgctatcagaaccccgttaccggccttttgtcagccagtcacgagcaaaaggacgcctgggtaagagacaacatatactccattctggctgtttggggacttggcatggcgtatcggaagaacgctgaccgcgatgaagacaaagccaaggcctacgagttggaacagaatgtcgtcaaacttatgcgtggtctgttgcagtgtatgatgcgacaggttgcgaaagtggaaaaattcaagcacacccagagcaccaaggatagcttgcatgccaaatacaataccgcgacctgtgggacggtggtaggggatgatcagtggggccaccttcaggtggacgccacttccctttttctcctttttctagcacaaatgaccgcaagcggactgcgtattatatttactctggatgaagtagcttttattcaaaacttggtgttttacatcgaagctgcttataaggttgcggactatggcatgtgggagagaggcgataagacaaatcaggggatccccgagttgaacgctagtagtgttggtatggctaaagcagcgctggaagccattgatgaactggacctgtttggagcccacggaggacgcaagagtgtaatccacgtcctgccagacgaagttgaacactgccagtcaatcctgttttctatgctgccaagggctagcacatcaaaggaaatagatgctggattgctgtcaatcatctcttttcccgctttcgcagtcgaggacgtgaatctcgtgaacgttacgaagaatgaaattatcagcaagctgcaaggccgctacggatgttgtcgcttcctgcgggacgggtacaagacaccgcgggaggatcctaaccgcctacactatgatcctgcggaactgaagctgtttgagaatattgagtgcgagtggcctgtgttctggacatacttcattattgatggtgtgttttctggggatgccgtgcaggtgcaagagtaccgcgaggcactggaagggatcctaatcaggggtaaaaatggcataagactcgtgcctgagctgtatgctgttcccccaaataaggtggacgaagaatataagaacccgcacacagttgaccgagttccaatgggcaaggtcccgcatctgtggggccagtcgttgtacattctgtcatctctactggcggaaggtttcctcgccgccggcgagattgatccactaaaccgccgtttcagcacctctgtaaaacctgatgtggttgtgcaggtgacagtactcgcagagaataatcatatcaaggatctgcttcgtaaacatggtgtcaatgttcagtccattgcggacatacatcccatccaagtgcagccgggcagaatcctgtcacacatttacgctaagcttgggcggaataagaacatgaacctctcaggccgcccctatcggcacatcggcgtgctgggaacctccaaactctacgtcatacgcaatcaaattttcacctttaccccccaatttactgatcagcaccatttctacctcgcactggataacgagatgattgtggagatgctgcgaattgagctcgcttacctgtgcacatgctggagaatgaccggccgaccaacactgacatttcctatttctaggacaatgctgactaatgacggttccgatattcatagcgccgtgttgtccaccattcggaagcttgaagatggctacttcgggggggctcgtgtgaaactgggaaacctgtcagagtttctgaccacatccttttatacttacttgacattcctcgaccctgattgtgacgaaaagctgttcgacaatgcgagcgaaggaacctttagcccagattctgattccgatctggtggggtacctcgaggacacatgtaaccaggagtctcaggacgagctagaccactatattaaccacctgctccagtccacttcgctgcgcagctacctgcctccgttgtgcaagaataccgaggatcggcacgtgttcagtgctattcactcaacccgagacattcttagcgttatggcgaaggctaaagggttagaggttccgttcgtccccatgaccctgcctaccaaggtgctatcggcacaccgaaagtctctgaacctagtggactcaccacagcccctcctggagaaagttcctgaaagcgatttccagtggccccgtgacgatcatggagatgtggattgcgagaaattggtcgagcagctgaaggactgctctaacttgcaggaccaggcagacatcttgtacattttatatgtgataaaaggcccatcctgggacacgaacctttccgggcagcacggagtgaccgtgcagaacctcctcggtgaattgtatgggaaagccggactgaaccaggagtgggggctgattcggtatatctccggtctactgagaaaaaaggtggaagtccttgccgaagcatgcacagatctcctgagccaccagaagcagctgaccgtgggcctgccgcctgagccaagagagaagattatctcggccccgctgccgccagaagaactcactaagctgatatacgaagcatccgggcaagacatatccatcgccgtcttgacacaggagatagtcgtgtacctcgctatgtacgtacgcgctcaaccatccctctttgtagaaatgctgaggctgaggataggcttaatcatccaggtcatggccacagagctggcaagaagcttgaactgctctggagaggaggcgagcgagagcttaatgaacctgtccccatttgacatgaagaacttgctccatcatatattgagcggaaaagagtttggtgtcgaaaggagcgtgaggcctattcatagttccacaagcagccccacaatttctatacacgaggtgggacataccggggtgacaaaaaccgagcggtccggcatcaaccgcctgcgcagcgaaatgaagcagatgactcgcagatttagcgcggatgagcagttctttagcgttgggcaggcagccagctcctccgcccactcctccaagagcgcccgtagcagcactcctagctcccccactggaacgtcatcttctgattctgggggccaccacatcggttggggtgaaagacaaggccagtggctgcgacgcagaaggcttgacggtgccattaatagggtgcccgtgggattttaccaacgggtttggaaaattctccagaagtgccatggcctgagcatcgatggctatgtattgccttcaagtactacacgagaaatgaccccccatgagattaaattcgccgtgcatgtggagtctgtcctgaaccgcgtgccacagccggagtatcgccaacttcttgtagaggccataatggttctgaccttgctatcagatacagaaatgacctctatagggggaatcattcacgtagaccaaatcgtacaaatggcgagccaattattcctgcaagatcaggtctcaattggggcaatggacacgctggaaaaggaccaggccacaggaatctgccacttcttttatgatagtgccccgtcaggggcctacgggactatgacttatcttacccgggctgtagcttcttacctccaggaactactgcccaattcgggctgccaaatgcag

SEQ ID NO: 18126 - DNA, 3705 bp, Artificial Sequence
  Description of Artificial Sequence: Synthetic coding sequence
atgcggtcaaggtccaactctggggtcaggttggatgggtacgccagactcgttcagcagaccatattgtgctaccagaaccctgtgactggcctcctgtcggctagccacgagcagaaagacgcatgggtgcgcgacaacatctactcgatcctggcagtgtggggtctgggaatggcataccgcaagaacgccgatcgcgatgaggataaggctaaggcctacgaattggagcaaaacgtggtgaaactgatgcgggggctcctgcagtgcatgatgcggcaggtggccaaggttgaaaagttcaagcatactcagtcgactaaggattccctccatgccaagtacaataccgccacctgcggcaccgttgtgggagacgatcagtggggacacttgcaggtcgacgcgacctcccttttcctgctttttctggcgcagatgactgcttcagggctgcggataatcttcaccctcgacgaagtggcttttatccaaaacctcgtgttctacatcgaagcagcgtacaaagtcgccgactacggcatgtgggagcgcggagataagaccaaccaaggtatcccagaactgaacgcgtcctcagtcggcatggccaaggctgcgctggaagccatcgacgagcttgatctgtttggtgcgcacggaggcagaaagtcagtcatccacgtgcttccggacgaagtggagcattgccagtccatcctgttctcaatgctgccgcgcgcttccacttcaaaggaaattgacgcggggctgctctcgatcatttcatttccagcgttcgcagtggaggacgtgaacctcgtgaacgtgactaaaaacgaaatcatttccaaacttcaaggacggtacggctgctgtcggttcctgcgtgatgggtacaagaccccaagagaagatccaaacagacttcactacgacccagcagagctgaaactgttcgagaacatcgagtgcgaatggcctgtgttctggacttatttcatcatcgacggcgtgttctcaggcgacgccgtgcaggtgcaggagtaccgcgaggcgctggaaggtatcttgatccggggcaagaacggaatccgccttgtccctgagctgtacgcggtgcctccgaataaagtggatgaggagtacaagaatccgcacaccgtggacagagtgccaatggggaaagttccgcacctgtggggccaatctttgtacatcttgagcagcctgctggcagagggattcctggcagcgggagagatcgatccgctcaatcgccggttctcaacctccgtgaagcctgacgtggtcgtgcaggtgaccgtgctcgctgaaaacaatcacatcaaagacctgctccgcaagcacggagtcaatgtgcagagcatcgcagatattcacccaatccaggtgcaaccgggaagaatcctgtcccacatctacgcaaagctggggcgcaacaagaacatgaacctgtctggtagaccgtacagacacatcggcgtcctgggaacctcgaaactgtatgtgatcaggaatcaaatcttcactttcactcctcaattcactgaccagcatcacttctacctcgcattggataacgagatgatcgtcgaaatgctccggattgaacttgcatacctgtgcacctgctggcgtatgaccgggcgcccaacgctcaccttccccatctcgcgcactatgctgactaacgatggatcagacatccactccgcggtgctgtcgactatcagaaagctggaggacggatactttggcggtgccagagtgaagttgggaaacctttctgagttcctcactacctccttctacacctacctgacctttcttgacccggattgcgacgaaaagctgttcgataatgcttcggaaggaaccttctccccggatagcgactccgatttggtgggctacctcgaggatacctgtaaccaggagtcgcaagatgagctggaccactacatcaaccatctgctccagagcacttcgctgcgctcctacctcccaccgttgtgcaagaacactgaggaccggcacgtcttttccgctattcactcaactcgggacatcctgagcgtgatggccaaggcaaaaggactggaagtgccctttgtgccaatgactctcccgaccaaagtgctgtcagctcacagaaagtcactcaacctcgttgattcaccccagcctctgctcgagaaagtgcctgaaagcgacttccaatggccgcgggacgatcacggagacgtcgactgcgaaaagctcgtggaacaactgaaagactgcagcaaccttcaagaccaggcagacatcctgtacattttgtatgttatcaagggcccgtcatgggataccaacttgagcggacaacatggagtgacggtgcagaacctcctcggagagctttacggcaaagctgggctgaaccaagaatggggactgatccgctacatctcaggactcctccgcaagaaggtggaagtcctggcggaagcctgtactgacctgctgagccaccaaaagcagctgaccgtcggactgcctcctgaaccgcgcgaaaagatcatctccgcccctctgccgccagaagagctgactaagctgatatacgaagcgagcggacaggacatcagcatcgccgtcctgacccaagaaatcgtggtctacctggccatgtacgtgcgggcgcaaccatcgttgtttgtggagatgctgcgcctgcgtattggtttgatcatccaggtgatggccaccgaactcgctagatcactcaattgttccggggaagaagcgtccgaaagcctcatgaacctttcgccttttgacatgaagaatctgcttcaccacatcctcagcggcaaagagttcggggtggagagatcagtgaggccgatccactcctcgacttcgtcccccactatctctatccacgaagtggggcataccggagtaactaagactgaacggtccggaatcaaccggctgagatccgaaatgaagcagatgactagacggtttagcgccgacgaacagttcttctccgttggacaggcagcctcatcctcggcacactcgtcaaagagtgctaggagcagcaccccgtcgtccccgactggaacctcgagctccgactcaggcggccatcatatcggttggggtgagagacagggacaatggctcaggagaagaagattggatggagccatcaatcgcgtgcccgtgggattctaccaacgggtgtggaagattttgcagaagtgtcacggactctccatcgatggctacgtgttgccatcgtcaaccacccgcgagatgactccgcacgagattaagtttgccgtgcacgtggagagcgtgctgaaccgggtgccacagcctgagtatagacagctcttggtggaagcaatcatggtgcttactctcctgtcggacactgagatgacttccatcggaggaatcatccacgtcgatcagatcgtccagatggcctcccagctcttcctgcaggaccaggtgagcattggagccatggataccctcgagaaagaccaagccactgggatctgccatttcttctacgattcggcgccctcgggtgcttacggaactatgacctatctcaccagagcggtggcctcatatctccaagaactgctccccaactcgggatgccagatgcaa

SEQ ID NO: 18127 - DNA, 3705 bp, Artificial Sequence
  Description of Artificial Sequence: Synthetic coding sequence
atgcgctcccgctcgaattcgggagtgagactcgatggatacgccagactcgtgcagcagactattctctgttaccagaatcctgtgactggccttctttcagcaagccatgagcagaaggatgcatgggtccgggacaacatatactcgatcctcgcagtgtggggacttggtatggcctaccgcaagaacgcagatcgggacgaagataaggcaaaagcctacgagttggaacagaacgtggtcaagctcatgagaggactgctgcaatgcatgatgcgccaagtcgcaaaggtggagaagtttaagcacacccaatccaccaaggactcccttcatgcaaagtacaacactgccacctgtgggactgtggtcggtgacgaccaatggggtcatctgcaggtggacgccaccagcctgttccttctgttcttggcacagatgactgcgtcgggcctgcgaatcatctttactctggatgaagtggcctttatccaaaaccttgtgttttacatcgaagcagcatacaaggtcgcagactacggaatgtgggagaggggcgataagactaaccagggcattcccgagctgaacgcgtcgtccgtcggaatggcaaaggcagcactcgaggcgatagatgaactggatctctttggtgcccacggaggcaggaagagtgtgatccacgtcctcccagatgaagtcgaacactgtcaatcaatccttttttcgatgctgcctcgcgcatcgacttcgaaggaaattgacgcaggactcctttcgattatctcgttcccagcgtttgccgtggaagatgtcaaccttgtgaacgtgaccaagaatgaaatcatatccaagctccagggaagatacggatgttgtcgtttcctgcgcgacgggtataagacccctcgcgaagatccaaacagacttcattacgaccctgccgaattgaagttgtttgaaaacatcgagtgtgaatggccagtgttctggacgtactttatcatcgacggtgtgttttctggcgatgccgtgcaagtgcaagaatacagagaggctcttgaaggcattcttattagaggtaagaatggcattcgccttgtcccagaactttacgcagtgcccccaaacaaggtcgatgaagagtacaagaacccacacaccgttgatcgcgtgccaatgggaaaggtcccacatctttggggacaatcgctttacatcctgtcatccctcttggccgaaggattccttgcggccggagagattgatcctctcaacaggcggttttcaacttcggttaagcccgacgtggttgtgcaagtgaccgtccttgcagaaaacaaccatatcaaggacctcctgcgcaagcacggcgtaaacgttcagtcaattgcggatattcatccgatccaggtgcagccaggtcgcattctgtcccacatatacgctaagctcggacgaaacaagaatatgaacttgagcggccgcccttacaggcatattggtgtgttgggaacctccaaactctacgtgatccgcaaccagattttcacgttcaccccgcaattcaccgatcagcatcacttttatctcgcacttgataacgaaatgatagtggaaatgctcagaattgaacttgcatacctctgcacttgctggcggatgaccggacgtcctaccctgacgtttccaatttcccgtaccatgcttactaacgacggctcagatatccattccgccgtgctttctactataaggaagttggaggacggttacttcgggggagcgagagtgaagttggggaacctgtcagaatttctcaccacttccttttacacctacctgacttttctcgaccctgattgtgatgaaaagttgtttgataacgccagcgagggtactttcagccccgatagcgattccgatctggtgggttacctcgaggatacctgcaaccaggaatcacaagatgagctcgatcattacataaatcatcttctccagagcacttcgctgagaagctacctgccacccctttgtaagaatactgaagatcggcatgtcttttcggctatacattcgaccagagacattctttccgtgatggctaaggcaaagggcctcgaagtccctttcgtgcccatgacccttcctactaaggtgttgtccgcacaccgtaagtccctcaacctcgtggacagccctcaacctcttcttgaaaaggtacccgagagcgatttccagtggcctagagatgatcacggtgatgtggattgtgagaagctggtcgaacaacttaaagattgctccaacctccaagaccaagcagatattctttacatcctttatgtgattaaaggaccatcgtgggataccaatctttcgggccaacatggggtgacggtccagaatctcctgggagaactgtatggaaaggcaggcctcaatcaggagtggggcctcatcagatacatttcgggtctgctgaggaagaaggtggaagtcctcgccgaggcatgcactgaccttctctcacatcaaaaacagctgactgtgggtctgcctcccgaaccacgcgaaaagatcatttccgcacccctgccgcccgaagaactgacgaaactgatctacgaagcatcgggacaggacatttcgatcgccgttctgactcaggagattgtcgtgtacctggccatgtacgtcagagcacagccaagcctgttcgtggaaatgcttagactgcgcatcggactgattatccaagtcatggcaaccgaactggcgcgtagcctcaattgttctggagaggaggcgtccgaatcccttatgaacctttcgccattcgatatgaagaaccttctgcatcatatcctctcaggaaaggaatttggagtggaacgatcagtgcggcctatccactcgtctacctcgtcccctactatttctatacatgaggttggtcacacgggtgtgactaagaccgaacgctcgggtattaaccgactcaggagcgaaatgaagcaaatgacccgcagattctccgcggatgagcagttcttctcagtggggcaagcagcctccagctccgcacactcgtccaaaagcgcaagaagctcgaccccatcaagcccgaccggtacgtccagctcggactcaggaggtcatcacattggctggggagaaagacaaggtcaatggctgcgacggcggagacttgacggcgcaattaaccgcgtcccggtcggattctaccaacgcgtttggaaaattctgcaaaagtgtcatggtctttccatagatggatacgttcttccgtcaagcacgaccagggagatgacgccgcacgaaatcaagtttgcagtgcatgtcgagtcggtcctcaaccgcgtgccacaacctgaatacaggcaactccttgtggaggctatcatggtgctgactcttctgtccgacaccgaaatgacttcgattggaggtatcattcacgtagaccaaattgtgcagatggcatcccagctgttcctgcaagaccaggtgtcgatcggtgccatggataccctcgaaaaggaccaggccacggggatatgtcatttcttctacgatagcgcaccttctggagcttacggaaccatgacctatctgactagggcagtggcatcgtacctgcaagaacttctgcctaactcagggtgccagatgcaa

SEQ ID NO: 18128 - DNA, 3705 bp, Artificial Sequence
  Description of Artificial Sequence: Synthetic coding sequence
atgcggtcccgatcaaatagcggggtgagactcgacgggtacgcacgcctggttcaacagactatcctctgctatcagaatccggtgaccggcctgctgtccgcctcacatgaacagaaagacgcatgggtgagggataacatctactcgatcttggccgtttggggactgggaatggcataccgaaagaatgcggaccgcgatgaagataaagctaaagcgtacgagctggaacagaatgttgtgaagttgatgcgcggcttgctccagtgcatgatgcggcaggtggcaaaagtggagaagttcaagcatacgcaatcaaccaaagactcgctgcacgccaagtacaacactgcaacttgtgggaccgtggtgggagacgatcagtggggacatctccaggtggacgccacgtcattgttcctgctgttcctggcacagatgactgcatctggcctgcgtatcatcttcacgctggacgaagtggcctttatccagaacctggtgttctacatcgaagctgcatacaaagtcgcggactacgggatgtgggaaaggggagataaaacgaatcaaggcatccctgagctgaacgcgagctccgtgggaatggcaaaggctgccctcgaagctattgatgagctggatttgtttggcgcgcacggcggcaggaagtcggtgatccacgtcttgccggatgaagtggaacactgtcagtcaattctcttctcaatgctcccgcgcgcctcgaccagtaaggaaatcgacgccgggctcctgtcgatcatcagtttcccggcgtttgccgtcgaggatgtgaacctggtgaatgtgactaagaatgagattatctccaaactccagggcagatacggatgctgcaggttcttgagagacggctacaagacccctcgcgaagatccgaatagactccattatgacccagccgagctgaagctcttcgagaacatcgaatgcgagtggccggtgttttggacttactttatcattgatggtgtcttttcaggcgatgcggtccaagtgcaggaatacagagaagcgctggagggaatccttatccgaggaaagaacggcatcagactggtccccgagctgtacgccgtgccgccgaacaaggtcgacgaggaatacaagaacccccataccgtcgaccgagtgccgatggggaaggtgccgcatctttggggacagtccctctacatcctgtcgtccctgctggcagaaggattccttgccgccggagaaatcgaccctttgaaccgccggttctctacttcagtgaagcctgacgtggtggtccaggtgaccgtactggcagaaaacaaccacatcaaggacctgctgcgcaagcatggcgtgaacgtgcagtccatcgccgacatccacccaatccaagtgcaacctgggagaatcctctctcacatttacgccaagctgggaagaaacaagaacatgaacctgtccggtcgcccataccggcatatcggagttctgggaactagcaagctgtacgttattagaaatcagattttcacttttacccctcagttcactgatcagcaccacttctacctggctcttgacaatgaaatgatcgttgagatgttgcgtatcgagctggcgtacctgtgcacctgctggcggatgaccggacggccgaccctcaccttcccgattagccgcactatgctgaccaacgacgggtcggacatccatagcgcggtcctctcgaccatcagaaaattggaagatggatacttcggaggggcccgcgtgaagctggggaatctctcggaattcttgaccacgtcattttacacttacctcactttcctggacccagactgcgacgagaagctgttcgataacgctagcgaaggaaccttcagccccgactcagactcggatctggtcggatacttggaggacacttgcaaccaagaaagccaagatgaattggaccactacataaaccatctcctccaaagcacttcgttgcggagctacctcccccctctctgcaagaacacggaggaccgccacgtgttctccgccatccattccacgcgcgatatcctctcggtgatggccaaagccaaaggcctcgaagtaccattcgttcccatgaccctcccgaccaaagtcctgtcggcccacagaaaaagccttaatctggtcgacagcccccagccgcttcttgagaaggtgccagagtcagacttccaatggccgcgcgatgatcatggagacgtggactgcgaaaaacttgtggaacagctgaaggactgctcaaacctccaagaccaagctgatattctgtatatcctctacgtgatcaagggcccgtcctgggacactaacctgagcggacagcacggggtgaccgtgcagaacctcctgggtgaattgtacggaaaggcaggcctcaatcaagaatggggactcatacggtatatcagcggattgctgcggaagaaggtggaagtgctggccgaggcctgtactgatctcctgtcgcatcagaaacaactgactgtgggattgccgccagagccgagagaaaagatcatctccgcgccgctgccacccgaggaactgacgaagctcatctacgaagccagcggtcaggacataagtatcgccgtgctgacccaagagatcgtggtgtacttggctatgtacgtccgcgcgcagccgtcgctgttcgtggagatgctcagactgcgcatcggcttgatcatccaggtcatggctactgaactggcgcgctccctcaattgctcgggggaagaagcatctgaatcactgatgaatctgtcgccttttgacatgaagaatctcctgcaccacatcctttcgggaaaagaatttggtgtcgagcggtccgtgcgtccgattcactcgtcaacttcctcaccaaccatctccattcacgaagtgggtcatacgggggtcactaaaaccgagaggagcggtattaaccgcctgcggtcggaaatgaagcagatgacccgccgcttcagcgcggatgaacaattcttcagcgtgggtcaggcagcttcctcgtcagcacactcgtccaaatcggcacgcagttcgaccccgtcctcccctactggaacttcctcctctgattcaggaggacaccatatcggatggggagagcggcaaggacagtggcttaggcgcaggcgtctggatggcgctatcaacagagtcccagttggcttctaccagcgggtgtggaagatcctgcaaaagtgtcacggacttagcattgacggttacgtcctcccttcatcgaccaccagagagatgactccacatgagatcaagtttgccgtccacgtggagtcggtgttgaaccgcgtaccgcaaccagagtacaggcaactgctggtggaggcaatcatggttctcaccttgctctccgacaccgaaatgacttcgatcggcggcatcattcacgtggatcagatcgtacagatggcctcacagctcttcctgcaggatcaggtttcaatcggagctatggacacccttgagaaggaccaggctaccggaatctgtcactttttctacgactcggcgccctccggtgcctacggtaccatgacttatctgaccagagcagtggcgagttacttgcaagagctccttcctaactccggatgccaaatgcaa

SEQ ID NO: 18129 - DNA, 3705 bp, Artificial Sequence
  Description of Artificial Sequence: Synthetic coding sequence
atgcggtcccgaagtaattctggtgtgaggttggacggctatgctaggctggtgcaacagacgattctgtgttatcagaatccagtgaccggactgctctccgcctctcatgaacagaaagacgcttgggtgcgcgacaacatctactccatactggccgtctggggattggggatggcttacagaaagaatgcggaccgagatgaagataaggcaaaggcttacgagttggagcagaatgttgttaaattgatgcgcggtctgttgcagtgcatgatgcgccaagtggcaaaagttgagaagttcaaacacacccagagcaccaaggacagcttacacgccaagtacaataccgctacgtgcggaacagtggtcggcgacgatcagtggggacatcttcaggtggatgctacatcactattcctactgttcctggctcaaatgactgcctccgggctgagaataatattcaccctagacgaggttgccttcatccagaacttagtcttctacattgaggctgcgtataaggtggctgactacggaatgtgggagcgcggtgacaaaaccaaccaggggattcctgagttgaacgcctcttccgtgggtatggccaaggccgctctagaggcaatcgacgagcttgacttgttcggcgcacatggcggacgcaaaagtgttatacacgtgctgccagatgaggtggagcactgtcaaagcatattattttctatgttaccaagggcatcaaccagcaaagagatagacgcagggcttctctcaattatatccttccccgcctttgccgtagaggacgtgaatctggtcaatgtgaccaagaacgaaattattagcaagctacaggggagatacgggtgctgccggttcctgagagatggatacaagacccctcgggaggatcctaaccggcttcactacgacccggcggaactcaagttgtttgagaatatcgaatgtgagtggccggtgttctggacttacttcattatagatggggtctttagcggagacgccgtccaggtccaggagtatcgcgaagctttggaaggtatcctaatcagagggaagaacggaatccgcctggtccctgaactgtacgcggtccctcctaataaggtggatgaagagtataagaacccccatacagtggacagagtgccgatgggcaaggtgcctcatctgtgggggcagtccctctacatcctgtcctccctgttggctgagggatttctggcggcaggagagatagatccactgaatagacggttttcaacttccgtgaaacctgatgtcgtggtgcaagttacagtgttggccgagaacaatcacatcaaagatcttctccgaaaacatggcgttaacgtacaatctatcgccgatattcatccaattcaagtgcagccaggtcggatactgtcccacatatatgctaagctcgggcgaaacaagaatatgaatctgagcggcagaccctatagacacatcggcgtcctggggaccagcaagctatatgtgattcgaaaccagattttcacgtttactccacaattcactgatcaacaccacttttacctggcattagacaatgaaatgatagtagaaatgctgcgtattgagctcgcgtatttatgtacatgctggagaatgactggaaggccgaccttaactttcccaatctccaggactatgttgacaaacgatggttctgacatacactcggccgtcttgtctaccatccggaaattagaggatgggtatttcggcggggcacgtgtgaagctcgggaaccttagcgagttcttgacaacgtcattttacacctatctgaccttccttgaccctgactgcgacgaaaaactatttgacaacgcctccgaaggcaccttcagcccagacagcgatagtgacctggtggggtatctggaggacacctgcaaccaggaatcccaggatgagctcgatcactacataaatcacctgctgcagtccacctcactcaggtcatacctaccgcccttgtgcaagaatacagaggaccgacatgtgttctctgcgatccattccaccagggacattctctccgtgatggctaaggccaaggggctcgaggtgcccttcgtgccaatgacgctgcctacaaaagtgctctctgcacatagaaaaagtcttaatttggtcgattccccccagccattgcttgagaaagttcccgaaagtgacttccaatggcccagggacgatcatggtgacgttgactgtgagaagctggtggagcagttgaaagattgctcaaacctgcaggaccaggcggatatcctgtacatcctctatgtcatcaagggaccttcttgggataccaatttatctgggcagcacggtgtaaccgtgcagaatctgttaggggagctttacgggaaggctggcctgaatcaggaatgggggttgatccgttacatatccggactattgagaaagaaagtagaagtgttggccgaagcctgcaccgacctgcttagccaccagaagcagctgacagttggactccccccggagccccgagaaaagataatttccgctcctctgcctcccgaggagcttactaagttgatttatgaggcctcaggacaagatatttcaatcgccgttttgacccaggaaatagtggtgtatctcgccatgtatgtgcgcgcccagcctagcctgtttgtcgagatgctaaggctaaggataggcctcatcatccaggtgatggcaactgaactggccaggagcctcaactgtagcggcgaggaggctagtgaatcactcatgaatctaagccccttcgacatgaaaaaccttctgcaccatattctgagtggcaaagagtttggagtcgagcgcagcgtaaggccgatccatagttcaacctcttctcctacaataagcatccatgaagttggacacaccggcgtcactaaaaccgaaagatccggtatcaatcgtctgagaagcgagatgaaacagatgacccgccgcttctcagcggacgagcaattcttcagtgtggggcaggccgcatcatctagtgcgcactcatccaagtccgctcgcagctcaacccccagctcgccgaccgggaccagctcctccgatagtggagggcaccatatcggctggggagagaggcagggacagtggctgcggcgcaggaggctggacggggccatcaacagggttccagtcggcttttaccagagggtatggaaaatattgcagaagtgccatggtctttcaatagatgggtacgtgctgccatcctcaaccacccgggaaatgaccccacatgaaataaagttcgcggtgcacgtggagagcgttctgaatcgcgtcccgcagccagagtatagacagttgctggtagaggccattatggtcctgactctcctaagcgatacagaaatgacgtcaatcggcggtatcatccacgtcgaccagatcgtccaaatggcgagccagctgttcctgcaggaccaggtttcaataggcgctatggacacgctagaaaaggatcaggcgactggcatttgtcacttcttctacgattctgctccatctggcgcatacggcaccatgacttacttgacccgtgcagtagccagctacctacaggagctgctgcctaactcaggatgtcagatgcag

SEQ ID NO: 18130 - DNA, 3705 bp, Artificial Sequence
  Description of Artificial Sequence: Synthetic coding sequence
atgagatcccgctcgaattcaggggtgcgcctggacgggtacgcacgccttgtgcagcaaacgatcctgtgctaccaaaatcctgtgactgggcttttgtctgcgtcccatgagcagaaggatgcatgggttcgcgataacatatacagcatcctggccgtgtggggactcggcatggcatatcgcaagaacgcagatcgggatgaagataaagccaaggcatacgagctcgaacaaaacgtggtgaaactgatgagaggccttctccagtgcatgatgcgccaggtcgcaaaagtggaaaagttcaagcatacccagtcgaccaaggacagcctccatgcaaagtataacactgcaacttgtgggactgtggtgggcgacgatcagtggggacacctccaggtggatgccacctcgttgtttctcctttttctcgctcaaatgactgcctcgggtctgagaatcattttcactctggacgaagtcgctttcatccaaaatctggtcttttacatcgaggccgcctacaaggtcgcagattacggtatgtgggagcggggagacaagaccaaccaggggatccctgaactcaacgcctcctcggtgggcatggcaaaggcagcgctcgaggctatcgacgaactcgacctctttggcgcacacggagggcgcaagtccgtgatccacgttctgcctgatgaggtggagcactgccagtccatcctcttttcaatgctgccacgcgcttcgacctcgaaagaaattgacgccggactgctgagcattatctcgttcccagccttcgccgtcgaagatgtcaatctcgtgaatgtcactaaaaacgagatcatctccaagctccagggacgctacggttgctgccgctttctgcgggatggatataagaccccaagggaggatccaaacaggctgcactacgacccggccgaattgaaattgttcgagaacattgagtgcgagtggcctgtgttttggacctacttcatcatcgatggggtgtttagcggtgacgcagtgcaagttcaggaatatcgggaagccctggaaggaatcctgataagaggcaaaaacggcatcagactggtcccagagctgtacgcggtgcctcccaataaggtggacgaagagtacaagaacccgcataccgtggaccgcgtcccgatgggaaaagtgccgcatctgtggggtcagtcgttgtacatcttgtcgtccttgctcgccgaagggttcctcgccgccggggaaatcgatccactgaaccgcagatttagcacttctgtcaagcccgacgtggtggtccaggtgaccgtgctggccgagaataatcacatcaaggacctgctgaggaaacacggtgtgaatgtgcagtcgatcgccgacattcacccaatccaagtgcaaccgggaagaatcctgagccacatctacgccaagctgggcaggaacaaaaacatgaatttgtcgggcagaccctaccggcacattggtgtcctcggcacttcgaagctctacgtgataagaaatcagatcttcacgttcaccccacagttcaccgatcagcaccacttctatttggcgctggataacgagatgatcgtggaaatgctgcgcatcgaattggcatacctgtgcacttgctggaggatgaccggtcggcctactctgaccttcccgatcagcagaactatgcttactaatgacggaagcgatatccactcagcggtgctgtcaacgatccgtaaactggaagatggctacttcggcggcgccagggtcaaactgggaaacctttcagaattcctgactacctcgttctacacctacctgactttcctggatcctgattgcgacgaaaaacttttcgacaatgcctcagaaggaactttctcgccagactccgattccgacctcgtgggatacctggaggacacttgtaaccaagagtcccaggatgagcttgatcactacattaaccacttgctgcaaagcacctcgctgcgcagctacttgccaccgctctgcaagaacactgaggaccgccatgtcttttcggccatccactcgactcgcgacatcctgagcgtgatggccaaagctaagggtttggaagtgccatttgtgcccatgactctgccgacgaaggtcctgtccgcacaccgcaagtcactcaatttggtcgactccccgcagccgctgctcgaaaaggtgcccgaatccgacttccagtggccgagggatgatcacggagacgtggattgtgagaaattggtcgagcagctgaaggactgctccaatctgcaagatcaggcggacatcttgtacatcctgtacgtgatcaagggaccctcatgggataccaatctgagcggacagcacggagtgacggtccagaatcttttgggtgagctgtacggaaaagcgggactgaaccaggagtggggactcatcaggtacatctcaggactgctgcgcaaaaaggtggaagtgcttgcagaagcatgcaccgacctgctttcgcaccagaagcaactcacggtgggattgccgccggaaccgcgggaaaagatcattagcgcgcctctgccgccggaagaactgacgaagctgatctacgaagctagcggccaagacatctcgatcgctgtgctgacccaagaaattgtggtgtacttggcaatgtacgtgcgggcgcagccatcgctgttcgtggaaatgttgagactgcggatcggcctgatcattcaggtcatggcgactgagctggcgcggtccctgaattgctcaggagaagaggcttccgaatcgctgatgaacctgtcaccgttcgacatgaagaaccttctgcaccatatcctgtcaggaaaggaattcggggtggagcggtcggtccgcccaattcattcgtccacttccagcccgaccatctcaatccacgaggtggggcacactggagtgacgaaaactgaaagatccggaattaaccgcttgcggtctgagatgaagcagatgacccgtagattctcagccgatgagcagttcttctcggtgggacaggcggccagctcctcggcgcattcttcgaagagcgccagatcatccactccatcctctcccacgggcacctcctcgtcagacagcggaggccatcacattggatggggcgaacgtcagggtcagtggctgcggcggagacggttggacggagcgatcaatcgggtcccagtggggttctaccagcgggtttggaagatcctccagaagtgtcatgggctgtctatcgacggatacgtgctgccgtcgtcgaccacgagagaaatgacgccgcacgagatcaagtttgccgtccacgtggaatccgtcctgaaccgcgttccgcagccagaatacagacagctgctggtggaggcgatcatggtcctgactctgttgagcgatactgagatgacctcaatcggcggcatcattcatgtggaccagattgtccagatggcgagccaactctttctgcaagaccaggtgtccatcggagccatggacactctggaaaaggaccaggccaccggcatctgccatttcttctatgacagcgcgccgtccggtgcctacggtaccatgacttatctgactcgggccgtcgcatcatacttgcaggaacttctcccgaattccggctgccaaatgcaa

SEQ ID NO: 18131 - DNA, 3705 bp, Artificial Sequence
  Description of Artificial Sequence: Synthetic coding sequence
atgcgtagccggtcgaactcaggggtgcggctcgatggatacgcccgactggtccagcaaaccattctttgctaccagaaccctgtgacgggactgctcagtgcctcgcatgaacagaaggatgcatgggtccgtgacaatatctacagtatccttgcagtgtgggggctcggaatggcatacagaaagaacgccgatcgtgacgaggacaaggccaaggcgtacgaattggaacaaaatgtggtgaaacttatgaggggccttctgcagtgtatgatgaggcaagtagccaaagtagagaagtttaagcacacccaaagcaccaaggattccctccacgcaaaatacaacactgcaacttgtggaactgtcgtgggagacgaccagtggggtcatcttcaagttgacgctacttctcttttcctcctttttcttgcgcagatgactgcctcaggtctgcggatcattttcaccctcgacgaagtggctttcatccagaaccttgtgttttacatcgaggcagcctacaaggtggcagattacggtatgtgggaaagaggagataagaccaatcaaggcatacctgagctcaatgcgagctcagtcggtatggcaaaggcagcacttgaagcaatagatgaactggacctttttggcgcacatggagggcgcaagtccgtgattcatgtgttgcctgatgaagttgagcactgccaaagcattcttttctcgatgcttcctcgcgcatcgacttcaaaggaaatcgatgcaggactgctgtcgatcattagttttcccgcattcgcagtggaagatgtcaacttggtgaacgtgacgaagaacgaaatcatttcgaagctccagggtcgctacggatgctgtcggtttctgcgcgacggatacaagactccgcgagaagatcctaaccggctccactatgatcctgcggaattgaaattgtttgagaacattgagtgtgaatggccggtgttctggacctatttcattattgacggtgttttcagtggggatgcagtgcaagtgcaggagtaccgagaagcccttgaaggcatcctgataagaggtaagaacggcattcggctggtgcccgagctgtacgccgtgccaccgaacaaggtggacgaagaatacaaaaatcctcataccgttgaccgagtcccaatggggaaggtcccacatctttggggacagtcgctttacatactttcgtcccttcttgcagagggctttctcgcggcaggagaaatcgacccgcttaaccgccgattttcgacttcggtgaaaccagatgtggtggtgcaagtgaccgtgctcgcagaaaacaaccatatcaaggacctgctcaggaagcatggtgtcaacgtgcaatcgatagcggatatccacccgattcaagtgcaacctggtcggatcctgtcacacatatacgcgaaactcggacgaaataagaatatgaacctgtcaggacgcccatacagacacattggagtgctcgggacctctaagctgtacgtcattcgtaatcaaatcttcacctttacccctcagtttactgaccaacaccacttctacctggcattggacaacgaaatgatagtggaaatgctgcggatcgaactcgcctacctgtgtacctgttggcgcatgaccggaaggccaacgctcactttcccaatttcccggactatgcttacgaacgatgggtccgatatccattcggcagtcctttccacgattaggaaactggaggatggatacttcggcggcgccagagtgaaactgggtaacttgtccgaatttcttaccacctcattctatacctaccttactttcctggatccagattgcgatgagaaactgtttgataatgcgtctgaaggtaccttttcgcccgactccgattccgatctggtaggttatcttgaggacacctgcaatcaggaatcgcaggacgagctcgatcattacataaatcatcttctccagagcacgagcctgaggtcgtaccttcctccactgtgtaagaacactgaagatcgccatgtcttttccgccattcactcaacccgcgatatcctcagtgtcatggctaaggctaaagggcttgaagtgccttttgttcctatgacccttcctactaaagtcttgagcgctcatcggaaaagcctgaatcttgttgatagcccccaacctctgctcgaaaaagtgcctgaatccgactttcaatggccaagggatgatcacggtgacgtggattgtgaaaagctggtggaacaactgaaggactgctccaacctccaggatcaagcagatattctttacatactctacgtcattaagggaccatcttgggataccaatctgtctggacaacatggagtgactgtccaaaaccttctcggggagctctacggtaaagccggacttaaccaggaatgggggctgattagatatatctcgggcctgcttcgtaagaaggtggaagtcctggcggaagcctgtaccgaccttctttcacatcaaaagcagctgaccgtgggactcccaccagagcccagagaaaagatcatttcagcaccacttccacctgaggagctcactaagctcatttacgaagcatcggggcaggacatttctatagcagtcctgactcaagaaatcgtggtgtaccttgcaatgtacgtccgggcacagccatcgttgtttgtcgagatgctgagactccggattggactgattattcaagtgatggctaccgaacttgcaaggtccctgaattgctcgggcgaggaggctagtgagtcgcttatgaatctcagccctttcgatatgaagaacctgctgcaccatatcctctccggtaaggaatttggagtggagagaagcgtcagaccgattcattcgtccacttcgtcgccaactattagcatccatgaggtgggacataccggagtgacgaaaactgagagatccggaatcaacagactccgatccgaaatgaaacagatgacccgacgcttttctgcagacgaacaattcttttcagtgggtcaagccgcatcgagctcggcacactcgagcaagtcggcacgctccagcaccccttccagcccaactgggactagcagctcggactccggaggacatcatattggctggggagaacgacagggtcaatggttgagacgccgtcggcttgacggcgcaatcaatagagtccctgttggtttttaccagcgggtgtggaagattctgcagaagtgtcatggtctttcaattgatggttacgtgctcccttcgtcgaccactagagaaatgactccccacgaaatcaagttcgcggtgcacgtggagagcgtgttgaacagagtaccccagcctgagtacaggcagttgcttgtggaagcaattatggtgctcacgctgctctccgacacggagatgacgtccattgggggtatcatccatgtggatcaaattgtccaaatggcctcacaactgtttctgcaagatcaagtgtcaataggtgcgatggatactcttgaaaaggatcaagccaccggaatctgtcatttcttctacgattccgcaccctcaggcgcatacggaaccatgacctacctgactcgagcagtggcctcctaccttcaagaactcctccccaactccggctgtcagatgcag

SEQ ID NO: 18132 - DNA, 3705 bp, Artificial Sequence
  Description of Artificial Sequence: Synthetic coding sequence
atgaggtcccgctctaattctggtgttcggctcgacggatacgcgcgtttagtccagcaaacaatcctttgctaccaaaacccagttacaggactcctgagtgcgagccacgagcagaaggacgcttgggtgagggacaatatctatagcattctagcggtctggggccttggcatggcttatcgtaagaacgccgatagagacgaagacaaagcgaaagcgtacgaactcgaacaaaacgtggtaaaacttatgagggggctgctgcagtgtatgatgcgtcaggtcgcaaaggtggagaagtttaagcatacccagtcaaccaaggattcccttcacgccaaatacaacacagcaacttgcggaactgtcgtcggtgatgatcagtgggggcacctgcaggtcgatgccacttcccttttcttacttttcttggcccagatgactgcctcaggtcttcgtattatttttactctagacgaagtcgcattcatccagaacttggtattctacattgaggcggcttacaaggtcgcagattacggaatgtgggaaaggggagataagacgaatcaaggcatccctgaacttaatgcttcctcggtggggatggccaaagccgcgctggaagccatcgacgagctagacttgtttggggcgcatgggggacgcaagagcgtaatccatgttttgcctgacgaggttgaacactgccaatctatcctgttcagcatgttaccacgcgcttcgacctccaaggaaattgatgcgggacttctaagcatcatctcatttcccgcgtttgcggttgaagatgtcaatctggttaatgtgaccaagaatgagataatctcgaagttgcaggggagatatgggtgctgccggtttctacgcgacggctacaagactccgcgagaagacccaaaccgtttgcactatgatcctgctgagctcaaactgttcgagaatatcgaatgcgaatggcccgtattctggacatactttatcatagatggagtgttctcaggagatgctgtgcaggtgcaagaataccgagaagctctagaaggtattctcattcgaggaaaaaacgggatcaggctcgttccggagctgtacgccgtgccgccgaacaaagtggatgaggagtacaaaaacccacatacggtagatcgcgttcctatgggcaaggtaccccacttatggggccagtccctatatatactgtcaagccttcttgctgagggtttcctcgctgccggggagattgatcctcttaaccggagattttcgacaagtgtcaagcccgacgtcgtcgtccaggtcacggtgttggcggaaaataatcatatcaaggatctgctccgaaagcacggggtcaacgttcagtctatcgcggacatccatcccatccaggttcaacctggtcgaatcctcagccatatttacgcgaaactgggaaggaataaaaatatgaacctctctggtcgcccctaccgccatataggtgtccttggaacatccaagctctatgttatccgcaaccaaatctttacattcaccccgcagttcacggatcagcatcatttctacctggctcttgataatgagatgatcgtggaaatgttgcgtatcgaattggcgtacctgtgtacttgctggaggatgacaggccggccgacccttacgttcccgatctcgcgcactatgctcaccaatgacgggagtgatatccattcggcagtattgtcgacgattcggaagctagaggatggttatttcgggggcgcccgggtgaaacttggcaacttaagcgagttcctaacgaccagcttctatacgtatctaaccttcctggatcccgattgtgacgaaaagcttttcgataacgcgtcagaaggcacgttttctccagacagtgacagtgatctagttggctatttagaagatacctgtaatcaagaatcccaggacgagcttgaccactatattaatcacctgttgcagagtacgtcgctcagatcgtatttgccaccgttatgcaaaaacactgaagacaggcatgtgttttcggcaatccactcgacgcgggatattttgagcgttatggcaaaggccaagggtctcgaagtcccattcgttccgatgacgttgccaacgaaggtgctctctgcccacagaaagagcctcaaccttgtcgattccccacagcccttgctcgaaaaagtgcctgagtcggactttcaatggcctcgtgatgaccatggcgacgtggattgcgagaaattggtcgagcagcttaaggattgttctaacctgcaggatcaagcggacattctctatatcctttacgtgatcaagggcccgagttgggatacaaacctttcaggccagcatggggttactgtacagaacttgctgggtgagctctatgggaaggctggacttaaccaggagtggggtctcatccggtatatcagtggtcttctaaggaagaaggtggaagtgctcgccgaggcatgtacagacttgctatcccatcagaaacaactgaccgtcgggctgccgcctgagccgcgagaaaagatcatcagcgcacccttgccgccagaggagctgacgaagttgatttatgaagcaagcgggcaggatatctccatcgctgtcctcacacaagaaattgtggtgtacttggctatgtacgtccgcgctcaaccaagccttttcgtcgagatgctgaggctaaggattgggctgatcatccaagtcatggccactgagctagctcggtccttaaactgttccggtgaagaggcctctgaatccctcatgaacctttcaccgttcgacatgaagaacctcctacaccacatcctcagcggtaaggagtttggagtagagcgttcagttcgcccaatacatagttcaacatcttcccctacgatttccattcatgaagtaggtcacacgggggttacaaagaccgagcggtctggcataaaccggttaagatccgagatgaagcagatgactcggagattttcggcggacgagcagttcttcagcgttggtcaagctgcttcttcgtcagctcattcttcgaaatcggctcgatcgtcgactccctcatccccaactggtacctcaagtagtgatagcggcggccaccatattggctggggcgagagacagggtcagtggttgcgcagacgacgattggatggtgcgatcaatcgcgtgcctgttggtttctatcagcgggtgtggaaaattttgcagaagtgccatggcctgtccatcgacggctacgtcctaccatcctcaacgacacgtgagatgaccccccacgaaattaagttcgccgtacatgttgagtcggtgcttaacagagttccacaaccggaataccgccagttgctcgtggaggctatcatggtgctaacgctattgtccgatactgagatgactagtattggcggtatcatccacgtcgaccagatagtgcaaatggcatcccagctgtttttgcaggaccaagtctctattggtgctatggacactcttgagaaggaccaggcaactggcatctgccacttcttctatgattccgctccttctggagcctacggaacaatgacctatttaacgcgggcggtcgcgtcatatctacaggagttattgcccaactcgggctgtcagatgcag

SEQ ID NO: 18133 - DNA, 3279 bp, Artificial Sequence
  Description of Artificial Sequence: Synthetic coding sequence
atggcaggagcagctggactcactgccgaagtgagctggaaagtgctggaacggcgtgcaagaactaaaaggtcgggttcagtgtacgaacctctcaaatcgataaacttgcctcgacctgacaatgaaaccctttgggataagctcgatcactactacaggattgttaaaagcacgcttctcctttaccaatccccaactactggtcttttccctaccaagacctgcggtggtgaccaaaaggcaaagatccaagactccttgtactgcgcagcaggggcgtgggcacttgcacttgcctaccggagaatcgatgatgataaaggaaggactcatgagcttgagcacagcgccatcaagtgtatgagaggtattctgtactgttacatgcgtcaggcagataaggtccagcagtttaaacaagatcctcgacccaccacttgtctccactccgtctttaacgtgcatacgggcgacgaactgttgtcgtacgaagaatatggacaccttcagatcaatgccgtcagcctgtacctcctgtacctggtggaaatgatctcctccggtctgcagatcatctataacaccgacgaagtgagcttcattcagaacctggtcttttgtgtggagagagtgtacagagtgcctgattttggagtctgggaacgaggttcaaagtacaacaacggttccaccgagctgcattcttcatcagtggggctggcaaaggcagcactcgaggcgatcaatggatttaacctctttggcaatcagggatgttcgtggtcagtgatttttgtggatctggatgctcacaaccggaacagacaaaccctgtgctctcttcttccacgcgaatcaaggtcccataacactgatgcagcactgctgccatgtatttcgtacccagctttcgctctggatgacgaggtgctttttagccagacccttgataaggtcgtgcgaaagctgaaggggaagtacgggtttaagcgctttctgcgcgacggatacaggactagccttgaggatccaaatcgttgctactacaagcccgccgaaatcaagctgtttgacggaatcgaatgtgaatttccaatattctttctgtacatgatgatagacggtgtgtttagaggaaatccgaaacaggtgcaggagtaccaagatctcctgactcctgtgctgcaccatacgaccgagggatacccggtggtgcccaagtactactacgtccctgcagattttgtcgaatacgaaaagaacaacccaggttcgcaaaagagatttccctcgaactgcggcagagatggaaagctctttttgtgggggcaagcattgtacataattgcaaagctgcttgcggacgaacttatttcccctaaggatatcgatcctgtccagagatacgtccctctgaaagaccaacgcaacgtgagcatgaggttctcaaatcaagggcctcttgaaaatgatctggtggttcatgtcgccctgattgcggaatcacagagactgcaagttttccttaacacgtacggaattcagactcagacgcctcagcaggtggagcctattcaaatttggccacaacaggagttggtgaaggcataccttcagctggggattaatgaaaaacttggtctgagcggcagacccgatcgacctatcggctgtctcggcacctctaagatttaccgtatcctcggcaaaaccgtggtgtgctaccctatcatttttgacctctccgatttctacatgtcgcaggatgtctttttgctgatcgatgacatcaaaaacgcactgcagttcataaagcaatactggaagatgcatggacggccgctgtttctggtgcttattagagaagataacattagaggatcaagatttaacccgattctcgatatgcttgcagccctcaagaaaggtatcataggaggagtgaaggtccatgtcgatagacttcagacccttatttcaggagccgtggtggaacagctcgactttcttagaatttcggatacggaggagcttcctgagtttaagagctttgaagaactggaaccccctaagcattccaaagtgaagcgccagtccagcactccatcggcacctgagctcggacagcaacccgatgtgaacatttcagaatggaaggacaaaccaacccacgagatactgcaaaaacttaacgattgctcgtgccttgcatcccaggccatcctgctgggtatacttctcaaaagggagggtccgaactttatcactaaggagggtactgtgtctgatcatatcgaacgcgtgtaccggagagcaggttcccagaaattgtggctcgcagtgcgatacggtgccgcatttacccagaagttttcctcctcgatcgcaccacacatcacgacctttcttgtgcatggtaagcaggtgacgctgggtgcattcggacacgaagaagaagtgatctccaaccccctcagcccccgagttatacagaacatcatatactacaagtgtaacactcatgatgaacgcgaagctgtgatacagcaagaacttgtcattcacatcggatggatcatctcaaacaatcctgagctttttagcggtatgttgaaaattcggattggatggattatacacgctatggagtacgaactgcaaattcgcggtggtgacaaacctgcattggacctttaccaattgagcccgtcagaggtgaaacaactgctcctggacattctgcagccacagcaaaatggacgatgttggctgaaccgtaggcaaattgatggaagcctgaatcgcactcctaccggtttctacgatcgcgtgtggcaaatcctcgaaagaactcctaatggcatcattgtcgcaggaaagcaccttccacaacaacctactctgagcgacatgactatgtacgaaatgaactttagccttctcgtggaagataccctgggtaacatcgaccaacctcagtaccggcagattgtcgtcgaactcctgatggtggtgtcaatcgtgctcgagagaaatcctgaattggagtttcaagataaagtggacctggaccggctggtgaaagaggcatttaacgagtttcagaaagaccagtcacgcctgaaggaaatcgagaagcaagatgacatgacgtccttctacaatactcccccacttggaaagaggggaacttgttcctaccttactaaggcagttatgaacctgcttcttgaaggagaagtgaagccaaataacgatgacccttgtctgatttcc

SEQ ID NO: 18134 - DNA, 3279 bp, Artificial Sequence
  Description of Artificial Sequence: Synthetic coding sequence
atggccggtgctgccggactgactgcggaggtgtcgtggaaagtgctggagcggcgcgcacgcactaaaagatcgggctcagtctacgagccgcttaagtccatcaacctgccccgcccagacaacgaaaccctctgggataagctggatcattactaccggatcgtgaagtctacgttgttgctttaccagtcgcccaccactgggctgtttccgaccaaaacgtgcggaggggatcagaaggccaaaatccaagattcactgtattgtgcagcgggagcctgggccctcgcattggcctataggagaatagacgacgacaagggaagaactcacgagctcgagcattcagcgatcaaatgtatgcggggtatcctgtactgctacatgcgccaagcagacaaggtgcaacagtttaagcaggatccgcgcccgaccacttgcctgcatagcgtgtttaatgtgcataccggagacgaattgctgtcctacgaggagtacggtcacctgcagatcaacgcagtctctctgtatcttctctatcttgtggaaatgatttcgtccggactgcaaatcatctacaatactgacgaagtgtcatttatccaaaaccttgtgttctgtgtcgagcgggtgtacagagtgccggatttcggcgtctgggagcgaggatccaaatacaacaacggatccactgagctgcactcctcatcggtcggactggcgaaggccgctctcgaggcgatcaacggctttaatctgttcggaaatcaaggttgcagctggtcagtcatctttgtggatctggacgctcacaaccggaaccggcagacgctctgttccctgcttccgcgagagtcgcgtagccataataccgacgctgcgctgctcccatgcatcagctaccctgcgtttgcactggacgatgaggtgctgttctcgcagacgctcgacaaagtggtgaggaaactgaagggaaagtatggattcaagcggttcctccgggatggataccgcacgtcgctcgaagatccgaaccgctgctactacaagcctgcggaaatcaagttgtttgacggcatcgagtgcgagttcccgatctttttcctgtacatgatgatagacggtgtgttcaggggcaatcctaagcaggtccaggaataccaggacctcctgactccagtgctgcatcacactaccgaagggtatccggtggtgccaaagtactactacgtcccggctgactttgtggaatacgaaaagaacaacccaggaagccaaaagaggttcccctctaattgcggaagagacggcaagctcttcctgtggggtcaggcattgtacatcattgcgaagctgctggcagatgaactgattagcccgaaagacattgaccccgtgcaaagatacgtgcccctcaaggaccagcggaacgtgagcatgcggttctcgaaccaaggacctcttgaaaacgatctggtggtacacgtcgcacttatagctgagtcacagcggcttcaagtgttcttgaatacctacggaatccagacccaaactccgcaacaggtcgaaccaatccagatctggcctcagcaggagcttgtcaaggcctatcttcagctcggcattaatgagaagctggggcttagcggacgcccggacagacctatcggctgcctgggaacttctaagatctacagaatcttgggaaagaccgtggtctgctacccgattatcttcgatctgagcgacttctacatgtcacaggatgtgttcctcctgattgacgacatcaagaacgccctgcagtttatcaaacagtactggaagatgcacggacgacccctgtttctcgtgttgatccgagaggacaacatccgcgggtccaggttcaaccccatcctggacatgctggccgctctgaagaaaggaatcatcggaggtgtgaaggtgcacgtggaccgcctgcagactttgatcagcggagccgtcgtggagcagctggattttctgcgcatctccgacactgaagaactccctgagttcaagtcattcgaggagcttgagccaccgaaacacagtaaggtgaagcgccaatcctcaaccccaagcgcgcccgagctgggtcaacaaccagacgttaacattagcgagtggaaggacaaaccaactcacgaaatcctgcaaaagctgaacgattgctcgtgtctggcctcccaagccattcttctgggaatcctcttgaagcgggagggaccgaacttcatcactaaagaaggaactgtttcggaccatatcgagcgagtgtacagacgggctggcagccagaaactctggctggccgtgcgatacggcgcagcctttacccagaagtttagttcttcgatcgccccgcatatcaccacttttctggtgcatggaaagcaagttaccctgggagcgtttggacacgaagaggaagtcatcagcaatcctctctctccgcgggtcatccaaaacattatctattacaagtgcaatacgcacgacgagcgagaagcggtcatccaacaagaactggtcatccacatcggatggatcatctccaacaacccggagctgttcagcggcatgcttaagatccggatcggatggattattcacgccatggaatacgaactccaaatcagaggaggggataaacccgctctcgatctctaccaattgtcaccttccgaagtgaagcagctcctgctcgatatccttcagccgcaacaaaatggacgttgttggttgaaccggcgccagatcgatgggtccctgaatcgcactccgaccggcttttatgatagggtctggcagattctcgaacggacgccaaacggcatcatcgtggcgggcaagcacctcccacagcagccaactctgagcgatatgaccatgtacgagatgaacttctcactgctcgtcgaagatactctggggaacattgaccagccgcaatacagacagatcgtcgtcgaattgctcatggtggtgtccatcgtcctggaacgcaacccagagctggagttccaggacaaggtggacttggaccgcctggtgaaggaggccttcaatgaattccagaaggatcagtcccgactgaaggaaatcgaaaagcaggatgatatgacgagcttctacaataccccaccgctgggaaaaagaggaacctgctcatacctgaccaaagccgtcatgaatctcctgctggagggagaggtgaaaccaaataacgacgacccgtgcctgattagc

SEQ ID NO: 18135 - DNA, 3279 bp, Artificial Sequence
  Description of Artificial Sequence: Synthetic coding sequence
atggccggcgcggcaggcctcaccgccgaggtctcctggaaggttctcgagaggcgcgctagaacaaagaggagtggtagcgtgtatgagccattgaagtcgattaatctgcctaggcctgataatgagactctctgggataaattggaccattactatagaatagttaaatccaccttgctgctgtatcagtctcccacaacaggcctgtttccaaccaagacctgcgggggggatcagaaagccaagattcaggattctttatactgcgccgccggcgcctgggctctggcgctggcctacagaaggatagacgacgataaggggaggactcacgagcttgagcatagcgccatcaagtgcatgcgagggatattgtactgctacatgaggcaagcggacaaagttcagcagtttaagcaggacccacggcctacaacgtgcctgcacagcgtgttcaacgtacatactggtgacgaattattatcatatgaggagtacggacatctacaaatcaacgccgtgtctctgtacctcctgtatctcgtggagatgatatccagcggactgcagattatctataacactgatgaggtttctttcattcagaacctggtcttctgcgtggaaagggtgtatcgcgtcccagacttcggcgtctgggaaagagggagtaagtataataacggttcaacagagctgcacagttcaagcgttgggctggcaaaggctgccctggaggcgataaatgggttcaacctctttggaaaccaaggctgcagttggtcagtgattttcgtggatctggacgcccacaaccgaaaccggcagaccctctgttcacttctgcccagggagtctcgcagtcacaatacggacgctgcactcctgccgtgtatcagctaccccgcatttgcactggacgatgaggtgctgttctctcaaacactcgacaaggtggttcgaaagttgaaggggaagtacgggttcaagagatttcttagagatggctatagaacatctctggaggacccgaacaggtgttattacaagcctgccgaaattaaactttttgatgggattgagtgtgagttccccatatttttcttgtacatgatgattgatggggtcttccgcggaaaccctaagcaggtccaggaatatcaggatcttttgactccggtgctccaccatacaaccgagggctatcctgtggtgcccaagtactattacgtgcccgctgacttcgtggaatatgaaaaaaacaatccagggtcccagaaacgctttccaagcaattgtggaagggacggaaagttatttctgtggggccaagccctgtacatcattgcaaagctgttggcagatgaacttatctccccaaaagatatcgacccagtccagcggtacgtgcccctcaaagaccagagaaatgtctccatgcgatttagtaaccaggggccactggaaaacgatctcgtcgtacacgttgcacttattgctgagtcacagagacttcaggtgttcctcaatacctatggaattcagacccagacaccacagcaggtcgaaccaatccagatatggccgcagcaagagctcgttaaagcctatctgcagctggggatcaatgagaaactaggtcttagtgggaggcccgatagacctattggctgtctaggaacctccaaaatctatcgtatcttgggaaagaccgtcgtttgttatccgataatcttcgacctgagtgacttttacatgagtcaagacgttttcctcttgatcgacgacattaagaacgccctgcagttcatcaaacagtattggaaaatgcatggtagaccgttgtttctggttctgataagagaggacaatattcgtggatctcgtttcaatcccattctcgacatgctagcagctctcaaaaaggggattatcggtggggtcaaggtccatgtcgaccgcctgcagacgcttatttcaggggccgtggttgagcagttagatttcctccgtatttcagataccgaggagcttcctgagtttaagagcttcgaggagctggagcctccgaagcactccaaggtaaagagacagtcctcaactccgtccgctccggagcttgggcagcagccggacgtgaacattagcgaatggaaagacaagccaacgcacgaaatactgcagaaactcaacgattgctcatgtctggcgagtcaggccatcttgcttggtatactactgaaaagagaaggacccaacttcatcaccaaagagggaaccgtgtctgatcatattgaacgagtctaccgcagggcgggatctcagaagttatggctggctgtgcggtatggtgcagccttcactcagaaattttcctcaagtatagcgcctcacatcactacattcctcgtgcacgggaagcaggtcaccctcggagcctttggtcatgaagaggaggttatctcgaatcctctgtcaccacgagtgattcaaaacataatttactacaaatgtaacacacatgatgaacgggaggccgtcatccagcaggaactcgtgatccatatcggctggattattagtaacaatccagaacttttttctggaatgctgaaaattcgcatcggctggattatccacgcgatggagtatgaactgcagattagaggaggtgacaagcccgctcttgatctgtaccagctgtcaccatctgaagtgaaacaactgctcctcgatattttacaaccacagcagaacggccgctgctggttgaaccgcaggcaaattgatggctccctcaaccggacccccacaggtttttacgacagagtttggcagattctcgagagaacacctaacggcataatcgtggcgggaaagcaccttcctcagcagcccaccctgtcggacatgacgatgtacgagatgaatttttcactcctggtagaagacaccctgggaaatatagaccagcctcagtataggcagatcgtcgtagaattgttgatggtcgtgtctatcgtgcttgagaggaatcctgagctcgagttccaggataaagtggatctcgacagactggtgaaggaggcctttaacgaattccaaaaggatcaaagcaggctgaaggagattgagaaacaggatgacatgaccagtttctataatacccctcccctcggcaagcgaggtacctgttcgtatctcactaaggccgtaatgaacttgttactcgaaggcgaagtaaagccaaataatgatgacccctgtctcatatct

SEQ ID NO: 18136 - DNA, 3279 bp, Artificial Sequence
  Description of Artificial Sequence: Synthetic coding sequence
atggcaggagctgccggactgactgcagaggtgtcttggaaggtcctcgaacgcagggctcggaccaagcggagcggatcagtgtacgagcccctcaagtcaattaaccttccacggcccgataacgagacgctttgggataaactggatcactactaccgaattgtgaagagcaccctgcttctgtatcaatctccaacgactggtctgtttcctactaaaacctgcggaggagatcaaaaagctaagattcaggattcgctttactgtgcagccggtgcatgggcgttggcgctggcttacaggagaattgatgacgacaagggtcggacccacgagctcgaacattcagccatcaaatgcatgcgaggaatcctttactgttacatgcgccaagcagataaggtgcaacaattcaaacaagacccgaggccgactacgtgtctccattcggtctttaatgtccatactggggacgaacttctttcctacgaggaatacggacacctgcagattaatgccgtcagtctttacctgctttacctggtcgagatgatttcatctggtctgcagattatctacaataccgacgaagtgtcgtttattcagaaccttgtattctgtgtggaacgagtgtaccgagtgcctgactttggtgtttgggaacgggggagcaaatacaacaatggatcaacggaactccacagctcctctgtcggtctggccaaggccgcacttgaagcgataaacggttttaacctctttgggaatcaagggtgctcatggtcggtgatctttgtagaccttgatgcacacaaccgtaatagacagaccctttgttcgctgcttccacgggagtcgcggtcgcataacactgatgcagcacttctcccatgtattagctaccctgcttttgcccttgatgacgaagtcctctttagccaaacgcttgataaggtggtcagaaagctgaagggcaagtacggttttaagcggtttctccgcgatggatacaggacttcccttgaagatcccaatcgctgttactataagcctgctgagattaagctgttcgacggcattgaatgcgaatttcctattttctttctgtacatgatgatagatggcgtgttcagaggaaaccctaagcaagtgcaggagtaccaggatctgcttactccagtcctccatcacacgactgaaggttaccccgtcgtcccaaagtactactacgtcccggcagatttcgtcgaatatgagaagaacaaccctggaagccagaagagattcccatcgaactgcgggcgagatggaaaactcttcctttgggggcaggccctctacatcattgccaagctgctggccgatgagctcatttcgcctaaggacattgatccagtgcagcgttacgtgcctctgaaggatcagcgtaacgtgtccatgcggtttagcaatcaggggccgctggaaaatgacctggtggtgcatgtggcattgatcgcggagtcacagagactgcaggtgttcttgaacacttatggtatccaaacccagactccacagcaagtcgaacccattcagatctggcctcagcaagaactggtgaaggcttatcttcagctggggattaatgaaaagctcggcctgtccggacggcctgataggccaattggatgcctcggaacttccaaaatctaccgcattctgggtaaaacggtggtctgttaccctatcatcttcgatctcagcgatttctacatgtcccaggatgtgtttctcctcattgatgacatcaaaaatgcccttcaattcattaaacaatactggaagatgcatggtcggcccttgttccttgttcttattcgggaagataacattcgggggagcagatttaacccgatacttgacatgcttgcagcacttaagaaagggattattggcggagtcaaggttcatgtggataggctccaaaccctgatatccggtgcagtcgtcgaacaacttgattttcttagaatctcggacaccgaagaattgcccgagttcaagagctttgaagaactggaaccacccaagcactccaaagtgaagaggcagagttcaactccctcagcaccagaattgggccaacaacctgatgttaacatatccgaatggaaggacaaacctacccacgaaattctgcagaaacttaatgattgttcgtgtctggcgagccaggcaatcctgcttggaatcttgctcaaaagggaaggtccgaactttatcactaaggaggggactgtctccgaccatattgaaagggtgtatcgccgcgcaggaagccaaaagctctggctggccgtgcgctacggagccgcattcactcaaaagttttcatcatctatcgccccccatataacgactttccttgtgcatggaaaacaggtgacgctgggcgcctttgggcatgaagaagaggtgatttccaaccctcttagcccgcgcgtgattcaaaacataatctattacaagtgtaacacccacgatgagagagaagctgtcatccagcaggagctggtgatacatatcggctggatcataagtaacaatccagagcttttttccggaatgcttaagatcaggattgggtggattattcatgctatggaatacgagctgcaaatcaggggcggtgataaacctgcacttgacttgtaccagttgtccccatcggaggtgaagcagttgcttctggacattcttcaaccccagcagaacggcagatgctggctcaatcgacgtcaaatcgatgggtcacttaatcgcaccccaaccggtttctacgatcgcgtctggcaaatcctcgagcggaccccaaatgggatcatagtggcaggtaagcatctgcctcaacaacctaccttgtccgacatgactatgtacgaaatgaacttttccctgctcgtggaggataccctcggtaacatagaccaaccccaataccggcaaatagtggtcgaactccttatggtggtgagcattgtgctggagagaaacccagaacttgaatttcaagacaaagtggacctggatcgtctggtgaaagaggcctttaacgaatttcagaaggaccaatccagacttaaggaaattgaaaagcaggatgacatgacgagcttttacaacacgcctccacttggcaagcggggtacctgtagctacctgaccaaggccgtgatgaacctgctcctggaaggagaggtgaaaccaaacaatgacgatccttgtctgatatca

SEQ ID NO: 18137 - DNA, 3279 bp, Artificial Sequence
  Description of Artificial Sequence: Synthetic coding sequence
atggcaggagcagcaggtttgaccgcagaagtgtcctggaaagtgcttgaaaggcgagcaagaactaagcgcagcggaagcgtgtacgagcctctgaagtcgatcaacctgccgcgccctgataacgagacgctgtgggataaacttgaccattactacagaatagtaaaatcgactttgctgctgtaccaatcgcctactactgggcttttcccaactaagacctgcggtggggaccagaaggcgaaaattcaagattcactctactgtgcagcaggagcctgggcacttgctctggcctaccgacggatcgacgacgataagggaaggactcacgagcttgaacattcggctattaagtgcatgcgtggaattctgtactgttacatgcgacaagcggataaggtgcagcagtttaagcaagacccaagaccaaccacctgccttcattcagtgttcaacgtacataccggagatgaattgctgagctacgaggaatacggacacctgcagattaatgccgtgtcgctttaccttctttaccttgtcgaaatgatctcgtctggtctgcagataatctacaacacggatgaagtgagctttattcagaatcttgtgttctgcgtggaacgggtctaccgggttcctgactttggcgtctgggagagaggctcgaagtacaataacggctccaccgaattgcactcatcatccgtgggacttgctaaagcggcacttgaagcgatcaacggattcaatctgtttgggaaccaaggctgttcgtggagcgtgatctttgtggatcttgatgcgcacaaccgaaaccggcaaaccctctgtagcctcttgccacgcgaatccaggtcccataacaccgatgcggcgctccttccctgcatatcatacccggcttttgctctcgatgacgaggtgcttttttcccaaactctcgacaaagtggtcagaaaacttaagggaaagtacggttttaagcggttcctcagggacggttaccgtaccagcttggaagatcccaatcgctgttattacaagcccgccgaaatcaaacttttcgatggtatagagtgtgaatttccgatcttttttctctacatgatgattgatggtgtgtttcgtggtaatcctaaacaagtgcaagagtaccaagacctcctgactcccgtcctgcaccacactactgaaggatacccagtcgtgccaaagtattactacgtgcccgcagatttcgtcgaatacgaaaagaataaccccggctcccaaaagcggttcccatcgaattgtggacgtgatggtaagctgtttctctgggggcaagcgctctacatcattgcaaaactcttggctgacgaattgatctctccaaaggacattgatcctgtccaacgttacgtgcccctgaaagatcaaagaaacgtgtccatgagattttccaatcaggggccactcgagaatgaccttgtcgttcatgtcgcccttattgcagaatctcagcgattgcaggtctttttgaatacctacggcattcaaacccaaactcctcagcaggttgagcccatacaaatctggcctcagcaggaactggtgaaagcatatctccaactgggtatcaatgagaagctcggattgagcggtcgccctgatcggcctatcggttgcctgggaacgtcgaagatataccgaattcttggaaagaccgtggtctgttatcctatcatttttgatcttagcgacttttacatgtcccaggatgtctttctcctgatcgatgatatcaagaacgccctgcagttcattaaacagtactggaagatgcacggcagacctctcttccttgtgttgatcagggaagataacataagaggttcgcggttcaatccaattctggatatgcttgctgccctgaaaaaaggtatcattggtggagtgaaggtgcatgtcgataggctccagaccctgattagcggtgctgtggtggaacagctcgactttcttcgcatttcggatacggaagaactgcctgaattcaagtcgtttgaggaacttgagcctcccaagcatagtaaagtgaaacggcaaagctcgaccccatctgcacctgaactgggacagcagcctgatgtgaacatctctgagtggaaggacaagcctacccatgaaattctccagaaactgaacgattgctcgtgtcttgcttcccaagcaattcttcttggcattttgctgaagcgtgaagggcccaacttcataaccaaggagggtactgtgagcgaccatattgagcgtgtgtacagaagagcaggaagccagaagctgtggcttgcagtcagatatggggcagcattcactcagaagttcagctcgtcgatagctccgcatatcactacgtttcttgtgcacgggaaacaggtgactctcggagcctttggacacgaagaagaagtgatctcgaatcctctcagccctcgcgttatacagaatatcatctattacaagtgtaatacccacgatgaaagagaagcagtcatccagcaagaattggttattcatattggctggatcatttctaacaacccagaacttttctcggggatgctgaagattcggattggttggattattcatgcgatggaatacgaactccagattaggggtggtgataagccggcacttgacctttaccagctgagcccaagcgaggtgaaacaactcctgctggacatcctgcagccgcagcaaaacggccgctgttggctgaaccggcgccagatagatggatcccttaaccggactccgaccggtttttacgatcgcgtgtggcagattctggagaggaccccaaatggaatcatcgtcgctggaaagcatctgccgcaacagcctacgctttcggatatgaccatgtatgaaatgaacttctccctgctggtggaggacacgctgggtaacatcgatcaacctcaatacaggcaaattgtcgtcgagctgctgatggtggtgtccatagtccttgagagaaaccccgaactggagttccaagataaagttgatcttgaccgacttgtgaaggaagcctttaacgaatttcagaaggatcaatcccggctgaaagagatagagaagcaagacgacatgacttcgttttacaacactccaccactggggaagcgaggtacgtgctcctaccttactaaagctgtcatgaatcttcttctcgaaggagaggtgaagcccaacaacgacgatccatgtcttatatca

SEQ ID NO: 18138 - DNA, 3279 bp, Artificial Sequence
  Description of Artificial Sequence: Synthetic coding sequence
atggcaggagccgccggacttactgcggaagtcagctggaaggtgctcgagcgccgggccagaaccaagcgctcaggatccgtgtatgaacctctgaagtcgattaatctccccagaccagacaatgaaaccctgtgggacaagctggatcactactaccggatcgtgaagtctaccctcctgctttaccagtcgccaaccaccggactgtttccgaccaagacttgtggaggcgatcagaaagccaaaatccaggacagcttgtactgtgctgcaggggcgtgggctttggctttggcataccgccggatcgatgatgacaagggtaggactcatgaactcgaacatagtgcaatcaagtgtatgcgcgggatactgtattgctacatgcggcaggcggataaagtgcagcagttcaagcaggacccgcgcccaaccacctgcctgcactcagtgtttaacgtgcatacgggagacgagttgctctcgtacgaagagtacggtcatctgcagatcaacgcggtcagcctgtacctgctgtacctggtggagatgatcagcagcggactgcagatcatatacaacactgacgaggtcagttttatccagaacttggtgttctgtgtggagcgcgtctaccgcgtccctgatttcggggtctgggagaggggctcgaagtacaataatggatcgactgagttgcactccagctcagtgggtctggccaaggcggccctcgaggcgatcaatggattcaacctgttcggaaatcaaggctgctcgtggagcgtcattttcgtggacctggacgcgcacaaccgaaacagacagacgctgtgctcgcttctgccgcgggaatcaagatcacataacactgatgccgccctcctgccttgcataagctatcccgctttcgcgctggatgacgaggtccttttcagccagaccctggacaaggtcgtgcgcaaactgaagggcaagtatggattcaagcgctttttgcgcgacggctacaggacttcactggaggaccccaatagatgctactacaagcctgccgagatcaagctgttcgacgggatcgaatgtgaatttccgatcttttttctttacatgatgattgacggggtattccgcggaaatccaaagcaagtgcaggagtaccaagatctgctgaccccagtcctccaccacactaccgagggctacccggtggttccgaagtactactacgtgccagcggacttcgtcgagtacgaaaagaacaatccggggagccaaaaaagattcccgtccaactgcggccgggatggaaagctgttcctgtggggccaagcgttgtacatcatcgctaagctgttggccgacgaactgatctcgccaaaggatatcgatccggtccagcggtacgtcccgctgaaggatcagcgcaacgtttcgatgagattctctaatcaggggcccttggagaacgacctcgtggtccacgtggctctcatcgccgaaagccagagactccaggtgttccttaatacgtacggcatccagacccaaacgccgcaacaggtggaaccgatccaaatctggccccagcaagagctggtgaaggcctacctgcagctcggaatcaatgaaaaactcgggctctcgggacgcccggaccggccgatcgggtgcctcggaacttcaaagatctaccgcatcctcggcaagaccgtcgtgtgctaccctatcatattcgacctgtcggatttctacatgagccaagatgtgttcctgctgatcgacgatatcaaaaacgcgctgcaattcatcaagcaatattggaagatgcacggacggccactgttcctggtgctgatccgggaagataacatccgaggatcgcggttcaacccgatcttggacatgctcgccgctttgaagaagggcattattggaggagtgaaggtccatgtagaccggctgcagactctgatctctggcgcggttgtggaacagctcgacttcctccggatctccgacactgaagaacttcctgagttcaagtcattcgaggagctcgaaccgccgaagcattcgaaagttaagcggcagtcgtccacgccgtcggccccagagctcggacagcagccagatgtcaatatctccgaatggaaggacaagccaacccatgagatcttgcagaagctcaatgactgcagctgcctggcaagccaggcaatcctgctcggtatcttgctgaagcgggaaggaccgaatttcattactaaggagggcactgtgtcggaccacatcgaacgcgtgtacagacgagcgggctcacagaagctgtggctggcggtgcggtacggggcagccttcacccaaaagttttcctcctcaatcgcgcctcatatcacgaccttcttggttcatggtaagcaggtgacccttggagccttcggacacgaagaagaggtgatctcgaacccactgtcacctcgcgtcatccaaaacatcatttactacaagtgtaacacccatgacgagcgcgaagcggtgatccagcaggagctggtgatccacatcgggtggatcatcagcaacaatccggagctgttcagcggaatgctcaagatccggatcggctggattatccacgcaatggaatacgaattgcagatcagaggcggagacaagcctgccctggatctctatcagctgtcgccgtcggaggtgaagcaactgctgctggatatccttcagccgcagcagaatggaaggtgctggctgaatcgaaggcagatcgacggctccctcaacagaacccctaccggattctacgacagagtgtggcaaatcctcgagcggactccgaatggcatcatcgtggccggcaagcacctcccgcagcagccaaccctgagcgatatgactatgtacgaaatgaacttcagcctcctggtggaagatacccttggaaacattgatcaacctcaatacagacagatcgtggtggagctgctgatggttgtctcaatcgtcctggaacggaatccggaactggagttccaagacaaggtggatcttgaccggcttgtcaaagaggcctttaacgaatttcagaaggatcaatcccgccttaaggagattgaaaagcaagacgacatgacctccttctacaacaccccgccgctgggcaagcgcggaacctgcagctacctgactaaggccgtgatgaacctgctgctggagggagaagtcaaacctaacaacgacgatccttgtctcattagc

SEQ ID NO: 18139 - DNA, 3279 bp, Artificial Sequence
  Description of Artificial Sequence: Synthetic coding sequence
atggccggcgccgccggcttaacagcagaagtttcttggaaagtcctagagagaagagcccgaactaagcgctccggcagcgtgtatgagcccctgaagtccattaatctgccaagacctgacaacgagacgttatgggacaagctcgatcactattataggattgtcaagtctacactcctgctgtaccaatcgcccactacaggtttgtttcccacaaagacatgtggcggagaccaaaaagcaaaaatccaggatagtctttactgcgctgcaggagcttgggcccttgcgctggcatatcggcgtattgatgatgataaggggagaactcatgagctggagcattctgctattaagtgcatgcggggcattttgtactgctacatgagacaagccgacaaagtgcaacagtttaagcaggatccccggcccacaacttgcctccatagcgtctttaatgttcatacaggggatgagctcttgagctacgaggaatatggccacctgcagataaatgcggtgtctttatacctgctctatctcgtggaaatgatcagctccggcctgcagatcatctataatacggacgaagtttcgttcattcagaatctggttttttgtgtggagcgcgtctatagggtgcctgacttcggtgtgtgggagcgcgggtccaaatataacaatgggtctacagagttacattctagcagtgtcggcttagccaaggctgcgctcgaagccattaatggctttaacctgttcggcaatcaagggtgttcctggagcgtaatcttcgtggatcttgacgcccacaatcgcaatagacaaacattgtgctcgctgctgccaagagagtccaggtcgcacaacacagacgccgccctgctgccatgtatctcttacccagcctttgccctcgacgatgaagtcctgttttcccagaccctggataaagtggtaagaaaattaaaagggaaatacggatttaaacggtttttacgggacgggtaccggacaagcctggaggacccaaacagatgttactacaaacctgcggagataaagctgtttgatgggattgagtgtgaattccccatcttcttcctgtacatgatgattgacggggtgttcagggggaaccctaagcaggtgcaggagtaccaggacctgctaactcctgtactacaccacacaacagagggatatcctgtcgttccaaagtattactatgttcctgccgatttcgtagagtatgagaaaaataaccccggatctcagaagcgattcccatccaactgtgggcgcgatggcaagctgttcctatggggccaggctctgtatattatcgcgaagctacttgccgatgaactcatttcacccaaggatattgatcccgttcagaggtacgtgcctcttaaagaccagaggaacgtgtcaatgagattttcaaaccaaggccctttagaaaatgacctggtggtgcatgtggctcttatagccgagagtcagaggctgcaggtgtttctgaacacttatggaattcagacccagacccctcaacaggtcgaacccattcagatatggcctcagcaggaactagtgaaggcttatctgcagctgggtatcaatgagaagctggggctgagcgggcggccagaccgaccgatcggctgcctgggtacaagtaagatctaccgcatcttggggaaaaccgtggtgtgttacccaatcatcttcgatctttcagacttttacatgtctcaggatgtatttctcctgattgacgatatcaagaatgcactgcagttcattaagcagtactggaagatgcatggaagaccactgttcttggtcctcatccgagaagataacattagaggctccagattcaatcctattcttgatatgctggcggccctcaagaaaggcatcatcggcggtgttaaagtacatgtcgacaggcttcagaccttaattagcggcgccgtcgtggaacagttggatttcctcaggatctctgatactgaggagcttccggagtttaaatcatttgaggaattggaaccgccgaaacactccaaagtcaagagacagagtagcacccccagtgcccctgagttggggcaacagccggacgtaaacatttctgaatggaaggacaagcccacccatgagatcctccagaaactgaacgactgctcctgtcttgccagtcaagcaatcttactcgggatactgcttaagcgggagggacccaactttatcacaaaagagggcacagtgagcgaccatatcgagcgtgtgtacaggagggccggaagtcagaaattatggctggccgtcagatacggtgctgcttttacccagaagttttcatcatcaatcgctcctcacataactaccttcctggtccatgggaagcaggtgaccctcggtgccttcggccatgaggaggaagttatcagcaaccctctctcccctcgggtgatccagaatataatctattataaatgtaatactcatgacgagagggaggccgtcattcaacaggagttagtgatccatatcggatggatcatcagtaacaatcctgagctgttttccggaatgctaaaaatcagaataggctggatcatacacgccatggagtacgaattgcaaattcgaggcggagacaagccagccctggatctttaccaactgtcgcctagcgaggttaagcagctgctgttggatatcttgcaaccgcagcagaacggtcgttgttggctaaatcggcgccagatcgacggatccctgaataggaccccgactgggttttacgacagagtttggcagatcctagagagaacccccaacgggattatagtggcagggaaacatttgccacagcagcccaccttgagcgatatgacaatgtatgagatgaatttttcactgctggtggaggacactctagggaatatcgatcagcctcagtaccgccaaattgtggtggagcttttaatggttgtatctatagtcctggaacgcaatcctgagctggaattccaagacaaagtagatctcgatcgactggtgaaggaggcatttaacgagtttcagaaagaccagagccggctgaaggagatcgaaaaacaagacgacatgacgagtttttacaacacgcctcccctcggcaagcgtggaacatgttcatacctcacgaaggctgtaatgaatctgctcttggaaggcgaggtgaagccgaacaatgatgatccgtgcctcatttca

SEQ ID NO: 18140 - DNA, 3279 bp, Artificial Sequence
  Description of Artificial Sequence: Synthetic coding sequence
atggcgggtgcggcgggtttaacggcggaagtttcgtggaaagtattagaacgacgtgcgcgaacgaaacgttcgggttcggtatatgaaccgttaaaatcgataaatttaccgcgaccggataatgaaacgttatgggataaactagatcattattatcgaatagttaaatcgacgctactattatatcaatcgccgacgacgggtttatttccgacgaaaacgtgtggtggtgatcaaaaagcgaaaatacaagattcgctatattgtgcggcgggtgcgtgggcgttagcgttagcgtatcgacgaatagatgatgataaaggtcgaacgcatgaattagaacattcggcgataaaatgtatgcgtggtatattatattgttatatgcgtcaagcggataaagtacaacaatttaaacaagatccgcgtccgacgacgtgtttacattcggtttttaatgtacatacgggtgatgaattattatcgtatgaagaatatggtcatttacaaataaatgcggtatcgttatatttattatatttagtagaaatgatatcgtcgggtctacaaataatatataatacggatgaagtatcgtttatacaaaatttagtattttgtgtagaacgtgtatatcgtgtaccggattttggtgtatgggaacgtggttcgaaatataataatggttcgacggaattacattcgtcgtcggttggtttagcgaaagcggcgttagaagcgataaatggttttaatctatttggtaatcaaggttgttcgtggtcggtaatatttgtagatctagatgcgcataatcgtaatcgtcaaacgttatgttcgttactaccgcgtgaatcgcgatcgcataatacggatgcggcgctattaccgtgtatatcgtatccggcgtttgcgctagatgatgaagtactattttcgcaaacgctagataaagttgttcgaaaattaaaaggtaaatatggttttaaacgatttctacgtgatggttatcgaacgtcgttagaagatccgaatcgttgttattataaaccggcggaaataaaactatttgatggtatagaatgtgaatttccgatattttttctatatatgatgatagatggtgtatttcgaggtaatccgaaacaagtacaagaatatcaagatttattaacgccggtattacatcatacgacggaaggttatccggtagttccgaaatattattatgttccggcggattttgtagaatatgaaaaaaataatccgggttcgcaaaaacgatttccgtcgaattgtggtcgtgatggtaaattatttctatggggtcaagcgctatatataatagcgaaattattagcggatgaactaatatcgccgaaagatatagatccggtacaacgttatgttccgttaaaagatcaacgaaatgtttcgatgcgtttttcgaatcaaggtccgctagaaaatgatctagtagttcatgtagcgttaatagcggaatcgcaacgtttacaagtttttctaaatacgtatggtatacaaacgcaaacgccgcaacaagtagaaccgatacaaatatggccgcaacaagaactagtaaaagcgtatttacaattaggtataaatgaaaaattaggtctatcgggtcgtccggatcgtccgataggttgtctaggtacgtcgaaaatatatcgtatattaggtaaaacggttgtatgttatccgataatatttgatttatcggatttttatatgtcgcaagatgtttttctattaatagatgatataaaaaatgcgctacaatttataaaacaatattggaaaatgcatggtcgtccgttatttttagttttaatacgtgaagataatatacgtggttcgcgatttaatccgatactagatatgttagcggcgttaaaaaaaggtataataggtggtgttaaagtacatgttgatcgtttacaaacgctaatatcgggtgcggtagtagaacaactagattttttacgtatatcggatacggaagaattaccggaatttaaatcgtttgaagaactagaaccgccgaaacattcgaaagtaaaacgacaatcgtcgacgccgtcggcgccggaactaggtcaacaaccggatgtaaatatatcggaatggaaagataaaccgacgcatgaaatattacaaaaactaaatgattgttcgtgtttagcgtcgcaagcgatattactaggtatactactaaaacgagaaggtccgaattttataacgaaagaaggtacggtatcggatcatatagaacgtgtttatcgtcgagcgggttcgcaaaaactatggttagcggtacgttatggtgcggcgtttacgcaaaaattttcgtcgtcgatagcgccgcatataacgacgtttttagttcatggtaaacaagtaacgttaggtgcgtttggtcatgaagaagaagttatatcgaatccgctatcgccgcgagttatacaaaatataatatattataaatgtaatacgcatgatgaacgtgaagcggtaatacaacaagaattagtaatacatataggttggataatatcgaataatccggaactattttcgggtatgctaaaaatacgaataggttggataatacatgcgatggaatatgaattacaaatacgtggtggtgataaaccggcgctagatttatatcaactatcgccgtcggaagtaaaacaactattattagatatattacaaccgcaacaaaatggtcgttgttggttaaatcgtcgacaaatagatggttcgctaaatcgtacgccgacgggtttttatgatcgtgtttggcaaatattagaacgtacgccgaatggtataatagtagcgggtaaacatttaccgcaacaaccgacgctatcggatatgacgatgtatgaaatgaatttttcgctactagtagaagatacgctaggtaatatagatcaaccgcaatatcgtcaaatagttgtagaattattaatggttgtttcgatagtactagaacgtaatccggaactagaatttcaagataaagtagatttagatcgattagtaaaagaagcgtttaatgaatttcaaaaagatcaatcgcgactaaaagaaatagaaaaacaagatgatatgacgtcgttttataatacgccgccgttaggtaaacgaggtacgtgttcgtatttaacgaaagcggttatgaatctattattagaaggtgaagtaaaaccgaataatgatgatccgtgtttaatatcg

SEQ ID NO: 18141 - DNA, 3279 bp, Artificial Sequence
  Description of Artificial Sequence: Synthetic coding sequence
atggctggagctgcaggactgaccgctgaggtatcttggaaggtgctggaacgccgggcgcgtactaaacggtctgggagcgtgtacgagcctctgaagtcaataaatctgcctagacctgataacgaaactctttgggacaagctggatcactattaccgaattgtgaagagtactcttctactttatcagagccccacaaccggtctattccccactaagacatgtgggggggatcagaaagcaaaaatccaggattctctgtattgcgctgcaggcgcttgggctctggcactggcctacagaaggattgatgacgacaaaggccgcacacacgaactggaacattccgccataaagtgcatgagggggatcttgtactgttatatgaggcaggccgacaaagttcagcagttcaagcaggacccacgtcctactacttgtctacatagcgtgttcaatgtgcacactggtgacgaactgttgagctacgaggagtacgggcacctgcagattaacgccgtgtccctctacttgctctacctcgtggagatgatctccagtggattacagattatttacaatacagatgaggtttcttttattcagaatctggttttttgcgtcgagagggtgtacagggtgcccgacttcggcgtgtgggagaggggtagcaaatataacaatggatcaaccgaactacattcctctagcgtgggcttggccaaggccgccctggaagcaattaatgggtttaacttgttcggtaaccagggctgcagttggagtgtgatcttcgtcgatctggacgctcacaatcgaaatcgccagaccctctgttccctattgcctcgagaaagcagaagccacaacacagacgcagctctcctgccatgcatatcataccctgcttttgccctggatgacgaagttcttttttctcagactctggacaaagtggttcggaagctgaaagggaagtatggtttcaaacgattcctgcgggacggttaccgaacatctttggaggaccccaaccgctgctactataagccagcagaaattaagctgtttgacgggatcgagtgtgagttcccaatcttctttctgtatatgatgatcgacggtgttttccggggtaatccgaaacaagtccaggaataccaggacctgctgactccggtgctgcaccatacgacagagggttatcccgtggtgcctaaatactactacgtccccgccgattttgtcgagtacgaaaagaataaccccggtagtcagaagcgcttcccctccaactgcgggagagacggcaagctgttcttgtggggtcaggccctatacattattgccaagctcctggccgacgagttaattagtccaaaagatatcgatcctgtccaacggtacgtgccgttgaaagatcaacgaaatgtctccatgaggttcagcaaccaaggtcccctggagaacgatctggtagtccatgtcgccctgattgcagagtcacagagattacaggtgttcctgaacacatatggtattcagacccaaaccccccagcaggtggaaccaatacagatctggccacaacaggaactggttaaggcctacctgcaactgggcattaatgaaaaattggggttgtctggacggcccgatagacccatcggatgtctgggcaccagcaagatctaccgcattctgggcaagaccgtcgtgtgttatcccatcatattcgatctgtcagatttctatatgtctcaggatgtctttttactgatcgatgatatcaaaaatgcacttcagttcataaaacaatactggaagatgcatggccgcccgttgttcctggtgctaatcagagaggataatatcagggggtcccgtttcaaccctatcttggacatgttggccgctctaaagaaggggataataggtggagttaaggtccacgttgacaggctgcaaaccctaatctcaggtgcagtggtggaacagttggactttcttaggatttctgataccgaagaattgcccgaattcaaatccttcgaggagttggagccaccaaagcattccaaggtgaagcggcaatccagtacaccgtcagcacctgaactaggccagcagcccgacgtcaacatcagcgagtggaaagataagccgactcatgagatcctccagaaactgaacgattgctcttgtcttgcttctcaggccattcttctaggaatactgctcaagagggagggaccgaattttatcaccaaagaaggcacggtgagtgatcatatagagcgcgtctaccggcgggccggcagccagaaactgtggctagctgtgcgatatggcgcggccttcactcagaaattctcaagctctatcgctccacacattacgacttttttggtccatggcaaacaggtgaccctgggagcttttgggcacgaagaggaggtcataagtaatccgctttcaccccgggtaattcagaatattatctactataaatgcaacacccacgacgaacgcgaggcggttatccagcaagaactcgtgatccatatcgggtggatcatctcgaataatccggagctgttcagcggcatgttgaagatcagaattgggtggatcattcatgcaatggagtatgagctgcaaattcgaggcggagataagccggccctagatctgtatcaactaagcccatctgaggtgaaacagctgctcttagatatattgcaaccacaacagaacggacgatgctggcttaacaggagacagatcgacggcagcctgaatcgcacccctaccggattctatgatcgcgtttggcagattcttgagcgcactcccaacggcataatagttgcagggaagcacctcccacagcagcccactctgagtgatatgacaatgtatgagatgaatttttctcttctcgtggaggatactttaggaaatatcgaccagccacagtaccgacagattgtagtcgaattgttaatggttgtttcaatagtgctggagaggaatcccgagctcgagtttcaagataaagttgacttggaccgacttgtgaaagaagcatttaacgagttccaaaaggatcaaagcagactgaaggaaattgaaaagcaggacgacatgactagtttctataatactcctcccttaggcaagcgtgggacttgtagctacctcacaaaagctgtcatgaacttgctgctagagggtgaggtgaaaccaaataatgatgacccatgcttaatctca

SEQ ID NO: 18142 - DNA, 3279 bp, Artificial Sequence
  Description of Artificial Sequence: Synthetic coding sequence
atggccggagcagccggcttgaccgctgaggtctcgtggaaggtcctggagcgacgcgcccgtaccaagagatcgggttctgtttacgagcctctcaagtccatcaacttgcctcgccccgataacgagacactgtgggataagctcgatcactactataggatcgtcaagagcacgctgctcttgtaccaatcgcctacgacaggactgttccccaccaagacatgcggaggcgaccagaaggccaagattcaggactcgctctattgtgcggccggtgcttgggctctggccctcgcctaccgccggattgatgatgataagggccgcacccacgagctagagcatagcgctatcaagtgcatgcgcggtatcctttactgctatatgcgtcaggccgataaggtccagcagttcaagcaggatccgcgccctaccacctgcctgcatagcgtcttcaacgtgcatactggcgatgagctcttgtcctacgaagagtacggacacctgcagatcaacgctgtcagtttgtatctattgtacctggtggagatgatatcctccggcctgcagataatctacaacactgatgaggtgtcgttcatccagaacctagttttctgtgttgagagagtctacagggttcccgacttcggagtgtgggagagaggctctaagtataacaacggcagtacggagctgcacagctcctctgtaggtcttgcgaaggccgctctggaagcgattaacggtttcaacttgttcggtaaccagggttgtagttggtctgttatcttcgttgatctagatgctcacaatcgcaacagacaaaccctttgcagcctcctcccgcgtgagtcccgaagtcacaatactgatgcggccctgctcccctgtatttcttacccggcttttgcccttgatgatgaggtcctattttctcagaccctggataaggtggtccggaagcttaaaggcaagtatggtttcaagcgtttcctgcgcgacggctaccgcactagcctggaagaccccaaccggtgctactacaagcctgcagaaatcaagctgtttgacggaattgagtgtgaatttccaatcttcttcctctacatgatgattgatggcgttttccgtggaaacccaaagcaggtccaggagtatcaggacctccttacccctgtgttgcatcatactacagagggataccctgtggtgccaaagtactattacgtcccagcggatttcgtggagtatgagaaaaacaaccccggctctcaaaagcgtttcccctctaactgtggtcgcgacggaaagttatttttgtggggacaggctctgtacatcattgctaagctgctggccgacgaactcatctctccaaaggatatcgatcctgtgcagcgttacgtcccccttaaggatcagcgcaacgtcagcatgcgcttcagcaaccagggtcccttggagaacgatctggttgttcatgtcgccctcatcgccgagagccagaggcttcaggtattccttaatacctacggtatccagacacagactccccagcaggtggagcccattcaaatttggccccagcaggaactggtcaaggcgtacctccagttgggcatcaacgagaaacttggtctgagcggccgccctgatcgtccgatcgggtgtctgggaacatctaaaatctatcgtattctgggtaagacagtcgtctgctatcccattatttttgacctgagtgatttctacatgagccaggacgttttcttgctgatcgatgatatcaagaatgccctgcagtttatcaaacagtattggaagatgcacggcaggccgttgtttctggtcttgatcagggaggacaacattcggggctcccgtttcaacccgatcctcgacatgctcgcggcgctcaagaaggggattattggcggtgtaaaggtgcatgtggatagactacagacccttatctccggtgctgtcgttgaacagctcgatttcctgagaatctccgataccgaggagcttccagagtttaagtccttcgaggagttggagcctcctaagcactctaaggtcaagcgccagtcgagcacgccgtcggcccctgagcttggtcagcaacccgacgttaatatctcggaatggaaggacaagccgacccacgagattctgcaaaagctcaacgattgctcgtgcctcgcaagtcaggcgattctactgggaattctactgaaacgcgagggtccaaactttatcaccaaggaaggcaccgtctctgatcacatcgagagggtatacaggcgggccggttctcagaagctctggctcgctgtccgctacggtgccgctttcacccagaagttctcttcgagtatcgccccgcacatcactactttcctggtccacggaaagcaggtgactctgggtgcctttggtcacgaagaagaggtcatctcgaacccactctcaccccgtgtgatccaaaacatcatttactacaagtgcaacacgcacgatgaacgggaggccgtcatccagcaagaactcgtgatccacatcgggtggataatttcaaataaccccgaactcttcagcggcatgcttaagattcgtatcggctggattatccacgcaatggaatacgaacttcagatccgcggaggcgacaagcccgctctcgatctgtatcagctttccccctcggaggtcaagcagctccttcttgacatcctacagccccagcagaacggtcgatgctggttgaaccgccgccagatcgacggctcgcttaaccgtacgcccacgggcttctacgatcgcgtgtggcagatactcgagcgcactcctaacggcatcatcgtcgctggcaagcatctcccccaacagccgactctgtcggatatgacaatgtacgagatgaacttctcattactggtcgaagacactctcggcaatatcgatcagcctcagtaccgccagatcgtcgtggagctgctcatggtggtcagtatcgtgcttgaacgtaacccggagctagaattccaggataaagtcgatctggatcggcttgtgaaggaggcgtttaacgagtttcaaaaggatcagtcgcggttgaaggaaattgagaagcaagacgatatgaccagcttctataacaccccccccctaggcaagcgtgggacatgtagctacctgaccaaggctgttatgaacctgctgctggaaggtgaggtcaagcctaacaacgacgatccctgcctcatctct

SEQ ID NO: 18143 - DNA, 3279 bp, Artificial Sequence
  Description of Artificial Sequence: Synthetic coding sequence
atggctggagcagctgggcttacggccgaggttagttggaaggtactcgaacgccgagcccggactaagcgctccggaagcgtgtatgagccacttaagagtattaacctgccgcggccagacaacgaaaccctgtgggacaagctggatcactactataggattgtgaaatctacactgctgctgtaccagtctccgaccactgggctgttcccgacaaagacctgcgggggtgaccagaaggcgaagatccaggatagcctgtactgcgcagcaggagcctgggccctcgcgctggcctaccggcgtatcgacgatgacaagggcaggacccatgagctcgagcactccgcaattaaatgcatgcgaggtatcctgtattgttacatgcgccaggccgacaaagttcaacagttcaagcaggacccgcgccctacaacttgcctccattctgtgttcaacgtgcacaccggggacgagttgttgagctacgaggaatatgggcacctgcagatcaatgcggtgtccctttacctgctgtatctcgtcgaaatgataagcagcgggctgcagataatctataacaccgatgaagtgtcatttatccagaatctcgttttttgcgtggaaagggtgtatagagttccggactttggtgtgtgggaacggggctccaagtacaataacgggtcaacggagctacacagttcctctgtaggtctggccaaagcagccctcgaagccatcaacgggttcaacctctttggtaatcagggctgctcgtggtccgtaatttttgtggacctggatgctcacaaccgcaatcgccagacattgtgctcattgctgccccgggaatctagatcccataacaccgacgctgccctcctgccctgtatttcgtaccctgcatttgcattggatgatgaagtgttgttctcacagacactggacaaagttgtccgaaaactcaagggcaaatatgggttcaaacgctttttgcgagatgggtaccgcacaagcctcgaagaccctaaccggtgctactacaaacctgctgagattaagttgtttgatggaatcgagtgcgagttccccattttttttctttatatgatgatcgatggcgtattcagggggaatccaaagcaggtgcaggagtatcaggacttgctgaccccggtacttcatcatactacagaaggatatccagttgtgcctaaatactattatgttcctgccgatttcgtcgaatacgagaagaacaacccggggagccaaaagagattccctagtaactgcgggcgcgacggaaagcttttcttgtggggacaagcactttacattatcgcgaagctcctggccgatgaactcatcagcccgaaagatatagatccggtccagaggtatgttccactgaaggatcagcggaacgtgtccatgaggttcagtaaccaggggccgttggaaaatgacctcgtagtccacgtcgcgctcatcgccgaatctcaacgactccaagtgtttctcaatacgtacggtatccagacacagacgccgcaacaggtggagcctattcaaatctggccccagcaggaactggtcaaagcatatctacagctggggatcaatgaaaaactaggcctaagtgggcggccagacagaccaatcgggtgcctcgggacatccaaaatctatcgcatactcggcaagacggtggtctgttatcctatcatcttcgacctttccgacttttatatgtcccaggatgtattccttctgatcgatgacatcaagaacgcattgcaattcatcaaacagtattggaagatgcatggtcggcctctgttcctggtgctgatacgcgaagacaatatacggggttctaggttcaatcccattttagatatgttggccgcactgaagaagggcattatcggcggagtcaaggtgcacgtggatcggcttcaaactttgataagcggggccgtcgtcgagcagctggacttccttaggattagcgacacagaggaattaccagaatttaaaagcttcgaggaactggaaccgcctaaacatagcaaggtgaaacgacaaagttctaccccatccgcgccggagctcggccagcagcccgacgtaaatatctccgagtggaaggataaacctactcacgaaatcctgcagaagttgaatgactgcagttgtcttgcgagtcaagctattctcttgggaatcctgttgaaaagggaaggacccaacttcatcactaaggagggcaccgtcagcgaccacattgaacgagtatatcgcagagccggcagccagaaactttggctagccgtccgttacggcgcagcctttacacagaaattctcaagttcaatagccccacacataactaccttcctggttcacggtaaacaggtcaccctcggagcttttggacatgaggaggaggtgatctccaacccgctgagcccgcgcgtgattcaaaacattatatattacaagtgcaatactcatgacgaacgcgaggccgtgatccagcaggaactcgtgatccacattggctggataatttccaacaatcccgaactgttcagcggcatgttgaagattagaatcgggtggataattcacgccatggaatacgagctccaaataaggggtggcgacaagccagcactggatctataccagttatcgccctcggaggtcaagcaattgctactggatatcctccagccgcagcagaatgggcgttgttggttaaaccgccggcagattgatgggagcctgaaccggacccccacagggttctatgatagggtatggcagattctcgaacggacccccaatgggatcatcgtggcagggaagcatcttcctcagcagcctactctcagcgacatgacgatgtacgagatgaatttttcactgttggtggaggataccctaggcaatatcgatcagcctcagtataggcagattgttgtggaactactaatggttgtgtccattgtgctggagcggaacccagaacttgagtttcaggacaaagtggatttggacagactggtcaaagaagctttcaacgagttccagaaggatcagagtaggcttaaagagattgaaaagcaagacgatatgacatccttttacaacacacctcccctcggtaaaaggggcacctgcagttacctgacaaaagccgtgatgaacctcctcctggagggggaggtgaaacccaacaatgacgacccttgtttgatctct

SEQ ID NO: 18144 - DNA, 3279 bp, Artificial Sequence
  Description of Artificial Sequence: Synthetic coding sequence
atggctggcgccgcagggctcaccgccgaggtgagctggaaagtcctagagcggagagctagaactaagcgcagtggctccgtctacgagcccctcaagtcaatcaatttgccacggcctgacaatgagaccctctgggacaagctggatcactactaccgtatcgttaaatctacgctactgctgtaccagagccccacaacaggactctttccgaccaagacttgtggaggtgatcaaaaggcaaagattcaggatagcttatactgtgcagccggggcgtgggctcttgccctggcataccgtcgtatcgatgatgacaaaggccggactcacgagttggagcactccgccatcaaatgcatgcgcgggattctgtattgctacatgcgccaagctgacaaggttcaacagttcaagcaagatcctcggccaacgacatgcctgcactccgtctttaatgtgcatactggtgacgaattattgagttacgaggagtacggccaccttcagattaatgccgtttccctgtatttgctctacctggtagagatgatttcatcaggcctccagattatctataacacggatgaggtcagcttcattcagaatcttgtgttttgtgttgagagagtgtatagagtgcccgatttcggcgtttgggaaagaggcagcaaatacaataacggatcgacggagttgcattcaagcagcgttggtctcgctaaggccgcccttgaagccattaacgggtttaacctatttgggaatcaggggtgttcgtggtctgtcatatttgtcgatctcgatgcccacaatcggaaccggcaaacgctttgcagcctgctaccaagggagtcccggtcacacaacaccgacgcggcattgttaccctgtatcagttaccctgcttttgccctggacgatgaggttctcttcagccagacactcgataaggtggttcgcaaactcaaaggcaagtacggatttaagagatttctgagggacggttataggacttcgcttgaagaccctaatcgctgctattataagccggctgagataaagctgttcgatgggatcgaatgcgagttcccaatcttcttcctgtatatgatgattgatggcgttttcagagggaaccctaaacaggtgcaggagtaccaggatctgcttacgcccgtgctccaccataccaccgagggttatcccgtggttccaaagtactactacgttcccgccgacttcgttgaatacgagaaaaataacccagggagccaaaagaggttcccctccaattgcggccgcgatggcaagctgtttctgtggggtcaggctctgtatatcatagccaagttgctggctgatgagttgattagtcctaaggacattgaccccgttcaacgctacgtcccactgaaggaccagcggaacgtatccatgcgctttagtaatcagggccctctggaaaacgacttagtggtacacgtcgctcttattgccgaatcccaacggctccaagtttttctgaatacatatggcatccagactcagacgcctcaacaagtcgagcctattcaaatttggccgcagcaggaacttgtgaaagcatatctgcagctggggattaatgagaagctgggactgagcggaaggcctgatcgtcccatcgggtgtctggggactagcaagatctaccgcatcctgggcaagacagtggtttgctatccaatcattttcgatctttccgacttctatatgtcccaggatgtttttctgctaatcgatgatattaaaaacgcactgcagttcattaaacagtactggaagatgcacggacgccccctgttcttggtgctcatccgggaggacaacattaggggcagtcgattcaatccaatcttagatatgttagccgctcttaagaaaggcattattgggggcgtgaaggtgcacgtcgatcgactgcagacactcatcagcggagctgtagtggagcagctcgattttcttagaatcagcgacaccgaggagctgccagagttcaagagtttcgaagaactggagccgcccaagcattctaaagtgaaaaggcagagttcaaccccatccgccccggaactgggtcagcagccggacgtaaatatttctgaatggaaggataaacccacacatgagatcctccagaaactcaacgactgcagttgtctggcctcccaagcaatcctccttggcatcctgctgaagagagaaggacctaattttataacaaaagagggaacagtcagcgatcacattgaaagggtttacaggcgagccggctctcagaagttgtggctcgctgttcgttatggggccgcctttacacagaagttctcttcgtctattgcgcctcatattacgaccttcttggtgcacggaaaacaggtgaccttgggggcctttggtcacgaagaggaggtcatctccaacccattgagtccccgagtcatacagaacatcatctactacaagtgcaacacacacgacgaacgcgaggcagtgattcagcaagagcttgtcatacacatcggatggataatatccaataacccagagctgttctctggaatgctgaagataaggattgggtggattatccatgctatggaatacgaactgcagatccggggaggcgataagcccgcgttggatttgtaccagttgtctccctccgaggtcaagcagcttttgctagatatcctgcaaccgcaacagaatgggcgttgttggctgaaccgcaggcaaatagacggctccttgaatcggacacccacgggattctacgaccgcgtctggcagattctggaaagaacccccaatggaattattgttgcgggaaagcatctgcctcagcagcccacactatcagatatgaccatgtacgagatgaacttttccctcctggtggaagataccctcgggaacattgaccaaccccagtaccgccagatagtggttgagctcctgatggtggtgtcaatcgtgctcgaacgaaatccggaactcgagttccaggataaagtggacctggaccgattggtgaaggaggcttttaacgaatttcagaaagaccaatctaggctgaaggaaattgaaaagcaagacgacatgacatcattctataataccccacccctggggaaacggggcacttgctcatacttgacgaaagccgtaatgaaccttctcctggagggggaggtgaagccaaacaatgacgacccttgtctgatctca

SEQ ID NO: 18145 - DNA, 3279 bp, Artificial Sequence
  Description of Artificial Sequence: Synthetic coding sequence
atggccggcgctgccggacttactgccgaggtcagctggaaagttctcgaacgccgggcccggacaaagagatccgggagcgtgtacgaacctctcaaaagcatcaacctacctcgccccgataatgaaacactgtgggacaagttggaccattactataggattgtgaagagcactctcctcctataccaatctcccaccaccgggctgtttcccaccaagacctgcggaggggaccagaaagccaaaattcaggattcactgtattgtgccgccggagcatgggccctggctttggcttacaggcgaatcgacgatgataagggtaggacacatgagctcgagcattcggccataaagtgtatgcggggcattctgtactgttatatgcgacaggcggacaaagtgcaacaatttaaacaggaccccagacctaccacctgtcttcactcagtgttcaatgtgcataccggggatgagctgctgtcatatgaagagtacgggcatctgcaaattaatgctgtcagcctgtacctcctctacctggtcgagatgatatccagtggacttcaaatcatctacaatactgatgaagtgtcttttatacagaatctggtgttttgcgttgagagagtgtatcgcgtaccggacttcggggtgtgggagcggggaagcaagtataacaacggctcaactgaactccacagctcctcagtcggcctggccaaggctgccctcgaggccatcaacggtttcaatctgtttggaaatcaaggctgttcatggtcggtcatcttcgtggatttggacgcacacaacaggaataggcagaccctgtgcagtcttctcccacgggagagccgatcccataacacggacgccgcactgcttccgtgcatttcatatcctgcattcgccctcgacgatgaagttctcttcagccagaccctggacaaagtcgtgcgcaagctcaaaggaaagtacggcttcaaacgctttctgcgggacggatataggacgtcattggaggacccaaatcggtgttactacaaaccagccgaaatcaaattatttgatggaatcgagtgcgaatttccaatattttttctgtacatgatgatcgatggcgtctttagaggcaaccccaaacaggtacaggaatatcaagatcttctcaccccagtactccatcacactacagagggataccctgtggtacctaaatattactatgtaccagccgatttcgttgagtacgagaagaacaatccaggctcccagaagcgatttcctagtaactgtggccgggacggaaagctgtttctgtggggacaggcactctacatcatagccaagctgctagccgatgaattgattagtcccaaggatatcgaccccgtccagagatatgtcccgctgaaagaccaaagaaatgtgtcaatgcggtttagtaaccagggcccgctggagaatgatttggtcgtgcacgtcgcactgattgcagaatctcagcgactgcaggtcttcctaaacacttacggaattcagacacagaccccacaacaggtcgagcccattcagatttggccacagcaggagctggttaaggcttaccttcagttgggaatcaatgagaagttgggcttatctggcaggcctgatcgccccatcggctgcctcgggacatctaagatttataggatattggggaaaacagttgtgtgctacccaattatttttgatctgagtgacttttatatgagccaagatgtgttcctgctgatcgacgatatcaagaatgccctgcagttcatcaaacagtactggaaaatgcatggaaggcctttattcttggtgttgatacgcgaagacaatatccgcggcagccggtttaaccccatactcgacatgctggctgccctcaagaaaggaatcatcggtggagtgaaggtccatgtggatagactgcaaacactgatttctggcgccgtagtcgagcagctcgatttcctgagaatctcggacacagaggagctgccagaattcaaaagcttcgaagagcttgaaccccctaaacactcaaaggtcaagcgccagtcatctaccccatccgccccggagttagggcagcagcctgacgtgaacatttcagaatggaaggataagcctacccacgagattctacagaagctcaacgactgttcatgcctcgcatcccaggctatactgctgggcatcctgctcaagcgagaggggccaaacttcattactaaggagggcactgtgagcgaccatattgaaagagtatacaggagagccggctctcagaagctttggctcgcagttaggtacggtgctgccttcacacagaagttttcgagcagcattgctccacacatcaccaccttcctagtccacggaaagcaagtgaccctgggcgccttcggccacgaggaggaagttatatctaatcccctttctcctcgcgtcatccagaatatcatctactacaagtgcaatacccacgacgagcgagaagcagtaatccagcaggaacttgtgattcacattggatggatcatcagcaataaccccgaattgttcagcgggatgctgaagatccgcatcggatggatcatccatgccatggagtatgagctccagatccgcggcggcgataagcctgccctggatttatatcagctgtccccctccgaagtgaagcaactgttgctggacatcctccagccccaacagaacggacggtgttggctgaaccgccgccagatagatgggagtctgaaccggacaccaactgggttttatgaccgggtttggcagattctcgagcgaacccccaatggcattattgtggccggcaaacacctgccccagcagcccactctttctgatatgaccatgtatgaaatgaacttctccctgctggtggaggacacactcggcaatattgaccagccccagtatcgccagatcgtcgtggaattgctcatggtggtttctatcgtgctggaacggaacccagagctagagttccaagacaaggttgatctcgatcggctggtgaaagaagcattcaacgagtttcagaaggaccaatccagactgaaggagatagagaaacaggacgatatgacgtctttttataacacccccccgctgggtaaaaggggcacatgttcctacctgactaaggctgtaatgaaccttcttctcgagggggaagttaaacctaataacgatgatccttgccttataagt

SEQ ID NO: 18146 - DNA, 3279 bp, Artificial Sequence
  Description of Artificial Sequence: Synthetic coding sequence
atggccggagccgctggcctcaccgcggaggtgtcatggaaggtgctcgagagaagagcccgaacaaaaagaagcggctccgtctatgaacccctgaagagcattaaccttcctagacctgataatgaaactctgtgggacaagttggaccattactaccggattgtgaagtccacccttctgctctaccaaagccccactacagggctgtttcccaccaagacatgcggcggggatcagaaggctaaaattcaagattctctgtactgcgcggcgggggcttgggctctcgctctggcctacaggaggatcgacgacgacaagggaagaacccatgaactcgaacacagcgccataaagtgcatgcgtggcatcttgtactgctatatgagacaagcagataaagtgcagcaatttaagcaagatccacggcccacaacatgcctccactccgtcttcaacgtgcataccggcgatgagctcctgtcgtatgaagaatatgggcacctccagatcaacgccgtgagcctgtacctgctgtacttggttgaaatgatctcgtcaggccttcaaatcatttataataccgacgaagtctctttcattcagaacttagtcttctgcgtcgagagggtttacagggttcccgacttcggagtctgggagagaggaagcaaatacaataacggtagcactgagttgcatagttccagcgtaggcctcgcaaaggccgcactggaagccattaatggctttaacttgttcggaaatcagggatgctcatggtccgttatctttgtggacctggacgcccacaaccgcaaccgacagaccctgtgctcacttctcccccgcgaaagccgctctcataacacagatgctgctctgctgccatgcatctcttacccggcctttgcccttgatgacgaggttctcttctctcagacccttgacaaagtggtgaggaaactcaagggcaaatacggttttaaacgtttcctccgcgatggctacaggactagcctcgaagaccctaaccggtgttactacaagcctgcagagattaaactgttcgatgggatcgagtgcgagttccccatcttttttctgtatatgatgatcgatggggtgtttagaggaaatccaaagcaggtgcaagaatatcaggacctgctcacgcctgtgctgcatcacacaactgagggatacccagttgtgcctaagtactactacgtgcccgccgacttcgtcgaatacgagaagaataacccaggtagccaaaaaagattcccaagtaactgcggaagagatggcaagttgtttctctggggccaggccctctatattatagctaagctcctggccgatgagctcatttcacctaaggatatcgacccagttcaacggtatgtgccattgaaggatcaaaggaatgtttctatgaggttcagcaatcaaggccctcttgagaatgatctggtggtgcacgtcgcacttattgcagagtctcagcggctccaggtgttcctgaatacatatggaatacagacccagaccccacagcaagtggagccaatacaaatatggcctcagcaggagctcgtgaaagcttatctgcaattggggattaacgaaaagctgggcctgagcggacgacctgatcgccctattggttgcctcggcacaagtaaaatataccggatattaggcaaaacggtggtgtgttatcctatcatctttgatctgagcgacttttacatgagccaggacgtgttcctcttgatcgatgacatcaaaaatgccctgcaattcattaaacagtactggaagatgcacggaaggcccctgttcctcgtgctcataagggaggacaacatccgcggctctcgctttaacccgatccttgatatgctggctgctctgaaaaagggaatcatcggcggagtcaaggtgcacgttgaccggctgcagacccttatttcaggcgctgttgttgagcaattggattttttacggatcagtgacaccgaggagcttcctgaatttaaaagctttgaggagttggaacccccaaagcattctaaggtcaagagacaaagtagcacaccctccgcccccgaactcggccaacagcctgatgtgaacatttccgaatggaaggataagccaacccatgagatcttgcagaagcttaacgattgcagctgcctggcatcacaggcaatccttttaggaattttgctgaaaagagaagggcccaacttcattacaaaagagggaacggtcagtgaccatattgagagagtgtacaggcgtgccggtagccagaaactgtggcttgctgtgcgttacggcgcggcttttactcagaagttttccagttctattgcacctcacataaccacatttctcgtgcatgggaaacaggtgacgctcggagctttcggccatgaagaggaagtgataagtaacccgctgagccccagagtaattcaaaacattatctactataaatgcaatacacatgatgaacgcgaggcagtgattcagcaggaactggtcattcatattgggtggattatctctaacaaccctgaactgttttcaggcatgctgaaaatcaggatcggatggattatccatgcgatggaatacgagctgcagatccggggcggagataagccggcgctggacttataccagctgagtccttctgaggtgaaacagctcttgttggacatcctgcaaccccagcaaaacggcagatgttggctgaacagaaggcaaattgacggatcactcaacagaaccccgactggcttctacgatagagtgtggcaaatcttagagaggaccccaaacggtatcattgtcgccggcaaacatctccctcaacagccgacgttgagcgatatgaccatgtatgaaatgaattttagcctgctggtagaggacactcttggaaacatcgatcaacctcagtaccggcagatcgtggtggaattgctgatggtggtgagcatcgtccttgagcggaatccagagctggaattccaggataaagttgatctggaccgcctcgtgaaagaggcctttaatgagtttcagaaagaccagtctcgcctgaaagaaatcgaaaagcaggatgatatgacaagcttttataacactcctccattgggcaagagaggcacctgcagttacctcactaaagctgtgatgaaccttcttcttgaaggagaagtgaaaccgaataatgatgacccgtgtctcatcagt

SEQ ID NO: 18147 - DNA, 3279 bp, Artificial Sequence
  Description of Artificial Sequence: Synthetic coding sequence
atggctggtgcagcggggctgaccgcggaggtatcgtggaaggttctggaacgccgagcaaggacaaagcggagcggctctgtgtacgagcccctgaagtctattaatctgccccggcctgataatgagaccctctgggacaagctggaccattactataggatcgtcaaaagcacacttctgctctaccaatctccaacgaccggactgttccccacaaaaacctgcggcggagatcagaaggccaagatccaggacagtttgtactgtgcagctggagcatgggctttagcactcgcgtatcggaggatcgatgatgacaagggtcggactcacgaactggaacactctgcaattaaatgcatgcgcggaatcctttactgctatatgcgacaagcagacaaagtccagcagtttaaacaagaccctagacccactacatgcctccactccgtgtttaacgtacataccggcgatgagcttttgtcctacgaagagtatggccatctgcagatcaacgccgtttccctctatcttctgtatttagtagagatgatcagctccggtctacaaataatctataacacagacgaagtgagtttcatacagaacctcgtgttttgcgtggagcgcgtttatcgagtacccgattttggggtgtgggagaggggctccaagtacaataacgggtctacagaattgcactcctcctcagtgggcttagctaaagcagccttggaggctattaatggctttaatctttttggaaaccagggctgctcctggagcgttattttcgtggacctggatgcgcataaccggaaccgccagaccctttgttcacttctgccccgagagtcccgttcgcacaacaccgacgcagctctgctcccctgtatcagttaccccgccttcgccctcgacgacgaggtcttgttcagtcagactctggacaaagtggtacgcaagttgaaagggaaatatggtttcaagcgctttctgcgcgacggatatagaaccagcctcgaggaccccaaccggtgctattacaagcctgccgagatcaagctctttgatggtatcgagtgtgaattccctatctttttcctctatatgatgatcgatggcgtttttcgaggtaatccaaagcaagttcaagaataccaggatctgttgacacccgtgctacaccacaccaccgagggatacccagtggtgcccaaatattactacgttccggccgatttcgtcgagtatgaaaaaaataatcctggttcccagaagcgattcccttccaattgcggtcgggatgggaaattgtttctgtggggccaggcattgtacatcattgccaaactgctcgccgacgagctgatttcaccaaaagatatcgatccagtgcagcgatatgtaccactgaaagaccaacgaaatgtgtccatgcgcttctcaaatcaagggccactggagaatgacttagtggtgcatgtggccctgatcgcagagtcccagaggctccaggtgttcctgaatacatacggtatacagacccagaccccccagcaggtggagcctatccagatctggccccagcaggagctggttaaggcttacctgcaattgggcattaacgagaaactgggcctatccggacgccctgataggcccatcggctgtcttggcacctctaagatctaccggatcctggggaaaaccgttgtctgttatcccataatatttgacctgtctgacttttacatgagccaagatgtctttttactgatagacgatatcaaaaatgctttacagtttatcaagcagtactggaagatgcatggacggcctttgttcctggtcctgatcagggaggataatatccgcggctctaggtttaatccgatactggacatgcttgccgccctcaaaaagggcattataggaggagttaaagtgcacgtcgaccgccttcagactcttatttcaggagctgtcgtcgagcagcttgattttttgaggatctcggacaccgaagaactccccgagtttaaatcattcgaggagttagagccgcccaaacattctaaggtgaagcgacaatcaagcacgccgtccgcgccggaactcggccaacagccggacgtcaatatctcagagtggaaagacaagcccacacatgagatcctacagaagcttaatgactgctcctgtctcgcaagccaggcaattctgctggggatcctcttaaaacgggaaggccctaatttcatcaccaaagaggggaccgtatcggaccacattgagagagtctaccggagggctgggtcgcagaagctgtggctggccgtcagatatggtgcagcatttacgcagaagtttagctcctctatcgctccccacatcacgacattcctggtgcatggcaagcaggtgactttaggcgccttcggacatgaagaggaagtcatttctaacccattgtcacccagggtcattcagaacataatttattataaatgtaacacccatgatgaacgggaagcagttattcagcaggagctagtgatacacatcggctggattatcagtaataaccccgaactgttctcaggcatgctcaaaattcggataggatggatcattcacgcaatggagtacgagctacagattcggggcggagacaaacccgcgttggacctatatcaactgagcccgagtgaagtaaaacaactcctcttggatattttgcagccacagcagaacgggcggtgctggctgaatagacgacagattgatgggtcactgaatcgaacacctacgggcttttacgatcgggtgtggcaaatactggagagaaccccaaacggaattatcgtcgctgggaagcacctgccccagcagccgaccttgagtgacatgactatgtatgaaatgaatttctccttgctagtagaggacaccttaggcaatatcgatcagccgcagtaccggcagatcgtggtagaactgttgatggtggtttcgatcgtgctcgagaggaatcccgagctggaatttcaggacaaggtagatttggaccgcctggtcaaagaagccttcaatgagtttcagaaggaccaaagccggctgaaggaaatcgagaaacaggacgacatgaccagtttctataatacacctcccttggggaaacggggcacctgttcttatttgacaaaagccgtgatgaacttgcttctggagggcgaagtcaaacccaacaatgatgacccgtgtcttataagc

SEQ ID NO: 18148 - DNA, 3279 bp, Artificial Sequence
  Description of Artificial Sequence: Synthetic coding sequence
atggcaggagccgctggactgacagccgaagttagttggaaagtactagagagaagagcacgaacaaagcgctccggctccgtgtacgagccactgaagtcaatcaacctcccgcgaccggataacgagaccctgtgggacaagctggaccattattatcgaattgtgaaaagtactctgctcctgtatcaaagcccaacgacaggtttgtttcctactaaaacctgtgggggggatcaaaaggcaaagattcaggatagcctgtattgcgctgcaggagcatgggctcttgccttggcgtaccgacggatagatgatgataagggtaggacacacgaactggaacatagcgccatcaagtgcatgcggggtatcctatactgttatatgcggcaggcggacaaagtgcaacagtttaaacaggaccctaggcccactacttgtctccattccgtctttaatgttcataccggagatgaactgctaagttatgaagagtacggccacctgcaaataaacgctgtgagcttgtatctgctctatctagtggaaatgatttcatccggattacaaataatctataatacagacgaagtcagttttattcaaaatctagttttttgcgttgagcgagtctatcgcgtgccagatttcggggtttgggagcgggggagtaaatataataacggttcaacagagctccacagttcgtctgtagggttagccaaggcagcgctggaggcgattaacgggtttaatctgttcggcaaccaaggctgcagttggtcagttatcttcgtggatctggatgcccataaccggaatcggcagactctctgcagcttactaccccgcgagtccaggagccacaatactgatgcggccctcctcccctgtattagctatcccgcgttcgctcttgatgatgaggttctgttctctcaaacactcgataaggtggtccgcaaattgaagggtaagtacggcttcaaaaggttcctccgcgatgggtacagaacctccctggaggatcccaatcggtgttactataaacccgcagagattaagctcttcgacggaatagaatgtgagttcccaattttcttcctgtacatgatgatcgacggggtgttccgcggcaacccgaagcaggtccaggagtatcaggatctgcttacccctgtgttgcaccacacaacagagggctacccagtagtcccaaagtattactatgtgcctgctgattttgtcgagtatgaaaaaaacaatcctggcagccaaaaacgatttcctagcaactgcggtagagatggcaaactgttcctctggggccaagcactttatattatagctaagctgctggcggatgagctgattagtcccaaagatatagatcccgtgcagcggtacgtccccctcaaagatcaacggaacgtgtctatgagattctctaatcagggacccctggaaaatgaccttgtcgtccacgtggctctgattgcagagtcccagcgccttcaagtgtttctgaatacatatggtatccagacccagacccctcagcaggtcgaacccattcagatctggccccagcaagaattggtcaaggcctacctgcagcttggcattaacgagaaacttggcctctccgggcgacctgatcgccctattgggtgcttgggcaccagcaaaatctacaggatcctgggaaagacagtagtctgctatcctataatctttgatctcagtgatttttacatgtcacaggacgtattcctgcttattgacgacattaaaaatgccctgcagtttataaagcaatactggaagatgcacgggagacccctcttcctcgtccttattagggaggacaatattcggggatcacgattcaatccaatcctagatatgctggcggccctgaaaaaggggattatcggcggggtgaaagtgcatgttgacaggctccagacattgatcagcggcgcagttgtggagcagcttgattttctacgcattagcgacacagaagagctccctgagtttaagagctttgaggaactggaacccccaaaacattctaaggtcaagagacagtcgagtaccccctctgcacctgaactggggcaacagccagatgtgaacatcagtgaatggaaagacaaaccaacgcacgaaattctgcagaagctcaacgattgcagttgtttggcaagccaggcgattctgcttggtatcctgttgaagcgcgaggggccaaattttatcaccaaggaaggaactgttagtgatcacattgagcgggtctatcgcagagcaggctcccagaagctgtggttagctgtgaggtacggagctgcatttacacagaagtttagctcttcgattgctcctcatatcacgaccttcctagtgcacgggaagcaagttaccctgggcgctttcggacacgaggaggaagtgattagtaatcctctgtcccctagggtgatccagaacataatctattacaagtgtaacacccatgatgagcgggaggccgtaatccagcaggaactggttatccacatcggctggattatttcaaataatccagagctgttcagcggaatgttgaagattcggattggatggatcattcacgcaatggagtacgagcttcagattcggggtggagataaacccgccctagatctgtaccagctgtctccttcagaggtcaaacagttacttctcgacattttgcagccccagcaaaacgggcggtgttggctgaaccgccggcaaattgatggaagcctgaacaggacgcctactggtttctacgacagggtgtggcaaattttggaaagaacaccgaacgggatcatcgtagccggcaagcatctgccccagcaacccacactctcggacatgactatgtatgagatgaattttagtctgctagtggaggatacattggggaatattgatcaaccccagtacaggcagatagtggtggaacttctgatggtggtatctatcgtgctcgaaagaaacccagaactcgagttccaggataaagtcgacctcgacaggttggtcaaggaggccttcaacgaattccagaaagaccagagcagactgaaggaaatagagaagcaggatgacatgacatccttttataatactccacccctggggaagaggggaacgtgctcttacctgacaaaagccgtaatgaatctgctgctggagggtgaggttaagcccaacaatgatgatccgtgtctaattagt

SEQ ID NO: 18149 - DNA, 3279 bp, Artificial Sequence
  Description of Artificial Sequence: Synthetic coding sequence
atggcaggtgcagctgggctgaccgcagaggtcagctggaaggttcttgaacgccgcgcaagaaccaagcgcagcggatcggtgtacgagccactgaaatcaattaaccttccaagacccgataacgaaaccctttgggacaaactggaccactattaccgtattgtgaaatcgaccctgctcttgtaccaatccccaactactggactgtttcctacgaaaacttgtggaggcgaccagaaggcaaagattcaggactccttgtactgtgcagcaggagcatgggcccttgccttggcatacaggagaattgatgatgataaggggagaactcatgaacttgagcattccgccatcaagtgtatgcggggaatcctgtactgctacatgcgtcaggcagataaggtgcagcagttcaagcaggaccctaggcctactacttgtctgcattccgtgtttaatgtgcataccggagacgaattgcttagctacgaagagtacgggcatcttcagattaacgcggtgtccctgtacctgctctacctggtggagatgatttcgtcgggtctgcaaatcatttacaatactgatgaagtctcctttatccagaatctggtcttttgtgtggagcgcgtttatcgggtgcctgattttggcgtgtgggagagaggatcgaaatacaataacggatccaccgaactccactcgtcatcagtgggactcgctaaagcagcccttgaagcgattaacggtttcaatctttttggaaaccaaggttgctcgtggtcggtcattttcgtggacttggacgcccataaccgaaatcggcagacgctgtgctctcttttgcctcgggaaagccgctctcacaataccgacgcagcactcctgccatgtatttcatatcccgcttttgccctggacgatgaagtgcttttctcgcaaactcttgataaagtggttcgtaagctgaagggaaagtacggctttaaacgttttcttcgagatggatatcgcacttcccttgaggatcctaatagatgctactacaaaccagctgaaatcaagctgttcgatggtatcgagtgcgaattccccatcttctttctttacatgatgattgatggtgtttttagaggcaaccctaagcaggtgcaggaataccaagatctgttgaccccagtcctgcaccataccaccgagggttacccagtcgtccctaagtactactacgtcccagcagactttgtggagtacgagaagaacaatcctggctcccagaagcgctttccgtcgaactgcggtagagacgggaagctctttctttggggccaggccctgtacattattgcgaagctcttggcggatgaattgatttccccgaaggacatcgaccccgtgcaacgctacgtccccctcaaagatcagcgtaacgtgagcatgcgattttcgaaccaagggcctctggagaatgatcttgtcgtgcatgtggcactgattgcagaaagccagagactgcaggtgtttcttaacacctacggaattcagactcaaacccctcagcaggtggaaccaattcaaatttggccccaacaggaacttgtgaaagcatacctccagttgggtatcaacgaaaagctgggactctccggtcgcccggaccgcccaataggctgtttgggtaccagcaagatatatcgaattctggggaaaactgtcgtgtgctaccctatcatttttgatctttccgacttctacatgtcccaagacgtgtttctgctgatagatgatatcaagaatgcactgcaattcataaagcagtactggaaaatgcacggaaggccacttttcctggtgcttattcgcgaggataacatcaggggatcgagattcaatccgattcttgacatgctggccgcgctgaaaaagggcataataggaggtgtcaaggtgcatgtggacaggctgcaaaccctgatcagcggcgccgtcgtggaacaactggattttctgaggatttccgataccgaagaacttcctgaattcaaatcttttgaggaactggaacctcccaagcattctaaggtgaagcggcagagctcaaccccatcagcgcctgaactgggccagcaacccgatgtgaacatctccgagtggaaggataagccaactcatgaaattctgcagaagctcaacgattgcagctgtttggctagccaggccatactccttggtatcctcttgaagagggaggggcctaatttcatcactaaagaaggtaccgtttccgaccacattgagcgtgtctatagaagggcgggttcccagaaactttggcttgcagtgcgctacggggcggcatttacccaaaagttttcatcatccattgcaccacatataactacgtttctcgtgcacggaaagcaagtgactctgggtgccttcggacatgaagaagaagtgatttctaatcctctctctcctagagtgatccaaaacatcatttactacaagtgtaacactcatgatgagagggaagcagtcattcaacaggagcttgtgatccatatcggttggatcatttcaaacaacccagaattgttttccggaatgctgaaaatccgcatcggctggattatccacgcaatggagtacgaactgcaaattagaggtggcgacaaacctgcactcgatttgtaccaactttctccttcggaggtcaagcagctgctgctcgatatactgcaaccacaacaaaatggaagatgttggttgaatcggcggcaaattgatggttcgctgaaccggaccccaacgggtttttacgaccgggtctggcagatacttgaaaggactccaaacgggatcattgtcgccggaaaacacctccctcaacaaccaactctgtcagacatgaccatgtacgagatgaatttctcccttctcgtcgaagataccctgggtaacatcgatcagccacagtaccgccaaatcgtggtcgaacttctgatggtcgtgtccattgttcttgagagaaaccccgagctcgaatttcaggacaaggtggatcttgaccggcttgtgaaagaagccttcaatgagttccagaaagatcaaagccggctcaaagaaattgagaagcaggatgatatgacttccttttacaatacgccccctctgggtaaacggggtacctgttcgtacctgactaaggccgtgatgaaccttctgcttgaaggagaagtgaagccgaacaatgatgatccttgtctgatatcc

SEQ ID NO: 18150 - DNA, 3279 bp, Artificial Sequence
  Description of Artificial Sequence: Synthetic coding sequence
atggcgggtgcagccgggcttacggcggaagtgtcctggaaagtcctcgaacggagagcgaggactaagaggtcaggctcggtctatgagccgctgaagtcaatcaacctgcctcggcctgacaacgaaaccctctgggataagctggatcactactatcggatcgtgaaatcgactctcctgctgtaccagagcccaaccaccgggttgttcccgactaagacttgcggaggagatcagaaagccaagatccaggatagcctgtactgcgcagcaggtgcttgggccctggcgctcgcatacagacgcattgatgatgataaaggaagaacgcatgagcttgaacattcagcgattaagtgtatgcgcggaatcctctattgctacatgcggcaggctgataaggtccagcaattcaagcaagatccaagaccgaccacctgtctgcactccgtgtttaatgtgcataccggggacgaactgttgtcatacgaggagtacggtcacttgcagataaacgccgtgagcctgtacctgctgtacctggtggagatgatttcatcgggacttcaaatcatctacaataccgacgaagtgtccttcatccagaatctcgttttctgtgtggaaagagtgtacagagttcctgatttcggagtctgggagcggggctcgaaatacaataacggctcgaccgaattgcactcatcgagcgtgggattggcaaaggctgccctggaggcgatcaatggattcaatctgttcggcaatcagggttgctcatggtctgtaatcttcgtggacttggatgcgcataaccgcaaccggcagactctctgtagcctgctcccacgggaatccagaagccacaacactgacgcggccctcctcccgtgcatctcgtacccggcgtttgcactcgacgacgaagtgctgttctcgcaaactctcgacaaggtcgtccgcaagctgaagggaaaatacggatttaagcgcttccttcgggacggatacaggacctccctggaggatccgaacaggtgttactacaagccggcagaaatcaagctgtttgacggaatcgaatgcgaattcccgattttcttcctctacatgatgatcgatggagtgttcaggggcaacccaaagcaagtccaggagtaccaagatctgcttacgcctgtgctgcatcacaccacggaaggatacccggtagtgccgaagtactactacgtgccagccgacttcgtggaatacgaaaagaacaacccgggctcccagaaacgattcccatcaaactgcggacgcgacggaaagctgttcctgtggggccaggctctgtatatcatcgcgaagctcctcgctgacgaactgatctcgcctaaggacatcgatccagtccagcgctacgtgccactgaaggatcaacgcaacgtgtcaatgagattctccaatcaaggaccacttgaaaacgacttggtcgttcacgtggccttgatcgcggagtctcaaagactgcaggtgtttctcaacacctacgggatccagacccagaccccccaacaggtggagcccatccagatatggccccagcaggagctcgtcaaggcctacttgcaacttggaatcaacgagaaactgggcctctcgggacgtccggatcgtcctatcggatgcctcggcactagcaagatctaccgcatccttggaaagactgtcgtatgttaccctatcatcttcgacttgtcggacttctacatgtcgcaagatgtgttcctgctgatcgacgacatcaagaatgcactgcagtttatcaagcaatactggaagatgcatggcaggccgttgttcctggtcttgatccgggaagataacatacgcgggtcgcggttcaaccctatcctcgatatgctggccgcgctgaaaaagggtatcatcggcggagtgaaagtgcacgtggaccggctgcaaactctgatcagcggagcagtggtggaacagctcgattttctgagaatctctgacactgaagaattgccggaattcaagtcgttcgaagaactcgagccgccaaaacacagcaaggttaagaggcagtcgtccaccccctcggcccctgaactgggacagcaacctgacgtgaacatcagcgagtggaaggacaagcccactcacgaaatcctgcagaagctgaatgattgctcatgcctggcctcacaagctatcctcctgggcattctcctcaaacgtgaagggccgaatttcatcacgaaagaaggcaccgtgagtgaccatatagagcgggtgtaccggcgcgcaggaagccagaaactgtggctcgctgtgaggtacggagcagcgttcacccagaagttttcctccagcatcgcgcctcacatcactacttttctggttcacggcaagcaggtcactctgggggcattcggtcacgaggaggaagtcatctcgaaccctctgtcgccacgcgttattcagaacatcatctactacaaatgcaatacccacgatgagcgggaagccgtgattcaacaagaattggtcatccatatcggctggattatctccaacaacccggagctgtttagcggaatgttgaaaatccgcatcggatggatcatccacgcgatggagtacgaacttcagattcggggaggagacaagccagcactggacctttaccagctgtcaccaagcgaagtgaaacagctcctcctggatatcctgcaacctcaacaaaatggacggtgctggctgaaccggcgacagatcgacggatcactcaatcgcaccccgactggattctacgaccgcgtgtggcaaatccttgaaaggacgcctaatggaatcatcgtggcgggtaaacatctgcctcaacagccgaccctgtcggatatgaccatgtatgagatgaacttttcactcctggtggaggataccttggggaatatcgaccagccacagtaccggcaaattgtggtggagcttctcatggtcgtgtcgatcgtcttggaacgtaatccagagttggaatttcaggataaggttgacctggaccggctggtgaaagaggccttcaacgaattccagaaggaccaatcccggctcaaggagatcgagaagcaagacgacatgacgtcgttttacaatacgcccccgctcggtaagcgcggcacctgctcttacttgaccaaagccgtcatgaacctccttcttgagggggaagtgaagccgaataatgacgacccgtgcctgatctcc

SEQ ID NO: 18151 - DNA, 3279 bp, Artificial Sequence
  Description of Artificial Sequence: Synthetic coding sequence
atggcgggtgcggccggccttacagcagaggtgagctggaaagttttagaaagaagagccagaacaaaaagatcaggctccgtttatgagcctctgaagtctattaatttaccacgtccggacaatgaaactttgtgggacaaattggaccactattaccggattgtcaaaagtacgttgctgttgtatcaatccccgacaaccggcctgtttcctacaaaaacgtgtggcggagatcagaaggctaaaattcaggactctttatactgcgcggcaggggcgtgggcattggcactagcatatcggcgcattgatgacgataaagggagaactcacgaactggaacattcggcgattaaatgtatgagaggaatcttatattgctacatgcgccaggcggataaagttcagcaatttaaacaagatccgcgcccgacgacttgcctccattctgttttcaacgtccatactggagacgaacttctcagctatgaagagtacggacatctgcaaataaatgctgttagtttataccttctgtatttggttgagatgatttcgtccggactccaaattatttataacacagatgaagtgtcttttattcagaacttggtattttgcgtggagagagtctacagggtcccggactttggcgtatgggagcgtgggtcaaagtataacaacggttcaaccgaactgcatagctcaagtgtggggcttgcaaaagcggctttggaggcaataaacggatttaatctgttcggcaaccaaggctgttcatggtcagtaatctttgtcgaccttgatgcacataaccggaatcgtcagaccctttgcagcttattacctcgggagtcacggtcccacaatacggacgctgctctcttaccttgtatttcgtatcctgcatttgcgctggatgacgaggttttgttttcacagacactggacaaggttgtgcggaagctgaaaggcaaatacggctttaaacgattcttgcgggatggatatcgcacaagtttggaggacccaaatcggtgttattataaaccagcggaaatcaaactgtttgatggaattgaatgcgaatttcctatctttttcttatatatgatgatcgacggagtgtttagaggaaaccctaagcaggtccaggaatatcaagatctgctaacacctgtacttcatcacacgacagaagggtacccggtggtgccgaaatactattatgttcctgctgattttgtcgaatatgaaaagaataacccgggaagtcagaaacgatttccgagcaactgcgggcgcgacggaaagctgtttctttggggccaagctttatatattattgcaaaactcttagccgacgaactgatctcaccgaaagacatagacccggtccaaagatatgtacctcttaaagaccaacggaatgtctcgatgagatttagcaatcaaggtcccttggaaaacgatctagtcgtacatgtagcccttatcgcggagtctcagcgcctgcaagtctttttgaatacatatggaattcaaacacaaacgcctcagcaggtggaacctatccagatctggccgcaacaagaattggttaaagcatatcttcagctgggcataaacgagaaactcggattgtcgggtcgaccggatcggcctatcggttgcttgggcacatctaaaatttatcgcatattaggtaaaacggttgtgtgctatccgattatttttgatctttccgatttctatatgtcccaggatgtctttttactaattgatgatatcaagaatgctctgcaatttattaagcaatactggaagatgcacggtaggccgctctttttagtcttgattcgggaggataatatcagagggtcgcgctttaatccgatcctggatatgctcgcagcactgaaaaaaggcattattggcggtgtaaaggttcatgttgataggttgcaaacattaatctccggagcggttgttgaacagttggattttcttcgcatatccgatactgaggaattgccggagttcaaatcgttcgaagaacttgaaccgcctaagcactctaaggtcaaaaggcagtcctccacgccgtctgcccctgagctggggcagcagccggatgtgaatatcagcgaatggaaagacaaacctacacatgagattttgcagaaactcaatgattgttcatgcttagcctctcaggccattttattgggcatcctccttaaacgggaaggtccaaactttatcacaaaagagggaacggtctctgaccacattgaaagagtctaccggcgcgccggaagccagaaattgtggctggcagttcggtatggcgcagcctttacccagaaattctcctcttcaattgcgcctcacattacaacctttctggtgcacggaaaacaagtaacactgggagcctttgggcacgaggaggaagtgatttcaaatccgctttcacctagagtgattcagaatattatctattataaatgcaatacgcatgatgagagagaagccgtgattcaacaggagcttgtcattcatatcggatggatcatctcaaataaccctgagctgttttctggcatgctaaaaattcgtattggctggattatccatgcgatggaatacgaactgcagatccgaggcggcgataaaccagctttagacctgtatcaactttctccgtccgaggtaaaacaacttcttctggatatcctgcagccgcaacagaatgggagatgttggcttaataggcgccaaatcgatggctctttaaatagaacgccaactggcttctatgatcgtgtttggcaaatcctggaacgcacaccaaacggcataattgttgcaggaaaacatctgccacaacagccgactttgtctgatatgacaatgtacgaaatgaatttttcacttctcgtggaagatacattaggaaacatcgaccaaccgcagtacagacaaatcgttgtggagttgcttatggtcgttagcattgtattggagcgaaatcctgaactagaatttcaggacaaagtggatcttgatagacttgttaaagaagcgtttaatgaatttcagaaagaccagtcacggttgaaagagatcgagaagcaagatgatatgacgagtttctataatacgccgcctttggggaaacgtggtacgtgtagttaccttacaaaagcagttatgaacttgttactggaaggcgaagtaaaaccaaacaatgacgatccttgtctgatttct

SEQ ID NO: 18152 - DNA, 3279 bp, Artificial Sequence
  Description of Artificial Sequence: Synthetic coding sequence
atggcgggcgcggcaggtctaacggccgaggtgtcctggaaggtgttggagcgccgcgcccgtaccaaacgcagcggctctgtgtacgaacccctgaagtccattaacctgcctcggccagataatgagacactgtgggacaagctagatcattactatagaattgtaaagtctaccctgctcctgtatcagtctccaaccacaggcttatttcccaccaagacctgcggaggcgaccaaaaggcaaaaatccaagactcactgtactgcgccgctggggcttgggccctcgcactggcctaccgtagaattgacgacgacaagggaagaactcacgaactggaacattctgccatcaaatgtatgcgggggatcctgtactgctacatgcgccaggccgataaagtgcaacagttcaagcaggaccccaggccaacgacatgtcttcacagcgtgttcaatgtgcataccggagacgagctgctctcatatgaagaatatgggcatttgcagattaacgcggtttcactgtacctcctgtacctggttgagatgataagctctggccttcagatcatttataacaccgacgaggtgtccttcatccagaacctagtgttctgtgtcgagagggtgtatcgcgttcctgattttggggtgtgggaaagagggtcaaagtacaacaatggctcaactgagctacactcttcgtctgtggggctagccaaggccgcattagaggctattaatggctttaacctgttcgggaaccagggatgctcatggagcgtcatcttcgttgacctcgatgcccacaataggaaccgacagacactgtgctcccttctcccacgggagtcccgctctcacaacacggatgccgcgctgctgccttgtataagttatcctgccttcgccctagacgatgaggtcctcttctcccagacgctcgataaggtggtccggaagttgaagggaaaatacggattcaagagatttctgagggacggctacaggacttcccttgaggacccgaatcgctgttactataagcctgccgaaattaagttgttcgatggcatcgaatgcgagttccctatctttttcctctacatgatgattgacggcgtgtttcgaggaaatcccaagcaagtccaagaataccaggatctgttgacgcctgtgctacatcacacaacggaaggttaccccgtcgttccgaagtactactacgtaccagccgacttcgtggagtatgagaagaacaacccgggaagccagaaacgattcccctctaattgcggacgagatgggaagctctttctgtggggtcaggctctgtatatcattgctaagctgttggctgatgaactcatttcaccgaaggacatagacccagtccagcggtacgtgccgcttaaggaccaacggaacgtgtcaatgcgtttttctaaccaggggcctctggagaatgatctggtagtgcacgtagcgttgatcgcagaatcacagagattgcaggtgttcctgaacacatatggtatacagacccagaccccacagcaagtggaaccgatccagatttggccgcagcaggaattagtcaaagcttacctgcagcttggtataaatgaaaaactcggactaagtggcaggccagaccggcccataggatgcttgggaaccagtaagatctaccggattctaggcaaaaccgtcgtttgctacccgattatcttcgacttgtctgacttctacatgagccaggatgtgttcctcctgattgatgacattaagaacgctctccagttcattaaacagtactggaagatgcatggccgccccctcttcctcgtgctgatccgtgaggacaatataaggggctcaagattcaacccgattctcgatatgctggccgcactcaagaaaggaataatcggcggagtcaaagtgcatgttgaccgattgcagacacttatctccggtgcagtcgttgaacagttagacttcctccgaatcagcgataccgaggaactccctgaatttaagagttttgaagagcttgaaccccccaaacattccaaagtcaagaggcagtcctctacaccaagtgcccccgagctgggccagcagcccgatgtgaatatttcagagtggaaagacaaacctacccatgagattctccagaagctgaacgactgctcttgccttgccagccaggctattctcctgggtattcttctcaagcgcgagggcccaaactttatcacaaaggagggtacagtgagcgatcacatagagagagtgtaccgcagagctggcagccagaagctttggctggcggtgagatatggagccgcatttacccagaaatttagttcaagcatagcaccccacataaccacttttctcgttcatggtaagcaggttacactgggcgcgtttgggcatgaagaggaggttatttctaacccgctcagtccgcgtgtcattcagaatatcatctactacaagtgtaacacccacgacgaaagagaagctgttatacagcaggaacttgtcatacatatcgggtggatcattagtaacaacccagagctgttcagcggaatgctgaagattcgcatagggtggatcatacacgccatggagtacgaattacagatccgtggcggagacaaacccgcactggatctataccagctgtctcccagcgaagtcaaacagctgctgcttgatattctgcagccacagcaaaatggtcgctgctggctcaatcgtaggcagatcgacgggtcacttaaccgaacacccacagggttctatgatagagtatggcagatcttggagcgcacccccaacggcatcatagtagcaggcaagcacttgccgcagcaacccaccctgagtgacatgaccatgtacgaaatgaactttagtctactagtagaggacaccctcggcaacatcgaccaaccccagtaccgacagattgtggtggagctattaatggtggtgtcaattgtcctcgaacggaacccagaacttgaattccaggataaggttgaccttgaccgcctcgtgaaggaagcttttaatgaattccagaaggaccagtcccgcctgaaagaaattgaaaagcaggatgatatgacctccttctataatacccccccactcgggaaacgcggtacctgcagttatctgacaaaagccgttatgaatttgctgctggagggggaagtgaaacctaataatgacgacccttgtcttatcagc

SEQ ID NO: 18153 - DNA, 3279 bp, Artificial Sequence
  Description of Artificial Sequence: Synthetic coding sequence
atggcgggagctgcgggccttactgcagaagtgtcgtggaaggtgctcgagcgtcgggccaggacgaaacggtcgggaagcgtctacgaacctcttaagtcgattaaccttcccagaccagataacgaaaccctgtgggacaaacttgatcactactacagaattgtgaagagcactctgctcctgtaccagagccccaccacggggctgtttcctaccaagacctgtggaggcgaccagaaggccaaaatccaagactccctgtactgtgcagcaggggcatgggcgctggcgcttgcgtaccgccggattgatgacgataaaggacgcacccacgaactggagcatagcgcaattaagtgtatgagaggaattctttactgctacatgcggcaagctgataaagtgcagcaattcaaacaggatcctcgtcctactacctgtttgcactcagtctttaacgtgcacactggtgatgagctgctgtcatacgaggagtacggccatcttcagattaacgccgtgtccctgtacttgctgtacctggtcgaaatgatcagcagtggtctgcagatcatttacaacactgatgaggtgagctttatccagaatttggtcttttgtgtcgagcgggtgtaccgagtgcctgattttggagtgtgggaacgggggtctaaatacaacaatggtagcaccgaactgcactcatcctccgtcggtcttgccaaggcggcccttgaagcgattaatggatttaacctctttggtaatcaaggctgtagctggtcagtcatctttgtggacctcgacgcacataataggaaccggcagaccctgtgttcccttcttcctagagaatcccgatcccacaatactgatgcggcgttgctcccgtgtatttcctaccctgcctttgcgctggatgatgaagtccttttctctcagaccctggacaaggtggtccggaagctgaagggaaagtacgggtttaagcggtttcttagggacggttacagaacgagcttggaagatccaaaccggtgttactataaacctgcagagattaaacttttcgacggaattgaatgtgagtttcctatcttttttctctatatgatgatcgacggtgtgttccgcggcaatccaaagcaagtgcaagagtaccaagatcttctcactccagtgcttcatcacaccaccgaaggttaccccgtggtccctaagtactattacgtgcctgctgacttcgtggaatacgaaaagaacaatcctggatcacagaagagatttccatcgaactgtgggagagatggcaaacttttcctgtggggtcaggcactgtacatcatcgccaagttgctggcagacgaactgatatccccaaaggacatcgacccggtccaacgatacgtcccactgaaagatcaaagaaatgtgtctatgagattcagcaaccaaggcccactcgagaatgaccttgtggtgcacgtcgctcttattgcagaatctcaacgcttgcaggtctttctgaacacctatggaatccagacgcagactccccaacaggtggaaccaatccagatctggccccaacaggaacttgtgaaggcctacctgcaactcgggatcaacgaaaaacttggtctgtccggacgcccagatcgcccaatcggatgtcttggaacctccaagatctacagaattctcggaaagactgtggtgtgttatcccatcatattcgacctgtcggacttttacatgagtcaggatgtgtttcttcttatcgatgacattaagaacgcacttcagttcattaagcagtactggaagatgcatggcagacctttgtttttggtgctgatcagagaagataacattcggggttcccgctttaaccctattctggatatgctcgcagcactgaagaaaggtattatcggaggtgtcaaagtccatgtcgatagactgcagacgctgatatcgggcgcagtggtggagcagcttgacttcctgcgaatttccgatactgaggaacttccggaattcaaatccttcgaagaactggagcctccaaagcattcgaaggtgaaaagacaatcctcgactccctcggcaccagaacttggacagcagcctgatgtcaacatatccgagtggaaggacaagccaacccacgagatccttcaaaagctcaacgactgttcctgtcttgctagccaggcaattcttctcggaattcttttgaagcgagaaggtccaaacttcataaccaaagagggaaccgtgagcgatcatatcgagagagtctaccgtcgtgccggctcacaaaagctgtggctggccgtgaggtatggagcggctttcactcaaaagtttagcagctcaattgcacctcatatcaccactttccttgtgcatggtaagcaggtgactcttggtgcattcggtcatgaagaagaggtcatttccaacccactgtcgcccagagtgattcaaaacattatctactacaagtgcaatacccatgatgagagggaagcagtcattcaacaagaacttgtcatccacattggctggattatctcgaacaacccagaacttttttcgggaatgctcaagattaggatcggctggatcattcacgcaatggagtacgagctgcaaatcagaggtggcgataagcctgcactcgatctgtaccagctcagcccttcggaggtgaagcagctcttgctcgacatactgcaaccacaacaaaacgggaggtgctggctgaataggagacaaatcgacgggtccctgaatagaactcctaccggattttacgatagggtgtggcaaatactggaacgaaccccaaatgggattattgtggccggaaaacatctcccgcaacagcctactctttccgacatgaccatgtacgaaatgaacttctcgctgctggtggaggatactcttggaaatatcgaccaacctcaatacagacaaattgtggtggaactcctcatggtggtgagcatcgtgctggaaagaaatcctgagctcgaatttcaggacaaggtcgacctcgaccgactggtgaaggaggcctttaacgaattccagaaagaccaatcccggcttaaagaaatcgaaaagcaagatgatatgacctcgttctacaacaccccgcctctcggcaaacggggtacttgctcataccttacgaaggcagtcatgaatcttctgctcgaaggtgaagtgaagccaaacaatgacgatccttgcctgatttcc

SEQ ID NO: 18154 - DNA, 3279 bp, Artificial Sequence
  Description of Artificial Sequence: Synthetic coding sequence
atggcgggcgcggccggcctcaccgccgaggtgagttggaaagtcctggagcgtcgagcaagaaccaagaggtcaggttctgtgtatgagccactgaagagcatcaatcttcccaggcccgacaacgagacactttgggacaaattggaccattattaccggatcgttaagtccacattgctgctgtaccagagccccacgaccggcctgtttccgactaagacgtgtgggggagatcaaaaggctaaaattcaggactccctctactgcgccgccggcgcctgggcattggcactggcttaccgccgaattgatgacgacaaaggacgcacacacgaattggaacattctgcaatcaagtgtatgagaggcattttgtattgctacatgaggcaggccgacaaagtgcagcagtttaagcaggacccccgcccaacaacctgcctacacagcgtgttcaatgtgcacaccggggacgaactgctgtcttacgaggagtatggccacttgcagattaacgctgtgagcctgtacctattgtacctggtggaaatgatctcttccggcctgcaaatcatctataatacggatgaggtaagcttcattcagaacctggtgttttgcgtggagcgggtctaccgtgtgcccgacttcggcgtttgggagcgcggctctaagtataataacggtagtaccgagctgcattctagcagtgtcgggttggctaaggccgccctggaggctatcaatgggtttaacctcttcgggaaccaaggctgctcttggtccgtaattttcgtggatctggacgcacacaatagaaatcgccagacgctgtgttctttgttgcctcgtgaatccagaagccacaatactgacgctgcgctgctgccatgcattagttaccccgcattcgctctggatgatgaagtccttttttcccagacgctcgacaaagtcgtgcgcaaattgaaaggcaaatacgggttcaagcgtttcctacgggacggctacagaactagcctggaggatccaaacaggtgctactacaaacccgctgaaattaagctgttcgatggtatcgaatgtgaattccccatctttttcttgtacatgatgatagacggggtgttccgaggcaaccccaaacaagtgcaggagtaccaggacctcctgacaccagtgttgcatcacacaacagaaggctatccggtggtgccaaagtattactatgtccccgcagatttcgtggagtacgaaaaaaacaaccccggcagccaaaagcggttcccatctaattgcggaagagacgggaaattatttctgtggggacaggccttgtacatcattgcaaaactccttgcggacgaactgatttctcccaaggatatcgatcctgttcaacgctacgtgccattgaaagaccagcggaatgtgagcatgcgcttctcaaaccagggccctctggaaaatgatctggtcgtgcacgtggctcttatagctgaatcccagcgtctccaagtgttcctgaacacttacggaatccagacgcagaccccacagcaggttgagccaattcagatctggccacagcaagagttagtgaaagcctacttacagctcgggatcaacgagaagctggggttgagcggtcgtccagatcgcccaattgggtgcctgggaacgtcaaagatctacaggatcctcggcaaaacagtggtgtgttatcctataattttcgacctgagcgacttctatatgagccaggacgtgtttctgttgatcgatgacatcaaaaatgccttgcagttcattaaacaatactggaaaatgcatggtaggccccttttcctcgtgttgatccgcgaggacaacattcgaggaagccgcttcaacccaatccttgacatgctggctgcactcaagaaaggtattattgggggagtgaaagtgcatgtcgatagacttcagaccctcatctccggcgcggtggtagagcaactggactttctgcggatctctgacaccgaagagctgcccgagtttaagtccttcgaggaactcgaacctccgaagcactctaaggtcaagaggcaaagctcaactccatccgctcccgaactcgggcagcagccagatgtgaatatcagcgagtggaaggacaagccaacccatgagattctgcagaaactgaacgactgttcatgtctggcctcccaggccatcttgctcggaatactgttgaaacgagaggggcccaactttattacaaaagaaggaacggtttccgatcatatcgagcgggtctatcggagagctgggtctcagaagctttggctcgccgtcagatatggtgccgcctttacccaaaaattctcctcttcgattgctccgcatataacgacctttctagtgcatggcaagcaagtcaccctaggagcatttgggcatgaagaagaggtcataagtaatcctctgagcccaagagtaatccaaaacatcatctactacaaatgtaacacccacgacgagcgggaagcagtgattcagcaggagctcgtgattcatatcggctggattatctctaacaatccggaattattttctgggatgttgaagatcagaatcgggtggatcatccatgcaatggagtacgaactccaaattagaggaggagataagccggcccttgacctctatcaactctctccgagtgaggttaagcaactgcttctcgacatactgcaaccccagcagaacgggaggtgttggctgaatcgacggcagatcgacggctccctgaaccgtactcccacagggttttacgaccgcgtgtggcaaatcctggaacggactcccaatgggatcatcgtcgcaggtaaacacttaccacaacagccaaccttgtccgacatgaccatgtacgagatgaatttttcccttttagtggaggataccctcggcaacattgaccagccacagtatagacagatcgtggtggagctgctgatggttgtatctatagtcctggaaaggaacccagaactcgagttccaggataaagttgatctggaccgactagtgaaagaggcattcaatgagttccagaaagatcaatcgcgcttgaaggagattgaaaagcaagatgatatgaccagcttctataacaccccccccttgggaaaaagaggcacctgctcctacctaacaaaggcagtgatgaatcttctgctagagggcgaagtgaaacccaataacgacgatccttgcctgatttcc

SEQ ID NO: 18155 - DNA, 3279 bp, Artificial Sequence
  Description of Artificial Sequence: Synthetic coding sequence
atggcaggagcagccggtcttacggcagaagtctcatggaaggtcttggagagacgggcccgcacgaaaaggagtggttccgtgtacgaacccttgaaatcgattaacctgcctagacctgataatgaaacactgtgggacaaactggatcattattatcggattgtgaagtcaactctgttgctctaccaatcacctacgactggtctctttccaacaaagacgtgtggcggggatcagaaggccaagatccaggacagcctgtattgcgcagctggcgcatgggcactggcactggcatataggcggatagacgacgacaagggccgtacacatgagctggagcattctgcaattaaatgcatgagggggattctttattgctacatgcggcaggccgataaggtccagcagtttaagcaagaccctcggccaactacctgcctccattcagtgtttaacgtgcatactggcgatgagctgctgtcctacgaagagtatggacaccttcagatcaatgctgtctccctgtaccttctctatttggtggaaatgattagctcggggctgcagatcatatacaatactgacgaagtgtccttcattcaaaacttggttttttgtgtggaacgcgtttatcgagttcctgatttcggcgtgtgggaacgtggcagtaagtacaataacggtagcaccgaactgcactccagtagcgtgggtctcgccaaggccgccctcgaagccataaacggattcaacctgttcgggaaccaaggctgttcttggtccgtgatcttcgtcgacctggacgctcacaaccggaaccgccagaccctgtgctctctgctcccgagggagagcagatcccacaatacagacgcggccctcttaccatgtatatcataccccgcttttgccctggacgacgaggttctgttttctcagaccctggacaaagtagtacggaagctgaaaggcaagtacggatttaagcggttccttcgagacggatataggacgtcccttgaagatccaaatcggtgctactataagcctgctgaaataaagctgtttgatgggatcgaatgcgagttcccaatatttttcctttacatgatgattgacggagtcttccgggggaatcctaagcaggtccaggaataccaggacttgttgacgcctgtgctccatcatactacggaagggtacccagtcgttcctaagtactattatgtacccgctgacttcgtggaatacgagaaaaacaatccagggtcccagaagaggtttcccagcaactgtgggagggatgggaaactgtttttgtggggacaggcattgtatatcatcgccaagctcttagcggacgagttgatttcccccaaggatatcgatcctgtgcagaggtatgtgccactaaaggaccagcgtaacgtgtctatgcggttctcaaaccagggacctctcgagaacgatctggtggtgcatgtggccctcatcgctgagagtcagagattgcaggtatttctcaatacatacgggattcagacgcagactccccagcaggttgaaccgattcagatttggccccagcaagagctcgtaaaggcatacttgcagctcgggataaacgaaaagttggggctctcagggcgtcctgataggcccattggatgcctggggaccagcaagatttaccgtatcctgggcaagactgtggtttgttatcctatcatttttgatctttccgacttctacatgtcccaggatgtgttccttcttatcgatgatattaaaaacgccttgcagtttatcaagcagtattggaaaatgcacggaaggccactgtttctcgtactcataagagaagacaacatcagaggctccagatttaatcctatcctcgacatgctcgccgccctcaaaaagggcataattggcggcgtgaaggtgcatgtggaccgcctccaaaccttgatctcaggggcggtagtggagcagcttgactttttgcgcatttctgacaccgaggagctgccagagttcaagtcgtttgaagagttggagcccccaaagcattccaaggtcaagaggcagtcttcgactcccagcgcccctgagcttgggcagcagccagacgtaaatattagtgaatggaaagataagccaacacacgagatccttcaaaagctgaatgactgcagttgtcttgcttctcaagccatccttctgggcattctgctgaaacgggagggcccaaacttcataaccaaagaagggacagtctcagaccacatcgagcgggtgtatagacgggccgggtcacaaaaactctggttggccgtccgatatggggccgcatttacccagaaatttagttcctcaattgcgcctcacatcaccacgtttcttgtccatggaaagcaggtcaccctgggcgctttcggccacgaggaggaagtcataagcaaccccctatccccccgagtcattcaaaatatcatatattacaaatgtaatacgcacgacgagagagaagccgtgatccagcaggagcttgtaattcacatcggatggataatttctaataatccggagctattttctggcatgctgaagattagaatcggatggattatccatgcaatggagtacgaactgcagatacggggaggagacaagcccgccctggatctctatcaattgtcaccatccgaagtcaagcagttgctactggatatccttcaacctcagcaaaatgggcggtgttggctgaatcgaaggcaaattgacggcagtctgaatcgtacccctaccggcttttatgaccgggtgtggcaaatccttgaaaggactcccaatggaatcatcgtggccggtaagcacctgccacagcagcccaccctgtctgatatgaccatgtatgagatgaatttttccctgctggtggaggatacgctgggaaatattgatcagccacaatacaggcagattgtagtggaactactgatggttgtttcgattgttctggaacgtaatccggagttagagtttcaggacaaagttgacctggatcggttagtgaaggaagcttttaacgagttccaaaaggaccagtctcgattgaaagagatagagaagcaggacgacatgacctccttttacaatactccaccactggggaaaaggggcacgtgctcctacctgacaaaagctgtgatgaacctgcttctcgagggagaggtaaaacccaacaatgacgatccctgcctaatctca

SEQ ID NO: 18156 - DNA, 3279 bp, Artificial Sequence
  Description of Artificial Sequence: Synthetic coding sequence
atggccggcgcggccgggttgaccgctgaagtatcttggaaggttctggagagacgcgctcgcacaaagcgaagtggttcggtgtacgaacctctcaagtccattaatttgcctcgtcctgataacgagaccttgtgggacaaactggatcactattacagaattgtaaaaagcacacttctgctgtaccagtcccccacgactggcctcttcccaactaagacctgtgggggcgatcagaaagccaagatacaagattcactgtactgcgctgccggggcatgggccctggcattggcctatagaagaatcgatgacgataagggcaggacacacgagttggaacactccgctatcaaatgtatgcggggaatattatactgctacatgcgacaggccgataaggtacagcaattcaagcaagatccaagacctacgacctgtctgcactcagtgttcaacgttcacactggtgacgagcttctctcctacgaggagtacggacatctccagatcaacgcagtgtcactgtatctcctgtacctggttgagatgattagctccggactgcagataatctataacacagatgaggtctcgttcatccaaaacctggttttctgcgtggagagggtttaccgcgttcctgattttggagtttgggagcgaggaagtaaatacaataacgggagtaccgaactgcacagttcctctgttggacttgctaaagccgccctggaggcgatcaatggattcaacctcttcgggaatcaggggtgtagctggtctgtgattttcgtggacctggacgctcataatagaaacagacagaccttgtgttcgctgttaccgagggaatctcggtcccacaataccgacgccgcattgctcccctgcatctcataccccgcgtttgctctggacgacgaagtattgttcagtcagacgttggataaggtggtgcgtaagctcaaagggaagtatggttttaagcgatttctcagagacggctacaggaccagtctcgaggaccccaatcgttgctattataaaccagctgagattaagctcttcgacggtatagagtgtgaattccctattttcttcttgtacatgatgatagatggggtatttcgcggaaaccccaaacaagtgcaagaataccaagacttgcttactccggtcctccatcataccaccgaagggtatccagtcgttccaaaatattattacgtcccagcggacttcgttgagtacgagaagaacaacccaggtagccagaagaggttcccttcaaattgtgggcgtgacggcaaactgtttctttggggacaggctctgtatattatcgccaaactgctggctgacgagttaatcagccctaaggatatcgaccccgttcagcggtacgtgcctctgaaggatcagcgcaatgtgtcgatgcgcttcagcaaccaggggcctctagagaatgatctggttgtgcatgtcgccttgattgcagaatcacagcggctccaggttttcttgaatacttatggcatccagacacagactccgcagcaggtggaacccatccagatctggccacagcaggaattggtcaaagcatatctgcagctaggcattaacgagaagctgggcttgagcggacgcccagacaggccaatcggttgtttgggcacatctaaaatctacagaattttgggcaagaccgtagtgtgctatccaattattttcgatctgagcgacttttacatgagtcaagacgtgttcctcctgatcgacgatattaagaacgccctgcaatttatcaagcaatactggaagatgcatgggaggcctctgtttttggtgctgatcagggaagacaacatccgaggctcccgtttcaaccccattctcgacatgctcgcagccctcaagaagggtatcatcggtggagtaaaagtgcacgtcgatcggctgcagaccctaatatccggagcagtcgtggagcagctggactttcttcgtatatctgatactgaggagctccccgaattcaaatcatttgaagaattggagccaccaaaacacagcaaagtcaaaaggcagtctagcactccatcagctccagagctcggccagcaacccgatgtgaacatttctgaatggaaagacaagcctactcacgaaattctccagaagctgaatgactgttcatgtttggcatcccaggctattctccttggaatattgctgaaaagagagggccccaactttattactaaggaaggcacagtttctgatcatattgagcgggtgtaccgtagagcggggtcacagaaactatggctggcggtcaggtacggcgctgcttttacgcagaagttctcctctagtattgccccacacatcaccactttcttggtgcacggcaagcaagtgaccctgggcgctttcggacatgaggaggaggtcatcagtaacccccttagcccccgggtgattcagaatattatctattataagtgtaacactcacgacgagcgtgaggcggttattcagcaggagcttgtcattcacatcgggtggattattagcaacaatccagaacttttttctggaatgcttaaaataagaattggatggattatccacgcgatggagtatgagctgcaaatccgcggcggagacaagcctgccctcgacctgtatcagttgtcaccatctgaagtaaagcagttgttgctcgatattctgcagcctcagcagaacgggcgctgctggctgaaccggcgccagattgacggtagtctgaaccgaactccaactggcttctacgatagagtctggcagattctggagaggacgcctaatggtatcatcgtggccggtaagcacctgccccaacagccgactctctcagacatgactatgtacgagatgaacttcagtctcctcgtcgaagataccctggggaacatagaccagcctcagtacaggcagatagtggttgaacttctaatggtggtttctatcgttctggagcgcaatccagagttagagttccaggacaaggtggacctggatagattggtgaaggaagccttcaacgagtttcaaaaggaccagagtagattgaaagagatcgagaaacaggatgacatgacctccttctacaacaccccacctctaggtaaacgcgggacctgttcatacctgacaaaggctgtcatgaacctcctgctggaaggtgaggtgaaaccaaataacgacgacccatgcctgatctct

SEQ ID NO: 18157 - DNA, 3279 bp, Artificial Sequence
  Description of Artificial Sequence: Synthetic coding sequence
atggccggggccgccgggttgacagccgaagtgtcttggaaagtactggagagacgggcgaggactaagagaagtggcagcgtttacgaacccctgaagtccattaacctacctcgcccagataatgagactctctgggacaaactcgatcactactaccgaatagtgaagagcacattgctcctgtaccagagccccacgaccgggctgttccccaccaaaacctgcggcggggaccagaaggcgaaaatccaggacagcctgtattgtgccgccggcgcatgggctctcgccttggcataccggcggattgatgatgacaagggcagaacacacgagttagagcactccgccattaagtgcatgaggggcatactgtattgttatatgaggcaggctgataaagtccagcagtttaagcaggacccgcgccccactacatgtctgcattctgtctttaatgtgcacacgggggacgagctactgtcatatgaagagtatggtcatctgcagatcaacgccgtgtccctgtatctcctctatcttgtggagatgatcagttctggcctgcaaatcatctacaacactgatgaggtctctttcattcagaatctggtgttctgtgtagaacgagtttatagagtgccggactttggcgtgtgggagagaggtagtaagtacaataacgggtctacagagttacacagctcgtccgtggggttggctaaagctgctttggaggctataaatggttttaacctattcggaaaccagggttgctcctggtccgtgattttcgtcgatctcgacgcgcataaccgcaataggcagacactgtgctccctcctgccccgcgagagcagatcccataataccgatgcagcgctactgccttgtatttcttatcctgccttcgccttagatgacgaagttctgttctcccaaacactggataaggtggtgcgtaaacttaagggaaaatacggcttcaaacggttcctccgggacgggtatagaacatctcttgaggatcctaacaggtgctactacaaaccggcggagatcaagctttttgacggcatagagtgtgagtttcccatcttcttcctgtatatgatgattgatggagtgtttcgcgggaacccaaaacaagtgcaggagtaccaggatttgctgacccccgtcctgcaccacactactgagggatacccggtggtgccaaagtactactatgtaccagctgattttgtggagtacgagaaaaacaatcccggctcccagaagcgattcccttctaattgcggccgcgacggaaagctctttctgtggggacaggcactgtatatcatagcaaaactcctcgccgacgagctgatctctcccaaagacatcgaccccgtccagcgttacgtgccgcttaaagatcagcgcaacgtcagcatgcgattttccaatcagggccccctcgaaaatgacctagtcgtgcatgttgcccttatcgctgagagccagcggctgcaggtctttttgaacacatacggcatacagacgcaaacgcctcaacaggtggagcccattcagatctggcctcagcaggaacttgtcaaagcttatctgcaactgggcataaatgagaagctcggcctcagtggccggccggaccggcctattgggtgtctgggcacctccaaaatttatcggattttgggtaaaacggtggtatgctatccaattatctttgatctgagtgacttctacatgagccaggacgtgttcctccttattgatgacataaaaaatgccttgcagtttattaagcagtactggaaaatgcatggccgtccactgtttctcgtgctcattagagaggataatatacggggatcacgatttaatcctatcttggacatgctggccgcattaaagaagggtattattggaggggtcaaagtgcatgtggacaggcttcagactcttataagcggagccgtggtcgagcagcttgattttctaagaatctccgacacagaagagctccccgaattcaagtcttttgaggaattagagccaccaaaacatagtaaagtgaagcggcagtcctctacgccctcagctcccgagttagggcagcagcctgatgtgaacattagcgagtggaaagacaaaccgacgcacgaaatcctgcaaaagctaaacgattgctcttgtcttgcctcccaagctatcttgctgggaatcctcctgaagcgcgagggaccgaatttcatcactaaagaaggtaccgtctctgaccatatcgaaagggtgtataggagagcgggtagtcagaagctgtggctagcagtgagatatggcgccgctttcacgcagaagttctcatcaagtatcgcccctcatataacaacatttctggtgcatggtaaacaagtaacactgggggcatttgggcacgaggaagaagtcatctccaaccccctatctccccgggtcatccaaaatatcatatattataagtgtaacacgcacgatgagagagaggccgttatccagcaagaactcgtgatccacatcggctggatcatctcaaataacccggagctgttcagtgggatgctgaagattagaataggctggatcatccatgccatggagtacgaactacagattcgcgggggcgacaaacccgctcttgacctgtaccagctgagcccaagtgaggtgaagcagctcctgttggacatcctgcagccacagcagaatggccggtgctggctgaatcggcgtcagatcgatggcagtttaaaccgcacgcctacaggtttttacgaccgggtctggcagatactggagcgaactccgaacggtattatcgtggctggaaagcacctgcctcagcagcccactctttccgatatgacaatgtatgaaatgaatttcagcttgctcgtggaggatactttgggaaacattgaccagccgcagtaccggcaaatcgttgtggaactcctcatggtggtttcgatcgtgctcgagcgtaatccagagctggagtttcaggataaggtggacttggaccgcttggtgaaagaggcttttaatgaatttcagaaggatcagagtaggcttaaggagatcgaaaagcaggacgatatgacctccttttataatactccacctctggggaaacgagggacatgtagctaccttactaaggctgtgatgaatttactcttggagggagaagttaaaccaaataatgatgatccttgcctgatcagt

SEQ ID NO: 18158 - DNA, 3279 bp, Artificial Sequence
  Description of Artificial Sequence: Synthetic coding sequence
atggcaggcgcagccggactcacagccgaggtgtcgtggaaggtgctcgagcggcgagcacggacgaaacgatccggctcagtatatgaacctctcaagtcaatcaacttaccaaggcctgataacgaaaccctgtgggataagttagatcattactaccgaattgtgaaatcaaccctgttgctgtatcaaagccccacaacaggcctgtttccaactaaaacctgcggaggtgaccagaaggcaaagattcaagattctctctactgcgcagccggcgcctgggccctggcactggcgtatcggcgaattgacgacgacaaaggcagaacgcacgagctcgaacactcagcgattaagtgcatgagaggaatactatattgctatatgcggcaggccgataaagtgcagcaatttaagcaagatcccagaccgacgacgtgcctgcactctgtctttaatgtacacaccggcgacgaactgctgtcatatgaggaatatgggcacctccagataaatgccgtgtctctgtatctgctatatctcgtggagatgattagctccggactccagattatctacaacactgacgaggtgtcctttatccagaatttagtgttctgcgttgaacgggtctacagggttccggactttggggtgtgggagaggggcagcaagtataataatgggagtaccgaactacattcttcctcggtcggattagccaaagccgccctggaggccatcaacggtttcaacttgttcggtaaccagggatgctcttggagtgtgatttttgttgaccttgatgcacacaacaggaataggcagactctctgtagcctgctgccaagggaaagcagaagccacaatacggatgccgcactgctgccctgtatcagttacccagcatttgcactcgacgatgaggtgcttttcagtcagaccttagataaggtggtccgcaaactcaagggcaagtatggctttaaaaggttcctgcgagacggctataggacaagcctcgaggacccaaacaggtgctactacaaacctgcagagattaagttgttcgatggcattgagtgcgagtttcctatatttttcctttacatgatgatcgatggcgtgttccggggaaatcctaagcaggttcaggagtaccaggatctcctgacccctgtgcttcatcacactaccgaggggtacccagttgtgcccaagtactattatgtccctgcggacttcgttgagtacgaaaaaaataatccaggtagccagaaacggttccctagcaactgcggacgggatggcaaactgttcctgtggggacaggccttatatattatcgccaaattactcgctgacgaattgatctctcccaaggacatcgatcccgtgcagaggtatgtgccccttaaggatcaaaggaatgtttccatgcgtttctccaatcaaggccctcttgagaatgaccttgtggtccatgtggcattgatcgcagagtcccagagactgcaggtattcctgaatacatacgggatccaaactcagactccacagcaggttgaacctatccagatatggccccagcaggaactggtgaaggcctacctgcaactgggtataaacgaaaaactggggctgtccgggcggcctgacagaccaattggctgcctaggcactagcaagatctatcgaatcttgggcaagaccgtagtttgctacccgatcatcttcgacttgagcgacttttacatgtctcaagacgttttcctgttgatcgacgacatcaagaacgccttacaattcatcaaacagtattggaaaatgcatggccggccactcttccttgtcttgatcagagaggataatattcggggatctcggtttaacccaattctagatatgctagccgccctgaagaagggaatcattggcggggtgaaggtccatgtcgatcgcctgcagactctgatttcaggcgcagtagtggagcagttggacttcctgcgaatctcagatactgaggagctgccagaatttaaaagttttgaagaactggagccccctaaacatagtaaagtgaagcgccagtcatccacgccctcagctccggagctagggcagcagccagacgtgaatatttcagagtggaaggataaacccactcacgaaatcttacagaaactcaacgattgctcttgtctcgccagccaggccattcttctgggaattctgctcaagcgagagggacctaattttatcactaaggaaggaacagtgtcagaccatatcgaaagagtgtatcggcgcgctgggtcccagaaattatggctcgcagtgaggtacggcgccgcattcacacagaaattttcgagtagtatcgctccacacattactaccttcctggtccacggtaaacaagtgaccctgggtgcattcggccacgaagaagaggtgattagcaaccctctgtctccacgagtgatccagaatataatctactataagtgcaatacgcacgatgaacgtgaggctgtgatccaacaagaactggtcatccacattgggtggatcatctccaacaatccagagttgttttcaggaatgctgaaaattagaatcgggtggatcatacacgctatggaatatgagctgcaaatacgaggcggggacaagcctgcactcgacctgtaccaacttagtcctagcgaagttaagcagttactccttgatatcctgcagcctcagcagaatggccgatgttggctcaatcgtcgccaaatagacggatccctaaatcggaccccaaccgggttctacgacagagtctggcagatattagagagaacacctaacggaatcatcgtagccggaaagcatctaccacagcaacccacgcttagcgatatgactatgtatgagatgaactttagcctgcttgtcgaagataccctgggcaacatcgatcagccccaataccgccagatagtggtcgaactgctgatggtagtgagtattgtgctcgagcggaaccctgaactcgagttccaggacaaggtcgacctcgatcggctcgttaaagaggcgtttaacgagtttcagaaagatcagtctaggctcaaggagattgagaagcaagacgacatgactagcttttataacacacccccactcggcaagcgcgggacatgctcctaccttacaaaagctgtgatgaatctactgctcgagggagaagtaaagcctaacaatgacgatccatgtcttatctca

SEQ ID NO: 18159 - DNA, 3279 bp, Artificial Sequence
  Description of Artificial Sequence: Synthetic coding sequence
atggctggtgccgcggggctgactgccgaagtctcgtggaaggtgctggaaaggagggctcggacgaaacggtcaggaagtgtgtacgaaccactcaagtcaatcaatttgccgcggccggacaacgaaaccctgtgggacaaactcgaccactactacagaattgtaaagtctaccctcctgctctaccagtccccaacgaccggattgttcccgactaagacttgcggaggtgaccaaaaggcgaagatccaggatagtctctactgcgccgcaggggcatgggctctggctctggcatacaggcggattgatgacgacaaaggacggactcatgaactcgaacactccgccatcaagtgcatgagagggatcttgtactgctacatgagacaggccgacaaggtccaacagttcaagcaggacccaaggccgaccacttgtctgcacagcgtgtttaacgtccacacgggagatgaactgctgtcgtacgaggaatacggacacctgcaaatcaacgcagtctctctgtatctgctgtacctcgtcgaaatgatctcgagcggactccaaatcatatacaacaccgacgaggtcagcttcatccagaatctggtcttttgtgtggaacgagtctaccgcgtgcctgacttcggggtctgggagagaggctccaagtacaacaacggatccaccgagctgcattcgagcagcgtggggctggcgaaggccgctctggaagctatcaatggattcaatctgttcggcaatcagggatgctcgtggtcagtgatctttgtggacctcgatgcccacaaccgaaaccggcagaccctgtgctcgctgctgccgagagaaagcagaagccataataccgacgccgccctgctgccatgtatttcctacccagccttcgcactggatgatgaagtgcttttctcacagacgctggacaaagtggtgaggaagctgaaggggaaatacgggttcaaacggttcctcagagacggctacagaacttccctggaggacccaaataggtgctactacaagccagcagaaatcaagctcttcgatggaatcgaatgcgagttcccaatcttcttcctctatatgatgatcgatggagtgtttaggggaaaccccaaacaagtgcaggaataccaagacctcctgacccctgtgcttcaccatactaccgagggatacccagtcgtgccgaagtactactacgtgcctgcagatttcgtcgaatatgagaagaacaatccaggatcgcagaagagattcccgtcgaactgtggacgcgatggaaagctctttttgtggggccaagcactttacatcatcgccaagctgctggcagacgagttgatttccccaaaagacatcgacccggtacaacggtacgtgcccctgaaagaccagcggaatgtgtccatgcggttctccaaccaaggacctctggagaatgatctcgtggtgcatgtggcgctgatcgcggaatcccagagactgcaagtgttccttaatacttacggaatccagacccaaaccccacagcaggtggaacccatccagatttggcctcagcaggagcttgttaaggcgtacttgcagcttggaatcaacgagaagctcgggctttccgggcgccccgaccggccaattggctgcctcggaacttcgaagatctacaggatcctgggaaaaaccgtggtctgctacccaatcatcttcgacctgtctgacttctatatgagccaggacgtgttcctgcttatcgatgatatcaaaaacgctctgcagttcatcaagcagtactggaagatgcacggacgcccgctgttccttgtgctgatcagggaagataacatccgagggtcgcggttcaatcctattctggacatgctcgccgccctgaaaaagggaatcatcggcggcgtgaaggtgcacgtggaccgtcttcaaacgctgatctccggtgccgtcgtcgaacaactggacttcctcagaatctccgatacggaggaactgccggaattcaagtcattcgaggaactggaaccgcccaagcatagcaaagtcaagcgccaaagctcgactccttccgccccggagctgggtcagcagccggacgtgaacatatccgaatggaaggataaaccgactcacgagattctgcaaaagctgaacgactgttcgtgcctggcctcgcaagcaatcttgctcggaatcctgctgaagagagaggggccgaatttcatcaccaaagagggtactgtctcggaccacatcgagcgggtctatcgccgcgcggggagccagaagctctggctggccgtgcggtacggggcagcttttacgcagaagttttccagtagcattgcccctcacatcactacctttcttgtgcacggaaaacaggtcacgctcggcgcatttggccatgaagaagaggtgatcagcaaccctttgtcccctcgggtcatccaaaacatcatctactacaagtgcaacactcacgatgaacgcgaagccgtcattcaacaggagctggtcatccacatcggatggatcatctccaacaatcctgaactgttctcgggtatgctgaagatccgcattggatggattatccatgctatggaatacgagctgcagatcagaggcggcgacaaacctgcgttggacttgtaccagctcagcccgtcagaagtgaaacaattgcttctggatatcctgcaaccacaacaaaacgggcggtgctggcttaatcggcgccagattgatggatcactgaatcggaccccaaccgggttttatgatcgcgtgtggcagatcctcgaacgtactccgaacggaatcatcgtggcggggaagcatctgccgcaacagccgactttgagcgatatgaccatgtacgagatgaatttttcgctgctggttgaggacaccctcggaaacattgatcagccccagtaccggcaaattgtggtggagctgttgatggtggtgagcatcgtcctcgagagaaacccggagttggaatttcaagataaggtagatctcgaccggctggtgaaggaagccttcaacgagttccagaaggaccagtcccgcctgaaggagatcgaaaaacaggacgacatgaccagcttctacaacaccccgccgcttggaaagcgcggaacctgctcataccttaccaaggctgtgatgaatttgctcctcgagggggaggtgaagccgaacaacgatgacccgtgcctgatctca

SEQ ID NO: 18160 - DNA, 3279 bp, Artificial Sequence
  Description of Artificial Sequence: Synthetic coding sequence
atggcgggagcagccggactgaccgcagaggtgagctggaaggtcctcgagcgccgcgcacgcaccaaacggtccgggagcgtttatgaacctctgaagtccattaacctgcctagacccgataatgaaactctctgggataaacttgatcactactaccggatcgttaagtcgaccctgttgctttaccaatcccctaccactggtcttttcccgaccaaaacttgtggaggcgatcaaaaggctaaaatccaagactcgctttactgtgctgccggggcatgggcactggcgcttgcctaccggagaatagacgacgataagggccggactcatgaattggaacattcggcgattaagtgtatgaggggcattctgtactgctatatgagacaagcagataaggtacaacagtttaagcaagatcccagacccaccacttgccttcactcagtgttcaacgtgcatacgggtgacgagttgctttcgtacgaggaatatgggcatctgcagattaacgccgtgtcgctgtacctgctgtacctcgtggaaatgataagctctggccttcagattatctataacaccgacgaagtgtcattcatacaaaacctggtgttttgcgtggagcgcgtgtacagagtgcctgattttggggtgtgggaaaggggctcaaagtataacaacggttcgactgaacttcatagttcgtcggtcggtctggcaaaagcggcactggaggccattaacggattcaatctgtttggaaatcaggggtgcagctggtcggtgatctttgtggatctcgacgcgcacaatagaaatagacaaaccctgtgtagcttgctccctcgcgaatcccgtagccataataccgacgcagcactcctgccttgtatttcataccctgcatttgcgctcgatgatgaagtcctcttttcccagactctggataaggttgtgagaaagctgaagggaaagtacggatttaagcgatttctcagagacggatacaggacttccctggaggaccctaaccggtgctactacaagccggccgagataaaacttttcgatggcattgagtgtgaatttccaattttctttctgtacatgatgatcgatggagtgtttcgcggtaatcctaagcaagtgcaggaataccaagatctgctcacccctgtcctccatcataccacggaaggatacccagtggtgccgaagtactactatgtcccggcggatttcgtggagtacgaaaagaacaaccccggatcgcaaaagcggttccctagcaattgcggacgggatggcaagctgtttctttggggtcaagcactttacataattgcaaagctgcttgcagatgaacttatttcgccgaaggatatagatcctgttcagaggtacgtgccgctgaaagaccaacggaacgtgtcgatgaggttttcgaaccagggccccttggagaacgaccttgttgtccacgtggcgctgatcgcggaatcacagagactgcaggtgtttctgaacacctacggaattcaaactcaaacgccacaacaagtcgaacctatccaaatctggccgcagcaagagctcgtgaaggcatacctgcagctcggtatcaacgaaaagctcggactgagcggcagacccgaccgtcccataggatgtttgggaaccagcaagatctacaggattctggggaaaaccgtggtttgttaccccatcatttttgatctctcggacttctatatgtcccaagacgtctttctccttatagatgatatcaagaatgccctgcagtttatcaaacagtactggaagatgcatggaaggccactctttctggtccttatcagagaggacaatatccgcggatcgagattcaatcctattctggacatgcttgctgcattgaagaaaggaataatcggtggcgtgaaggtgcatgtggaccgactgcagacccttatctccggggcagtggtggagcagttggattttctgagaatttccgatactgaggaacttccagagttcaaatccttcgaagaactcgaaccacctaaacattccaaagttaagcgccaaagctcgaccccttctgcacccgaactggggcagcagccagatgtcaatatcagcgaatggaaggacaagccaactcacgaaattctccaaaagttgaacgactgttcgtgccttgcatcgcaagcaattctcttgggtatcctgctgaagagagagggtccaaactttatcactaaggaggggaccgtctccgatcacatcgaaagggtgtacaggcgtgctggaagccaaaaactgtggctggcggtgaggtacggagccgcttttacccagaagttctcgtcaagcattgccccacacattactactttcctggtgcatggcaaacaggtgactcttggggcattcgggcatgaggaggaagtgatttcaaaccctctgtcacccagggtaatccaaaacataatctattacaaatgtaacactcatgatgaaagagaggcggtgatccagcaggagcttgtcatccatattggttggatcatttcaaacaatccagagctgttttccggtatgctgaaaattcggattggttggattattcacgcaatggagtacgaacttcagatcaggggcggtgataaacccgcgcttgatctttaccagctttcaccatcggaagtcaagcagctccttcttgatattctgcaaccacaacagaatggaagatgttggctcaataggaggcagatcgacggatctctgaatcgcacgcccaccggattctacgacagagtctggcaaatccttgaacgcacccctaacgggataatagtcgccggtaaacacctgccacaacaaccaactctttccgatatgaccatgtacgagatgaatttctccctgcttgtggaggacacccttggaaacattgatcaaccacaataccgccaaattgtcgtcgaactgcttatggtagtcagtatcgtgctggagcgaaacccggagctcgaatttcaggataaagtggacctcgatagacttgtgaaggaagcatttaacgagtttcagaaggaccaatcaaggcttaaagaaatcgaaaagcaggatgatatgacctcgttttacaatactccaccgcttggaaaacggggtacctgtagctacctgacgaaagcagtcatgaatcttctgctcgaaggagaagtgaagcctaacaacgacgacccttgtcttatctcc

SEQ ID NO: 18161 - DNA, 3279 bp, Artificial Sequence
  Description of Artificial Sequence: Synthetic coding sequence
atggcgggagcggcaggactgacggcagaagtgtcttggaaggtcttggaacggcgggcgcgcactaagcgctcaggcagcgtttacgagccgctgaagagcatcaatctccctcggccggacaatgaaaccctctgggacaaactggatcactactacagaatcgtaaaatccacgcttcttttgtaccaaagcccgactactgggctgttcccaactaaaacttgtgggggagatcagaaagccaagatccaggactccctgtattgcgccgccggagcttgggcactcgcactggcttaccgcaggattgacgatgataaggggaggactcacgagctcgagcatagcgccataaagtgcatgcgcggcatcttgtactgttacatgcggcaagctgacaaggtgcagcaattcaagcaggaccctcgcccgactacgtgcctgcactcagtctttaacgtgcataccggagatgagctgctttcctatgaagaatacggacacctccagatcaacgcagtctccctttacctgctgtacctcgtggagatgatctcaagcggtctgcaaatcatttacaataccgacgaggtgagctttatccagaatctggtgttttgcgtcgaacgcgtgtaccgggtcccggattttggagtgtgggaacgcggatctaaatacaataatgggtcaaccgaactgcactcaagctcggtcgggttggccaaggccgccctggaggctatcaacggattcaacttgttcggcaatcagggctgctcatggtcggtgatctttgtggacctggatgcccataacagaaaccggcaaaccctctgttccctcctgccgagggagtcccgctctcacaacactgacgcggcccttctcccctgcatatcctacccagccttcgcgctggacgatgaagtcctgttctcccagaccctggacaaagttgtccgaaaactgaagggcaagtacggattcaaacgctttttgcgggacgggtaccggacttcgctggaggacccgaaccgctgctactacaagccagcagagatcaagctgttcgacgggatcgagtgtgaattccctatcttctttctgtacatgatgatcgacggagtgtttcgtgggaaccctaagcaggtgcaagagtaccaagatctcctcactcctgtcctgcaccataccaccgaggggtacccggtggtgcctaagtactactacgtccccgctgacttcgtggaatatgaaaagaataatccgggctcccaaaagagattcccgtcaaactgtggtagggacggtaaattgttcctgtggggacaggccttgtacattattgccaagctcctcgccgatgagcttatttccccgaaggatatcgatcccgttcaacggtacgtcccactcaaagaccagcggaacgtgtcgatgcgcttttcgaaccaaggccctctcgaaaacgacctggtggtgcacgtggctctcatcgccgagtcacagaggctccaagtattcctgaatacttacggaatccagactcagaccccgcaacaagtcgaacctatccaaatctggccgcagcaggaactggtgaaggcttacctgcagctgggcatcaatgaaaagttgggtctgtcgggacgcccggacagaccgatcggatgcctgggaactagcaagatctacagaattttgggaaaaactgtcgtttgctacccgattatcttcgacctctccgacttctacatgtcgcaggatgtgttcctgcttatcgatgacatcaagaacgctctgcagttcatcaagcagtactggaaaatgcatgggaggcctctgttcctggtgttgatccgggaggacaatatcagaggaagtcggttcaatcctattctcgacatgctggctgccctgaagaagggcatcattggaggtgtcaaagtgcacgtggaccggctgcagactcttatttctggtgcggtcgttgaacaactggacttcctccggatctctgataccgaagagctgccggaattcaaatcattcgaagaactcgaacctccaaagcactccaaggtgaagcgccagagcagcaccccgagcgccccagaactcgggcagcagccagatgtgaatatctcagaatggaaggataaacccactcatgagattctccaaaagctgaacgattgcagctgtctcgcgtctcaggcaatcttgctcggcatcctgcttaagcgggaaggaccaaatttcatcaccaaggaaggcaccgtttcggaccacatcgaaagagtgtatagacgagccggttcccagaaactctggctggcggtccggtacggagccgcatttactcagaagttttcaagctcaatcgccccacacatcactaccttcctggtgcatggaaagcaggtaactctgggcgcatttggacatgaggaagaagttatctcgaacccactgagcccgcgagtcattcagaacatcatctattacaagtgcaacactcacgacgagcgagaagcagtgatacaacaagaactggtgatccatatcggatggataatctccaacaatcctgaactgttttccggaatgcttaagatcaggatagggtggatcatccacgcgatggaatacgagctgcagatacgcggaggagacaagccagcactcgacctgtaccaattgagcccgtcagaagtgaagcaactgctgctggacatcctccagccgcagcagaacggaagatgttggctgaaccgtcgtcagatcgacgggtcgctcaacaggaccccgacgggattctacgaccgcgtgtggcaaatcctggagcggaccccaaatgggatcatcgtggccggcaagcatctcccgcagcaaccgaccctgtccgacatgacgatgtacgagatgaacttctcgctgttggtggaggatactctgggaaacatcgatcaaccacagtatcgccagatcgtggtggagctcctgatggtcgtctcgatcgtccttgaacgcaatcccgagctggagttccaggataaggtggatcttgatcggctcgtgaaggaggccttcaacgagttccagaaagaccagtccaggctgaaggagatcgagaagcaggacgatatgactagcttctacaatacgccaccccttggaaaacgcggcacctgctcgtacctgaccaaagcggtcatgaacctgctgttggaaggtgaggtgaagccgaacaacgatgacccatgcttgatcagc

SEQ ID NO: 18162 - DNA, 3279 bp, Artificial Sequence
  Description of Artificial Sequence: Synthetic coding sequence
atggctggcgcagcagggttgaccgctgaagtctcttggaaggtgctcgaacgcagggctcgtactaaacgcagcgggtcggtatatgagccactgaagtcgattaacctcccccgaccggataatgagactctttgggacaagcttgatcattattacagaatcgtcaaatccacccttctgttgtatcaatctcctaccaccggactttttccaacgaaaacctgtggtggtgatcaaaaggccaagattcaagattccctgtattgcgctgccggcgcttgggccctggcgctggcgtaccggcgtatagatgacgacaaagggaggacgcatgaattagaacactctgccatcaagtgtatgcgcggtatcctctattgttatatgcggcaggctgataaggtgcagcagtttaagcaggaccctagaccaacaacctgcctgcacagcgtctttaacgtacatacgggcgacgagttactcagctacgaagagtacggccatcttcagatcaatgccgtgtccctctacttgttatatctcgtggagatgatctcgagcggactgcagatcatctataatacggatgaagtgagcttcatccagaatctggttttttgcgtggaaagggtataccgggtgcccgatttcggcgtttgggaacgtggcagcaagtacaacaacggcagcaccgagctgcactcaagctcagttgggttagccaaagccgccttggaggccataaatgggtttaacctctttggaaatcagggttgttcctggtctgttatcttcgttgacctagacgctcacaaccgaaataggcagactctttgctccctcctaccaagggagtcccggtcccacaacactgatgcagccctgcttccctgcatcagctatcctgccttcgcgttagacgacgaagtgctattctctcaaaccctggacaaggtggtgagaaaactcaagggaaagtacggtttcaaacgctttctgcgggatgggtaccggaccagcctcgaagaccccaatcgctgttactacaagcccgcagaaatcaaactctttgatggcatagagtgcgagtttcccatatttttcctctacatgatgatagatggagtttttcgggggaatcctaaacaggttcaagagtatcaggatctgcttaccccagtgttacatcacactaccgagggatatcctgtggtcccaaagtactattacgtgccggcggactttgtagaatatgagaagaacaatcctggttcacaaaagcggttcccgtccaactgcgggagagacggaaaactgtttctgtggggccaggctctgtatatcatagccaagctgttggcagacgaacttatttctccaaaagacatcgacccagtgcagaggtatgtacctctgaaggatcagcgcaacgtgtccatgcgcttcagtaaccaggggcccctggagaacgatcttgtggtccatgttgctctaatcgcggagagtcagcgattacaagttttcctgaacacctatggtattcagactcagactccccagcaggtggagccgatacagatctggccacagcaggaacttgttaaagcctatctgcagctgggtatcaacgagaagctgggtctgtcggggagaccagacaggcctataggctgtctgggcacatcaaagatctatcggatactcgggaaaacagtggtgtgctacccaatcatcttcgacctgtctgacttctacatgagccaagacgtgtttttgctgattgatgatattaaaaatgcactgcagtttataaagcagtactggaaaatgcacggacgacccctgttcctggttttgatcagggaggacaacatccggggaagtcgatttaatcctattctagatatgctggctgcgcttaagaaggggataataggcggggtgaaggtgcatgtggaccgcttgcagacactgatttctggagcagtggtcgaacagcttgacttcctgcgcattagcgatactgaggaacttcccgagtttaagagctttgaggagttggaaccgcccaagcactctaaggttaaacggcagagctctacaccttcagcccccgagcttggtcagcagcccgatgtcaacatttccgagtggaaggacaaacctacacacgagatacttcagaagctgaatgattgcagctgcctggcctcccaagcaatcttattgggcatattgctcaaacgcgaaggccctaacttcattaccaaggaaggcacggtgtcagaccacatcgagcgagtctacagacgtgctggaagccaaaagctctggctggctgttaggtacggtgctgcatttacccagaagttctcgtcaagcatagccccacatataaccacattcctcgtccatggtaagcaggtgacactgggagcctttggacatgaagaagaagtgatctccaatccgctgtccccacgggtcatccagaatatcatatactataaatgcaacacccacgacgagcgggaggccgttattcagcaagagttggtcattcacattggatggatcatcagtaacaaccccgagctgttctcaggaatgctcaagatccgtatagggtggattatacacgcaatggagtacgaactgcagatacggggcggggataagcccgccctcgatttgtatcagctgtctccatccgaagtgaagcaactgctgctcgacatattgcagccccagcagaatgggaggtgttggctcaatcgcaggcagatcgacggttccctgaatcgtacccctacgggtttctacgaccgtgtttggcagattctggaacggacaccaaatggcatcatcgtggcaggaaaacatctgcctcagcagcccaccctctccgatatgacaatgtacgagatgaatttcagcctgctggtggaagacacgttaggaaacatcgaccagccccagtatcggcagattgtggtcgagttgctcatggttgtttctattgtgctggagagaaatcctgaattggagtttcaagacaaggtggatctggaccgcctggtgaaggaggcctttaacgagtttcagaaggatcagagccgtctcaaggaaatcgagaaacaggacgacatgacctcattttataatacgccccccctggggaaaagagggacctgctcatacttaacaaaggctgtgatgaatctcctgctcgagggtgaggtgaagcctaataatgatgacccgtgcctaatctct

SEQ ID NO: 18163 - DNA, 3279 bp, Artificial Sequence
  Description of Artificial Sequence: Synthetic coding sequence
atggctggggccgccggcttgacggcggaagtgtcttggaaagtcctggagagacgggcccgcaccaaaagatctggatccgtgtacgaacccctcaagtcaatcaatctgccgcgccccgacaatgagactctctgggacaaactggatcattactacagaatcgtgaagtcgactctgctgctgtaccagtccccgaccaccggactcttcccgacgaaaacttgcggaggtgaccaaaaagcgaagatccaagattccctgtactgcgccgccggcgcctgggcactggcccttgcctacagaaggatagacgatgacaagggcagaacccatgagcttgagcactcggcgatcaagtgcatgcggggaatcctgtactgctacatgcgccaggctgacaaagtccaacagttcaaacaagacccgcgaccgactacgtgccttcatagcgtgtttaatgtgcataccggcgatgaactgctctcttacgaagagtacgggcacctgcagatcaatgccgtgtccctgtatcttctctatctggtggaaatgatctcatcgggattgcagatcatttacaacactgacgaggtgtcattcatccagaacctcgtgttctgcgtcgaacgggtgtatagagtgcctgactttggagtgtgggagcgggggagcaagtacaacaatggtagcaccgagctgcactcctcctcagtggggctcgcaaaggctgcattggaagccatcaacggattcaatctgttcggaaaccaaggctgttcttggtccgtgatctttgtcgacctggacgctcataaccgcaaccggcagactctgtgttcgctgctgccgcgcgagagcagaagccacaacaccgatgcagcactgctcccgtgcatcagttacccggcctttgcactggacgacgaggttctgttctcccaaaccctcgacaaggttgtccgcaagctgaaaggaaaatacggattcaagcggtttctgcgggacggttatcggacctccctggaggatccaaatagatgctactacaagccggcagaaatcaaattgttcgacggcattgagtgcgagtttcccatcttcttcctgtacatgatgatcgacggggtgtttcggggaaacccgaagcaggtgcaggaataccaggacctgctgactcctgtcctgcaccataccactgagggatacccagtcgtgccaaagtattactacgtgccagcagacttcgtggaatacgaaaagaacaacccgggatcgcaaaagcgcttcccttctaactgcggaagagatggaaagctgttcctgtggggacaggccctgtacataatcgccaaactgcttgccgacgagcttatctcaccgaaggatatcgacccggtgcaaaggtacgtcccactcaaagaccagcgcaatgtgtcgatgcgcttctccaatcagggcccgctcgagaatgacctggtggtccacgtggccttgatcgcagaatcgcagagactgcaagtgttcctcaacacttacggcatccagactcagacgccccagcaggtcgagcctattcaaatctggccgcaacaagaactggtcaaggcgtacctgcaactgggaatcaacgaaaagctgggcctgagcggacgaccggacagaccaatcggatgtctcggcacttcgaagatctacagaattctgggaaagaccgtggtgtgttatcccatcatcttcgacctgtcagatttctacatgtcacaagatgtgttcctgcttatcgacgatatcaagaatgctctccaattcattaagcagtactggaagatgcatggacggcctttgttcctggtccttatccgagaggataacatcaggggatcgcgcttcaatccaatcctggatatgctggccgctcttaagaaggggattatcggaggggtgaaggtgcatgtggatagactccaaaccctgatctctggcgcggtggtggaacagctcgacttcctgaggatctcagataccgaggagctgccagaattcaaatcgttcgaggaattggagccgccgaaacactccaaggtgaagaggcaatcaagcactccctcggcgcctgagctgggacagcagcctgatgtcaatatctccgaatggaaggacaagccaactcacgaaattctccagaagctgaacgattgttcctgcctggcttcacaggcaatcctgctggggatactgttgaaacgggaaggtcctaacttcataactaaggaaggaacggtgtcggaccacatcgagcgcgtgtacagaagagccggttcacaaaagctgtggctggctgtccgctatggagccgcgtttacccagaagtttagctcaagcatcgccccacatatcactacctttcttgtgcacggtaaacaagtgactctgggcgcgtttggacatgaagaagaggtcatctcgaaccccctttcccctagggtgattcagaatatcatctactacaaatgcaacactcatgacgaaagagaagccgttatccagcaggagcttgtgatccacatcggatggattatctccaacaacccagagctgttctccggcatgcttaagatccggatcggttggatcatccacgcaatggaatacgaactgcagatccgcggaggtgacaagccggcgctggacctgtaccagctctccccgtcagaagtgaagcagctcctgttggacatcctgcaaccgcaacagaatggacggtgctggttgaaccggagacagatcgatggctccctgaatagaacccccaccggattctacgacagggtgtggcagatcctcgaacgcacgccgaatggcatcatcgtggctggcaaacacctgccgcagcagcctaccctgtctgatatgacgatgtacgaaatgaatttcagcctcctggtggaggataccctggggaacatcgaccagccgcaataccgccagatcgtggtggagctcctgatggtggtttcaattgtgctggaacggaaccctgagcttgaatttcaagataaggtggacctcgaccgcctggtgaaggaggctttcaacgagtttcaaaaggatcaaagccggctgaaggaaattgaaaagcaggatgacatgacctcgttctacaacacccctccgttggggaagcgcggaacttgcagctacctgactaaagccgtgatgaatctgctcttggagggagaagtgaagccgaacaacgatgacccatgcctgatctct

SEQ ID NO: 18164 - DNA, 3279 bp, Artificial Sequence
  Description of Artificial Sequence: Synthetic coding sequence
atggcaggagcagcgggacttaccgcagaggtgtcatggaaagtgcttgaacggcgggcaagaactaagagatcagggtcggtgtacgagcctctcaaatccattaacctcccaagaccagataacgaaaccctttgggataaactggatcactactaccgtatcgtgaagtcgactctcctgctctaccaaagccctaccacgggactctttcctaccaaaacctgcggcggcgaccaaaaagcaaagatacaggattcactttactgtgcagcaggagcgtgggccctcgccctggcgtaccggcggattgacgatgataagggcagaacccacgaacttgaacattccgccatcaaatgtatgagaggcattctctactgttatatgagacaggcggacaaggtgcaacagtttaagcaggatcctaggccaaccacctgtctccattcagtgttcaacgtccataccggcgacgagttgctgtcgtacgaggaatacggtcatctgcagataaacgcggtgtccctttaccttctgtacctggtcgaaatgatatcgtcaggacttcaaatcatttacaacactgatgaagtcagcttcattcagaatcttgtcttttgtgtcgaaagggtgtatcgggtgcctgatttcggcgtctgggagcgggggtcaaagtacaataacggcagcactgagctgcattcttcctcggtgggacttgcaaaggcagcgcttgaggcaattaacgggtttaacctttttggaaatcagggatgttcatggtccgttatctttgtggatcttgatgcacataatcggaataggcaaactctgtgttccctgctccccagagagagccgttcgcacaataccgacgcagccctgctgccatgtatttcgtacccagcctttgcacttgatgacgaggtgcttttctcacaaaccctcgacaaggtggtgagaaaactgaaagggaagtacggattcaagcgattcctgcgggatggatatcggacctcactggaggaccccaaccgttgctactacaagccagctgagattaaactgtttgacggcatcgagtgcgaattcccaatcttctttctctacatgatgattgacggggtctttcgtggaaatccaaaacaagttcaagaataccaggaccttctcaccccagtgctccaccacaccactgaaggatacccagtcgtgcccaagtactactacgtgcccgcggactttgtggaatacgaaaagaacaatcctggatcccagaagcgctttccatctaattgtggacgtgatggaaaactttttctgtggggacaggctctttacatcatcgcaaaactgctcgctgacgaactcatttcccccaaggacattgacccagtgcaaagatacgtcccccttaaggatcagagaaacgtgagcatgcgattttcaaatcagggtcctctggaaaatgatctcgtcgtccacgtggcccttattgccgagtcgcaacgactgcaggtgttcctcaatacttacggcatacaaacgcaaactccacaacaggtcgaaccaatccagatatggccgcagcaggaattggttaaagcatacctccaacttggaattaacgaaaagttggggttgtcgggaaggcctgatcggcctatcggttgccttggtacttctaagatctaccgaatactgggtaagactgtcgtgtgctaccctatcatatttgatctttccgacttctacatgtcacaagatgtctttcttctgattgatgatatcaagaatgccctgcaattcattaagcagtattggaaaatgcacggacggccactttttcttgtgcttatacgggaagataacatcagaggttcgcgctttaatccaatcctcgacatgcttgcagctctcaaaaagggaataatcggcggtgtgaaggtccatgtggatcgccttcaaacgctcatttcgggggcagtggtcgaacaactggattttctcaggatttcagatactgaggaattgccggaattcaagtcgttcgaagaactcgaacctccaaagcatagcaaggtgaaaagacaatctagcactccttcagctcccgaactgggtcagcaaccggacgtaaacatttctgaatggaaggacaagccaacccatgaaattctgcaaaagctgaatgattgttcctgtcttgcgtcgcaagcaattctgcttggtattctcctcaagagggaagggccaaacttcatcacgaaagagggaactgtttccgatcatattgaacgagtgtaccgcagggccggttcgcagaagctgtggcttgcagtgcgatacggagcggcctttactcagaagtttagctcatcgatcgctccacatatcaccacttttcttgtgcatggtaaacaagttactctcggtgctttcggacatgaagaagaggtgatctcgaacccactgtcgcctcgggttattcaaaacatcatttactacaagtgcaatactcatgacgaacgtgaagccgtgattcagcaagagctcgttatccatatcgggtggataatctcgaataaccctgaactcttttctggcatgctgaaaattcggattgggtggataattcacgcaatggaatacgagttgcaaatccgaggtggcgataagccagcactcgatctgtaccaactttctccatccgaagtgaagcagctcctgctggatattcttcagcctcagcaaaacggacgatgttggctgaaccgcagacaaatcgacggttcccttaaccggaccccgactggattctatgaccgcgtgtggcagatccttgagcgaactccaaacggaattatcgtcgcaggtaagcacctcccgcagcagcctaccctgagcgacatgactatgtacgagatgaacttttcgcttctggtagaggataccctggggaacatcgatcaacctcaatacagacagatagtggttgaactgctgatggtcgtatcaatcgtgctcgaacgcaatccagagttggagttccaggataaggtggatctcgatagacttgtcaaagaggcatttaacgagtttcaaaaagatcaatcgaggcttaaggaaatcgaaaagcaagacgacatgacgtcattttacaacacgcccccgctgggcaagcgcgggacttgcagctatctgaccaaggccgtcatgaaccttctgctggagggcgaagtgaagcctaacaacgatgatccatgtcttatttcc

SEQ ID NO: 18165 - DNA, 3279 bp, Artificial Sequence
  Description of Artificial Sequence: Synthetic coding sequence
atggccggagcagccggattaacggcagaggtgtcttggaaggtccttgaaagaagggctcgaactaaacggtccggctcagtctacgagccgcttaagtccatcaacctcccccgacctgataacgaaactctgtgggataagctagaccactattacaggattgttaaaagcacactgctcctctaccaaagccctaccacgggcctgtttcccaccaaaacatgcggcggcgatcagaaagctaagatccaggactccctgtactgcgcagccggggcatgggcccttgcactcgcttaccgcagaattgacgatgacaagggtcgtactcatgaacttgaacacagcgccattaaatgcatgaggggaattttatactgttacatgcggcaggctgataaagtgcagcagttcaaacaggacccaaggcctactacgtgtctccactcggtgttcaacgtgcacacgggagatgaactgttgtcatatgaggagtacgggcacctgcagataaacgccgtatctctgtatcttttgtatctcgtggagatgatcagtagtgggctccaaatcatttacaacaccgacgaggtgtctttcatccagaatttggtcttctgtgtagaaagggtgtaccgggtgcccgactttggcgtgtgggaacgcggatcaaaatacaataacggctcaactgaactgcacagttcatccgtagggctggcaaaagccgccttggaagctataaacggcttcaacctgttcggtaaccagggttgttcatggagcgtgatttttgtggacctcgatgcgcataataggaaccgtcagaccctttgctccttgctgcccagagagagccgttcacataatactgacgctgccctcctgccttgcatctcatacccagcctttgccctggacgacgaagttctctttagtcagactttagataaagtagtgagaaaactcaagggcaagtatggcttcaagcgctttctacgcgacggttacagaacctccctcgaggatcctaacaggtgttactacaaacccgcagagataaagttgttcgatggcatagagtgcgagtttcctatcttctttctttatatgatgatagatggggtgttccgtggtaatccaaagcaggtgcaggaatatcaagacctcctgacccccgtcctccaccatacaacagagggctatccggttgttcccaaatattattacgtgcccgcggattttgttgaatatgaaaaaaataacccgggttcacaaaagcgcttcccgtcaaactgcgggcgcgatggcaaactctttctttggggacaggcactctatattatcgcaaaactcctggctgatgaactgatatctcctaaagacatcgatccggtacaacggtacgtgccgctgaaagaccagcgcaacgtttcgatgcgtttctccaatcaggggcctttggaaaacgacctggtggtccacgtagctttaatcgctgagagccagcgattgcaagtgttcttaaatacatatggtatacagacgcagacacctcagcaggtcgaaccgatacagatctggccccagcaggagctggtcaaggcgtatctgcagttgggaattaatgagaaattgggattgtctggccgcccggacagacctatcggctgccttggaacaagcaagatctaccgaattcttggcaaaacagtcgtgtgttaccccataatctttgacctgagcgatttttacatgtcacaggacgtgttccttctgatcgatgacatcaaaaacgctttacagttcatcaagcagtactggaagatgcacgggaggcccctgtttcttgtactgattagagaggacaacatcagaggttcccggttcaatcccattctggatatgctagccgcactaaagaaggggatcatcggtggcgttaaagttcatgttgaccgtcttcagaccctgatcagcggagctgtcgtggaacagctcgatttcctgagaatcagtgacaccgaggagttgccggaatttaaaagttttgaagagcttgagccccctaagcactccaaagtgaagcgccaatcaagcactccctcggcccctgagttgggacagcagccagacgtgaatatatccgaatggaaggacaagccgacccatgaaatcttacagaagctgaacgactgctcttgcctggcatctcaagccatactgctcggtatactgctgaaacgggaagggcccaactttattacaaaagagggtactgtgagcgaccacatcgagagggtctaccgcagagccggaagtcaaaagctgtggctggctgtaagatacggggcggcctttacacagaagttcagcagcagtattgctcctcatattacaactttcttggtgcacggcaagcaggtgaccttgggagccttcggacatgaggaagaggtgatatctaatccgttgagccctcgtgttattcagaacatcatttattataagtgtaatacgcatgatgaacgcgaggccgtcattcagcaggaactcgtcattcacatagggtggattatctcaaataatcctgaattattcagcgggatgctgaagatccggataggctggatcattcatgcgatggaatacgagttgcaaatccggggcggtgataagcctgccttggatctgtaccagcttagccccagcgaggtgaagcaattgttactggacatactgcagccccagcagaatggcaggtgctggctaaaccgtcgacagattgacgggagtctcaacaggacgcccaccggattttatgatagagtgtggcagattctagaaaggactcctaatgggatcattgttgccggaaagcacctcccgcagcagccaaccctgagcgatatgacaatgtatgagatgaacttttcccttttggtggaggacacgcttggcaacatcgatcagcctcagtatcgacagattgtggtcgaactcctcatggtggtctcaattgtcctggaacgcaatcctgaacttgaattccaagataaggtggatttggatcgcctggtgaaagaggctttcaacgaatttcagaaggatcagtcccgcctaaaggaaatcgagaagcaggacgatatgacatccttttacaataccccacctttgggaaaacgaggaacttgttcatatttgactaaggccgtaatgaacttattgctggaaggagaagtgaagcccaacaatgacgatccttgcctgatttct

SEQ ID NO: 18166 - DNA, 3279 bp, Artificial Sequence
  Description of Artificial Sequence: Synthetic coding sequence
atggcaggagcagccggactgactgcggaagtgtcgtggaaggtgctggagagaagagctagaaccaagcggtccggatcggtgtacgaacccctcaaatccataaaccttccaagacccgataacgaaaccctttgggataagctggatcattactaccgtattgtgaaatcgaccctcctcctttaccaatcgccaaccaccggtctgttccccaccaaaacgtgtggaggagatcaaaaggctaagattcaagactcactgtactgtgccgcaggtgcatgggcgctggcccttgcctatcggcgaatagatgatgataagggtaggacccatgagcttgaacattctgcaattaagtgtatgagaggtatcctctactgctacatgcgacaggccgacaaggtgcaacagtttaagcaagaccctagacctactacctgccttcattccgtgttcaacgtgcatacgggagacgagctgctgagctacgaagaatacggacaccttcagatcaacgccgtctccctttacttgctgtacctcgtggaaatgatcagctcggggcttcagataatctacaacaccgatgaagtgtcgtttattcaaaatcttgtgttttgcgtggagcgggtctaccgcgtgccagacttcggtgtgtgggagaggggttcgaagtacaacaatggatcgaccgaactccactcaagctctgtcggactggcaaaagcagccctcgaggcgatcaacggatttaaccttttcggaaatcagggctgctcctggtccgtgatttttgtggacttggacgcccataatcggaacagacagactctctgttcccttcttccacgggaatctcgttcgcataatactgacgcagccctcctcccatgcattagctaccctgccttcgcactggatgatgaggtgctgttttcgcaaacccttgacaaggtcgtccggaaacttaagggaaagtacgggttcaagagattcctgcgtgatggataccggacctcattggaggatccaaacagatgttactataagccagcggaaatcaagctgtttgatgggattgaatgtgagtttcccatctttttcctctacatgatgattgacggtgtctttaggggcaaccctaaacaagtgcaggaataccaagacctcttgacccctgtgttgcatcacaccaccgaaggatacccagtggtccccaaatactactacgtgccagcagattttgtggaatacgaaaagaacaaccctggatctcaaaagcgctttccttcgaactgtggccgcgatggcaagctgttcttgtggggacaggctctgtacatcattgcgaagttgcttgcagacgaactgatttcaccaaaggatattgaccctgtgcagcggtacgtgccacttaaagaccaaagaaatgtcagcatgcgcttctccaatcaaggcccactggagaacgatctggtggttcatgtcgctctgatcgcagaatcccaacggcttcaggtgtttctgaatacctacgggatacaaacccagacgccacaacaggtggaaccaatccaaatctggccccagcaagaacttgtgaaggcatatcttcagctgggcattaatgagaagttgggactctccggacgcccagacaggcctatcggatgccttggaacctcaaaaatctaccggatactggggaaaacggtggtctgttatccaatcatttttgacctctcagacttttacatgagccaggacgtatttctcttgattgatgacatcaagaacgcgctgcagtttatcaaacagtactggaagatgcacggtaggcctcttttcctcgtccttattagagaggataacatcagggggtcccgatttaaccctattcttgatatgctggcagcattgaaaaagggtatcatcggaggcgtcaaagtgcacgtggacaggcttcaaactctgatctcaggcgccgtggtcgaacagctggactttcttagaatttccgataccgaagaactgccagaattcaagtccttcgaagaacttgagcctcctaagcactcgaaggtgaaacggcaaagctcgactccatctgcccctgaactcggacaacaacctgatgtgaacatctcagaatggaaggataagcctacccacgaaattcttcagaagctgaacgattgttcctgtctggcatcccaagcaatactccttggtattctgctcaagcgggaaggccctaacttcattactaaggagggcactgtgtcagaccacatcgaacgcgtctacagacgggcggggtcgcagaagctctggctggccgtccgctacggcgcagcattcacgcaaaagtttagttcctcgattgcgccgcatattaccacctttctcgttcatggcaagcaggtgacgttgggagcattcggacatgaggaagaagtgatcagcaatccacttagccctcgcgtgatccagaacatcatttactacaagtgtaatacccatgatgaaagagaggcagtgatccagcaggaactggtcattcacatcggttggattatcagcaacaaccccgaacttttttcaggaatgctgaagattagaatcggatggatcatccatgcgatggagtacgaacttcaaatcagaggaggggacaagccggccctggatttgtaccaactgtcacctagcgaagtgaagcaacttctgctggatattctccaacctcaacaaaacgggcgttgctggctcaatcgtagacaaattgacggttcgcttaatagaaccccaactggcttttacgatcgcgtgtggcagattctggaaaggacgccaaatggtatcattgtggcagggaagcatcttcctcaacagcctacgctttccgatatgaccatgtacgagatgaacttttctcttttggtcgaagatacccttggaaacatcgatcagcctcaatacagacaaatcgtggtggaactcctgatggtcgtcagcattgtcctggagagaaacccagagcttgaattccaagacaaggtcgacctcgatcgcctggtgaaagaagccttcaatgagttccaaaaggatcaatcgcgccttaaggaaattgaaaaacaggatgatatgaccagtttttacaacactccacctctcggcaagaggggtacgtgttcgtacctcaccaaggcagtgatgaacttgttgctcgagggcgaagtcaagccgaacaacgatgatccatgtctgatttcc

SEQ ID NO: 18167 - DNA, 3279 bp, Artificial Sequence
  Description of Artificial Sequence: Synthetic coding sequence
atggctggagccgcgggactcactgccgaagtgtcctggaaggtcctggaacggagagcaagaaccaaacgttcaggctccgtgtacgaaccgctgaagtcgatcaacctgccgcgccccgataacgagactctctgggacaagctggaccactactaccgcattgtcaagagcaccctgttgctctaccagtccccgaccaccggtctgtttccgaccaaaacttgcggaggcgaccaaaaggccaagatccaggactcactgtattgtgcagcgggcgcgtgggctctggccctggcttacaggcgcattgatgatgacaagggacgcacccatgagcttgagcattccgccatcaaatgcatgcgaggtatcttgtattgctacatgagacaggcagacaaagtccagcagttcaagcaagacccgcgcccgaccacctgccttcactcggtgttcaatgtgcataccggagatgaactgcttagctacgaagaatacgggcatttgcagatcaatgctgtgtccttgtacctgctctacctggtcgaaatgatttcctctggcttgcagatcatctataacaccgatgaggtttcgttcatccagaacctggttttctgcgtggagcgggtctaccgcgtgccggatttcggagtgtgggagcgcggtagcaagtacaacaatggatcaaccgaactgcactcgagctccgtgggcttggccaaggcggcactcgaagctatcaacggattcaacctgttcggcaatcaaggatgctcgtggtccgtcatctttgtcgaccttgacgcccataaccggaacagacagaccctttgctcgctcctcccgagagaatcgcgcagccacaataccgacgccgccctgctgccttgcatttcgtacccagccttcgctcttgatgatgaagtgctcttttcgcagactctcgacaaggtggttaggaaactcaaggggaagtacggctttaagaggttcttgcgggacggttaccgcacttccctggaggacccaaaccggtgttactacaaaccagccgaaatcaagttgttcgacgggatcgagtgcgagttccccatcttctttctgtacatgatgatcgatggggtgttccggggaaatcctaagcaggtccaggagtatcaggatctgctcaccccagtgcttcaccataccactgaaggctaccccgtggtgccgaagtactactacgtgcccgcggatttcgtggaatacgaaaagaacaatcccggctcccagaagcggttcccgtcgaattgcggccgggatggaaaattgttcctgtggggacaggcactgtacatcatcgccaagctgctggccgacgagcttatttcgccgaaggatatcgatccagtgcagagatacgtgccgctgaaggatcagaggaacgtgtcgatgaggttttcgaatcaggggcctctggaaaatgacctggtggtccatgtggcccttattgcggaatcccagcggctgcaagtgttcttgaacacttacggaatccagacccagaccccgcagcaagtggaaccgattcagatttggccgcagcaggagctcgtgaaggcatacctccagctgggaattaacgaaaaactcgggctttcgggccgcccggatcgccctattgggtgtcttggaacctcgaagatttacagaatcctcggaaagactgtggtctgctatccaattatctttgacctgtccgatttctacatgtcacaggatgtctttctcctcattgatgacatcaagaatgccctgcagttcatcaaacagtactggaaaatgcatggcaggccactgttcctggtcctgatccgcgaggacaacatccgcggatccaggtttaacccgatcctggatatgctggccgcactgaagaaaggcatcatcggaggggtcaaggtgcacgtggaccggttgcagaccctgatctccggagcagtggtggaacaactggacttccttcgcatctccgacacggaagaactcccggaattcaagtcattcgaagaactcgaaccgccgaagcattcgaaggtcaagcgccaatcctcaaccccgagcgctccggaactgggtcagcagccggatgttaacataagcgaatggaaggataaaccgacccacgaaatcctccagaagctcaacgattgctcatgtctggccagccaggcaatcctgctgggaatcctcttgaagcgcgagggaccgaatttcattactaaggaaggcactgtctcggaccatatcgagcgcgtgtaccgcagagcggggtcacagaagctctggttggccgtgagatacggagcagccttcactcagaagttcagctcaagcatcgcaccgcacatcactactttcctggtccacggaaaacaggtgacgctgggggccttcggacatgaagaggaggtcatctccaaccccttgtcaccacgcgtgatccaaaacatcatttactacaagtgcaacacccacgatgaacgggaagcggtgatccaacaggaactcgtgatacatattggctggatcatctccaacaatccggaactgttttcaggaatgttgaagatccgcatcggctggatcattcacgctatggaatacgaactgcagatccggggaggtgataagcctgcgctcgacctgtaccagctgtcgccgagtgaagtgaagcaattgctcctggacatcctccaacctcagcaaaacggccggtgctggctgaatagacgccagattgatggatcgctgaatagaactccaaccggattctacgaccgcgtgtggcaaatcctggaaagaacccctaacggcattatcgtggctggcaagcacctgccgcagcaaccgacgctctccgacatgacgatgtacgagatgaatttctccctcctggtggaagatactttgggaaatatcgatcagcctcagtacaggcagattgtggttgagctccttatggtggtgagcatcgtgctggagaggaaccccgagctggagttccaggacaaggtggacctggaccggcttgtgaaggaggcatttaacgaattccagaaagaccagagccggttgaaggaaatcgaaaagcaggacgatatgaccagcttctacaacactcctccgctgggaaaacgcggtacttgctcatatttgaccaaggcggtcatgaacctgctgctcgaaggagaagtgaaacctaacaatgatgatccgtgcctgatctcc

SEQ ID NO: 18168 - DNA, 3279 bp, Artificial Sequence
  Description of Artificial Sequence: Synthetic coding sequence
atggccggggccgccggactgaccgcggaagtgtcgtggaaagtactggaacggagagcgcggaccaaacgatcgggatcggtgtacgagccactcaaatccatcaatcttcctagaccggacaatgagacgctctgggacaagctcgaccattactaccgcatagtgaagtcgactctgctgctgtaccagagcccgaccactggactgtttccaactaagacttgcggtggcgaccagaaagcaaagatccaggactcgttgtactgcgctgcgggcgcatgggccctggccctcgcgtaccggcgcatcgacgacgacaagggcaggacccacgagctggaacacagcgcgatcaagtgcatgcgcggaatcctctactgctacatgcgccaggcggataaagtgcagcaattcaagcaagatccacggccaaccacttgcttgcactctgtgttcaacgttcacaccggagatgaactcctgagctacgaggagtacggacatctccagattaacgccgtctctctgtatctgctctaccttgtggagatgatctcttctggtttgcaaatcatctataacaccgatgaggtgagctttattcagaacctcgtcttttgtgtggaacgggtgtaccgggtgccggacttcggcgtttgggaacggggaagcaagtacaataatggaagcaccgaactgcattcatcgtcggttggacttgccaaggcagccctggaggccatcaacggtttcaacctgttcgggaaccagggttgtagttggtccgtgattttcgtggacctggatgctcataatcgtaaccggcagactttgtgcagcctgctgccgcgggagagccggtcacacaatactgatgccgcgctcctgccatgcatcagctaccctgcattcgcactggacgatgaggtgctgttcagccaaactttggataaggttgtgagaaagctcaaggggaagtacggctttaaacgcttcctcagggatggatatcggacctccttggaggaccccaaccggtgttactacaaacctgcggagatcaagctgttcgacggcatcgagtgcgagtttccaatcttcttcttgtatatgatgatcgacggcgtgttccggggcaacccgaagcaggtgcaggaataccaagatctcctgaccccagtcctgcaccacaccaccgaaggatacccggtagtcccgaagtactactacgtgcccgctgacttcgtggagtacgaaaagaataacccagggtcgcaaaagcggtttccttccaactgcggacgcgatggtaaactgtttctctggggccaggcgctgtacatcattgccaagctgctggcagatgaactcatctccccgaaggacatcgaccctgtgcaacgctacgtcccactgaaggaccagcgcaatgtgtcgatgcgttttagcaatcagggccccctggagaacgatctcgttgtgcacgtggcgcttattgcagagagccaacggcttcaggtatttctgaacacttacggcatccagactcaaacgcctcagcaggtggagcccatccagatctggccacaacaggaactggtcaaggcctacctgcagctcggaatcaacgaaaaactgggcttgtccgggaggccggacagaccaatcggatgcctgggaacgagcaagatttaccgcattttgggaaagacggtggtgtgctacccgattatcttcgacctctcggatttctatatgtcacaggatgtattcctgttgatcgacgacatcaagaatgccctgcagttcattaaacagtactggaaaatgcacgggcggccactctttttggtcctcatcagggaggacaacatccgcggttcccgcttcaatccgatcctggatatgctcgccgcgttgaagaagggtatcattggaggagtgaaagtgcacgtggacagactgcaaaccctgatcagcggcgccgtggtcgaacaacttgactttctgaggatctccgacactgaggagttgcccgagttcaaatcgttcgaagaactcgaaccacctaagcatagcaaggttaaacggcaatcctcgactccttcggccccggagctcggacaacaaccagatgtgaacatttctgaatggaaggataagcctacccatgaaattctgcagaagctcaacgattgttcctgtctggcttcgcaagcgatcttgctggggatcctgctgaaacgggaaggaccgaacttcatcaccaaagagggaactgtgagcgaccacatagagcgggtgtaccgccgagcaggcagtcaaaaactgtggcttgccgtccggtacggtgccgccttcacccagaaattctcttcatcaattgccccccacatcaccaccttcctggtccacggtaagcaggtgactctgggggccttcggacatgaagaggaagtcatctccaacccgctttcccctcgcgtgattcagaatatcatctactacaagtgcaacacgcatgacgaacgggaagccgtcatccagcaagaactggtgatccatatcggctggatcatctccaacaacccagagctcttctccggtatgttgaagatcagaatcggatggattatccacgccatggaatacgagctgcaaatccgcggcggagacaaaccagcccttgacctgtaccagctgtcaccgtcagaggtgaagcagctgctgctggacatcctccagccccagcagaacggacggtgttggctgaataggcgccaaatcgacggatcgctgaaccgcaccccaactggattctacgatcgagtgtggcaaatcctggaaagaactcctaacgggatcatcgtcgcgggaaagcatttgcctcaacagccgaccctgtcagatatgacgatgtacgaaatgaatttctcgctgctcgttgaagataccctcggaaacatcgatcaaccgcagtaccggcagatcgtggtggagctgctgatggtcgtgtcgatcgtgctcgaacgaaatcccgagctggaatttcaggataaggtcgacctcgatcggctggtgaaggaggcattcaatgaattccaaaaggatcaatcacgactcaaagaaatcgaaaagcaggatgacatgaccagcttctataacactccgccgctcggaaagagaggtacttgctcgtacctcaccaaagctgtcatgaatctgctgctggaaggagaagtcaagccgaacaacgacgatccctgcctcatttca

SEQ ID NO: 18169 - DNA, 3279 bp, Artificial Sequence
  Description of Artificial Sequence: Synthetic coding sequence
atggcaggggcggcaggacttactgccgaagtctcgtggaaagtgctcgaacgcagagcccgcactaagagatccggcagcgtctacgaacccctcaaatcaattaacctcccccgcccggacaacgaaaccctctgggataaacttgaccattactacagaatcgtgaagtcgactttgctgctgtaccagagcccaactaccggcctgttcccaactaagacttgtggcggggaccagaaagcgaagattcaggactcgctgtactgcgcagctggcgcatgggccctggcgctggcctacagaaggatcgatgacgacaagggacgaacccacgaacttgagcacagcgcaattaagtgcatgcggggcatcctctactgctacatgcgtcaggcagacaaggtgcagcaattcaaacaagaccccaggccaaccacgtgcctgcattcggtgttcaacgtgcacactggcgacgagcttttgtcgtacgaggaatacggacatctgcagattaatgctgtctccctgtacctcctgtaccttgttgaaatgatctcttccggcctccagattatctacaatacggacgaagtctcgttcatccaaaacctggtcttttgcgtcgaacgcgtgtatcgtgtgccggatttcggcgtgtgggagaggggctcgaagtacaacaacggatccactgaactgcactcgtcaagcgtcggactggctaaggcggccttggaggctatcaatgggtttaatcttttcggaaaccagggatgttcctggtccgtgatcttcgtcgacctcgatgcccataaccgtaaccggcagaccctctgctcccttcttccacgcgagagccgatcacataacaccgatgccgcactgctgccttgcatctcctaccctgcctttgccctcgacgacgaagtgctcttcagccaaaccctggataaggtggtgagaaagctcaagggcaagtacggattcaagcggttcctcagagacgggtaccgcacctcactggaggatccgaatagatgctactacaaaccggcggagatcaagctgttcgatgggatcgaatgcgaattccctatcttctttttgtatatgatgatcgacggggtgttccgcggcaatccgaaacaagtccaggaatatcaagacttgctgactccggtcctgcaccacaccacggaaggctacccggtggtgccaaaatactactacgtgccggctgacttcgtggaatatgaaaagaacaacccgggaagccaaaagcggttcccatccaattgtgggcgggatggtaagctgtttttgtggggtcaggccctctatatcatagcgaagctgcttgctgatgaactcatcagcccgaaggacatcgaccctgtccaacgatacgtcccgttgaaagaccagagaaacgtgtcgatgcgcttttcaaatcagggaccactcgaaaacgacctcgtcgtgcacgtggctctgattgccgaatcacagcggttgcaggtctttctgaatacctacggtatccagactcagaccccccaacaagtcgaacccatccagatctggccgcagcaggaactggtgaaagcctacctgcagcttgggattaacgagaagctggggttgagcggtagaccagacaggccaattggctgcttgggcacctccaagatttacagaattctcggaaagaccgtcgtgtgttacccaatcatctttgatctgtctgatttctacatgagccaggacgtctttctgctcatcgacgacatcaagaacgcgctgcagttcatcaagcagtactggaagatgcatggcagacctctgttcctcgtgctcatcagagaggataacatcagaggatcgagattcaatccgatcctggatatgctggccgcccttaagaagggaataatcggaggcgtgaaggtgcatgtggaccggctgcagactctcatctccggagcagtggtcgagcagctggacttcttgcgcatctcagatactgaagagctgccggaattcaagtcatttgaggagctcgaacctcctaagcactcgaaggtgaagcgccagtccagcaccccgtctgcccctgagctgggacagcagcccgacgtcaacatctcagagtggaaagataaaccgactcatgagatcctccagaaactcaacgactgctcatgccttgcatcccaggccatccttctgggaatcctcctgaagcgcgaaggaccaaacttcatcacgaaagaaggaactgtgtcggatcacatcgagcgcgtgtacaggcgggcaggctcgcaaaagctctggctggcagtgcgctacggcgcagcctttactcagaagttttcaagctccattgccccccacatcactacgttcctggtgcatggaaagcaggtgactttgggagctttcggacacgaggaggaggtcatttccaatccactgtcgccgcgcgtgatccagaatatcatatactacaagtgtaacacccatgacgaacgggaggccgtgatccagcaagagctggtcatccacatcggctggatcatcagcaacaatccagaactttttagcgggatgcttaagatccggatcggttggatcattcatgcgatggaatatgagctgcaaatccgcggtggagacaaaccggcacttgacctctaccaactgtccccatccgaggtgaagcaactgctgctcgatatcctgcaacctcaacagaacgggcggtgttggttgaaccggcggcaaatcgatggctccttgaacagaaccccgacgggattttacgatagagtctggcagatcttggagcggaccccgaacggcatcatcgtggcaggtaaacacctcccccagcagccgactctgagcgacatgaccatgtacgagatgaacttctcgctcttggtcgaagatactctgggaaatatcgaccagccgcagtacaggcagattgttgtggagctcctcatggtggtgagcatcgtgctggagcggaatccggaacttgaattccaggataaagtggacctggacagattggtgaaggaggcgtttaatgagtttcagaaagatcaatctcgactgaaagaaatcgagaagcaagacgatatgacttccttttacaatactcccccactgggaaagcgcggtacctgctcgtatctcaccaaagccgtgatgaacctcctgctggagggtgaagtcaaaccgaataatgacgatccgtgcttgatcagc

SEQ ID NO: 18170 - DNA, 3279 bp, Artificial Sequence
  Description of Artificial Sequence: Synthetic coding sequence
atggccggggccgccgggctaacagcagaagtcagttggaaagtgctggaaaggcgagctagaacaaaacgttctggatcagtgtacgaaccattaaagtccatcaatcttcctaggcccgataacgaaacattgtgggataagctggatcattactatagaatagtcaaatctacattactcctatatcagagtccaacaactggactttttcctactaaaacttgcgggggagaccagaaggctaagatacaggattcactgtactgcgccgccggggcctgggctttggcccttgcatatcgccggatcgatgatgataaagggagaactcatgaacttgaacattccgctataaaatgtatgcgaggaatactttattgctacatgcgccaggccgataaggtgcagcagtttaaacaagatcctcggccaacgacatgtctgcactctgtgttcaacgtgcacacaggggatgaactgctttcctatgaagaatatgggcacttacagataaacgcggtctctctttatcttctctatctcgtagaaatgataagttctggactccagataatctataacactgacgaggtctctttcatccagaatctggtgttttgcgtcgaaagagtatatcgggtcccagacttcggggtatgggaaagaggatctaaatataacaatgggtcgacagaactccatagttcttccgtagggctcgccaaggctgctctcgaagctataaatggatttaacttgttcggaaatcaggggtgttcctggtcggtgatctttgtcgatctggacgcacacaacagaaaccggcagacactgtgctctctgcttccacgcgaatcccggtcccataatacagatgctgccctgctcccttgtatttcatatccggcctttgcgctagacgatgaagtgctatttagtcagactctggataaagtggtgcgaaagctcaaagggaagtatgggttcaaacggttcctgcgggatggataccggacttctcttgaggatcccaataggtgctattataagcccgcggagatcaagcttttcgatggaatcgagtgtgaattcccaatctttttcctttacatgatgatagacggagtctttaggggaaaccccaaacaggtacaggaatatcaggatttactcacaccagttctgcatcatacaacagaggggtatcccgttgttccaaaatactactatgtccctgccgactttgtagaatatgagaagaataaccctgggtctcagaaacgcttcccatcaaactgcggaagagatgggaagctcttcctttggggacaggcactctatataatcgctaaactcctggcagatgaactaatatcccctaaggatatagatcctgttcagcgatatgtgccactaaaagatcagaggaacgtgagtatgcggttctcaaaccaggggccattggaaaacgatctggtggttcacgtggctctcatcgcagaatcccagcggcttcaggtctttctaaatacttatggaatccagacacaaacgccacagcaggtggaacccatacagatctggccccagcaggaactcgtgaaagcttatctacagcttggaataaatgaaaaacttgggctctccgggagaccagatcgacctataggatgcctgggaacttcaaaaatctaccggatactggggaaaactgtggtttgttatcccatcatttttgacctgtccgatttctacatgtcacaggatgtgtttcttctgatagacgatatcaaaaacgccctacagtttatcaagcagtactggaagatgcatgggcggccattgtttttggtgctaatacgcgaagataatattaggggatcaaggttcaatcctatcctagatatgctggcagcgctaaaaaaagggataataggaggggttaaggtgcatgttgaccggcttcagactctcatatccggggccgtggtggaacagctggattttctcaggatctccgatacagaagagctgcccgagtttaagtcatttgaagaactggaaccccccaaacattccaaagtaaaaagacagtcttctacaccctctgctcctgaactggggcaacaaccagatgtgaacatctccgaatggaaggacaaacccactcacgaaatacttcagaaacttaatgattgctcttgcctcgcaagtcaggcaatcctcttgggaatactcttgaaacgggagggacccaactttatcacaaaagaaggaacagtttcagatcacatagaacgggtatacagacgggctggatctcagaaactctggctggcagtgaggtacggggcagcttttacacagaagttttcttcttccatagccccacacatcactactttcctcgtccatgggaagcaggtcactctcggggccttcggacacgaggaagaggtcatttcaaatcctctaagtcctagagtgatccagaatatcatctactataaatgcaatactcatgatgaacgggaggccgtcatacaacaggagctagttatacatatcggatggataatatcaaataatccagaattattctcaggaatgttaaaaattcggatcggatggataatacacgcaatggaatatgagttacagattagaggaggggacaaaccagctttggacctctaccagctctccccatctgaggtcaaacagctactcctagatatcctgcagccacagcagaatggacgctgctggctaaatcgccgacagatagatggatccctcaacagaactccaacagggttttacgatcgcgtctggcagatattagaaaggactcccaacggaattatagttgccggaaaacatctcccccagcagcccacattatctgacatgacaatgtatgaaatgaacttctcgctacttgtagaagacactctggggaatatcgatcagccacagtacaggcagatcgtggtagagcttctgatggtggtgtctatcgtcctggaaagaaacccagaactagagtttcaggataaagtggacctagataggcttgttaaagaagccttcaacgaattccagaaagatcagtcacggctgaaggaaatagaaaaacaggatgatatgacttctttttataacacaccgcctctggggaaaaggggaacttgtagttatctgacaaaagccgttatgaacttactcctggagggggaagtaaaacccaataacgatgatccatgtttaatctcc

SEQ ID NO: 18171 - DNA, 3279 bp, Artificial Sequence
  Description of Artificial Sequence: Synthetic coding sequence
atggctggcgctgccggcctcaccgcagaggtgtcctggaaggtcttagaacgcagggcccgaaccaaacggtccggctccgtttatgagcctctcaagtctatcaatctgccacgaccagacaatgaaacactgtgggacaagctggatcattactatagaattgtgaaatccacactactgctctaccagtccccaaccaccgggttattccctaccaaaacctgcggtggcgatcagaaagctaagatccaggactctctgtattgtgcagccggtgcctgggctctcgctctggcctatcgcagaatcgatgacgacaagggtcgcacccacgaattggaacattccgccataaaatgcatgcggggcatactctattgttatatgaggcaggctgataaggttcagcagttcaagcaagatcctcgtccaaccacatgcttacatagcgtgtttaatgtccatactggggacgagctcctgagctacgaggaatatggacatctgcagataaatgccgtcagtttgtacctgctctatctggtggagatgataagcagcgggctgcagattatatataatacagacgaggtctcatttatccagaatctggttttttgcgtagaacgggtgtaccgggtgcctgattttggcgtttgggagcgcggatctaagtataataatggttcaacagagctgcatagctcctctgtcggcctggcaaaggcagccctggaggcaatcaatgggtttaatctgtttggcaatcagggctgtagttggagtgtgatattcgtcgacctggatgctcataatagaaacagacaaacattatgttccctcctgccccgtgaaagtcgatcccataacaccgatgctgcactgcttccctgtatcagctatcctgccttcgctctggacgacgaggtgttgttctctcagactctggacaaggttgtgcggaagctgaaaggtaaatatggatttaagaggttcttacgtgatgggtatcgaaccagcttggaagaccctaacagatgctattacaaaccagccgaaatcaaactgtttgacggaatagaatgcgaattcccaatcttcttcctgtatatgatgatcgacggggtgttcagggggaaccccaagcaagtgcaagagtatcaggaccttttaacaccagtgcttcaccatactactgaaggctatccagtcgtgccaaagtattactatgtgcccgcagacttcgtggaatacgagaaaaataacccagggtctcagaaaagattcccttctaattgtggaagagatggaaagcttttcctgtggggtcaggctctctacatcatcgccaaacttctggccgatgaacttatttcaccaaaagacattgaccccgtgcagcgatacgtccccctgaaggaccaacgaaacgtttctatgcgattcagcaaccagggcccactggaaaacgacctggttgttcatgtggccctgattgccgaatcccagcggctgcaggtgttcttaaacacttacggaatccagactcagacaccacagcaggtggagccaatacagatctggcctcagcaggaactcgttaaggcttaccttcagctcgggatcaatgaaaaactgggcctctccggacggcctgaccgccccataggctgtctgggcaccagtaaaatctaccgaattctgggcaaaaccgttgtgtgttaccctatcatctttgacctgtctgatttttatatgtctcaggacgtttttctgctgattgacgatatcaaaaacgctctgcagtttattaagcaatattggaagatgcatggcaggcccctgttcctggttttgatacgcgaggacaacatcaggggcagtagatttaatcccattttagatatgctggccgctctgaagaaaggcatcattgggggtgtgaaagtgcacgtcgaccggttgcagacactgattagcggcgccgttgtagagcagctggacttcctgcggattagtgacactgaggaactgccagaattcaagagttttgaggagcttgagcctccaaaacactccaaggtgaaacggcaatccagcactcctagcgcaccagaactaggacagcagcctgacgtgaacataagcgagtggaaggataaacccacccacgagattctccagaaattaaacgattgttcctgtctagcctcccaggctattctgctggggattctgttaaaacgagaaggacctaacttcattaccaaagaggggaccgtttctgatcacatagagagggtgtatcgccgcgctggcagtcaaaaactgtggctagctgtgaggtatggcgccgcctttactcagaagttctcctctagcatagctcctcacattaccacattcctggtgcatggcaagcaggtaaccctgggtgcattcggccatgaagaagaagtcatttccaaccctctgtcccccagagtgatacagaacatcatttactacaaatgtaacacccatgacgaacgagaggctgtgatccagcaggagctagttattcatatcggatggataatatctaacaatcccgagctgttctccgggatgctgaaaatcaggatcggctggattatacatgccatggaatatgagctgcaaatcaggggtggagataaaccagccttagacctgtaccagctgagccctagcgaagttaagcagctacttctggacatcctgcagccccagcaaaatgggcggtgctggctgaacaggagacaaattgatggcagcttaaatcgtacccctactggattttacgaccgagtctggcagatactggaacgaaccccaaacgggattatcgtcgcaggcaaacatttgcctcagcagcccacactgtccgatatgacaatgtacgagatgaatttttccctgctggtcgaagatactctcggcaatatcgaccagcctcagtataggcagattgttgtggaattgctcatggtagtctctatcgttctcgagcgtaacccagagctggaattccaggacaaggttgacctagaccggctggtgaaggaagccttcaatgagttccaaaaagatcagtcccggctaaaggagatagagaagcaagacgacatgaccagcttctacaatacacctccactgggcaagcggggcacatgttcatatttaaccaaggctgtgatgaacttactgctggaaggagaagtgaagcctaacaacgatgatccttgcctgatatct

SEQ ID NO: 18172 - DNA, 3279 bp, Artificial Sequence
  Description of Artificial Sequence: Synthetic coding sequence
atggccggtgccgctggcctgactgccgaagtgagctggaaggtcctggagaggagagcacgtaccaagagatcaggctcagtgtatgaacctctgaaatcaatcaatctgccacggcctgacaacgagaccttgtgggataaactggatcactattataggatcgtgaaatctacactgctgctgtatcaatcccccaccaccggattgtttcctactaagacttgcggcggggaccaaaaggcaaaaattcaggactcactttactgtgcggcaggtgcatgggctttggcccttgcctaccgtcgaatcgatgatgacaagggcagaacacatgagctagagcactccgcaattaagtgcatgcgcggaatcctatattgttacatgcgacaagccgataaggtccagcagtttaaacaagatccgcggcccactacctgccttcactctgttttcaatgtgcatactggcgacgaactgctcagctacgaagagtacgggcaccttcaaatcaatgccgtgtctctctacctgctgtatttggtcgagatgatctcttcgggcctgcaaattatttataacaccgacgaagtgagcttcatccaaaatctggtgttttgtgtggagcgcgtctatagagtacccgatttcggagtatgggagcgaggctctaaatataataacggatcgacagaacttcactctagtagtgtcggcttagctaaagctgccctcgaggctatcaatggtttcaaccttttcggtaaccagggatgctcttggagcgtgatcttcgttgacctggacgcccacaacagaaaccgccagaccctctgttcactcttgcctcgggaatcccgcagccataataccgatgcagcgctgctcccctgcatctcataccccgccttcgcactcgacgacgaggtgctgttttcgcagactctcgataaagtcgtccgcaagctgaagggaaagtacgggtttaaaagattccttagagacggttacagaacctcgttagaagacccaaataggtgctattacaagcctgccgagatcaagctgtttgacggcattgagtgcgagtttcccatcttcttcctgtacatgatgatagacggagtcttccgaggaaacccaaagcaggtgcaggagtatcaggatctgcttacacctgtgttacaccacaccactgagggttatccagtggttcccaagtattattacgttcctgccgatttcgtcgagtatgagaagaataatcccggcagccagaagaggttccctagcaactgcgggagggacggaaagctgttcctgtggggacaggcactgtacataattgctaagctgctcgctgatgaactaatcagtcctaaggacattgatcccgtgcagcgatatgtgcccctgaaagatcagcggaatgtgtccatgagatttagcaatcagggccctttggaaaatgatcttgtcgtgcacgtcgctttgatagccgaatcccagcggctgcaggtgtttctgaatacctacggcattcagactcaaaccccccagcaggttgagccgattcagatctggcctcagcaagaattggtcaaagcctatcttcagctaggaatcaatgaaaagctgggactgagtggccgcccagatagacccatcggctgcttgggcacatcaaagatctaccggatcctgggcaagactgtggtgtgctatcccattatctttgacttgtctgacttttatatgtctcaggacgtgtttctcctaattgatgacataaagaatgccttgcagttcatcaaacagtattggaagatgcacggccggcctctctttcttgtgcttattcgggaggataatatcagaggcagtcggtttaaccctatcctggatatgctagccgccttaaaaaaaggcattatcggcggcgtcaaggtccacgtggacagattacaaacactgattagtggcgccgtggtggagcagctggacttcctgcgtatttccgacactgaagagctaccggaatttaagagtttcgaggagcttgagccacctaagcacagcaaagtgaagaggcagtcgagtacccccagtgcgcccgaactgggccagcagcctgatgtaaacattagtgaatggaaggacaagccgacacacgagatactccaaaaactgaatgattgctcatgcctggcctcccaggccatcctgctaggaattctcctgaaacgcgaaggaccaaattttatcacaaaagaaggcacggtctcagatcatatcgagcgcgtctatagacgggctgggtcccagaagctatggctagccgttcggtatggcgctgcctttactcagaagttttcttcatccatcgccccccacatcactacatttctcgtgcacggtaagcaggtgaccctcggcgcgttcggccacgaagaggaggtgattagcaaccctctgagtccccgagtaatacaaaatataatatactataagtgcaatactcacgacgaacgggaggctgtgatacaacaagaactagttatacacattggctggatcatctcgaataacccggagcttttcagtgggatgctgaagattagaatcggctggatcatccacgctatggagtatgagttacagattcgaggcggagataaacctgccctcgacctgtatcaactgtcaccttcagaggtgaagcagctgttactcgatattttacagcctcagcagaatggtagatgctggctaaacaggcggcagattgacggtagcctcaaccgcacacctacaggattttacgatcgggtctggcagatcctcgagcggacacccaatggcattattgtggctggcaaacaccttccacagcaaccaaccctctctgacatgacaatgtacgagatgaacttttctctcttagtcgaggacacactggggaatatcgatcaacctcagtatagacagatcgtagtggaattgttgatggttgtgtctatagttttggagaggaacccggagctcgagttccaggataaggtggatctggatcgattagttaaagaggcttttaacgagtttcagaaagaccagtcgcgactgaaggagatcgagaagcaggacgatatgacctccttctacaacaccccacccctgggaaagagaggaacctgctcttaccttaccaaggcagtgatgaatctgcttctggaaggtgaggtaaaaccaaacaatgatgatccctgtctgatctcg

SEQ ID NO: 18173 - DNA, 3279 bp, Artificial Sequence
  Description of Artificial Sequence: Synthetic coding sequence
atggcaggagcggccggccttaccgcagaagtgagctggaaagtgctcgagcgccgcgccagaaccaagcgctccggtagcgtgtacgaaccccttaagtccattaatctccctcggccagacaatgaaactctttgggataagctggatcactactaccggatcgtcaagtccaccctccttctgtaccagtcgcctacgactggactcttccctactaaaacctgcggaggggaccagaaagccaagattcaggattccctctactgcgctgcgggggcttgggccctggccctcgcgtacagaagaatcgatgatgataaagggcgcactcacgaattggaacattctgccatcaaatgcatgagaggtatcctgtactgctacatgagacaggcggataaggtgcagcagttcaagcaggatcccagaccgaccacctgcctgcattccgtctttaacgtgcacaccggggacgaactgctttcctacgaggaatacggacacctccagatcaacgccgtgtccctctacctgctgtacctcgtcgagatgatctcatcggggctgcagatcatctacaatactgacgaagtgtcattcatccagaatttggttttctgtgtggagcgggtctacagagtcccagacttcggagtctgggaacggggcagcaagtacaataatggatccactgaactgcacagcagctccgtgggactggccaaagcggcccttgaagccatcaacggattcaacctgttcggaaaccaggggtgttcctggtctgtgatcttcgtggacctcgacgcccataacaggaatcgccagacgctgtgctcactcctgccaagagagtcaaggtcccataacactgatgcggccctccttccgtgcatctcatacccggccttcgcactggatgacgaagtgctgttttcgcagactttggataaggtggtgaggaaactgaagggtaagtacggattcaagcggttcctgagagacggttaccggacctcactggaggatcctaaccggtgctactacaagccggccgagatcaagctgttcgacggtattgaatgtgaatttcctatcttttttctgtacatgatgatcgacggagtgttccgcggaaacccgaagcaggtccaagaataccaagacctgctgacgccggtgctccaccacaccactgaaggataccctgtcgtgcctaaatactattacgttccggccgacttcgtggaatacgagaagaacaacccgggatcacaaaagcgctttccctccaactgcggaagggacggcaaactctttttgtgggggcaggccctttacatcatcgccaagctccttgcggatgaactcatctcgccgaaggatattgaccctgttcagcgctacgtcccacttaaggaccaaaggaacgtgtcaatgcgcttctccaaccagggcccgctcgaaaatgatcttgtggtgcatgtcgccctcattgccgaaagccaacggctgcaagtgttcctgaatacgtacggtatccagacgcagactccgcagcaagtcgaacctatccagatctggccgcaacaggagctcgtgaaagcgtacctgcaactgggcattaatgagaagctcggactctccggtcgcccagaccgcccgatcggatgtctgggcacctcgaagatctaccggatcctcggcaagaccgtggtgtgctaccccattatcttcgacctgtcggacttctacatgtcccaagatgtgttcctgctgatcgacgacatcaaaaacgccctgcagttcatcaagcagtactggaagatgcatggaaggcctctgttcctcgtcctcatccgagaggataacatcagagggtcccgctttaatccgattttggatatgctggccgcgcttaagaagggaatcatcgggggcgtcaaagtgcatgtcgatcggctgcaaaccctgatatcgggcgcggtggtggaacagctcgactttttgcgcatctcagataccgaggaactccctgaattcaaatccttcgaagaactcgaaccgcccaagcactcgaaagtgaagcggcaatcctccacgccatcagcgccggagctgggtcaacagcctgacgtgaacatcagcgaatggaaggacaagcctacccacgaaatcctccagaagttgaatgattgctcttgcttggcctcgcaagcgattcttctcggaattcttctcaagagggaaggacctaacttcatcacgaaggagggaaccgtgtcggatcacatcgagcgagtctaccgccgcgctggttcgcaaaagttgtggctcgccgtgcgctatggagccgctttcacccaaaagttctcgtcctcgatcgccccgcacatcactaccttcttggtgcacggaaagcaggtgacgctgggggcattcggccatgaagaagaggtgatcagcaatccgctgtctccaagggtgatccaaaacatcatctactataagtgcaatacccacgatgagcgggaagccgtgatccagcaggagcttgtcatccacataggctggattatctcaaacaatccggaactgtttagcggaatgctgaaaattcgtatcggctggatcatccatgcaatggaatacgagctgcagatccggggcggagacaagccggcccttgacctgtaccagctgagcccatcggaggtcaaacagctgctgctggacatcctgcagccacagcaaaatggaagatgttggctcaaccgcagacaaatcgatggatccctcaaccggacgccgactggtttttacgatcgcgtctggcaaatccttgagcgcacgccgaatgggatcatcgtggcaggcaagcacctgcctcagcagccgaccctgtccgatatgacgatgtacgaaatgaacttttcgctgctggtcgaggacaccctggggaacatcgaccagccgcagtaccgccaaattgtcgtggagctgctgatggtggtgtcgatagtgctggagaggaacccggaactggagttccaagacaaggtggacctggaccggcttgtgaaagaagcgtttaacgagttccaaaaagaccaaagccgactcaaagagatcgaaaagcaagatgacatgacttccttttacaacactcccccactgggaaagcgaggaacctgctcatacttgactaaagcggtgatgaacctgctgttggaaggagaggtgaaacccaataacgatgatccctgcctgatttcc

SEQ ID NO: 18174 - DNA, 3279 bp, Artificial Sequence
  Description of Artificial Sequence: Synthetic coding sequence
atggctggtgcggcaggccttactgctgaggtgtcatggaaagtgctggaaaggagagcacgcactaaaagatccggctcggtttacgaaccactcaaatcaatcaatttgcccagaccggataacgaaacactttgggataagctcgaccattactaccgaatcgtgaaatctacactgctcctgtaccaatccccaactacagggctcttcccaaccaagacttgcgggggggaccaaaaagccaagattcaggatagtttatattgcgccgccggggcgtgggctctagccctggcctaccgtcggattgacgacgataaaggcaggacacatgagctcgagcacagtgcaatcaagtgcatgagggggatcctgtactgctacatgaggcaggcagataaggtccagcagttcaagcaagaccctcggcccacgacttgcctgcacagcgtcttcaacgtgcacaccggggatgaattgcttagctacgaggaatatggacatttgcagattaatgcagtatccctgtatcttttgtacctggtcgaaatgatctcatcagggctgcaaattatttacaatacggacgaggtcagcttcatccagaacttggtcttctgcgtagagcgagtgtatagagtccccgattttggagtctgggagaggggctcgaaatataacaacggctccaccgaactacatagtagcagtgtgggcctggccaaggctgctctggaggcgataaacggcttcaacctgtttggaaaccagggttgcagctggagcgtgatctttgtagacctagatgcacacaatagaaacaggcaaacactatgcagcttgctgcccagagaatcacgttctcataacacagacgcggcattgcttccctgcatctcgtaccctgcctttgccctcgatgacgaagttcttttcagccagactctggataaggtggtcagaaagctcaagggcaaatacggattcaagcgtttcctgcgggacggatatcggacttctctcgaagatcccaataggtgttactataagcctgccgagatcaaactgtttgacggcattgagtgtgaatttcctatctttttcttgtatatgatgatcgacggtgtcttcagaggtaaccccaagcaggtgcaggaataccaggacctcctgaccccagtcctgcatcacaccaccgaaggctatccagtggtccccaaatattattacgtaccagcagacttcgtcgaatacgaaaagaataacccaggctctcagaagagatttccctcaaactgcggccgcgatgggaagctgtttctctggggtcaggctctgtacattatcgccaagctacttgcggacgaattaatatccccaaaggatatcgatcctgtccagcgatacgtccccctcaaggaccagagaaatgtgtccatgaggttttctaatcaggggcccctggaaaacgacctggtggttcacgttgccctgatcgccgaatctcagagactgcaagtgtttctgaatacatatggaatccagacgcagacgccacagcaggtggagcccatacaaatatggccgcagcaggagctggtcaaggcctacctccagctgggcattaatgagaagttgggactgtcagggagacctgacaggcccatcgggtgcctgggtacttcaaaaatctataggattttaggcaaaacagtggtgtgctaccccatcatattcgacctctctgacttttacatgtcccaagacgtgtttctccttattgacgatatcaagaacgcattacagtttattaaacagtactggaagatgcatggacggccgttgtttctggtattaatccgggaggacaatattcggggatcgagattcaacccaatcttagatatgttggccgccctgaagaagggtattatcggaggtgtgaaagtgcacgtcgacaggctccaaaccctcatatccggcgcagtggtggagcagttggacttcctcaggatcagtgacactgaagagctgcccgagttcaagagttttgaagagctggagccaccaaagcactctaaggtgaagcgtcaaagtagcactccatccgcccctgagttgggtcagcagccagacgtcaacatctctgagtggaaggataagccaacccacgaaattctccagaagcttaatgactgttcctgtctggccagtcaggctattttactgggaatattgctaaagcgagaagggcctaattttatcacaaaagagggtaccgtatcagaccacattgagcgcgtgtaccgcagggccggttcccagaagttgtggctcgcggttagatatggagccgcctttacacaaaagttttcatctagtattgctccacacataaccacgtttcttgtgcacggtaagcaagtaacactgggcgctttcgggcatgaggaggaagtcatctctaatcccctcagtccccgggtgatccaaaacatcatctattataaatgtaacacccacgatgagagagaagccgtgatccagcaggaattggtaatccatatcggctggatcatatccaataacccggagctgttttccggtatgcttaagatccggattggatggatcatccatgcaatggaatacgaacttcagattagagggggcgataaaccagcgttagatctataccagttatctccaagcgaagtgaagcagctgctgttagacatcctgcagccgcagcagaatggccggtgctggttgaaccgcagacagattgacgggtctctcaaccgtacccctaccggtttttatgaccgagtctggcagattctggagcggacccctaatgggattatcgtcgctggtaaacaccttccacagcagcctaccctgagcgacatgactatgtacgaaatgaacttttccctgctcgtcgaggacaccctgggcaatatcgatcagcctcaatatagacagattgtggtcgagctccttatggtggtctcaatagtgctggaacggaatcccgaattagagtttcaagataaagtggatctggacaggctcgtaaaggaggcttttaacgagtttcagaaagaccagagccggctaaaagagattgagaaacaggacgacatgacctctttttacaatacaccacccctggggaagagaggtacatgttcatacctcaccaaggcagtcatgaacctcttgctcgagggtgaagtgaagccaaataacgatgatccctgcctgatatca

SEQ ID NO: 18175 - DNA, 3279 bp, Artificial Sequence
  Description of Artificial Sequence: Synthetic coding sequence
atggcaggggctgcagggctaaccgcagaggtgtcctggaaggtcttggaacggcgcgcgaggaccaaaagatctggaagcgtttatgagcccctcaaatccattaatttgccccgtccagataacgaaacgctgtgggacaagctagaccactattaccggattgtgaaatccacgttgctgttgtaccaatccccgacaaccgggctattccctactaaaacctgcgggggagatcaaaaggctaagattcaggactccctgtactgtgccgcaggagcgtgggctttagcccttgcctacaggcgcatagatgacgataaggggagaacccacgagctcgaacactctgccatcaagtgtatgcggggcattctctattgttacatgcgtcaagctgataaggtgcagcagttcaagcaggaccccaggcccacaacctgcctccactctgtttttaatgtgcatacgggagatgaactgttgagctatgaggaatacggtcatctgcagatcaacgctgtttcactttaccttttatacctcgtcgaaatgatatcctctggattgcagatcatctacaatactgatgaggtcagctttatccagaatctggtgttctgtgtcgagcgagtatacagagtcccagatttcggagtgtgggagcgaggttcaaagtacaacaatggatccacagagctccactcttcctctgtaggccttgccaaagccgccctggaggccattaacggattcaacctatttggaaaccagggatgtagttggtcggtgattttcgtggacctggatgcacataaccgcaacagacagacactgtgttccctcctcccaagggaatctcggtctcacaataccgatgcagccctattaccctgcatcagttaccccgctttcgcactggacgacgaggtgctgttttctcagacgctcgacaaggtggtaaggaaactcaaaggcaagtatggattcaagcgtttcttgcgggacggctaccgaacatctcttgaggacccaaatcggtgctactataagccagccgagatcaaactgttcgacggcatcgaatgcgagttcccaatattctttctctacatgatgatcgacggagtattcagggggaaccccaagcaggttcaggagtaccaggacttgctgaccccagtgcttcaccacaccactgagggctaccccgttgtgccgaagtactactacgtccctgccgatttcgtcgagtacgagaagaataatccaggcagtcagaaacggttcccgtctaactgcggccgggacggaaaactgtttctctggggccaagctctctacatcatagcgaagctgctggcggacgaactgatctctccgaaggacatcgatcctgttcagcggtacgtgccattgaaagaccagcgcaatgttagtatgcggtttagtaatcagggcccactagagaatgaccttgtggtacacgtggctctaatcgccgaaagtcagaggctgcaagtgtttttgaacacatatggcatccaaacccaaacgccgcagcaggtggagccaatacagatttggcctcagcaggagctggtgaaggcatatttgcaactaggaattaacgaaaaacttggtctctctggaagacctgaccggccaatcgggtgcctcgggacgtctaaaatctataggatcctagggaaaactgttgtgtgctaccccatcatattcgatctgtctgacttctatatgtctcaggacgtttttcttttgatcgacgatatcaaaaatgctctgcagttcattaaacagtattggaagatgcacggcaggccactgttcctcgtacttatcagggaggataatattcgggggagtcgtttcaatcccattcttgacatgttagcagcattgaaaaaaggtattataggaggagtgaaagtgcatgtcgatcggttgcagacactcatatctggcgcggttgtagaacagcttgactttttaagaatcagcgacacggaggaattacccgaatttaagtctttcgaggagctggagccccccaagcacagcaaggtgaagaggcaaagttctaccccatcagcccccgagctgggccagcagcctgacgtgaacatcagcgagtggaaggataagcccacccatgagattctccagaagctgaatgactgttcctgcctggccagccaggccattttgctgggtattctgctgaagcgggaaggtcccaacttcatcaccaaagagggtacggtgagtgaccatattgagagggtatatcgccgcgcaggcagtcagaaactgtggctggccgttcggtatggcgccgccttcactcaaaagttctcctccagcatcgctcctcatattactacctttctggtgcacggaaagcaggtgaccctcggggccttcggacacgaggaagaagtgatctctaacccacttagtccaagggttatccagaatattatctattacaagtgtaatacccacgacgagagggaggccgtgattcagcaagagcttgtcatacatatcggttggatcatcagcaacaatcccgagcttttttccgggatgctgaagatcagaattggctggatcatacatgccatggagtatgagctccagattagaggtggcgataagccagctctcgatctctaccagcttagtccgtccgaggttaaacaactgcttctcgatatactacagccccagcaaaatggacggtgctggctaaataggagacaaattgatggatcacttaatagaaccccgactgggttctatgatcgggtgtggcagattctcgaaagaacacccaatgggattatcgtggccgggaagcatctcccacaacagcccacattgagtgacatgacgatgtacgaaatgaatttcagcctactggtagaggatacactggggaatatcgatcagccgcagtacaggcagatagtggtggaactactcatggtggtgtcaatcgtgctggaacggaaccccgaactcgagttccaggacaaagtggacctggaccgcttggtgaaggaagcattcaacgaatttcagaaggaccagtcccggctcaaggagatcgagaagcaggacgatatgacgtcgttttataatacccccccacttggaaagcgaggaacctgctcctatctgaccaaagcagtgatgaacttactactcgaaggcgaagtaaagcccaataacgatgacccctgtctcatttca

SEQ ID NO: 18176 - DNA, 3279 bp, Artificial Sequence
  Description of Artificial Sequence: Synthetic coding sequence
atggcaggagctgctggcctcactgccgaggtctcctggaaggtcctggagcgtcgtgccagaactaagagatctggcagtgtttacgaaccccttaaaagcataaacctccccaggcctgacaacgagactttgtgggacaagctggaccactattacaggatcgttaaaagtactctgctgctgtaccagtcccctacaactggtctgtttccaaccaaaacatgcggcggcgaccaaaaggctaaaatccaagacagtttgtactgcgctgctggtgcatgggctttggccctggcataccgtaggattgatgacgacaagggccgcacccacgagctggaacactccgctatcaaatgcatgaggggtatcctgtactgttacatgagacaggctgataaggttcagcaattcaagcaggatccccgtccaacaacatgtttgcattcagtgtttaacgttcataccggcgacgaactcctgagctacgaagagtacggacaccttcaaataaacgctgtgtctttgtatctcctgtacctggtggaaatgatctcttctggcctgcagattatttataataccgacgaggttagctttatacagaacctcgtcttttgtgtggaaagagtgtacagggtgccagacttcggcgtttgggaaaggggcagcaaatataataacggttcaacagaactgcacagcagctctgtcggattggccaaggctgctctcgaagctatcaacggcttcaatttgtttggcaaccaaggttgctcctggagcgttatattcgtcgacctggacgcccacaaccgtaacaggcagaccctgtgttccctcctgcccagagagagccgtagccataacaccgacgctgccttgctgccttgcatctcatatccagccttcgcactggacgacgaggttctcttttcacagaccctcgacaaggtcgtgcgtaagctcaaaggaaagtacggtttcaaacgtttcttgcgcgacggttaccgcacctccctggaagaccctaaccgttgctattacaaacccgcagaaatcaagctgtttgatggcattgaatgcgaattcccaatcttcttcctgtatatgatgattgacggcgtctttagaggaaaccccaagcaggtgcaagaataccaggatctgcttacacctgtgctgcaccatactaccgagggatacccagtagtacctaaatattactatgtgccagctgacttcgtcgagtacgagaagaataatccaggctctcaaaaaaggtttccaagcaactgcggcagggacggcaaactcttcttgtggggacaggctctctatatcatcgccaaactcctggccgatgaacttatttccccaaaagacatcgaccctgtacagaggtatgtcccactgaaagaccaacgcaacgtgtccatgcgtttctcaaaccaaggtccacttgaaaacgatctggtcgtccacgttgcccttattgctgaatcccaacgtctgcaagtgttcctgaacacatatggaatccaaacccagactccccagcaggtggaacccatccaaatctggcctcagcaggaactcgttaaggcatatctgcagctgggaatcaatgagaaactgggtctctctggcagaccagatcgtccaatcggttgtctgggaacctctaagatctatcgtatactcggaaagaccgtggtgtgctaccctattatattcgacctgagcgacttctatatgtcccaggacgtcttcctgctcattgatgatatcaagaatgccctccagttcattaagcagtactggaagatgcacggccgtcccctcttcctcgtactcatccgtgaagataacataaggggttccaggttcaatcccatacttgatatgctggcagccttgaagaaaggaatcatcggcggcgtgaaagtgcatgtggaccgcttgcaaactttgatatctggtgccgtcgtagaacagctggacttcctgcgcatctcagacaccgaggagctgccagaattcaagtccttcgaagaactggaacctcccaagcacagcaaagtgaagcgtcagtcctccacaccctcagcccccgaattgggtcagcagcccgatgtgaatatcagtgagtggaaggacaaaccaactcatgagattcttcagaaactgaacgactgtagctgcctggcaagtcaagcaatcctgcttggtatcttgctgaaacgtgagggacctaattttatcaccaaagagggaaccgtctcagaccacatcgagcgtgtgtaccgtcgtgccggctcccagaagctgtggctcgcagtgcgctacggcgcagctttcacccagaagttctcctcctctatcgcaccacacatcaccacctttttggtgcacggtaagcaagtgacactcggtgcttttggtcacgaggaagaagtgatctcaaaccctttgtctcccagggttatccagaacattatctactacaaatgcaacactcacgatgagcgtgaggccgtcatccaacaagagctggttatccacatcggatggatcatttctaataaccctgaactcttctctggaatgctgaagataagaatcggctggatcatacatgctatggagtacgagttgcaaattagaggaggcgacaaacccgcactcgacttgtatcaactgagccccagtgaggtaaaacagctgctcctcgacatcctgcaacctcagcagaacggcaggtgctggcttaacagaagacagatcgacggatccctgaaccgtactcctacaggattttacgatcgcgtctggcaaatcttggaacgtacccctaatggcatcatcgtggctggtaagcacctgcctcagcagccaaccttgtctgacatgaccatgtacgaaatgaacttttctctcctggtggaggataccttgggtaacatcgatcagcctcagtataggcagatcgtagtggagctgttgatggtcgtgtctatagttctggagagaaatcccgaactcgaattccaggacaaggttgatctcgatcgcctcgttaaggaagccttcaacgagttccaaaaggatcagtcccgtttgaaggaaatcgagaagcaggatgacatgacatccttctacaacaccccacctctgggcaagagaggcacatgctcctacctgaccaaggccgttatgaacctccttctggagggtgaggtgaagcctaacaacgatgacccttgtctgatcagt

SEQ ID NO: 18177 - DNA, 3279 bp, Artificial Sequence
  Description of Artificial Sequence: Synthetic coding sequence
atggccggagctgctggactcactgcggaggtcagttggaaggttctggaaagaagggccaggactaagagatccggatccgtttacgaaccactgaagtccatcaatctcccacgccccgacaatgaaacattgtgggacaagcttgaccactactacaggatcgtgaagtcaacactgctgctgtaccagagccctaccaccggccttttcccaactaaaacatgcggaggcgaccagaaagcgaaaattcaagacagtctctactgcgctgctggtgcctgggcactcgcgcttgcatataggagaattgatgacgacaagggcaggacgcacgaactggaacactccgcaataaagtgcatgaggggaattctgtactgttacatgcgccaagcggacaaggttcagcagttcaaacaggacccaaggcccacaacctgtcttcactcagtcttcaacgtgcacaccggagatgagcttctttcctacgaggagtacggccacctgcagataaatgccgtgtctctctacctcctgtatctggtggaaatgataagctcaggtctgcagatcatatataacacagatgaggtatccttcatccagaatctcgtattttgcgttgagagggtgtaccgcgtaccagatttcggtgtctgggaaagaggtagcaagtataataatggatcaactgagttgcactcatcttctgtcggtctcgctaaggctgcgcttgaggcgattaacggcttcaacctcttcggtaaccagggatgctcctggtctgtgattttcgtggacttggacgcccacaacagaaataggcagacgctgtgttccttgctcccgcgcgagtccagaagtcataatactgatgcagccttgctgccatgtatctcataccctgcctttgctcttgatgacgaagtgctgttctcccagactttggataaggtagtgagaaagttgaaaggcaaatacggtttcaagaggttcttgagagacggctatagaaccagtctcgaggacccaaatcgctgctactataagcctgcagaaatcaagttgttcgacggcatcgagtgtgagtttcctatcttcttcctttacatgatgatcgacggcgtctttagaggcaacccgaaacaagtgcaggaatatcaggatctgttgaccccagtgttgcaccacacaaccgagggatacccggttgtgcccaaatattattacgtaccagctgatttcgtggagtatgaaaaaaacaaccctggtagtcaaaaaagattcccttcaaactgcggaagggacggcaagctttttctctggggccaagcgctttacattatcgccaagctgctggccgacgaactcatctctcccaaggacatagaccctgttcagcgctacgttccactgaaggatcagagaaacgtgagcatgagattctcaaaccagggtccacttgagaacgacttggtggtgcacgtggccctgatagccgagtctcagcgcctccaagtcttcctgaatacgtacggcatccaaacccaaaccccccaacaggtagaaccaatccagatctggccgcagcaagaactggttaaggcatacctgcagcttggtataaatgaaaagctgggcctgagcggtaggccggacagaccaataggatgtttgggtacgagcaagatatatagaattttgggaaaaacagtcgtatgttaccccatcatcttcgacttgtcagacttctacatgtctcaagacgtgtttttgttgatcgatgacataaagaacgcgctgcaatttatcaagcagtactggaagatgcacggtaggcctcttttcctcgtgcttatcagggaagataacattaggggctcccgcttcaatcccattctggatatgcttgccgcactgaagaagggcatcatcggcggcgtgaaagtgcacgttgatagactgcagacactgattagtggagctgttgtggagcagctcgacttcttgagaattagcgacacagaggagcttcccgagttcaagtcatttgaggaactcgaaccgccgaaacattctaaagttaaaagacaatcctctactccgagcgcgcccgaactgggtcagcagccggacgtgaacatatctgagtggaaggataagcctactcacgaaatcttgcagaaactcaatgactgcagttgccttgcgtcccaggctatcctcctcggcatcctcctcaaaagggaaggtcctaacttcatcactaaagagggtaccgtgtctgaccatattgaaagggtgtatagaagggccggtagtcaaaagttgtggctggctgtcaggtacggcgcagctttcacccagaaatttagctcatccattgctccgcacatcacgactttcctcgtgcacggcaaacaagttaccctgggagctttcggtcacgaggaggaagtcatcagtaatccactgtcaccccgcgtcatacagaacattatttactacaaatgcaacacacacgacgaaagagaggcagttatccagcaggagcttgtcatccacataggttggatcatctccaataacccagaactgttcagtggtatgctgaagatcaggattggctggattatccacgctatggaatacgaactgcaaattcgcggaggagacaagcctgctcttgacctctatcagttgtccccttcagaagttaagcagctcctccttgatatcctgcagccacagcagaacggtaggtgctggctgaaccgcagacaaatcgacggatcactgaacagaacacccacaggattctatgacagggtctggcaaattcttgagcgcacacccaatggtattatcgtcgcgggtaagcacctcccgcagcaacccacccttagcgatatgacaatgtacgagatgaacttcagtctcctggttgaggatacactgggaaacatagatcaaccgcagtataggcaaatcgtggtcgaacttttgatggtcgtgtcaatcgtgctggaaagaaacccggagctcgaatttcaggacaaggtagatctggataggttggtcaaggaggccttcaatgaatttcaaaaagaccagtctaggctcaaagagattgagaagcaagacgacatgacttcattctataataccccaccgcttggaaagcgcggtacctgctcatacctgaccaaggcggtgatgaacttgctgctcgaaggcgaggtcaagcctaacaacgacgatccttgtctgatcagt

SEQ ID NO: 18178 - DNA, 3279 bp, Artificial Sequence
  Description of Artificial Sequence: Synthetic coding sequence
atggcgggcgcagctggcttgacagctgaggtgagctggaaggtactggagcgccgggcacgcacaaagcgatctgggagtgtgtatgagccattgaaaagtatcaacctgccgaggcccgacaatgaaactctctgggacaagctcgatcattattatagaattgtaaaatccactcttctgctctaccaaagccctacgacaggactctttcccaccaagacctgcggcggcgaccaaaaggctaaaatacaggattccctctactgcgctgctggtgcttgggcgctggctctcgcatatcgccgcattgacgacgacaaaggaagaacgcacgagcttgagcacagcgcgatcaagtgtatgcggggcatcttgtattgttacatgcgccaggccgacaaggtgcagcagtttaaacaggaccctagacccacaacctgccttcattccgtgttcaacgttcacaccggtgatgaattgctgagctacgaagaatacgggcacctgcagataaacgccgtgtccctctatctgctctatcttgttgagatgatctcctcagggctccaaataatatataataccgatgaggtttcctttattcagaatctcgtcttttgtgtggaacgggtttaccgagtgcctgactttggcgtgtgggaacgaggcagtaagtacaataacggttccaccgaactgcacagtagctctgtaggtctggccaaggccgccctggaggccattaacgggtttaatctgttcgggaaccagggttgctcctggagcgtgattttcgtggatctggacgctcacaatagaaaccgccaaaccctgtgttccttgctcccccgcgaaagtaggtcacacaacacagatgccgcccttttgccatgcataagttacccagcattcgcactggatgatgaggtactttttagtcagactctcgataaggtggtccgcaaactgaagggcaaatacggctttaaaagattcctgcgggatggttatcgaacttctctggaggatccaaacaggtgctactataaaccagctgagataaagctgttcgacgggatcgagtgcgagttcccgattttctttctgtacatgatgatcgatggtgtgttccggggaaaccccaaacaggtccaggagtatcaggacttgctcactccagtgctgcaccacactactgagggataccctgtagtcccgaaatactactacgtcccggccgactttgttgagtacgaaaagaacaaccccggtagccagaagcgctttcctagcaactgtggcagagacggaaaactcttcttgtggggacaggctttgtatatcattgccaagctgctcgctgacgaacttatctcaccgaaggacatcgatcccgtgcagcggtatgtgccgctgaaggaccagagaaacgtgagcatgagattcagtaatcagggacctctcgagaacgacctcgtggttcatgttgctctgatagccgagtcccagcggctgcaagtcttcctcaacacatatgggatacagacccagaccccgcagcaggtagagccaatccagatttggcctcagcaggaattggtgaaagcttacctgcagcttggcatcaacgaaaagctcggcctgagcggtaggcccgatcggcccattggctgtctgggcacttccaaaatctatcgaatcctcgggaagacagttgtgtgttacccgattatttttgacctttccgacttctatatgtcacaagacgtcttcctgttgattgatgacattaagaacgcgcttcaattcatcaagcagtattggaagatgcatgggaggcccttgtttctcgtgctgattcgcgaggacaacattcggggcagcaggttcaatccaatcctggacatgctggccgcattgaagaaggggatcatcggcggagttaaggtacacgtggaccggttgcagactctcatctcaggagcagtagtcgagcagttggacttcttgaggattagtgacacagaagagcttcccgaattcaagtccttcgaggaattggagccccccaagcattctaaggtcaaacgccagtcaagcacgcccagtgctcccgagcttggacagcagcctgatgttaatatcagtgaatggaaggacaagcctactcacgagatcctgcagaaactgaatgactgctcttgcctcgcaagtcaggccattctgctcggcattctgcttaagagagagggacctaactttattacaaaggaaggaacagttagcgatcacatcgagcgagtgtaccggagggcaggttcccagaagctgtggcttgccgtgaggtacggagccgcctttacacagaagttctccagcagcatcgcgcctcacatcaccaccttcctggtgcatggcaagcaggtgactctgggtgcgtttggtcatgaggaagaggttatctctaatcctctcagtccccgagttatccagaacatcatttattataagtgtaacacacacgacgagcgagaagctgtgattcagcaagaattggtcattcacatcggctggattatcagcaataacccagaactcttcagcgggatgctgaagattagaatcggttggattatccatgctatggagtatgagttgcagatcaggggtggggacaaacctgcactggacctgtatcaattgtcccccagtgaagtgaaacagctgctcctggatatcctgcaaccccaacagaatggaagatgttggctgaataggcggcaaatcgacggttccctgaacagaacccccaccgggttctatgatagggtctggcagatcctggaacgcacaccaaatgggatcattgtggcgggcaagcatctgccccaacagcctactctgtctgacatgacaatgtacgaaatgaatttctcactgctggttgaggacactttgggcaatattgaccagccccagtaccgacaaatagtggttgagctgcttatggtggtaagcatcgtgctggaaaggaaccccgagttggaattccaggataaggtggatctggataggcttgttaaggaggcgttcaatgagttccagaaggaccagagcagactgaaagaaatcgaaaaacaagacgatatgactagcttttacaacacgccccctctcggcaagcgcggtacctgtagctaccttacaaaagctgtgatgaacctccttcttgaaggagaggtgaagcctaacaacgacgatccgtgcttgatatca

SEQ ID NO: 18179 - DNA, 3279 bp, Artificial Sequence
  Description of Artificial Sequence: Synthetic coding sequence
atggccggtgctgcagggctcaccgccgaggtgtcgtggaaggtcctggaacgccgcgctcgtaccaagaggtctggaagcgtgtacgagcctctgaaatccatcaaccttccacggcctgacaacgaaactctgtgggacaaactcgatcactactacagaattgtgaagagcacccttctgctgtaccagagccctaccacaggtttgtttcctacaaagacctgcggaggtgatcagaaagccaagattcaagactcactctactgcgctgcaggagcttgggccctggccctggcgtaccgccgcattgacgacgacaagggccgtacccacgagctcgagcattcggcaataaagtgtatgaggggaattttgtattgttacatgcgccaagcagataaggttcagcagttcaaacaggaccctaggccaacaacctgcctgcacagcgtgtttaacgtgcataccggagatgagcttctcagttatgaagaatacggacatctccaaatcaatgccgtctcgctctatctgctgtatttggtcgaaatgatctcaagtggtttgcagatcatctacaacacggatgaagtgagcttcatccaaaatcttgtgttctgtgtggaacgggtatacagagttccggattttggcgtgtgggaacgcggatctaagtataataacggtagcaccgaacttcattcctcaagcgtcggattggcaaaggctgctttggaagcaatcaatggctttaatctttttggtaaccagggatgtagctggagtgtaatcttcgtcgatctggacgctcataaccggaacagacagaccctctgctccctgctgccccgggagtcccgtagtcacaacaccgacgctgcattgctgccctgcatctcataccccgctttcgccctggacgacgaggttctgttttcacagaccctggataaagttgtcagaaagctcaagggtaaatatggatttaagagatttctgcgggatggatataggaccagccttgaagaccccaaccggtgttactacaagccagctgaaatcaaactttttgatggaattgaatgtgagttccccatcttctttctgtacatgatgatcgatggcgtcttcagaggcaaccctaaacaggtgcaagaataccaagatttgctgacccccgtgcttcatcatacaaccgagggctaccctgttgtgcctaagtactactacgtacccgcagattttgtggaatacgagaagaacaatcccggttctcagaaaagatttccctctaactgcggtagggacgggaaactgttcttgtggggtcaggcgctgtacatcatagccaaacttctggctgacgagcttatctcccctaaggacatcgaccccgtgcagcgctacgtgcctctgaaagatcaacggaacgtgtcaatgaggtttagcaaccagggccccctggagaatgacctggtcgtccacgtagcattgattgcagaatcccaaaggctccaggtgttccttaacacctacggaatccagacacagacaccgcaacaggtggagcctatacagatctggccccagcaggagctggtcaaagcttacctgcaacttggaatcaacgaaaaactgggtctgagtggcaggcccgacaggcccatcgggtgcctggggacttccaaaatttatcggatcctgggcaaaacagttgtctgttatccaatcatctttgacctgagcgatttttacatgtcccaagacgtattcctgctaatagacgatatcaaaaacgcccttcagtttattaaacagtattggaagatgcatggaaggccacttttcctggtcttgattcgggaagataacattagggggtcgaggtttaacccgatcctggatatgctcgctgccttaaagaagggaatcattggcggagtgaaagtccacgtggataggcttcagactctgatcagcggagcagttgtcgaacagttagactttcttcgcatctccgataccgaggaattgccagaattcaaaagctttgaagagctggaaccccccaaacacagcaaggtgaaaagacagtcaagtacaccaagcgcacccgagctgggccagcagcctgatgtcaatatctctgaatggaaggataaacctacacacgagatcttgcagaagcttaacgactgctcatgccttgcttcccaggccatccttttgggcatccttctgaagcgcgagggacccaacttcataaccaaggaggggaccgtttccgaccacattgaacgtgtctacaggagggccgggtcccagaagctgtggttggcggtccgctatggagccgcattcacccagaaattcagcagtagcatcgcccctcatattaccacctttctcgtgcatggaaaacaagtcactctgggagctttcggacacgaggaggaggtgatctcaaaccccctgagcccgagggtgatacagaatatcatttactacaaatgcaacacccacgacgagcgcgaggccgtgatccaacaggaacttgtcattcacatcggctggattatcagcaacaatccagaactctttagcgggatgttgaagatcagaatcggttggatcatccatgcaatggagtacgaacttcaaatcaggggtggcgataagccagcattggacctctaccagctgtccccttccgaggtcaagcagctgctgctcgatatccttcaaccacaacagaacggaagatgctggttgaaccgccgccaaattgatggaagcctgaacagaaccccaactggattttatgaccgcgtttggcagatccttgagagaactcccaacggcataatcgtggcaggaaagcatctgccacagcaaccaactctgtccgacatgaccatgtacgaaatgaatttttctcttctggtcgaggacactctcggcaacatcgaccaaccacagtatagacaaatcgtcgtggaactgctgatggttgtgagcatagtacttgagcgcaacccggaattagagttccaggacaaggtggacctcgatagactggttaaggaagcttttaacgagttccagaaggatcagtctcgtttgaaggaaatcgagaagcaggacgatatgacaagcttctataacacgcccccactcggcaagcgcggaacatgttcttaccttacgaaagcagtgatgaatctgctcctcgaaggtgaggtgaagccgaacaacgatgacccatgccttatcagc

SEQ ID NO: 18180 - DNA, 3279 bp, Artificial Sequence
  Description of Artificial Sequence: Synthetic coding sequence
atggcaggcgcagcagggctcaccgcagaagtctcatggaaagtgctggagcgccgcgcaagaaccaagagatcaggatcagtgtatgaaccactgaagtccataaatctgccaagaccagacaacgaaaccctgtgggataaacttgatcattactaccggattgtcaagtccactcttcttctttaccagtcgcctaccaccggactttttccaacgaaaacctgtggaggtgaccaaaaagcgaaaatacaggatagcttgtactgcgcagcaggggcatgggcgcttgcattggcatacagaagaattgatgatgacaaggggcggacccatgaactcgaacactcggcgatcaagtgtatgagaggaattttgtactgttatatgaggcaggcagataaagtccagcagtttaagcaagatcctagacccaccacttgtctccactcagtgtttaacgtgcataccggagatgagcttctctcctacgaagaatacggacatcttcagattaacgccgtgagcctgtacctcctgtacctggtggaaatgatctcctctggcttgcagattatctacaacactgatgaagtgtcgttcattcagaacctggtgttttgtgtcgagcgggtgtatagggtgcctgacttcggcgtgtgggagagaggctccaagtacaataatgggtccacggaacttcattcgtcgtccgtcggactggcgaaggccgcactcgaagcaattaacggcttcaacctctttggtaaccaggggtgctcatggagcgtcatcttcgtagatctcgatgcacataatcggaacaggcagactctctgcagccttcttccacgcgaatcgcgatcacataacaccgatgcagcacttctcccatgtatctcctacccagcatttgcgctggacgacgaagtgctgttttcccaaacccttgacaaggtggttagaaaacttaaaggaaagtacggatttaagagattcctgcgggacgggtacagaacctcgcttgaggaccctaatcgctgttactacaaacctgcggaaatcaaacttttcgatggaatcgaatgtgaatttcctatcttttttctgtacatgatgatcgatggagtctttcgtggcaaccctaagcaggtgcaggaataccaggacctgctgactccggtgcttcatcatactacggagggctacccagtcgtgcccaagtactactacgtcccggcagattttgtggagtacgagaagaataatccaggcagccagaagcggttcccgtcgaactgcgggcgggatggcaagctgttcctgtgggggcaagcattgtacatcatagctaaacttcttgccgacgagctcatttcacctaaagatattgacccggtccagcgatacgtcccacttaaggatcaaaggaatgtgtcaatgcgattttccaaccagggtccacttgaaaacgatctggtggtgcacgtggcgcttattgcagagtcgcagcgcttgcaagtctttctcaacacctacggtattcagacccaaactccgcaacaggtggagcccattcagatctggcctcaacaggagctcgtgaaagcctaccttcaactgggaattaacgaaaaacttggactgtccggacgccctgatagacctatcggatgccttggaacctccaagatttaccgtattctcggtaaaactgtggtgtgttaccccatcatcttcgatctgtcagatttctacatgtcacaagacgtctttctccttatcgatgacatcaaaaatgcacttcaattcataaagcagtactggaagatgcatgggcggcctctgtttctcgtgctcatcagggaagataacattcgtggatcgcgcttcaatccgattcttgatatgcttgcagccctcaagaagggaatcattgggggtgtgaaggtccacgtggatagactgcagacccttatttcaggcgccgtcgtggaacagctggattttctgcgaatttctgacactgaggaattgccagaattcaagagctttgaagagctcgaaccaccgaagcattccaaggtgaagaggcaatcttcaactccttccgcgccagagctgggccaacagcctgatgtcaacatctcggagtggaaggataagccaactcacgaaattctgcaaaagttgaacgattgttcgtgtctcgcctcgcaagcaattcttctgggaattctcctgaagagagagggtccaaatttcatcactaaggagggtaccgtgagtgatcatatagaacgtgtgtaccgccgtgcaggaagccaaaagctctggctggctgtccggtacggagcagcttttactcaaaagttttcatcgtccattgcgccgcacattaccacctttctggtccacggtaagcaggtcaccctgggcgctttcggtcatgaagaagaggtgatatcgaatcctctctcgccacgtgtgatccaaaacataatctactacaaatgtaacacccatgatgagcgggaagccgtgatccagcaagaacttgtcattcatattggctggattatctccaacaatcctgaactgttctcagggatgctgaagatacggatcggatggatcatccatgccatggagtacgaactgcaaattaggggtggagataagccagcgctggatctttaccaactgtcaccctccgaggtgaagcaactcctgctcgacatcctgcaaccacagcaaaacggtagatgctggctgaaccgtagacagatagacggatcgcttaacagaacccccaccggcttctacgatcgagtctggcagatactggaacggaccccaaatggaattatcgtggctggtaaacatcttccacagcaaccaaccctgtccgatatgaccatgtacgaaatgaacttttcgctcctcgttgaggatacccttggaaacatcgaccagccacaatacagacaaatagtggttgaactgctgatggtggtcagtatcgtgctggaaagaaaccctgaacttgaatttcaagataaggtggacttggatcgtcttgtgaaggaggcatttaacgaatttcaaaaggaccaatctcgcctgaaggagatagaaaagcaggatgatatgacctcgttttacaacaccccgccccttggtaagcgaggaacctgcagctaccttactaaggctgtcatgaaccttcttctggagggtgaagttaagccgaataatgacgacccttgtctgatttct

SEQ ID NO: 18181 - DNA, 3279 bp, Artificial Sequence
  Description of Artificial Sequence: Synthetic coding sequence
atggcgggcgcggccggcctcaccgcggaagtcagctggaaagtgctcgaacgccgcgcaagaaccaaaaggtcgggcagcgtgtacgagccactcaaatcaatcaacctgccacggccggataatgagacgctgtgggataaactcgaccactactaccgcattgtgaagtccacgctgctgctctaccaatcccctactactggacttttcccgaccaaaacttgcggaggagatcagaaggctaagatccaggatagcctctactgtgccgccggagcctgggccctggcgctggcctaccgcagaatcgatgacgacaaagggagaacccatgaactcgaacatagcgcgatcaagtgcatgcgcgggatcctgtactgctacatgcgccaagctgataaggtgcaacagttcaagcaagatcctcgcccaactacttgcctccattcggtgtttaacgttcacacgggcgacgaactcctgagctacgaagagtacggacacctccaaatcaatgccgtgtccctctacctgctgtacttggtggagatgatctcgtccggactgcagatcatctacaacacggatgaagtttccttcatccagaacctcgtgttctgcgtggagagagtgtaccgggtccctgatttcggcgtgtgggagcgcggatcgaaatacaataatggtagcactgagctccattcctcaagcgtggggctggctaaagctgcgctggaggccatcaatggattcaacttgttcggaaatcagggctgctcgtggtcagtcatcttcgtggacttggatgcccataaccggaatcgccaaaccctgtgctccctgctgccacgggaatcacggtcacacaatactgatgctgcgctcctgccgtgcatctcctacccggcgtttgcactcgacgacgaggtgctgttctcccaaactttggataaagtggtgagaaagctgaagggaaagtacgggttcaaacggtttcttcgggacggttacagaacctcattggaggaccccaaccgctgctattacaagcctgccgaaatcaagctgtttgatggcattgaatgcgaattcccgatcttcttcctgtacatgatgatcgatggggtgttccggggcaaccccaaacaggtgcaggaataccaggacctcctcacccctgtcctgcaccacactaccgaaggttaccctgtcgtgccgaagtactactacgtgcccgccgatttcgttgaatatgaaaagaataacccggggtcacagaagcgctttccctcgaactgcgggcgggatggaaaacttttcttgtggggccaagccctttacatcatcgccaaactgcttgccgacgagctgatctcccccaaggacatcgaccctgtccagcgctacgtgcctctcaaggaccaacgcaacgtctcgatgcggttctcgaaccaaggcccgctcgagaatgacctggtggttcacgtggcgttgatcgctgagtcgcagcggctgcaagtgttcctcaatacctatggtatccagacccagactccacagcaggtggaaccaatccagatctggcctcagcaagaactggtgaaggcgtacctgcagctgggcataaacgagaaactcggcctgtccggacgcccggacaggccaattggatgtctcggaacttccaagatttaccggattctgggaaagactgtcgtgtgctaccccatcatctttgacctctccgatttctacatgtcgcaggatgtttttcttcttatagacgatatcaagaacgcccttcagtttatcaagcagtactggaaaatgcacggaaggccgctctttttggtcctcattcgcgaagataacattagaggctcaaggttcaatcctatcctggacatgttggccgccctcaaaaaaggaattatcggaggtgttaaagtgcacgtggataggttgcaaactctcatctctggtgcagtcgtggaacaattggatttcctccgcatctcagatactgaggagctcccggagtttaagtcatttgaggaactcgagccaccgaaacattcaaaggtcaagaggcagtcatcgacgccttccgctccggaactcggacaacagccggatgtcaacatcagcgaatggaaggacaagcccactcatgagatccttcaaaaactcaacgactgcagctgtctggcgtcccaagccatcctcctcggaatcttgcttaaacgcgagggaccgaacttcatcacgaaggaagggaccgtgtctgaccatattgaacgagtctaccgccgcgcgggatcccagaaactgtggctcgctgtgcggtacggtgcagccttcactcagaaattcagcagctccatcgcgccgcatatcacgaccttcctggtccacggaaagcaggtcaccttgggggctttcggtcacgaagaagaagtgatctcgaacccactgagcccccgggttatccagaacattatctattacaagtgtaacacccacgacgaaagggaggcggtgatccaacaggagctggtcatccatattggatggattatctccaataacccggagctgttttctggaatgctgaagatcaggatcggctggatcatccatgcgatggaatacgaactgcagatccggggaggtgacaagccggccctggacctgtaccaactgtccccatcggaggtcaaacaacttctgctcgacatcctgcagccgcagcaaaacggccggtgctggctgaatcggcggcagatcgacggaagcctgaatcgcactccgaccggattctacgatcgggtgtggcagattctggagcggactccaaacggaatcatcgtggcgggcaagcatctgccacaacaaccaaccctgagcgacatgaccatgtatgagatgaatttctcgttgctcgtcgaagataccctgggcaatatagaccagccgcaataccggcaaatcgtggtggaactgctgatggtcgtctcgatcgtcctcgaaagaaatccagagttggagtttcaggacaaggtggatctcgatcggctggtcaaggaggccttcaacgaattccaaaaggatcagtcgagactgaaggagatcgagaagcaggatgacatgacctcgttctacaacactccaccgctggggaagcgcggaacttgcagctacctgacgaaggcggtcatgaacctcctccttgaaggggaggtcaagccaaacaacgacgatccgtgtctgatttcg

SEQ ID NO: 18182 - DNA, 3279 bp, Artificial Sequence
  Description of Artificial Sequence: Synthetic coding sequence
atggctggagctgcgggtttgactgccgaggtctcgtggaaagtgctggagcgccgcgcccgcaccaagcgttcgggatctgtttacgagcctttaaagtcaattaacctgccgcgccccgacaatgaaacattgtgggataaattggatcattactaccgaattgtcaagtcgactcttttgctttaccaatcacctactacgggccttttcccgaccaagacctgtggcggggatcaaaaggccaaaattcaagattcactttattgtgccgccggagcctgggcactcgccctcgcctatagacgcatcgatgacgataagggccgcacgcacgagttggaacattcggctattaagtgcatgaggggtatcctctactgttacatgcgacaggcagataaggtgcagcaattcaaacaggacccgagacccacaacgtgcctgcactcggtctttaacgtacacaccggtgatgaacttctgagctacgaggaatatggacatctccaaattaatgcagtttcgttatatctcttgtaccttgttgaaatgatttcaagcggcttgcaaatcatctataatacagacgaagttagtttcatccagaacctggtcttttgtgttgagcgggtttatcgcgtgccagattttggagtttgggagcgcggatcaaagtacaataacggctccaccgagctccactcatcctcggtgggtctggctaaagcggcattggaagcgatcaatggatttaatctgttcggcaaccaagggtgctcctggagtgttattttcgtcgaccttgacgcacataaccgtaaccggcagacactttgcagcttgctgcccagagagagtcgttcacataacacagatgcggcgctgttgccttgtatcagctatccggccttcgctttggatgacgaagtcctattttcgcagacattggataaggtggttaggaaattgaaagggaaatatggctttaaacggtttctccgggacggttaccgtacgtctcttgaagacccgaaccgttgttactacaagcctgctgaaatcaaactgttcgatggcatcgagtgcgaatttcccatatttttcctctatatgatgattgatggagtgtttagaggtaaccccaagcaagtgcaagaataccaggacttacttaccccggtcctacatcatacaacggaggggtacccggttgtgcctaagtactactatgttcccgcggatttcgtcgagtatgaaaagaataacccggggtcccagaagagatttccttctaactgtggtcgtgatggtaagctattcctgtggggtcaggcactgtatattatagccaagctccttgctgatgagttgatttcgccaaaggacattgaccctgtacaacgttacgtcccattgaaggaccaacggaatgtgtctatgcgtttcagtaaccagggtccactcgaaaacgaccttgtggttcacgtcgcactcattgccgaatctcaacgtctgcaggtttttttgaacacatatggaatccaaacacaaacccctcagcaagtggagcccattcaaatctggcctcaacaggagctggtaaaggcttacctgcagcttgggatcaatgaaaagcttgggctctcaggtcgtcccgaccgtccaatcggttgcctgggtacaagcaagatttatcgaattctcgggaagacagtcgtctgttatccaattattttcgacctgtcagatttttacatgtcccaggacgtttttctgttgattgacgacatcaagaacgccttgcagttcataaagcaatattggaagatgcatgggagaccccttttcctcgtgttgatccgagaggataatatcagagggtcacgttttaacccgatcctcgacatgctcgcggccttgaaaaagggcatcatcggtggggtcaaggtacatgttgaccggttgcaaactctgatatcaggcgccgtcgtcgagcaacttgattttctacgcatttccgacacggaagaactcccagagttcaagtcgttcgaagaattggagccgcctaagcattctaaggtcaagcgtcaatccagtacaccgtcggctcctgagttggggcaacagccagatgtgaacatctccgagtggaaggataaacctacccacgaaatcctccagaagctaaatgattgctcgtgtctagcttcgcaagcgattctcctcggtatccttctcaagcgagagggtcctaatttcatcaccaaagagggcaccgtctccgatcatatcgaaagggtttatcgtcgggctggaagccaaaagctgtggttggctgttcgttacggagcagccttcacgcaaaaattctccagtagcatcgcgcctcacatcacaactttcctagtacatggaaagcaggtgacactcggcgctttcggccatgaagaagaggtcatctcaaatcctttgtctcctagggtaatccagaacatcatttactacaagtgcaacacacatgatgaacgcgaggcggtgatccaacaggagctcgtaatccatatcggatggatcatctctaacaatcctgaactgttcagtgggatgctcaagattcggatcggctggattatccatgccatggagtacgaacttcaaattcgcggcggggacaagcctgccttggatctttatcaattgagtccatcagaggtgaagcagctattgcttgatatcttgcaaccacagcaaaacggacgttgttggttgaatagacgtcaaatcgatggctccctgaaccgtacacccacgggtttttacgatcgcgtctggcaaatactagagcggacacctaacggcataatcgtggctggcaagcatttaccgcagcagcctaccctctccgatatgactatgtacgagatgaacttttctctcctcgtcgaggacactctggggaatatcgatcaaccacagtatcgacaaattgttgtggagcttcttatggtcgtttcaattgtgctcgagcggaacccggagctggaattccaagataaggttgacctagatcgacttgttaaggaagcgttcaacgaattccagaaggaccaatcgcgacttaaggaaattgagaaacaagatgatatgacgtccttctacaatacaccacccctcggtaaaagaggcacttgcagttatttaacgaaggcggtcatgaatctacttttggagggtgaggtgaaaccgaataacgatgatccatgtctgatctct

SEQ ID NO: 18183 - DNA, 3279 bp, Artificial Sequence
  Description of Artificial Sequence: Synthetic coding sequence
atggcaggtgccgcaggtctgactgcagaagtcagctggaaggtgctggagagacgggcacggaccaaaagaagcggctcagtgtacgaaccccttaagagcattaacttgcctaggccagacaatgaaaccctgtgggacaaactcgatcattactaccgcattgtgaagtccacccttctgctttatcaatcacctaccaccgggttgtttccaaccaagacctgtggtggcgaccaaaaggccaaaattcaggattcgctgtactgtgcagccggggcatgggcccttgcccttgcttacagacggattgatgatgacaaagggcggactcatgaacttgagcattcagcgattaagtgtatgagaggtatcctgtactgctacatgagacaagcagataaagtccagcagtttaagcaggaccctcgaccaactacgtgcctgcactccgtctttaacgtgcataccggagatgaactgttgtcgtatgaagaatacggccatcttcaaatcaacgctgtgtcactctacctgctgtaccttgtggaaatgatcagctccggtctgcaaatcatttacaacaccgacgaagtctcattcattcagaaccttgtgttctgcgtcgagagggtctacagagtccctgatttcggcgtctgggagagggggtccaaatacaacaacggtagcaccgaactccattccagctctgtgggactggccaaggcagcgcttgaggcgattaatgggttcaacctgtttggtaatcagggatgttcttggtcggtgatttttgtggatctggatgcccataacaggaatagacaaactctctgtagcctccttccgcgcgagtcaaggtcccacaacaccgatgcggcactgttgccttgcatttcctaccctgcatttgcgttggacgacgaagtgctgttttctcagaccctcgataaggtggtccgaaaactgaaaggaaagtacggctttaagagattcctgagagatggataccgtacttcgctggaagatccaaatcgctgttactacaaacccgcagagataaaactctttgatggtatcgaatgcgagtttcctatctttttcttgtatatgatgatagatggggtgtttcgcggtaaccctaagcaggtccaagaataccaggatctcttgacgcctgtgttgcatcataccactgaggggtaccctgtcgtgcccaagtattactacgtaccggccgactttgtcgaatacgagaagaacaatccaggttctcaaaaaagattcccgtcgaattgcgggcgagatggcaaactctttctctggggacaggcactgtacattatcgcaaaacttctggcagacgagctgatctccccaaaagatattgatccagtgcaacgctacgtgccacttaaggaccaaaggaatgtctccatgcgctttagcaatcagggtccactggagaacgacctcgtggttcatgtggctcttattgcagaatcgcagcggctgcaggtgtttctcaacacgtacggaatacagactcagacgcctcaacaggtcgaacccattcagatttggccccaacaagagcttgtgaaggcatatctgcaactgggcataaatgaaaagctcggactgtcgggacgtcctgacaggcctatcggatgccttggtacttcgaagatttaccggattcttggaaagacggtcgtatgttaccccatcatctttgatttgagcgatttctacatgtcgcaagatgtgttcctcctgatcgacgacattaagaacgcactgcagttcattaaacaatactggaaaatgcacggtagacccctgtttctcgttttgatccgtgaggacaacattagagggtccagattcaacccgatcctcgatatgctcgcagcgttgaagaagggaataatcggaggggtgaaggtgcatgttgataggttgcagaccctgatctcaggtgccgtagtggaacaacttgattttcttcgtatttctgataccgaagaattgcctgagtttaagtcatttgaagagcttgagcctcctaaacactccaaggtgaagcggcaaagctcgactccatcagcacctgaactcgggcaacagccagacgtcaacatctcagaatggaaggataaaccgactcacgaaattctccaaaagctgaatgattgctcgtgtcttgcaagccaggcaatactgcttggtattcttctcaagcgggaaggacctaacttcatcaccaaagagggaaccgtttcagatcatatcgaacgtgtgtaccgaagggccggctcacaaaagttgtggctggccgtgcgctacggggccgcatttactcaaaagttcagcagctcgatcgcacctcacatcactaccttccttgtgcatggtaaacaggtcacccttggtgcatttggacacgaagaagaagtgatctcaaacccactttctcctcgggtgatacagaacattatctattacaagtgtaatacccacgatgaacgcgaagctgtgattcaacaagaactcgtgattcatatcggctggatcatttcgaataaccctgaactgttttcggggatgctcaagatccgaataggatggatcattcatgcaatggaatacgaacttcaaatacgtggaggagacaagcctgcgctggatctgtaccaactctcgccctcagaggtcaaacagcttcttttggatattctgcaaccccaacaaaacggaagatgttggctgaaccgccgtcagattgacggatcgctgaatcgtaccccaactggattttacgatcgtgtgtggcagatcctggagagaacccctaacggcattattgttgccggtaagcacttgccacagcagccaactctctctgacatgactatgtacgaaatgaacttctcgttgcttgtggaggataccctcggaaacatagaccagcctcaatacagacaaatcgtcgtggaactgctgatggtcgtgagcattgtgctggagcggaatccggaacttgaattccaggataaggtggacctggatcgcctcgtgaaggaggcgtttaacgaatttcaaaaggatcaaagccggctgaaggaaattgagaagcaagacgacatgacttccttctacaatacgccccctctgggaaagcgaggcacgtgttcgtaccttactaaggccgtcatgaaccttcttcttgaaggtgaggtgaagccaaacaatgacgacccttgtttgatctct

SEQ ID NO: 18184 - DNA, 3279 bp, Artificial Sequence
  Description of Artificial Sequence: Synthetic coding sequence
atggccggagcagctggtcttaccgcagaagtgagctggaaggtgctcgaacgccgtgcgcggacgaagcgatcaggttccgtctatgagcctctgaaatccattaatctgccacgaccagataacgagactctttgggataagttggatcactactacagaattgtcaaatccactctccttctttatcaatcgccaaccaccggcctctttccaaccaagacttgtggcggcgaccaaaaggcaaagatccaagactcgctgtactgtgccgcgggcgcctgggcactcgcgctggcataccggcgtattgatgacgataaggggcggacgcacgaacttgaacactcagcaatcaagtgtatgagagggatcttgtactgctacatgagacaggctgacaaggttcagcaattcaagcaagatccgcgccccactacgtgtctgcactccgtgtttaacgtgcacaccggagatgaacttctgtcgtacgaagaatacggtcaccttcagatcaacgcagtttcgctgtacctcctctatctcgtggagatgatttcttcaggactccaaatcatctacaatactgatgaagtcagcttcatacagaacctggtgttctgtgtggaacgcgtctaccgcgtgccagattttggggtgtgggagcggggcagcaagtataacaatggatcgaccgagctgcattcatcaagcgtggggctcgcaaaggcggcacttgaagcgattaacggattcaacctctttggtaatcaaggatgttcatggtcagtgatcttcgtcgatctggacgcacataatcgaaaccgtcagactctctgcagccttctcccccgcgaaagcagatcccataacaccgacgcagcactgcttccatgcatctcgtatcccgcatttgcccttgacgatgaagtgctgttttcgcaaactctggacaaggtcgtcagaaaactcaagggaaaatacggattcaaaagatttttgcgcgacggctaccgcacctccctggaagatcccaatcgatgttactacaagccggcggagataaagctgtttgatgggattgagtgcgagtttccaatattctttctgtatatgatgattgacggggtgtttcggggtaaccctaagcaagtccaggaataccaagatctgcttaccccagtgctgcatcatacgaccgaaggttacccggttgtccctaagtactactacgtaccagcagattttgtcgaatacgagaagaataatcctgggtcacaaaaacgatttccgagcaattgcggtagggacggaaaacttttcctttgggggcaagcactctacatcatagcgaagttgttggcagacgaactgatttcaccaaaggacattgatccagtgcagcgctacgtgccactgaaagaccaaaggaacgtgtcgatgcggtttagcaatcaaggaccgctggaaaatgatctcgtggtccacgtggcactcattgcggagtcgcagcgtctccaagtgtttcttaacacctacggaattcaaactcaaaccccacagcaagtcgaacccatacagatctggcctcaacaggagctggtgaaggcgtacctgcagttgggaataaacgagaagctcggcctctcgggtcgccctgatagaccaatcggatgtcttggaacttcaaagatctaccgtatcttgggcaaaactgtggtgtgttacccgatcattttcgacctttccgatttctacatgtcgcaggacgttttcctgctcatcgatgatatcaaaaacgccctgcagttcataaagcaatactggaagatgcatggacgacctctttttctggtgctgattagagaagataacatcagggggtcacgttttaaccccatactggacatgctggccgcactgaagaaagggatcattggaggcgtgaaggtccatgtggataggctccagactcttatctcaggagcagtggtggagcaattggattttcttaggattagcgataccgaagaacttccggagtttaagagcttcgaagaactcgaaccacccaaacatagcaaggtgaaaagacagtcatcgactccttcggccccagagctgggccagcagcctgacgtcaacatttccgaatggaaggataaacctacgcatgagattttgcaaaaacttaacgattgtagctgccttgcgagccaggctattctgctgggtatactcttgaaacgtgaaggcccgaatttcataactaaagaaggaaccgtgtccgatcatatcgagcgagtctaccggcgcgctggctcgcaaaagttgtggcttgcggtgcggtacggggccgctttcacccaaaagtttagcagcagcatagccccacacattaccacctttctggtgcacggaaagcaggtgactcttggtgcttttgggcatgaggaggaggtcatctcaaacccacttagcccacgcgtaattcagaacattatctactacaagtgcaatacccatgacgaaagagaagcagtgatccagcaggaactggtaatccacatcggctggattatctccaacaaccctgagctgttttcgggtatgctgaaaattcgaatcggctggataattcatgccatggaatacgaactccaaatcaggggaggtgacaagccagcccttgacctctaccaactttccccttcggaggtgaaacaactgcttcttgacatacttcaaccccagcaaaatggacggtgttggctcaatcggcggcaaattgacggttcgttgaatcgaacgccaactggattttacgatcgtgtgtggcagatcctggaaagaacccctaacggcattattgttgccgggaagcatttgcctcagcagcctaccctttcggatatgaccatgtatgaaatgaacttctcgctcctggtggaagataccctgggcaacatcgaccaacctcaataccgtcagattgtggttgagttgttgatggtcgtgtcaattgtcctggagagaaaccccgaactggaatttcaggataaggtggacctggaccgcctggttaaagaagcattcaatgaatttcaaaaggatcaaagccgccttaaggagatagagaagcaggatgatatgacttccttctataacaccccacccctcgggaagagaggaacgtgttcataccttactaaggccgtcatgaatttgcttctcgagggagaagtgaagcctaacaacgatgacccttgcctcattagt

SEQ ID NO: 18185 - DNA, 3279 bp, Artificial Sequence
  Description of Artificial Sequence: Synthetic coding sequence
atggcaggagccgctggtctgacggccgaagtctcctggaaggttttggagcggagggcaagaacaaagcgcagtggctccgtgtatgagcccctcaagagcataaaccttccaagacccgataatgagactctctgggataaactcgatcactattaccgtatcgtgaagtcgacattgttgctgtaccaatcccccacgactggcctgttccccacaaagacttgcggaggggatcagaaagccaagatacaggactccttgtattgcgcagccggagcctgggctcttgcactggcttatcggcgcatagacgatgacaagggcaggacccatgaactcgaacacagtgctatcaagtgcatgcgtggcatcctgtattgctatatgcggcaggctgacaaagtccagcagtttaaacaagatcccagaccaacaacctgtctgcattctgtttttaatgtgcacaccggggatgaattactctcgtatgaggaatatggccacctccagatcaacgctgtgtcgctgtacctgctgtatctggtcgagatgatctcatcaggacttcagattatatataatactgacgaggtttcatttatccaaaatctggtgttttgcgtggaacgcgtttatcgcgttccagatttcggcgtgtgggagcggggctcaaagtataacaatggatccacagagctacacagttccagtgtaggactagctaaggccgccttggaagccatcaatgggttcaatctgttcggcaatcaggggtgcagttggagtgtaatatttgtcgatctggatgcacacaatcggaacaggcagaccctttgttccctcctaccgcgggagagtagaagccacaatacggatgcggcacttctgccctgcatttcctatcctgcttttgccctggacgacgaagttcttttttctcaaaccttggataaggtagtgcgcaagctgaaagggaaatatggctttaaacgctttctgcgagatggatatcggacctccttggaggacccaaatcgctgctattacaaacctgccgagataaaactgttcgatgggattgaatgcgaatttcccattttctttttgtatatgatgatcgatggcgtgtttcgtggtaatcctaaacaggtccaggagtaccaagatcttttaactcccgtcctacaccacaccactgagggctaccctgtcgtgccgaaatactactatgtacctgccgatttcgtcgagtatgagaagaacaaccccgggtctcagaagaggttcccatcaaattgtggccgtgacggaaaactgttcctgtgggggcaggctttgtacattatagctaaactcctagccgatgaattgatttcacctaaagacattgatccagtccagcgatacgttcccctcaaggaccagcgcaacgtgtcaatgcggttcagtaaccaaggccccctggaaaatgacctcgtggtacacgtggccttgattgcagagtcccaacgcctccaggtttttcttaatacctacggtattcagacccagaccccccaacaggtggagccaatacaaatctggccgcagcaagagttggtcaaagcatacctgcagctgggcataaacgagaagttgggcctgagtggacgaccagatagacctattgggtgccttgggacttccaagatttacaggatcctgggtaagacggtggtttgttatccaatcatattcgacctttccgacttttacatgtctcaggacgtatttttgcttatcgatgacattaagaatgctttgcagtttatcaaacaatactggaagatgcatggtcgaccgttgtttctggtcctcatccgggaagacaatatacgtggcagcaggtttaaccctattctggacatgctggctgcactgaagaagggcattatcggcggagtcaaggtccatgttgaccgtttgcagaccctgattagcggggcggtggtggaacaattggattttctaagaattagtgataccgaagagctgccagagtttaagagcttcgaagagctcgaacctcccaaacacagcaaagtgaagcgccagagttccacccctagtgcgcccgagttaggacagcagccggacgtcaacatctccgagtggaaagacaagccgacacatgagattctccagaaactcaacgattgcagttgcctggcctcccaggcaatcctcctcgggattctgttaaagcgcgagggacccaattttatcacaaaggaggggacagtcagtgatcacattgagcgagtctaccgacgcgccggcagccaaaagctgtggctagccgttcgctatggagccgcctttactcagaagttttcgtcttccattgctcctcacatcactacctttttagtgcacggcaaacaggtcacacttggcgcttttggacatgaagaagaggtgatttctaaccccctatctccccgggtgatccagaatatcatttactacaagtgcaatacgcatgatgaacgcgaggcggttatccagcaggaactggtgattcatatcggatggatcatcagtaataatcctgaactattttcaggaatgctgaagatacggatagggtggattatccatgccatggagtacgaactgcagatcaggggcggcgacaaacccgccttagatctttatcagctgagcccttcagaggtgaagcagctcctgctggacattctgcagccccagcagaacggtagatgttggctaaatcgcagacagatcgacggctcactcaatcggacaccgacaggcttttacgatagagtgtggcaaatcctggagaggaccccaaatgggatcattgttgcaggcaagcacctgcctcagcagcctacactctccgacatgactatgtacgagatgaatttctccttactggttgaagacacactcggcaacattgatcaaccccaatataggcagatcgtggtcgaattattgatggttgtgtcaatagtgctcgagcggaatccagaacttgaatttcaggacaaagtggacctcgaccggcttgttaaggaggcatttaacgaattccagaaggatcagtcacgtctgaaagagatagagaagcaggacgacatgacaagtttctacaacaccccacctctgggtaagagaggcacttgctcttatcttacaaaggcagtgatgaatctgcttctggagggtgaagtaaaacctaacaatgatgacccctgcctaatttca

SEQ ID NO: 18186 - DNA, 3279 bp, Artificial Sequence
  Description of Artificial Sequence: Synthetic coding sequence
atggcgggcgccgcaggcctgaccgccgaggtgtcgtggaaggtgctcgaacgcagggcacgcactaagcgctccggatcagtgtacgagcctctcaagtccattaatctgcctcgcccggacaacgagacgttgtgggacaagctggaccattactaccggattgtcaagtcgacgctgctgctgtaccaaagcccgaccaccggactctttccaactaagacctgtggcggcgatcagaaggcaaagatccaggattccttgtactgcgcagctggagcctgggcgctcgccctggcctacagacgcatcgacgacgataaagggcgcacccacgaactcgagcacagcgcgatcaagtgcatgagagggatcctgtactgctacatgcgccaagctgacaaagtccaacaattcaagcaagatccgcgtcctaccacttgcctgcattcagtgttcaacgtccatactggagatgagctgctctcctacgaggaatacggccacctgcaaatcaatgcggttagcctctacttgttgtacctggtggaaatgatctcctcgggcctgcagatcatttacaatactgacgaggtgtcgttcatccaaaacctggtgttctgcgtggaaagagtgtaccgggtgcccgattttggagtctgggagagaggttcgaagtacaacaacggctctaccgaacttcactcctcctcggtgggactggctaaggctgcactggaggccatcaatggatttaacctgttcggaaatcagggctgttcatggtcggttatcttcgtggatctggacgcgcataaccggaataggcagaccctgtgtagcttgctcccgcgcgagtcccgctcgcacaacaccgacgcggcgttgctcccatgcatctcatacccggcgttcgcccttgacgacgaagttctcttttcccagactctcgataaggttgttcggaagttgaagggtaaatacggattcaagcgctttctgcgcgacggttacagaacctcactggaggacccaaacagatgctactacaagccggctgagattaagctgtttgacggaatcgaatgcgaattccctatcttcttcctgtacatgatgatcgatggtgtgttccgcgggaatccgaagcaggtgcaagagtatcaggacctgctgacgccggtgctgcaccacacgaccgaaggatacccggtggtgcccaaatactactacgtgcccgctgacttcgtggaatacgaaaagaataatccagggtcccagaagagattcccttcaaactgcggccgcgatggaaagctctttttgtggggacaggcactctacatcatcgctaagctcctggcggatgagctgatctccccaaaggatatcgatccagtgcagcgctacgtgccgctgaaggaccaacggaacgtctcaatgaggttcagcaatcaaggtcccctggaaaatgacctcgtggtgcacgtggcactcatcgccgaatcccaaaggctgcaggtattcctcaacacctatgggatccaaacccagaccccccagcaggtcgagcctatccagatttggccacagcaggaactcgttaaagcgtatctccagctgggtatcaacgaaaaactgggactctcgggacgtccagaccgaccgatcggctgtctgggaacctccaagatctaccgcatcctcggaaagaccgtggtgtgctatccgatcatcttcgacctgagcgacttctatatgtcgcaggacgtgttcctcctcatcgatgatatcaagaacgcgctccagttcattaaacagtactggaagatgcacgggaggccgttgtttctggtgcttatccgggaagataacatccgcggtagtcgtttcaacccgattctggatatgctggcagccttgaagaagggcatcatcggcggcgtcaaggtccatgtggacagactgcagactctgatctcaggagccgtggtggaacagctggattttctgcggatctcagacaccgaagaactccccgagtttaagagctttgaggagctcgaaccgccgaagcactcaaaggtgaagcgccaaagcagcaccccgtctgccccggagctcgggcagcagccggacgtgaatatcagcgagtggaaggataaaccgacccacgagattcttcagaagctcaacgactgctcctgcctcgccagccaagctatactgctcggtatcttgctgaagcgggaaggacccaacttcataacgaaggaggggaccgtctcagaccacatcgaacgggtgtacaggagggccggaagccagaagctgtggctcgccgtccggtatggcgcagccttcacccagaagttcagcagctcgattgccccgcacatcactaccttcctggtccatggaaagcaagtgaccctcggagccttcggacacgaagaggaggtcatctcgaatccgctctccccgcgcgtcatccaaaacatcatctactacaagtgtaacacccacgacgagagagaggccgtcatccaacaagaactggttattcacatcggttggattatcagcaacaaccctgagcttttctcgggaatgctcaagatcaggattggttggatcatccatgccatggaatacgagctccagatcagagggggtgacaagcctgcgctcgacctgtaccagctgagcccaagcgaggtgaaacagctgcttctggacatcctccagccgcaacaaaacgggaggtgttggcttaaccggagacagattgacggatcgttgaataggaccccaactgggttctacgatcgggtgtggcagatcctcgagcgcacgccaaatggaatcatcgtggccggcaagcatcttcctcaacagccgaccctgtcggacatgactatgtacgaaatgaacttctccttgctcgtggaagatactttgggcaatatcgaccagcctcagtaccggcaaattgtcgtcgaacttcttatggtggtgtcgatcgtgctcgaacggaaccccgagcttgaatttcaggataaggtcgacttggaccgcctggtcaaggaagccttcaacgaattccagaaggatcagtcgaggctgaaggaaatcgagaagcaggatgacatgactagcttttacaacactcctccactgggaaagcgcggcacctgctcttacctgactaaggcggtgatgaaccttctgctcgagggcgaagtgaagccgaacaacgatgacccgtgcctcatcagc

SEQ ID NO: 18187 - DNA, 3279 bp, Artificial Sequence
  Description of Artificial Sequence: Synthetic coding sequence
atggctggggcggccggtctcacagctgaggtcagctggaaagtgctggaacgccgggccaggaccaagcgcagcgggtctgtgtacgagccgctgaagtcaattaaccttccaagaccggataacgaaacactttgggataaactcgatcattactacaggattgtgaaatccacgcttttgctgtaccagtctcccaccacgggactctttccgacgaagacctgcggaggagatcagaaggctaagatccaggactcactctactgcgccgccggcgcttgggcccttgccctggcctacagacggatcgacgatgataaaggtcggacgcacgagcttgagcactctgcgatcaagtgtatgagaggaatcctttattgctacatgagacaggcggataaagttcagcaatttaagcaggacccacggcccaccacctgcctgcacagcgtattcaacgtgcataccggtgatgaactgctgtcctacgaggagtacggtcatcttcagattaacgcagtctccctttacttgctttaccttgtggagatgatttcttctggcttgcaaatcatatataacaccgacgaagtgagcttcatccagaacctggtgttctgtgtggagcgggtgtacagagtgccagactttggcgtctgggagcggggctcaaagtataataacgggtcaaccgaactgcacagttcctcagtggggttggccaaggctgctctcgaggcaatcaatgggtttaatctcttcggtaaccaggggtgttcttggtccgtgatatttgttgacctcgacgcacataataggaatcggcaaaccctttgtagtttgctgccaagagaaagcaggtctcataatacggatgcggctctcctcccatgcatttcttatccagcgttcgcgttggacgatgaagtcctgttctcccagaccttggacaaggtggtccgcaaactgaaggggaagtacggtttcaagcgattccttcgcgacggctacaggacctcccttgaggaccccaacaggtgttattacaagcccgcagaaattaagctctttgatggcattgagtgcgaatttcctatattctttctctacatgatgatagacggagtcttccgcggaaatcccaagcaggtgcaggagtaccaggatctgttgactccggtcttgcatcacacaaccgaagggtacccagttgtgcccaagtactactacgtgcctgctgactttgtggagtatgaaaagaacaatccaggctcccagaaaagattccctagtaattgcggcagagatggaaaactgttcctgtggggccaggccttgtatattattgctaaactgctggctgacgaactcatctctcctaaggacatcgatcctgtccagagatacgtaccgctgaaggatcaaaggaatgtaagcatgcgattttctaaccagggaccattggaaaacgatctcgtggtccatgttgcccttatcgccgaaagccagagactccaggtttttctgaacacttacgggattcagactcaaacgcctcagcaggtcgagcctatacaaatttggccacaacaagagctggtgaaggcctatctgcagctggggatcaacgaaaagctgggactgagcggaaggccagatcgacccatcggctgcctcggcaccagcaagatatatcggattctgggaaaaacagtggtttgctaccctataatcttcgacctgtctgatttctatatgtcacaagatgtctttctcctcattgacgacatcaagaacgccctccagtttataaaacagtactggaaaatgcacggtcgcccactgtttctcgtcctgatccgcgaggacaatatcagagggagccggtttaacccaatattggacatgctggccgctttgaaaaagggtatcataggcggtgttaaggtccatgtggatcgacttcagaccctgatctctggagctgtggtagagcagctcgatttcctgcgcatctccgacaccgaggaactgcccgaattcaagtccttcgaagagctcgaaccacccaagcactcaaaagttaagcgccagagctctacgcccagcgccccagagcttggtcaacagcctgatgtgaatataagcgagtggaaagacaaacccacccacgaaatccttcaaaagttgaatgactgctcttgtctggcttcccaggcgatcctccttgggattctccttaagcgagagggaccaaatttcataaccaaagagggaactgtgagcgatcacatcgagcgcgtctatcgccgggccggttctcagaagctgtggctggcagttcgctatggggcggccttcactcaaaagttctcatccagtatagctccccacattactactttcctggtgcatggcaagcaggttacactgggcgcattcgggcacgaggaggaagttatttctaacccgctttcccctagagtcatccagaatatcatctactacaaatgcaatacccacgatgagcgagaggcagtgatacaacaggagctggtgatacacatcggctggataatcagcaataatccagagctgttctctgggatgcttaagattcgcatcggctggattatacatgccatggagtacgaacttcaaattcgcggaggagacaagcctgcactggatctgtatcagttgagcccctctgaagtaaagcagctcctgctcgatatactgcagccccagcagaatggcagatgctggctcaataggaggcagatagatggcagtctcaaccggacccctactggcttctatgaccgcgtgtggcagatcctggagaggactcctaacgggattattgtggctggcaagcatctgccacagcagcccaccctgtctgacatgactatgtatgaaatgaatttcagcctgctcgtggaagacactctcggaaacatcgatcagccacagtataggcagatcgttgtcgagctgttgatggttgttagcattgtgctcgagaggaacccagagctggaatttcaggataaagtggacctggatcgattggtgaaggaggcctttaacgagtttcagaaagatcaaagccggctgaaggagattgaaaagcaggacgatatgacgagcttttataatactccacctctgggcaagaggggaacgtgttcctacctgactaaggctgtgatgaacctgctgctcgagggcgaggtaaagcccaataatgacgacccttgtcttatctcc

SEQ ID NO: 18188 - DNA, 3279 bp, Artificial Sequence
  Description of Artificial Sequence: Synthetic coding sequence
atggctggtgctgctggattaacagctgaagtttcttggaaagttcttgaaagaagagcaagaactaaaagatctggttcagtttatgaacctttaaaatctattaatttacctagacctgataacgaaacattatgggataaacttgatcattattatagaattgttaaatctactttattgttataccaaagtcctactacaggattattcccaactaaaacttgtggaggagaccaaaaagctaaaattcaagattcattatattgtgctgcaggagcatgggctcttgctttagcatacagaagaattgatgatgataaaggtcgtactcatgaattagaacattcagctatcaaatgtatgagaggaattctttattgttatatgagacaagccgataaagtacaacaattcaaacaagatcctagaccaactacatgtttgcattctgtttttaatgtacatacaggagatgaacttttatcatatgaagaatatggacatttacaaataaatgctgtttcactttatttattatatttagttgaaatgattagtagtggattacaaataatttataatactgatgaagtctcgtttattcaaaacttagttttctgtgttgagcgtgtgtatagagtaccagattttggagtttgggaaagaggatctaagtataataatggaagtactgaacttcatagttcaagtgttggattagcaaaagcagcacttgaagcaattaatggatttaatttattcggaaatcaaggatgttcatggtcggtaattttcgtagatttagatgctcataatagaaatagacaaacattatgtagtttattgccacgagaatcaagatcacataatactgatgctgctttacttccatgtatttcatatccagcatttgctcttgatgatgaagttcttttttcacaaacgctagataaagttgtaagaaaattgaaaggaaaatatggatttaaaagatttttgagagatggatataggacatcacttgaagatccaaatagatgttattataaaccagcagaaattaaattatttgatggaattgagtgtgaatttccaattttttttctatatatgatgatcgatggagtgtttcgtgggaatccaaagcaagttcaagaataccaagacttacttacaccagttttacatcatacaactgaaggatatccagttgttccaaaatattattatgttcctgcagatttcgttgaatatgaaaaaaacaatccaggatctcaaaaaagattcccttcaaattgcggaagagatggaaaattatttttatggggacaagctctttatattatagcaaaacttttagcagatgaacttatttcaccaaaagatattgatcctgtccaaagatatgttccacttaaggatcaacgtaatgtttcaatgaggttttcaaatcaaggaccattagaaaatgatcttgttgttcatgttgcattaattgcagaatctcaacgtttacaagtttttttaaatacttatggaattcaaactcaaacaccacaacaagttgaaccaattcagatttggccacaacaagaacttgttaaagcttatcttcaattaggtattaatgagaaacttggacttagtggaagaccagatcgaccaattggttgtcttggaacatcaaaaatttatagaatattaggaaaaacagttgtttgttatcctattatatttgatctttctgatttttatatgtcacaagatgttttcttattaattgatgatatcaaaaatgctttacaatttattaaacaatattggaaaatgcatggaagaccattatttcttgttttaataagagaagataatattagaggaagtagatttaatccaatccttgatatgttagcagctcttaagaagggaattataggtggtgtaaaagtccatgtagatagattacaaactttaattagtggagctgttgttgaacaattagatttcttaagaatatctgatacagaagaattaccagaatttaaaagttttgaagaattggaaccaccaaaacattcaaaagttaaaagacaatctagtacaccttctgcaccagaattggggcaacaaccagatgttaatatttctgagtggaaagacaaaccaacgcatgaaattttacaaaaattaaatgattgttcttgtttagcatcacaagctattttacttggtattttactcaaaagagaaggaccaaattttattactaaagaaggtactgtttcagatcatattgaaagagtctatagaagggctggatctcaaaaattatggttagctgttagatatggagcagctttcacacaaaagttttctagttcaattgctccacatattacaacctttttagtccacggtaaacaagttactttaggagcctttggacatgaagaagaagttatttcaaatccattgagtccaagggttattcaaaatattatttattataaatgtaatacacacgatgaaagagaagcagttattcaacaagaattagttattcatattggatggattattagtaataatccagaattattttcaggaatgcttaaaattcgtattggttggattatacatgcaatggaatatgaacttcaaatacgtggaggagataaaccagctttagacttatatcaattatcaccaagtgaagtaaagcaattattattagatatactacaaccacaacaaaatggacgatgttggttaaatcgtagacaaattgacggatcacttaatagaacaccaactggattttatgaccgtgtttggcaaattttagaaagaacaccaaatggaattattgttgctggaaaacatttaccacaacaaccaacattatcagacatgaccatgtatgaaatgaattttagtttattggttgaagatactttaggaaacatagatcaaccacaatatcgtcaaattgttgttgagttacttatggtggtttcaattgttcttgaaagaaatcctgaacttgaatttcaagacaaagtggatttagaccgtttagttaaggaagcttttaatgagtttcaaaaagatcaatcacgtcttaaagagattgaaaaacaagatgatatgacttctttttataatacccctcctcttggaaaaagaggtacatgttcatatttaactaaagcagttatgaatcttttattagaaggagaagttaaaccaaataatgatgatccatgtttaatttca

SEQ ID NO: 18189 - DNA, 3279 bp, Artificial Sequence
  Description of Artificial Sequence: Synthetic coding sequence
atggcaggtgcagctgggctgacggccgaagtctcctggaaggtgctcgagcgccgggccaggactaaaaggtcaggatcagtctacgaaccgctgaagtcaatcaatctcccgcgcccggacaatgaaacgctgtgggataagctcgaccattactatagaatcgtgaagtcaaccctgctgctctaccagtccccgactaccggactgttccctaccaaaacctgcggaggtgaccagaaagccaagatccaagattcgctctattgcgcggccggagcgtgggcgctggctttggcatacagacgcattgatgacgataaggggcggacccatgaactggagcacagcgcgattaagtgcatgcggggtatcctgtactgctatatgagacaggcggataaggtccaacaattcaagcaagatccgcgccctaccacctgcttgcactcggtgttcaacgtgcacaccggagatgagctcctcagctacgaagaatacggacatctccagatcaacgccgtgtcgttgtaccttctgtacctggtcgagatgatctcctcggggctgcagattatctacaacactgacgaagtgtcgttcattcagaacctggtgttctgcgtggaacgagtgtacagagtgccggactttggagtttgggaacggggttcgaagtacaataatggatcgactgagctgcacagtagctcggtgggcctggctaaagcagctctcgaggcgatcaatggcttcaatctgttcggcaaccagggatgctcctggtcggtgatttttgtggatttggacgcccataaccggaacagacaaacgttgtgctcactgctgcctcgtgaatccagaagccataacaccgatgcagcactgttgccttgtatcagctacccggcttttgccctggacgacgaagtgctgttctcccagacccttgacaaggtggtgcgcaagctgaagggcaaatacggctttaagcgcttcctccgcgacggatacagaacgtccttggaagatccgaaccgctgctactacaagccggcagaaatcaagttgttcgatggaatcgagtgcgagttcccgatctttttcctgtatatgatgatcgacggagtgttcagaggaaatccgaagcaggtgcaagaataccaggacctgctcaccccagtgctccaccacactactgaaggatacccggtcgtcccaaagtactactacgttcctgccgattttgtcgaatacgaaaagaataacccgggatcccaaaagcggttcccgagcaactgtggtcgggacggcaaattgttcctttggggccaagcactctacatcatcgcgaaactgctggccgacgagttgattagccccaaggacatcgatcccgtgcaacgctacgtcccgctgaaggaccagcgcaatgtgtcaatgagattttcaaaccaaggaccactggaaaatgaccttgtcgttcatgttgctctgattgctgagagccaaaggctccaggtctttctcaacacttacggcatccagacccaaacccctcagcaggtcgagcctatccagatctggccgcaacaggagttggtgaaggcgtacttgcagttgggaatcaatgagaaacttggcctttcaggacggcccgatcggccaatcgggtgtctgggcacctcaaagatctatcgcattctgggcaaaaccgtggtttgctaccctatcatcttcgacttgtccgacttttacatgtcgcaagacgtgttcctgctgatagacgacatcaaaaacgccctgcagtttatcaaacagtactggaagatgcatgggcgtccactgttccttgttttgatccgcgaggataacatcagaggatcccgctttaaccctatccttgatatgcttgcagctctgaagaaggggatcatcgggggagtgaaggtgcatgtagaccggctgcagaccctgatctccggcgcagtggtggagcagttggatttcctccggatctccgatactgaagagttgccggaattcaagtcgttcgaagagttggaaccaccgaagcactccaaggtgaagcggcagtccagcactccctcagccccagaattgggccagcaaccagatgtgaatatctccgagtggaaagataagccaactcatgaaatcctgcagaagctgaatgactgtagctgccttgcctcccaggcaatccttttggggatcctgctgaagcgagaaggaccaaacttcattactaaggagggaactgtgtctgaccacatcgaaagagtctacaggcgcgccgggtcacagaaactgtggctcgcggtgaggtacggagctgcattcactcagaaattcagctccagtatcgcaccgcatatcacgacctttctcgtgcatggtaagcaggtcactctgggggctttcggacacgaggaggaagtcatttcgaatccgctgtcgccgcgcgtcatccagaacataatctactacaaatgcaacacgcatgatgaacgggaagcagtgatccagcaggagctcgtgatccatatcggatggatcatctcgaacaacccggagctgttctccggtatgctcaagatcagaatcggttggatcatccacgcaatggaatacgaactgcaaatccggggtggcgacaagcccgctctcgacctgtaccagctcagtccatcggaagtcaagcagctcttgctcgacatcctgcagccgcagcaaaatgggagatgttggctcaatcggaggcaaatcgacggctctcttaaccggacccctactggcttttacgaccgcgtctggcagattctggagcgtaccccgaatggtatcatcgtcgccggaaagcacctcccgcaacagccgactttgtccgatatgaccatgtacgagatgaacttctcgctcctcgtcgaggatactcttggcaatatcgaccagccacaataccgccagattgtcgtcgaactcctcatggtggtgtcaatcgtgctggaacggaacccagaacttgaatttcaggacaaagtcgacctggatcgcctggtcaaagaagcattcaacgaatttcagaaagatcagtcgcgcctgaaagaaatcgaaaagcaggatgatatgacctcattctacaacacgccgccattgggaaagcgcggcacctgctcgtacttgaccaaggccgtgatgaatcttctgctcgaaggagaggtcaagcctaacaacgatgacccctgcctcatttcg

SEQ ID NO: 18190 - DNA, 3279 bp, Artificial Sequence
  Description of Artificial Sequence: Synthetic coding sequence
atggccggcgctgccggcctgaccgccgaagtgtcatggaaggtcctcgagagaagggcaagaaccaagcggtccggtagtgtgtatgagcccctgaaatccattaacttaccccgaccagataatgagaccctgtgggacaaactggaccattactatcgaatagttaagtcaaccctgctgttgtaccagtctcctacaaccggcttatttcccaccaagacctgtggaggtgatcaaaaagccaagatccaggacagcctgtattgtgccgcaggagcttgggccctcgcgctggcttaccgacggatcgatgatgacaagggccggactcacgagcttgaacatagcgccatcaagtgtatgcgagggatcctttactgttatatgcggcaggcagataaggtgcagcagttcaagcaggacccaagacccacgacgtgtctccatagcgtgtttaacgtacatactggggacgagcttctcagctacgaagaatacggccacttgcaaattaacgccgtgtctctgtacctgttgtacctggtggaaatgatttctagtggcctccagatcatatataacaccgatgaagtgagttttattcaaaatctggtattttgcgttgaacgtgtgtatcgggttcctgattttggagtgtgggaacgcggatccaagtataacaatggcagtaccgagctgcattcctccagtgttggtttggccaaagcagccctcgaagctataaacggctttaacttatttggaaatcagggctgtagttggtcggttatcttcgttgacttggatgcccacaatagaaaccgccaaaccctgtgcagcctgcttccccgcgagtcacgtagccacaacaccgatgctgccctgttaccctgtatttcctatcccgcctttgcactcgatgacgaggtgttgttctctcagacgcttgataaagtggtacgcaaactcaagggcaagtatggattcaaacgttttttgcgcgacggataccgtacctccctggaggatcccaacagatgctactacaaacccgcggagattaaattgtttgacgggatcgaatgcgagttccctattttttttctctacatgatgatcgacggggtgtttcgcggaaacccaaagcaagttcaggaatatcaggatctgcttacccccgttctccaccacaccactgaagggtatcctgtggttccgaagtactactatgtccccgctgactttgtggagtacgagaagaacaatcctggttctcagaaacggttcccatctaactgtggtagagatgggaaattgttcctttgggggcaggccctttacatcatcgcaaaactcctggccgatgagctcatatctcccaaagatatagacccagtacagcggtacgtgccgctgaaggaccagagaaacgtgtctatgcggttttctaatcagggaccgctcgaaaacgatttggttgtgcatgtggcgctgattgctgagtctcagcgactgcaggtgtttttgaatacgtatggcattcaaacccagaccccacagcaggtcgagcccattcagatctggcctcagcaggaactagtgaaggcttatctccagctgggaataaacgagaagctgggtctctctggacgtccagataggcccatcggctgcctcgggacctccaagatttaccggatcctgggaaagacagtggtgtgctatccaatcatcttcgatctttctgacttttatatgtcacaggacgtgttcttgctgattgatgatattaagaacgccctgcagttcattaagcagtactggaagatgcatgggaggcccttgtttttggtgcttatcagggaagataacatcaggggaagtaggttcaatcctatactggatatgctggctgccctgaagaaaggaattataggtggagttaaagtgcatgtcgataggctgcagactcttatctctggggctgtggtcgagcagcttgattttctcagaatctcagatacggaagagctgcctgagttcaaatcttttgaggagctagaacctcccaaacactctaaagtaaagcgccagagctccaccccttcagccccggaactagggcagcagccagatgtgaatatcagcgaatggaaagacaaacctacccacgaaatcttgcagaaactgaacgattgttcctgtctggcttctcaggcgatactgctgggcatactgctcaagagggaaggccctaacttcattactaaggagggtaccgttagtgatcacattgagagagtgtatcgtagggcaggatcccagaaactgtggctagccgtgcgctatggcgccgcttttactcagaagttctcatcaagtattgcccctcacataactacctttctggtacatggcaagcaagtgacactgggggcattcggccacgaggaagaggtaatttctaatccattgtccccaagggttatccagaacatcatttactacaaatgtaatacacacgacgagagggaagccgtgatccaacaggagctggtgattcacatcgggtggataattagcaacaacccggagctgttttctggcatgctgaaaattagaatcgggtggatcatccacgcgatggagtacgagctgcagatccgggggggagataagcccgccctggacctttaccagctcagccctagtgaggttaaacaactgcttcttgacatccttcaaccccagcagaatggacggtgctggctcaacagaagacagattgatgggtctctgaatagaacaccaacaggcttttacgaccgggtttggcagatcctagagcgcacgcctaacggcataatcgttgcaggaaaacatcttccacagcaacccaccctgtcagacatgaccatgtacgaaatgaatttctccttactcgtcgaggatactttaggcaacatcgatcagccacagtaccgccaaatcgtcgtggagctgctaatggtggtgtccatagtattggagcgcaaccctgagctagagttccaggacaaggtggatttggacaggcttgttaaagaggccttcaatgaattccaaaaggaccagtcccgtcttaaagaaattgagaaacaggacgacatgaccagcttctacaatactccacctttgggaaagcgcgggacttgctcatacctgactaaggctgtaatgaacttacttctggagggcgaggtgaagcctaacaatgatgatccctgtctgatcagc

SEQ ID NO: 18191 - DNA, 3279 bp, Artificial Sequence
  Description of Artificial Sequence: Synthetic coding sequence
atggccggcgccgctgggttgaccgctgaggtctcgtggaaggtcctggaacgtcgcgccagaaccaagcgcagcggctcggtgtacgaaccgctaaaaagtatcaaccttccccgtcccgataatgaaactctgtgggataagttggaccattattatcgtatagtgaagagcactctcctgctttaccagagcccaacgacgggcctattccctaccaagacatgcggcggcgatcagaaagcaaagattcaggacagcctgtactgcgccgccggcgcttgggccctagctctcgcctaccgtcgcatcgacgatgacaaaggccggactcacgaactggagcacagtgccatcaagtgcatgcggggtatcctgtattgttatatgaggcaggcagacaaggtgcagcagttcaagcaagaccctcgccccaccacttgcctgcacagcgtcttcaatgttcacacaggtgatgagcttctgtcttacgaggagtacggccacctccaaatcaacgctgtgtccttgtacctgctgtacctcgttgaaatgatttcctccggtctacagataatatacaacacggacgaggtttctttcatccagaacctggtcttctgtgttgagcgtgtgtaccgagtgccggatttcggagtctgggagcggggctcgaagtacaacaatggcagcaccgagcttcacagctcgtccgttggtttagccaaggcggcccttgaagccattaacggcttcaacttgtttggcaatcagggctgcagctggagcgtcattttcgttgatctagacgcgcacaacagaaataggcaaacactgtgttctctgctgcctagagaatcccgatctcacaacacggatgcagcgctgctgccatgcatcagttacccagcttttgccttggacgacgaagttttgttctcgcagactctcgacaaggtggtgcggaagttgaaggggaagtacggattcaagcgattcctgcgagatgggtatcgcacgtctctggaggaccccaaccgctgctattataagccggccgagatcaagctgttcgacggcatagagtgcgagttcccgatcttctttctctatatgatgattgatggtgtgttccgcgggaacccgaagcaggtgcaagagtaccaggacttgctcactccggtactgcatcacactacggagggttatccagtggtccctaagtactactatgtccccgccgatttcgtggagtacgaaaagaacaacccgggctcgcagaagcgcttcccttcgaactgcggccgtgatggcaagctgttcctgtggggtcaggccctgtacatcatagctaagctgctggccgacgaactgatatcccccaaggacatcgatccggtgcaacggtatgtccctctgaaggatcagcggaatgtcagcatgcgattctcaaatcaaggccccttggagaatgatctggtcgtccatgtcgctctgatagcagagtcacaacggctacaggtattcctcaacacatatggtatccagacccaaacgccacagcaggtggagccaattcagatctggccccagcaggaattagtaaaggcctatttacagttgggaattaatgagaagctgggcctgtctggtcgcccggacaggcccatcggttgccttggaacgtctaaaatatatcggattctgggcaagacggtagtgtgttaccctatcatctttgatttgagcgacttctatatgtcccaggatgtgttcctgttgatcgatgatattaagaatgctctgcagtttatcaaacaatactggaagatgcacggcagaccactgttcctggtattaatccgggaggataacatccgcggctctcgtttcaatccaatactggatatgctggctgctctgaaaaaaggcattatcggcggtgtgaaagtgcacgtggaccggcttcaaacgttgatctcaggcgcagtggttgagcagttggacttcctgcgtatcagtgacaccgaggagctgcccgaattcaagtcattcgaggagctggagcccccgaaacattccaaagtgaagcgccagtccagcactccaagcgcccccgagctgggacagcagcctgacgtgaacataagcgagtggaaggacaaacccacgcacgagatcctgcagaagctgaacgactgctcgtgcctcgcgagccaggccatcctgctgggaatcctcctcaagagggaggggcccaatttcattactaaggagggtacagtgtcagatcacattgaacgcgtgtaccgccgcgccggtagccagaaactgtggctcgcggtgaggtacggtgctgcgttcacgcagaagttctcctcgtccatcgccccccacattactacgttccttgtgcacggtaaacaggtgacactgggtgcgttcggacacgaagaagaggtgattagtaatccgctatcccctcgcgtgattcagaatatcatttactataagtgcaatacccacgacgagagggaggccgtaatccagcaggagttggtcattcacattgggtggataatttccaataacccagagctcttttccggaatgcttaagatcagaataggctggatcatccacgccatggaatacgagcttcaaatccgcgggggcgacaagccggctctggacctgtaccaactgtcgccttcggaggtaaagcaacttctgctggatatcctccagccgcagcagaacggccgttgttggttgaatcgtcgacaaattgatggctcattgaaccgtaccccgacgggtttttatgaccgagtctggcagatcttggagcgcacaccgaatggtatcattgtagccggaaaacatttgccacagcagcctactctcagcgacatgaccatgtacgagatgaacttctctctgctggttgaggacaccctaggcaacatagaccaaccacagtatcgccagatcgtcgtggagttattgatggtggtgtcaatcgttctggagcgcaaccccgagctggagttccaggataaggtcgatctagatcgtcttgtgaaggaggccttcaacgagttccagaaggatcagtcccggctcaaggagatcgagaagcaggatgatatgacgtccttctataacaccccgccgttgggaaagcgtggcacttgcagctacttgaccaaggccgtcatgaacttactcctggagggagaagtgaagcctaataatgacgatccctgcttaatctcg

SEQ ID NO: 18192 - DNA, 3279 bp, Artificial Sequence
  Description of Artificial Sequence: Synthetic coding sequence
atggcaggcgcagccggacttacggcggaggtgtcctggaaggtcttggaaaggcgtgcaaggaccaagagatcggggtccgtgtacgagccacttaagtctataaacctgccacgccctgataacgaaaccttgtgggacaaactcgaccattactaccggattgtgaagagcaccctcttgctgtaccagtcccctaccactgggctcttcccaaccaaaacttgtggaggggatcaaaaagcaaagatccaagactcgttgtactgtgcggccggcgcctgggccctggcacttgcatacagaaggatagatgatgacaagggcaggacccatgaactggaacattccgctatcaagtgtatgagaggaatcttgtattgctacatgcgccaggcagataaggtccagcagttcaagcaggacccgcgacctaccacctgcctgcattccgtgtttaatgtgcacaccggagacgagcttctttcgtacgaagaatacggacaccttcagattaacgcagtctctctttacctgttgtacctggtcgaaatgatctcgtcagggctccagatcatttacaacactgatgaagtgtccttcatccaaaacctggtcttttgcgtagaacgggtgtaccgcgtgcccgattttggcgtgtgggagagaggaagcaagtacaacaatgggtcgaccgagctgcactcgtcatccgtgggactggcgaaggcagcactcgaggccataaacggatttaacttgtttgggaaccagggatgtagttggagcgtcatttttgtggacctcgacgcacataacagaaacaggcaaactctttgctccctcttgccaagagagagccgttcgcataatactgatgcggcgttgctcccttgtatttcatacccagcattcgcccttgacgatgaagtgctttttagccagactctcgataaagtggtcagaaaactcaagggtaagtacggattcaaaagattcctgcgggacggttatcggacttcacttgaggatccaaaccggtgttactacaaacctgcagagataaaactttttgatggtattgaatgtgaatttcccattttcttcctgtacatgatgatcgatggagtgttccgaggtaaccccaagcaggttcaagagtaccaggatctgctgacccctgtgcttcatcataccactgaggggtatcccgtggtccctaaatactactacgtgccagcagacttcgtggaatacgagaaaaacaacccgggatctcagaagagatttccctccaactgtgggcgggatggaaagctgttcctttggggccaagcactctacattatagctaaacttctggccgatgaactcattagcccaaaggacatcgatccggtgcagcggtacgtcccacttaaggaccagagaaatgtgtcgatgcgctttagcaaccagggtccacttgaaaacgatcttgtcgttcatgtggcgctgatcgcagagtcccaacgacttcaggtgtttctgaacacttacggcatccaaactcaaactccacaacaagtcgaaccaattcaaatatggcctcagcaggaacttgtcaaggcgtacctgcagcttggaattaacgaaaaacttggtctgtccggacgaccggatcggcctattggatgtcttggaactagcaagatctaccgcatcctcggcaagaccgtggtgtgttatcctatcatatttgatctgtccgatttctacatgagccaagacgtctttttgttgattgatgacattaagaatgctcttcagttcattaagcagtactggaagatgcatggacgacccctgtttctggtgcttattcgtgaggacaacatcagaggtagcaggtttaacccaattcttgacatgctggccgcactgaaaaagggcattattggcggagtgaaggtgcatgttgatagactccaaaccctgatttcaggagcggtggtggaacaactcgactttcttcgcatatcggataccgaagaactgccagagtttaagagtttcgaagaacttgagccacctaagcattcaaaggtgaagcgacaatcatcaacgccctcggcaccagaactgggccagcaaccggatgtgaacatctccgaatggaaagacaaacctacccatgaaattctgcaaaaactcaatgattgcagctgtttggcatcgcaagcaattctgcttggaatcctgctcaaacgtgaggggcctaacttcatcactaaggaagggaccgtctcggatcatattgagagggtgtacagacgcgcaggatcgcagaaactttggctggcggtgagatatggtgctgcgttcacgcaaaagttttcttcgagcatagcccctcacatcacgacgttcctggtgcacggcaagcaggtcaccctgggcgcatttggccacgaagaggaagttatttccaacccactctcccctcgcgtgattcaaaacatcatttactacaaatgcaacactcacgatgagcgagaagcagtaatacaacaggaactggtgatccacatcggttggatcatctcgaacaaccctgaacttttttccggtatgttgaagattcggattggatggattatccatgctatggagtacgaactgcaaatcaggggaggtgacaagccggcactggacctctaccaactttcgcccagcgaagtgaagcaactgttgctggatattctgcagccacaacagaatggccggtgttggcttaaccggcggcaaattgacggcagccttaataggacgccaaccggattttacgaccgagtgtggcaaatcctcgaacgtaccccaaacggtataatcgtcgccggcaagcaccttcctcaacagccaactttgagcgacatgaccatgtacgaaatgaacttttccctgcttgtggaggatactctgggtaacattgaccaacctcaatacaggcagattgtggtcgaattgctcatggtcgtcagtatcgtgctcgaacgaaatccagaacttgagtttcaagataaagtggatctggaccggctggtgaaagaagcgtttaatgaatttcagaaagatcaatctaggcttaaggagattgaaaaacaggacgatatgacgtcgttctacaatactcccccactgggaaagaggggaacttgctcctaccttaccaaagctgtgatgaaccttctgctggaaggagaagtgaagccaaacaacgatgatccttgccttatttct

SEQ ID NO: 18193 - DNA, 3279 bp, Artificial Sequence
  Description of Artificial Sequence: Synthetic coding sequence
atggccggcgccgcgggactgaccgcagaggtgtcctggaaggtcctggaacggcgggcgcggactaaacgctccggatccgtgtacgagccgctgaagtcaatcaacctgccacgccccgataacgagactctctgggacaaacttgatcactactaccgcatcgtgaagtcgaccctgttgctgtaccagtccccgaccactggactgttcccgactaagacttgcggaggagatcaaaaagccaaaatccaggactcgctttattgcgcggcaggtgcctgggcgctggcccttgcgtaccgccggatcgacgacgacaaaggacgaacgcatgagctggaacattcagccatcaagtgcatgagaggaatcctgtactgctacatgagacaggctgataaagtgcagcaattcaagcaggatccacggcctaccacttgcctgcactcggtctttaatgtgcatactggcgatgaattgttgtcctacgaagaatacggacatctgcaaatcaacgccgtgagcctgtatctgctctacctggtggaaatgatctcctcaggactccagatcatctacaacaccgacgaggtgtccttcatccagaatctcgtgttctgtgtggagagggtgtacagggtgcctgacttcggagtgtgggaacgaggttcaaagtacaacaacggttcgaccgaactccactcgtcgtccgtgggtcttgccaaggccgcgctggaagcgattaacggcttcaacctgttcggaaatcagggatgttcctggtcggtgattttcgtggacctcgacgcccacaaccgcaaccgccaaacgctctgttcccttctgccgagggaaagtagatcgcacaacactgacgcggcgctcctcccgtgcatttcatacccggctttcgctttggacgatgaagtcctcttctcgcagactctggacaaggtggttcggaagctcaaggggaaatacgggtttaaacgctttctccgggacgggtacagaacgtcgttggaagatcccaaccgctgctactacaagcccgcggagattaaactcttcgacggcatcgaatgcgagtttcccatcttctttctctacatgatgatcgacggcgtgttccgtggtaatccgaagcaggtccaggaatatcaagaccttctgactccggtgctgcatcataccactgagggataccccgtggtgccgaagtactactatgtgcccgcggatttcgtggaatacgagaagaataacccaggatcacagaaacgattcccaagcaattgtggaagagatggcaagttgttcctctggggtcaggccctctacatcatcgctaagctgctggctgacgaactgatctcgccgaaggatatcgacccggtgcagagatacgtgccactgaaggatcagagaaacgtatcaatgcggttctccaaccagggccccctggagaacgaccttgtggtgcacgtggctctgatcgccgagagccaacggctgcaggtctttttgaatacttacggaattcaaactcagactccgcaacaggtggagcccatccaaatctggcctcagcaagaactcgtcaaggcttacctccagctcggcatcaacgagaagctcgggctgagcggacggccggatcgtccgatcggctgcctgggcacttcgaaaatctaccgcattctgggcaaaactgtcgtctgctacccgatcatcttcgatctgagcgacttttacatgtcccaggacgttttcctcctgatcgatgacatcaagaacgcactgcaattcatcaagcaatactggaaaatgcacggacggcctctgttcctggtgctgattagggaggacaacatccgcggctcgcggttcaacccgattctggacatgctggcagcactcaaaaagggaatcatcggtggggtcaaggtgcacgtggaccgcctgcaaaccttgatcagcggagccgtggtggaacagctggatttcctccgaatcagcgacactgaggagcttcctgaattcaagtcattcgaggaactcgagccaccgaagcactcgaaagtgaagcgccagtcctcgactccctcagccccagagcttggccagcagccggacgtgaacattagcgaatggaaggataaaccaactcacgagatcctgcaaaagttgaacgactgctcgtgcctggccagccaggctatcctgctcggcatactgctcaagagagagggcccgaactttatcacgaaggaaggaactgtgagcgatcacatcgagagagtctaccgccgcgccggatctcaaaagctgtggctggctgtgagatacggggcggccttcacccagaaattctcttcatccattgcaccgcacatcaccacgtttctggtgcacggaaaacaagtgaccctgggagcatttgggcatgaggaagaggtgatctcgaacccactgtcgccgcgcgtaatccaaaacatcatctactacaagtgcaacactcacgacgaacgcgaggctgtgatccaacaggaactcgtaatccacatcggatggatcatttcgaataatccagaactgttctccggaatgctgaagattcgcatcggttggatcatccacgccatggagtacgagctgcagatacgcggcggagataagccggcactggatctctaccagttgtcaccaagcgaagtcaaacagttgctgttggacatcctgcagccgcagcagaatggccgctgttggctcaataggagacagatagatggctccctcaaccgcacccccaccgggttctacgaccgggtgtggcaaattctcgagaggaccccgaacggaataatcgtggccgggaaacatctcccacagcagccgactctgtccgacatgacgatgtatgagatgaacttcagccttctcgtcgaggatactctgggaaacatcgaccaacctcaataccggcaaatcgtggtggaactgctgatggtggtgtccatcgtgctggagagaaacccggaactggagttccaggacaaggtcgacttggaccggctcgtgaaggaggccttcaacgaattccaaaaggaccagtcccggctgaaggagatcgaaaagcaggatgatatgacctccttctacaacaccccgccgttggggaaacggggcacttgctcctacctgacgaaggcagtcatgaacctgctcctcgagggagaggtcaaaccaaacaacgatgatccatgtctgatctca

SEQ ID NO: 18194 - DNA, 3279 bp, Artificial Sequence
  Description of Artificial Sequence: Synthetic coding sequence
atggccggggccgcaggcctcaccgccgaagtctcatggaaggtgttagagcgcagagcaaggaccaaacgctctggctctgtctatgagcctcttaagtctatcaacctacccaggcctgacaatgagacactgtgggacaagctggaccactactatcgtatcgtcaaatcaaccctcctcttatatcagtctcccactactggtttgtttcctacaaaaacttgtggaggcgaccaaaaggccaagatccaagattctctttattgtgctgctggggcgtgggcgctggccctggcctaccgacggatcgatgatgataagggacggacccatgagctcgaacactccgccatcaaatgcatgagaggtatcctttactgttatatgcgtcaggccgacaaagtgcagcagttcaagcaagatcccagacctacaacatgtctgcactcggtgttcaatgtgcatacaggagacgagcttctgtcatatgaagagtatgggcatctccagattaatgctgtttctttgtaccttctgtatctggtggaaatgatctccagcggcctacagataatctacaacacggatgaagtgagcttcatccagaacctggtgttttgtgtcgaaagagtctacagggtgccagatttcggcgtttgggaacggggatccaaatataacaatgggtccacagaactgcactcctcttctgtgggcttagctaaagctgccctggaggccatcaacggattcaatctgtttggcaaccagggatgctcttggtcagtgatcttcgtcgatcttgacgctcataacaggaaccggcagaccctgtgttccttactccctcgcgaatctaggagccacaacaccgacgcagcccttctgccatgtatatcatatccagctttcgccctggatgacgaggttctcttctcacagacgctggataaggtcgtccgcaagctgaagggcaagtatggttttaaaagatttctaagagacgggtatcggactagcctggaagatcccaataggtgttactacaaacccgctgagattaagttatttgatggaatcgaatgtgagttccccatcttcttcctctatatgatgatcgacggagtgttccgcgggaaccctaagcaggtgcaagagtatcaggatctgcttactccggttctgcaccatactaccgaaggctaccccgtggtgccgaaatattactacgttcccgccgatttcgtcgaatacgagaagaacaatcccggatcccaaaagcgctttccctccaactgcggcagagacggcaagttgtttctctgggggcaggctttgtatatcatcgccaaactgctcgccgacgaactaattagccctaaggatattgacccagtgcagagatatgtgcccctaaaagatcagagaaacgttagtatgaggttttccaatcagggacctttggagaacgatttggtggtgcacgtggcccttatcgcagagtctcagcgcctgcaggtgttcctcaatacatatgggatccaaactcaaaccccccagcaggtagagcctattcagatctggcctcaacaagagcttgtgaaagcttacctgcagctaggaattaacgagaagctcgggctgtcaggacgccctgatcggcccattgggtgtctagggacttccaaaatctatagaatcctcggtaaaaccgtcgtgtgttatcctataatctttgaccttagcgatttttacatgtctcaggacgtgttccttctgatcgatgatatcaagaatgcccttcaattcattaagcaatattggaaaatgcatggccgacccctgttcttggtgttgattagggaggataacatccggggatcgagattcaaccccatcttagatatgttggccgccttgaaaaagggcataataggtggggtgaaggtacacgtagatagactgcagacgctgatatccggcgctgtagtggaacagctggatttcctgaggatctccgacacagaggagctgccagagtttaagagtttcgaggagctggaaccccctaaacatagcaaggtgaaaagacagtcttccacccctagcgcacccgagctgggccagcagcctgacgtaaacatcagcgaatggaaagacaaacctacacacgaaatcctgcagaagctgaacgattgctcctgtttggcctctcaggctatcctgcttgggatcctgttaaagagagaaggcccgaattttattaccaaagagggcacagtgagtgatcacattgagagagtgtaccgacgggcggggtcacagaaactgtggctcgcggtccgctatggggctgcgttcacccagaagttcagcagcagcatagccccgcacattactaccttcttggtgcatggaaagcaggttacactcggcgctttcggccatgaagaagaggtgatatcaaatcccctgtccccccgcgtaatccagaatataatctactataagtgcaacacgcatgacgagcgcgaagcagttattcaacaggagttggttatccacattggttggataatcagcaataatcctgaactgttttctggaatgctgaagatccggatcgggtggatcattcatgccatggaatatgagctgcagattcgcggaggcgataaacctgctcttgatctgtatcagctgtcaccaagtgaagtgaaacagcttctcctagatattctccagccacagcagaacggcaggtgctggctaaacagacggcaaatagacggctccctgaatagaacccccactgggttttacgacagggtgtggcagatcctcgagcgtacccccaatggaatcattgtggcaggaaagcaccttccccagcaacccactctcagcgatatgaccatgtacgagatgaacttctcactgctggtggaggacactcttggaaatatcgatcagccccagtaccgtcaaatcgtcgtggagctgctcatggtagtgagcattgtgttagaaaggaaccccgagctggagttccaggacaaggttgatctggatcggctcgtcaaagaagccttcaatgagtttcagaaggatcaaagccgcttgaaggaaatagagaaacaagatgatatgacaagcttttacaacacaccaccccttggcaaacgcggcacttgtagttacctaacaaaagcggtgatgaacctcctgctcgaaggggaggtgaagcccaacaatgacgacccttgcttgatcagt

SEQ ID NO: 18195 - DNA, 3279 bp, Artificial Sequence
  Description of Artificial Sequence: Synthetic coding sequence
atggccggggcggcaggtctgaccgccgaagtctcatggaaagtgcttgagcgtagggcaagaacgaagagatcgggcagcgtgtacgaacccctcaagagcatcaatctccctaggcctgacaacgaaaccttgtgggataaactcgatcactactacaggatcgtgaagtccaccctgctgctttaccaaagccctaccacgggattgtttcccaccaaaacctgtggtggtgaccaaaaagcaaagatacaggattccctttactgtgcagcaggagcctgggccctggccctggcttataggagaattgacgacgataagggcagaactcatgaactcgaacattcggcaatcaagtgtatgaggggcatactgtactgttacatgagacaagccgataaggttcaacagtttaagcaggatcctcgcccgacgacctgcctccattccgtgtttaacgttcacactggagatgagcttctttcttacgaggaatacggacatctgcaaatcaacgccgtgtccctttaccttctctacctggtggaaatgatctcgtcaggacttcagataatctacaacactgacgaagtgtccttcatccagaatcttgtcttttgtgtcgaacgcgtgtacagggtgccggatttcggagtgtgggaacggggatccaagtacaacaatggtagcactgaactgcactcatcgtcagtgggtcttgccaaggcagccctcgaggcaattaacggtttcaatctttttggtaaccaaggttgctcctggtcagtgatattcgtcgatttggatgcacataaccgtaaccgccaaaccctttgttctcttctgccaagagaatcccgctcccacaataccgatgcagctctccttccatgtatttcctacccggcgtttgcacttgacgatgaggtgctgttttcccagactctggacaaagttgtcaggaagttgaaaggaaagtacgggttcaagcgcttcttgagggatggttaccgtacctcgctggaggacccaaatcgatgctactacaagccagcggagattaaactgtttgatggcatagaatgtgagttccccattttctttttgtacatgatgatcgacggtgtgtttaggggtaatcctaaacaggtccaagaataccaagatctgctgacccccgtgctccatcataccacggaaggctaccctgtcgtcccaaagtactactacgtccctgccgattttgtggagtacgagaagaataatcctgggtcgcaaaagcggttcccaagcaattgcggaagagacggaaaactgtttttgtgggggcaggcactgtacatcattgcaaaacttctggccgacgaattgatttcgcctaaggatatcgatccagtgcaacgatacgtgcctctgaaagatcagagaaacgtgagcatgaggtttagcaatcaaggacctcttgaaaatgacctcgtcgtgcatgtcgcattgatcgcagagtcacaaagactccaggtttttctgaatacgtatggtatacagactcagacgccccagcaagtggagcccattcaaatatggccacaacaagaattggtgaaggcgtatctgcaacttgggattaacgaaaaactgggtttgtcaggtcgtcctgacagaccaattgggtgtctcggaacctcgaagatatacagaatcctgggtaagacggtggtgtgttaccctatcatttttgacctgtcagatttctacatgtcccaggacgtgttccttcttatcgacgatatcaagaatgcccttcaattcatcaaacaatactggaagatgcacggacggccgctctttttggtgcttattcgagaggataacattcgaggttcacgttttaacccgatactggatatgctcgcagcacttaagaagggaatcattggcggtgtgaaagtgcatgtggatcgcctccaaaccctgatttcgggagcagtcgttgaacaactcgattttcttagaatttcagataccgaagaactgcccgagtttaagagctttgaggaactggaaccacctaagcattcgaaggtcaaacggcaatcgtcgactccatcggcccccgaactcggacaacagccagatgtgaacatttcggaatggaaggataagccgacccacgagatactgcagaaactcaacgattgctcgtgtcttgcatcccaagccatactccttgggatcctgctgaaacgtgaaggacctaactttatcacgaaggaagggactgtgtctgaccatatagaaagagtttaccgcagagcaggatcgcagaagctctggcttgcggtgagatacggtgctgcgttcacccaaaagttctcttcatcgatcgctcctcacatcactacctttctggtgcatggaaagcaggtgaccctgggtgcatttggccatgaagaggaagtcattagcaatcctctctcgccgcgtgtcatccagaatatcatctattacaagtgcaacactcatgacgaacgcgaagcagttattcaacaagaactcgtgatacatattggttggataatctccaataacccggaactgttttccggcatgcttaagattcgcatcggctggatcatacacgcaatggagtacgagcttcagatacggggaggcgacaagccagctctggatctgtaccaactctcaccttcagaagtgaagcaacttctcctcgacattctgcaaccacaacaaaacggcaggtgttggctcaaccgcagacaaattgatggctccctcaacagaacccctactgggttttacgatagagtgtggcagattctcgaacgcactccaaacggaatcattgtcgcaggcaagcaccttccacagcaaccgactttgtccgatatgaccatgtacgagatgaacttttccttgctcgtcgaggacacgctggggaatattgatcagccacagtaccgccagatagtggtcgagctgctgatggtggtgtccatcgtgcttgaaagaaaccccgaactggagtttcaagataaagtcgacctggatcggcttgtcaaggaagcattcaacgagtttcagaaagatcagtcgagactgaaggaaattgaaaagcaggacgacatgactagcttctacaacacccctcccctcgggaagagagggacttgtagctacctgactaaggccgtgatgaaccttcttcttgaaggagaggtgaagcctaacaacgatgatccttgcctgatcagc

SEQ ID NO: 18196 - DNA, 3279 bp, Artificial Sequence
  Description of Artificial Sequence: Synthetic coding sequence
atggcaggtgcagcgggccttacggcagaagtgtcgtggaaagtgctggagcgccgggctcgcacgaagcggtcaggctcggtgtacgaaccgttgaagtccatcaatctgccgcggcctgacaacgaaaccctctgggataagctggaccactactaccgcatcgtcaagtcgaccctgctgctgtaccaatccccgaccaccggcttgtttccgactaagacctgcggaggagatcagaaagcaaaaatccaggacagcttgtactgcgcagccggtgcttgggctctcgcgctcgcgtaccgccgcattgatgacgacaagggccgcacgcacgaactcgaacacagcgccatcaagtgtatgcgcggaatcctctattgctacatgcggcaggctgacaaggtgcagcagtttaagcaggatcctcggccgaccacttgcctgcatagcgtgtttaatgtgcacactggggacgaactgcttagttacgaggagtacggacatttgcagatcaatgcagtctccctctacctcctgtatctggtggagatgatttctagcggactgcagatcatctacaatactgacgaagtgtccttcatccaaaacctggtgttctgcgtggaaagagtgtacagggtgccggacttcggagtgtgggaacgtggctcaaagtacaacaacggatcaaccgagcttcacagctcttcggtgggactggccaaagcggcgctcgaggcgatcaacggtttcaacctcttcggcaatcagggatgttcatggtcagtcatcttcgtggacctcgacgcccataaccgcaatcgacagaccctgtgctccctcctgccgcgtgagagtcggtcacacaacactgatgctgcgcttctgccctgcatcagctaccctgcgtttgccctggatgacgaggtcttgttctcacaaactctcgataaggttgtgcgcaaactcaaggggaagtacggcttcaagagattccttcgggatggataccgcacgtcccttgaggatcctaatcggtgttactacaagccggcagagattaagctcttcgacggaatcgagtgcgagttcccaatcttcttcctgtacatgatgatcgatggagtgttccggggaaacccgaagcaagttcaagagtaccaagatctgctgactccggtgctgcaccataccactgaaggatacccggtcgtcccgaagtactactacgtgcctgcagacttcgtagaatacgaaaagaataaccctggatcccagaagcgcttcccttcaaactgcggaagagacggaaagctgtttctgtgggggcaggccctgtacattatcgccaaactgctggctgacgaacttatctctcccaaagatatcgatccggtccagcggtatgtgcctctgaaggaccagaggaacgtcagcatgcggttttctaaccagggtcccctggaaaatgacctcgtggttcacgtggcgctgatcgccgaatcgcaaagactccaggtgttcctcaatacttatggaatccaaacccagactccgcagcaggtcgagcccatccagatttggccacaacaggaactggtgaaggcctacctccagctgggaatcaatgagaagctgggtctgagtggcaggcctgacaggcccataggttgcctgggcacttccaagatctaccggatcctcggcaaaaccgtggtctgctacccgatcattttcgatctctcggacttttacatgtcccaggacgtctttctgctgatcgacgatatcaaaaacgccctccagttcatcaagcaatactggaagatgcacggcagaccactcttcttggtgctgatcagagaggacaacatccgagggagcagatttaacccaatcctcgacatgctggccgcgctcaaaaagggaatcatcggtggcgtcaaggtgcacgtcgaccgcctgcaaacccttatctcgggagcggtggtggaacagctggatttcctgcgcatctccgacacggaggagctgccggagtttaagtcattcgaagagctggaaccgccgaagcattcgaaggtcaagcgacagagctcgaccccttctgctcccgagctggggcaacaacctgacgtgaacatttccgaatggaaggataagccgactcatgagatcctgcaaaaactgaatgactgttcatgcctggcctcgcaggcaatcctgctggggattctgcttaagagagagggaccgaacttcattaccaaagagggtaccgtttctgaccacattgagcgcgtgtatcgacgggcggggtcccagaagttgtggttggcagtccgctacggtgcggcctttacccagaaattcagctctagcatcgctccacatatcaccacgttcctggttcatggaaaacaagtgactctgggcgccttcggccacgaggaagaggtgatctccaaccccctgtccccgcgggtcatacagaacattatctactacaagtgcaacactcacgacgaacgcgaagcggtgattcagcaagagttggtcatccacatcggatggatcatttccaacaacccggaacttttttcgggaatgctcaaaatccgcatcggctggatcatccacgccatggagtacgaactccagatcagagggggagataagccggctctggatctgtatcaattgtccccgagcgaagtgaagcaacttttgctcgacatcctgcaacctcaacagaatggccggtgctggctgaaccgccggcaaatcgatggatcactgaatcgcactccgacgggcttttacgaccgggtctggcaaatcttggaacgcacccctaacggcatcatcgtcgcgggaaagcacctccctcagcagcctaccctttcggacatgaccatgtacgaaatgaactttagtctgcttgtcgaagataccctgggaaacattgaccaaccgcagtataggcagattgtcgtcgagctcctgatggtggtgagcatcgtgctggaaaggaatcccgagctcgaattccaagataaggtggacctcgatcgccttgtgaaagaggccttcaacgagttccaaaaagaccagagcagattgaaagaaatcgagaagcaagacgacatgacctccttttacaacactccgcctctcggaaagcgcggaacgtgctcgtacctcactaaggctgtcatgaatctgctgctggagggagaggtcaagccgaacaatgatgacccatgccttatcagc

SEQ ID NO: 18197 - DNA, 3279 bp, Artificial Sequence
  Description of Artificial Sequence: Synthetic coding sequence
atggcaggtgcagccgggctgacggctgaagttagctggaaggtcctggagcgccgggcccgaaccaagcgttccggcagcgtgtacgagccactgaaatccatcaacctcccccgtcctgataacgaaactctgtgggataaacttgatcactattatagaatagtaaaatccacactgctcctgtatcagtcccctacaaccggcctctttcctacaaagacctgtgggggcgatcagaaagccaagatccaggactcactctattgcgcagccggagcctgggccttggcattagcctataggcggattgatgatgacaaagggcgtacacatgaactcgagcattcggcaatcaagtgtatgagaggcattctgtactgttacatgagacaagctgacaaagtgcagcaattcaagcaagaccctcgaccaacaacctgtttgcacagtgttttcaacgtgcacactggagacgaactgctctcttacgaggagtatgggcacctacagattaacgcagtctctctgtacctcctgtacttggtggaaatgattagttctgggctccaaatcatctataacaccgatgaggtctcattcattcagaaccttgtcttctgcgtcgaaagggtctacagagtgcctgattttggggtgtgggaacgcggatccaaatacaacaacggctcaaccgagctccactcaagctctgtgggattggccaaagccgctctagaagccattaacggtttcaacctgtttggtaatcagggatgttcttggtcagtgatatttgtagacttagatgcccataatcggaatagacagactctgtgttcattactgccccgagaaagtaggagccataatacggatgctgcactactaccttgcatctcctaccccgcatttgctttggatgacgaggtcttgttttcccaaacgttggacaaggttgtacgtaagctgaagggcaagtacggttttaaacgatttctgagggatggatacagaacctccttggaggaccccaacaggtgttattacaaaccggctgaaatcaagctgttcgacggaattgaatgcgaattcccaatcttttttctgtacatgatgatcgatggcgtcttccgcggcaatccaaagcaggtgcaggagtatcaagacctcctcacccctgtactacatcatacaaccgaagggtatcctgtggttccgaaatattactacgtacctgctgattttgtcgagtacgagaagaacaaccccggctcacagaaacggtttccaagcaattgtggaagagatgggaagctgtttctgtggggtcaagcactgtatatcatcgccaagctgttggctgatgagctgatcagcccgaaagatatcgaccctgtccagagatatgtccctcttaaggatcaaagaaacgtatctatgaggtttagcaatcagggcccactggaaaacgacttggtggtgcatgtggctcttatcgcggagtctcagaggttacaggtgttccttaatacatacggaatacagactcagacaccccagcaggtggagcccattcagatctggcctcaacaggaactcgtgaaggcatacctccagctgggcatcaacgaaaaattaggattgtccggcagacccgaccgacctatcggttgtttgggcactagtaaaatttaccgtatacttgggaaaaccgtagtgtgttacccaattatctttgacctgagcgacttctacatgagtcaagacgtttttctgctgatcgatgatataaagaacgcactccagtttataaagcagtattggaagatgcacggtagacctctgtttctggtgttaatccgcgaagacaacattagagggtccagattcaacccaatactcgacatgctcgcagctctgaagaagggaataatcggaggggtcaaagttcacgtggacagactacaaacactgatctccggcgccgtagtggaacagctcgacttcctgaggatttctgacactgaagaactcccagagttcaagtctttcgaagaactggaaccaccgaaacactccaaagtgaaaagacagtccagtacgcccagtgcgccagaacttggccagcaaccagatgtgaacattagcgagtggaaggacaaaccaacccatgaaattcttcagaagctaaacgattgttcctgcttggcctcccaggccattctcctcggtatcctcctgaagagggagggcccgaattttataacaaaggaggggacagtctctgaccacatagagagagtgtaccggcgggctggatcgcagaagctctggctggccgttcggtacggagccgcgtttacacagaaattttcttcatctattgccccccacatcaccacatttctggtacatgggaaacaagtgaccttgggggccttcggacatgaagaggaggttatcagcaaccccctgagtccccgagtgattcagaacatcatctactataagtgtaatacgcacgacgaaagggaagccgtcatccagcaagaactcgttatacacattggatggattatttcaaacaatcctgagctgttttccggaatgctgaagatccgaatcggctggataatccacgcaatggaatacgaactgcaaatcagaggaggtgataagcctgccttggatctgtatcagctttccccatcagaggtcaagcagcttcttctagacatattgcagccacaacagaatggtcgatgctggctcaacaggcgacagatcgatggaagtcttaaccgaaccccaacaggattctacgaccgagtgtggcagatcctggagagaacacctaatggcattatcgtggccggcaagcacctgccacagcagcctactctgtcggacatgacaatgtatgagatgaacttcagcctgttagtggaagacactttaggaaacatcgaccagcctcagtatcggcagatcgtggtcgaactgctcatggtggtgtcaatagtgctggaaaggaaccccgagttagaatttcaggataaggttgacctggatcgattggtgaaagaggcatttaatgagtttcaaaaagaccagagccgtctgaaggaaattgaaaagcaggacgacatgaccagcttttataacactccgcctctcggtaagcgagggacctgcagttacctcacaaaggccgtgatgaatcttctgctcgagggcgaggtgaaacctaataacgatgatccatgtcttatctca

SEQ ID NO: 18198 - DNA, 3279 bp, Artificial Sequence
  Description of Artificial Sequence: Synthetic coding sequence
atggccggcgcggcaggcttaactgcggaggtgtcatggaaggtgctcgagaggagggcaagaacaaaaaggtctggtagcgtatacgagccactgaagagcatcaatctcccaaggccagacaacgaaacactgtgggataaacttgaccactactaccgcatcgtaaaaagcaccctgttgttatatcagagccccaccaccggcctatttcccactaagacttgtggcggagaccagaaggctaaaattcaggacagtctgtactgcgcagctggcgcatgggcgctggcccttgcttatagaaggattgacgatgataaaggccggacccatgagctggaacatagcgccatcaaatgtatgagaggcatactctattgttacatgcgtcaggcagacaaggtccagcagttcaagcaggacccacgccccactacctgtctccactcagtgttcaatgtgcacacgggtgatgaactcttgtcctacgaggagtacgggcatctgcaaatcaacgccgtctctctctatctcctgtacctggtggagatgatctccagcgggctccagatcatttacaatactgacgaggtgtcattcatccagaatctcgtcttctgcgtggaacgcgtttacagggtgccagactttggagtctgggagcgcggtagtaaatataacaatggttccaccgagctgcactctagctcagtaggacttgccaaggcggccctggaggccatcaacggatttaacctgtttgggaaccaggggtgcagctggtccgtgatatttgtggacctggacgctcacaatcgcaatagacaaaccctatgttctcttcttccccgggagtctcgctcacacaacactgacgcggcactgttgccatgcatcagctaccctgcctttgccctcgatgatgaggtgctgttctcccaaactctggacaaggtcgtaagaaaactgaagggaaagtatggttttaagcggtttcttcgcgacgggtacagaaccagtctcgaggacccgaatcgatgttactacaaacccgcagaaataaaattgttcgatgggatcgaatgtgagtttccaatatttttcctctatatgatgattgacggggtattccggggcaatcccaagcaggtccaggaataccaggatcttctcacacctgtgctgcaccatacaacagagggatatcctgtggtacctaagtattactacgtgccagcggatttcgtagaatacgagaagaataaccccggcagccaaaagcgctttccatccaattgcggacgggatggtaaactcttcctctgggggcaggccctctacattatcgctaagttacttgccgacgagctgatcagcccaaaggacattgaccctgtccagagatatgtgccgcttaaagaccagaggaacgtatccatgcgtttttcaaatcaggggccacttgaaaacgacctcgtggtgcacgtagcattgatcgccgagagtcaacgactccaggtattcctcaacacctatgggattcagacacagacaccacagcaggtggagcctatacagatctggccacaacaggagctggtgaaagcttatctgcagctcggcatcaatgaaaagcttggattgtcgggacggccggacaggcctataggctgcctcggcacaagtaaaatctatcgaattctgggcaaaacggtcgtgtgctacccgataatcttcgatcttagtgatttctatatgagccaggatgtatttctgctgatcgacgacatcaagaatgctctccaattcataaagcaatattggaagatgcatggcaggcctttgttcttagtcctgatacgtgaagataatatccgagggagccggttcaaccctatcttagacatgctagctgcattgaagaaaggaatcatagggggggtcaaagtacacgtggatcggctacagactctcatttctggggccgtcgtcgagcagttagatttccttcgcatctcggacaccgaagagctacctgagttcaagagttttgaggagttagagccgcctaagcacagtaaggtgaaaagacagtcgtctacacccagtgcgcctgaacttggtcagcaacctgacgtgaatatcagcgagtggaaggacaaacctacccacgaaattctgcagaaactgaatgattgctcctgcttggcctcacaggccatcctcctcggcattctgctaaaacgggaaggacctaattttataacaaaagaaggaaccgtgtcggaccacatagagagagtttatcggcgggcaggctcacagaaactgtggctcgccgtgaggtatggcgctgcctttactcagaaattctcatcctctattgctccacatataactacttttcttgtccacgggaagcaggttactctcggcgcattcggacacgaagaagaagtcatttcaaaccccctgagcccacgcgtgatccagaacataatttactataagtgcaatacccacgacgagagagaagccgttatccaacaggagctggttatccacatcggttggataataagcaataatcctgagctgttctcgggaatgctgaaaattcgcattggttggataattcatgccatggagtatgaactccaaatcagaggtggcgataagccagcgctggacctgtaccagctctctcctagcgaggtcaaacagcttctactggatattctacagccacaacagaatggaaggtgttggcttaatcgaaggcagatagatggcagcttaaatcggactcctacaggcttctacgacagagtgtggcagatactagagagaaccccaaacgggataatcgtcgctgggaaacatcttcctcaacagccgactctgtccgatatgactatgtacgaaatgaacttcagtctgctagttgaagacaccctgggcaatatcgatcagccccagtatcggcagatcgtcgtggaactactcatggtcgtgagtatagtgctggagaggaaccctgagcttgagtttcaggacaaggtggatctggaccgtctagtcaaggaggcttttaacgaatttcagaaagaccagtctcgtctgaaagaaatcgagaaacaggacgacatgacctcattctataatactccacccctcggtaagcgcggaacctgttcttatttgacaaaagcggtgatgaacctgcttctagagggagaggtgaagcctaataatgatgacccgtgtttgattagt

SEQ ID NO: 18199 - DNA, 3279 bp, Artificial Sequence
  Description of Artificial Sequence: Synthetic coding sequence
atggccggagcagccggtctgaccgcagaggtgtcatggaaagtgctggagcggcgagccagaactaagcgcagcggatcggtgtatgagccgcttaagtccatcaacctcccgcggccggacaatgagacgctgtgggataaacttgaccattactataggatcgttaagtctaccctccttctgtaccaatctcctaccactgggctgttcccgaccaagacctgtggcggtgatcagaaggccaaaatccaggacagcttgtactgcgcagcaggagcgtgggccctcgccctcgcctaccgcaggatcgatgatgacaagggaagaacccacgaattggaacattcagccatcaaatgtatgcggggaatcctgtactgctacatgcgccaggccgataaagtccaacagttcaagcaagacccgcgacctactacctgtctgcactccgtctttaacgtccacactggcgatgagttgctgagctacgaagaatacggacatctgcagattaatgccgtttcgctgtaccttttgtacctcgtggagatgatctcaagcggactccaaatcatctacaatacggacgaggtttcgttcatccaaaaccttgtgttctgcgtggagcgggtgtaccgggtgccggattttggcgtgtgggagcgcggctccaagtacaataatggaagcacggagctgcactcatcctcggtcgggctggctaaggccgccctggaggcgatcaatgggtttaacctgttcggtaaccagggatgctcatggtcggttatctttgtcgacctggacgcgcacaacagaaataggcagaccctgtgcagcttgctcccgagggaatctcgcagccacaacaccgacgcggcactcttgccatgcatctcgtacccggcgttcgctctcgatgacgaggtcctttttagccaaactctcgacaaggtggtgcggaagctcaaaggaaagtacggtttcaagagattcctccgggacggataccgcaccagcctggaggacccgaaccgttgttactacaaacccgctgaaatcaagctgtttgatggcatcgagtgcgagttcccaattttcttcctgtatatgatgatcgacggagtgtttaggggaaatccgaagcaagtgcaggaataccaagacctgctgactccggtgctccatcacaccaccgaaggttacccggtggtcccaaagtactactacgtcccggctgatttcgtggagtatgagaaaaacaacccgggaagccagaagcgctttccttccaactgtggaagggacggaaagctgtttctgtggggccaggctctgtacatcattgctaaactgcttgcggatgaattgatctcaccgaaggacatcgacccggtgcagcggtacgtgcctttgaaggaccagcggaatgtgtcgatgcgattctcgaaccaggggccactggagaacgatctggtggtccacgtggccttgatcgccgaaagccaacggctgcaagttttcctgaatacttacggtatccagacccaaacccctcaacaggtcgaaccgattcagatctggcctcaacaagaattggttaaagcctaccttcaactcggaatcaatgagaaactcggcctttcaggacggccggaccggccaattggctgcctgggtaccagcaagatctaccgaattctgggaaagactgtggtgtgctacccgatcatcttcgacctgtcggatttctacatgtcccaagacgtgttcctcctgatcgatgacatcaaaaatgcgttgcagttcattaagcagtactggaagatgcatggtaggccgctttttctcgtcctgattcgagaagataacattaggggctcgagattcaacccgatcctggacatgctcgctgcactcaagaagggaatcattgggggagtcaaggtgcacgtcgacagacttcaaactctgatctccggagccgtggtggagcagctcgacttcctccgcatttccgatactgaagaattgccggagttcaaatccttcgaagagttggaaccaccaaaacattcgaaggtgaaacgacagtcgtcgactccgagcgcgccggaactcggccagcaaccggacgtgaacatcagtgagtggaaggacaagcctacccacgaaatcctccagaagctcaacgactgcagctgcctggccagccaggctatcctccttggaattcttcttaaacgcgaaggaccgaatttcatcacgaaggaaggaaccgtgtcagatcacatcgaacgggtgtatcgccgcgctggatcccaaaagttgtggctcgcagtgcgctacggtgcagcgtttacccagaagttcagctcctcaatcgccccgcatatcaccaccttcttggtccatggaaagcaggtgactctgggagcatttggacacgaagaagaggtcattagcaacccgctgtctccacgcgtcatccagaatatcatctactataagtgcaatactcacgacgaacgggaggcagtcattcagcaagagttggtgattcacatcggatggattatctctaacaatccggaactgttctctggcatgctgaaaatccgcatcgggtggatcatccatgccatggagtacgagttgcaaattcgcggcggggataaaccggcactggacctgtaccaactgtcgccgtccgaagtcaagcaactgctcttggacatcttgcagccgcaacaaaacggacgctgctggctgaataggcgccaaatcgatggaagcctcaacagaaccccaactggattctacgaccgcgtgtggcaaatcctggagagaactcctaatggaatcatcgtggcaggaaaacacctcccccaacagccaactctgagcgacatgaccatgtacgaaatgaatttctcgctcctggtcgaagataccctcggaaacatcgaccagccacaataccggcagatagtcgtggagttgctgatggtcgtgtcaatcgtgctggaacgcaacccagaactggagtttcaggacaaggtggacctggatcgcctcgtaaaagaagcgttcaatgagttccaaaaggatcagtcccggctcaaagaaatcgagaaacaagacgacatgacgtcattttacaacactcccccactgggcaaaagaggcacttgctcttatctgactaaggctgtgatgaacctcctgctggaaggcgaagtgaagcctaataacgacgatccctgcctgatcagc

SEQ ID NO: 18200 - DNA, 3279 bp, Artificial Sequence
  Description of Artificial Sequence: Synthetic coding sequence
atggcaggcgctgcgggcctcactgccgaagtgagctggaaggtgctagagaggagagccaggacgaaaagatctggctccgtttacgagccccttaaaagtattaacctgccacgaccagacaacgagactttatgggacaagctggaccactactacagaatagtgaaaagcacgctgctgttgtatcagtcccccaccacgggcttgttcccaaccaaaacttgcgggggtgaccagaaggctaaaattcaagacagcctgtattgcgctgccggcgcatgggctttggccctggcctacagacgcatcgacgatgataaaggcagaacccacgagttagagcattctgccatcaaatgcatgaggggcattctgtactgttatatgcgacaggccgataaagttcaacaatttaaacaggatccgcgacctaccacctgtctccactccgtgtttaacgtccatacaggggacgagcttctttcatacgaggagtacgggcacctgcaaatcaatgccgtatcactatacttgttgtatcttgttgagatgatttcttccggtcttcagattatttataatactgatgaggtcagtttcatccagaatctggttttttgtgttgaaagagtgtatagggtgccagactttggtgtttgggagcgaggtagcaaatataataacggcagtactgaattgcattcttccagcgtcggcctcgctaaggcagctctggaagccattaatggctttaacctcttcgggaaccagggctgtagctggtcagtgatattcgttgacctagacgcgcacaaccgcaaccgtcaaacactttgctctttgttgccgcgagaatcacgctctcataacacggacgcagcgcttcttccttgtatcagctaccctgcattcgcactcgacgatgaggttttgttctcccagacactggataaggtggtgagaaagctgaaaggcaagtacggttttaaaagattcctgcgtgacggatataggaccagccttgaggatccgaatcgatgctattacaagcctgccgagatcaagctttttgacggtatcgaatgtgagttccctatcttcttcctttatatgatgatcgatggggtgtttcgaggtaaccccaagcaagtccaggagtaccaggatctgctgacgcctgtgctacaccatacaactgagggataccccgtggtccccaaatactattacgtgccagccgactttgtcgagtatgaaaaaaataaccccggttcccagaagaggttcccatcgaattgcggtagagacgggaaactgttcctgtgggggcaggcactctacataatcgcaaaactactggcagatgaattaatcagtcccaaagatatcgaccctgttcaaagatatgtgcctctcaaggaccagagaaatgtgtccatgcgcttctcgaaccaggggccattggaaaacgacctggtagtacatgtcgcattgatcgcggagtcccagcgactgcaagtcttcctgaatacatatgggatccagactcaaactccacagcaagtggaaccgatccagatatggccacagcaggaacttgttaaagcctatctgcagcttggcattaacgagaaactcggcctgtctggacgccccgatcgacccattgggtgcctgggtacctccaagatataccggatactgggaaagactgtggtgtgttatcctattatattcgatttgtccgacttctatatgtcacaggacgtgtttctccttatcgatgacataaagaatgccttgcagtttatcaagcagtattggaagatgcacggcaggccgctgttcctcgtgctgatcagggaagacaatatccgtggcagccgatttaatccaatcctggacatgctggcagcattaaagaagggaatcataggaggggtgaaagtacacgtcgaccgtctccagactctgatatccggcgctgtagtagagcaacttgactttttaagaatttccgatacggaagaattgcccgagttcaaatccttcgaggagctggaaccgcccaagcatagcaaagtgaagcgccagtctagtacaccatcagcgcccgagctggggcagcagcctgacgtcaacatcagcgaatggaaagacaaacccactcacgagatcttgcagaagctaaatgactgctcatgtctagcctctcaggcaatcctcctggggatacttctgaagagagagggcccaaactttattaccaaggaaggaactgtgagcgaccacattgagagggtctatagacgggccggctcccaaaaattgtggctggctgtgagatacggggccgcgttcacacagaagttctcctctagcatcgccccacatatcacaacctttcttgttcatgggaagcaggtgaccctgggggccttcggccacgaagaagaagtgatttccaacccgcttagcccgagggtcattcagaatatcatctactacaagtgtaatactcatgatgaaagggaggccgtgatacaacaggaactggttatccacattggctggatcataagcaataatcccgagcttttttccggtatgctcaaaatccgcattggatggatcatccatgctatggagtacgaacttcaaattcgaggcggagacaagcccgctctggacctgtaccaactgtcgccttcagaggtcaagcagctgctgctcgatattctgcagccacagcaaaacggtcgttgttggctaaacaggcgtcagattgacgggtcccttaacagaaccccaaccggcttctatgaccgcgtttggcagattttagaacgtaccccaaacggaattatagtggccgggaagcacctgccacaacagcccacactgtccgacatgactatgtacgaaatgaatttctccctactggtggaggacaccttgggcaacatcgatcaacctcagtaccgccagatcgtggttgaactccttatggtggtatcaatcgtgctggagaggaatcccgaactggaattccaggataaggtggacctggacagactcgttaaagaggcttttaatgagttccagaaagatcaaagcaggctgaaggaaatcgagaagcaagatgatatgacttcattctacaatacccctcctctgggcaaaaggggcacttgctcttacctaaccaaggctgttatgaatctcttgctggaaggagaagtcaagccaaacaatgacgatccctgcttgatatca

SEQ ID NO: 18201 - DNA, 3279 bp, Artificial Sequence
  Description of Artificial Sequence: Synthetic coding sequence
atggccggggctgccgggcttacagctgaggtgtcctggaaggtgcttgagcgcagggcccgcacaaaaaggtccggcagtgtctacgagccccttaaatccatcaacctgcccaggccagataacgagacactgtgggacaagctcgatcattactaccgaattgtaaaatcaacattgcttctgtaccaatcacccactaccggattgttccctacaaagacttgcggaggcgaccagaaagcaaaaattcaagatagtctctactgcgcagccggcgcttgggcccttgccctggcgtatcggaggattgacgatgacaagggccggactcacgagctggagcactcagccattaaatgcatgaggggcatactgtactgctatatgagacaggctgacaaggtacagcagttcaagcaagacccccgccctaccacttgcttgcactccgtctttaacgtgcacactggcgacgagctcttgtcttatgaagagtatgggcatctccagatcaatgccgtgtccctctatctgctgtatctcgtggagatgatcagcagcgggctccagatcatatataatacggacgaagtgagctttattcaaaatctggtcttctgcgtcgaacgcgtttatcgggtacctgacttcggcgtgtgggagcggggctctaagtacaacaacggcagtaccgagcttcacagttccagtgtgggacttgccaaggccgctctggaagccatcaacggattcaacctgtttgggaatcaaggctgtagttggtctgtcatcttcgtcgaccttgatgcccataatcggaatagacagacactgtgttctttgctccctagagaatcacgatcacataacactgacgccgctctgctcccgtgcatatcctaccctgcttttgcactcgacgatgaggtgctgtttagtcaaactctggacaaagtggttcgcaaacttaaggggaagtatggcttcaagcgctttttgagggacgggtaccgaacatcattggaggacccaaatcggtgttactacaagcctgccgaaatcaaactctttgatggcatcgagtgcgaattccccatcttcttcctgtatatgatgattgacggcgtgtttcgcggaaatcctaaacaggtgcaagagtatcaagaccttctcaccccagtcctccatcacacgacggaagggtaccccgtggtacccaagtactactatgtcccagccgattttgttgagtacgagaagaacaaccctgggtctcagaagcggttcccttctaactgcggtagagatgggaagctctttctgtgggggcaggccctttatatcatagctaagctgctggccgacgagctgattagtccgaaagacattgatcctgtgcagcggtacgttccgctgaaagaccagcggaatgtctccatgaggttttccaatcaaggccccctggaaaatgacctggtggtacatgttgcacttatcgcagagagccagagactgcaggtcttcctgaacacctatggcattcagacgcaaacgcctcagcaggttgaacccattcagatctggccgcaacaggaattggtgaaggcctacctgcaactgggcattaacgaaaagctgggattgtcaggtcgcccggatagaccaatcgggtgcctgggcacttctaaaatataccggatccttggaaagaccgtggtgtgttaccccattattttcgatctttccgatttttatatgtcccaagacgtgtttctcctgattgatgatataaagaatgcgctgcaattcatcaagcagtactggaaaatgcacggtaggcccctgttcctggtgctcattagggaggacaacataagaggttcacgcttcaacccaatcctggatatgctcgccgccctcaagaagggcatcattgggggagtgaaggtgcacgtggatcgccttcagacacttatcagcggggcagttgtggaacagctcgacttcctgaggataagcgacacagaagagttgccggagtttaaaagtttcgaggaactggagcccccgaagcactctaaggtgaagagacagtcttctactcctagcgcgccagagctgggacagcagcctgacgtaaatattagcgagtggaaggataaacccactcatgagattctccagaagctcaacgactgcagttgtctggccagtcaggctatcctgctcggcatattgctgaagagggaagggcctaattttatcaccaaggaaggtacagtgagcgaccatatcgaacgggtgtacagacgggccgggtcccagaaattgtggctggccgtgagatacggcgctgccttcacccagaagttttctagttccatcgctccacacataacaacttttttggtgcacggaaagcaagtgacactgggcgcatttggacacgaggaagaggtcatttccaaccccctgtccccacgcgtgatacaaaacatcatatactacaaatgcaatacacatgatgagcgcgaggctgtgattcaacaggagctggtaatccacatagggtggatcattagcaataacccagagcttttcagtggcatgctgaagatccgaatcggatggattatacatgctatggagtacgagctccagattcggggcggagacaagcccgcgctggacctgtaccagctttctccttctgaggttaagcaactgctgcttgatattctgcaaccccagcagaatggaaggtgttggctcaaccggaggcagattgatggctctctgaatcggacgccgacaggcttctatgaccgcgtatggcagattctggagcgaacacctaacggcatcattgtcgcagggaagcacctcccccagcagccaacactgagcgacatgacgatgtatgagatgaacttcagtctgctggttgaggatactttgggaaatatagaccagccccaatatcgacagattgtggttgaactcctcatggtggtatctattgtgttggagcggaacccagaacttgagttccaagataaggtggacctggaccgactggtcaaagaggctttcaacgagttccagaaggatcagagccgccttaaggagatcgagaaacaggatgacatgacttctttctataatactcctcccctgggaaaacgaggcacatgttcctatctgactaaggccgttatgaacctgctcctggagggcgaagtcaagcccaacaatgatgacccatgcctgatcagt

SEQ ID NO: 18202 - DNA, 3279 bp, Artificial Sequence
  Description of Artificial Sequence: Synthetic coding sequence
atggctggggccgcgggactcactgctgaggtatcatggaaagttctcgagcgtcgcgcgcggactaagaggagtgggtcggtctacgagccactgaagtcaatcaacctgccgaggcctgataacgaaactctctgggacaaactcgaccattactaccggatcgtgaagtcgaccctgcttctctaccagtccccgaccacgggcttgtttccgaccaagacctgtggcggcgatcaaaaagccaagattcaggactcactctactgcgcggcaggggcctgggccctggcgctcgcataccgtcgcatcgacgacgacaagggacgcactcacgagcttgaacattcggccatcaagtgcatgcggggaatcctgtactgctatatgcgacaggccgataaggtccagcaattcaagcaggacccaagaccgacgacgtgcttgcactcagtgtttaacgtccacactggagacgagttgttgtcctacgaagagtacgggcacctgcagattaatgcggtgtcactctacctgctctatcttgtggaaatgatatcgtcaggcctccagatcatctacaacaccgatgaagtgtcattcatccagaatctggtcttttgtgttgagagggtctaccgagtccccgacttcggcgtctgggaacggggatcaaagtacaataacggatcgactgaactgcactcttcatcggtgggactggcaaaggccgctctggaagctatcaacggattcaacttgttcggcaatcagggatgttcctggtcggtgatcttcgtggacctggatgcgcacaaccggaaccgccagactctgtgctcacttctcccgagggaatcccgatcgcacaacactgacgcagctctcctgccgtgtatctcgtaccctgcgttcgccttggatgacgaagtactgttctcacaaacccttgataaagtggtgcgcaagctcaagggtaagtatggtttcaaaagattcctgagggacggctaccggacgtcgctggaggatccgaatcgctgctactacaaaccggccgaaatcaagctgttcgatggtatcgagtgtgagtttccaatctttttcttgtacatgatgatcgacggcgtattcagaggaaacccgaagcaggtgcaagaataccaagacctcctgactccagtccttcatcatactacggaaggataccctgtggtgccaaagtattactacgtgcctgctgacttcgtcgaatatgaaaagaataacccaggcagccaaaagaggttcccttcgaattgcggccgcgacgggaagctgttcctctggggacaggccctttacatcattgctaaattgttggctgacgaactgatcagcccgaaggacattgacccagttcagcggtacgtccctctgaaggaccaacgcaacgtgtcgatgcgctttagtaaccaaggaccactcgaaaatgacctggtcgtccacgtggcccttatcgcggaaagccagcggctgcaggtctttcttaacacctacgggatacagactcagaccccccagcaagtggagccaattcagatctggccgcaacaagaactcgtgaaggcatacctgcaactcggcatcaacgaaaaacttggactgtccggtcggccggaccgacccatcggctgtcttggaacttccaagatttaccgaatcttgggaaaaaccgtggtgtgctacccaatcatcttcgacctgtccgatttctacatgtcccaagatgttttcctgctgatcgacgacatcaaaaacgcgttgcaattcatcaagcagtactggaagatgcatggacggcctctcttcctggtcctgatccgcgaggacaatatcaggggctcgcgcttcaacccgattctggacatgctcgcagcactgaagaagggaatcatcggaggggtgaaggtgcacgtcgatcggctgcaaactctcatcagcggtgccgttgtggagcaattggacttcctgcgcatctccgacactgaggaacttcctgaattcaaatccttcgaagaactcgagccgccgaagcatagcaaggtgaaacgacagagctccaccccctcggcaccagaactgggccagcagccggacgttaacatttccgaatggaaggacaagccgactcatgagatactgcaaaaacttaatgattgctcctgtctggccagccaggcaatactgctcgggattctgctcaagagagagggaccgaatttcatcaccaaggaaggaactgtgtctgatcatatcgaacgcgtgtaccgccgcgctggtagccagaaactctggttggcggtgcggtacggagccgcgtttactcagaagttttcttcgagcatcgccccgcacatcaccacctttctggttcacggcaaacaggtgaccttgggcgctttcggacacgaggaagaggtgatcagcaatccgttgtccccgcgcgtgatccagaacattatctactacaagtgcaatacccatgacgaaagagaagccgtgatccaacaggaattggtgattcacatcgggtggatcatctcgaacaaccccgaactgttctccggaatgttgaaaattcggattggctggatcatccacgccatggagtacgagctccaaatccggggaggggataaaccggccctggacttgtaccagctctcgccctcagaggtgaaacagctgctgctggatatcctgcagcctcaacagaacggacgctgctggctcaaccggcgccagatagatgggagtctgaatcgcacgccgaccggtttctatgatcgtgtctggcagattctcgaacgcacccccaatggcatcatcgtggcgggaaagcatttgccgcagcagccaaccctgtcggatatgactatgtacgagatgaacttctccctgctggtggaagataccctcggaaacatcgaccagccgcaataccggcaaattgtggtcgaactcttgatggtcgtgtccatcgtgctggagcggaacccagagctggaatttcaggataaggtcgatctcgatcgcctggtgaaggaggcgttcaacgaattccagaaggatcaatccagactgaaggagatcgagaagcaggacgacatgacttcgttttacaacacccctccactgggaaagcggggaacctgcagctacctcaccaaagcagtgatgaatctgctgctcgaaggagaggtgaaacctaataacgatgacccgtgcctgatctca

SEQ ID NO: 18203 - DNA, 3279 bp, Artificial Sequence
  Description of Artificial Sequence: Synthetic coding sequence
atggcaggagcagctggtcttacggcagaggtttcttggaaagtgctagaaagacgtgcccgtactaaacgttctggttctgtttatgaaccacttaagtctataaacttgccaagaccagataatgaaactctatgggacaagctcgatcattactaccgtatcgtgaaatcaactcttctgctgtaccaatcaccaacaaccggactcttcccgaccaagacttgtggaggagatcagaaagcaaaaatccaggacagtctctattgtgcagctggagcatgggcactggcccttgcatatcgcagaatcgacgatgataaaggcagaacacacgagctggaacattcagctatcaaatgcatgcgagggatcttatactgttacatgagacaagccgacaaagttcaacaattcaagcaggatcctcggccgactacctgtctacattcagtgtttaatgtccatacaggggacgaacttttgagctacgaggagtatggacatctgcaaataaatgctgtctcgctttatttgctctaccttgtcgaaatgattagtagtggacttcagattatttataatacagacgaagtctctttcatccaaaatcttgtcttctgcgtagaacgagtttatagagttccagattttggggtttgggaacgaggatcaaaatataacaacggaagtacagaactccattcatcctcggttggactagctaaggcagctttggaggcaataaacggatttaatctttttggaaatcaaggatgcagctggtccgtaatttttgtggatttagatgcgcacaataggaatagacaaacattgtgctcgcttcttccaagggaatctcgctcccataatactgacgcagcactccttccatgcatatcttatccggcttttgctcttgacgatgaagtacttttttcacaaacactggataaggtggtccgtaagctaaagggaaagtacggatttaaaaggtttcttcgtgatggttaccgaacatctctcgaagaccctaaccgatgctactataaaccagctgagattaaattgttcgatggaattgagtgtgaatttcctatcttttttctttacatgatgatcgatggagtctttcgcggaaatccaaagcaagttcaggaataccaagatctactaacgccagtattgcatcatactacagagggatacccggtggtgccgaagtactattatgtaccggcggatttcgtagaatatgagaaaaataatccgggatcgcaaaaacgttttccatcgaactgtggacgagatggcaagctctttttgtggggacaagcactgtatataattgcaaaattgttagctgatgagttaatctcgccaaaagatattgacccggtacagaggtatgtgcctctgaaagatcagagaaatgtttccatgcgattcagcaatcaaggaccattggagaacgacctcgttgttcacgtagccctcatcgctgagtcacaacgattgcaagttttccttaacacctatggaatccaaacgcaaactccacagcaagtcgaaccgattcagatttggccacaacaagaacttgttaaagcgtatttgcaattgggaatcaatgaaaagctgggactatcaggacgtccagacagaccaattggttgccttggcacctcaaagatttatcgaattctcggtaaaacagtggtttgttatccaattatctttgatttgtcagatttttatatgtctcaggacgtcttccttctgattgatgatattaaaaatgccttgcagttcataaaacaatactggaaaatgcacggacgtcccctgttccttgtgttgattagagaggacaacatcaggggatcgagatttaatccaatcttagatatgttagccgcactgaaaaagggtattataggtggagtcaaagtgcatgtagaccgcttgcaaactttgatttcaggagcagtagtcgaacagctcgacttccttcgcatatctgataccgaggaattaccagaattcaaatcttttgaagaattggaacccccaaaacattcaaaagtgaaacgtcagtcgtcgaccccatcagcaccagagttaggacaacagccagatgttaatatctctgaatggaaggataaaccaacacatgaaatcctgcaaaaacttaatgattgcagttgtcttgcatcacaagctattttgttgggaatactcttgaaacgagagggaccaaattttatcactaaggaaggaacggtatcagatcatattgaaagggtttaccgtcgagctggatctcaaaagctatggctcgctgtaaggtatggcgcagcttttacgcaaaagttttcttcatctattgcgccacatattacgactttcttggtccatggaaagcaggtcactttgggagcgttcggtcacgaagaagaagttatatcgaaccctctatccccacgagtgatacagaatatcatctattataaatgtaatacccacgatgagcgtgaggccgttattcaacaggaactcgtcattcatatcggttggatcatttccaataatccagaactattctcgggtatgttgaaaattcgaataggatggattatccatgcaatggaatatgaactacagattagaggaggagataaaccggcactcgacctttatcaactctctccgtccgaagttaagcaactgcttcttgatatcctgcagccacagcagaacggaaggtgttggctcaatcggagacaaattgatggctcccttaatcgaactccaactggattttatgacagagtgtggcaaattttagaacgtactccgaatggaataatagtagccggaaaacatttgcctcagcaaccaactttgtcagatatgactatgtacgaaatgaatttttcattgcttgttgaagatacattgggaaatatcgaccaacctcaatacagacaaattgtggtagaactattaatggttgtctcaatagttttggaacgtaatcctgaactggaatttcaagacaaggtggatcttgatagacttgtaaaagaagcctttaatgaatttcaaaaggatcagtctcgcctaaaggaaatcgaaaaacaggatgatatgactagcttctacaatacacctccattgggaaaaagaggtacatgcagctaccttacgaaggcagttatgaatctcctcctagaaggagaggttaagccaaacaacgatgatccgtgtctaatttct

SEQ ID NO: 18204 - DNA, 3279 bp, Artificial Sequence
  Description of Artificial Sequence: Synthetic coding sequence
atggccggggctgcgggactgaccgcagaggtaagttggaaagtcctggaacggagggccaggaccaagcgctccggatctgtctatgagcccctcaaatcaatcaatctacccagaccagataacgagactctgtgggataaactagaccactactatcggattgttaagtccacgctgctcctgtaccagtcaccgacgacagggctatttccaaccaagacgtgcgggggagaccaaaaggccaaaatccaggatagtctatactgtgctgcgggcgcctgggctctggctctcgcatataggcggattgacgatgacaaaggtaggacccacgaattggagcattctgccatcaaatgtatgcggggcatcctgtactgctatatgaggcaggccgacaaagtgcaacagttcaagcaggacccgagaccaacaacatgcctgcactcagtctttaatgtgcacactggagacgagctgttgtcttatgaggaatatggacaccttcagatcaacgccgtatctctctacctgctttatctggtcgagatgatttcttcaggtctgcagattatctataacactgacgaagtgagttttatccagaatctcgtcttctgcgtggagcgggtatatcgggtgcccgactttggcgtgtgggagcggggaagcaaatacaacaatggaagtacagagttgcacagttccagcgtaggtcttgcaaaagctgcacttgaagctattaacggcttcaatttgttcggcaaccagggatgctcatggagtgtaattttcgtggaccttgacgcgcacaaccgcaacagacagacactctgcagcctgcttccccgtgagagcagatctcacaacactgacgccgccttgctcccgtgcatatcatacccggccttcgctcttgatgatgaggttttattctcccagacgctggacaaggttgtccgtaaattaaagggcaagtatggatttaaacggttcctgagagatggctataggacctctctcgaagacccaaatcggtgctactataagccagcggagattaaactttttgatgggatcgagtgtgagttcccaatatttttcctttatatgatgattgatggggtgtttaggggaaatcctaaacaggtgcaggaataccaagatctgctcacccctgtgctgcaccacaccacagaggggtacccggtagtcccaaagtactattatgtccctgctgatttcgttgaatacgagaagaataatccgggcagtcagaaacggttccccagcaattgtggtagggatgggaagctattcctgtgggggcaggccctgtatattatcgcaaagctgcttgcagatgaattaatctctcccaaggacatcgaccccgtccagcggtacgtgcctctgaaggaccagcgaaacgtgtccatgcggtttagtaatcagggaccgctggagaatgacctggtggtgcatgtagccctcatcgccgagagtcagcggttgcaggtctttctaaatacttacggtatacagacacagacccctcagcaggttgaaccgatccaaatttggccccaacaagaactcgtcaaagcctatttacagctggggatcaatgaaaagcttggtttgtccgggcggcccgatcggcctatagggtgcctcggtacctctaaaatctaccgcatcctgggcaagaccgtggtttgttacccaataatttttgatctttctgacttctacatgagtcaggacgtgttcctgctgatagacgatattaaaaacgcactgcagttcattaagcagtattggaagatgcatggccggcctctgttcctcgtcctgataagagaagacaacatccgaggctctagattcaatcccattctggacatgctggcagcgttgaaaaagggcattatcgggggtgtgaaagtacacgtcgaccgcttacaaaccctaataagcggggccgtggttgaacaactcgatttcttgagaattagcgacactgaagaactgcctgagtttaagagtttcgaagagctcgagccacccaagcacagcaaagtgaaaaggcagtcatcaacaccttccgcccccgagcttgggcagcagcctgacgtcaacatcagtgagtggaaagataagccgacccatgaaatactgcagaagctgaacgattgttcttgtctggccagtcaggccattctcctcgggatcctgctgaaaagggaaggcccaaactttatcaccaaagaaggcaccgtctctgatcatattgagagggtttacagacgagcgggcagccagaaactttggctagcagtacgctacggagccgccttcacacagaaattcagctcatccatcgcccctcatatcaccacattcctggttcacgggaagcaagtgacgctgggagcttttgggcatgaggaagaagtgatttccaaccccctgagtccccgcgtgattcaaaatatcatttactacaagtgtaacacccacgacgagagggaagcagtgatccagcaggagctggtgatccacattggctggattatctccaataacccggaactcttctcaggaatgctgaagattaggattggctggattatccacgccatggaatacgagctccagatcagaggaggtgataaaccagctctggatctctaccagctgagtccgtccgaggtgaagcagctactgctcgatattctccagccccagcagaatgggagatgctggctcaatagacgccagattgatggcagccttaaccgtacaccaaccgggttctacgaccgcgtgtggcaaatccttgagcgcacccctaacgggatcattgtggcaggcaagcatctgcctcaacagccaaccctgagcgatatgaccatgtatgagatgaatttctccttactagtggaggataccctgggaaatatagaccagccacagtaccgccaaattgtggtggaactgctaatggtggtatctattgtcttggagcgcaaccccgagctggagttccaggataaagtcgacctagaccgcctcgttaaggaagcattcaacgaatttcagaaagatcagtctaggctcaaagagatcgagaagcaagatgatatgacgagcttctataataccccccctttgggaaaaaggggcacttgttcctacttgaccaaggcagtcatgaatctgctccttgaaggggaagtgaagcccaacaatgatgatccttgcctcatctct

SEQ ID NO: 18205 - DNA, 3279 bp, Artificial Sequence
  Description of Artificial Sequence: Synthetic coding sequence
atggctggcgccgccggtttaaccgcagaagtcagttggaaagttctggaacggcgcgctcgcactaaacgatccggctctgtgtatgagccattgaagagcatcaacctgccgaggcccgacaatgagaccctctgggacaaactagatcactattaccggattgtaaagagtaccctcctgctttatcagagcccgacaactggattatttcccacaaagacctgcggtggcgatcaaaaggcaaaaatccaggactctctgtactgcgcagcgggagcttgggcactggccctcgcgtatcgccgtatagatgacgataagggaaggacgcatgagcttgagcattcagccatcaaatgtatgcgggggattctctattgctacatgcgacaggccgataaggtgcagcagttcaagcaggatcccaggcctacaacatgcctgcatagcgttttcaacgtccatactggtgatgagctcttaagctacgaagagtatggccacctgcagataaacgccgtgagtctgtatctcctctatctggttgagatgatctctagcgggctccagatcatttataacaccgatgaggtgagcttcattcagaacctcgtgttttgcgtcgaaagggtgtaccgcgtacctgactttggagtgtgggagcgtgggtctaaatataacaacggaagcacagagctccactctagcagtgtcggcctcgctaaggctgccttggaggccattaatggcttcaacttgttcggtaaccaagggtgttcttggtccgtcatattcgtggacctagatgcccacaatcgtaatcgacagaccttgtgctctctgctgcctcgggagtctagaagtcacaataccgacgccgcactgctgccgtgcattagttatcctgcttttgccctggatgacgaagtactcttttctcaaaccctcgacaaagtcgtacgcaagttgaaagggaagtacggattcaaacgctttttacgcgacggctacagaacatctctggaggatccgaaccggtgttactacaaacccgcggagatcaaactgtttgacgggattgagtgcgaatttcctattttcttcctctacatgatgattgacggcgtgtttcgcggaaatcctaagcaggttcaagagtatcaggacctgctgacccctgtgctgcaccataccacggagggctaccctgtggtacctaagtactattatgtacccgcagatttcgtcgaatacgagaagaataaccccggctctcagaaacgctttccatccaattgcggcagggacggtaagctatttctgtgggggcaggcactctacattattgccaagttgctggcagacgaactcatttcgccgaaagatatagatcccgtccagagatacgtcccgttgaaggatcaaaggaatgtatcaatgaggttcagcaatcaggggccgctggagaatgatctggtggtgcatgttgcactcatcgcagagtcacagagactgcaagtgttcctgaacacttacgggattcagacccagactccgcagcaagtagaacccattcaaatatggccccagcaagagctggtgaaagcgtatctgcagctggggatcaatgaaaaacttggactatctgggcgcccggaccgccctatcgggtgcctggggaccagtaagatctacaggattctcggtaagacagtcgtctgctaccctataatcttcgacctgagcgacttttacatgtcccaggacgtcttcctcctcatagatgacattaaaaacgctctccaattcatcaagcagtattggaagatgcacggtagacctctttttttagtgctgatcagagaggacaatatcagaggtagccgctttaaccctattctcgatatgctggctgccctgaaaaagggtatcattggaggagtgaaggttcatgtcgatcggctccagactctgatcagcggcgcagtcgtagagcagctggatttcttgcgcattagcgataccgaggagctcccagagttcaagtcattcgaggaactcgagcctccaaagcatagcaaggtgaagcgacaatcttcaaccccatcagctccggaattgggtcagcagcctgatgtcaacatatccgagtggaaggacaaacccacacatgagattctccaaaaactgaatgattgcagttgtcttgcgagccaggccattctgcttgggatcctgcttaagcgggaaggccccaatttcattaccaaggaagggactgtgagtgatcacattgaacgcgtgtatcgtcgcgccggatctcagaagttgtggttagcagtgcgttatggggccgcctttacccagaaattttcctcttcaatcgccccgcatatcacaacattccttgtgcatggcaagcaagtaactctcggcgctttcggccacgaggaagaagtgatttcaaaccccttgtctccacgcgttattcagaacatcatctactacaagtgcaatacccatgatgagagagaagccgtcatccagcaagagctggtcatacacatcgggtggatcatctctaacaatcctgaattgttcagtgggatgctgaagatcagaataggatggattattcatgcgatggagtacgagctccagatccgcgggggtgataagcctgcgctggacctgtaccagttgtccccctccgaggtgaaacagctgctccttgacattctgcagccccagcagaacggcaggtgctggttgaatcgtaggcaaatcgatggctcccttaacagaacccccaccggcttctacgaccgcgtgtggcaaattcttgagcgtacgcctaacggcattatcgtggcgggcaagcacctcccacagcaacccaccctttcagatatgacaatgtatgagatgaatttctcccttttggtagaagacacactggggaacattgaccagcctcagtatcgccagatcgtggtggaactgctcatggtggtgagtatcgtgctcgaaaggaatccagagctggaatttcaagacaaggttgatcttgaccgtcttgttaaggaagcatttaacgaatttcagaaggaccaatcgcggttgaaggagattgagaagcaggacgatatgacgagtttttataacacccccccccttggcaagcgtgggacctgctcatacctaaccaaggcggtgatgaatttgttgctcgaaggggaagtgaaaccaaacaacgacgatccttgcctaatcagt

SEQ ID NO: 18206 - DNA, 3279 bp, Artificial Sequence
  Description of Artificial Sequence: Synthetic coding sequence
atggcaggagcagcggggctgactgccgaagtgtcgtggaaagtcctggaaaggcgcgcacggaccaaaaggtcgggatccgtctacgagcctctgaagtcgataaatctgcctcgcccagataatgagactttgtgggataagctcgaccattactacagaattgtgaagtccactcttctgctctaccaatcgcctactaccggtttgttcccaactaagacttgcgggggtgatcagaaggcaaagattcaggacagcctgtactgtgcagctggggcttgggcattggccctggcctacaggcgaattgacgatgataaaggtagaactcacgagcttgaacactcggcaatcaagtgcatgcgggggatcctttactgttacatgcgccaagcggataaggtgcagcagtttaagcaagatcccagacctaccacgtgtctgcattccgtgtttaacgtccataccggagatgagctgctctcctacgaagaatacggtcatctccagataaatgccgtgtcgctttaccttctgtaccttgtggaaatgataagctcgggactgcagattatctataacaccgatgaagtgtcgtttattcaaaacctggtgttttgtgtggaacgggtctatcgcgtgcccgatttcggcgtctgggagagaggttcaaaatacaacaatggaagtaccgagttgcatagctcaagcgtgggactcgcaaaggccgccctggaagccattaacggctttaacttgtttggaaatcaagggtgttcgtggtcggtcatttttgtggatttggacgcacacaatagaaatcggcaaaccctttgttcacttcttcctcgagaaagccgttcgcacaatactgacgcagccttgctgccatgtatatcatacccagcattcgcgcttgatgatgaggtcctcttctcccaaactcttgataaagtagtgcggaaattgaagggaaagtacggtttcaaacgatttcttcgggatggatacagaacgtcgctggaggatcccaacagatgttactacaagcctgcagaaatcaagctctttgatggtattgaatgcgagtttcctatcttcttcctttacatgatgattgatggcgtgtttcgaggaaaccccaagcaggtgcaggaataccaggatctgcttaccccagtgctgcatcacaccacggaagggtacccagtggtgcccaagtactattatgtgcctgccgatttcgtggagtacgaaaagaataatccaggttcgcaaaagagatttccgtccaactgtggaagagatggcaaattgtttctttggggacaggcactttacattatcgctaaacttctggcagatgaactgatctcgcctaaggatatagaccctgtccaaagatacgtccccctgaaagatcaaagaaacgtaagtatgaggttctcgaaccagggcccactcgaaaatgatttggtcgtgcatgtggctctgattgcagaaagccagcgccttcaagtctttctcaacacctatggtatacagacccagacccctcagcaggtcgaaccaattcaaatatggcctcaacaagaacttgttaaagcgtacctccagctcggcataaacgagaagctcggattgtccggcagaccagatcgaccaattggttgcctgggtacgagcaagatttacaggatcctgggtaagacggtcgtgtgctacccaatcatttttgacctcagtgacttttacatgtcccaagacgtttttctgctcattgacgacatcaagaatgcgttgcaattcatcaaacaatactggaaaatgcatggccgccccctcttcctggtcctcatacgtgaagataacatcagaggttccagattcaaccctattctggacatgctggcagcgcttaagaaaggaatcatagggggcgtgaaggtgcatgtggatcgtctgcaaactcttattagcggggcagtcgtcgaacaactcgattttcttcggatctccgatactgaagaactgccagagttcaaatccttcgaggagcttgagcctcctaagcactctaaggtgaaacgccagagctccactccgtcagcacctgaacttggacaacaacctgatgtgaacattagcgaatggaaagataagccaacccatgaaatccttcaaaagttgaacgattgcagctgccttgcatcccaagctattctcctcggcattctgctgaagagggagggtccgaactttatcactaaagaaggtacggtgtccgatcacattgagagagtgtaccggagggcagggagccaaaagctctggttggcagtacgttacggagccgcctttactcagaagttttcgtcgtcaattgcaccgcatattaccacttttcttgtgcacggtaagcaggtgaccttgggagcgtttggacatgaagaagaagttatttccaatcccctctccccacgtgtcattcaaaacatcatatactacaagtgtaacacccacgatgagcgcgaggccgtcattcaacaagagcttgtgattcatattggttggatcatctcaaacaaccctgaactttttagcggaatgctgaagatacgaatcggatggattattcatgcaatggaatatgaactgcagatcagaggtggagacaagcccgcactggatctttaccaactgtcgcctagcgaagtcaaacaactgctccttgacatcttgcagccacaacaaaatggaaggtgttggctcaatcgcagacagatcgatggatcactgaatcggaccccaactgggttttatgaccgcgtgtggcagatcctcgagaggacccctaatggaattatcgtggcagggaagcatcttccccaacaaccgacgctcagtgatatgactatgtacgaaatgaacttctctttgctggttgaggacaccctgggtaacatcgaccagccgcagtaccggcagattgtcgtggaactgttgatggtagtctcgattgtgctggagcggaaccccgagctcgaattccaagacaaggtggaccttgacaggctcgtgaaggaggccttcaacgaatttcagaaggaccagtcccgtctgaaggagattgaaaagcaagacgacatgacctcgttttacaacactccgccactgggcaaacgaggtacctgttcttacctgaccaaagcggtgatgaacctcctgctggaaggagaagtgaaacccaacaatgacgacccttgccttatcagc

SEQ ID NO: 18207 - DNA, 3279 bp, Artificial Sequence
  Description of Artificial Sequence: Synthetic coding sequence
atggccggtgccgctgggctcactgcagaagtgtcgtggaaagtgcttgagcgtagagcacgaaccaaaagatcggggagcgtgtacgagccacttaagagtatcaatctgcctagacctgataacgagactctgtgggataaacttgatcactactaccggatcgtgaagtcaaccctgctcctttaccaatctccaacgactggtctgttcccgaccaagacttgtggaggggatcagaaggcaaagattcaagactcactttactgtgcagcaggagcttgggcactggcattggcctatcgacggattgatgacgataagggtcgcactcatgagctcgaacattccgcaatcaagtgtatgaggggaatcctttactgctacatgcgtcaggcagataaagtgcaacagtttaaacaagatcctcgtccaactacgtgtctgcactccgtgtttaacgtccatactggcgatgagctgctttcctacgaagaatatggccacctgcagataaatgcagtgtctttgtaccttttgtatcttgtggaaatgatctcgtcgggactgcagattatctacaacaccgacgaggtgagcttcatacaaaacctcgtgttttgtgtggaacgcgtgtatcgcgtgcctgattttggagtttgggagagaggttcaaagtacaacaacgggtcgacggaacttcactcgtcaagcgttggcctggccaaggcggccctcgaagctattaacggattcaacttgtttggtaaccaaggttgtagctggtcagtgatctttgtggatctcgatgcacataacagaaatagacagaccctttgttcacttcttcccagagaatcaagatcccataacaccgatgcagcactccttccttgcatctcctaccctgcctttgcgctggatgacgaagtccttttctcacagaccctggataaagtggtgcgcaaattgaagggcaaatatggattcaagcgattcctgcgagatggttaccgtaccagccttgaagatccaaacagatgctactacaaacccgcagaaatcaaactttttgatggaattgaatgcgaatttcccattttcttcctgtacatgatgatcgatggggtctttcgtggaaatccaaaacaggtgcaggagtaccaggaccttttgaccccagtcctgcaccacactactgaaggatacccagtggtgcccaagtactactacgtgcctgcggattttgtggagtacgagaagaataacccaggatcacagaagagattcccatccaattgtggaagagatggaaaactttttctttggggtcaggcgctgtacatcattgccaagctgctggcagatgagctgatctcaccaaaggatatagatcctgtgcaacgatacgtgcctcttaaggaccaaagaaacgtctcaatgcgcttttccaaccaagggccactcgagaacgacctggtggtgcatgtcgctctcattgctgaatcccaaagattgcaggttttcctcaatacctacggtatccaaacgcaaacccctcaacaagtggagccgatccaaatttggccgcaacaggagcttgtcaaggcgtatctgcaactcggaattaacgagaaacttggtctttcaggaaggcccgataggccgattggctgtttgggaaccagcaagatctacagaattttgggcaagaccgtggtttgttacccaattatcttcgatctgtccgatttctacatgtcccaggacgtgtttctccttatcgatgatatcaagaacgccctgcagtttatcaagcaatattggaagatgcacggccggcctcttttccttgtccttattcgagaggataacatccggggatcgaggtttaatcctatcctggatatgttggccgctcttaagaaaggaatcataggaggagtgaaggtgcatgtcgatagacttcagaccctgatctcaggcgcagtggtggaacaacttgattttcttcgtatttccgacaccgaggaactgcctgagtttaagtccttcgaggagttggagcctcctaagcatagcaaggtgaagagacaatcctcgaccccttcagccccagaactcgggcagcaacccgacgtcaacatctccgaatggaaagataagcccacccatgaaattctgcaaaaacttaacgattgcagctgcttggcatcccaggcaattctcctcgggattttgctgaaaagagaaggacctaacttcattactaaggaagggactgtgtcggatcatatagaacgcgtgtacaggagagcgggctcccaaaagctctggcttgccgtgcggtacggagcagcatttactcaaaagtttagctcgtcaattgcccctcacattacgacttttctcgtgcatggcaagcaggtgacgctgggggcctttggccatgaggaagaggtgattagcaatcctctttcgccaagagtcattcagaatatcatttactacaaatgtaacacccacgatgaacgtgaggcagttatccaacaggaactggtgatccatattggctggatcatatccaataaccctgagctcttttcgggaatgttgaagatccggattggctggattattcatgcaatggagtacgagctgcaaattaggggaggagataagcctgcgctggatctttaccaactttcgccatcagaagttaaacagctgctcctcgatatccttcagccacagcaaaatggccgatgttggcttaaccgcaggcaaattgacggttcgcttaatagaactccaaccggtttctacgacagagtatggcagattctggaaagaactcctaacgggattattgtcgctggaaaacatctgcctcaacagcctaccctgtcggatatgactatgtacgagatgaatttctccctgctggtcgaggataccctggggaatattgaccaacctcagtacagacaaatcgtggttgagcttctgatggtggtgtccatagtgctggaaagaaatcccgagctggaatttcaggataaggtggatctggaccggcttgtgaaggaggcgtttaacgaattccagaaggaccaatcccggctgaaggaaattgaaaagcaggatgatatgacttcattctacaatactccacctcttggtaagaggggaacctgttcctaccttactaaggctgtgatgaacctcctgcttgagggtgaagtcaagccgaacaacgatgatccgtgcctgatatca

SEQ ID NO: 18208 - DNA, 3279 bp, Artificial Sequence
  Description of Artificial Sequence: Synthetic coding sequence
atggcaggcgccgcggggctgaccgccgaggtgtcatggaaagtcctcgagcggagagccaggactaagcgctcaggttcagtctacgaaccacttaagtccatcaacctgcccaggcccgataatgaaacgctctgggacaagctcgaccattattacagaatcgtcaaaagcaccctgctgctgtatcagtcaccaaccaccggactgttccctaccaagacctgcggtggagatcagaaagcaaagatccaagactcactgtactgcgcggctggcgcttgggccctcgccctcgcttacaggcggatcgacgatgataagggacgcacccacgaactggaacatagcgcgatcaagtgcatgcgaggaatcctgtactgctacatgcggcaagccgacaaggtgcagcagttcaaacaagacccgcgcccaaccacttgtctgcactccgtgtttaacgtgcacactggagacgagcttctcagctacgaggaatatggacatctccagatcaacgccgtgtcactgtacctgctgtacttggttgaaatgatctcctcgggcttgcaaattatctacaacactgatgaagtctcgttcatccagaatctggtgttctgcgtcgagcgcgtctaccgcgtgccagacttcggcgtgtgggagcggggctcaaagtacaataacggctcgacggaactccattcctcgtccgttgggctggcaaaggctgcactcgaggccattaacggattcaacctcttcggaaatcaaggatgctcgtggtccgtgattttcgtggacctggatgcccacaataggaaccgccagaccttgtgctcacttctgccgcgggaatcgcgctcgcacaacaccgacgcggccttgcttccgtgtatcagctaccctgcgttcgcgctggatgacgaggtgctgttttcgcaaaccctggacaaggtcgtgcgcaaactgaagggaaagtacgggttcaagcgcttcttgcgggatgggtacagaacctccctggaggacccgaaccggtgctactacaagccagcagagatcaagttgttcgacggcattgaatgcgaattccctatcttctttctgtacatgatgatcgatggcgtgttccgcggtaatcccaaacaggtgcaagaatatcaggatctcctgactccagtgctccatcatactactgaagggtacccggtcgtccctaagtactactacgtgcctgccgacttcgtggagtacgagaaaaacaatcccggtagccagaagagatttccgtcgaactgcggacgggatggaaaactcttcttgtggggacaggccctttacatcatcgcgaaactcctggcagatgaacttatctccccgaaggacattgacccggtgcaacgctacgtgccactgaaggaccaacggaatgtctccatgcgatttagcaaccagggtccgctggaaaacgacctggtcgtccacgtagcccttatagctgaaagccagcgcctgcaggtgttcctcaacacctacggcatccaaacgcagactcctcagcaagtcgagccgattcagatctggccgcaacaggaacttgtcaaagcatacttgcagctcggcattaacgagaagctgggactgtccggaaggcctgacagaccgatcggctgcctcggaacttcgaagatctaccgcatccttggaaaaactgtcgtctgttacccgatcatcttcgacctcagcgacttctacatgtcacaagacgttttcctgttgatcgacgacatcaagaacgccctgcagttcatcaagcagtactggaaaatgcacggacgcccactgttcctcgttctgatccgtgaggacaatatcagaggatcgaggttcaaccctatcctcgacatgcttgccgcccttaagaagggaatcattggaggtgtgaaggtgcatgtggatcgcttgcaaacgctgatctccggagcggtggtggaacagctggattttctgcggatctcggacactgaggaactgccggaattcaagagcttcgaggagctggaaccgcccaagcattcgaaggtgaaacgccaatcgtcaactccgtctgcgccagagctcggacagcagcctgacgtgaacatctccgaatggaaagataagccgacgcacgaaatcctgcagaagctcaacgactgtagctgcttggcgtcgcaggccatcctgttgggaatcctgctgaagcgcgaaggcccgaactttattactaaagaaggaaccgtgagcgaccacatagagagagtgtatcggagagcgggctcgcaaaagctgtggctggcggtgcggtacggggctgccttcactcagaaattttcgtccagcatcgcaccacacattaccactttcctggtgcacggcaagcaggtgaccctgggcgctttcggacacgaggaagaggtcatcagcaacccgctcagtccgagagtcattcagaatatcatctactataagtgtaacacccacgatgagcgagaagccgttatccagcaggaactcgtgatccatattggatggatcattagcaataatcccgagctcttctccggaatgctgaagatccgcatcggatggattatccatgctatggaatacgagcttcagatccgcggtggggacaagcccgcactcgacctgtaccaactgtcgccgtccgaagtgaagcaactcctgctcgatatcctgcaaccacaacagaacgggagatgctggctgaacaggagacaaatcgatggttccctgaatcggactccaaccgggttttacgatagagtgtggcagatcctggaacgtaccccaaatggcatcatcgtggcagggaagcacctcccgcagcagccaaccctgtcagatatgaccatgtacgaaatgaacttctctctgctcgtggaagatactttgggaaacatcgatcaacctcaataccggcagattgtcgtggaactcctgatggtggtcagcatcgtgctggaacggaatccggagctcgagtttcaagataaggtggaccttgatcggctcgtgaaagaggctttcaatgagtttcagaaagaccagtctcggttgaaggaaatcgaaaagcaggatgacatgacgtccttttacaatactccaccgctgggaaagcgcggtacttgttcctacctgaccaaagccgtgatgaatctgttgctcgagggagaggtcaaacccaacaacgacgacccttgcctcatctca

SEQ ID NO: 18209 - DNA, 3279 bp, Artificial Sequence; identical to SEQ ID NO: 18174
  Description of Artificial Sequence: Synthetic coding sequence

SEQ ID NO: 18210 - DNA, 3279 bp, Artificial Sequence
  Description of Artificial Sequence: Synthetic coding sequence
atggcgggcgccgctgggttgacggcggaggtgagctggaaagtgctcgaacgccgcgcacgcacaaagagatctggttcggtctacgagcctctgaaatccattaatctcccacgtccagacaacgaaaccctgtgggataagctggaccactactatcgcattgttaagagcactttgctgttatatcaaagccctaccacgggtcttttcccgaccaagacatgcgggggtgaccaaaaggccaagattcaagattccttgtactgcgccgccggtgcgtgggcactagcactggcctatcgtagaattgacgacgacaagggtcgcacccacgagctagagcacagcgccatcaaatgtatgagggggattttgtactgctacatgcgacaagcggataaagttcagcagttcaagcaggacccgcgtccaaccacgtgtctccattcagttttcaatgtccataccggtgatgaactgttgagttatgaggaatacgggcacctacagatcaatgcagtcagcttgtacctcttgtacctggtggagatgatcagctcaggtctgcagatcatctataacactgacgaggtgtctttcattcaaaatttggtgttctgtgttgagcgcgtgtatcgcgttcctgacttcggcgtgtgggaaagaggatccaagtataataacggcagcacagagttacattcaagcagcgtcggtttagcgaaagcggcattagaagcgatcaacggttttaacctgttcggtaatcagggctgttcatggtccgttatcttcgtggacctggatgcgcataaccgaaacagacagactctgtgtagcttactgccacgcgagtccagatctcataacaccgacgcggctttgctgccatgcattagctacccagcgtttgcgctggatgacgaggtcctgttttcccagaccctggataaagtcgtgcgtaagttgaaggggaaatatggctttaagcgttttctgcgcgatggttatcgcaccagcctggaggatcctaaccgttgttactataagcctgcggagatcaagttatttgacggtattgagtgtgaatttcctatctttttcctgtatatgatgattgatggcgtttttaggggtaatcctaaacaggtgcaagagtaccaggatttgctgaccccagttctgcaccacactacggagggctatccggtggtgccaaaatattattacgtgccagcggacttcgtagaatatgaaaagaataacccgggaagtcaaaagcgttttcctagcaattgtggtcgcgatggtaagctctttctatgggggcaggcactatacatcatagccaaattgttggcggatgaattgatttccccaaaggatattgacccggtgcagcgttatgtcccactcaaagaccagcgcaatgtgagtatgcgattcagcaatcagggtccactcgagaatgatctagtcgtccatgttgctctgattgctgaaagccagcgcctgcaggtgttcttgaacacttacggtatccagacccaaactccgcagcaagtggagcctatccagatctggccacagcaggagctggttaaggcgtacctccagctgggaatcaacgaaaagctgggcctgagcggtcgtcccgaccgcccaataggttgcctgggaacctctaagatatatcgaatactgggcaagactgtggtgtgttacccgataatcttcgacctgagcgacttttacatgtcccaagatgtgtttctgctgatcgatgacatcaagaatgctttgcagtttattaagcagtactggaagatgcacggccggcctttgtttttggtgctaatccgtgaggacaacattcgaggtagccgcttcaatccaatcctcgacatgctcgccgcactgaagaaaggaatcatcggcggagttaaggtccacgtcgatcgtctgcaaacactcattagcggcgcggtggtggaacaactggacttcctgcgcatctcagataccgaagagctgccggagtttaaatccttcgaggaactggaaccaccaaaacactcgaaggtgaagcgccagagctccacaccgagcgccccggaactcggtcaacaaccagacgttaacatttcagaatggaaggataaaccgacgcacgagattctgcagaagctgaacgactgttcctgtctggcctcccaggctatcctgctggggatcttactcaaacgcgagggaccgaacttcattacgaaagagggaactgtttcagatcacatcgagcgcgtctacagacgtgcgggcagccagaaactgtggctggccgtgcgttacggggcagccttcacccagaaatttagcagctccattgcgccacacattactacctttttagttcacggtaaacaggtgacccttggtgcttttggccacgaggaggaagtgattagcaatccactgtcccctcgcgtgatccaaaatatcatttactacaaatgcaacactcatgacgaacgggaggccgtgattcagcaagaactggtcatccacattggttggatcatttctaataatcctgaactcttttccggtatgttgaagatccgcatcggttggatcatccacgccatggaatatgagttacaaatccgcggtggtgacaaaccggctctggatctgtatcaactgagcccttctgaagtgaaacaactcctgctggatatactgcaaccgcagcaaaatggccgctgctggcttaaccgccgtcagattgacgggagcctgaatcgcacgccgacgggattctacgatcgagtgtggcaaattctggagcgcactcctaatggaattatcgtagcgggcaagcacctgccacaacagcctacgttgtctgacatgacaatgtatgagatgaacttctctcttttggtcgaggatactttaggtaacatagatcaaccacagtaccgacaaattgtggtggagcttctgatggttgtttctatcgttctggaaaggaatccagaattagaattccaggacaaggtggacctggatcgcctggttaaagaggcatttaacgagtttcaaaaggaccagagccgtctgaaggagattgaaaagcaagacgacatgacatctttctacaatactccgccattagggaagcgcggtacgtgctcatacctgactaaggccgttatgaacctgctgttagagggcgaggtaaaacctaacaatgacgacccttgtctgatcagt

SEQ ID NO: 18211 - DNA, 3279 bp, Artificial Sequence
  Description of Artificial Sequence: Synthetic coding sequence
atggcaggagccgctgggctgaccgccgaggtctcatggaaagtcttggagcgccgagcccgcacaaaacggtccggctccgtctacgaaccactgaagtccatcaacctgcccaggcctgataatgaaactctatgggacaaactggatcactactacagaatagttaagtcgactctcctgctctatcagagccctaccaccgggttgttccccacaaaaacatgtgggggggatcagaaagcgaaaatacaggatagcttgtattgcgctgcgggcgcatgggccctcgccctggcctacaggcgcattgacgatgataagggtcgtacacatgagctggagcactctgccataaaatgtatgcggggaattctgtactgctacatgcggcaagcggacaaggtacaacaatttaaacaggacccccggcctactacctgtctacacagtgtctttaacgtgcatacaggagacgagcttctttcctacgaggaatatggccacttgcagattaatgctgtttccctgtatctgctgtatctggtggaaatgatcagtagtggattacagatcatctacaatactgacgaggtgagctttatacagaacctggtgttctgtgtcgagcgagtgtatcgggtgcctgatttcggcgtgtgggaacgcggcagtaaatacaacaatggatccaccgaactgcactcatcctctgtggggctcgccaaggccgctttggaagctatcaacggctttaacctttttgggaatcaggggtgctcgtggtccgtcatcttcgtcgacctggacgcacacaatcggaacaggcagacactgtgctcgctgctaccgcgggagtcgagaagccacaataccgatgcggcgctcctcccctgtatttcttacccagcctttgctctggacgatgaagtcctcttctcgcagaccctggacaaagtggtccggaaactgaagggtaagtacgggttcaaacggtttttacgcgatggctatagaactagcctggaggacccaaatcgctgttattacaaaccagctgaaatcaagctgttcgacggaatcgagtgcgaatttcccatttttttcttatacatgatgatcgacggggttttcaggggaaatccgaaacaggtccaggaataccaagaccttctgaccccggtgctgcaccatactaccgaagggtatccagtggtgccaaaatactattacgtacccgcagattttgttgagtacgagaagaataatccgggctcccagaaaagattcccatccaattgtggccgggacggaaagttgttcttgtggggtcaagcactttacattatagcaaagctcttggccgatgagctcattagccctaaagatattgaccccgtccagcgctacgtgcccctgaaggaccagagaaatgtgtcgatgcggttctccaaccagggccctctcgaaaacgacctggtcgttcacgtcgctctgatcgcggaaagccagcggctgcaggtcttccttaacacatatggaatccagacgcaaactccgcagcaagtcgaaccaatccaaatctggccacagcaggagctcgtgaaagcctacctgcagttaggtatcaatgaaaagctgggcctgagcggcaggcccgaccggcccataggctgcctgggtactagcaagatctatcgaatcctggggaagaccgttgtgtgctaccccataatattcgatttgagcgatttttatatgtcccaggatgtgttcctgctgattgatgacatcaaaaacgcactgcagtttattaaacagtattggaagatgcacggcagacccctctttttggtgctcatacgggaggacaacatcaggggctcaaggttcaatccaattctcgatatgcttgcggccctcaagaaggggattatcggtggggtgaaggtgcacgtggacagactgcagacactgatatctggcgcggttgtagagcagctggacttcctgaggatctccgacaccgaggaacttcctgagtttaaatcgttcgaggaacttgagccacctaaacactccaaggtgaaacgtcagtccagcactccatccgccccagagctaggccagcagcccgatgttaacatctctgaatggaaagataaacccacccatgagatcctccagaaattaaatgactgttcttgcctggccagccaggccatcctgctggggattctgctgaagagagagggtcccaacttcatcaccaaggaaggcaccgtctctgaccacattgagcgagtctatcgacgcgcaggctctcagaaactatggttggctgttcgttatggggccgcattcacgcagaaatttagctcgtccattgcccctcacatcaccaccttcctggtgcatggtaagcaggtcacccttggggccttcggccacgaagaggaggtgattagtaacccgttgtctcccagggttatccagaatattatctactacaaatgcaatactcacgacgagagagaagctgtgatccagcaagagctcgtgatacacattggatggattatttccaacaatcctgaactgttctctggtatgctgaaaatcaggattgggtggatcatccacgctatggagtacgagctccagatcaggggcggggataaacccgcgttagacctgtaccagctgtccccctctgaggttaaacagctactgctggatatacttcagccgcagcaaaacggacgctgctggcttaaccggcgtcagatagacgggtccctcaataggacgccgaccggattctacgaccgcgtttggcagattcttgagagaacccccaatggtattatcgtggccggcaagcatctgcctcaacagccgactctaagcgatatgaccatgtatgaaatgaatttttcccttttggtggaggacacactgggcaatatcgaccagccacagtatcgccagatagtggtggagctgctgatggtcgtttccattgtgctggagagaaaccccgagttagagttccaagacaaagtcgatcttgacaggctggtgaaggaggccttcaacgagtttcaaaaagatcagtcacggctgaaagagattgagaaacaggacgacatgacaagcttctacaatacaccaccgctgggaaaacgtggcacttgtagttatcttacgaaggctgtgatgaacctgctgctggagggtgaagtgaaacctaataatgatgacccctgcctcatcagc

SEQ ID NO: 18212 - DNA, 3279 bp, Artificial Sequence
  Description of Artificial Sequence: Synthetic coding sequence
atggcaggtgctgcaggcctcactgctgaggtgtcttggaaagtgcttgagcgaagggcgcgaactaaaagatcaggcagcgtttatgaaccattaaagtctataaatctcccacgcccagacaacgagactctctgggacaagctcgaccattactacagaatcgtcaaaagcaccttgcttctgtatcagagtccaactacgggacttttcccaactaagacctgtggtggagatcaaaaggctaaaatacaggactcgttgtattgcgctgcaggtgcttgggctctggctttagcataccgcaggattgacgatgataaaggtaggactcatgagctcgaacatagtgcaataaagtgcatgcgtgggatcctctactgttacatgagacaggccgataaagttcaacagtttaagcaagatccccggcctactacttgcctccatagcgttttcaatgttcacacaggtgatgaacttctttcctatgaagaatacgggcatctccagatcaatgctgtgagcctatacctgctgtacttggttgaaatgattagtagtggacttcagattatctataatacggatgaggtttcattcattcagaacttggtgttctgtgttgaacgagtgtaccgtgtacctgattttggtgtttgggaaaggggatctaaatacaataacggttccaccgaacttcatagttccagtgtaggcctcgctaaggcagccttggaagctattaacggatttaatttgttcgggaatcaaggctgtagttggtccgtgattttcgttgacctggatgcacacaatcgaaatcgtcaaaccttgtgtagtctccttccgcgtgagtcccgttcacataacacggatgccgccctccttccttgcatcagttaccctgccttcgctttggatgacgaggtgttgttctcacaaaccctcgataaggttgttcgtaaattgaaaggcaagtatggattcaagaggttcctccgagatggttatcgaactagtctagaggatcctaatcgatgctattataagcctgcggaaattaaactcttcgatggtatcgaatgtgaattcccaatctttttcctgtatatgatgatagacggagtttttagggggaacccaaagcaagtccaagaatatcaagatttactgacgccagtgctacaccacaccactgagggttaccctgtagtccccaaatactactatgttcccgctgattttgtcgaatatgaaaaaaacaatcccggctctcagaagagatttccctccaactgtgggagagatgggaagctgttcctgtggggtcaagccctttatattatcgctaagttgcttgctgatgaacttattagccctaaagacatcgatcctgttcagcgatatgtgccactgaaggatcagaggaatgttagtatgcgattctccaatcagggacctcttgaaaacgatttagttgtccacgttgctctcattgctgagtcccaacggttgcaagttttccttaacacttatgggattcaaactcaaactcctcaacaggtggaaccaatacagatctggccacagcaggagctcgtcaaagcatatttgcaacttggaatcaatgaaaagctcggcctcagtggtcgtcctgatcgtcccattggatgtttggggacttcgaaaatctaccgcatcctaggcaaaactgttgtttgctaccccataatatttgatttgagtgatttttatatgagtcaggacgtcttcctgctcattgatgatataaaaaatgctcttcagtttattaagcaatattggaaaatgcacggtaggcctctgtttttggtattaatccgggaggacaatatcaggggtagcagattcaatcctattttagatatgctggcagctcttaaaaagggtattataggtggggttaaggttcatgttgataggctccagactttgatatctggggctgtggttgagcaattggatttcttgcggatcagcgacactgaggagcttccggagttcaagtcattcgaagagttagaacctccgaagcacagcaaggtcaaaagacagagttccacaccatccgcacctgagttgggccaacaacctgacgtcaatatctccgaatggaaggataagccaactcacgagatccttcaaaagcttaatgactgctcctgccttgcttcacaagctatcctcttgggcattctcctgaagcgtgagggccctaacttcatcacaaaggagggtaccgttagtgatcatatagagcgtgtttacagacgagctgggagtcagaaactttggcttgcggtacgatacggtgcggctttcacccagaaattttctagctctatcgccccgcatatcaccacttttcttgtgcacggcaagcaggtgacccttggagctttcggacatgaagaagaggtgatttctaacccactctcacctagggtcatacagaatattatttattacaaatgtaacacccatgatgagcgtgaagcggttatacagcaggagcttgttattcatatcggttggattatatccaataatccagaactgttttcaggaatgttaaagatacgtattggatggattattcacgccatggaatacgaattgcagattagaggcggcgataaaccagccctcgacctctatcaacttagtccatctgaggttaaacaacttcttctggatatattacaaccacaacagaacggccgttgctggcttaatcgtagacaaatcgatggtagcttgaatcgcactcccaccggtttctacgatcgtgtttggcagattcttgagaggacgccaaatgggataattgtggctggtaagcatctcccacagcagccaaccctttccgatatgacaatgtacgagatgaatttttcgttgttggtcgaagacactctgggaaacattgaccagcctcagtataggcaaattgtggtagaactattaatggtcgtgtctatagtgttagagcgtaatccagaattagaatttcaggataaagtagacttggataggctggtgaaggaggccttcaacgagttccagaaggatcaatcacgcttaaaggaaattgagaaacaagatgacatgactagcttctacaacactccccccctcggaaagagaggtacgtgttcatacttaacaaaagccgttatgaaccttctacttgaaggagaagttaagcctaataacgacgatccttgtttgatttca

SEQ ID NO: 18213 - DNA, 3279 bp, Artificial Sequence
  Description of Artificial Sequence: Synthetic coding sequence
atggcaggtgccgcgggccttaccgccgaagtctcctggaaggtgcttgagcgccgagcgaggaccaagagatcaggatcggtgtacgagccgcttaaatccatcaatctgccacgcccagataacgaaactctgtgggataagctggaccattactacaggattgtaaagtcgacccttctgctgtaccaatcaccaaccactggcctgtttcccactaagacctgtggaggggaccaaaaagcgaagatccaggattccctctactgtgcagcgggtgcgtgggccttggcccttgcgtaccggcgaattgatgacgacaagggacggacccatgaactcgagcatagcgcaatcaaatgtatgagaggaatcctgtactgctacatgaggcaagccgataaggtgcagcaattcaagcaggatccacggccaaccacctgccttcactcggtgttcaacgtccatactggcgatgaacttctgtcatatgaagaatacggacatctccagataaacgccgtctccctgtacctcttgtaccttgtggagatgatatccagcggactgcaaatcatctacaacactgatgaagtgtcatttatccaaaaccttgtgttttgtgtggaacgcgtctacagagtgcctgattttggggtctgggagaggggatcaaagtacaacaacggaagcaccgagctccattccagcagcgtcggacttgcgaaggcagcccttgaagctattaacggattcaacctgttcggaaatcaggggtgttcatggtcagtgatatttgttgacttggacgcccataatagaaatagacaaaccctttgttccctccttccacgggagtcccgttcgcataacaccgacgcagcactgttgccatgtatttcgtatcctgccttcgcactggatgatgaggttcttttttcccaaactctggacaaggtggttagaaaacttaagggaaaatacggttttaagcgatttctcagagacgggtaccgcacctcgctggaggacccgaaccgctgttattacaaacctgcagagattaagctgtttgacggaattgaatgtgaatttcctattttcttcctgtacatgatgattgacggagttttcaggggaaaccccaagcaagtccaagaataccaagatctgttgacccccgtcctgcatcataccaccgagggctaccccgtggtgcctaagtactactacgtgccagcggactttgtcgaatacgagaagaataatccaggatcgcaaaaacggttcccatcgaactgcggaagagacggtaagctgtttctttggggacaagcattgtacattattgcaaaactgctcgctgatgaacttatcagcccaaaagacattgatcctgtccaaagatacgtccctctcaaggaccagagaaacgtgagcatgcggttttcgaaccaaggtccgttggaaaacgatctcgtggtccatgtggcactgattgccgaatcccaaagactgcaggtgtttctgaatacgtacggaattcaaacccagactcctcagcaagtggaacctatccagatttggccacaacaggaactcgtgaaggcatacctgcagcttgggattaacgaaaagctcggactgtcgggacggcctgataggcctattggttgtcttgggacgtcgaagatctacagaatcctcgggaaaactgtcgtctgttaccccattatcttcgatttgagcgatttctacatgagccaagatgtgtttctccttattgacgatatcaagaatgcattgcagttcattaagcaatattggaagatgcatggcaggcctctctttctggtgctcattagagaggacaacatcaggggctcgagatttaacccaatccttgatatgcttgcagcactcaagaagggaattatcggtggtgtgaaggttcacgtggacaggctgcagaccctcatatccggcgccgtggttgagcaactcgattttcttcgaatcagcgatactgaggagcttcctgagtttaagagctttgaggaacttgaaccacctaagcattccaaggtcaagcgtcaatcaagcactccgtcagcgcctgagttgggacaacagccagacgtgaacatctcggagtggaaagacaagccaacccatgaaatcctgcagaaacttaatgattgctcctgccttgcgtcccaagcgattctgctgggaattctgttgaaaagagaaggtccaaacttcattaccaaggagggaaccgtgagcgatcacatagaaagggtgtacagacgggccggatcgcagaagctgtggctggcagtgagatacggtgccgcctttactcagaagttttcgtcctccatcgcacctcacatcaccaccttcttggttcacggcaaacaagtgacccttggtgcattcgggcacgaagaagaggtgatctccaaccctctttcgccacgtgtgattcaaaacattatctactacaagtgtaacactcatgatgaaagggaggcagtgatccaacaggagctggtcatccacatcggttggatcatttcgaataatcccgaattgttttcgggaatgctcaagattcgaattgggtggataatacacgctatggaatacgagcttcagattagagggggtgataagcctgcacttgacctctaccagctttccccctcggaagtcaagcagctgctgttggatattctgcaaccccaacaaaatggcagatgttggcttaatagaaggcaaatcgatggaagccttaatcgcactcctaccgggttctacgatagggtgtggcagatcctcgaaaggacccccaacggtatcattgtggcagggaagcaccttcctcagcaaccgaccctgtcggatatgaccatgtacgaaatgaacttcagcctgttggtggaagatactctgggaaatatcgatcaacctcaatacagacagattgtggtcgagcttctcatggtggtgagcatcgtgctcgaacgcaaccctgaactggagttccaggacaaggtggatctggatcgtctcgtgaaggaggcatttaacgaatttcagaaggatcaatcccgactgaaggaaattgaaaaacaggatgatatgacgtcgttttacaataccccacctctcgggaagcgtggtacctgcagctacctcacgaaagcggtgatgaatctgcttcttgaaggtgaggttaagcctaacaacgatgatccatgccttatttcg

SEQ ID NO: 18214 - DNA, 3279 bp, Artificial Sequence
  Description of Artificial Sequence: Synthetic coding sequence
atggccggcgcggccggcttaaccgccgaggtgtcctggaaagtgcttgagcggcgggctcgcaccaagcgctctggctctgtgtatgagccactaaagtccatcaacctccccagacccgataacgagactctgtgggacaagttggaccattactacagaatcgtgaagtccacccttttactctatcagagtccaacgaccggattattccccactaaaacttgcggcggtgaccaaaaggctaagatccaggattcactctattgtgctgctggggcttgggctctggctctcgcctacagacgtatcgacgacgataaaggcagaacacacgagctggagcacagtgccatcaagtgcatgcggggcattctatattgctatatgagacaggccgacaaagtccaacagttcaagcaagatcctagacccaccacttgccttcactccgtgtttaacgtgcatacaggcgatgaactgctgtcatacgaggagtacgggcacctccagattaacgccgtgtcattgtatctgttgtatctcgtggagatgatctcctctggcctgcagatcatctacaatacagacgaggttagcttcatccagaatctggtgttctgcgtcgaaagagtgtatcgcgtccctgactttggcgtatgggagagaggctctaaatataataatggttctaccgaactccactcatcttctgtgggcctagctaaggcggcgcttgaagctattaatggatttaacctgtttgggaaccaaggttgtagttggtccgtgatttttgtagatctggacgcacataacaggaacagacagacgctgtgttcgctactgccccgggaatcccgttcacataacaccgatgcagccctcttgccatgcatctcttacccagctttcgctctcgatgacgaagtactcttctcacagacattggacaaggtggtgcgcaaacttaaggggaaatacggcttcaaacgcttcctcagagatggctatcgcaccagcctagaagacccaaaccgatgttactataaaccggccgagatcaaactgttcgacggcatcgaatgtgagtttcctatcttcttcttgtacatgatgatagacggagttttccgcggcaacccgaaacaagtccaagaatatcaggacttactcactcccgttctacaccataccacagagggttacccagtcgtgccaaagtactactatgtgcctgcagacttcgtggaatatgaaaaaaataaccccgggtctcagaaacggtttccatccaattgtggccgtgatggcaaactgtttctttggggccaggcgctgtatatcattgccaagcttctggcggacgagcttatttctccaaaggacatcgatcctgttcaacgctatgtgccattaaaggatcagaggaacgtgtcgatgcgcttttccaatcagggaccgctggaaaacgacctcgtcgttcacgttgccctgatcgcagaatctcaaaggttacaggtttttctgaatacatatggcatccaaacacaaacccctcagcaggttgaacctattcaaatctggcctcagcaggagttggtgaaagcatacctacaactgggcataaacgaaaagctgggattatccggacgcccagaccgcccaatcggatgtctgggcacatctaagatttatagaatcctcggtaaaaccgtggtttgctacccaataatatttgacctctctgatttttacatgtcacaggacgtgttcctgctgatcgacgacattaaaaatgccctgcagttcattaaacagtactggaaaatgcatgggagacctctctttctggtgttaatcagggaagataatatcaggggttcacggttcaatcctatcctggacatgttggccgctctgaagaagggcatcattggaggcgtcaaggttcacgtcgaccgtctgcagacactgatctctggggctgtagtggaacaactcgattttctgcgcattagtgataccgaggagctgcctgaattcaagagctttgaggagctcgagccacccaagcactcgaaagtgaaacggcaatcatccacccccagcgcccccgagctgggccaacagcccgacgtgaatatttctgagtggaaagataaacccacacatgagatactgcagaagctgaatgactgctcttgtctggcaagccaggcaatcctgctagggatcttactgaagcgcgagggacccaacttcataaccaaagaaggcacagtgtctgaccacatcgagagggtgtaccgaagggccggcagtcagaagctttggcttgccgttagatatggcgccgcttttactcagaagttttcatcaagtatcgcccctcatatcactacgttcctggtccatggtaaacaggttacgttaggagctttcggtcatgaggaggaggtgatatccaacccgctttctccaagggtgattcagaatatcatttactataaatgcaacacacacgacgagagggaggctgtgatccagcaggagttagtgattcatatcggttggatcatttcaaacaaccccgaacttttcagcgggatgctcaaaataaggattggatggattattcacgccatggaatacgaactgcagatacgcggaggcgacaagcccgccctggatctctaccagctctctccctcagaggtcaaacagttgctcctggatattctccagccccagcagaatggcaggtgttggctgaaccggaggcagattgacgggtccctgaatcggacgcccacaggcttttacgacagggtgtggcaaattcttgaaagaactcctaatggcattatcgtcgccggaaagcacttgcctcagcagcctaccctctcagacatgactatgtacgagatgaatttcagcctcttagtggaggacaccctggggaacattgatcaacctcaataccgtcaaatcgtggtggagctgcttatggtagtgagtatagtcctagagaggaatccagaattggaattccaggacaaggtcgacctggacaggctggtgaaggaagcgtttaacgagtttcagaaggatcagtccaggctcaaggaaatagagaagcaggacgatatgacctcattctacaataccccaccactgggcaagcgaggaacctgctcatatctcacaaaggccgtgatgaatctgttactcgagggcgaggttaagccgaacaacgatgatccttgtctgatcagc

SEQ ID NO: 18215 - DNA, 3279 bp, Artificial Sequence
  Description of Artificial Sequence: Synthetic coding sequence
atggcgggagccgcgggccttactgcagaagtgtcatggaaggtgcttgagagacgggcaagaaccaagcgctccggttctgtgtacgaacctctgaagagcattaacttgccaagaccagacaacgaaactctttgggataagctggatcattactaccggatagtcaagagcaccctgctgttgtaccaatccccaaccacgggcctttttcctactaaaacctgtggaggagatcaaaaagccaagattcaggattccctttactgcgcagctggtgcttgggcacttgcgctggcctaccggagaatcgacgatgataagggaagaacgcatgagttggagcactcggcaattaagtgtatgcgcggaattctgtactgctacatgcgccaggctgataaggtgcagcaattcaagcaagatccgcgcccaactacttgccttcattccgtctttaacgtgcacactggagacgaactgctgtcatacgaggagtacggtcaccttcagatcaacgcagtctcgctgtatctgctttacctggtcgagatgatctcatctggactgcaaatcatctacaacaccgacgaagtgtcgttcattcagaatcttgtgttttgtgttgagcgcgtgtatcgggtgccagactttggagtctgggagagaggtagcaaatacaacaacggatcgaccgagctgcattcctcctcggtgggacttgcgaaggcggcccttgaggcaattaacggattcaacttgtttggcaatcagggatgttcgtggtccgtgatcttcgtggatctggacgctcacaatcgaaaccgccagactctttgttcgctccttcctagggagtcgcgctcccataataccgatgcagcattgctgccatgcatctcctaccctgcctttgcactggatgatgaggtgcttttttcccagaccctggacaaggtggtgcgcaagctgaagggaaaatacggattcaagaggtttttgagagacggttacagaacctccctggaggatccaaatcggtgttactacaaaccagccgagattaaactttttgacggaattgaatgcgaatttccgatattcttcctctacatgatgattgatggggtgtttcgtggcaaccctaagcaagttcaagagtaccaagaccttctcaccccagtgctgcatcatactaccgaaggatatccagtcgtccctaagtactactacgttccagccgactttgtggaatacgagaaaaacaatcctggttcgcaaaaacgttttccttcgaattgtgggagggacggcaagctgtttctttggggccaagcgctttacataattgcaaagctgcttgcggatgaactgatttcccccaaggacattgaccctgtgcagcgatatgtgcctctcaaagatcaaagaaacgtgtccatgagattttcaaatcagggaccactggaaaacgaccttgtggtgcacgtggcactcatcgcagagtcccagcgcctgcaagtctttcttaacacctacggtattcaaacccaaacgcctcaacaggtggaacctatacaaatttggccgcaacaggagttggtgaaggcttacctgcagctgggcattaatgaaaaacttggacttagcggtaggccagatcggcccatcggctgtcttggaacctcgaaaatctaccggatacttggaaagacggtcgtctgttatcctatcattttcgatctttccgacttttacatgtcccaagatgtctttcttctcattgatgatatcaaaaacgcactccagtttatcaagcagtactggaagatgcatgggcggcctctttttctggtgctgatcagggaagataacattcgggggtcccgctttaatcctattctggatatgttggcagcacttaagaagggcattataggaggcgtgaaagtgcatgtggatcggctgcagactctgatctcgggggcagtcgtggaacagctggattttctccggattagcgataccgaagaacttcctgagttcaagtcgttcgaggagctcgaaccgccaaaacattccaaggtgaagcgccaatcgtcaaccccttccgcacctgaactggggcagcaaccagacgtgaacatttctgaatggaaagacaagcctactcatgaaatcctgcaaaagctgaacgactgctcatgtctcgcaagccaagctattctgctcggcattcttcttaaacgagaaggaccaaatttcatcaccaaggagggaaccgtctccgatcacattgaacgcgtctacagacgggccgggagccagaaactttggctggcagtgagatacggcgcggcctttactcagaagttttcatcctccatagcacctcatatcaccacttttcttgtgcatgggaagcaagtcactctgggcgcattcgggcatgaagaggaagtgatttccaatccactgtcgccaagagtgattcagaacataatctattacaaatgtaacacgcatgatgaacgcgaagcagttatacagcaggagcttgtgatccatattggttggattatctcgaataaccccgagcttttctcggggatgcttaagattaggatcggttggattattcacgctatggaatacgagcttcagatccggggtggcgacaagccagctcttgatctgtaccaactttcaccttcggaggtcaagcaacttctcctggatattctgcagccccagcagaatgggcgctgttggctcaaccgtagacaaatcgatgggtccttgaatcgaactcctactggattttacgaccgcgtgtggcaaatccttgagcgaaccccaaacgggattatcgtggctggtaagcacctgcctcagcagcccaccctctccgacatgactatgtacgaaatgaactttagcttgctggtggaagatactcttggcaacattgatcagcctcaataccgtcaaatcgtcgtcgaactcttgatggtggtgagcattgtcttggagcgaaacccagagcttgaatttcaagacaaagtggatctggatcggctggtcaaggaagcgtttaacgaatttcagaaggaccagagccggctcaaggaaatcgaaaaacaggatgacatgacctctttctacaacaccccacctttgggaaagcggggtacttgctcgtatctgaccaaggcagtcatgaatcttttgctcgaaggagaagtgaagccgaacaatgatgatccctgtcttatttcg

SEQ ID NO: 18216 - DNA, 3279 bp, Artificial Sequence
  Description of Artificial Sequence: Synthetic coding sequence
atggccggggctgctgggcttacagcagaagtctcctggaaagtactagagagaagagcccgcacaaagagatctggatcagtgtatgaaccactcaaaagtataaacctgccccggcctgacaatgaaacactctgggacaaacttgatcactattacagaatcgtaaaatccactctccttttatatcagtctcctactacaggactattcccaacaaaaacttgtgggggggatcagaaagccaaaatccaagattcactctattgcgccgcaggggcttgggcccttgccctggcctatagacggatcgatgatgataaagggcggactcatgagttagagcactccgccatcaagtgtatgagggggatcctgtactgttatatgcggcaggccgataaagtgcaacagttcaaacaggatccacgcccaacaacttgcctgcactctgtgtttaatgttcatacaggagatgaacttctatcatatgaagaatacggacatctccagataaacgcagtgtcattatacctcctctacttagtggagatgatctcatccgggctacaaatcatatataacacagatgaagtgtctttcatccagaatcttgtattctgcgtggaaagggtgtatagagttccagatttcggagtgtgggaaagggggtcaaaatataataatggatctactgagctccattcctcctccgtggggctggccaaagctgccctcgaggccataaatggattcaatctttttgggaatcagggatgctcttggtctgtgattttcgtagatctggatgcccacaaccggaacagacagactctttgttccctcctgcctagagaatccagatctcacaacacagatgctgccctgctcccctgtatatcttaccccgcgtttgcactagatgatgaggtgctcttctcgcagactctagataaggtcgtgaggaaactgaaagggaaatatgggtttaaacggttccttagagacggatacagaacttcactggaggatcctaacagatgttactataaacccgctgagatcaaacttttcgacgggatagaatgcgaattcccaatcttctttctgtacatgatgatcgacggagtatttagggggaatcccaagcaggtccaggagtaccaggatctcctcactccagtgctccatcatacaactgaagggtatcctgtggtcccaaaatactattatgtgccagctgatttcgtggaatatgaaaaaaataaccccgggtcacagaaaagattcccctccaattgtgggagagatggaaaactgtttctatggggacaggctctctatatcatagccaaacttttggccgatgaacttatctcccccaaagatattgatcccgttcagaggtacgtgcccctgaaagaccagcggaacgtatctatgcgattcagtaatcagggaccacttgaaaatgaccttgtcgtgcatgtcgcattaatagcagaatctcaacgacttcaggtctttctaaacacttatgggatccagacacagactccacaacaggttgagcctatccagatctggcctcagcaggaactggtcaaagcctacctccagctcggaatcaacgaaaaactggggctgtctgggagacctgataggccaatcgggtgtctggggacatccaagatctatagaatactaggaaagacagtggtatgttaccccatcatctttgatctcagtgacttctatatgtcccaagatgtgttcctgcttatagacgatatcaaaaatgctcttcagttcataaaacagtattggaaaatgcatggaaggcccctgttcctggtcttaatccgcgaggataatataagggggtctcgatttaatccgatcctcgacatgctggccgcccttaaaaaagggattatagggggggtgaaagtgcatgtcgatcggctgcaaacactaatctctggagctgttgtagaacagttggattttctgagaatatcagatacagaggaactaccagagttcaaatcatttgaagaattagaacctcctaaacactccaaagtgaaaaggcaaagttcaacaccatcggcccctgaactcgggcagcagcctgatgtgaatatatccgaatggaaggataagcctactcatgaaatactccaaaaactcaacgattgttcgtgtctcgcctcacaggcgatcctcctcggaatcctacttaaacgggaggggcctaacttcattactaaagaagggacagtgtccgaccatatcgagagagtatatagaagggctggatcccagaaactgtggctagccgtgcggtacggggccgcctttacacagaaattcagttcctcaatcgccccacacataacaactttcctcgtgcatgggaaacaggtcacactcggagctttcggacacgaagaagaagtgatcagtaacccactctcaccacgagtgatacagaatatcatatattataaatgtaatactcacgatgaaagggaagctgtgatacagcaagagctggtcatacatatagggtggataatatcaaacaatcctgagctgttctccgggatgttaaaaatcaggatagggtggataatccatgccatggagtatgaactgcagataagaggaggggataaacccgcccttgacctataccagctgtctccttctgaagtaaaacagttactgctcgatattttgcagccccagcagaacgggcggtgttggctgaaccgccgccagattgatggaagtctcaaccggactccaacagggttctatgatagagtctggcagatccttgaaaggacacccaatggaattatcgtcgcaggaaaacacctccctcagcagcccacactttctgatatgacaatgtacgaaatgaatttctcactgctcgttgaggatactctaggaaacatcgatcagcctcaatatagacaaatcgtcgtcgaattattaatggtggttagtattgttttggaacgcaaccctgaactcgaatttcaggataaagtcgacttagatcggctggtgaaagaagctttcaacgaattccagaaagatcaatcacggctgaaagaaatcgaaaaacaggatgacatgactagtttctacaacacacctcctctgggaaaacgtggaacatgcagttatctaacaaaagctgtaatgaaccttctcttagaaggagaagtaaagcctaacaatgacgatccctgcctcatatca

SEQ ID NO: 18217 - DNA, 3279 bp, Artificial Sequence
  Description of Artificial Sequence: Synthetic coding sequence
atggctggcgccgccggattaacagctgaagtgtcctggaaagtcctggagcgccgggctcggactaagcgcagcggttctgtgtatgagccgcttaagagtatcaatctcccaagacctgacaacgaaacattgtgggataagctggaccattattatagaattgtgaagagtacgctgctgctgtatcaatcaccgactaccggactgttcccaacaaagacctgtggaggtgaccagaaagctaaaatccaggacagtttatattgtgccgctggcgcctgggccctggccttagcttaccgccgaatcgacgacgacaagggacgcacgcacgaactcgagcactctgcaattaagtgcatgcgtggaattctctactgctatatgcgacaggccgacaaggtacagcagtttaagcaggatccccggccgactacatgcttgcatagtgtctttaatgtccacacaggtgacgaactgctgtcctacgaggaatacggccaccttcaaattaacgctgtctcactctatcttttgtacttggttgaaatgatttccagcggactccagatcatttataacacagacgaggtgagcttcattcagaacctggtattctgcgttgaaagggtgtaccgtgtgcccgacttcggcgtctgggagcgcggctctaagtataataacggctcaactgagctgcactcctctagcgtggggctggccaaggctgcactcgaggcaatcaatgggtttaatctgttcgggaatcaggggtgtagctggagcgttatcttcgtggacctggatgcccacaatcgcaacaggcagaccctctgctcgttgttgcctagagagtccagaagccataacaccgacgcagccctcctgccatgtattagctaccctgcattcgcccttgatgatgaggtgttgttttctcaaaccttggacaaggtggtacgtaagttgaagggcaagtatggcttcaagcggttcctccgcgatggctatcggacctctctggaggaccctaatcgttgttactataaacccgctgaaattaagctgtttgatggcatcgagtgcgagtttcccattttttttttgtacatgatgatcgatggagtgtttagagggaacccgaaacaggtgcaagaatatcaggacctgctgacccccgtgctgcatcacaccacagaaggctatccggtcgtgcccaagtactattatgtcccagccgacttcgtcgaatacgagaaaaataatccgggcagccagaagagattcccgtctaactgtgggagagatggaaaattattcctttggggacaagctctctatattattgcaaagctattggcagacgagttaatttctcctaaggatatcgacccagtgcaaagatatgttcctctgaaagatcagaggaacgtgtctatgcgcttcagtaaccaggggccactggaaaatgatctagtggtccatgtggccctcattgcggaatcacagcgactccaagtgtttctcaacacctatggcatccagacgcagactccacaacaggttgagccaatccaaatttggcctcagcaggagctagttaaagcttacctgcagctcgggatcaacgaaaaactggggctctcaggcaggccagataggccgatcggatgtctcggaacgtccaagatctatcgcatcttgggaaagacagtcgtgtgctatcctattatcttcgatttatccgatttttatatgtcacaggacgtcttcctgctgatcgatgatatcaagaacgctctgcaatttatcaaacagtactggaagatgcatggaagaccgctgttcttggtactcatacgcgaagataacatacgcggctcacgcttcaacccaatccttgatatgcttgctgctctaaagaaggggatcattggtggggtgaaagtgcacgttgacagactacagactttgatatcgggtgcggttgtggaacagctagatttcttgaggatctctgatacggaagagctacctgaatttaaaagctttgaagagctggagccgccaaagcacagtaaggtgaagcgacagtcgtccacacccagcgcccctgagctcggccagcagcccgacgtgaatataagtgagtggaaagacaaacccactcacgagatcctgcagaagctgaatgattgctcctgtctcgctagccaagctatcctcttgggcattctcctcaaacgcgaggggcccaacttcattacaaaggagggaactgtgtcagaccacatagagcgcgtttaccgaagagccggatcacaaaaactttggctggccgtgaggtatggcgccgccttcacacagaaattctcgagctccattgcaccacatatcactacctttcttgtccacggaaagcaggtaactctcggggcttttgggcatgaagaggaggtgatcagtaatcctttgagcccaagggttatccaaaatataatctactataagtgcaacacacacgatgaacgagaggccgtgatccagcaagaactggtgatccatattgggtggatcatttctaacaatcccgaactgtttagcggcatgttgaaaatcaggattggatggatcatccatgctatggaatacgagttacagattaggggcggcgataagccagcgcttgacctatatcagttaagcccatccgaagtaaaacaactactcctcgacatcttgcagccacagcagaacggcaggtgctggctaaaccggaggcagatcgatgggtccctgaatcgaactccaaccgggttttacgatcgggtatggcaaatattagagaggaccccaaatggtatcatagtggcgggtaagcacctaccacagcagccaactctgagcgacatgacaatgtacgagatgaatttctcgctcttggtggaagacactctgggaaatatcgatcagcctcagtaccggcagatagtggtcgagctcctgatggtcgtgagcatcgtcctggagcgaaaccctgagctagagtttcaggacaaggtcgatctggacagactcgtgaaggaagcgttcaatgaattccagaaggatcagtctcggttaaaggagattgagaagcaggatgacatgaccagcttctacaacacccctcccttggggaagagaggcacctgttcctatctaactaaggccgtgatgaacctcttgctcgaaggcgaggtcaagcctaacaacgacgatccatgcctcatctct

SEQ ID NO: 18218 - DNA, 3279 bp, Artificial Sequence
  Description of Artificial Sequence: Synthetic coding sequence
atggccggagccgccggactgacagccgaagtgagctggaaggtcttggagagacgagctcgcaccaagcggtcaggttccgtttacgagccccttaaaagtataaatctgcctaggccagataacgagaccttgtgggataaactggatcactactacagaatcgtgaaatccaccttgcttctgtaccagtcgcctaccacaggcttgtttcctacaaagacatgtggcggagatcaaaaagccaagatacaggacagtctgtattgcgccgctggcgcctgggcattggcgctggcctaccgtcgcattgatgacgataaaggaaggactcacgaactcgagcattccgccattaagtgtatgagaggaattctgtactgttacatgcgccaggctgataaagtgcagcagtttaagcaagacccgcggccaacaacatgcctccactctgtattcaatgtgcatacgggcgacgaactgctttcctatgaggaatacggacatttgcaaattaatgccgtttccctttatctgctatacctcgtggagatgatatcatccggactgcagatcatctacaatacggatgaagtaagtttcatccagaacctcgtgttttgtgttgagagggtgtaccgggttcccgactttggggtgtgggagagaggttctaagtacaacaacggttctacagagctgcatagttcttccgtgggacttgccaaagctgcacttgaggcaattaacgggttcaacctcttcggcaatcagggctgtagttggagcgtgatctttgtagacttggatgcccataatagaaatagacagaccctctgttcccttttaccccgcgagagccgatcccacaacaccgatgctgcactgcttccatgcatttcatatcctgcattcgcattggacgacgaggtgcttttttcccagaccctggacaaagtcgtccgtaagctgaagggtaagtatgggttcaagcgcttcctaagagatggatataggacatcccttgaagaccctaaccggtgttattataaaccggccgagatcaagctgttcgacggcatcgagtgtgagtttccaatattctttctttacatgatgattgacggcgtgttccgcggaaatcctaagcaggtacaggaataccaggatcttctgacacctgtgttacaccatacaactgaaggctatcctgtagtgcccaagtattattacgtgcccgccgactttgtggaatacgagaaaaataatccggggtctcaaaaaaggtttcctagtaactgcggaagagatggaaaattattcctttggggacaagctttatacatcattgctaaactcctggcagacgagctgatctcccctaaggatattgatcccgtgcagcgttatgtgccactgaaggaccagcggaatgtgagcatgaggttctcaaaccagggtccgttagagaatgacctggtggtgcacgtagccctgattgcagagagccagcgcctccaggtctttctgaacacatatggaattcaaacacagactcctcagcaggtcgagccgattcagatttggccgcagcaagaactggttaaagcttatctacagctgggcatcaacgagaagctcggattatctggacgacccgatcggccaatcggctgcctcggcactagcaaaatctataggattttaggtaaaaccgtggtctgctaccctatcatcttcgatttgagcgatttttatatgtcccaggacgtgtttctcctgatcgatgatattaagaatgccttacaattcattaagcaatattggaagatgcatggacggcctctgtttcttgttctcatcagggaagacaatattcgaggctcacgcttcaatccgatcctggatatgctggctgccttgaaaaaagggattattggaggtgtgaaagttcacgtggacagactgcagactctcatctctggtgctgtggtggaacagctcgattttctgagaatctccgacaccgaggagttgcctgaattcaagagttttgaggaacttgagccccctaagcattccaaggtcaagaggcagtcctccaccccctctgccccagagctcggccagcagcccgacgtgaatattagtgaatggaaggacaagcccacccacgagatcctgcagaaactgaatgattgctcctgtttggcctctcaagccatactgctaggaatactactgaaacgagagggtccaaactttattacaaaggaagggaccgtctcggatcacatcgagagagtctaccgtcgagccgggtcccagaagctgtggcttgctgtcaggtatggggcagcattcacccagaagttctcaagtagcattgccccccatataactacattccttgtacacgggaaacaagttactttgggggcctttggacatgaagaggaggtgatatcaaatcctttatctccacgggtgatccagaacatcatctactataaatgtaacactcatgacgaacgggaagcagtaattcagcaggagctcgtcatccacattggatggattatttctaacaacccagagctgttttcaggaatgctgaagatcaggatagggtggattattcatgcgatggaatatgaattacagattcgcgggggtgacaagcccgcgctggatctgtaccaattgtcgccctcggaggtgaaacaattgctgctggacattctacagccccagcagaacggccgatgctggctgaatcggaggcaaattgacggatccttgaaccgcacccccaccggtttctatgaccgggtgtggcaaattttagagcgcacgcctaacggcatcattgtcgccgggaagcacctccctcagcaacctacactctcagacatgactatgtacgagatgaacttctccttgctggtcgaagataccctggggaacattgaccaaccccagtatcgccagatcgtggttgagttattgatggttgtctcaattgtactcgagcgtaatccagagctagaatttcaggataaagtcgatttagaccgcttggtgaaggaagccttcaacgagttccagaaggatcagtcacggcttaaggaaatcgaaaagcaagatgacatgacgagtttctacaacaccccgccactcggcaagcggggcacctgctcctatctgacgaaagctgtcatgaaccttctgctggaaggcgaagtgaagccaaataacgacgacccctgccttataagc

SEQ ID NO: 18219 - DNA, 3279 bp, Artificial Sequence
  Description of Artificial Sequence: Synthetic coding sequence
atggcaggagccgcgggactcaccgcagaggtatcgtggaaggtgctcgagaggagggcacgcactaagagatcggggtccgtctacgaacccctgaagtcgatcaacttgccgaggccggacaacgagacgctgtgggataagctcgatcactattaccggatcgtcaaatccactcttctgctctaccagtcacctactaccggactcttcccaactaagacttgtggaggcgaccaaaaggcgaagatccaagactctctctactgcgctgcgggcgcatgggccctcgcactggcataccggcggattgacgacgacaaggggcggacccacgaactcgaacactccgcgattaagtgtatgcgcggaatcctctactgctacatgagacaagcggacaaggtgcagcagttcaaacaggacccaaggcctaccacctgcctgcactccgtgttcaacgtccacactggcgacgaattgttgtcttacgaggagtacggacatctgcagatcaacgcggtgtcgctctacctgctctacctggtggagatgatatcctctgggctccagattatctacaacaccgatgaggtgtccttcattcagaacttggtattctgcgtggaacgcgtgtacagagtccccgactttggagtttgggagcgcggttctaaatacaataatggatcgaccgaactgcattcgtcgtcagtgggcctcgcaaaggctgccctggaggctataaacggattcaatctgtttgggaatcagggttgctcctggtcagtcattttcgtcgacttggacgcgcacaacagaaaccgccaaacgctgtgcagcctgctgcctagggagagccgcagccacaacactgacgcggcgctgctcccatgcattagctacccggcttttgcactggatgatgaggtgctgttttcacagaccctcgataaggtggtgcggaaattgaaaggcaagtacggcttcaagcgcttcctgcgcgacggctaccgtactagccttgaggatccgaatcggtgctactacaagccggccgagatcaaactgttcgacggaatcgaatgcgagttcccgatcttcttcctctacatgatgatagacggagtgttccggggaaatccgaagcaagtgcaagaataccaagacctcctgacccccgtgctgcatcacactaccgagggatacccagtggtgccgaagtattactacgtgccagccgactttgtcgaatacgagaagaacaacccggggtcccaaaagcgctttccatcaaattgtggaagagacggaaaactctttctgtggggacaagccctttacatcatcgccaagctgctggccgatgaactcatctcacccaaagacatcgatcctgtccagcggtacgtcccgctgaaggaccagagaaacgtgtccatgcggttctccaatcaaggaccactcgaaaatgatctggttgtccacgtggctctgattgccgagtcccagcgcttgcaagtgtttctcaatacgtacggcattcaaacccaaactccacagcaggtggaaccgatccagatctggcctcaacaggagctggtgaaggcctacttgcagttgggaatcaatgaaaagctgggtctgtcaggcagaccggacaggccgatcggatgcctgggaacttcgaagatctaccggatcttggggaaaacggtggtctgctacccaatcatcttcgatctgtccgacttttacatgtcgcaggacgtgttcctcctgatcgatgacattaagaacgctctccagttcatcaaacagtactggaagatgcacggacgtccgctgttcttggtcctgatccgggaagataacatcagaggatcccgctttaatccaatcctggatatgcttgcagcgctgaagaagggtatcatcggaggggtgaaagtgcatgtggaccgactgcagaccctgatctcaggggcagtggtggaacagctcgactttctgcggatttccgacactgaagaactgccggaattcaaatctttcgaggaactggaaccgccaaagcactcaaaagtgaagcggcaatccagcaccccgtctgcaccagaactggggcaacagcccgatgtgaacatcagcgagtggaaggacaagcctacccatgagattcttcagaagctcaatgattgctcatgcctcgcgagccaggctatcctgttgggaatcctccttaagcgtgaaggcccgaatttcatcaccaaggaaggaactgtctcggatcatatcgagcgcgtctacaggagagcaggctcgcaaaagttgtggctcgcggtgcgctatggcgcggcctttacccagaaattctcttcctcgatcgctccgcatatcaccaccttcctggtgcacggcaagcaggtgaccctcggcgccttcggccacgaagaagaggtgatctcaaacccgcttagcccgagagtgatccagaacattatctattacaagtgcaacacccacgacgaacgggaagcggtcatccagcaagaactcgtgatccatatcggatggatcatttcgaataacccagaactgttctccgggatgctgaagatccggatagggtggataattcatgctatggaatacgaactgcaaatcaggggaggagacaagccggccctggatctctaccagctgagcccttccgaggttaagcagctgctgctcgatatcttgcaaccgcagcagaacggtcgctgttggctgaaccgccgccaaatcgacggatcactgaaccggactccgactggattctatgacagagtgtggcagatcctcgaacggactcctaacgggatcatcgtcgcagggaaacatctgccacaacagccgaccctgtcggatatgaccatgtacgaaatgaacttctccctgctggttgaggacacccttggtaatatcgaccagcctcaataccggcagattgtggtggagttgctgatggtcgtgtcgattgtgctcgaacggaatccggaactcgagtttcaggataaggttgatctggatcgcctggtcaaggaggcattcaatgaattccaaaaggaccagtcccggctgaaggagatcgaaaagcaagatgatatgacttccttttacaatactccacctcttggcaagcgcggaacctgttcgtacctgaccaaggccgtcatgaacctgctcctggagggcgaggtgaagccgaacaatgacgacccatgtctcatcagc

SEQ ID NO: 18220 - DNA, 2430 bp, Artificial Sequence
  Description of Artificial Sequence: Synthetic coding sequence
atggagcacaaagaggtggtgctgctgctattgttgtttttgaagagcggacagggagaacctctggatgactacgtcaatactcagggagcctcactattctcagtcacaaagaaacagctgggtgccggatctatcgaggagtgcgccgcaaagtgcgaagaggatgaggaatttacctgtcgtgcattccagtaccattctaaggagcagcagtgtgtaataatggcagagaacagaaagtcttccatcataattaggatgcgggacgttgtattgttcgagaagaaagtctacctgagcgaatgtaagactggcaatgggaaaaactacagaggtaccatgagtaagactaagaacggcattacatgccagaagtggagttctacctctccacataggcctcggtttagtcccgctacgcatccgagtgaaggtttggaagaaaactactgccgcaacccagacaatgatccccagggtccgtggtgttacacaacagatccggaaaagcgctatgactattgcgacattcttgagtgcgaggaggaatgtatgcactgctccggggagaattatgatggtaaaatctccaagaccatgtcaggcctcgagtgtcaggcctgggatagtcagtcacctcatgcacatggctacataccttccaaattccctaacaaaaaccttaagaagaactattgcagaaaccctgatcgagaactccgtccttggtgttttacaactgaccccaacaaaagatgggagttatgtgacattccacgctgcacaactcccccaccctctagtggacctacctaccaatgcctgaaggggaccggcgagaattataggggcaacgtggccgtgaccgtgtcaggccacacttgtcaacactggagtgcacaaaccccacatacgcacaaccggaccccagaaaacttcccttgcaagaacctggatgagaactactgtcggaacccagacggaaaaagggccccctggtgccacaccaccaatagtcaggtgagatgggaatattgcaaaatccccagttgtgactcaagccccgttagtacagagcagctggcaccgactgctccacctgaactgaccccggttgttcaagactgttaccatggagacggccagtcataccgcgggacgtccagcaccaccaccactggcaagaagtgccagtcatggagttccatgaccccacacaggcatcagaagacacctgaaaactaccccaacgccggcctcacaatgaactactgccggaacccagatgctgataaggggccatggtgttttaccaccgaccctagcgtcagatgggagtactgtaacctgaaaaagtgttccgggaccgaggcctcggtagtcgcccccccgcccgtcgtgttgcttccggacgtcgagaccccaagcgaagaagattgtatgttcgggaatggaaagggatatcgaggcaaacgcgctaccaccgtcacaggaacaccatgccaagattgggcagcccaggagccacatcggcatagcatattcacccctgagacaaatcccagggcaggattggagaagaattattgccgaaatcctgatggcgacgtgggcggtccatggtgttatactacaaacccccggaagctctacgattattgcgatgttcctcagtgtgctgcgccttcattcgactgcggcaagccccaggtggagccgaagaagtgccccggccgggttgtcggcgggtgcgtggcacacccccattcatggccgtggcaggtgtcgctgaggacaagattcgggatgcacttctgtggtggaactctcatatcccctgaatgggttctgacagcggcacattgcctcgaaaaaagccctaggccgtctagttacaaagtcattttgggcgcccaccaggaagtgaacctggagcctcacgtgcaggagattgaggtatctaggctgtttctggagccaacacgtaaagatatcgctctgctgaagttgagttcacccgccgtcataaccgataaagtcatccctgcatgtctgccctcccccaattatgtcgtcgccgatcgcacagaatgcttcatcaccggttggggggaaacgcagggcacctttggagcagggcttctcaaagaggcacagctccccgtgattgagaacaaagtgtgtaatcggtatgaatttttaaatgggagagtgcaatctacggagctgtgtgctggccacttggccggaggaaccgattcatgccagggtgattccggaggcccactagtgtgtttcgaaaaggacaaatacatactccaaggggtgactagttggggtctagggtgtgcgaggccaaacaagccaggtgtctacgtacgtgtctcacgcttcgttacatggatcgagggtgtaatgagaaacaac

SEQ ID NO: 18221 - DNA, 2430 bp, Artificial Sequence
  Description of Artificial Sequence: Synthetic coding sequence
atggaacacaaagaagttgtcttgttgttgctcctgtttctgaagtctggccagggagagcctctggatgactatgttaatacacagggtgcgagtttgttcagcgtgactaagaagcagctgggggccggaagtattgaggagtgtgcggctaaatgcgaagaagatgaagagtttacctgccgcgcatttcaataccatagcaaagagcagcaatgcgtcatcatggcggaaaaccgcaagagcagcatcattattcgcatgcgggacgtggtgttgttcgagaagaaagtttatttgagcgagtgcaaaacgggcaacggaaaaaactaccgtggtaccatgagcaaaaccaaaaacggaatcacctgccagaagtggagcagcaccagcccacataggcctcgttttagcccagccacccacccgtccgaaggcctggaagagaattattgccgcaatccagacaacgacccgcaagggccatggtgttataccacagaccctgagaagcgctatgattactgtgacattcttgaatgcgaggaggaatgcatgcattgctcaggcgaaaattacgatggcaagattagcaaaaccatgagtggcctggaatgtcaagcgtgggacagtcaatcccctcatgcccacggttatattccttccaagttcccaaacaaaaacctgaagaagaactattgtcgcaacccggatcgtgagctgcgtccatggtgcttcacaacagacccaaacaaaaggtgggagctgtgtgacatcccacgttgcacaaccccaccgccgtcatcagggccgacctaccaatgtctgaaaggcactggagaaaactatcgcggtaatgtggcagttaccgtcagcggacacacctgtcagcactggtccgcccagacaccgcatactcacaaccgcaccccggaaaacttcccgtgcaagaatctggatgagaactactgcaggaacccggatggcaagcgagcaccttggtgccatacgacgaattcccaggtccgctgggagtactgcaagatcccaagctgtgactctagcccagtgagcacggaacagctggccccaaccgcaccaccagaacttaccccggtcgtgcaagattgttatcatggtgatggtcaaagctaccgcggtactagcagcaccactacaaccggaaagaagtgtcagtcttggagcagcatgaccccgcatcgacaccagaagacccccgagaattaccctaatgcgggtctgacgatgaattattgtaggaacccggacgccgataaaggcccctggtgtttcaccactgatccaagtgtgcgatgggagtattgtaacttaaaaaagtgttctggcaccgaggcgtccgttgttgcccctccgccagtggtgctcctccctgatgtggaaaccccttccgaggaggactgtatgttcggtaacggtaagggttataggggtaagagggccaccaccgtgactggcaccccttgtcaggactgggcagcccaggagcctcaccggcacagcatcttcactccggagaccaaccctcgcgcagggctggaaaagaattattgccgaaaccctgatggcgatgttggcggcccttggtgctatactacgaatccacgcaagttatacgattactgtgatgtgcctcaatgtgccgctcctagtttcgactgcggaaaaccccaggttgaacccaaaaagtgtcctggtcgcgttgtcggcggctgtgtggcacatccgcacagctggccgtggcaagtctccctgcggaccaggtttggtatgcacttctgcgggggtactctcatctcgcctgaatgggttttgaccgccgctcactgtttggaaaaatctccacgcccgtccagctataaagttatactgggtgcccaccaagaggtgaacttggagccacacgttcaggagatcgaagtatccagactgtttctggagcctactcgaaaggatatcgcactgctgaaactgagttctcctgcagttatcacggacaaagtcatccctgcgtgcttaccctctccgaattatgtggtggccgaccgcaccgagtgcttcatcacgggttggggcgaaacccaagggaccttcggcgctggtctcttgaaagaagcacaactgcccgttattgaaaacaaagtttgtaatcgttacgaatttcttaatggacgcgtccaatcaaccgagctgtgcgccgggcacctcgcaggcggtacggacagctgtcaaggcgattccgggggtccgctggtttgtttcgagaaagacaagtacatcctgcagggcgtgaccagctgggggctgggctgtgcgcgccctaataaacctggggtttacgtgcgcgtttcacgcttcgtcacctggatcgagggtgtgatgcgcaataat

SEQ ID NO: 18222 - DNA, 2430 bp, Artificial Sequence
  Description of Artificial Sequence: Synthetic coding sequence
atggaacacaaggaagttgtcctgctgcttctcttgttcttgaagtcagggcagggcgagcccctggacgattatgtaaacacgcagggtgccagcctgttttcggtcactaaaaaacaactgggcgcgggctctattgaagagtgtgctgccaagtgcgaggaagatgaggaatttacttgtcgggcatttcaataccactctaaggagcagcagtgtgtcattatggcagagaatagaaagtcatctattatcatacggatgagggatgtggtcctattcgaaaaaaaagtttacctgtccgagtgcaaaaccggcaatggaaagaattacagaggaacgatgtccaagaccaaaaatggcataacatgccagaagtggagctcaacgagcccgcataggcctcggttttctccagcaacccatccctcagaagggcttgaagagaattactgtcgcaatccagacaacgacccccaagggccttggtgttatacaacagacccagagaagaggtacgactattgcgacatactggaatgcgaggaggagtgcatgcactgtagcggtgaaaattatgatggaaagatctccaagaccatgtccggcctggagtgtcaggcgtgggattctcagagtccacacgcccatgggtatatcccctctaagtttccaaacaagaaccttaagaaaaactattgcaggaatccagatcgagaactgcgtccatggtgcttcactaccgatcctaacaagcgctgggagctctgtgacattcctcgatgtaccactccccctccgagtagtggccctacataccagtgtctcaagggtacgggagagaactacagaggaaacgtggccgttaccgtctcaggccacacctgtcagcattggtcggctcagaccccacacacccacaatagaacccccgagaactttccctgcaaaaacttggatgagaattactgtagaaatccggatggaaaacgcgcgccatggtgtcacacaaccaattctcaggtgcgctgggagtattgcaaaataccatcctgtgactcatcaccagtgtccactgagcagctcgcacccacagcgccccccgaattgaccccagtagtgcaagactgttatcacggcgacggccagagttatcggggcacgagctccactaccaccacaggtaaaaagtgccagagctggtcaagtatgacccctcacaggcaccagaagacacccgagaattaccctaacgcaggcttgactatgaactattgccgtaatccagatgcagacaagggcccctggtgcttcacaacagacccgagcgtccgttgggagtattgcaatcttaagaaatgctccggaacggaggcatccgtggttgcacctccacccgtcgtgttactgcctgacgtggagaccccgtctgaggaggattgcatgtttgggaacggaaaagggtatcggggtaagagagctaccactgtaacgggtacaccttgccaggactgggcggcccaggaacctcatagacatagtatcttcacacctgagactaatccacgtgctgggctggaaaagaattactgcaggaatcctgacggggatgttggcggcccgtggtgttacacgactaatccacggaagctgtatgactactgcgacgtaccacagtgtgccgccccatctttcgactgtgggaaaccacaggtggaaccaaaaaagtgcccaggtcgagttgtcggaggctgtgtagcccaccctcattcgtggccttggcaggtgagcctgcgaacccgcttcggaatgcacttctgcggcgggaccctcataagtcccgaatgggtcctgactgctgcccactgtctcgagaagtctccacggccatctagctataaagttatccttggggcacatcaggaggtgaatcttgaaccccatgtgcaggagatcgaggtgagcagactgtttttggagcctacacgcaaggatatcgctcttctaaaactctcatctcctgcagtgatcacggacaaagttattcccgcatgcctaccatctccaaattacgtggtggcggacagaacggagtgttttattactggttggggagaaactcagggtacctttggggccggactgctgaaggaggcccagctaccagttatagagaacaaggtctgtaacaggtatgagtttctgaacggtcgcgttcagtccactgaattatgcgctgggcacctggcgggtgggaccgattcttgccagggtgactccggcggtcctttagtgtgcttcgagaaagacaagtacatcctacaaggagtgaccagttgggggctgggttgcgctaggccgaataaacctggggtgtatgttcgcgtcagccgattcgttacgtggatcgaaggcgtgatgagaaacaac

SEQ ID NO: 18223 - DNA, 2430 bp, Artificial Sequence
  Description of Artificial Sequence: Synthetic coding sequence
atggaacacaaagaagtggtccttcttctcctcttgtttcttaagtctggtcagggggagccactggatgattacgtaaatacacaaggggcctctttgttttccgtgacgaagaaacagctgggagccgggtcaatcgaggagtgtgccgctaaatgcgaagaagatgaggagttcacttgccgggccttccagtaccactctaaggaacaacaatgcgtgatcatggcggaaaatagaaaatcctccatcatcatccgaatgcgtgatgttgtgctgtttgagaagaaagtatacctgagtgagtgcaagactggcaacggaaagaattacagaggtactatgagcaaaaccaaaaacgggataacttgccagaaatggtcaagtacgagtccccaccgaccacgcttcagcccagctacacaccctagtgagggcctggaggagaattactgccgaaaccccgacaacgacccccagggcccatggtgctacactactgaccccgagaagcgttacgactactgcgacatcctagagtgtgaggaagagtgtatgcattgttctggcgaaaactatgacgggaaaatcagcaagactatgtcgggcctcgaatgccaggcctgggacagccagagtccacacgctcacgggtacattccctctaagtttcccaacaagaaccttaagaaaaattactgccggaaccccgaccgggagcttaggccatggtgtttcactaccgaccccaacaaacgttgggaactgtgtgatatccctcgttgcaccacaccgccaccaagtagtggtccaacctatcaatgcctgaaaggcactggggagaactaccgcggcaacgtggcagtaaccgtaagcgggcatacttgtcagcattggagcgcacagacgccacatacacataatcgcacacccgaaaattttccttgcaagaatctcgacgagaactactgtagaaaccccgatggcaaaagggcgccgtggtgccacactacaaattcccaggtccgttgggaatactgtaaaattccttcttgcgactccagtcccgtgagcacggagcagctggcaccaacagctcctccagaactgacaccagtggttcaggactgctatcatggcgacggtcaatcctataggggaacctctagcacaacaactactggcaaaaagtgtcagtcctggagcagcatgacaccccacagacaccagaagactcctgagaactacccaaatgcaggactgacaatgaattattgcaggaatccagacgccgataagggtccatggtgtttcacaacagatcctagcgttagatgggagtactgtaacctcaaaaaatgctctggaaccgaagctagtgtggtcgcgcctccgcctgtggtacttctgcccgacgtcgaaacccccagcgaggaggactgcatgttcggcaatggtaaaggatacagagggaagcgtgctaccactgttacaggtactccctgccaggattgggcagcccaggaaccgcaccggcactcaatctttactcccgagaccaatccccgtgccggattggagaaaaactattgccgtaacccagacggggacgtcggaggcccttggtgctacactactaaccccaggaaattgtacgattactgcgacgttcctcagtgtgccgctcctagcttcgattgtggcaaaccccaggtagaacctaagaaatgcccaggtcgggtcgtggggggctgcgtggctcatccacactcttggccttggcaggtctcgctgcgcactagatttggcatgcatttctgtggtgggacattgatctcccccgaatgggttctaactgctgcacactgcttagagaagagtccgcgcccctcttcatacaaggttatcctgggggcgcatcaagaggtaaaccttgagccacacgtacaagagatcgaagtctctagactgttcttagagccgacgcgaaaagacattgctttactcaagttatcgtcccccgccgtgatcacagataaggtgataccagcctgcctccccagccccaactatgtggtggcagatcgtacagaatgtttcattactggatggggagagactcagggaaccttcggtgccggcctactgaaggaagcacagctgcccgtgatcgaaaacaaggtttgcaacaggtacgaattcctgaacggaagggtccagagcactgaactgtgtgcaggccatttagccggcgggactgatagttgtcagggagactccggaggacctctcgtgtgttttgagaaggataagtatattctgcagggcgtgacctcctgggggctcggatgcgcccgcccaaacaagccgggagtgtatgtcagggtgtccaggtttgtgacctggatcgaaggggtgatgaggaataat

SEQ ID NO: 18224 - DNA, 2430 bp, Artificial Sequence
  Description of Artificial Sequence: Synthetic coding sequence
atggaacataaggaggtggtgctcttattattgctgttcttaaagagcggccagggcgaacctctggatgactacgtaaacactcagggtgcctccctgttcagcgtgaccaagaagcagcttggagcagggagtatcgaggagtgtgccgccaagtgtgaggaagacgaggaattcacctgccgggcattccaatatcacagtaaggagcagcagtgcgttatcatggctgaaaatagaaaaagcagcataattatccggatgcgagacgtggtcctgttcgagaagaaggtgtatctctctgagtgtaaaaccgggaacggcaagaattatcggggaacgatgtccaaaaccaaaaacggaattacgtgccagaagtggtccagcacaagccctcatcgcccccgatttagcccagcaacacatccctctgagggcctggaggaaaactactgcaggaatccggataacgatccgcaaggaccctggtgttacactactgacccagagaagagatatgactattgtgatatcctagaatgcgaagaggaatgtatgcactgctccggggagaattacgatgggaagatctccaagactatgtccgggttggaatgtcaggcctgggactcacagtctccccatgcacacggttacatcccaagtaagttcccaaataagaaccttaaaaaaaattactgcagaaacccagaccgcgaactgcggccgtggtgttttactactgatcccaacaaaagatgggagctgtgtgacattccccgctgcaccacgcctcctccgagttcgggcccaacttaccagtgcctgaagggcactggagagaactacaggggaaatgtggcggttaccgtcagcggtcatacttgtcagcactggtctgctcagacaccccacactcataataggactcctgaaaattttccatgtaagaatcttgacgagaactattgccgtaatcccgatgggaagcgagccccgtggtgccacacaaccaactcccaagttaggtgggagtactgcaaaatcccctcatgtgacagctccccagtgagcaccgagcagctggccccaaccgccccgccagagttgacacccgtggtccaggactgttaccatggcgacggtcagagctaccgtggcaccagttccacaaccactactgggaagaagtgccaatcgtggtcatccatgacccctcaccgccaccaaaaaacccctgaaaactatccaaacgccgggctgacaatgaactactgtcggaaccctgacgccgacaaaggcccgtggtgcttcacgactgacccgtccgtgaggtgggaatattgtaacctgaaaaagtgcagcggcacagaggcttccgtggtcgcaccccctcctgtggtgctgttgcccgatgtcgagacaccttcagaagaagactgcatgttcgggaatggcaaggggtaccgggggaagagagcgacaaccgtgacggggacaccttgccaggactgggccgctcaggaaccacaccggcactctatctttactcctgagactaaccctcgcgcaggcctggagaagaactactgccgtaatcccgatggcgacgtgggtggcccctggtgctacacaaccaaccctcgtaagctgtacgattattgtgacgtcccacaatgcgcggcgccaagctttgactgcggtaagcctcaggtcgagccgaagaagtgcccagggcgggtcgtgggaggctgtgtggcacatccccactcctggccatggcaagtgagtctgagaacaaggtttggcatgcatttttgcggagggaccttaattagccccgagtgggtgttgacggcagctcactgcctcgagaaatcccccagaccgtcctcgtataaggtgattctgggagcccaccaggaggtgaatctggagccccacgttcaagaaatcgaggtctccagactttttctggaaccaacaagaaaagatatcgcgttactgaaactgtccagcccagcagtaatcaccgacaaggtcattccagcatgtcttccctcacctaattacgtcgtcgcagatcgtacagaatgctttattacaggatggggtgagacccaagggacgttcggcgccggattgctgaaagaagcccagctccctgtgatcgaaaataaggtatgcaataggtatgaattcctcaacggacgagtgcagagtactgaactctgtgctggtcacctggccggaggaactgatagttgtcaaggcgacagtggtgggcctctggtatgcttcgagaaggataagtatatccttcagggcgtgacctcatggggcctgggctgtgctagacctaataaaccaggggtttacgtgagggtgagtaggttcgtgacatggatcgaaggagtaatgcgcaataac

SEQ ID NO: 18225 - DNA, 2430 bp, Artificial Sequence
  Description of Artificial Sequence: Synthetic coding sequence
atggagcacaaagaggtcgtgctactactgctcctgttcttgaaatccggacagggtgagccgttagatgattacgtcaacacccagggggcgtcattatttagcgtgactaagaaacaattgggcgcgggaagcattgaagaatgtgccgccaaatgcgaggaagacgaggagttcacctgccgagcctttcagtaccattcaaaagaacaacaatgcgtgattatggccgagaaccgaaaatcttcaattattatccggatgagggacgtggtactatttgaaaagaaagtgtatctttcagagtgtaagaccggcaatggaaagaactaccgaggtacaatgagcaagacaaaaaacggtatcacctgccagaaatggtctagcactagcccgcataggccacgattttcaccagcgacacacccatccgaaggacttgaggaaaattattgccgcaaccctgacaacgaccctcaaggtccatggtgctatacaactgacccagaaaaaaggtatgactactgtgatatcctcgaatgtgaggaggagtgtatgcattgctcgggcgaaaattacgatgggaagatcagcaaaaccatgagtggacttgagtgtcaggcctgggacagtcagagtccacacgcacatgggtatataccctccaaattcccaaacaagaacttgaaaaaaaactactgccgtaaccccgatagggagctgcgcccgtggtgtttcaccacggatcccaacaagcgatgggagctgtgtgacataccaaggtgcaccacgccaccgccatcctcggggccgacttaccagtgcctcaagggaaccggagaaaactaccgggggaacgtggccgttacagtgtccggacacacttgtcagcactggagcgcacaaactccacatactcataatcgaaccccagagaattttccctgtaaaaatctcgatgaaaactactgccgcaatcccgatggtaaaagagcaccttggtgccacactacgaacagtcaggtgaggtgggagtactgtaaaataccctcttgcgatagcagtcccgtgagcacagagcagctggcacccaccgctccccctgaactgacccctgtggtgcaggattgttaccacggagatggacagtcctaccggggtacttcctctaccactactacagggaaaaagtgtcagtcttggagctctatgaccccacacaggcatcagaaaacgcctgagaattaccccaacgcaggtctcacgatgaattattgcaggaaccccgacgctgacaagggcccatggtgttttactacggatcctagcgtgagatgggagtactgcaatctaaaaaagtgcagtgggactgaggcctctgtagttgcccctcctccagtagtgctgcttccggatgtagaaaccccctcggaggaggactgtatgttcgggaatggcaaaggttaccgcggcaaacgagccactaccgtgacgggaactccctgtcaggactgggccgcgcaggagccacatcgacactccatctttacgcctgaaaccaatccgcgcgcaggcttggagaagaactattgtcgaaatcccgacggagatgtgggcggaccttggtgttatacaacaaaccccaggaaactgtacgactattgcgatgtgccccagtgcgctgccccatccttcgactgtgggaaacctcaagtggaacccaaaaagtgtccaggcagagttgtgggcggttgcgtcgctcacccccatagctggccatggcaggtaagtttgaggaccaggttcggaatgcacttttgcggggggacattgatatcaccagagtgggtgctgactgccgcccactgcctcgagaaatcccctcgacccagtagttacaaagtgattttaggcgcacatcaggaggtgaatctagaacctcatgtgcaggagatcgaggtgtcccgactgtttctagagcctacacgtaaggatatcgcgctgctgaagctctcaagtcccgctgttatcacagacaaggtaatcccagcctgtctgcccagccctaattacgttgtggcggatcggacggagtgcttcatcacaggctggggagaaactcagggaacattcggagcagggctgctgaaagaggcccagttacccgtgattgaaaataaagtgtgcaacagatatgagtttcttaatggcagagtccagtccactgagttatgcgccggccatttggcaggcggcacagactcatgtcaaggcgacagtggtggcccactagtgtgtttcgagaaggacaaatacatcctacaaggcgtaaccagttggggtctaggatgtgcaaggccaaacaaaccgggggtgtatgtccgtgtctctcggttcgtcacatggatagagggagtcatgcgcaacaac

SEQ ID NO: 18226 - DNA, 2430 bp, Artificial Sequence
  Description of Artificial Sequence: Synthetic coding sequence
atggaacataaagaggtggtactgctgctgctgctctttctgaagagcggccagggggaaccattagatgactatgtcaatactcagggcgcatcactctttagcgttactaaaaagcagctgggggctggctcaatcgaggagtgcgccgccaagtgcgaggaggatgaagagttcacctgccgggccttccagtaccattccaaagagcagcagtgcgtgattatggccgaaaatcggaagagttcaattatcattagaatgcgggacgtagtgctgttcgagaagaaagtctatctgtctgaatgcaagacagggaacggcaagaactacagggggactatgtctaagaccaagaatgggattacatgtcagaaatggtccagcactagcccacaccgcccccgattttcacccgccacccatccgtccgaaggcctggaggaaaattattgccggaaccccgacaatgatccccagggcccatggtgctacaccactgaccctgagaagcgatacgactactgcgacatcttggagtgtgaagaggaatgcatgcattgctctggggaaaattacgacgggaaaatcagcaagacaatgtctggactcgaatgccaggcatgggactctcaatctccccacgctcatggatacatcccctctaaattcccaaataaaaacctaaagaaaaattactgtcggaacccagaccgagaactgagaccctggtgtttcactacagatcctaataagaggtgggagctttgcgatatcccgcggtgcactacccctcctcccagttctgggcctacctaccagtgcctgaaaggcactggggagaattatagaggcaatgttgccgtgaccgtgtcaggtcacacttgtcagcactggtcagctcagactccacacactcataacaggacaccagaaaacttcccctgcaagaatctggacgaaaattactgccgcaatcccgatggcaagagggcaccatggtgtcacaccaccaactcacaggtgcggtgggaatactgcaagatcccaagctgcgattcttctccggttagtaccgaacagctggcgcccaccgctccccctgaactgacacccgtcgtgcaggactgctaccacggtgacggacagtcatacaggggcacttccagtacaactacaactggtaaaaagtgtcagtcatggagtagcatgacacctcataggcaccagaagacccccgagaattatcctaacgcaggcctaaccatgaactactgtagaaacccggacgctgacaaaggcccatggtgtttcacgaccgatccaagtgtcaggtgggaatactgtaacttgaaaaaatgtagcggaacagaagcctcagtcgtggcccctccgcctgtggtcctgctccctgatgtggaaaccccttcagaggaagattgtatgttcgggaatgggaaagggtatcggggtaagagagccaccaccgttacggggactccttgccaggactgggctgcgcaggagcctcatagacattcaatattcacccccgagaccaatcctcgggctggactcgagaagaattactgtagaaaccctgatggcgatgttggcggtccttggtgttatacaaccaatccccgtaaattgtacgattattgcgatgtgccccagtgtgcagctccttcatttgactgcggcaaaccccaagttgagcctaaaaaatgtccaggtagggtcgtcggaggatgtgttgcccacccacatagttggccctggcaagtttcgctgagaacgagattcggtatgcacttctgtggaggcaccctgatttcccctgaatgggtgttgactgccgctcactgcctcgaaaaaagcccgcggccaagcagctataaggtgatactgggcgcccaccaggaagtgaacctcgagccacacgtccaggaaattgaagtgagcaggctttttctagaaccaaccagaaaggacatcgctctgctgaaactgtcatcgcctgctgtgatcactgacaaggttattccagcgtgtctgccttcccccaattacgttgtggccgataggaccgagtgcttcatcaccggttggggtgaaacacagggtacattcggagctggattattgaaggaagcccagcttccagtgattgagaacaaggtttgtaatcgctacgagtttctgaatggacgggtgcaaagcaccgagctttgtgccggccacctcgccggtggcactgactcttgccaaggggacagcggaggccccctcgtctgttttgagaaggataagtatatcctccaaggcgtgacatcgtgggggctaggatgtgctaggccaaataagccaggcgtgtatgtaagggtttcaagattcgtcacgtggatcgaaggtgtcatgcgcaataac

SEQ ID NO: 18227 - DNA, 2430 bp, Artificial Sequence
  Description of Artificial Sequence: Synthetic coding sequence
atggagcataaggaagtggttctcttgttactgctgttcctgaaaagtggtcagggcgagccactggatgactacgtcaatacccagggggctagcctgttcagtgtaactaagaaacaattgggggcaggcagcatcgaagaatgcgccgccaagtgcgaggaagatgaggagtttacctgcagggcttttcaataccactctaaggagcagcaatgcgtaatcatggcagagaaccgaaagtcgtccatcataattagaatgcgagacgtggtgctgtttgagaagaaagtctatctcagcgagtgtaaaactggtaacggaaaaaactacaggggcacaatgtcaaaaactaagaatggaattacatgtcagaagtggagctcaaccagtccgcaccgacctagattttctccagccacccatcccagcgagggattggaggaaaattactgtcgtaatcctgacaatgatcctcaggggccatggtgttatacaaccgaccctgagaagcgctatgattactgcgacattctcgaatgtgaggaggaatgtatgcactgtagcggggagaattacgacggaaaaatctctaaaacaatgtccggcctcgagtgtcaggcatgggatagccagtccccacatgcccatggctacattcctagtaaatttccgaacaagaatctcaagaaaaattattgcaggaacccggatcgtgagctcagaccctggtgcttcaccactgatcccaataaacgttgggagctttgtgacatcccccggtgcacaacacccccccccagctctggccctacctatcaatgtcttaagggaaccggagaaaattacagaggaaacgttgcggttactgtatccggacacacgtgccaacattggagtgcccagactccacacactcataaccgcacccctgagaatttcccctgcaagaacttggacgagaattattgtagaaaccctgacggcaaacgggccccatggtgccacacaacaaacagtcaggtgcggtgggaatactgtaagatcccaagctgtgattcttccccagtgtctactgagcaactcgcccccacagcaccacctgagctaaccccagtggtgcaggattgctaccacggcgacggacaatcttacagaggaacatcaagtacaactaccaccggaaagaagtgtcagagctggagtagcatgacaccccaccggcaccagaagacccccgaaaattatcctaacgcaggactaaccatgaattactgccgcaaccccgatgctgacaagggcccgtggtgttttaccaccgaccctagcgtgcgctgggaatattgcaacctgaagaagtgcagtgggacagaagcctctgtcgtggctcctcctccagtggtccttctgccggatgtggaaaccccttctgaagaagattgcatgttcggcaacggcaagggatatagggggaaacgggctactacagtcaccggaacaccttgtcaggactgggctgcccaggaaccccaccggcattccatattcacacctgagacaaatcctcgcgcaggcctggaaaagaattattgccgcaaccctgatggcgatgtgggcggtccatggtgctatactacaaatccccggaagttgtacgactattgtgacgtcccacagtgtgctgcaccatctttcgactgcggtaagccacaagttgagcctaaaaaatgtccaggacgcgttgtgggtggctgtgtggctcaccctcattcctggccttggcaagtgagcctcaggacccggttcggaatgcatttctgcggtgggacattgatctctccggaatgggtgctgactgctgcacactgtctcgagaaaagccccagaccttcctcctacaaggtgatcctgggcgctcatcaagaagttaatctcgagccccacgttcaggagatcgaggtttctcgactattccttgagccgacccggaaggatatcgccctcctcaagctctccagtcccgctgttattacagacaaggtgattcccgcatgcctgccttcacctaactacgtcgtggcagaccgcactgagtgttttatcacaggttggggagaaacccagggcaccttcggggcaggccttctgaaagaggcacagctgccggtgatcgagaacaaagtgtgcaaccgctacgagtttctgaacggcagggttcagagcaccgaactttgcgctgggcacctcgctggaggcactgacagctgccagggggatagcggtgggccgctcgtctgcttcgagaaggacaaatacatcctccagggggtgacgagctggggccttgggtgtgcccggcccaataagccgggagtgtatgtgcgagtaagccgctttgtgacatggatcgagggagtaatgaggaataat

SEQ ID NO: 18228 - DNA, 2430 bp, Artificial Sequence
  Description of Artificial Sequence: Synthetic coding sequence
atggaacacaaggaggtggtgcttctcttgctgctgttcttgaaaagcggacaaggtgagcccctggatgactacgttaacacccaaggcgcctccttgtttagtgtgactaagaaacagctcggagccgggagcatcgaggagtgtgctgcgaaatgcgaggaggatgaagaatttacctgtcgcgctttccagtaccatagtaaggagcagcaatgcgtgatcatggccgaaaataggaaatcttctatcattattaggatgcgggatgtcgtcctctttgaaaagaaagtctatttgagcgagtgtaagaccggaaacgggaaaaattatcgagggacgatgagcaaaaccaagaacgggatcacttgccagaagtggtcctccacctccccgcaccgcccccgcttttctcccgcgacacatccatctgaagggttagaggaaaattattgtcgaaatccggacaatgatccgcagggaccctggtgctacaccactgaccccgagaaacgttacgactattgtgatatccttgagtgtgaggaggaatgtatgcactgcagcggggagaactacgacggtaaaatcagtaagacaatgtctggccttgaatgtcaggcatgggacagtcagagcccacatgcacatggctacatccctagcaagtttccaaataaaaatcttaagaagaattattgccgcaatcctgatagagaactaagaccgtggtgcttcacaacagatcctaataagcgatgggaactatgcgatatacctagatgcaccacgcctcccccctcgtctggaccaacgtatcagtgcctgaaaggcacaggcgagaattatcgcggaaatgttgccgtgaccgttagtggccacacttgccagcattggtccgcccagacaccacacacacacaaccggacacccgagaatttcccttgtaagaaccttgacgagaattattgcaggaatcccgatggaaagcgcgctccatggtgccacaccaccaattcccaggtccggtgggaatattgcaaaattccatcttgcgactcctctcccgttagtaccgagcaattggcccccactgccccacccgaactgacaccagtcgtgcaagattgttatcatggtgatggacaatcatacaggggcactagcagtacaacaactacgggcaagaaatgtcagtcctggtcttctatgacgccgcaccgtcaccagaaaacaccagagaattatcccaacgccgggctcacaatgaattactgccgaaatcctgacgcggacaagggaccctggtgttttaccaccgaccccagcgtccgttgggaatactgcaatctcaaaaaatgcagtggtaccgaagcctccgtggtcgcaccaccaccagtggtgctcctccctgatgtggaaacaccaagcgaggaagactgcatgttcggtaatggcaaaggctataggggcaagcgggccacaaccgtgaccggcacaccctgccaggactgggctgcgcaggaacctcaccgccatagcatttttacacccgagaccaaccctcgggcagggctggaaaagaactactgcaggaatccggatggggatgtcggcggaccatggtgctatacaacaaacccaaggaagctttatgactattgtgacgtcccacagtgtgctgcaccgagcttcgattgtggcaagcctcaagtggagcccaaaaagtgtcctggcagggtcgtgggtggttgcgttgcacacccccattcgtggccgtggcaggtttccctgcggacccgcttcggtatgcacttctgtggcggcacactgatttcccctgagtgggtccttactgccgcacattgtttggagaaatcaccccgcccttcgtcctacaaggttattttgggagctcatcaggaagtcaatctggagccacacgtacaggaaattgaagtcagtcgcttattcctcgagccaacacggaaagatattgcactcctcaagttgtcatcacctgccgtgattacagataaagtaatccctgcatgcctaccgagtcccaactatgtggtggcagatcggaccgaatgctttattacgggatggggagagactcaaggaacctttggggcaggactcctaaaggaggctcagctgcctgtgatcgagaataaggtgtgtaacagatacgaatttctgaacggacgcgtccagagtacagagctctgcgctggccatctggccggtggaacagactcatgccagggggactccggcggacctctggtctgctttgagaaggataaatacattctgcagggcgtgaccagttgggggctgggttgtgcaaggcctaataaacctggggtgtacgtcagggtaagccgcttcgtcacctggatcgaaggtgtcatgagaaataac

SEQ ID NO: 18229 - DNA, 2430 bp, Artificial Sequence
  Description of Artificial Sequence: Synthetic coding sequence
atggaacacaaagaagttgtactgctgctactgttattcctcaaatcaggtcaaggagagccactagacgattatgtaaatacccagggggccagcttgtttagcgtcactaaaaagcagcttggcgctggctccatagaggaatgtgcggctaaatgtgaggaagacgaggagttcacttgccgcgccttccagtaccatagcaaagagcagcagtgcgtgattatggcagaaaaccgcaaatcaagcattataatccggatgcgcgatgtggttctgtttgagaagaaggtttacctatccgagtgtaaaactggtaatggcaagaactaccggggaaccatgagtaaaaccaagaacggcatcacatgccagaaatggtcctctacttctccccaccgaccgaggttctcacctgctactcacccttccgagggacttgaggagaactactgtcgcaatcctgataacgatccacagggtccctggtgttatacaacagaccctgagaagagatacgattactgtgatattctggagtgcgaggaagagtgtatgcattgttccggggagaattacgacggtaaaatctctaaaacaatgtccgggctcgagtgccaggcgtgggacagtcaaagtccacatgctcacggttacatcccctctaagttccctaataagaatctcaagaagaactattgcagaaaccctgatcgggagctgcgaccctggtgtttcaccactgacccgaataagcgctgggaattgtgcgatattccaagatgtaccacgcctccaccatcttctggccccacctaccagtgtctaaagggtactggcgaaaattacagaggcaacgtggcagtcacggtgagtgggcatacctgtcagcattggtctgcccagacacctcatactcacaataggaccccggagaactttccctgcaagaacctcgacgagaattattgcagaaaccctgacggtaagcgcgcaccgtggtgccacacaactaatagtcaggttcgatgggagtactgcaaaatcccctcttgcgatagctctccagtctcaactgagcaattggctcctactgccccacccgagcttactcctgtggtccaggactgttatcatggagacggtcagagctacaggggcacttctagtaccacaacgaccggcaagaagtgtcagtcctggagcagtatgaccccgcacagacaccagaagacgccagagaactatcccaatgctgggctcacaatgaactactgccgcaatcccgatgccgataaaggtccctggtgctttacaaccgatcctagtgtccggtgggaatattgcaatctgaagaagtgctctggaaccgaggcaagcgtcgtagcacctccccccgtggtcctcctgccagacgtggagactccgagcgaagaggactgtatgtttggaaatggcaagggctaccgtggtaagagggcaacgaccgtcactggaacgccctgccaggactgggcagcccaggagccccacaggcatagcattttcactcctgaaactaacccgagagcaggcctcgaaaagaactactgccgaaaccccgatggggacgtgggagggccttggtgttatacaaccaaccccagaaagctatatgactattgcgatgtgcctcagtgcgccgcacctagctttgactgtgggaagccccaggtggagcctaaaaagtgccccggaagagtcgtcggcggctgtgttgcccatccccattcctggccttggcaggttagtctgaggacacggtttggtatgcacttctgcggtggcacccttatttcgcccgaatgggtgctaactgccgcgcactgtctggagaaatctccgcgcccctcaagttataaggtcatccttggagctcaccaggaggtgaacctggaacctcacgtgcaagagatcgaggtcagccggctgtttctggagcctacaagaaaagacatagccttactgaagctttcatcaccagcggtgattaccgataaggtcattccagcgtgcctcccttccccaaattatgttgtggccgatcgtacggagtgcttcattaccggctggggtgagactcaggggacgtttggagccgggctgctcaaggaggcccagcttcctgttatagaaaacaaagtgtgtaatcgttacgaatttctgaacggcagggttcagtccactgaactgtgtgcaggccacctggcaggcggtaccgacagctgtcaaggcgacagcggggggcccctggtgtgcttcgagaaggataaatatatcctacagggtgtgacatcttggggactcggatgtgctagaccaaacaaacctggtgtgtacgtccgagtttcaaggtttgtcacatggatcgagggggtgatgagaaataac

SEQ ID NO: 18230 - DNA, 2430 bp, Artificial Sequence
  Description of Artificial Sequence: Synthetic coding sequence
atggagcacaaagaagtagtcctactgcttctactcttcctgaaatctggccagggagagcctctggacgattacgtcaatactcagggtgcaagcttattttccgtcaccaagaagcagttgggcgctggcagcatagaggagtgtgcggccaaatgcgaggaggatgaagaattcacctgcagggccttccaataccattctaaagaacagcaatgtgtcattatggcagaaaatagaaagtccagcataataatacgcatgagggatgtcgtcttgttcgagaagaaagtgtacttgtctgagtgtaaaaccgggaacggaaaaaactatcgcggcacaatgtctaagactaaaaatgggattacctgccagaagtggtcctcaaccagccctcatcgccctcgcttttcaccagctacccatccttctgagggcttggaggaaaattactgccgaaaccccgacaacgacccccaggggccctggtgctacacaaccgaccctgagaagcgatacgactactgtgacatcctcgaatgcgaagaggagtgcatgcactgctccggtgagaactacgatggcaagatctctaagacaatgtccggactcgaatgtcaggcctgggactcacaatcaccccacgctcacggctatattccaagtaaattccctaacaaaaatctcaagaagaactactgccgaaaccctgatcgggagttgcgcccatggtgtttcaccacggatccaaataaaaggtgggagctgtgcgacattccgcggtgcaccactccacccccctcttccgggcccacatatcaatgcttaaagggaactggggaaaactaccgaggaaacgtggccgtgaccgtaagcggccatacctgccaacactggagcgcccagactcctcacacccataatcgcacgcctgaaaacttcccatgcaagaacttagacgaaaactattgccgcaaccccgacggaaagcgagcaccctggtgtcataccaccaacagtcaggtgcgttgggagtactgtaagatccctagctgtgacagctcaccggtgtccaccgaacagctggctcctaccgcaccacctgagctgaccccagtggttcaggattgttatcatggcgatgggcagagttatcgaggaacttcaagtaccacaaccaccggaaaaaagtgccagagttggtctagcatgacaccccacagacaccagaaaacacccgaaaactatcctaacgccgggctcactatgaattactgcaggaatccggacgccgataaggggccgtggtgtttcacaactgatccgagcgtaaggtgggagtactgcaacctgaaaaagtgctccggtaccgaggcctctgtggtggctccgccccccgttgtactgctgccagacgtcgagactccctcagaagaggattgcatgtttggaaacggcaaaggttaccgcgggaaacgagccacaacagtcactggaactccctgccaggattgggccgcacaagagccacaccggcattccatttttacaccggaaactaaccctcgggccgggctggaaaagaactactgccgcaacccagacggtgacgtgggaggcccctggtgctatacgacaaacccaagaaaactctatgattactgcgatgtaccgcagtgtgctgcccccagctttgactgtggtaaaccccaagtagaacctaagaaatgtcctgggcgggtggtcggaggttgcgttgctcatcctcactcctggccttggcaggtgtcactgagaacccggtttggaatgcatttctgtggagggacgttaataagccctgagtgggtgctgacagcagcccactgtctggagaagtcacccaggcctagctcctacaaggttattctgggcgcacatcaggaagtcaatctggagccacacgtccaggaaattgaggtctctagattgtttttagagccaacccggaaagatatcgccttgcttaaactctcctcccctgccgtgatcactgataaggttatcccagcctgtctgccaagcccaaattatgttgtcgctgacagaaccgaatgctttataaccggttggggtgagacccaggggaccttcggagctggccttttaaaggaagcccagttgcccgtgatcgagaacaaggtgtgtaatcggtatgagttccttaatggacgcgtgcagagtacagagttgtgtgcaggacacttggccgggggcacggacagctgtcaaggtgacagcggcggaccactcgtgtgctttgaaaaggacaaatatatcctgcagggggtcactagctggggcctcgggtgtgctcgacccaataaaccaggcgtgtatgtaagagtgagtaggttcgtcacgtggatcgagggcgtgatgcgaaacaat

SEQ ID NO: 18231 - DNA, 2430 bp, Artificial Sequence
  Description of Artificial Sequence: Synthetic coding sequence
atggagcacaaggaagtggttctgctgctgctcctgtttttgaagtctggccaaggcgaacctctcgatgactatgtaaatacccaaggggccagccttttcagcgtgacaaagaagcagctgggagccggcagcatcgaggaatgtgcagccaagtgtgaagaagacgaggagttcacctgtagggctttccagtatcactccaaagagcaacagtgtgtgataatggccgaaaatcggaaaagttctattattatcaggatgagagatgtcgtcctctttgagaaaaaggtgtatctctccgagtgtaagacagggaacggaaagaactaccgcggaaccatgtccaagaccaaaaacggcatcacttgccagaagtggtcatccaccagtcctcataggccaagattcagccctgcaacacatccgtccgaaggactcgaggagaactactgccggaatccagacaacgatcctcaggggccctggtgctacacaaccgaccccgagaaacggtacgactattgcgatattctcgaatgcgaagaggaatgcatgcactgttcaggagagaactatgacgggaaaattagtaagacaatgtccggacttgagtgccaggcctgggactcccagtcaccgcacgcccacgggtacattccatccaagttccctaacaaaaatctgaagaagaattattgcaggaatccagaccgcgagttgagaccatggtgtttcaccacagatcccaacaagagatgggaactttgcgatataccacgctgcactacaccccctccatcttctgggcccacatatcaatgcctcaaagggactggcgagaactatagagggaatgtggcggtgactgttagcggtcacacttgccagcactggagtgcgcaaacaccacacactcacaatagaacccctgaaaacttcccatgcaagaacctcgacgaaaattattgtcgaaacccagatggcaagagagccccctggtgccacactaccaactctcaggtccggtgggagtattgtaaaataccatcttgtgactcaagtcctgtttctactgaacagttggcccctaccgctcctcctgagctcacccccgtggtgcaggattgttaccacggagatggtcagagttatcgcggcacctcaagtacaactacaacaggcaagaaatgtcaaagctggagctcaatgactccccataggcaccagaagaccccagagaactaccccaacgcgggactgacgatgaattactgcaggaacccagacgctgacaagggcccctggtgctttacaactgacccctctgttcggtgggagtattgcaatctgaaaaagtgttccggcactgaagcctccgttgtggcccctccccccgtggtgctgctgccggacgtcgagacaccgtcagaagaagattgcatgtttggcaacggaaaggggtatcgaggaaagagggccactacagttaccggaacaccttgtcaggattgggccgcacaagagccccatagacactcaattttcacgcccgaaacaaacccgcgcgcaggacttgaaaagaactactgtaggaatcccgatggcgacgtgggcggtccctggtgctacacgacaaatcctcggaagttgtatgactactgcgacgtgcctcagtgtgccgctccttccttcgactgtggaaaacctcaagttgagcccaagaagtgcccaggcagagtcgtcggcgggtgcgtggcacaccctcattcctggccctggcaggtgagccttcggactaggttcgggatgcacttctgcggagggacacttatcagccctgagtgggtgctgaccgctgctcactgtctggaaaagtccccaaggccatccagctacaaggtcatcttgggcgcacaccaagaagtcaacctcgaaccgcacgtgcaggagattgaggtatctcgcctgttcctggagccaacccggaaagatatcgccctgctgaagcttagcagtcctgccgtgattactgacaaagtaatccccgcctgtcttcccagcccaaactacgtggttgctgacaggacagaatgtttcatcaccggatggggcgagactcagggcacattcggcgccggcctgctgaaagaggctcaactccccgtgatcgaaaataaagtgtgtaataggtacgagtttctgaacggccgcgtgcagtccaccgagctctgcgccggtcatcttgcgggcggcacagattcttgccagggcgactcaggcgggcccctggtgtgtttcgaaaaagacaaatacattttgcagggcgtgaccagctgggggttgggatgcgcacggcccaacaaacctggggtgtacgtgcgcgtctctcgctttgtgacatggatcgagggagtgatgagaaataat

SEQ ID NO: 18232 - DNA, 2430 bp, Artificial Sequence
  Description of Artificial Sequence: Synthetic coding sequence
atggagcataaggaagtggtactcctcctccttcttttcttgaagtccggtcagggcgagccactggatgattacgttaacacacagggagcttcactgttcagcgtaaccaagaagcagctgggcgctggatcaattgaggagtgcgccgctaagtgcgaggaagatgaggagttcacttgcagggctttccaatatcatagtaaggagcaacagtgtgtgattatggcggagaatcgcaagagctccatcatcatcagaatgagggacgtcgtactgtttgaaaagaaagtgtacctgtccgagtgtaaaacaggcaatggcaagaactaccgcggaacaatgagcaaaacaaaaaacggtattacatgccaaaaatggtcctctacttctccgcacaggcctaggttctctcctgccacacaccctagcgagggacttgaagagaactactgccgcaaccctgacaatgacccgcagggtccctggtgttacactaccgacccagagaagagatacgactactgtgacatccttgagtgtgaagaggaatgtatgcactgtagcggcgagaattatgacggcaagatctccaagaccatgtccggattggagtgccaagcgtgggactcccaatctccgcacgctcatggttacatcccctcaaagttcccaaacaagaacctcaagaaaaattactgcaggaaccctgacagagaacttaggccctggtgttttactaccgaccccaacaagagatgggagctgtgtgacattccccgctgtacgactcctccaccctcctccggccccacatatcaatgtctcaaaggaactggagaaaactaccgcggcaatgtggcggtcactgtctcaggacacacttgtcagcattggagcgcccagactccacatacgcacaataggacccccgagaactttccttgcaaaaatctggacgagaactactgcagaaaccctgatggaaagagggccccttggtgtcacaccaccaattctcaggtcagatgggaatactgcaagataccgtcctgtgacagcagcccagtcagtaccgaacagcttgcacccacagctccccccgagcttacccccgttgtccaggattgctaccatggtgacggtcagagttaccgcggaacctcttctactactactaccggcaaaaagtgtcagtcctggagctccatgacgccccacagacaccagaaaaccccagaaaactaccctaacgctggactcactatgaactattgtaggaaccctgatgcggacaagggaccatggtgcttcaccaccgatcctagtgtgaggtgggagtattgcaatcttaagaagtgctccggaaccgaggccagcgtggtcgctcccccacctgtcgtcctgttgcccgacgtggaaacgccaagtgaggaggactgcatgtttggaaacggcaaaggttacaggggtaaaagagcaaccacagtcaccggtacaccttgccaggactgggctgctcaggagccgcacagacacagcatctttacgcctgaaacaaaccctagggctggactggaaaagaactactgccgcaacccagacggcgacgtgggtggtccctggtgttatacaaccaaccctcgcaagttgtacgactattgcgacgttcctcagtgtgccgccccaagcttcgactgcggcaagccgcaagtcgaacccaaaaagtgccctggccgcgtagttggcggatgcgtcgcacacccccatagttggccgtggcaagtctccttgagaactagattcggaatgcatttctgtggcggaacacttatctcccctgagtgggtgttgaccgccgctcactgcctcgagaagagccccaggcccagttcctataaggtcattctgggagctcaccaagaagttaatctggagccccatgtgcaggaaattgaggttagtcgcctgtttctcgaacccacacgcaaagacatagctctccttaagctttcctctcctgcagtcatcaccgataaggtaatccccgcctgcctccccagtcctaactacgtggtggctgacaggacagaatgcttcattaccggttggggcgaaacccaaggcacattcggagcgggacttttgaaggaggcccagctcccagtaattgagaacaaggtctgcaataggtacgagttcctgaatggaagagtccagagtacagaactgtgcgccggccaccttgccggcggcactgactcttgtcagggcgattcaggaggccccctcgtctgtttcgaaaaggacaagtatattctgcaaggagtaacgtcctggggacttggatgcgctaggccgaataagcccggtgtgtatgtcagggtctccaggttcgttacttggatcgaaggagtaatgaggaacaac

SEQ ID NO: 18233 - DNA, 2430 bp, Artificial Sequence; identical to SEQ ID NO: 18226
  Description of Artificial Sequence: Synthetic coding sequence

SEQ ID NO: 18234 - DNA, 2430 bp, Artificial Sequence
  Description of Artificial Sequence: Synthetic coding sequence
atggaacacaaggaagtggtcttgcttcttcttctattcctgaagagcggccagggcgagcccctggatgattatgttaacactcaaggtgcttctctgttttcagtgacaaagaagcagttgggagctggttcaatcgaagaatgcgcagcgaaatgtgaggaagacgaagaatttacctgccgggcttttcaataccattcaaaagaacaacaatgcgtcattatggctgagaacagaaaatcttcaataattatccgcatgagagatgtcgtccttttcgagaaaaaagtgtatctcagcgaatgtaagaccggaaacggcaaaaactaccgcggtaccatgagtaaaactaagaacggtattacttgccagaagtggtcgtctactagcccccacagaccaagattctcgcccgccacccatcctagtgagggactcgaggaaaactattgtaggaacccagataacgatccgcagggcccatggtgttacacaaccgatccagagaaacggtacgattactgcgacatcctggaatgcgaggaggagtgcatgcactgcagtggcgaaaactatgacgggaagatcagcaagacaatgagcgggctggaatgccaggcttgggactctcagagccctcatgcccacggctacattccatcaaagtttcccaacaaaaatctgaaaaagaattactgccgaaaccccgatagagagctgaggccttggtgcttcacgaccgacccaaacaaaaggtgggagctgtgcgatatccccagatgcactacccctcccccttcctctggcccaacctaccagtgtcttaagggtacaggtgagaattataggggcaacgtcgccgtgactgtgtctggccacacctgtcagcattggagtgcccagacaccacacacacataataggaccccggagaactttccttgtaaaaacctggacgagaattattgcagaaacccagatgggaagagagctccatggtgccacactaccaatagccaggttagatgggaatattgcaagatcccatcatgcgatagtagccctgtcagcacagagcagcttgctcccaccgctccacctgaacttactcctgtcgtccaagattgctatcacggcgacggccagagctatcgcggcacctcttctaccaccaccacaggaaagaaatgtcagagttggtcttccatgacaccccacagacaccagaaaacgcctgagaactacccaaacgccggactaacaatgaactattgtaggaaccctgacgctgacaaaggcccttggtgctttaccacggatccaagcgttcggtgggagtattgcaacctcaaaaaatgtagtggaaccgaagctagcgtcgttgccccaccaccggtcgtgcttctgcccgatgtggaaacccctagcgaggaagattgcatgttcggcaatgggaagggctatcggggcaaaagggccaccacagttacaggaacgccatgccaggactgggccgctcaggagccacaccgacacagcatttttactccagagacaaatcctagagctggtctggagaaaaattactgtaggaacccagatggagatgtgggaggaccctggtgctacactaccaatcccagaaagctgtacgattactgcgacgtcccgcagtgcgccgctccaagctttgactgcggaaaaccacaggtcgagcccaaaaagtgccccggccgagtcgtaggcgggtgcgttgctcaccctcacagctggccgtggcaggttagtctgaggacacgattcggcatgcacttctgtggaggaactctgatctctcctgagtgggtgctgactgccgcccactgcctcgaaaagagcccacgaccaagttcttataaggtgatcttgggcgcccaccaagaagtaaacctcgagcctcacgttcaagaaatcgaggtgtcccggttgttcctggaacccacccggaaggatatagccttgcttaagctctcttcccctgcggtgatcacagataaggtgatccctgcatgtttgccttctcccaattatgtagtggcagataggactgaatgttttattacaggctggggcgagactcagggaacatttggagctgggctcctgaaggaggctcagctgccagtgattgaaaataaggtctgtaacaggtacgaatttctgaatgggcgggtgcagagtaccgagctctgtgcagggcatttggcagggggaaccgactcctgccagggggatagtggaggacctctcgtctgctttgagaaggataagtatatccttcagggtgtaacatcttggggcctgggatgtgctcgtccaaacaagcccggcgtttacgtcagagtgtccaggtttgtaacctggattgaaggcgtaatgaggaacaac

SEQ ID NO: 18235 - DNA, 2430 bp, Artificial Sequence
  Description of Artificial Sequence: Synthetic coding sequence
atggagcataaggaggtcgtgctactgctgctcctctttctcaaaagtggtcagggtgaacctttggacgactacgtgaacactcagggggctagcttattttcggttactaaaaagcagctcggcgccggaagcatagaagaatgcgctgccaaatgcgaggaggatgaggagttcacatgcagggcttttcagtaccattcgaaagagcagcagtgtgtcattatggctgaaaatcgcaagagcagcattatcataaggatgcgggatgtcgtgctgttcgaaaagaaagtgtatttgtcggagtgcaaaacaggcaatggaaagaactacagagggacaatgtccaagacaaaaaatggaatcacgtgccaaaagtggagttctacatcgccccaccggccccggttttcacccgccacccacccaagcgaggggctggaggaaaattattgcagaaatccggacaatgatccccagggtccctggtgctacaccacagaccccgagaagcgctacgactattgcgacattcttgagtgtgaagaggaatgtatgcattgttctggcgaaaattacgacgggaagatcagcaagacgatgtccggtctcgaatgccaggcgtgggactcccagtctccacacgcacacggatacattccctctaagttccctaataaaaacttaaagaagaattactgccggaacccagatcgggaattaaggccgtggtgcttcactactgatcccaacaaacgatgggagctatgcgatatcccacgctgtactacccctccacctagttctggccccacttaccaatgtctgaaaggcactggagaaaactatagaggaaacgtggcagtcacagtgtccgggcacacttgccagcattggagtgctcagaccccccatacacacaacaggacgcctgagaattttccgtgcaagaatctggacgaaaattactgcagaaaccccgacggaaagcgggcaccatggtgccatacaacaaacagtcaagtccggtgggagtattgtaagattcctagctgcgactccagccccgtttccacggaacagcttgcacctactgctccgccagagctgacccccgtggtgcaggattgttaccacggtgacggccaatcataccgcggcactagctccacaaccaccaccgggaagaagtgccagagctggtcttcaatgaccccacaccgccatcagaagacgcctgaaaattaccccaatgctggcttgaccatgaattactgccgcaaccctgatgcggataagggaccttggtgttttactaccgaccctagcgtgagatgggagtattgcaacctgaaaaagtgtagcgggactgaggcttccgtggtcgcccctcctcctgtggtcctgctgccagacgtggagaccccctcagaggaggattgtatgtttggaaatggcaaaggctataggggaaagagggcaactaccgtgacaggaacaccttgccaagattgggctgcccaagagccgcatagacactccattttcacacccgagactaaccctagggctggcttggaaaagaattactgcagaaacccagacggcgatgttggcggaccttggtgctacacaactaatccaaggaagctgtatgactattgcgacgtgccccagtgtgccgctccctctttcgattgcggaaaaccccaggtggaacccaagaaatgtcctggtcgggtggttggcgggtgcgtggctcacccacactcttggccttggcaggtctcattgaggacacgcttcggaatgcatttctgcggcggaaccctgatcagtcccgaatgggtgctgacggcagcccattgtcttgagaaatccccaaggccatcatcgtataaagtgatactgggcgcccatcaggaggtaaaccttgaaccacacgtgcaggagattgaggtgagccgactgttcctagagcccaccaggaaggacatagccctcctgaagctgtcctctccagcggtgatcaccgataaagtaatccctgcttgccttccgtctccaaattacgtggtagctgacaggaccgaatgttttatcaccgggtggggcgagacgcagggaacgtttggagcagggctgctgaaggaggctcagctgcccgttatcgaaaacaaagtgtgcaaccggtatgaattcctgaatggaagagtccagtcaaccgagttgtgcgccggtcacctggccgggggaacagactcttgccaaggcgattccggtgggcccttggtgtgctttgagaaagacaagtacattcttcagggagtgacgtcttggggactgggatgtgctaggcccaacaaacctggagtctatgtgagggtctctagattcgtgacatggatcgaaggcgtcatgcgaaataat

SEQ ID NO: 18236 - DNA, 2430 bp, Artificial Sequence
  Description of Artificial Sequence: Synthetic coding sequence
atggagcacaaggaagtggtcctcctgctgctacttttcttaaagtctgggcagggtgagcccctagatgactacgtgaacacacagggcgcatcgctgttctctgtcaccaagaagcagctgggcgccggctccattgaagaatgcgctgcaaagtgtgaagaagacgaggagtttacttgtagagcttttcaataccactccaaggagcagcagtgtgttatcatggctgagaatagaaaatcttccataataattcggatgagagacgttgtgttgtttgagaagaaggtgtacctaagcgagtgcaagacaggcaatgggaaaaactacaggggcacaatgagtaagacaaagaacggcattacttgtcagaagtggagctctacgagcccacacagaccgcgattttcccctgcaacgcatccatccgagggcttagaggagaactattgcaggaaccccgacaacgacccgcaaggcccctggtgttacactactgatccagaaaaacgctatgattattgtgatatccttgaatgcgaagaggaatgcatgcactgctcaggggagaactatgacggaaagatctccaagactatgtctggcctggagtgccaggcttgggattcccaatcaccacacgcgcatggatacattccttctaaattcccgaacaagaacctgaaaaagaactactgcagaaatcctgaccgtgagctccgtccctggtgcttcactacagatcctaataaacgctgggaactttgcgacatcccacgctgcaccaccccgcccccttcaagcggacccacctaccaatgcctgaagggcacaggagagaattatagaggtaatgtcgccgtgacggtctccggccacacgtgccagcattggagtgcccagactcctcacacccataataggaccccagaaaacttcccctgtaagaatctggacgagaactactgccggaaccccgatgggaagcgagccccctggtgtcacacgacaaattcccaggttagatgggagtactgtaagatcccaagctgcgactcctcaccagtcagtaccgagcagcttgctccgactgcaccacccgaactgactcccgtagtgcaggactgctatcacggggacggccaatcttacagagggacctccagcactaccactaccggcaagaagtgccagtcatggagtagtatgactccccatagacaccagaaaacccctgagaactatccgaatgcgggactgacaatgaattactgcaggaaccctgacgctgacaaggggccttggtgcttcacaacagacccaagtgtgcgttgggaatattgcaatcttaagaaatgttctggcacagaagcctcggttgtggcaccacctcccgtggtgctccttcctgatgtggaaaccccgtctgaggaggattgtatgttcgggaacggcaagggctatagaggcaaacgggccacaacagtcacagggactccttgtcaggactgggccgcacaggaaccacatcggcattcaatcttcacacccgagaccaaccctcgtgccggactggagaaaaattactgtcggaaccccgatggggacgttggcggcccatggtgctacactaccaacccccggaagctatatgactactgtgacgtgccccagtgtgcagctccatccttcgactgcggtaaaccccaggtggaaccaaaaaaatgtccagggcgcgttgtcggaggatgtgtggctcaccctcattcatggccttggcaggtcagtctgaggacccgattcggaatgcatttctgcggcggcaccttaatttcacccgagtgggtcctgaccgccgcacactgcctcgagaaaagtccgcggccctctagttacaaagttatcctgggggcgcaccaagaggtgaatttggagccccatgtacaggagatcgaggtaagccgactgtttctagagcccacgcggaaagatatcgccctattgaagttgtccagtcccgcggtcattaccgacaaagtgattcccgcctgtctgccgagccccaactatgttgtcgcagatcggaccgagtgcttcatcaccggctggggcgagacacagggcacatttggagctgggttgctgaaggaagcccaactacccgtgattgagaacaaggtatgcaaccgatacgagttcttgaatggcagggtgcagagcaccgaactgtgcgctggacacctggctgggggtaccgactcttgccaaggtgatagtggtggccccttggtctgtttcgagaaagataagtacatcctccagggggtaacctcgtgggggctcggatgtgcacgtcctaataaacccggggtgtacgtgagagtctcaaggtttgtaacatggatcgaaggcgttatgaggaacaac

SEQ ID NO: 18237 - DNA, 2430 bp, Artificial Sequence
  Description of Artificial Sequence: Synthetic coding sequence
atggagcacaaggaggtggtgctgctcctcctgctgttcctgaagtccggccagggagagccgctggacgattacgtcaatacccagggcgcctcccttttttccgtcacgaagaagcaactgggagccggaagcatcgaagagtgcgcggccaagtgtgaggaggatgaggagttcacctgccgtgccttccagtatcattcgaaggagcagcagtgtgtgattatggccgagaatcggaaatctagcattattataagaatgcgagacgtcgtgctgtttgaaaagaaggtatatttgagcgaatgcaagacgggcaatggcaaaaattaccgaggcacgatgtcgaagacgaaaaatggtattacttgccagaaatggagtagtacgagtccccacagaccgcgtttctcgcctgcaacccatccctcagaagggttggaggagaattactgccgcaacccagataatgacccccagggcccttggtgctacacgactgatccagaaaagcggtacgactattgcgatatcctggagtgcgaggaagagtgcatgcattgctcgggcgaaaactatgacggcaagatctcgaagacgatgtccggtctagagtgtcaagcatgggacagccagagcccgcacgcccacggatacattcccagcaagtttcctaacaaaaacctaaagaagaactactgccgcaacccggatcgagagcttagaccgtggtgttttaccactgatcccaacaagcgctgggaactctgcgacattccacgatgcaccacgccaccaccaagcagcggccctacctaccagtgtctcaagggaacaggtgagaactaccgtggcaatgtggccgtgaccgtgtccggccacacgtgccagcactggtccgcccagacgccccacacgcacaacagaacgcccgagaacttcccctgtaagaatttggacgagaattattgccgcaaccccgatggaaagcgcgcgccctggtgtcacacgactaatagtcaggtcagatgggagtattgcaagataccgtcgtgcgattcctccccggtgtccacggaacagctggccccaacagctcccccagagctgactcccgtcgtgcaggattgctaccacggcgatggccaatcctaccgcggcacgtcttccacaacgacgaccggaaagaaatgccagtcctggagctccatgacaccgcaccgccatcagaagaccccggagaactacccaaatgccggcctgacaatgaattattgccgcaatccggatgccgataagggcccatggtgcttcactactgatccatcggtgcgctgggagtactgcaacctgaagaagtgcagcggcaccgaggcgtctgtggttgctcccccgcccgtcgtactcctgcctgacgtagaaacccccagtgaagaggactgcatgttcggtaacggcaaagggtaccggggcaaaagggccaccaccgtgaccgggaccccatgccaggattgggctgcacaggagccccacaggcactcaatatttacccctgagaccaatccgcgcgctggactggagaaaaactactgtcgtaaccccgacggtgatgtaggtggaccctggtgttacacgaccaacccgcgcaagctgtatgattactgcgacgtgccccagtgcgccgctccctcgttcgactgcggaaaaccccaggtggaaccaaagaagtgtcccggccgggtggtaggcggatgtgtggcccacccccattcctggccatggcaggtaagcctgcgaacccgattcgggatgcatttctgcggcggaacactgatatcccccgaatgggtgctgacagctgcacactgccttgagaagtctccccgtccctccagctacaaagtgattctgggtgcacaccaggaggttaacctggaaccacacgtgcaagagatcgaggtgtcgcgattgtttcttgaacctacgaggaaggacattgctctgcttaagctgagttcgcccgctgttatcactgacaaagttattcctgcctgtctgccatcaccgaattacgtagtggcagatcgtacggagtgcttcatcactggctggggggaaacgcaaggaacatttggggcaggcctgttgaaggaggcccaactgccggtcatagagaacaaggtgtgtaatcgatacgagttcctgaatggaagagtgcagagtactgagctctgcgcaggccatctggctggaggcacagattcctgtcagggtgatagtggtggacccctggtatgcttcgaaaaggataagtacattctgcagggcgtcacgtcctggggtttggggtgcgcgcggcccaacaagcccggagtgtacgtgcgcgtgtcccgcttcgtgacatggatagaaggcgttatgcgcaacaac

SEQ ID NO: 18238 - DNA, 2430 bp, Artificial Sequence
  Description of Artificial Sequence: Synthetic coding sequence
atggaacacaaggaggttgtactgctcttgctcctatttctgaagagtgggcagggtgagccccttgatgactatgtaaacacgcagggtgccagtctgttcagcgtgacaaagaaacaacttggtgctgggtctatcgaagaatgcgccgccaagtgtgaagaggacgaggaattcacgtgcagggctttccagtatcatagtaaggagcagcagtgtgtgataatggccgagaatcggaaaagcagcattatcattcgcatgcgcgacgttgtgctgttcgagaagaaagtgtatctatccgaatgtaagaccgggaacggcaaaaattatagaggaacaatgtccaaaaccaagaacggaatcacgtgccagaagtggtcgtcaaccagcccccatcggcctcgtttttccccggctacccatccgtctgaagggttggaggagaactattgccgaaatcctgacaatgatcctcaaggcccctggtgttacactacagacccagagaaacgttacgactactgcgatatcctggagtgcgaggaggagtgcatgcactgttcaggggaaaactacgacggcaagatctcaaagaccatgagcggcctggaatgccaagcctgggactcacagagtccacacgcccacggatacatcccttctaagtttcctaacaagaacctcaagaagaattattgcagaaatccagaccgggaattgaggccctggtgctttactacagaccccaataagcgctgggaactgtgcgacatcccgcggtgtacaaccccaccacctagtagcggtccaacataccagtgtcttaaaggaaccggggaaaactatcggggcaatgtggctgtcacagtttcaggccacacttgtcagcactggagcgcccagactcctcacacacacaacagaacacctgagaacttcccatgcaagaatctcgacgagaattactgtagaaatcccgacggaaagcgtgccccttggtgccacaccacgaacagccaagtgcgttgggaatattgcaaaattccttcctgcgatagcagtcctgtcagcacggaacaacttgcacccaccgctcctccagagttaacgccagttgtccaggactgctatcatggggacggtcaatcttaccgaggcacaagctccaccacaaccaccgggaagaaatgtcagagctggagctctatgaccccccatcggcaccagaagacacctgagaactacccaaacgctggactaacaatgaattattgccgaaaccccgacgcggacaagggcccttggtgcttcactaccgaccctagcgtgaggtgggagtattgtaatctaaagaagtgcagcggcactgaggcttcagtcgtggccccgcccccagttgttctactgcctgacgtggagacaccgtcggaggaggattgcatgtttggaaatggcaaaggatataggggcaagagggccacaacagtgactggcacaccctgtcaggactgggcagcccaggagccacaccgccactccatttttactccagagacaaatccccgggcaggtctagagaaaaactattgccggaatcctgacggtgatgttggcggtccgtggtgctacacaactaatccaaggaaactatatgattactgcgatgtaccccagtgcgcagcaccaagttttgactgcggtaagccccaggttgagccaaagaaatgccctgggcgggtagtgggtggatgtgtcgcccatcctcattcgtggccatggcaggttagcctgaggacaagattcggcatgcacttctgtggcggaaccctgatctctcccgagtgggtactgaccgcggcacattgcctggaaaagtccccgcgcccttcctcctacaaggtgatcctcggcgctcaccaagaagtgaatcttgagcctcacgtgcaagagattgaggtcagtcggctctttcttgagcccacccgcaaagatatcgctctgctgaagttgagttctcctgctgttataaccgataaagttatcccagcatgcctgccctcacccaactatgtggtggcagatcgcacagagtgcttcattaccggttggggggagacccagggaactttcggagccggcctcctaaaagaggcacagctccccgtgatcgaaaataaagtgtgtaaccggtatgagttccttaatggaagggtacagtccaccgaactgtgcgccggccatttggctgggggaactgattcatgccagggcgactcaggaggaccactggtttgtttcgagaaggataaatatattctgcaaggcgtgactagctggggtctgggttgtgcgcgtcccaacaaaccaggagtttatgttagggtatcccggttcgtgacatggatcgagggtgtgatgcgcaacaat

SEQ ID NO: 18239 - DNA, 2430 bp, Artificial Sequence
  Description of Artificial Sequence: Synthetic coding sequence
atggaacataaggaggtagtgcttctcctgctgctgtttctcaagtccggacagggtgagccactggatgactatgtgaatacacagggcgcctcattgtttagcgttaccaagaaacaattgggagcaggttccatcgaggagtgtgctgcaaagtgtgaagaggatgaggagttcacctgtagggctttccaataccacagtaaggagcagcagtgcgtaatcatggctgagaataggaagtcatccatcattatccgtatgagagatgtggtcctctttgagaagaaggtgtacttgtccgaatgcaagaccggaaacggcaagaactataggggcactatgtcaaaaaccaagaatggaatcacatgccagaaatggtcctctactagtccacatagacctcgcttctcacctgcaacccatccatcagagggtctggaagagaattactgtaggaaccccgataacgatccccaaggcccttggtgttatactaccgatcccgaaaagaggtacgactactgcgacatcctggaatgtgaggaggagtgcatgcactgtagtggtgagaattatgatggcaagatctctaagacaatgtctggcttggaatgtcaagcctgggacagccaatcacctcacgctcatggatacattccctctaagtttcctaataagaatttgaaaaaaaattattgtcgtaatcctgatcgtgagctgcgtccctggtgtttcactacagaccctaataagcgttgggaactgtgcgacatcccccgttgcacaacccctcctccatccagtggtccaacataccagtgtctcaagggaacaggcgaaaactaccgcggaaacgttgcagtgaccgtgagcggccacacatgccagcactggagcgctcagacacctcacacacacaacagaacccccgagaacttcccctgcaagaacttggatgaaaattattgcagaaatccagatggaaagcgcgctccatggtgccacaccactaattcacaggtccgttgggaatactgcaagatcccatcatgcgactcctctccagtctctacagagcaactggcacctaccgcaccaccagaactcacacccgtggttcaagactgctaccatggagatggacaaagttacaggggtacctcatccacaactactaccggtaaaaaatgccagtcttggtcttccatgaccccccacagacaccagaagacccccgaaaactatcccaatgccggtctcacaatgaactactgcaggaaccccgatgctgataaaggtccatggtgcttcaccacagatcccagtgttaggtgggagtactgtaacctcaagaaatgctccggtacagaagcttctgtcgtcgcacctccccccgtggtgctgctccccgacgttgaaactcctagcgaagaggactgtatgttcggtaacggcaagggctacaggggaaaacgtgctaccactgttaccggaaccccatgtcaggattgggcagcccaggaaccacatcgtcactcaatcttcacccccgagacaaacccacgtgctggactcgaaaagaactattgtaggaatcctgatggagacgtcggaggcccatggtgttacaccaccaacccccgcaaactctacgactactgcgatgtcccacagtgtgcagctccctctttcgactgtggtaagccccaggtagagcccaagaaatgccccggcagggtcgtcggtggttgcgtggctcaccctcactcctggccttggcaggtttccctgcgtacccgctttggcatgcacttttgtggtggtactttgatctctcccgaatgggtcctgaccgctgcccattgcctggagaagtccccacgtccctcttcctacaaagtaatactgggagcccaccaggaagtgaatcttgaaccacacgtgcaagagatagaggtgagcaggcttttcctggagcccactagaaaggacattgctctcctcaagttgtcttctcctgctgttatcactgataaagtaattcctgcctgtctccccagccctaactacgtggtggcagataggacagaatgctttatcacaggatggggcgagacacaaggaactttcggcgccggcttgctgaaggaggcccagctgcccgtaatcgaaaataaagtgtgcaaccgttacgagttcctcaacggtagagtgcagtctaccgaattgtgtgcaggccatctcgctggaggtactgattcctgccagggcgattctggaggtcctctcgtgtgcttcgagaaagacaagtacatcctccaaggtgtaacctcttggggccttggatgtgccaggcccaataagcctggagtgtatgtcagggtatctcgcttcgtgacttggatcgaaggcgtcatgcgtaataac

SEQ ID NO: 18240 - DNA, 2430 bp, Artificial Sequence
  Description of Artificial Sequence: Synthetic coding sequence
atggaacataaagaggttgtgctgctgctgcttctttttctgaaatccggccaaggggaaccactcgacgactatgttaacacccaaggcgcctccctttttagtgtgacgaagaaacagctgggggcaggatctatagaggagtgtgctgccaaatgtgaagaagatgaagagtttacttgtcgtgccttccaataccacagcaaggaacagcagtgcgtgattatggccgaaaacagaaaatctagtataatcattcgtatgagggacgtggtgctattcgagaagaaagtctacctgtctgagtgtaaaactgggaatggcaagaattaccgaggcactatgtccaaaacaaaaaatggcataacctgccaaaagtggagctccacttctcctcatcgtcccagatttagtcccgcaactcacccttcagaaggccttgaggaaaactactgtcgaaaccccgataatgaccctcaggggccttggtgctacaccacagacccggaaaaacgttacgactattgtgacatcctggaatgcgaagaagagtgcatgcactgctcaggggagaactacgacggtaaaataagtaagactatgagtggcttagaatgtcaggcttgggattcccagtccccccatgctcacgggtacataccttctaagtttccgaataaaaaccttaaaaagaattactgccgcaatcctgatcgagaacttaggccttggtgtttcactaccgatcctaataaacgctgggagctgtgcgacatcccaagatgtaccacacctccccctagctctgggccaacttatcagtgcttgaagggcactggcgagaactacaggggcaacgtcgccgtaaccgtgtctggccatacttgccagcactggtcagctcagacccctcatacacataaccgcacacctgagaactttccttgtaaaaatctcgacgagaattattgccgcaacccagacgggaagcgggcaccctggtgtcataccaccaactcacaggttaggtgggagtactgtaagatcccatcatgtgactcatcccctgtaagtacagagcaactggctcctaccgctcccccggagttgactccagtggtccaggattgctatcatggtgacggtcagtcatacagaggtacgtcatccactaccactacaggtaaaaaatgccagagttggtcctccatgaccccacatcgccaccaaaaaactcccgagaactaccccaacgctggactcacaatgaactactgccgcaaccccgatgccgacaaaggcccatggtgctttacaaccgacccctcggtcaggtgggagtattgcaatctgaagaaatgttctgggaccgaggctagtgtggttgcgcccccccctgtcgtgctgctacctgacgtggaaaccccttcagaggaggattgtatgtttggaaacgggaaggggtaccggggcaaaagggcaaccacagtaacggggaccccttgtcaagattgggcagcacaggaacctcatagacatagcatctttacccctgaaaccaatccccgcgctgggctggaaaaaaattattgccgcaacccagacggcgatgtcggaggcccttggtgctataccaccaatccccggaaattatacgactattgcgacgtgcctcaatgtgcagcaccatcttttgattgtggaaagccgcaggtggaaccaaagaaatgcccgggacgagtagtgggtgggtgtgttgcacatccgcattcttggccctggcaggtaagcttgagaacacgctttgggatgcatttctgcggcggcaccctgatttcaccggagtgggtcctgactgcagcgcactgcctggaaaaatcgccgcggccttccagttataaagtcattctgggtgcacatcaggaagtgaacctggaaccgcacgtgcaggaaatcgaagtcagcagactattcctcgaacctaccaggaaggatatcgcactgctcaagttgtccagtccggccgtgatcacagacaaagtgatccccgcttgtctgccatcacctaactacgttgtcgcagaccgcaccgagtgtttcatcacaggatggggagagacccagggaacttttggtgctggattactcaaagaggcacagctgccagtcattgaaaacaaggtgtgtaaccgatacgaattcttgaatggaagagtccagtctacagaattatgcgccgggcatttggctgggggaacggactcttgccagggggatagtggcggcccactagtgtgctttgagaaggacaaatacatcctgcagggtgtgacctcctggggtctcggctgcgcccggcccaacaagcctggcgtgtacgtgagggtttctcggttcgttacatggatcgagggtgtgatgagaaataac

SEQ ID NO: 18241 - DNA, 2430 bp, Artificial Sequence
  Description of Artificial Sequence: Synthetic coding sequence
atggagcacaaagaagtcgtgctgctcctcctcctctttctcaaatccgggcagggtgagcccctggacgactacgttaatacccagggcgccagcctctttagtgttacgaaaaaacagcttggagccgggagcattgaagaatgtgcggccaagtgtgaggaagatgaagagttcacatgtcgggccttccagtaccactctaaggaacagcagtgcgttattatggccgagaatcgcaagtcgagtatcatcatccgcatgcgagacgtggtgttgttcgagaagaaggtgtacctgtccgaatgcaaaactggcaatggaaaaaattatcggggaactatgagcaagactaagaacggaatcacctgccagaaatggtcatctacctctccccacagacctcgattctccccagccacccacccaagcgaggggctcgaagagaattactgtaggaaccccgacaatgacccacagggcccgtggtgttataccactgaccctgagaagcggtatgactactgtgatatcctcgagtgtgaggaggagtgtatgcattgcagcggagaaaactatgatggaaaaatctctaagacaatgtctggcctcgaatgtcaagcctgggattcacaaagtcctcatgcgcacggttacatcccttccaaattcccaaataaaaacctcaaaaaaaattattgtcgtaatcctgatagggaattaaggccatggtgtttcacaaccgacccaaacaagcggtgggaactgtgtgacatcccccggtgcacaactccccccccatctagcggccccacctatcagtgcctgaagggaacaggcgaaaactaccggggtaacgtggccgtaactgtgagcgggcatacgtgccagcattggagcgcgcagacaccgcacacgcataacaggacccccgagaatttcccatgtaaaaacttggatgagaattattgtaggaacccagacggcaagagggctccctggtgtcacaccacaaattctcaggtgcggtgggagtattgcaaaattcccagctgtgacagctctcccgtctcaactgagcagctagcaccgacagctcccccagagctaactccagtagtacaggattgctaccacggcgacggccagagctataggggtacctcatcaaccactactaccggcaaaaagtgtcaatcctggagctctatgaccccccatcggcatcagaagaccccagagaactaccctaacgccgggctcaccatgaattattgtcgcaatcccgacgccgacaaaggcccttggtgcttcacaacagaccccagcgtcaggtgggagtactgcaacctgaaaaaatgctctggcacagaagcatctgttgttgcaccccccccggtagtacttctcccagacgtggagactccttctgaggaggactgcatgttcggaaatggtaagggataccgaggcaagagagctaccaccgtgactggcacaccctgccaggactgggcagctcaggagccccacaggcatagtattttcacacccgagacaaacccaagggccgggctggaaaagaattactgtcggaatcctgacggggacgtcggcgggccatggtgttacacaactaatcctcggaagctttatgactattgcgacgtcccacaatgtgcagccccatccttcgactgtggcaagccccaggtagaaccgaagaaatgtcctggacgagtggtaggcggctgtgttgcccacccccatagctggccctggcaggtgagtctaagaaccagatttggcatgcacttttgtggcggcacactaatctccccagagtgggtgctcactgccgcccattgcctcgaaaaaagccccaggccctccagctacaaagtgatcttgggggcacatcaggaagtgaatttggaacctcacgtccaggagatcgaagtgtcaagactgtttctcgagccgaccaggaaagatattgcactcctcaaactgtccagcccggctgtcatcacagacaaggttattcccgcatgtcttccaagtcccaattatgtagtagcagacaggaccgaatgcttcataactggctggggtgagactcagggaactttcggagcgggcctccttaaggaggcccagctcccagttatagagaataaggtatgtaatcgctatgaatttttgaatggtcgggtgcagtctacagaactttgtgcaggacacctcgcgggcggaacagactcttgccagggtgactcgggcgggccccttgtttgtttcgaaaaggacaagtatatccttcaaggcgtgacctcctggggattgggttgtgctcggccgaataagcccggagtgtatgttcgggtctcccggttcgtgacatggattgaaggggtcatgagaaacaat

SEQ ID NO: 18242 - DNA, 2430 bp, Artificial Sequence
  Description of Artificial Sequence: Synthetic coding sequence
atggaacacaaagaggtggtactactcctgctgctattcctcaaatctgggcaaggtgagccgctggatgactacgttaacactcaaggagctagcctgttttccgtgacaaagaaacagctgggcgccggatctattgaggagtgcgcagccaagtgtgaagaagatgaggagttcacctgtagagcattccagtaccattccaaagaacaacagtgtgttattatggcagagaaccgaaagtcgtcaatcattattagaatgcgtgacgtagtcctgttcgaaaaaaaggtatacttaagcgaatgcaagacggggaacgggaagaactatcgaggcactatgtccaagaccaaaaatggtattacatgccagaaatggagttctacctctccccataggcctcgtttttctcccgctacccacccttcagaaggattggaggagaactattgcagaaacccagataatgacccccagggaccttggtgttacacaacagacccagagaagaggtatgattactgcgacatcctcgaatgcgaagaggaatgcatgcactgctccggcgagaattacgacggcaagatttctaagaccatgtcaggattggagtgtcaggcgtgggactctcagagtccgcacgctcatggatatatcccttctaaattcccgaacaagaacctcaagaagaattattgtcgaaatccggatagggaactgcggccttggtgttttactactgacccaaacaagagatgggagttgtgcgacattccacgttgcaccacccccccccctagctccgggcctacctatcagtgcttgaaggggacgggagaaaactataggggcaacgtggctgtcacggtgagtggccatacatgccaacattggtcagcacagacccctcacacccacaatagaaccccagaaaatttcccctgcaaaaatcttgacgagaattattgcaggaatcccgatgggaaaagggctccatggtgccacacaaccaactcacaagtcagatgggagtactgcaaaattccttcttgcgacagttcgccagtgtccacagagcaactggcaccaactgcacctcccgaactgacgcccgtagtacaggactgctatcacggcgatggccagtcctacagagggacatccagcacaacgaccactggcaagaagtgtcagtcctggtcttccatgacccctcatcgccaccagaagactcctgaaaactatcctaacgctggattaaccatgaattactgccgaaatcccgacgcagacaaaggaccatggtgtttcaccaccgacccctccgtgcgatgggaatattgcaacttgaaaaagtgttctggtaccgaggccagcgtggtggcgcccccacctgtggtcctgcttcctgatgtagagacgccatccgaggaggattgcatgtttggcaatgggaaaggatatcgcgggaagcgcgcaactaccgtcacagggacaccgtgtcaggactgggcagctcaagaaccccataggcattcaatcttcacacccgagactaacccccgcgcgggactggagaaaaactattgccgtaacccagatggggacgtcggtggaccgtggtgctacacaaccaatccacgaaaactgtacgattactgcgatgtgcctcagtgtgcagcgccgagctttgattgtggtaagccccaagtcgagcccaagaaatgcccaggacgcgtagtaggaggctgtgtagcccatccccatagctggccatggcaggtcagtctgcgaactcggttcggtatgcatttttgtggcggcacccttatttctcctgaatgggttctcactgcagcacattgcctcgaaaaatccccacgaccttccagttataaggtgatattgggagcccatcaagaggttaacctagagccccacgtgcaggaaatagaagtctcacgattatttcttgaacctactcgaaaagatatcgcccttctcaaactctcttccccagcggttattactgacaaggtgattcccgcctgcctgccatctcccaattacgttgtggctgataggacggaatgcttcatcaccggctggggcgaaactcaggggactttcggtgcaggcctccttaaggaggcccaactgccagttattgaaaataaggtttgtaatcgatacgaattcctgaacgggcgagtgcaatccaccgaactgtgtgcgggacacctggcgggaggaacagatagttgtcagggcgattcaggcggtcctctggtctgctttgaaaaagataaatacattttgcagggcgtgacaagttggggactcggctgcgcccgaccgaataaaccaggagtgtacgtgagagtttcccgctttgttacctggatcgaaggtgtgatgagaaataac

SEQ ID NO: 18243 - DNA, 2430 bp, Artificial Sequence
  Description of Artificial Sequence: Synthetic coding sequence
atggagcataaggaagtggtgctgctgctcttgctgtttttgaagagcggccaaggtgagcctctcgacgattacgtcaatacacagggagcctccttattcagcgtaaccaagaagcagctgggcgccggatctattgaggaatgtgccgccaagtgcgaggaggatgaagagttcacctgccgtgctttccaataccattcaaaagagcagcaatgcgtcattatggccgaaaaccgaaaatcatccatcatcatccgtatgcgagacgtcgttttatttgagaagaaggtgtatctgtctgagtgtaaaactggtaatggcaagaattaccgtggcaccatgagcaagaccaagaatggcatcacatgtcaaaagtggtcaagcacatcaccccacagaccccgcttcagccctgctacccaccccagcgaggggctagaagaaaactattgtcggaaccccgacaacgacccccagggtccctggtgctacactacagacccagagaaaaggtatgactactgtgacattctggagtgtgaggaggagtgtatgcactgctccggggagaattacgacggtaaaatctctaaaactatgagtgggctggagtgccaggcctgggactcacagagtccacatgctcacggctacatcccgagtaaattccccaataagaacctcaagaagaactactgtcgaaacccagatcgtgaattgcgcccatggtgtttcaccaccgaccccaacaagagatgggaactatgcgacatcccacgttgtactactccaccaccctcatccgggcctacataccagtgcctcaagggaacaggggagaattatcgaggaaatgtagctgtcacagtaagcgggcacacttgccaacactggtctgcccagacccctcacacccataatcggacacctgagaatttcccatgtaaaaacctagatgagaattactgcagaaaccctgacggaaaacgggctccttggtgtcacacaactaactcccaagtgcgctgggagtattgtaaaattccatcctgcgattcctcaccagtctccaccgagcagctcgctcctacagctcctcccgagcttacccccgtggttcaagattgttaccatggggacggacagtcttacagaggcacaagtagcaccactaccactgggaagaaatgtcagtcatggagctccatgaccccacataggcatcagaagacgccagaaaactaccccaacgccggactcacaatgaactactgcaggaaccccgacgcagataagggaccctggtgtttcaccactgacccgtctgtgagatgggagtactgcaatttgaaaaaatgttcgggtactgaggccagcgttgtggctccgccaccagtggttctgctgccagacgtggagaccccatccgaggaagattgcatgtttggcaatggcaaaggttatcggggcaagcgtgctacaaccgtgactggcaccccatgtcaggactgggcagcacaggagccacataggcactccattttcacccctgaaacaaaccctcgcgcgggcctggaaaagaactactgtcgtaatcccgacggggacgttggcgggccctggtgttataccacaaatccgaggaaactgtatgattactgtgacgttccgcaatgtgcggcaccctctttcgactgtggcaagcctcaggtcgagccgaagaaatgccctgggagggtggtaggtggctgtgtcgcccatccacattcgtggccttggcaagtctcactccggacacggtttggcatgcatttctgtgggggaacattgattagcccagaatgggtactgaccgcagcacattgtctggagaaaagtccgcggcctagctcatataaagtcattttgggggcccatcaggaagtgaacctcgagcctcatgtccaggagattgaagtctctcgtctctttctggaaccgacacgtaaggacattgcccttctgaaactttccagccccgctgtgattacggataaggtgattcccgcatgtctcccctctccaaactacgtggtggctgaccgaacggagtgcttcatcaccggttggggtgaaacacaggggacattcggcgccggcttgctaaaagaggcccagctgcctgttatagagaataaagtgtgcaatcgttatgagttcttaaatgggagagtccagagtacagaattgtgtgcaggccatttagctggcggtacagatagctgtcagggtgattcaggcggccctctggtttgctttgagaaggataagtacatcttgcagggagtgacaagttgggggcttggttgcgcgcgtccaaacaagcccggcgtctacgtgcgggttagtcgttttgtgacctggatcgagggtgttatgaggaataat

SEQ ID NO: 18244 - DNA, 2430 bp, Artificial Sequence
  Description of Artificial Sequence: Synthetic coding sequence
atggagcacaaggaagtcgtgctgctactgctactgttcttgaagtccggacagggagaacccctagatgactacgttaacacccagggagcatctctgttcagcgtgacaaagaaacagctcggggccggtagtattgaagaatgtgctgcaaaatgcgaggaagacgaggagttcacgtgccgggcattccaataccattccaaggagcagcagtgtgttatcatggccgagaaccgaaaatcttccatcattattcggatgcgcgacgtggtcctgttcgaaaagaaggtgtatctctccgagtgcaaaaccggaaatggcaagaattataggggaaccatgtctaaaaccaagaacgggattacctgtcagaagtggtccagcaccagtccccaccggcccaggttttctcctgcaacacacccaagcgagggtctggaagaaaactactgtcggaacccagacaatgatccccagggcccgtggtgctataccacggaccccgagaagcggtacgactactgcgatatcctggagtgcgaggaggagtgtatgcattgtagcggcgaaaattacgatgggaagattagcaaaaccatgagtgggcttgagtgtcaggcctgggattcccagtctccacatgctcacggatacataccctctaaattccctaataagaatctgaagaagaactactgtcggaatcctgatagggagctgaggccatggtgttttacgacagaccccaacaagcggtgggaactgtgtgacatcccacgttgtaccacaccgccaccctcgagtggacccacctaccaatgtttgaaggggacaggcgagaactaccgcgggaacgtggccgtgaccgtgtcaggccatacatgccagcattggtctgcccagactccccatacacacaataggacccccgagaacttcccatgcaaaaacctagatgaaaattactgtagaaatccagacggcaaaagagcgccttggtgtcacactactaacagccaggtccggtgggaatactgtaagatccctagttgcgatagttctcccgtgagcacagagcagctagctcccaccgcacccccagaacttacacccgtggtgcaggattgctaccacggggacggccaatcttaccgggggacctcctctacgactaccacaggaaagaaatgtcaatcttggtcctcaatgacacctcaccggcatcagaagacccctgagaactatccgaatgctgggctgaccatgaactattgccggaatcccgacgcggataagggcccctggtgttttaccacggatccctctgtcaggtgggagtactgtaatctaaagaagtgtagtggcaccgaggccagcgtcgtggccccgcctccagttgtacttctgcccgatgttgagacaccctccgaagaggactgcatgtttggaaacgggaaggggtatcgaggaaaacgcgcaaccaccgttaccggcactccctgccaggactgggccgcgcaggagcctcacaggcacagcatcttcacgccagagacgaacccacgggctgggctggagaaaaattactgccggaacccagacggggacgtcggcggcccatggtgttacacaactaacccgcggaaactctacgactactgcgatgtgcctcagtgcgccgcacctagcttcgattgtgggaagcctcaggtagaacctaagaagtgtcctgggcgggtcgtcggaggatgtgtggcccacccccactcctggccttggcaagtgtccctgcggactagattcgggatgcatttctgtggaggcactcttatttcccccgaatgggttctgaccgcagcccattgtctcgaaaaaagcccacggcctagcagctataaggtaatcctgggagcgcaccaggaggtgaacctcgaaccccacgttcaggaaattgaagtgtcaaggttatttctggagcccacccgcaaggatatagcactgcttaagctctcttctccagccgtgattacagataaagtgattcccgcttgcctgccttcacccaactatgtagtcgcagatcgcaccgaatgcttcattacgggatggggcgagacgcagggaacctttggtgcaggcctactaaaagaggctcagctgcctgtgatcgagaacaaggtttgtaaccgctacgagtttctgaacgggcgagttcagtccacagaactgtgcgccggtcatctcgcaggcgggacagattcttgtcagggggacagcggcgggcccctggtatgcttcgaaaaggataaatacattctccaaggcgtgactagctggggcctgggctgcgcacggcctaataaaccaggagtctatgttagagtctcaagatttgttacttggatagagggggtgatgcgtaataat

SEQ ID NO: 18245 - DNA, 2430 bp, Artificial Sequence
  Description of Artificial Sequence: Synthetic coding sequence
atggagcacaaagaggtcgtactgcttctgcttctttttctcaaatcagggcaaggcgagcctcttgatgattacgtgaacacccagggcgctagtctgttcagtgtaactaaaaagcaactaggagccgggtcaatagaagagtgtgctgcgaagtgcgaggaagatgaagagttcacttgtcgcgctttccaataccactctaaagagcagcagtgcgttatcatggcggaaaatcggaagtcttcgataatcatccgcatgagggatgtggtgctcttcgagaaaaaagtatatttgtccgaatgcaagactggcaatggtaaaaactaccggggaactatgtccaaaacaaaaaatggaataacatgccagaagtggtcatcaactagcccacacaggcctcggttcagtcccgccacccacccatctgaggggctggaggagaactactgtagaaaccctgataatgatccccagggcccttggtgttacaccacggacccagagaaaagatacgattattgcgatattctggaatgcgaagaggaatgtatgcactgcagcggtgaaaactatgatgggaagatcagcaaaacaatgagtgggctggaatgccaggcctgggacagtcagtcaccccatgctcacggatacatcccatcgaaattcccgaacaagaaccttaagaagaactactgcagaaaccccgacagggagctccggccttggtgctttaccaccgatccaaacaaacgctgggaactctgcgatattccgagatgtacaaccccacctcccagcagcggaccaacctaccagtgcctgaagggcacaggagagaactatcgtggaaacgtcgccgtgacggtctctgggcacacttgtcaacattggagtgcgcagacaccacacactcacaacagaactcctgaaaacttcccatgtaagaacctggacgaaaattattgccggaaccctgatggtaaacgcgccccttggtgccatacaacgaacagccaagtgcgctgggagtactgtaaaatcccaagctgcgattcaagtccagtttctactgaacagttagcacccacagcgccaccagagctcaccccagtagtgcaggactgctaccatggcgacggtcagagctacaggggtacttcaagcactaccaccacaggcaaaaagtgccagtcatggagtagcatgacccctcacagacaccagaagaccccagagaactatccaaacgccggccttaccatgaactattgcagaaatccagatgcagacaagggaccatggtgtttcaccactgatccctcagtccgttgggagtactgtaacctcaaaaagtgctcgggcactgaggccagtgtcgtcgctcctcctccagtcgtcctgttgcctgatgtggaaacaccatctgaagaagactgtatgtttggtaacggcaaaggctacagggggaaacgcgccactacagtgacgggcactccatgccaggactgggcagctcaggagccacataggcattccatcttcacacccgagacgaacccacgggctggccttgagaaaaattactgtcgcaacccggacggggacgtcggcggaccatggtgctataccacaaaccctcggaaactgtacgattactgcgacgtccctcaatgtgccgcaccttcttttgattgcggaaagccacaggtggaacccaaaaaatgtcctgggcgtgtcgtcggcgggtgtgtggcacacccacatagttggccctggcaggtgtctctgaggactaggtttggaatgcacttttgcggcggcaccttgatttctccagagtgggttctgaccgctgctcactgcctggaaaaatccccccgaccgtcaagttataaagttatcctgggcgcccaccaggaggtaaacctcgaacctcatgtacaagaaatcgaggtcagccgcctgtttctggaaccaacgcgcaaagatattgctctgctgaaacttagttccccagcagtgataacggataaggttattccagcctgtcttccatctcctaattacgttgtggctgaccgcacggaatgttttatcaccgggtggggcgaaactcagggtacattcggcgctgggctgctgaaggaagcccaattgcctgtgattgagaacaaggtatgtaataggtacgagtttctgaacggacgcgtacagagcaccgagctgtgcgccggacaccttgccgggggtacagattcatgtcagggtgattccggagggccactggtttgcttcgaaaaggacaagtacatcttgcagggggtcacttcttggggcctgggatgcgctcgcccaaacaagcctggggtttacgtcagggtgtcgcgcttcgtgacgtggatagaaggagtcatgagaaacaac

SEQ ID NO: 18246 - DNA, 2430 bp, Artificial Sequence
  Description of Artificial Sequence: Synthetic coding sequence
atggaacataaagaggtggtgctgctgctactgttgttcttgaagtccgggcagggggagcccctcgacgactacgttaacacccaaggcgcctctcttttcagtgtcacgaagaagcagctgggcgctggatctatcgaagagtgcgcagcgaaatgcgaagaggacgaggagttcacctgccgggccttccagtatcactccaaggaacagcagtgcgtgatcatggctgaaaatcgtaaatcttccatcatcattcgtatgagagatgtggtgctcttcgagaagaaggtgtacctctcagagtgtaaaacggggaatggtaaaaattatcggggcaccatgagcaaaacaaagaacggtatcacttgccagaaatggtcctctacgtcaccccaccgcccccgttttagccctgctactcatccctccgaaggtttggaagagaactactgccgcaatcctgataatgatcctcagggcccgtggtgttataccaccgacccagaaaaacgctatgactactgtgatattctcgaatgcgaggaagagtgtatgcactgttccggagaaaactacgatggcaaaatcagcaagaccatgtcaggccttgagtgtcaggcgtgggattcgcaatccccccacgctcacggttacataccgtcaaagttccccaataaaaatttgaagaaaaactattgcaggaatcctgacagagagctgaggccatggtgtttcaccactgatcctaacaagaggtgggagctgtgtgacattcccagatgcactacaccgcctccttcatctggccctacctatcagtgcttgaaggggacgggggagaactatagaggtaacgtggctgtgacggtcagtggccatacatgccagcactggagcgcacagaccccacacactcacaatagaacacccgaaaacttcccctgcaagaacctggacgagaactattgtcgcaaccctgatggtaaaagagcgccgtggtgtcacacaactaattcccaggtccgatgggagtattgcaaaatcccttcatgtgactcaagccctgtgagcacagagcagctggccccaaccgccccacctgagctgaccccagtggtgcaagattgttaccacggagatggccagagctataggggcacatcttctaccactacaacaggtaaaaagtgccagtcatggtcatcaatgactccccatagacaccaaaagacacccgaaaattaccctaatgctggtctgactatgaactactgtcgcaatcctgacgctgacaaaggaccctggtgctttacgacggacccctcagtcaggtgggagtactgcaacctcaaaaaatgcagcggaaccgaagcttctgtggtagctcccccccccgtggtgcttcttcccgatgtggaaacaccatctgaggaagactgtatgtttggcaacggcaaaggatatcgcggcaagcgggcaactaccgtgaccggaaccccttgtcaggactgggccgcccaggaaccacaccgccatagcatctttaccccagagacaaacccaagagcgggacttgagaagaactactgtagaaatcccgacggcgatgtggggggaccctggtgctacactaccaatccaaggaagctctatgattactgtgacgtgccacagtgtgctgccccatcctttgattgtggcaagccccaggtcgaacctaaaaagtgtcccggtcgtgtagtgggtggctgcgtggcccacccacacagttggccttggcaggtgagcctgaggacacgatttggcatgcacttctgcgggggaaccctgatctcccctgagtgggtgctgactgccgctcactgcttagagaagtcaccaagaccaagctcatacaaagtgatcttaggagctcaccaagaagtgaatctggagccccacgttcaagaaatcgaggtgtccagactgttcctggaaccaacccgcaaggacatcgccctcctcaagctgagttctcctgccgtgattacagacaaagtgatccccgcctgcctaccatcacctaactacgtggtggccgatcggacagagtgctttatcacgggctggggagaaactcaaggcacctttggtgccgggctgcttaaggaagcccagcttcccgttatcgagaacaaagtgtgcaatcggtacgaattcttgaacggccgggtgcagtccactgaattgtgcgcagggcacctggcgggcgggactgatagctgtcagggtgactcgggcggtcctctcgtgtgttttgaaaaagacaagtatatcctacaaggcgtgacatcctggggcctggggtgcgcgcgccctaacaagcccggcgtctacgtccgcgtctctcggttcgtgacgtggattgaaggtgtcatgcggaataac

SEQ ID NO: 18247 - DNA, 2430 bp, Artificial Sequence
  Description of Artificial Sequence: Synthetic coding sequence
atggagcacaaggaggttgtccttctcttgttgctgtttttgaaatcggggcaaggggaacctttggatgattatgtcaatacacaaggggcttcgctcttttccgttaccaagaaacagttgggagccggatcaattgaggagtgtgctgcaaagtgcgaggaggatgaagaattcacctgtcgagctttccagtaccattctaaagaacagcaatgcgttatcatggccgaaaataggaaaagcagcataataataagaatgcgtgacgttgttctctttgaaaagaaggtctatctttctgaatgcaagacaggaaatggaaagaactatagaggtaccatgagcaagactaagaacgggattacatgtcagaagtggtccagtacctcccctcataggccgagattctcacctgccacccatccctcagagggtcttgaagaaaattactgccgcaacccggataacgatccccagggtccgtggtgttataccaccgatccagagaaaagatacgattattgtgatatcttagagtgcgaagaagaatgtatgcattgttctggagagaactacgacgggaagatatctaagacgatgtccgggttagagtgtcaggcctgggactcccaaagcccccatgcccatggatatattccatcgaaattcccgaacaagaatcttaagaaaaattactgcagaaacccagatagggagttgcgaccttggtgttttacgactgatcctaacaaacgctgggagctatgcgacattcctagatgtaccactcctccgccatcctcgggcccgacatatcagtgcctaaaaggaacaggtgaaaattatcgtggtaacgtcgctgttaccgtctctggccatacttgccagcactggtctgcacaaaccccccatacacataacaggactcctgaaaacttcccttgtaagaacctagatgagaattactgccgtaacccagacggtaagagagccccatggtgtcatacaaccaatagccaagttaggtgggaatactgcaaaatacccagttgtgacagttcaccagtttcaacggaacagctagctccaaccgctccacctgagcttacccctgtggtacaagattgttatcatggtgatggtcaatcctaccgcggaacgagcagtacgacaaccacaggcaaaaaatgtcaaagttggagttcgatgacgccacatagacaccagaaaacacctgagaattacccaaatgcaggattgaccatgaactattgtcgtaaccctgacgcagataagggaccttggtgcttcaccaccgacccttctgttcgatgggagtattgtaatttgaaaaaatgcagtgggaccgaagccagtgtcgttgcaccgccaccagttgttttgctcccagatgtggaaactccttccgaagaagattgtatgtttggaaatggaaagggttatagaggcaaacgtgcaactactgttacgggcactccatgtcaagattgggctgcacaagagccacacagacatagtattttcacgcctgaaacaaaccctcgagcagggttagaaaaaaattattgtaggaatcctgatggcgatgtcggtggaccgtggtgttatacgacgaatcctcgaaagctgtatgattactgtgatgtccctcaatgtgcggctccctcttttgactgtggcaaacctcaggtagaacctaagaagtgcccgggacgtgtggtaggtggctgtgtggcacatccgcactcctggccttggcaagttagtttgaggacacgattcggcatgcatttttgtggtggtactttgatctcccccgagtgggttctcaccgcggctcattgtttagaaaaatctccgcggccatcatcgtataaggtgatattaggcgctcatcaagaggtcaacctcgaacctcacgttcaggaaatcgaagtctctaggttatttcttgagcctactagaaaggatatcgccctcttgaagctctcgtcaccggctgtgataacagataaagtcatccccgcatgcttgccgagtccgaattatgttgtggctgacagaaccgagtgtttcataactggatggggagaaacacaagggaccttcggcgctggtctcctcaaggaagctcaactccctgtaatcgaaaataaagtttgtaatcgttacgaattcctgaacggaagagtgcaatccaccgaactctgcgccggccatcttgcgggaggaaccgattcttgtcaaggcgactctggaggtccactcgtttgtttcgaaaaggataaatatatccttcaaggtgttacctcttgggggttggggtgtgcacgtcctaataagccgggcgtatatgtcagggtgagcaggttcgtcacttggatagagggggtcatgagaaataac

SEQ ID NO: 18248 - DNA, 2430 bp, Artificial Sequence
  Description of Artificial Sequence: Synthetic coding sequence
atggaacataaggaggttgttctccttctgctcctttttcttaagagtggtcagggtgagcctttagacgattacgttaatacacaaggtgccagcctgttcagcgtcacaaagaaacaactgggtgccggaagcatcgaagagtgcgctgcgaaatgcgaggaggacgaggaattcacctgccgagccttccagtatcattccaaggaacagcaatgtgtgatcatggccgagaatcggaagtcaagtattatcatacgaatgcgtgacgtggtcctgtttgaaaaaaaggtttatctttcagaatgtaaaaccggtaacggcaagaattaccgcggtaccatgtctaagacaaaaaatggtatcacctgtcaaaagtggtcgtccacgtcgcctcacaggccgcgtttctcgccggcaacccatccctcagaggggttagaggaaaactactgtcggaatccagataacgatccacagggcccttggtgctacactactgacccggagaagcggtatgattattgtgacatacttgaatgtgaggaggagtgtatgcattgctctggcgagaactacgatgggaaaatctctaagacaatgtccgggttggagtgccaagcgtgggactcgcagagtccccacgctcatggctacattcccagcaagttccctaacaaaaaccttaaaaaaaactattgtcggaatcccgatcgagaacttcgtccttggtgctttactactgatcccaacaaacgttgggagctctgcgacatcccaaggtgcaccacccccccgccgtccagcggtcccacttatcagtgtctgaaagggactggggaaaattatcggggcaacgtagctgttactgtcagcgggcacacttgtcagcattggtctgcacaaacccctcatacgcataaccgtacgcccgaaaacttcccgtgcaagaacttggatgagaattattgtcgcaaccctgacggtaaacgtgcgccatggtgccatactacgaattcgcaagttcgatgggaatattgcaagatccccagttgtgattcttcgccggtttctactgagcaactggcgcctacggcacccccggaattgactcctgttgttcaggactgttatcatggagacggccaaagttatagaggcacgtcttccactaccactaccggcaaaaagtgccagtcctggtcgtctatgacaccgcatcgccaccagaagaccccagagaactatccgaacgccggtctcaccatgaattattgtcgtaaccctgatgctgataaaggtccttggtgcttcaccaccgatccgagcgttcggtgggagtattgcaacttgaagaagtgttccggaacagaggcctcggttgtcgcaccgcctccggtagtgctgcttcctgatgtcgaaacaccttccgaggaagactgtatgtttggtaatgggaagggctaccgaggtaagcgagccacaaccgtgactggcactccttgccaagactgggcagctcaagaaccacatcgacattccatttttacgccagagacaaacccgcgtgccggattggagaagaactactgtcggaatccagatggcgatgtgggtggaccgtggtgttatacaacgaacccaagaaagctatacgactattgcgatgtgccacaatgcgctgccccttccttcgactgcgggaaacctcaggttgagcccaaaaagtgtccgggccgcgtggtcggtggatgcgtggcccacccccattcttggccttggcaagttagtttgcggacccgcttcggtatgcatttttgtggtggcacactgatttctccggaatgggttcttacggcagcacattgtcttgaaaagtctccccgaccaagctcttataaagtaattctgggggcgcaccaggaggttaatttagaaccccatgttcaagagatcgaggtgtctcgactctttttggagcccacccgcaaggacattgcactgcttaagctatcttcgccagccgttataacggataaggttatcccggcttgtctaccttcccctaactacgtcgttgctgaccgtactgaatgtttcatcaccgggtggggtgagacgcaaggcacctttggcgctggtctgcttaaggaagcccagcttccggtaatcgaaaacaaagtgtgtaaccggtacgaattcctcaatgggcgtgtccagagcacggagctttgcgcaggccatttggctggtggcacggactcctgccagggggattccggtgggccccttgtctgtttcgagaaagacaaatatattttgcaaggagttaccagctggggcttaggttgtgctcgccctaacaaaccaggggtgtatgtgcgagtgagccgttttgtcacatggattgaaggcgtcatgcgcaacaat

SEQ ID NO: 18249 - DNA, 2430 bp, Artificial Sequence
  Description of Artificial Sequence: Synthetic coding sequence
atggagcataaagaagtggttcttttgcttctactttttttgaaaagtggccagggcgaacctctggatgactacgtcaatacgcagggtgcatctctcttctctgtgaccaagaaacagttgggagctggaagtatcgaggagtgtgctgccaagtgcgaagaggacgaggaatttacttgcagggccttccagtatcactctaaagaacagcagtgcgtaataatggccgagaatcgtaaaagctctataataataaggatgcgagatgtcgtcctgttcgagaaaaaggtctatctgtcagaatgtaagaccgggaatggcaagaactaccgaggcactatgtccaagaccaagaacggcattacttgccaaaagtggtcaagcaccagtccacataggccacggttcagccccgctactcacccttctgaagggctggaggagaactattgccgcaatcccgacaatgaccctcaaggaccatggtgttatacgactgatccggaaaagcggtatgattactgcgacatcctggagtgtgaagaggagtgcatgcattgctccggggaaaactatgatggtaaaatcagcaaaactatgagtggccttgagtgccaagcatgggactcccagagcccccacgcccacggttacatcccaagtaagttccccaataagaaccttaagaaaaattattgcagaaatccagatagagaactgcgtccgtggtgctttactacagaccctaacaagagatgggagctgtgtgatatccctaggtgcactacgcctcccccatcttccggcccaacctaccagtgtctgaagggaaccggcgagaattaccggggtaacgtcgccgtcaccgttagtgggcatacatgtcaacactggtccgcgcagaccccccatactcacaaccgcactccagagaattttccttgtaaaaacctagacgaaaattactgtcgtaatcccgatggtaagagggcaccgtggtgccacaccaccaatagccaggtgcgctgggagtattgcaagattccctcctgtgacagcagccccgtgtccacagaacagttggcccctacggctcccccagaactgactccagtcgtacaagattgttaccacggggacggccagtcctatcgcgggacttcgagcacgactacaacagggaagaagtgccagtcctggagctccatgactccgcaccggcatcagaagacgccggagaactatcccaacgctgggcttacaatgaattactgtcgaaatcctgacgccgataaggggccctggtgttttacgacagacccatccgttcgttgggagtactgtaacctgaagaagtgtagcggcacagaggctagcgttgtagcaccacctcccgttgtcctgctgccagacgtcgaaaccccatcggaggaagactgcatgtttggcaacgggaaagggtatcgcggcaagagggccaccactgtgaccgggactccttgtcaggattgggccgcccaggagccacaccgccactcaatctttactccagaaacaaatccacgcgccggacttgaaaagaactactgcaggaatcccgacggcgacgtgggtggcccttggtgttatacaactaatccacgaaaattatatgactactgcgacgtacctcaatgtgcagcccccagtttcgactgcggaaagccacaggtggagccgaagaaatgccccggaagggtggtcggtggttgcgtcgcccatccccactcatggccgtggcaggtgagcctgcggacgcgctttggaatgcacttttgcggaggaactctgatcagccctgagtgggtcctgaccgctgcccactgcctcgagaagagcccacgtcccagctcatacaaagtcattcttggtgcacatcaagaagtcaatctggagccccacgtccaggagattgaggtctccagactgttcctggagcccacccgaaaagatattgcgctgttgaaactgtctagccccgcagtgattaccgacaaagtaattcctgcctgtttgcccagtcccaactacgtcgttgcagatagaactgagtgctttatcactggttggggcgaaacccagggaacctttggcgctggccttctgaaagaagcgcagttgccggtcatagagaataaagtctgcaacagatatgaatttttgaacggccgggtacaatccactgagctgtgtgccggccacctggcaggaggaacggactcctgccagggagacagcgggggcccattggtttgttttgaaaaggacaagtacattctacaaggggttacctcctggggcttggggtgtgcacgcccgaacaaacctggtgtatacgtgagggtgtccaggtttgttacctggattgaaggggtcatgcgtaacaat

SEQ ID NO: 18250 - DNA, 2430 bp, Artificial Sequence
  Description of Artificial Sequence: Synthetic coding sequence
atggagcataaggaagtagtgttgctgcttctcctgtttctgaagtccggacaaggggagccgctggacgactacgtgaatacgcagggagccagcttgtttagtgtgactaagaaacagctcggcgccggatctatcgaagagtgtgcggcgaagtgtgaggaagacgaagaattcacctgtcgcgcttttcagtaccattccaaggagcagcagtgtgtaattatggctgagaatagaaaaagctccatcattatccgaatgcgggatgtggtactcttcgagaagaaagtgtatctgtcggagtgcaagactggtaacggcaagaactaccggggcaccatgtccaagacaaagaacggcatcacctgtcagaagtggtcctccacgtccccgcacagaccaagattttcccccgctacacacccaagcgaggggctggaagaaaactattgccgaaatcctgataatgatccccagggcccttggtgctacacaacagaccctgagaaacgttacgattattgtgatattcttgaatgcgaggaagagtgcatgcactgttctggcgaaaactatgatggcaagatctccaagacaatgtctggcctggaatgccaggcttgggattcacagtccccgcacgcacacggctatatcccaagcaaattccccaataagaatcttaaaaaaaactattgccggaatcctgatagggagctgcgaccttggtgttttactaccgaccctaataaacggtgggaactctgcgatataccacgatgcaccacaccccctccctcatctggcccgacttaccagtgcctgaagggcacaggggaaaactaccgaggaaatgtcgccgttactgtgtcaggtcacacttgtcagcattggtcagctcagactcctcacacccataatcgtacaccagagaacttcccttgtaaaaacctggacgagaactattgcaggaaccccgatggcaagagggctccttggtgtcacacaacgaacagccaggtgcgctgggagtattgcaagattccgagctgcgacagcagcccggtgagtaccgaacagctagcgccgaccgcacccccagaactgacacctgtggtgcaggattgttatcacggtgatgggcagagttacaggggcaccagctccaccacaaccactggcaaaaagtgtcagtcttggagctccatgactcctcatcggcatcaaaagactccagagaactacccaaacgcaggactgacaatgaattactgtagaaatcccgacgccgacaaggggccctggtgctttacaaccgatccaagtgtgcggtgggaatactgcaatctgaaaaaatgttctggcacggaagcatccgttgtggccccacctccagtggtgttgctgcccgatgtcgaaactccaagcgaggaagattgtatgttcggtaacggcaaggggtaccggggaaaacgtgcgacgacagtgaccgggaccccttgccaggactgggcagcccaggagccccaccgtcatagcatctttacccctgaaaccaatcccagagcaggtctagagaagaattactgcagaaatcctgatggggacgtggggggtccttggtgttatactaccaacccacgaaaactgtacgactattgcgatgtaccccagtgtgccgctccttctttcgactgcggcaagcctcaagtggaaccaaagaaatgtcccggccgcgtagtgggggggtgcgtagcgcatccccattcatggccatggcaggtgtctttgcgaacacggtttgggatgcatttctgcggcggtacactgatctcacccgagtgggtgctcacggccgcacattgtctggagaaaagccctcggccgtcatcttataaggtgatactgggggctcaccaagaggtgaatttggagccacatgttcaagaaatagaggtcagcagattgttccttgaacctacacggaaggatatcgctctgctgaagctttcttcacccgctgtaatcactgacaaggtaattccagcgtgtttgccctctcccaactatgtcgtggccgacagaaccgagtgttttatcaccggctggggcgaaacccaggggacatttggcgctggtctgctcaaagaggcccagctccccgtgatcgagaataaagtatgcaacaggtacgagtttctaaacggtcgtgtgcagagcactgaactgtgtgccggtcatctagctggaggtaccgattcttgtcaaggtgattccggcgggcctcttgtgtgctttgaaaaagacaaatacattctccagggagtgacaagctgggggctgggctgcgcgcgaccaaataaacccggagtgtacgtccgagtttcacgctttgtgacctggatcgagggcgttatgagaaacaat

SEQ ID NO: 18251 - DNA, 2430 bp, Artificial Sequence
  Description of Artificial Sequence: Synthetic coding sequence
atggagcacaaggaagtagtgctccttctcctgctcttccttaaatcaggccagggcgaaccacttgatgactacgtcaacacccaaggggcgtctttgttcagcgtgactaagaagcagttgggcgcaggctctattgaagaatgcgctgccaagtgcgaggaagacgaggaattcacgtgtcgagcattccaatatcattcaaaagagcagcagtgcgtgatcatggctgagaacaggaaatccagtattattattaggatgagggatgtggtgttgttcgagaaaaaggtgtacctctccgagtgtaaaacaggcaatggcaaaaactatcggggcaccatgtccaagaccaagaatggtatcacttgccagaaatggagctctaccagcccccaccggccaaggttctctcctgccacccaccccagtgaaggtctggaggagaattactgcagaaaccccgacaacgaccctcagggaccatggtgctacactaccgacccagagaagcgctacgactactgtgacatcctcgagtgtgaagaggaatgtatgcactgttctggcgagaattacgatggtaagatttctaaaaccatgagcggcctggagtgccaggcctgggactcccagagtccccacgcacacggatacattccatcaaagttcccgaataagaacctcaaaaaaaattactgccggaatcctgatagggaactgcgcccatggtgctttacaactgacccaaacaagcgatgggaactgtgcgacattccaagatgcacgactcctcccccctcttcagggcctacctatcagtgcctgaagggcaccggggaaaattataggggcaacgttgcggtgacagtgtctgggcatacctgtcagcactggagcgcccagacccctcatacccataacagaacacccgagaacttcccatgcaaaaatttggatgaaaattattgtaggaatccagacggaaaaagggccccatggtgtcatacaaccaactctcaggtgagatgggagtactgtaagattccatcatgcgacagctcacccgtgtctactgaacagctggcccctactgcccctccagaactcacacccgtagtgcaggactgctatcacggcgatggccagtcctataggggcacttcttccacaaccacaactggaaaaaagtgtcaatcttggagctcaatgactccccaccgccaccagaagaccccagagaactatccaaacgccggcctcacaatgaattattgccgcaacccggatgctgacaaaggcccgtggtgtttcacaacagatccgtctgtccggtgggagtattgtaacctgaagaagtgctccggaacagaggccagtgtagtcgccccgccccctgtggtgctcctccccgacgttgagactcctagcgaggaggactgtatgttcggcaacggaaaaggttacagagggaagagagccacaaccgttaccggcaccccctgccaggattgggccgctcaggagccccaccggcattccattttcacccctgagaccaacccacgcgcaggtctcgaaaagaactattgccggaatcccgatggcgatgtcggcggcccctggtgctatacaacgaatcctcggaaactgtatgactactgcgatgtgccacagtgtgccgctccttcttttgactgtgggaagccccaagtggagcctaagaaatgccctggtcgggtcgtcggcgggtgcgtggctcaccctcacagctggccatggcaggtgagcctcaggacacgcttcggcatgcacttttgcgggggtacgcttatctccccagagtgggtcttgactgcagcccactgtctcgagaagagccctcggccaagttcatataaggtgattttgggtgctcaccaggaggtgaacctcgaaccgcacgtacaggagatcgaggtttctcgactgttcttggagccaactcggaaagacattgccttgctcaagctgagctcacctgctgtcatcactgataaagtaatacccgcctgcctgccgtccccgaattacgtggtggctgaccgaacagagtgcttcatcaccggctggggagaaacacaaggtaccttcggtgcgggcctgctcaaagaagctcagctccccgttatcgaaaacaaggtctgcaaccggtacgaattcctgaacgggcgggtgcagtccaccgagctttgcgctggccacctggcaggcgggacagactcctgccagggagattctgggggtccactggtctgctttgagaaagacaagtacatccttcaaggagtgacttcttggggattgggatgcgccaggccgaataagcctggtgtgtacgtgagggtgtcccggtttgtaacgtggattgaaggtgtcatgcgaaacaac

SEQ ID NO: 18252 - DNA, 2430 bp, Artificial Sequence
  Description of Artificial Sequence: Synthetic coding sequence
atggagcacaaggaagtggttctcttgcttctgctgttcctgaagagtggccagggcgagcctctggacgattacgtgaatactcagggagctagccttttctctgtcaccaaaaaacagctgggcgccggctccattgaggagtgtgcggccaaatgtgaagaggatgaagagttcacatgccgagcatttcaataccactcaaaagagcagcaatgtgtgattatggcagaaaatcgaaaaagttcaatcataattcgcatgcgagacgtcgtgttatttgagaaaaaggtatatctttctgagtgcaaaaccgggaacggaaagaactaccgaggcacgatgagtaaaacgaaaaatggaattacttgtcagaagtggagtagcactagcccgcatcgcccccggttttccccggcgacacatccgtccgagggtctggaggaaaactactgtcgcaaccctgacaacgacccacagggtccttggtgctacaccactgaccctgaaaagcggtatgactattgcgatatactggagtgcgaagaagagtgcatgcactgcagtggggagaactatgacggtaagatttcaaagactatgtctggtctggaatgtcaggcgtgggactctcagtcccctcacgctcacgggtatattcctagcaagtttccgaataagaacttgaagaaaaattattgcaggaaccccgatcgggagttaaggccctggtgtttcaccacagatcccaataaacggtgggaactatgcgacattcctcggtgcacaacaccaccaccaagtagtggcccaacctatcagtgcctgaaagggaccggtgaaaactatcgtgggaatgtggcggtgaccgtgagtgggcatacttgccagcactggagcgcccagacaccacatacccataatcggactccagagaacttcccctgcaaaaacctggacgagaactattgtcggaacccagacggaaagagggcaccgtggtgtcacactactaactctcaggtgcgatgggagtactgtaaaatccccagttgcgattcctcgcctgtcagtacagagcagctggcccccaccgccccccccgagcttacgccagtcgtgcaggactgctatcacggcgacggacagtcctaccgaggaacttcctctactacaaccaccggaaaaaagtgccagagttggagttccatgaccccccatcggcaccagaagactcctgaaaactacccaaatgcaggccttactatgaactattgccgtaatccagacgccgataaaggcccctggtgcttcactaccgaccctagcgtgaggtgggaatattgcaatctgaaaaaatgtagtgggacagaggcttcagtggtggccccgccccctgttgtgctacttccggacgtggagactccatcggaggaagactgtatgtttgggaatggcaaggggtacagagggaaaagagctaccactgtcactggcacaccctgtcaggactgggcagcccaggagccgcatagacattctattttcacacccgagaccaatccacgtgcgggactcgaaaaaaactactgcaggaacccagatggagacgtaggcggtccatggtgctataccaccaatccccgaaagctttatgactattgcgatgtgcctcagtgtgccgctccgtcatttgactgtggtaagccgcaggtggagcccaaaaaatgtcccggaagagttgtcggtggatgcgtggctcatccccatagttggccttggcaggtgagcctgcgcacccggttcggtatgcacttctgtggaggtactttgatctccccggagtgggtgttgaccgcagctcactgtttggagaaaagtccacgtcccagctcctacaaagtaatattgggcgctcaccaagaagtaaacctggagccccacgtgcaggagatcgaggtgagtcggctttttctggagcctacgcggaaggatattgccttgctgaagctctcgtctcctgcggtgatcacagataaagttatccctgcttgtctcccgagcccaaactatgttgtagcagataggaccgaatgtttcataacaggatggggcgagacacagggaactttcggcgccggcctcctgaaagaggcccaactgccagtcattgagaacaaggtctgtaacagatacgagttcctgaatggaagagtccaatccacagagctctgcgcaggccatctggctggtggcaccgattcctgtcaaggagactccggcggacccctcgtatgcttcgaaaaagataaatacatcctgcagggggtgacctcttggggcctgggctgcgccagaccaaataagcctggcgtgtatgtaagggtctcacggtttgttacctggatcgaaggcgtcatgcggaacaat

SEQ ID NO: 18253 - DNA, 2430 bp, Artificial Sequence
  Description of Artificial Sequence: Synthetic coding sequence
atggaacacaaggaggttgttctgctgctgctcctatttctaaaatcaggtcagggggaaccgttggatgactatgtcaatacccagggtgcatctctcttcagcgtcactaaaaagcagctgggggccggcagcatcgaagaatgtgccgctaagtgcgaggaggatgaagaattcacctgtcgggcctttcagtaccacagcaaagagcaacagtgcgtgattatggctgagaaccgaaaatctagtatcatcattcgaatgagagatgtggtgctgtttgagaagaaagtgtatttaagcgaatgcaaaacaggcaatggtaagaattaccggggcactatgagcaaaaccaagaatggtattacttgccagaaatggtcctccacatcccctcaccgacctcgattctctcctgctactcacccatctgaaggcttggaggaaaactattgcaggaatcccgacaacgatccccagggcccttggtgctatacaaccgatcctgagaaacgatacgactactgcgatatcctggagtgcgaggaggagtgcatgcactgttctggtgagaattacgacggcaagatttccaagaccatgtcggggcttgagtgccaggcctgggactcgcaatctccacacgcacacggctatatcccgagcaaattccccaacaagaatcttaaaaaaaactattgtaggaatcccgatcgggagctgaggccctggtgtttcaccactgatcccaataaacgctgggaattatgtgatattccacgatgcacaacgccaccccccagcagcgggcctacctatcagtgcttgaaggggactggcgagaattatcggggcaacgtagcagtgacagtctcagggcacacctgtcagcactggagcgcgcagacgccacacacacacaatcggacacctgaaaactttccttgtaagaacctggatgaaaattactgccggaatcctgatgggaagagggccccatggtgtcataccaccaattcccaggttcgatgggagtattgcaagatcccttcatgcgactcctcccctgtctccacagagcaactcgcacctacagctcccccagaacttacacctgtcgtgcaagattgttaccacggcgacggccagtcgtaccgggggacctcaagtaccaccacaaccggaaagaagtgtcagagctggtcaagtatgacccctcatcgccaccagaaaacacctgagaactacccaaatgccggcttgacaatgaactactgccgcaaccccgacgccgacaaagggccttggtgtttcaccacagacccatccgtgcgttgggaatactgtaatttgaaaaagtgcagtggcactgaagccagcgtggtggctccacctccggtggtattactgcccgacgtggagacacctagcgaggaggactgcatgttcggaaatgggaagggataccgggggaagcgagccactactgtaactgggaccccctgccaagattgggcagcccaggaaccgcaccgacattccatttttactccagaaaccaaccccagagcaggcctcgaaaagaattattgccggaatcctgatggcgacgtaggcgggccttggtgctatacaaccaatcctagaaaattgtacgactactgcgacgtgccacaatgtgcggcaccatccttcgattgtggaaagccacaagttgagccaaaaaaatgccctggtagggtggtgggcggctgcgtggcccatccacacagctggccttggcaggtatcgcttcggaccaggttcggcatgcacttttgtggcggtacactgataagccccgaatgggtcttgaccgctgcccactgcctggaaaagtcacctagacccagctcctataaggtcatcctgggggctcatcaggaggtgaacctggaaccacacgtgcaagagattgaggtgtcaagactgttcctggagccaacacggaaggatatcgccctcctgaagctatcctctcctgccgtgattacagataaggtcattccggcttgccttccttccccgaattacgtggtggccgatcgaactgagtgtttcattacgggctggggcgagacccaggggacattcggtgctgggctgctcaaagaggcacaactaccagtaatagagaacaaggtgtgtaatcgatacgaatttctgaacggcagagttcagtcaaccgagctgtgtgccgggcatctggcaggcgggactgacagctgccagggggactctggcggcccactcgtgtgcttcgaaaaagataaatacattctccagggagttacgtcttggggcctgggctgtgccaggcccaataagcccggggtctacgttcgggtcagtagattcgttacctggattgagggggtaatgaggaacaac

SEQ ID NO: 18254 - DNA, 2430 bp, Artificial Sequence
  Description of Artificial Sequence: Synthetic coding sequence
atggagcataaggaggtcgtgctgcttctcctgctgttcctgaagtccggccaaggggagcccctcgacgattatgtgaacacccagggtgcttctctattttctgttacaaaaaaacagctaggtgccggcagcattgaggagtgcgccgcaaagtgtgaggaagatgaggagttcacctgccgtgcattccagtatcattctaaggaacagcagtgtgtaatcatggctgagaacaggaaatcatcaatcattattagaatgagagacgttgtgctgttcgaaaagaaggtgtatttatctgaatgtaagactggcaacggcaagaactatcgggggactatgtcaaagaccaagaatggtataacttgccagaagtggtcttctactagtcctcaccgtccacggtttagcccagccacccacccttccgagggcctggaagaaaactactgtaggaatcccgacaacgatccccagggtccctggtgctatacaaccgaccccgaaaagcggtacgactactgcgatattctcgaatgtgaagaagagtgcatgcattgtagtggagagaactatgatggaaaaatatctaaaactatgagcggattagagtgccaggcttgggactcccaaagtcctcatgctcacggctacatcccaagtaaatttcctaacaagaacctgaagaagaattactgtcggaatcctgatagagagctccggccatggtgttttactactgacccaaataaacggtgggagctatgtgatatccccagatgcacaactccaccaccctcctctgggcctacctaccagtgcttgaagggaacaggggagaactaccgaggtaatgtcgctgtgaccgtgtccggtcatacctgtcagcactggtctgctcagactcctcacactcataatagaacacccgaaaacttcccttgtaagaacctggatgagaactattgcaggaaccccgatggtaaacgagcaccatggtgccacaccaccaactctcaggttcgctgggagtactgcaagattccatcttgtgacagctcccctgtgtcaacagaacaattggcacctacagctcctcccgaactgacccctgtcgtgcaggactgttatcacggggatggacagtcatacaggggcacaagctcaactacaactaccgggaagaagtgccagtcatggagttccatgacaccacaccgacatcaaaaaacccccgagaactacccaaatgctggcctaacaatgaattactgtcggaatcctgacgctgataaggggccatggtgttttactaccgatccctcagtccgctgggagtactgtaacctgaagaaatgcagtggcacagaggcatcagtcgttgcacccccaccagtagtgctcctgcccgacgtggagacaccaagtgaggaagattgtatgtttgggaacggcaagggctacaggggcaagcgagctactacagtgactggtactccttgtcaggattgggctgcacaggagccacacagacattccattttcacacctgagacaaatcctcgtgcaggcctggaaaagaactattgccggaacccagacggcgacgtgggggggccttggtgttacactacaaacccaagaaaattgtatgactactgcgatgttccccagtgtgcagcaccatcttttgactgcggcaaacctcaggtggagccgaagaagtgcccggggcgggttgttggaggctgcgtggcacatcctcacagctggccatggcaggtcagcctgaggacaagatttggcatgcacttctgcgggggaactttgatcagtccagagtgggtcctgaccgctgcccattgtctcgagaagtccccacggccatcctcatacaaggtcattctgggcgcacatcaggaggtgaacctggaaccccatgtccaggagatagaggtctcaagactgtttttggaaccaacacgcaaggatattgccctgttgaagctgagcagccccgctgtgatcactgacaaggtgatacccgcatgtctaccctccccaaattatgtggtggccgaccggaccgagtgttttatcaccggctggggggaaacccagggtacattcggcgccgggctgctcaaagaagcacagctgcccgtgatagaaaacaaagtgtgtaacaggtatgagtttctaaacgggagagtgcagagtaccgagctatgtgccgggcatttggccggcggtactgattcctgccagggcgattctgggggcccactggtttgtttcgagaaagataaatacattttacagggtgtgactagttggggcctgggatgcgcccggccaaataagcctggcgtgtatgttcgggttagccgctttgttacatggatcgaaggagtgatgcgcaacaac

SEQ ID NO: 18255 - DNA, 2430 bp, Artificial Sequence
  Description of Artificial Sequence: Synthetic coding sequence
atggaacacaaagaagtggtccttctgcttttgctctttcttaaatcaggtcaaggcgaaccgttagatgattatgtgaacacacaaggagcgtcacttttttcagttactaaaaaacaactgggtgccggctcaattgaagagtgtgctgctaaatgtgaggaggacgaagaatttacatgtagagcgtttcagtaccacagcaaagaacagcaatgcgtaatcatggccgaaaaccggaaaagctcaatcattattcgcatgcgggatgtcgtcttgttcgaaaaaaaagtttacctatctgaatgtaaaacaggaaatggcaaaaactatcggggcactatgagcaaaactaagaatgggatcacatgtcagaagtggtcgagcacctctccgcataggcctcgtttctccccggctacgcatccgtctgaaggactggaggagaattattgccgcaaccccgataatgaccctcagggcccttggtgttatacaacagatcctgagaagagatatgattattgtgatatcttagaatgtgaggaagaatgcatgcattgctcaggcgagaactacgatggaaagatttctaagacaatgtcagggctggagtgccaagcatgggatagccaaagtccacatgctcatggctacattccgtcaaaatttcctaacaagaatttaaagaagaattactgccggaacccggatagagagctgcgcccttggtgctttacgactgatcccaacaaacgctgggaactgtgtgatattccgcgttgtacaacaccacctccgtcatctgggcccacctatcaatgcctaaaaggcactggtgagaattatcggggcaacgtggcggtgactgtatcgggacatacttgtcagcattggtcagcccaaactccgcatacacataatagaacaccggagaattttccatgcaaaaatcttgatgaaaattactgcagaaatcctgatggcaagcgagcaccatggtgccacacgacgaatagccaggtacgttgggaatattgcaagattccgtcatgcgactcatcacctgtaagcacagaacagctcgcaccgactgcccctccggaactgacacctgtagttcaagattgctaccatggagacggtcagtcttatagaggcaccagcagtacgaccacgacgggaaaaaagtgtcaatcttggagtagcatgacgccacaccgccatcagaaaacgcctgaaaactatccgaatgccggcttgactatgaactattgtcgaaatcccgacgccgacaagggaccgtggtgtttcactacagatccatcagtacgctgggagtattgcaacctcaaaaaatgctctggcacggaagcatcggtggtggccccacctccggttgtgttgttgccggatgttgaaaccccgtccgaagaagattgcatgttcggcaatggaaagggatataggggtaagcgggcaacgactgtcacaggaacaccatgtcaagattgggctgctcaagaacctcaccggcatagtattttcacaccggaaactaacccgagagcggggcttgaaaaaaattactgtagaaacccggacggcgatgtgggcggtccgtggtgctatacgacgaacccgcggaaattgtatgattattgcgacgtcccgcagtgcgcagcgcctagctttgattgcggaaaaccacaagtggaacctaaaaaatgcccgggacgggtggttggcggttgcgtagctcatccacattcctggccatggcaagtctcccttcgaacgcgttttggtatgcatttttgcggcggaactttgatctcacctgagtgggttttaaccgcagcgcattgcctcgagaaaagcccaagaccatcttcttacaaagtcattcttggtgcgcatcaggaggtgaatctggaaccgcacgtgcaggaaattgaggtgagccggctcttcctagaacctacacggaaggatattgcgctgctgaaactgtcaagtccagccgtaatcaccgacaaggtgattccggcatgtttgccaagtccaaactacgttgtagctgataggacagagtgctttattacgggttggggcgaaactcaaggtacgtttggagccggattattaaaagaagcgcaactgcctgtaattgaaaataaagtctgcaatcgatacgaattcctgaacgggcgtgtccagtccacggaactatgcgccggccacttagctggaggtaccgacagttgccaaggcgattcagggggccctctggtctgcttcgagaaagataaatatatcctgcaaggtgtcacttcctggggacttggttgcgcacgaccgaataagccgggcgtctatgtgcgtgtcagtcgctttgtcacctggattgagggcgtgatgcggaataat

SEQ ID NO: 18256 - DNA, 2430 bp, Artificial Sequence
  Description of Artificial Sequence: Synthetic coding sequence
atggagcataaagaagtggtactcctgctgctgttgttcttaaagtctggccagggagaacctctggatgactacgtcaatacccagggcgcctccctcttctcggtcactaaaaagcagcttggcgcgggcagcatcgaggagtgcgctgcaaagtgtgaagaggatgaagagtttacctgccgcgccttccaataccacagcaaggagcaacagtgcgtcatcatggccgaaaacagaaagtcctccatcatcatccgtatgcgcgacgttgtgctcttcgagaagaaggtgtatctgtcggagtgcaagaccggaaatgggaagaactaccgtggcacaatgagcaaaactaagaacggaataacgtgccagaagtggagctcgacctccccgcaccgtccccgtttcagtccggcgacgcatcccagcgagggccttgaggagaactactgccgcaatcccgataacgacccgcagggcccctggtgctataccactgatccggagaaacgctacgactactgtgatattcttgagtgcgaggaggagtgtatgcattgctcgggcgaaaactacgacggtaaaattagcaagaccatgagtggcctggagtgtcaagcatgggactctcaatccccgcacgcccacggctatattccctccaagtttccgaacaagaacctcaaaaagaactactgccgtaaccccgatcgcgagcttagaccctggtgtttcaccacagatccgaacaaacgctgggagctgtgcgacatcccccgttgtacaaccccgcccccctccagtggccctacgtaccagtgtctgaaaggcactggcgagaattaccgaggtaacgttgctgtgacagtctcgggccatacttgtcagcattggagtgctcagaccccccacacccataatcggacccctgagaactttccgtgtaagaacttggacgagaactactgccgcaaccctgatggcaagcgtgccccgtggtgtcacactactaactctcaagtgcgctgggagtactgcaagatcccctcctgtgattcctctcccgtgtctaccgagcagctcgccccaacggccccgcccgagctgacccccgtcgtccaagactgttaccacggtgatggccagtcctaccgtggcaccagttcgaccaccacaacaggaaagaagtgtcaaagctggtcttcaatgaccccccaccgccaccagaagactcctgagaactacccgaacgcaggcttgaccatgaattattgccgcaatcctgacgccgacaaaggcccctggtgctttacaaccgatccctcggttcgctgggagtactgcaacctcaagaagtgctccggtaccgaggcttccgtagtggcccccccccctgtggtactgctcccggacgttgaaactccttccgaggaggattgtatgttcggcaacggcaaggggtaccgcggcaagagggctaccaccgtcacgggtaccccttgtcaggactgggcagcccaggagccccatcgtcattcgattttcactccggagactaaccctcgcgcgggcctggagaagaattattgtcgtaatcccgatggagatgtaggcggtccgtggtgctacaccacgaatcctcgcaagttgtacgactactgcgacgtgccccagtgcgcggcacctagctttgattgcggcaagccgcaggttgaaccgaagaagtgcccgggccgtgttgtcggcggatgcgtggctcaccctcatagctggccttggcaagtctcattacgaactcgctttggcatgcacttctgcggcggtaccctgatatctccagagtgggtcctcacggccgcgcactgccttgagaagagcccccgcccatcctcgtacaaggtcattcttggcgctcatcaggaagtgaacctggaaccgcacgtccaggagattgaggtgagtagattgttcctggaaccaacccgtaaggacattgccctcttgaagctatcctcacctgccgttatcaccgataaggttatccccgcttgccttccttctcccaactacgtggtcgccgacaggacggagtgtttcatcaccggttggggcgagactcaggggaccttcggcgcgggcctcctgaaggaggctcaactcccggtcatcgagaataaagtgtgcaatagatacgaattcctgaacggccgtgtccagtccactgagctttgtgccggacatctagctgggggcaccgattcgtgtcagggcgattcaggcggacctctcgtctgcttcgagaaggataagtacatcctccagggcgttaccagctggggtctcggttgcgcacgtcccaataagcctggcgtttacgttcgcgttagtcgcttcgtcacctggattgaaggcgttatgcgcaacaat

SEQ ID NO: 18257 - DNA, 2430 bp, Artificial Sequence
  Description of Artificial Sequence: Synthetic coding sequence
atggaacacaaagaagtagtgctcctcctcctattattcctaaaatcgggacaaggcgagcctcttgatgattatgtcaatacccaaggagcgtcgcttttttctgtgactaaaaaacaacttggagctggatcaattgaggagtgtgcagcaaaatgtgaagaggatgaggaattcacgtgccgcgcttttcaatatcacagtaaggagcaacaatgtgtcattatggcggaaaatcgaaaatcaagcatcattatcagaatgagggatgtggtgttatttgaaaaaaaggtgtatttatctgaatgcaaaacaggaaatggtaagaactatcgtgggacaatgtcgaagactaaaaatggaattacatgtcaaaaatggagttctacctcgccgcatagaccacgtttctctccggcaacacacccatcggagggattggaagagaattattgtagaaacccagataatgaccctcaaggaccatggtgctacacaaccgatcctgaaaaacgttatgactattgcgatatactggagtgtgaggaagagtgtatgcactgctcaggggaaaactacgatgggaaaatttcaaaaacaatgtccggtcttgaatgtcaagcatgggacagccaatctcctcatgcacatggttacattccctcgaaattccccaataaaaatctcaagaaaaattattgtcgtaacccggaccgtgaactgagaccatggtgcttcacaactgatccaaataagcgatgggaattgtgcgacattcctcgatgcactactccaccaccaagttctggacccacctaccaatgcttgaaaggaactggtgaaaattacagaggtaatgtggctgtaacagttagtggacatacttgtcaacattggagcgcacaaactccacatacgcataatcggactccggagaactttccttgcaaaaacctggatgaaaattactgtagaaatccagatggaaaacgtgcaccgtggtgccacactacaaattcgcaagtgcgttgggagtattgcaagattccatcttgcgactcatctcctgtcagcacagaacaattggcgccaactgccccacctgaacttactcctgtggttcaagattgttatcatggagatggtcaatcgtatagaggaacatcgagtaccaccaccaccggaaaaaaatgtcaatcttggtcatcaatgacaccacaccgacatcaaaaaaccccagaaaactacccaaacgctggattaaccatgaattattgccgaaatccggatgcggataagggaccgtggtgctttaccaccgatccatctgtccgctgggagtactgtaatcttaaaaagtgttcaggaacagaagctagtgtagttgcaccaccgccagttgttctacttccagatgttgaaacgccgtccgaagaagattgtatgttcggcaatggaaaaggatatcgtgggaaaagggcaacgactgtaactggaactccatgtcaggattgggctgcacaggagcctcatagacattcaattttcacgccagagaccaacccaagggcaggcctcgagaagaactactgcaggaatccagatggagacgtaggtggaccctggtgttacaccaccaaccctagaaagctctacgattactgcgatgtccctcaatgtgcagcgccatcctttgattgcgggaaaccgcaagttgaacctaaaaagtgtccgggtagagttgttggcgggtgcgttgcacacccacactcatggccttggcaagtatcattgcggacgcggttcgggatgcatttctgtggtgggacattgatttcgccagaatgggtgctcacggcagctcattgccttgaaaaaagtccacgtccatcttcatataaggttatcctgggagcacaccaagaagtcaatttggagccacacgtgcaagaaattgaagtgtcaaggctcttcttggagccgacgcgtaaggatatcgccttactgaaattgagttctccagcagtcattacagataaagttattccggcctgtctcccgtccccgaattacgtcgtggctgaccgtacagaatgttttatcaccggatggggtgagacgcagggaacattcggagctggactacttaaggaagcacaactcccagtaattgaaaataaagtttgtaatcggtatgaattcttgaatggaagagtccagtcaacagaattgtgtgcaggacatctcgccggcgggaccgattcatgtcaaggagactctgggggaccacttgtgtgttttgagaaggataaatatatcctgcaaggagtgacttcgtggggactggggtgtgctcgcccaaataaaccaggtgtctacgtaagagtaagccggttcgttacatggatcgagggagtaatgcgaaataat

SEQ ID NO: 18258 - DNA, 2430 bp, Artificial Sequence
  Description of Artificial Sequence: Synthetic coding sequence
atggaacataaggaagtcgtcctcctgttactgttattcctcaagagcggacagggggagccattagacgactatgtcaatactcagggtgccagccttttctcagttactaagaagcagctgggggcgggctcgattgaggagtgcgccgccaaatgtgaagaggacgaagagtttacatgtcgagcctttcaatatcactcaaaagagcagcaatgtgtgatcatggcagagaacaggaagagctccattatcatacgaatgagggatgtagttctatttgagaagaaggtctacctgtcagagtgtaagaccggcaatgggaaaaattaccgaggcaccatgtcaaagaccaagaatgggatcacctgccagaagtggagttctacttccccacaccgacctcggttttcccccgcgactcaccccagtgaggggttggaagagaactactgtcggaaccccgataacgatcctcagggtccctggtgctataccacagatccagaaaagaggtacgactactgtgatattctggaatgcgaggaggaatgcatgcactgcagcggagagaattacgacgggaaaataagcaagaccatgagcggtcttgagtgccaagcctgggatagccaatctccacacgcacacggctatatcccaagcaagtttcccaataaaaatttgaagaaaaattattgccggaaccccgatagggagctccggccgtggtgtttcactacagaccctaataagaggtgggaactgtgcgacatcccccgttgtaccacccccccaccatcgtctggccctacataccagtgccttaagggcactggagagaactataggggtaatgtagctgtgaccgttagtgggcatacttgtcagcattggtccgcccagaccccgcacacacataacagaactcccgagaactttccctgcaaaaacttggatgagaattactgcagaaatcccgatggtaagagggctccttggtgtcacacaacaaactcccaggtaaggtgggagtattgtaaaattccctcctgtgactcgtcccccgtttctaccgaacagcttgcccctacggctccaccagaactgactcccgtggtgcaggattgctatcacggggacgggcagagttacagaggcacctcttcaacaaccacaacgggcaaaaagtgtcagagttggagctccatgacgccccacaggcaccaaaaaacaccagagaactatccgaatgcaggcctcacaatgaattattgtcgaaacccagatgccgacaagggaccgtggtgctttactacagaccccagcgtaaggtgggagtactgcaatctgaaaaaatgcagtggcaccgaagcgagcgttgtggctccccctccagtcgtccttttgccagatgttgagaccccctctgaggaggactgcatgttcggaaatggcaagggttatcgcgggaagcgagccacaacagtgactggcaccccgtgccaggattgggctgcccaggagcctcacagacattccatattcactccagagaccaaccccagagctggcctggaaaaaaactactgccggaacccagacggggacgttgggggcccctggtgctataccaccaatccaaggaaattgtatgactactgcgatgtaccacagtgtgccgcccctagtttcgactgtggtaagcctcaggttgagccaaaaaagtgccctggtcgcgtggtgggaggctgtgttgcgcaccctcacagttggccgtggcaggtgagtttgagaacgcggttcgggatgcatttttgcggcgggacactgatctcacctgagtgggttcttacggcagctcattgcctggaaaaatctcctaggcccagctcatataaggttatcctgggcgctcaccaggaggtcaacttggaacctcacgtgcaagaaatcgaagtgagccgtctgttcctcgaacctaccaggaaagacattgccttgttgaagttgtcatcaccggccgtgatcactgacaaagtcatccccgcctgtctgcccagtcccaattacgtggtcgcagaccgcaccgagtgttttattactggatggggggagacccagggaacctttggcgccggtttgctgaaggaggcacagcttcctgttatcgaaaacaaggtatgtaaccgttatgagttccttaacggtcgggtgcagtcaaccgagctgtgcgctggtcaccttgctggtggaacagacagttgtcaaggcgactcaggtggccccttagtatgctttgagaaggacaaatacatacttcagggggtcacgtcctggggcctcgggtgtgccaggcccaacaagccgggtgtctatgtgcgagtgtcccgctttgtgacttggattgaaggcgtaatgcgaaacaat

SEQ ID NO: 18259 - DNA, 2430 bp, Artificial Sequence
  Description of Artificial Sequence: Synthetic coding sequence
atggagcataaggaggttgttcttctgctgcttttgttcctaaagagcggacaaggagaacccctggatgactacgtcaacacacagggcgccagcctgttctcagttaccaaaaaacagctgggagccggctctatcgaagagtgcgccgccaaatgcgaggaagatgaagagtttacctgccgcgctttccagtatcactcgaaggaacagcagtgcgtgatcatggcagagaatagaaagtccagtatcatcattcggatgcgggacgtggttctgtttgaaaaaaaggtgtatttatcggagtgtaagactggcaacggcaagaattatcgaggaactatgtctaaaaccaagaatggcatcacttgtcaaaaatggtccagtaccagtccccatcgtccccggttttctcctgctactcatccttctgaagggctggaagagaactactgtagaaatcctgataatgacccccaggggccgtggtgctataccacagacccggagaagcgatacgactattgtgatattctggaatgtgaggaagaatgcatgcattgctctggcgagaattatgacgggaagataagcaagacaatgtctgggctggagtgtcaggcatgggactctcagagtccgcatgctcatgggtatattccaagtaagtttcctaataaaaaccttaaaaagaattactgtagaaacccagaccgggagctgcgtccctggtgcttcacaaccgacccaaacaagcggtgggagctctgtgacattcctagatgtactacacctccacctagttccggaccgacctatcagtgccttaaggggactggtgagaattaccgaggtaatgttgccgtgactgtctccgggcatacctgccagcactggagcgcacagaccccgcacacccataatcgtacaccagagaactttccttgtaagaatctcgatgagaattactgccggaaccccgacggcaagcgcgcaccctggtgccacactacaaatagtcaggtgcggtgggaatactgtaagatcccctcctgtgattcttcccctgtgtctaccgaacagctggcccctacagccccccctgaacttactccagtagtacaggactgctaccatggcgatggacaatcatatcggggaaccagctccactacaactactgggaagaaatgtcaatcatggagcagcatgactccccatcgccatcagaagacacccgagaattatccaaatgctggcctgacaatgaactattgtcggaacccagacgctgacaagggaccctggtgctttacgaccgacccctccgttcgatgggaatattgcaatttgaaaaaatgcagcggaaccgaagcttctgtagttgccccaccccccgtggtgctgctcccagatgtggaaactcccagcgaggaggactgcatgttcggcaatgggaaaggatatagagggaaacgggccaccaccgtgacggggacaccctgtcaggattgggccgcccaggagccacataggcatagtattttcacacctgaaaccaaccctcgggccggcctcgagaagaactactgtcgtaaccccgatggggacgtcggcgggccttggtgttataccaccaaccccagaaaattatacgactattgcgacgtgccacaatgtgcagccccaagcttcgactgcgggaaaccccaggtggagcccaagaagtgccccggacgcgtcgtggggggttgtgtggcacacccacattcgtggccctggcaggtctcgctgagaacacgatttgggatgcacttttgcggcggaaccttgatctcccccgagtgggtcctgaccgccgcacattgtctagaaaaatccccaagaccatcttcctacaaggtaatcctcggagctcatcaagaggtcaacttggagcctcacgtacaagagatagaagtttccagactcttcctcgaacccacccgaaaggatatagcactgttaaagctctcctcgcccgcggtgattactgacaaggtcatcccggcttgtttacccagcccgaactacgtcgttgcggatcggacagagtgttttataaccggctggggagagacacaggggacgttcggtgctggtctgcttaaagaagcccagctccctgtcattgaaaacaaggtatgtaacaggtacgaattcttgaacgggagggtacaaagcaccgaactttgcgctggccatctggctggaggaacagattcctgtcagggtgatagtggaggcccgttggtatgcttcgagaaagacaagtacatcctacagggcgtgacaagctggggcctgggatgcgctcggccaaataaacctggtgtatacgttcgtgtctccaggtttgtaacgtggattgaaggtgtcatgaggaacaac

SEQ ID NO: 18260 - DNA, 2430 bp, Artificial Sequence
  Description of Artificial Sequence: Synthetic coding sequence
atggaacacaaagaggtcgttcttctcctgcttctgttcctgaagtccgggcagggggaacctcttgatgactacgtgaacacgcaaggcgcctccttgttcagcgtcacaaagaaacagctgggggccgggtctattgaggagtgcgccgccaaatgtgaagaggatgaggaattcacatgccgcgcgttccaataccactccaaggagcagcagtgcgtgattatggctgagaatcggaagtcctccatcataatccggatgcgggacgtggtcttatttgaaaagaaggtctacctcagcgaatgcaagaccgggaacggaaaaaattatcggggcaccatgagtaagacaaagaacggcataacatgtcagaagtggagttctactagtcctcatagaccacgctttagtcccgccacacacccgtccgagggcttggaggagaattactgcaggaaccctgataatgatccacaggggccctggtgctatacaactgatcctgaaaagcgctatgattactgcgacattctcgagtgtgaggaggagtgtatgcattgttcaggagagaactacgacggaaagatctccaagaccatgtccgggttggagtgccaggcgtgggactcgcagtccccacatgcccatgggtatatccctagtaagtttcctaacaagaacttgaaaaaaaattactgccgcaacccggaccgggagctgcggccatggtgtttcaccactgacccaaataagagatgggaactctgcgacattccccggtgtaccacaccaccaccatcatccgggccaacctaccaatgcctgaagggaacgggggagaactaccggggtaatgtggccgtcacagtgagtggccatacgtgtcaacactggtccgcccaaactcctcatacgcataacaggactccggaaaacttcccttgcaagaacctggatgaaaactattgccggaaccctgatgggaagagagccccatggtgccacacgaccaattcgcaagtgcggtgggagtattgtaagatcccatcgtgtgactcctcacctgtgtccactgaacaactggcaccaactgctcctcctgagctcacccccgttgtccaggattgctatcatggcgatggccagagctaccgggggaccagttccaccaccacaacgggaaaaaagtgtcagagctggagttccatgactcctcaccgccatcagaagacaccggagaactacccaaatgctggactgacgatgaactactgtaggaatcctgacgccgataaaggcccatggtgcttcaccactgatccgagtgtccgctgggaatactgtaatctgaagaaatgctctggaacggaggcaagtgtggtcgcacccccacctgtagtgctcctccccgacgtggaaaccccttcggaagaggactgtatgtttgggaacgggaagggctatagggggaagagggcaaccaccgtcacaggtaccccctgtcaagattgggccgcccaggagccgcataggcactcaatcttcacgcccgagactaaccctcgcgccggactggagaaaaattactgccggaaccctgacggcgacgtgggtggcccatggtgctacaccacaaatccccgaaagctgtatgactattgtgacgtgccccagtgcgccgcaccttcctttgattgtgggaagcctcaagtcgaaccaaaaaagtgtcccggtagggtggtgggcggctgtgtggcacacccgcacagctggccatggcaggtgagtttgcgaacacgcttcggaatgcacttctgcggaggaaccctgatcagccctgaatgggttctcaccgctgctcactgcctggaaaagagcccccggccctctagctataaagtgattctgggtgctcatcaagaggtgaatctcgagccccacgtacaggagattgaggtgagccgcttatttctggagccgaccagaaaggatattgccctgttgaagcttagctctcccgccgtgatcaccgacaaggtcattcccgcttgccttcccagcccgaactacgtggtggcagatagaaccgaatgttttatcacagggtggggagagacgcaggggaccttcggcgcaggcctgctgaaagaggcgcagctacccgttattgaaaacaaagtgtgtaatagatacgagttccttaacggccgggtccagtcaaccgaactctgcgctggccacctggccggagggaccgacagttgtcagggtgatagtggcggacccctcgtgtgtttcgagaaagataaatacattctgcagggggtcaccagctggggtctgggctgtgcccgcccgaacaagcccggagtatatgtccgggtaagtcgttttgtcacttggatcgagggtgtgatgaggaataac

SEQ ID NO: 18261 - DNA, 2430 bp, Artificial Sequence
  Description of Artificial Sequence: Synthetic coding sequence
atggaacataaagaagttgtactactactactattatttctaaaatcgggtcaaggtgaaccgttagatgattatgttaatacgcaaggtgcgtcgttattttcggtaacgaaaaaacaactaggtgcgggttcgatagaagaatgtgcggcgaaatgtgaagaagatgaagaatttacgtgtcgtgcgtttcaatatcattcgaaagaacaacaatgtgtaataatggcggaaaatcgtaaatcgtcgataataatacgaatgcgtgatgttgtattatttgaaaaaaaagtatatctatcggaatgtaaaacgggtaatggtaaaaattatcgtggtacgatgtcgaaaacgaaaaatggtataacgtgtcaaaaatggtcgtcgacgtcgccgcatcgaccgcgtttttcgccggcgacgcatccgtcggaaggtctagaagaaaattattgtcgaaatccggataatgatccgcaaggtccgtggtgttatacgacggatccggaaaaacgatatgattattgtgatatactagaatgtgaagaagaatgtatgcattgttcgggtgaaaattatgatggtaaaatatcgaaaacgatgtcgggtctagaatgtcaagcgtgggattcgcaatcgccgcatgcgcatggttatataccgtcgaaatttccgaataaaaatttaaaaaaaaattattgtcgtaatccggatcgtgaactacgtccgtggtgttttacgacggatccgaataaacgatgggaactatgtgatataccgcgatgtacgacgccgccgccgtcgtcgggtccgacgtatcaatgtttaaaaggtacgggtgaaaattatcgaggtaatgtagcggtaacggtttcgggtcatacgtgtcaacattggtcggcgcaaacgccgcatacgcataatcgtacgccggaaaattttccgtgtaaaaatttagatgaaaattattgtcgaaatccggatggtaaacgtgcgccgtggtgtcatacgacgaattcgcaagttcgttgggaatattgtaaaataccgtcgtgtgattcgtcgccggtttcgacggaacaattagcgccgacggcgccgccggaactaacgccggtagttcaagattgttatcatggtgatggtcaatcgtatcgtggtacgtcgtcgacgacgacgacgggtaaaaaatgtcaatcgtggtcgtcgatgacgccgcatcgtcatcaaaaaacgccggaaaattatccgaatgcgggtttaacgatgaattattgtcgaaatccggatgcggataaaggtccgtggtgttttacgacggatccgtcggtacgttgggaatattgtaatctaaaaaaatgttcgggtacggaagcgtcggttgtagcgccgccgccggttgtactattaccggatgtagaaacgccgtcggaagaagattgtatgtttggtaatggtaaaggttatcgtggtaaacgagcgacgacggttacgggtacgccgtgtcaagattgggcggcgcaagaaccgcatcgacattcgatatttacgccggaaacgaatccgcgtgcgggtttagaaaaaaattattgtcgtaatccggatggtgatgtaggtggtccgtggtgttatacgacgaatccgcgtaaattatatgattattgtgatgttccgcaatgtgcggcgccgtcgtttgattgtggtaaaccgcaagtagaaccgaaaaaatgtccgggtcgtgtagttggtggttgtgtagcgcatccgcattcgtggccgtggcaagtatcgttacgtacgcgttttggtatgcatttttgtggtggtacgctaatatcgccggaatgggtattaacggcggcgcattgtttagaaaaatcgccgcgtccgtcgtcgtataaagtaatactaggtgcgcatcaagaagtaaatctagaaccgcatgttcaagaaatagaagtttcgcgattatttctagaaccgacgcgaaaagatatagcgttattaaaattatcgtcgccggcggttataacggataaagttataccggcgtgtctaccgtcgccgaattatgttgtagcggatcgaacggaatgttttataacgggttggggtgaaacgcaaggtacgtttggtgcgggtctactaaaagaagcgcaactaccggttatagaaaataaagtatgtaatcgatatgaatttttaaatggtcgagtacaatcgacggaactatgtgcgggtcatttagcgggtggtacggattcgtgtcaaggtgattcgggtggtccgctagtatgttttgaaaaagataaatatatattacaaggtgttacgtcgtggggtctaggttgtgcgcgtccgaataaaccgggtgtatatgttcgagtatcgcgatttgtaacgtggatagaaggtgtaatgcgtaataat

SEQ ID NO: 18262 - DNA, 2430 bp, Artificial Sequence
  Description of Artificial Sequence: Synthetic coding sequence
atggaacacaaagaggttgtgctattgttgctactgtttctgaagtctggtcagggcgaacctctggatgattatgtgaacacccagggtgcttcactcttttcagttaccaaaaagcagcttggcgccggtagcattgaggagtgcgccgcaaaatgcgaggaggacgaggaatttacctgtcgagcctttcagtatcactcaaaggaacagcaatgtgtgatcatggcagaaaatagaaagtcctcaataatcatccgaatgagggacgtggttctgttcgagaaaaaggtgtacctgagcgaatgcaaaacaggcaatggaaagaactaccgaggaaccatgtctaagacaaagaatgggattacttgccaaaagtggtcatcaacaagcccacatcgccccagattctcccctgcaacacacccaagcgaggggctcgaagaaaactactgtagaaatcctgataacgaccctcagggcccttggtgctataccactgaccccgagaagaggtatgactattgcgatatcctcgaatgtgaagaggaatgcatgcattgcagcggcgaaaactatgacgggaagatttcaaagaccatgtctggcctggaatgtcaggcctgggattcccagtctccccatgcccacggctatatacctagtaaatttccaaacaaaaatctgaagaagaattactgtagaaatcccgatcgggagctgcgaccgtggtgcttcacaacagaccccaacaaacgatgggagctctgcgacatccctcgatgcacgacccccccacccagttccggccctacatatcagtgcctgaagggaactggcgagaattaccgaggaaatgtcgcagtgacagtgtctgggcacacatgccagcactggagtgctcagacacctcacacacacaataggacccccgagaactttccctgcaaaaacttggatgagaactactgtaggaatcccgatggcaaaagggctccatggtgccacacaaccaactcacaggtacgatgggaatattgcaaaattccctcctgcgattcatcccccgtgtccacagagcagctggctcctactgctcctccagaactgacacccgtcgtacaggactgctatcatggcgacggacagagctatcgagggactagtagcaccactacgaccggaaagaagtgccagagctggtctagcatgactcctcacagacatcagaagacccccgaaaactatcctaatgccggcctgactatgaattactgccgaaatccagacgcggacaaggggccttggtgcttcacgactgaccccagtgtcagatgggagtattgtaatttgaagaagtgtagcgggaccgaggcctctgtggtggctcccccgccggttgtgctgctgccagacgtggaaaccccctccgaagaggactgcatgtttggtaacggcaaaggctatagggggaagcgagcgaccaccgttactggtacaccttgccaggactgggccgcgcaggaaccacacagacactcaatatttaccccagaaacaaacccaagagccggactggagaagaactactgtcgaaatccggatggcgacgtgggaggaccgtggtgttatactacaaatcctaggaagctgtacgactactgtgatgtacctcagtgcgccgcccctagtttcgattgtggcaagcctcaggtcgagcctaagaagtgtccgggtagagtggtcggtgggtgcgtggctcatcctcatagctggccttggcaggtatccctgaggacaaggtttgggatgcacttctgcgggggcactctaatttcacccgagtgggtgttgactgcagctcattgcctagagaagagtccaagaccatcatcatataaagttattctaggggctcaccaggaagtgaacttggaaccgcatgtgcaggaaatcgaagtcagtagattgttcttggaacctacaaggaaggacattgccctgttgaagttgagttctcccgctgtgataacggataaggttattcccgcctgtctacccagccccaactatgtcgtagctgaccgcactgagtgtttcatcactggctggggcgagacacaagggacatttggcgctggacttctgaaggaggcacagttgccggtcatcgaaaataaggtgtgcaatcgatacgaattcttgaatgggcgtgtgcagagcacagagctgtgtgctgggcacctcgcgggtggaacagattcctgtcagggagatagcggaggtccgcttgtctgttttgagaaagataaatacattctgcaaggcgtgacaagctggggccttggctgtgccagaccaaataaaccaggcgtgtatgttcgagtctccaggttcgtgacctggatagaaggcgtgatgaggaataat

SEQ ID NO: 18263 - DNA, 2430 bp, Artificial Sequence
  Description of Artificial Sequence: Synthetic coding sequence
atggagcacaaggaggtagtgctgctcctcctcctgttcctgaaatccgggcagggtgaaccactggacgactacgtcaacacccagggagcgtccctgttctcggtgactaagaagcagctgggcgctggctccattgaagagtgcgcggccaagtgtgaagaagatgaagagtttacctgccgcgcgtttcagtaccactcaaaggaacagcagtgtgtgatcatggcagagaaccggaagtcctccatcatcatccgcatgagagacgttgtgctgttcgaaaagaaggtctacctgagcgagtgcaaaaccgggaacggcaagaactatcgcggtactatgtccaaaacgaaaaacggcatcacttgccagaagtggtcctcgacgtccccacatagacctcggtttagcccggccacccacccgtcggaaggactggaagaaaactactgtcgcaatccagataacgacccacaagggccgtggtgctatactaccgatccggagaaacgctacgattactgcgacattctggaatgcgaagaagagtgcatgcattgcagcggagagaattacgatggaaagatcagcaagactatgtcgggactcgagtgtcaagcatgggactcccaatcgccacatgcccacgggtacatcccatcgaaattcccgaataaaaacctcaagaagaattactgtcgaaacccagatcgggaacttcgaccgtggtgttttaccacggacccaaataagcggtgggagttgtgtgatattccacggtgcactactccacccccatcgagcggtcctacttaccagtgcttgaagggaacgggtgagaattaccgggggaacgtcgccgtgaccgtgagcggacatacctgccagcattggtcagcgcaaacccctcatactcacaacaggacgcctgagaatttcccatgcaagaatcttgacgagaattattgcagaaacccggacggaaaacgggccccgtggtgccataccacgaactcacaggtgaggtgggagtactgcaagatcccgtcctgcgattcaagccccgtgagcaccgaacaactcgctcccactgcccctccggagcttactccggtggtccaggactgttaccacggcgatggacagtcttacagaggcacctcctcgactactaccactggaaagaagtgccagtcgtggtcatccatgaccccccatcggcaccaaaagacccccgagaactacccgaatgcaggtcttactatgaactactgccgtaacccggatgccgacaagggcccctggtgtttcaccaccgacccatcggtgagatgggaatactgcaatctgaaaaagtgctcggggaccgaggcctctgtcgtggccccaccccccgtggtcctccttccggacgtggaaactccgtccgaagaggactgtatgttcggaaacggtaaaggatacagaggaaagcgcgcgactaccgtgaccggtactccgtgccaagactgggccgcacaggaaccgcacagacactcaatcttcaccccggagacgaacccgagggctggcctggaaaagaactattgcaggaaccctgacggagatgtgggaggaccttggtgctacaccaccaacccaagaaagctctacgactactgcgatgtgccgcagtgcgctgcaccgtcgttcgactgcggcaaaccgcaggttgagccaaaaaagtgccctggacgcgtcgtgggaggctgcgtggcccacccgcacagttggccttggcaagtcagcctgcgcacccggttcggcatgcatttttgcggcggaaccctcatctcgccggaatgggtcctcactgcggcccattgtttggaaaagtcgccgcgcccgtcaagctacaaggttatcctcggggctcaccaggaagtgaacctggagccacacgtgcaggaaatcgaagtgtccaggctgttcctggaaccaactcgcaaagacatcgccctcttgaagctgagtagcccggcggtcataaccgacaaggtgatccctgcgtgtctgccgtcacctaattacgtggtggccgaccggaccgagtgcttcattactggctggggagaaactcaggggacttttggcgcaggactgctgaaagaagctcaactgcctgtgatcgagaataaagtctgcaaccgctacgaattcctgaacggccgggtgcaatcaaccgagttgtgcgccggccacctggcggggggaaccgattcgtgtcagggagattccggaggtccgctggtgtgtttcgaaaaggacaaatacatcctgcaaggagtcaccagctggggactcggatgcgcacggcctaataagcccggagtgtacgtccgcgtgtcacgcttcgtcacttggatcgaaggagtgatgcgcaacaat

SEQ ID NO: 18264 - DNA, 2430 bp, Artificial Sequence
  Description of Artificial Sequence: Synthetic coding sequence
atggaacataaggaagtggtactgctgcttctgctgttcctgaaaagtgggcagggggaaccattagatgattacgtgaatacgcagggcgcgtcccttttcagcgtcacgaaaaaacagctaggagccggctctatcgaggagtgcgccgctaagtgcgaggaggacgaagaatttacatgtcgagcctttcaatatcattctaaggagcaacagtgcgtcatcatggcagagaatcgaaaatcatcaatcatcataagaatgagagacgtggtgctgtttgagaagaaggtttatctcagtgagtgtaagacaggcaatgggaagaattacagagggacaatgtctaagaccaaaaatggcattacctgtcaaaagtggtccagtacctccccacacagacctagattctcaccagcgactcatccatctgaaggattggaggaaaactactgtcgcaatccagataacgatcctcagggaccttggtgctacacgacagacccagagaaacgttatgactattgcgacattcttgaatgcgaagaggaatgcatgcattgttcaggggagaactacgatggcaagatttcaaagacaatgagtggattggagtgtcaggcatgggactcacaaagccctcatgctcacgggtacatcccttccaaattccctaataaaaacctgaagaagaactactgcagaaaccccgaccgcgagttgcgaccgtggtgtttcacgaccgaccccaataagagatgggagctctgtgatatcccaaggtgtacgacaccccccccaagcagtggaccaacgtaccagtgcctgaagggtaccggcgagaactatagaggtaatgtcgctgtgaccgtgagcggtcacacatgtcagcactggagcgcgcaaactccccatacacataacagaacacctgagaatttcccatgtaagaatctggacgaaaattactgcagaaatccggacgggaaaagggcaccttggtgccacacaactaactcacaggttagatgggagtattgtaagatcccatcatgcgacagttcacccgtgagcaccgaacagctagcaccgacggcgccgcccgaactgacaccagtcgttcaggactgctaccacggcgacggccagagctaccgcggcaccagtagcaccacaacaacaggcaagaagtgtcagtcttggtcctccatgaccccacaccgacaccagaagacacccgaaaattaccctaatgccggcctgacgatgaactattgtcgcaacccggatgccgacaaaggtccttggtgctttaccacagatcctagcgttagatgggagtactgcaatttaaaaaaatgttcgggaacagaagcatcagtcgtcgccccaccacctgttgtgctgttaccggacgtggaaacaccatctgaggaggattgcatgttcggaaatggaaaaggatatcgaggcaaacgcgcaacgacagtgacaggcactccttgccaagattgggccgcccaggagccccataggcatagtatctttacccccgaaacaaacccccgcgccggtttggaaaaaaactactgcaggaaccccgatggagatgtgggagggccttggtgttacaccacaaacccacgtaaattatacgattactgcgatgtcccacagtgtgcagcgcccagcttcgactgcggcaaaccacaggtggaacccaagaaatgtccagggagggtggtaggagggtgtgtagcacatccacattcatggccctggcaggtgtctctcaggactaggttcggcatgcacttctgtggtggcaccctcatctctccggaatgggtgctcactgccgctcattgcctagaaaagagcccaaggccatcttcttataaggtcatcctcggtgcccatcaggaggtgaacctggagcctcacgtgcaggagattgaggtgtcacgtctttttctcgagcctaccaggaaggatatcgcactgctgaaactgtcatctcctgcagttattaccgacaaggtcattcctgcatgcctcccgtcacccaactatgtcgtcgcagatcggactgagtgtttcataacaggctggggcgagacccaggggacatttggcgcaggcctcttgaaagaggcccagctccccgttatcgagaacaaagtctgtaaccgctatgagtttctgaacggaagggttcagtccacggaattgtgtgcaggacatctcgccggggggacagatagctgccaaggcgacagtggggggcctctggtatgtttcgagaaggacaagtacatcctccaaggggtgacatcgtggggattgggatgtgctcggcctaataagccgggagtctacgtgagggtatctcgattcgtcacgtggatcgagggggtgatgcgtaacaac

SEQ ID NO: 18265 - DNA, 2430 bp, Artificial Sequence
  Description of Artificial Sequence: Synthetic coding sequence
atggagcataaagaggtggtcctcctgctgttactcttcttgaagtctggtcagggagagcctctagatgattatgtgaatacgcaaggcgcatcccttttttcggtgaccaaaaagcagctcggcgccgggagcatcgaggaatgtgctgcgaaatgcgaagaagacgaggaattcacatgccgggcgttccagtatcattctaaggaacagcagtgcgtgatcatggcagaaaatcgcaaatcctctatcatcatccggatgagggacgtcgtactgtttgagaaaaaagtgtacctttccgagtgcaagacggggaacggtaaaaactatagagggactatgagtaaaacgaaaaacggaattacttgtcagaagtggtccagcacgtcgccccaccgaccacgatttagccctgccacacacccctccgaggggctggaagaaaactactgcagaaatcccgacaacgacccccaaggaccctggtgttataccacagatcccgagaaacggtatgattactgtgatatactggagtgtgaagaggaatgtatgcattgttccggggaaaactatgacggcaagatatcaaaaaccatgtccggactggagtgccaggcctgggattcgcagagcccgcacgcccacggttacatccctagcaaatttccaaataaaaatcttaagaagaactactgtcgtaaccctgacagagagctcagaccatggtgtttcacgaccgaccctaacaagcgatgggagctctgcgacatacctagatgcaccacacctcctccatcctctggacctacatatcaatgcttaaaggggacgggggagaattatcgcggcaacgtcgcggtcaccgtgtccggccatacttgccagcactggtctgcacagactccccacacgcacaacagaacaccagagaatttcccctgcaaaaacctggatgaaaattactgcaggaaccctgacgggaagcgtgccccttggtgtcatactaccaattcccaagtcaggtgggaatactgtaagattccaagctgtgattcctcccccgtgagcaccgagcagctggcaccaactgccccaccagagctaactccagtggtacaggactgttatcatggagacggacagtcctaccgggggaccagcagtacaacaacgacaggtaaaaagtgccaaagctggagctccatgactccacaccggcaccagaaaacccccgagaactacccaaacgccggactgaccatgaactactgcaggaaccccgatgcggacaaggggccatggtgtttcaccactgatccctctgtcaggtgggaatactgtaacctcaaaaaatgtagcgggactgaagcctcagtggtggccccacccccagttgtgcttctgcccgatgtcgagaccccctcggaggaagactgcatgtttggtaatggcaagggttatcgaggcaagagggccaccacagtaactggcacaccctgccaagattgggccgctcaggagccccacaggcactcaatctttacccccgaaacgaaccccagagccgggctggaaaaaaactactgtcgaaaccccgacggggatgtcggtggtccgtggtgttacaccaccaatcccaggaagctttacgattattgtgatgtgccacagtgcgccgccccctcttttgattgtggcaaaccgcaggtggagcccaagaagtgccccggacgcgtcgtgggaggttgtgtggcgcatccccacagttggccctggcaggtgagtctacggacgaggtttggcatgcacttttgcggcggcactctaattagcccagagtgggtgttgacagctgcccactgtctggagaaaagcccccggccttcatcttacaaggtaatactgggcgcccaccaggaagttaatcttgaacctcatgttcaggagatcgaagtctccagactcttccttgaaccaactcggaaggacatagccctcctaaaactctcctcccctgctgtaattacagacaaggtgattccggcctgcctcccaagcccaaactacgtcgtggccgataggacagagtgtttcattaccgggtggggagaaacccaggggaccttcggtgctggactgttgaaggaagcccagctccctgtaattgagaataaggtttgcaatagatacgagtttctgaacggccgagtgcagtcaacggagctgtgtgcggggcacttggcaggagggaccgactcttgccaaggagacagcggggggccactcgtctgcttcgagaaggacaagtacatactccagggcgtgacgagctgggggctaggatgcgcacggccaaataagcccggagtatacgttagggtgagtaggtttgtgacatggatcgagggggtgatgcgcaataac

SEQ ID NO: 18266 - DNA, 2430 bp, Artificial Sequence
  Description of Artificial Sequence: Synthetic coding sequence
atggaacataaagaagtcgtacttctccttctcctctttctgaaatccgggcagggggaaccccttgatgattatgtgaatactcagggagctagtctgttcagtgtcacaaaaaaacagctgggggcaggatcaatagaggaatgcgctgctaagtgtgaagaagatgaagaatttacatgtcgtgcattccagtatcattcaaaagaacagcagtgtgtgattatggcagaaaatcgaaaatcctccatcataatccgaatgcgtgatgtggttctcttcgaaaaaaaagtttacctatctgaatgtaaaactgggaacggaaaaaactaccgaggaactatgtcaaagactaaaaatggaataacatgccagaaatggtcctctacatctccccatcgccctcgattttctcctgcgacacacccctcagaagggctcgaagaaaattattgtcgcaacccagataacgaccctcagggaccctggtgttatactacagatcctgaaaaaagatatgattactgtgatattctcgaatgcgaagaagaatgtatgcattgtagtggggaaaattatgatggaaaaatctctaaaactatgtccgggctagagtgtcaggcatgggattctcagtccccccatgctcatgggtatatccccagtaaatttcctaataaaaatctaaaaaaaaattattgcaggaaccctgatcgggaactcaggccctggtgctttacaactgatcctaataaacggtgggaactgtgtgatataccacggtgtactacgccgcccccctcttctggacctacatatcagtgtttgaaagggactggagagaactatcggggaaatgtggccgttactgtgtcaggacatacatgtcagcattggtctgctcagacaccccacacacataaccggacaccagaaaattttccctgcaaaaacctcgatgaaaactactgccgaaatccagatggaaagcgggccccctggtgccacacaactaattctcaggtccggtgggaatattgtaaaatcccctcctgcgatagttcgccagtgtcaactgaacagcttgcaccaacagccccaccagaactgacaccagtggtccaggattgctatcacggagacggacagtcctaccgagggacttcaagtactactacaacaggaaaaaaatgccagtcttggagttctatgactccacataggcaccaaaaaactcccgaaaactatcccaatgccgggctgactatgaattattgtcgaaatcccgatgcagacaaagggccttggtgtttcacgactgatccttcagtccgctgggaatactgtaatctgaagaagtgtagtggaactgaggcatccgtagtcgcgccccctccagtcgtcctgttacctgatgtggagactcctagtgaagaagactgcatgttcggaaacggaaaaggatatagagggaaaagagccactactgtcactgggactccctgccaggattgggcagctcaggaaccccaccgacattctatttttacaccagaaacaaaccctcgagcagggcttgaaaagaattattgcaggaatcctgatggggatgtgggagggccttggtgctacactacgaatccacgcaaattgtatgactattgtgatgtccctcagtgtgccgcccctagttttgattgtgggaaaccccaggtcgaacctaaaaagtgtcccggaagggtagtaggaggatgcgtagcgcatcctcacagttggccatggcaggtgtcactcagaactcgattcggaatgcacttctgcgggggaactctcatttcacccgaatgggtgcttacagccgctcattgcttagagaaatcccctcgtccttcttcctacaaagtgatcctcggggcccaccaggaagtcaatctggaaccccatgtgcaggaaatcgaagtgtctcgcctttttctcgaacctactagaaaggacatagcccttcttaaattaagtagtcctgctgtgatcacagataaagttatccccgcctgcctcccatcaccaaactatgtggtggccgatagaactgaatgttttattactggatggggagaaactcaggggacattcggggccggattgctcaaggaagctcaacttccagtaatcgaaaacaaagtgtgcaacaggtatgaattccttaacggacgagtgcagtccacagaattgtgtgctgggcatctcgctgggggaactgattcctgccagggagattccggaggacccttggtctgtttcgaaaaagataaatatattctacagggagtaacttcctgggggctgggatgcgctagaccaaataaacctggagtttatgtccgagtgtcaagattcgtaacatggatagaaggagtgatgcggaacaat

SEQ ID NO: 18267 - DNA, 2430 bp, Artificial Sequence
  Description of Artificial Sequence: Synthetic coding sequence
atggagcacaaagaggtggtactgcttttgctgctcttccttaagtcaggccaaggggagcccctggatgactacgttaacacacaaggagcgagtctgttctctgtgactaagaaacagctcggcgctggctccattgaagaatgtgccgcgaagtgtgaagaagacgaggagtttacctgcagagcatttcagtatcatagcaaagaacagcagtgtgtgatcatggcagagaatagaaaaagttcaatcattatacgaatgagggacgttgtactttttgagaagaaagtctacctgagtgaatgcaagacaggaaatggcaagaattatagaggaaccatgagtaaaactaagaatggcatcacatgtcaaaagtggagcagtaccagcccccatagaccccggttttcacccgctacacatccttctgaagggctcgaggagaattattgcaggaacccagacaacgatccacagggcccctggtgttataccactgatcccgagaagcggtacgactactgcgatatactggaatgcgaggaggaatgtatgcactgctccggagaaaactacgatggaaaaatctccaagacaatgtccggactcgagtgtcaggcctgggattctcagagcccgcatgcccacggatacattcccagcaagtttccaaataaaaacctcaagaagaactattgtcggaacccagacagggagttgagaccttggtgcttcactaccgaccccaataaaagatgggaactgtgcgatattccccgctgtacaactcctcctccgagcagcggacctacctaccagtgccttaaaggcacgggagaaaattaccgagggaacgtagcagttacagtgtctggacacacgtgccaacattggagcgcccagaccccccatactcacaatcggacgcctgaaaatttcccgtgcaagaacctcgacgagaattattgccggaacccagacggtaagagggcaccttggtgtcacacgacaaactctcaggtccgctgggaatactgcaagatcccgtcttgtgatagttcccctgtcagtactgagcagttggctccaacggccccgccggaactgacaccagtggtgcaggactgctaccacggcgatgggcagagctacaggggcacatcttctaccacaactacaggcaaaaaatgccagagttggagttctatgactccccatagacaccagaagacacccgagaattacccaaatgcagggctgactatgaactattgccgaaatccagacgccgataagggcccttggtgttttacaactgacccttcagtcagatgggaatattgcaacctcaaaaagtgttcaggaacagaggcctctgtggtcgcccctccccctgtggtgctcctgcccgatgtcgagaccccttcagaggaagactgtatgtttggaaacggcaaaggttatagaggcaaacgagcgaccacagtcacgggaacaccctgtcaggactgggctgcacaggaaccgcaccgacactccatttttactcccgagactaatccaagggccggtctcgaaaaaaattattgcagaaatccagacggagacgtagggggcccttggtgctataccaccaatcccagaaagctttacgactattgtgatgtaccacagtgcgccgcaccatctttcgattgcggaaagcctcaggtggaacctaaaaagtgtcctgggagagtagtgggtggctgtgtcgcccatcctcatagttggccttggcaggtctcccttcgcacacgattcggaatgcatttttgcggtgggacactgatatcccctgagtgggtccttaccgcagctcattgccttgaaaaatccccgcggccatctagttataaagtaattctgggagcacaccaagaagtgaatctggaaccacacgtgcaggaaatcgaagtgtcccgactgttccttgagccgaccagaaaggacattgccctgttgaaactctccagtcccgccgtgatcacagataaggtaattcctgcctgcttgccttctcccaactacgtggtagcagacagaactgagtgtttcataacgggatggggcgaaactcaaggaaccttcggagctggactcctcaaagaggcgcagctgcctgttatagaaaataaagtgtgtaacaggtacgagttcctgaatggaagggtgcagagtactgagttgtgtgctgggcacctggcgggaggcactgattcatgtcaaggggattcagggggccccctggtttgcttcgaaaaagacaagtatatacttcagggcgtaacatcttggggtctcggttgcgcaagacccaacaaaccgggtgtgtatgttagagtcagtcggtttgtcacctggatcgagggcgttatgagaaacaat

SEQ ID NO: 18268 - DNA, 2430 bp, Artificial Sequence
  Description of Artificial Sequence: Synthetic coding sequence
atggaacataaagaagtggtgctactactgctcttatttctcaaatcgggacagggggaacctctagatgattacgtgaacactcagggagcctccctcttctccgtgactaaaaaacagcttggggccggaagtatcgaagaatgtgctgcgaaatgtgaagaagatgaagaattcacttgtagggcattccagtatcattccaaggaacagcagtgcgtgattatggctgagaatcgcaaaagttcgatcataattcgaatgcgcgatgtcgtcctcttcgaaaaaaaagtatacttatctgaatgcaaaacagggaacggaaaaaactatcggggaactatgtctaaaacaaaaaatgggatcacatgccagaagtggtcttctacatctccccatcgaccccgcttctctcccgcaactcacccatccgaagggctcgaagaaaattattgcaggaatcccgacaatgatccccaggggccctggtgctacactactgaccccgagaaaagatatgattactgtgatatcttagagtgtgaggaagaatgtatgcattgctccggagaaaactatgatggaaaaatttctaaaacaatgtctgggctcgaatgccaggcatgggattcgcaatctcctcatgcacacggatatattccctcgaaattcccaaacaaaaacttaaagaagaactactgccgcaatcctgaccgcgagctcaggccatggtgtttcactactgatccaaacaaacggtgggagttatgtgatatccccaggtgcacaactccccctcccagttctgggcctacttaccagtgccttaaaggaactggggaaaactatagaggaaacgttgcagtgactgtgtctgggcacacatgccagcattggtctgctcagacaccacacactcataacaggactccagaaaacttcccctgtaaaaacctagacgagaattattgtaggaaccccgatggaaaacgtgccccctggtgccatacaacgaatagtcaggtacgctgggagtactgcaagataccttcttgtgattcctctcccgtgtctacagaacagctggctcctactgccccccctgagctgacacctgtcgttcaggattgctatcacggggacggacagagttacagagggacgtcctccactacgacaacaggaaaaaagtgccagtcttggtcatcaatgacacctcatagacaccagaaaactcctgagaattaccctaacgccgggctcacaatgaattactgtcgaaacccagatgctgataaagggccttggtgcttcactacagatccatcggttcgatgggaatactgtaatctcaagaaatgttctggaactgaggcatccgtggttgcacctcctcccgtggtcctcctcccggatgttgaaacaccttctgaagaagattgtatgtttggaaatggaaaagggtaccgaggaaaaagagccacaacagtaactgggacaccctgccaggattgggctgctcaggaaccacataggcactccatcttcacacccgagactaatcctcgggcaggactagagaaaaactattgtaggaacccagatggagatgtgggagggccgtggtgctatacaacaaatcccagaaaactctacgattattgcgatgtcccccagtgcgccgctccatcttttgattgtgggaaaccacaggtcgaacctaaaaaatgtcctggacgtgttgttggagggtgcgtcgctcacccacattcctggccctggcaggtcagtcttaggactaggttcggaatgcacttttgtggaggaacactaataagtcctgagtgggtgttgacagccgcccattgtctggaaaaaagtccaaggccctcctcctacaaagtaatacttggggctcaccaggaagtaaatctggaaccacatgtccaggaaatagaggtgtctagactcttcctagagccaacaaggaaagatatcgccctgttaaaactctcctcacccgcagtgataacagataaagtgatacctgcctgtctcccctctcccaattacgtagtcgccgataggactgaatgtttcataacagggtggggagaaacacagggaacatttggagccgggctcttaaaagaagctcagcttccagtcatagaaaacaaggtatgcaacaggtacgaattcctcaacgggagagtgcagtccacagaactttgtgcaggacacctggccggggggactgatagttgtcagggagattctggggggcctctcgtatgttttgaaaaagataaatacatacttcagggagttacgtcctggggactagggtgtgccaggcctaacaaaccaggagtgtacgtgagagtatctaggtttgtcacttggatcgaaggggttatgaggaataac

SEQ ID NO: 18269 - DNA, 2430 bp, Artificial Sequence
  Description of Artificial Sequence: Synthetic coding sequence
atggaacataaagaagttgttcttcttttacttttattccttaagtctggacaaggagaaccacttgatgattatgtaaatacacaaggagcatctcttttttctgtaactaagaagcaattgggagcaggatcaatagaagaatgtgctgcaaaatgtgaagaagatgaagaatttacttgccgagcctttcaatatcattctaaagaacaacaatgtgttattatggcagaaaataggaaatcatcaattataattagaatgagagatgtagttttatttgaaaaaaaagtatatctttctgagtgtaaaacaggaaatggtaaaaattatagaggtactatgagtaagactaaaaatggaattacttgtcaaaaatggtcatcaacatcaccacacagaccacgtttttccccagcaactcatccatcagaaggattagaagaaaactattgtagaaatccagacaatgatccacaaggtccttggtgttatactacagatcctgagaaaagatatgattactgcgatattttagaatgtgaagaagaatgtatgcattgtagtggagaaaattatgatggaaaaatttcaaaaactatgtctggattagaatgtcaagcatgggattctcaatcaccacatgcacatggatatattccatcaaaatttcctaataaaaatttaaaaaaaaattattgtcgtaatcctgatcgagaattacgaccatggtgttttacaactgatccaaacaagagatgggaactttgtgacattccaagatgtactactccacctccatcaagtggtccaacatatcaatgtttgaaaggtacaggagaaaattatagaggtaatgttgcagtaacagtttcgggacatacctgtcaacattggtcagctcaaactccacatactcataatagaactcctgagaatttcccatgtaaaaatttagatgaaaattattgtagaaatccagatggaaaacgagctccttggtgtcatactactaattctcaagttagatgggaatattgtaagattccatcatgtgacagtagtccagtttctacagaacaattagcacctactgcaccaccagaattaactccagttgtacaagattgttatcatggagatgggcaatcatatcgtggaacgtctagtactactactacaggaaaaaagtgtcaaagttggagtagtatgacaccacatagacatcaaaaaacaccagaaaattatccaaatgctggattaacaatgaattattgtagaaatccagacgctgataaaggaccatggtgttttacaactgacccatcagttagatgggaatactgtaatttaaaaaagtgttcaggtactgaagcatctgttgttgctccaccaccagttgttcttttaccagatgttgaaacaccaagtgaagaagattgtatgtttggtaatggaaaaggttataggggaaaacgtgcaacaactgttacgggaacaccatgtcaagattgggcagcacaagaaccacatcgacattctatttttactccagaaacaaatccaagagcaggattagaaaaaaattattgtcgaaatcctgatggtgatgtaggaggaccttggtgttatactactaatccaagaaaactttatgattattgtgatgttcctcagtgtgcagcaccaagttttgattgcggaaaaccacaagttgaacctaaaaaatgtccaggacgagttgttggaggatgcgtagctcatccacattcatggccatggcaagtttcacttcgaacaagattcggaatgcatttttgtggaggtacattaatttcaccagaatgggttttaacagctgctcattgtcttgaaaaatcaccaagaccttcgtcttataaagttatattaggagctcatcaagaggttaatttagaaccacatgtacaagaaattgaagtatcaagactttttcttgaaccaactcgtaaagatatagccttacttaaattatcaagtcctgctgttataacagataaagttataccagcttgtttaccttctcctaattatgtagttgcagatagaactgaatgttttataactggatggggagaaacacaaggaacttttggagctggtcttttaaaagaagctcaacttccagtcatcgaaaataaggtgtgtaatagatatgaatttcttaatggaagagtacaatcaacagaactttgtgcaggtcatttagctggtggtacagattcatgtcaaggtgattcaggaggaccacttgtatgttttgaaaaggataaatatatattgcaaggagttacttcatggggattaggatgcgctagaccaaataaaccaggagtctatgttagagtttcaagatttgtaacatggatagagggggtaatgcgtaataat

SEQ ID NO: 18270 - DNA, 2430 bp, Artificial Sequence
  Description of Artificial Sequence: Synthetic coding sequence
atggagcacaaggaggtggtgctcttactcctgctctttttaaagagtggccaaggagagccactagacgattatgttaatacgcagggcgcctccctattctctgtcacaaagaaacagcttggtgccggttcaatagaggagtgcgctgccaagtgtgaagaagacgaggaatttacttgccgtgcgtttcagtatcacagtaaggagcagcagtgtgttatcatggccgaaaaccggaagagctctattattatccggatgcgcgatgtcgtattgttcgagaaaaaagtgtacctgtctgaatgcaaaacaggcaatgggaagaactatcgcggaaccatgtccaagaccaaaaatggaataacatgccagaaatggagctcgacctctccccacaggccacgattttcccctgccactcatccaagcgaaggactggaagagaactactgccgtaatccagacaatgatccccagggcccctggtgttacactaccgaccccgaaaagcggtatgactactgtgacatcttagagtgtgaggaggagtgcatgcattgttccggcgagaattacgatggcaaaataagtaaaacaatgagtggtctagaatgccaggcgtgggactcccagtcaccccacgctcatggctatattccctcaaagtttccaaacaagaatttgaagaagaactattgcaggaaccccgaccgagagttacgcccttggtgcttcacaacagaccctaacaagcgctgggaactgtgcgatatcccgaggtgcaccacaccaccacctagttcaggtcctacatatcagtgcctgaaaggcacgggcgaaaattatagaggtaatgtcgccgtgaccgtctctggacacacctgccagcactggagtgctcaaacaccacacactcacaaccggacacccgagaatttcccctgcaagaatctcgatgagaattactgccgaaatccagatggcaaaagggcgccctggtgtcatactacaaatagccaggtcaggtgggagtactgcaaaatcccctcctgcgactcaagccctgtgtcgactgagcagctggccccgaccgccccaccagagttgaccccagtggttcaggattgttatcatggtgacggacagtcctacagaggaacctcctcaacaaccactaccggcaagaaatgccagtcttggtctagcatgacacctcataggcatcagaagacaccagaaaattaccctaacgccggactgacgatgaactactgccgtaacccagatgctgacaagggtccctggtgcttcaccaccgacccttcggtgaggtgggagtactgcaatctgaaaaaatgcagcgggaccgaggcgtctgttgtcgcccccccaccagtagtgctcttaccagatgtggagacaccttccgaggaggattgtatgtttggtaacgggaagggttatagaggtaagagggccactacagtaacggggaccccatgtcaggattgggccgcccaggagccccataggcactccatttttacgcctgagacaaaccctagggccggactagaaaagaactattgccgcaatcctgatggcgatgtgggtgggccctggtgctacaccaccaatcccagaaaactttatgactattgcgacgtccctcagtgtgccgctcctagcttcgattgcggcaagccgcaagttgagcccaaaaagtgccctggacgcgtagttggcggatgcgtggcgcacccgcacagctggccttggcaagtgagtctccgaacaaggttcggcatgcacttttgcggtggaacgttaatttccccagagtgggtcctgaccgccgcacattgcctcgaaaagtccccacgcccatcgagctacaaggtgatcttaggcgctcatcaagaggtcaacctagaaccgcacgtacaggaaattgaagtgagtagactcttcctggaaccaacgaggaaggacattgctcttctcaagctgagttcccccgcagtaataacagacaaagtgatccccgcttgtctgccctctcctaattacgtagttgcagaccgcacagaatgtttcatcactggttggggcgagacccagggcaccttcggggcaggacttttgaaagaggcccagctgccagtcatagaaaataaagtttgcaatcggtatgaatttctgaatggccgagtccagagtacggagctgtgcgctgggcacctggcgggagggactgatagctgtcagggggactccggggggccgttagtgtgctttgagaaagacaaatacattttacagggtgtgacgagctggggactggggtgcgcgcgccccaacaaacctggagtgtatgttcgtgtgtcgaggttcgttacatggatcgagggagtgatgaggaacaat

SEQ ID NO: 18271 - DNA, 2430 bp, Artificial Sequence
  Description of Artificial Sequence: Synthetic coding sequence
atggaacacaaagaggttgtcctcctgctgctcctcttcctgaaatctggacagggagaacctctggacgattacgtcaatacccaaggggccagcctgttcagcgttacaaagaagcagcttggagccgggagtattgaggagtgcgccgctaagtgcgaggaagacgaagagttcacatgtcgcgcgttccagtaccattctaaagagcagcagtgtgtgatcatggccgaaaatcggaaaagttccatcattattagaatgagggacgtggttttgttcgagaaaaaagtctacctgtccgaatgtaagacagggaatgggaaaaactaccgcgggactatgtctaagaccaaaaacgggattacctgccagaagtggtcatctacttcccctcacaggccccgttttagccctgccacacatccctccgaaggactggaagaaaactactgccggaatccagataatgacccccagggaccctggtgttacactacagatccggaaaagcgttacgactactgtgacattctggagtgtgaggaagagtgcatgcattgcagtggcgaaaattacgacggcaaaatttccaaaacaatgtccggattggagtgccaggcctgggactctcagagcccccacgcccacggctatataccctcaaaattccccaacaagaacctgaaaaagaactactgtcgtaaccccgaccgggagcttcgcccctggtgtttcacgacagaccctaacaaaaggtgggagctgtgcgacatccccaggtgtacaacaccacccccttccagcggcccgacttatcagtgtctgaaggggaccggcgagaattatcgcggcaatgtcgccgtcacagtctcaggtcacacatgccagcactggtcagctcaaacgccccacacccataatcgcacccctgaaaatttcccctgcaagaatttggatgaaaattactgtaggaatcctgatggtaagagagcaccatggtgccacactaccaatagccaggttaggtgggagtattgtaagattccatcctgcgactcctcaccggtgtcaacagagcagctggcccccacggctccaccggaactgaccccagtcgtgcaggactgttaccatggggatggacagagttacagaggcacctcaagtaccacgacaacgggaaaaaagtgtcagagctggtcctcaatgactccccatcggcatcagaagacaccagaaaactacccaaatgcggggctcacgatgaattactgcagaaatcctgacgctgacaaaggcccttggtgtttcaccacggacccctccgttagatgggagtattgcaatttgaaaaaatgtagcggaacagaagcttctgtggttgcaccaccccccgtcgtgttactcccagacgtcgagactccttcagaggaggattgcatgtttggaaatggtaaggggtaccgaggaaagagggcgacaactgtgaccgggacaccctgtcaggactgggcagctcaggagccacatcgacattccatcttcacccctgagacaaatccaagggcagggctggagaagaattactgtaggaaccctgacggcgatgtgggcggtccctggtgctacacaaccaacccaagaaaactgtacgattactgtgacgttccccagtgtgcagcccctagttttgattgcggtaaacctcaggttgagccgaaaaagtgtcctggccgagtagtcggaggttgcgttgcccatcctcattcttggccctggcaggtgtctcttcgcaccaggtttgggatgcacttttgtggtggcaccctcatttcacctgagtgggtgctaaccgctgctcactgcctcgaaaaaagccctaggcctagctcgtataaagttatcctcggcgcacaccaagaggtgaacctggagccccatgtgcaagagatagaagtttctcgtttgtttctcgaacctactcgcaaagacatcgcactactaaagctgtcttcacccgccgtgattaccgataaggtaatcccagcttgtctccctagtcccaactatgtcgttgccgatcggaccgagtgctttataacgggatggggagaaacgcagggcactttcggcgcgggactcctgaaagaggctcagctgcctgtcattgaaaataaggtttgcaataggtacgaatttttgaatggacgcgttcagtccaccgaactctgtgcgggccacttagcaggcgggactgattcttgtcaaggcgactctggtggaccactcgtgtgcttcgagaaggataaatatatcctgcagggggttacatcttgggggctgggatgcgctcgaccaaacaaaccgggggtgtacgtgcgggttagtagatttgtcacctggatcgagggagtgatgcgtaataat

SEQ ID NO: 18272 - DNA, 1686 bp, Artificial Sequence
  Description of Artificial Sequence: Synthetic coding sequence
atggacgccatgaaacgcggtctgtgctgtgttttactcctgtgcggtgcagtgttcgtgagccccagtcaggaaatacacgcacggtttaggaggggagcacggagctaccaagtgatctgtagggatgagaagacacagatgatttaccaacagcaccagtcctggctgagacccgtgctcagatcgaatcgagttgagtattgttggtgcaattccggtagggctcagtgtcacagcgtcccagtgaagtcatgttctgaacccaggtgcttcaatggtggaacttgccagcaggccctgtactttagtgattttgtttgccagtgcccggagggcttcgctgggaagtgctgtgaaatagatacaagggcaacctgctacgaagaccaggggatctcataccgcgggacttggtccaccgccgagagtggagctgagtgcactaactggaacagtagtgcgttagcgcaaaagccctatagtggtcgccgaccagatgcgatccgattgggacttgggaaccataattactgtagaaatccagaccgagattcgaaaccctggtgctacgtgtttaaggctgggaagtacagtagcgagttctgctctaccccagcttgctcggagggcaacagtgattgttactttggaaatggctcggcctaccggggcactcactcacttacggagtcaggagccagctgcttgccgtggaacagcatgattttaattggcaaggtctacaccgcccagaatccaagtgcgcaggccttaggtttggggaaacataactactgccggaatcccgacggggatgcaaaaccctggtgtcatgtgctcaagaacaggaggttaacttgggaatactgtgatgtgccatcttgcagcacatgtggattacgccagtacagtcagccgcagtttaggatcaaggggggtctgttcgccgacatagcctcacacccgtggcaggcagccattttcgccaagcatagacgcagtccaggagagcggtttctgtgtggaggcattctgatatccagttgttggatattgtccgccgcacattgctttcaggaacggttcccgccccaccacctcacagttatactggggcgcacctatcgcgtggtgccgggagaagaggaacagaagttcgaggtggaaaaatacattgtgcataaggagttcgatgatgatacttacgataacgacatcgctttactccagctcaagagcgactcttcccggtgcgctcaagaatcttcggtggtgcgaactgtctgcttgcctcccgccgacctgcagctgcccgactggacagagtgtgagctgtcaggatatggaaagcatgaagccttaagtcctttctactccgagagactaaaagaggctcacgtgcggctgtacccctcaagtaggtgtacaagccagcatctcctcaatcgtaccgtgactgataatatgctatgcgcgggagatacccggagcggggggcctcaggcaaacctgcacgacgcttgtcaaggcgattcagggggccccctcgtctgtctaaacgacggcaggatgacactcgttgggattatctcttgggggcttggctgcgggcaaaaggatgtgcctggcgtttacacaaaggtgactaattatctagattggatccgagacaacatgaggcct

SEQ ID NO: 18273 - DNA, 1686 bp, Artificial Sequence
  Description of Artificial Sequence: Synthetic coding sequence
atggatgcaatgaagcggggactgtgttgcgtgcttcttctgtgtggagccgtgtttgtgtcccctagccaggaaattcatgcacgattccggagaggtgcacgctcataccaagtgatttgtagggacgagaaaactcagatgatctatcaacagcatcaatcgtggcttcggcctgtgctcagatctaatcgcgtcgaatactgctggtgcaattctggccgcgcccaatgccattcagttcctgtcaaatcctgttcggaaccgcgttgctttaatggcggcacgtgtcagcaagcgctttacttttccgatttcgtgtgtcaatgtccagaagggttcgccgggaagtgttgcgagattgacacgcgtgcaacgtgctacgaagatcagggtatttcataccgtggtacgtggagcacggctgagtcgggagcagaatgtactaactggaattcatcggcactggctcaaaagccctacagcggaagaaggccggacgcgataagacttgggctgggcaatcacaactactgcagaaaccctgatcgagatagcaagccatggtgttacgtgtttaaagcaggtaaatactcctcagagttctgttcaaccccagcatgttcggagggtaactcagactgttactttggaaacggctcggcttacagaggcactcatagccttaccgagagtggagcctcgtgtttgccttggaactcgatgatcctcattgggaaggtgtacaccgcgcagaacccatctgcacaggcactcggactcggtaagcacaactattgcagaaacccagatggggacgctaagccttggtgtcatgtccttaagaataggagactgacttgggaatactgtgatgtgccaagttgctctacttgcggcctgagacagtactcacaaccccagtttcgaatcaagggtggtctgtttgcagatatcgcaagccacccctggcaagcagcaattttcgcaaagcatagacgctcccctggagaaagatttctgtgtggtggaatcctgatatcgtcatgttggattctgtccgccgctcattgctttcaagaacggttccctccccatcaccttacggtcatacttggccgtacctacagagtagtgccgggcgaagaggaacagaagtttgaggtggagaaatacattgtccataaagaattcgacgatgatacctatgataatgacatcgcattgctgcaactcaagtcggattccagcaggtgtgcccaagaatcctcagtcgtgagaactgtgtgcctcccacctgcagatcttcaactgccagattggaccgaatgcgaactttcgggatacgggaagcatgaagcgctgtccccgttttacagcgagagactgaaagaagcccatgtgagattgtacccctcttcccgctgcactagccaacacctgcttaacagaactgtcactgataacatgttgtgtgctggtgatacccgctcgggaggaccccaggcgaatctgcacgacgcctgtcaaggcgatagcggggggccccttgtgtgtcttaacgatgggcgcatgacccttgtcgggataatctcctggggcctgggttgtggtcagaaggatgtgccaggagtgtatactaaggtaaccaattacctggactggattcgagacaacatgcgaccg

SEQ ID NO: 18274 - DNA, 1686 bp, Artificial Sequence
  Description of Artificial Sequence: Synthetic coding sequence
atggatgccatgaagcgaggtctgtgctgcgtgcttctcttatgtggggcagtattcgtctcaccgagccaagagattcatgctagattccgcagaggagctcgctcatatcaagtgatctgtagagatgaaaaaacacagatgatttaccaacaacatcagtcttggctccggccagttcttagatctaaccgagtagaatattgttggtgcaattcaggacgggcgcagtgccattcagtcccggtcaaatcatgcagtgaacctaggtgttttaacgggggtacctgtcagcaggccctgtattttagtgactttgtatgtcagtgccctgagggttttgcgggcaaatgctgcgaaattgatacaagagcgacatgttatgaagaccaaggtatttcgtatcgtggcacttggagcacagcagagtctggtgctgaatgcactaattggaattctagtgcacttgctcaaaaaccctattctggccggcgcccagatgcaattcgtcttggacttgggaatcataactattgtcgtaatcccgatagagattcaaagccgtggtgctatgtattcaaggcaggcaagtatagtagcgaattctgcagcactcccgcgtgctcagaagggaactcagattgttactttggcaatgggagcgcataccggggcacgcacagcttaaccgagtctggagcgagttgcttaccctggaactccatgattctgattggcaaagtatataccgcacaaaatccttcagcgcaagcactgggtctgggcaaacataattactgccgaaaccccgatggagatgcgaaaccttggtgtcatgttctgaaaaatcgccgcttgacatgggaatattgtgacgtccctagctgttctacatgtggattgagacaatattctcaacctcagttccgcataaaaggaggcctgtttgctgatattgcgtctcacccgtggcaagccgcaatctttgctaaacatcgtcgttctccgggagaaagatttctgtgtggaggcattcttatatctagttgctggatattaagcgcggctcattgctttcaggaaagatttccgccgcatcatctgacagtcatactaggacgaacctatagagtagttccgggggaggaagaacaaaaattcgaagtagagaaatatattgtgcataaagaatttgatgacgatacttacgacaacgatattgcgcttttacaattaaaaagcgattcatctagatgtgcgcaagaatcatctgtggtacgaactgtgtgcttaccgcccgcagatctccaactgccagactggacagaatgtgaattgtctggttatggtaaacacgaggcactgtcaccgttttattcagagcgtctaaaagaggcgcatgtgcgcttatatcctagttctcgatgcacgtctcagcacctgcttaataggacagttacggataatatgttatgcgcgggcgatactcgtagcggagggcctcaggctaacctccacgacgcatgccaaggagattcgggagggccgttagtctgcttgaatgatggacgcatgacacttgtcggaattatctcttggggattggggtgtggacagaaagacgtccctggtgtgtatacgaaagtgacaaattatctggattggatccgggataatatgcgacct

SEQ ID NO: 18275 - DNA, 1686 bp, Artificial Sequence
  Description of Artificial Sequence: Synthetic coding sequence
atggacgccatgaaacgtggtttgtgttgcgttctgctgctctgtggagccgtgttcgtgagtccctcccaggagatccacgcgaggttcagaagaggtgctaggagctaccaagtgatctgtagggacgagaagacgcagatgatctatcagcagcatcagtcgtggctcaggcccgtgctgcgaagtaaccgggttgaatactgctggtgcaactcaggacgggcccaatgtcattccgtgccagtgaagagctgttcagaaccaaggtgttttaacgggggtacttgtcagcaggctttgtatttctccgatttcgtctgtcagtgtcctgaagggtttgctggtaagtgttgtgagattgatacgcgggccacctgttacgaggaccagggaatcagctatcgcggcacttggtccacggcagaatcgggagcagagtgcacaaactggaattcgtcagcactggcccagaaaccctacagcggaagacgtcccgacgccattcgcctgggattgggtaatcacaactattgccgcaatcccgacagggactccaagccatggtgttacgtgtttaaggccggcaagtatagttcagagttttgttctacacccgcttgttctgagggaaactcagattgctatttcggcaacggctccgcttatcgtgggacacactcgcttacagaatccggcgcttcatgcctgccatggaactcaatgattctcatcggcaaggtgtacaccgcgcagaatcccagtgctcaggccttaggactaggcaaacacaactactgcaggaatccagacggcgatgctaagccatggtgtcacgtacttaagaatcggagattaacctgggagtactgtgacgtaccttcgtgcagcacctgcggactgcggcagtattcccagccacagttccgcatcaaaggcggactgtttgccgacatcgcctctcacccttggcaggctgccatatttgctaagcacaggaggagcccaggagagaggttcttgtgcggcgggatccttatctcctcttgttggattctctctgcagcccattgctttcaggaacgttttcctccacaccacctcacagtcatcttagggagaacataccgggtagtgcccggggaagaggagcagaaatttgaggtggagaaatatattgttcacaaagagttcgatgatgacacatatgataacgatattgccctgctgcagctgaagtcagactccagccggtgtgcgcaggaatctagcgtggtgagaacagtgtgtctgcctcccgccgacctacagctgccagattggaccgagtgcgagctttctggctatggcaaacatgaggctctgtctccgttttactctgaacgactcaaggaggcacatgttcggctgtacccgtcttctcggtgtacgagccagcacctactaaacaggacagtcaccgacaatatgttatgcgccggggacacacggtccggcggtccacaagccaatctgcacgacgcatgtcagggcgactctggaggccctctggtgtgccttaacgacggcaggatgaccctggtgggcattatcagctgggggctgggatgtggacagaaagatgtcccgggagtctataccaaagtaacaaactacttggactggatcagagacaatatgcgacca

SEQ ID NO: 18276 - DNA, 1686 bp, Artificial Sequence
  Description of Artificial Sequence: Synthetic coding sequence
atggatgccatgaagcggggactgtgttgtgtgcttttgctttgcggggccgtctttgtctcaccatctcaagaaatccatgcaaggttcagaaggggcgcgaggtcctaccaggtgatctgtcgggatgagaaaacccagatgatctaccaacagcatcagtcctggctgaggccggtgcttagatccaacagggtggaatactgttggtgcaattcgggccgcgcacaatgtcattccgtccccgttaagtcgtgtagcgaaccccgttgcttcaacggaggaacctgccagcaggccctctacttttcagactttgtgtgccaatgtcctgaaggttttgcgggaaagtgctgtgaaattgacactagggcaacctgttacgaagatcagggtatctcctaccgcggtacctggagcactgcagaaagcggagcagaatgcactaactggaattcatcggccctcgcccagaagccctatagcggtaggaggccagatgcaattagactgggcctgggtaaccacaattactgcagaaatcctgatagagattccaaaccatggtgttacgtgttcaaagctggaaagtattcgtcggagttctgctcaacccctgcgtgttcggaggggaacagcgattgctattttggaaatgggagcgcataccgcgggacccactcccttactgaaagcggagcctcatgccttccgtggaactcgatgattcttattggaaaggtctacactgcccagaatccatcggcccaagcactgggactcggcaaacacaactactgtaggaaccctgatggtgatgcaaagccttggtgtcatgtgctgaaaaaccggcggctcacgtgggaatactgcgacgtgccttcctgctccacttgcggactgcggcagtactcgcagcctcaatttaggatcaagggagggctttttgctgatatcgcttcccatccatggcaggcagccatctttgcgaagcatagacgatcccctggagagcgctttctttgtggaggaatcctgatttcatcctgctggattttgtcggcagcccactgcttccaagaacgttttcctccacatcatctgaccgtgattcttggacggacttatagggtggtgcccggggaggaagaacagaaattcgaggtggagaaatacattgtccacaaggaatttgatgacgatacttacgataatgatattgcacttctgcaacttaagtcggattcatcaaggtgtgcacaggagtccagcgtcgtgaggaccgtgtgtctcccacctgccgaccttcaactgccagactggaccgagtgcgagcttagcggatacggtaagcatgaagccctctctcccttttactcggaacgcctgaaagaggctcacgtcagattgtaccccagctccagatgcacctcgcagcatcttctgaatcgtactgttacggacaatatgctgtgtgcaggtgacactcgatcgggaggaccacaagccaacctgcatgatgcatgtcaaggtgattcaggggggcccctcgtgtgccttaatgatggaaggatgactctggtcggaataatcagctgggggctgggatgtggtcaaaaggacgtcccgggagtgtacacgaaagtgaccaactacttggattggatccgggacaatatgcgtcct

SEQ ID NO: 18277 - DNA, 1686 bp, Artificial Sequence
  Description of Artificial Sequence: Synthetic coding sequence
atggatgcaatgaagagaggcctgtgttgtgtcctgcttctctgtggagctgtgtttgtttcaccttcacaagagatccacgcacggtttcggagaggagcaagaagctaccaagtgatctgccgtgatgaaaagacgcaaatgatttaccaacagcatcaatcgtggcttcgacctgtgctgagaagcaaccgcgtggaatactgttggtgtaacagcggtcgcgcgcaatgccactccgtccctgtcaagagctgttccgaacctcgctgtttcaacggagggacttgtcagcaagcgctttacttctcagattttgtctgccaatgccctgagggattcgccgggaagtgctgcgagattgatactagagccacctgttacgaggaccagggaatttcctaccggggtacttggtccactgcagaaagcggtgcagaatgtaccaattggaattcgtcagcccttgcacagaagccatactcaggtagacgtccagatgccattcggctgggactcggtaaccataactactgtaggaatcctgatagggattcaaagccttggtgctacgtgtttaaggccggcaagtacagctcagagttctgctccactccagcatgtagcgagggtaatagcgattgttactttggcaatggttcagcatacaggggtacccattcactcactgaaagcggagcaagttgccttccttggaactccatgattctcatcggtaaggtctacactgcacaaaatccctcagcacaggcactcgggcttggaaaacacaactactgtagaaacccagatggtgacgctaaaccatggtgtcacgttctgaagaataggcgactcacttgggaatactgtgatgtgccgtcgtgtagcacttgcggactgagacagtactcgcaacctcagtttcgcataaagggaggccttttcgctgacatcgcatcgcatccttggcaggccgcgatattcgcaaagcacagaagaagccccggtgaaagattcctgtgtggggggatactgatatcgtcctgttggattctgagcgcggcccattgctttcaagaacggtttcctccacatcaccttaccgtcattctcggacgtacttaccgcgtggtgcctggggaagaagagcagaaatttgaggtcgaaaagtacattgtgcataaggagttcgacgatgatacttacgataatgacattgcacttctgcaattgaagtcggattcgtcgcgctgcgcacaggaatcatccgtggttcgaactgtgtgtctgccacctgcagatcttcaacttcctgactggaccgaatgtgaactctcaggatacggaaagcacgaggcactttcacctttttactctgaaagacttaaggaagcacacgtcaggctctatccttctagcagatgtacgtcccaacaccttctgaaccgcactgtgactgataacatgctctgtgcgggcgatactcggtccggaggtccacaggcaaacctccatgatgcgtgtcaaggagattcgggcggacctctcgtctgtctgaacgatggtaggatgaccctcgtgggaattatctcatgggggttgggatgcggacagaaggatgtgcctggagtgtatactaaagtaaccaactaccttgactggattagggataacatgcgtccc

SEQ ID NO: 18278 - DNA, 1686 bp, Artificial Sequence
  Description of Artificial Sequence: Synthetic coding sequence
atggacgcaatgaaacgcggcttgtgctgtgtccttcttctgtgtggtgctgtgtttgtttcaccgtctcaggagatccacgcgaggtttcgtcgcggcgcgagaagttaccaggtcatttgtcgagatgaaaagacacagatgatataccagcaacatcagtcatggctccgaccagttctccggagcaatagagtggagtactgttggtgcaactctgggcgggctcaatgtcacagcgtccctgtgaaatcgtgcagcgaacctcggtgcttcaacgggggcacctgtcagcaggctttgtattttagcgattttgtctgtcaatgcccggagggcttcgcgggaaagtgctgtgaaattgataccagagcgacttgctatgaagatcagggtatatcttataggggcacctggagtacggcggaatcgggtgccgagtgtacgaattggaattctagcgcattagctcagaaaccctattccggtcgccggccggacgcaatccgcttgggcttagggaaccataattactgtcgcaatcctgatcgcgattcgaagccctggtgttatgtgttcaaagcgggtaaatatagctcagagttctgttctacccccgcctgcagtgaagggaattcggattgttattttggaaatggatccgcttaccgaggcacccactccttgactgagagtggagcatcctgcctcccatggaactctatgatcctaattggcaaggtttataccgcacaaaacccgtccgcccaagcgctgggtctgggaaagcataattactgcaggaatccggatggggatgccaagccctggtgccacgtgctgaaaaacagacgtctgacatgggagtactgcgacgtccctagttgcagtacttgtggattacggcagtacagccagccacaatttaggatcaagggaggactgtttgccgacatcgctagccacccgtggcaagctgccatctttgccaaacatcggcggtctccaggcgaacggttcctgtgcggagggatcctgatatcctcctgctggatcctgagtgctgctcattgcttccaggaacggttccctccacaccacctgactgtgattttgggccggacctacagagttgttcccggggaggaggagcagaagttcgaggtcgagaagtatattgtgcacaaagagttcgatgatgacacatatgacaacgacattgcactgctacaactgaagtccgactcttcgagatgcgcccaagagtcatcagtcgtccgcaccgtgtgcctgccccctgccgacttacagctgccagattggactgaatgtgaactgtcggggtatggaaaacacgaagccctgagcccattttatagtgagaggctgaaggaagctcacgtgcgtctgtatccctcatccagatgcaccagccaacacctgctgaaccggacagtaaccgataacatgctttgtgctggtgacacccgctcagggggcccacaagccaatttacacgacgcatgtcagggggacagtggaggacctctggtgtgtctaaatgatgggaggatgacacttgtcggaattatcagttggggactgggatgcggccagaaagacgtacccggcgtttacaccaaggtcactaactacctagactggattcgcgataacatgcgacca

SEQ ID NO: 18279 - DNA, 1686 bp, Artificial Sequence
  Description of Artificial Sequence: Synthetic coding sequence
atggacgccatgaagaggggactgtgctgcgtgctgcttctgtgcggcgccgtgtttgtttcaccgagtcaagaaatacatgcacggtttagacgcggagcgcgcagctaccaggtcatctgccgcgacgagaagacccaaatgatctatcagcagcaccaatcctggcttagacctgtcctgcgaagcaaccgagtcgagtattgctggtgtaactcaggtagagcacaatgtcactcggtgcccgttaaatcctgctcagagccccgttgttttaatggtggcacttgtcagcaggctctatacttttctgacttcgtctgccagtgtccagaaggatttgcaggtaaatgctgcgagatagatacccgggcgacctgttacgaggatcagggaatttcttacagaggaacatggagcaccgccgagtcaggtgcagagtgcacaaattggaatagttctgcactggcgcagaagccttattcaggccgcagacctgacgccattagacttggcctggggaatcacaattattgtagaaatccggatagagactctaagccctggtgctatgtattcaaggccggaaagtactcttcagagttttgctcaacgcctgcctgtagcgagggaaattctgactgctactttggaaatggctctgcatatagggggacgcattccctcaccgagtctggggcttcctgtctgccttggaattctatgattttaatagggaaggtttacaccgcgcaaaatcctagtgcacaggccctgggcctaggcaagcacaactattgccgcaaccccgacggcgacgctaagccgtggtgccatgtcctcaaaaacagacggctgacttgggaatactgtgacgtcccttcatgctctacctgtggactcagacagtactcccagcctcagttccggatcaaaggagggctatttgccgacattgcttcacatccgtggcaggcggcaatttttgccaagcacaggcggagcccgggagaaagatttctgtgcggcggaatactgatttcttcttgctggatcttgagtgctgctcactgttttcaggaaagatttccaccacatcatcttaccgtaattttgggccgtacataccgcgtggttccgggagaagaagagcagaaatttgaggttgagaaatacatcgtccacaaagagttcgacgacgatacctatgacaacgatatcgccttgctgcaactgaaatcagacagcagcagatgcgcacaggagagttcagtagtgcgaacagtgtgtttgccacccgccgacttgcagctgcccgactggaccgaatgcgaactgtctggatatgggaagcacgaagctttatcacctttctattcggaaaggctgaaagaggctcacgtgcggctgtatccatcttcgcgatgtacttctcagcacctgctgaatcgcaccgtaaccgataacatgttgtgtgcaggcgataccagaagcgggggcccccaggctaacctgcacgacgcctgccagggcgatagtggtgggcctctagtctgtctgaatgacggtcgtatgacactggtggggattatctcatggggcctaggctgtggccagaaagacgtaccaggtgtctacaccaaggtgactaattacctggactggattcgagataacatgcggccc

SEQ ID NO: 18280 - DNA, 1686 bp, Artificial Sequence
  Description of Artificial Sequence: Synthetic coding sequence
atggatgcgatgaaacggggtttgtgttgtgtgctcctgctgtgtggcgcggtgtttgtgtcaccatcccaggagatccatgcacgcttccggcgcggggcccgctcctaccaagtgatctgtcgggatgaaaagacccagatgatctaccagcagcaccagtcctggcttcgccctgtgctgcgctcaaacagggtcgaatactgctggtgcaattcgggacgcgcccaatgccactcagtgccagtgaagtcgtgctcagaaccgcgttgtttcaatggcggaacttgccagcaggcgctgtatttctccgatttcgtgtgccagtgtccggaagggttcgccgggaagtgctgcgaaatagacacccgggccacctgttacgaggaccaaggtatctcctaccggggaacttggagcaccgccgagtcgggagccgaatgcacgaactggaactccagcgccctcgcccagaaaccctactccggccgcagaccagacgcaatccggctgggactcggaaaccacaattactgccgtaacccggacagggacagcaaaccgtggtgttacgtgttcaaagcgggaaagtactcgagcgagttttgctcgaccccagcctgcagcgagggaaatagcgattgctactttggcaacggcagcgcttaccgcggaacgcattcgctcaccgaatccggagcctcatgcctcccgtggaactcgatgatcctcatcgggaaggtgtacaccgcacagaacccgagcgcccaggccctgggcttgggtaagcacaactactgcaggaacccggacggtgatgctaagccttggtgccacgtgctcaagaaccggcgcctgacttgggaatactgtgatgttccgagctgctcgacctgcggccttcggcaatattcgcaaccccaatttaggatcaaaggtggcctgttcgctgacatcgcctcacacccctggcaggcagccatcttcgcaaagcacagacggagcccgggagaaaggtttctttgcgggggcatactcatctcctcctgctggatcctctcggcggctcattgtttccaagaacgcttccccccgcatcacctcactgtgatccttggacggacttatcgcgtggtgcctggcgaagaggaacagaagtttgaggtggagaagtacattgttcacaaggagttcgacgacgatacgtatgacaacgacatcgctctgttgcaactgaagtccgactcctcccggtgcgctcaggagtcgtcagtcgtcagaaccgtttgcttgcctccagccgatctgcaactgcccgattggaccgaatgcgagctgtcgggctacggcaagcatgaggcactgagccctttctactcagaacggcttaaagaggctcatgtcaggctgtacccgtcgtcgagatgcacttctcagcacctcctgaatcggaccgtcactgacaatatgctgtgcgctggagatactcggagcggaggcccgcaagcgaatcttcatgacgcatgccagggagatagcggaggaccattggtttgtctgaatgacggacgaatgacgctggtcgggatcatctcatggggactgggatgcggtcagaaagacgtgcctggcgtctatactaaggtgactaattaccttgactggatccgcgacaacatgcgccct

SEQ ID NO: 18281 - DNA, 1686 bp, Artificial Sequence
  Description of Artificial Sequence: Synthetic coding sequence
atggacgccatgaagaggggtctctgttgtgtgctcctgctgtgcggggcagtattcgtttcccctagccaagagatacatgcaagattccgccgcggtgcccgctcctaccaggtgatctgcagggatgaaaaaactcagatgatctatcaacagcaccagtcttggctgcgaccagtcctacggtctaaccgcgtggaatattgctggtgcaattccggcagagctcagtgccattcagtgcccgtgaaatcttgttcagagccccggtgcttcaacgggggcacgtgtcagcaggctctgtatttcagcgacttcgtgtgtcaatgcccagagggttttgcaggaaagtgttgcgaaatagacacccgcgcaacctgttacgaagatcagggcatctcttacagaggtacctggtctacagccgagtcgggagcggagtgcaccaactggaactcgtcagccttggctcagaagccgtactctggaaggcgaccggacgctattcgtctggggcttggaaatcataactattgcagaaacccagatagagattccaagccgtggtgctatgttttcaaagcggggaagtacagttcagagttttgctctacgcccgcatgttccgaaggcaatagcgactgttatttcggtaatgggtctgcttatcgtggcacccactctttaactgagagcggggcttcctgcctcccatggaacagcatgattctcattggcaaggtgtatacggctcagaacccgtctgctcaggctttgggcctgggaaaacataattattgtcgaaaccccgatggcgatgcaaagccctggtgccatgtgctgaagaatagaaggttgacttgggagtactgtgatgttcctagttgctccacttgtggtctccggcagtatagccaacctcagtttcgcatcaaaggcggactgttcgccgacatcgctagccatccttggcaagccgcgatctttgctaagcaccggcgatcaccgggggaaagattcctgtgcggagggatactcatctccagctgctggatcctgtctgccgcgcattgtttccaagagagattcccaccgcatcatctgaccgttattctgggccgaacctacagagtggtgcctggcgaggaagagcagaagttcgaggtggagaagtatatcgtgcataaagagttcgatgatgatacgtacgataatgatatcgctctgctgcagctgaagtcagattcttccaggtgcgcccaggaatcttccgtcgtccgtacggtgtgcctgcctcctgccgaccttcaactccctgattggactgagtgtgagctgagtggatacggaaagcacgaagctctgtcccccttctactccgagcggctgaaggaggctcacgtgagactgtatcctagctctcgctgcactagtcagcatctcctgaaccggacagtgacagataacatgttgtgtgctggtgacacacggagtggaggcccgcaggctaacctgcacgacgcgtgtcagggtgactcgggcgggccattggtgtgtctcaatgacggcagaatgaccctggttggtatcatttcctggggactaggatgtggccagaaagacgtcccgggggtctacacaaaagtgacaaactatttggactggataagggacaacatgaggcca

SEQ ID NO: 18282 - DNA, 1686 bp, Artificial Sequence
  Description of Artificial Sequence: Synthetic coding sequence
atggatgcgatgaagagaggattgtgttgtgtacttttgttgtgcggagctgtatttgtctcgccgtcccaggaaattcacgctagattcagacgtggagcacggtcttatcaagtcatttgcagagatgagaagactcaaatgatttaccaacagcatcaaagttggctaagaccagtgctccgatccaatagagttgaatactgttggtgcaattctggacgagcacagtgtcatagtgttccagttaaatcctgctctgaaccaagatgttttaatggaggaacttgtcaacaggcgctttacttttcggactttgtatgtcaatgtccagaaggctttgctggcaaatgctgcgaaatagataccagagccacttgttatgaagatcagggaatctcttaccgcggcacatggtcaacagcggaatcgggtgcagaatgcactaattggaattcgtccgccttggcccaaaaaccttactcgggacgtcgaccagatgctataagacttggactaggaaatcacaattattgccgaaatccagatcgagattccaaaccatggtgttacgttttcaaagccggaaagtattcatctgagttctgttctacccctgcatgctcggagggaaattccgattgttacttcggaaacggatcggcttatagagggactcactcactcacagagtcgggagcatcatgccttccatggaattcaatgattttgatcggaaaagtatatacggcacagaaccccagcgctcaagccctgggcctgggaaaacataattattgtagaaatccagatggtgacgcaaaaccatggtgccacgtcctgaaaaatcgccgactcacatgggaatattgtgatgttccaagttgttcaacctgtggtttgcgtcaatactctcaaccgcagtttcggatcaagggcggattgtttgctgatattgcctctcatccttggcaagctgcaatctttgcaaaacaccgtcgctcaccaggagaacgatttctctgcggtggaattttgatctcgtcttgctggattctttcagcggctcattgctttcaggagcgattcccaccacatcatctaactgttattctgggacgtacttatagagtagtcccaggtgaagaagagcagaaattcgaagtcgagaaatacattgtccataaggaatttgacgatgatacttatgacaacgatattgctctattacagcttaaaagtgactcctcgcgatgtgcacaagagagctctgtcgtacgaaccgtttgtttacccccggcagaccttcaactgccagattggacagaatgcgaactttctggatatgggaaacatgaagcattgagtcccttctactccgaaagactgaaggaagcacacgtacgtctctacccttcttcgcgctgcacttcacagcatttgcttaaccgaacagtaactgataatatgctctgtgctggagacacgcgttcaggtggaccgcaagctaatcttcatgatgcttgccaaggcgattcaggtggtccgttggtttgtcttaatgatggacgaatgactctggtcggcatcattagttggggcctaggatgtggacaaaaggatgtgccaggagtctacactaaggttaccaactaccttgactggatacgtgataatatgcgtcca

SEQ ID NO: 18283 - DNA, 1686 bp, Artificial Sequence
  Description of Artificial Sequence: Synthetic coding sequence
atggatgctatgaaaaggggactatgctgtgtgctacttctgtgcggagctgtgtttgtttctccttcacaggaaatacacgcccggttcagaagaggggcacggtcttatcaagtcatctgtcgggacgaaaaaacacagatgatttaccagcaacaccagtcctggctgcgacctgtactccgttctaaccgagtggaatattgttggtgtaattccgggcgggcgcaatgtcatagtgtcccagtaaaatcctgttccgaacctagatgttttaacggagggacttgccagcaggcactatacttctctgatttcgtgtgtcagtgtcctgaaggatttgccggaaaatgctgtgagattgatactcgggccacatgctacgaagatcagggaatctcctataggggaacttggtctacagcagaaagtggggcagaatgtactaattggaactcttctgccttggcccagaaaccatacagtgggcggaggccagatgctatccgcctcggactcggaaaccacaattattgtagaaatcccgaccgtgactcaaaaccctggtgctacgtgttcaaagccgggaaatattcttccgaattctgctccactcctgcatgcagtgaagggaactcagattgctattttgggaacgggtccgcctaccgcggaacacattccctgacagaatccggggcatcctgcctcccttggaattcaatgatcctaatcgggaaagtttacactgctcagaacccatccgcccaggcactggggctcgggaaacataactattgccggaaccctgatggggatgctaaaccctggtgccatgttctaaaaaacaggcggctgacttgggagtattgcgatgtgcctagttgttcaacttgtggacttcggcagtacagtcagccccaattcaggataaaaggggggctcttcgccgatattgcttcacacccctggcaggctgctatctttgctaagcaccggcggtctccaggggagcgctttctttgcgggggaatacttatctcttcttgttggatactatcagctgctcattgcttccaggaaagattccctccacaccaccttactgttatcctcgggaggacatatagagtcgtaccaggggaagaagagcagaaatttgaagttgaaaagtacattgtgcacaaggagttcgatgatgatacttatgataacgatattgccttactccagctcaaatccgattcttcacgttgtgctcaggaaagttcggtcgtgaggactgtctgcctgccaccggctgatctgcagttaccagattggactgaatgtgaattgagtgggtatgggaaacatgaagcactgtcccctttttatagtgaaagactcaaagaagctcacgtgaggctgtatccctcttcaaggtgcacttctcagcatcttctaaacaggacggtcacagataatatgctctgcgcaggggatacaaggtctgggggaccacaggcaaatctccacgatgcatgtcagggagattccggagggcctcttgtttgtctaaacgatggaagaatgactctggtggggattatctcatggggattaggatgcggacaaaaagatgtccccggagtatatactaaagtgacaaattatctcgattggatccgcgataatatgagaccc

SEQ ID NO: 18284 - DNA, 1686 bp, Artificial Sequence
  Description of Artificial Sequence: Synthetic coding sequence
atggacgctatgaaacgagggctttgctgtgtcctgctgttgtgcggagctgtgtttgtcagcccatcacaggagatccatgcacgctttcgacggggtgctaggtcttaccaggtcatctgcagagatgaaaaaacacagatgatctatcaacagcaccagtcctggctacggcccgtgctgagatcgaaccgcgttgagtattgctggtgcaattcaggtcgagcccagtgtcactctgtgcctgtgaagagttgctctgaaccaaggtgcttcaatggtggcacctgccaacaagccctgtacttcagcgactttgtctgccagtgtccggaggggttcgcagggaaatgctgtgaaatagatacacgagccacctgctatgaggatcagggaatttcataccgcggcacttggtcaaccgccgagtctggagccgagtgtacaaactggaacagctcggcgcttgcgcagaagccttacagcgggaggagaccggacgccatccgcctggggttgggcaatcacaactattgccggaatccagaccgggacagcaagccctggtgctacgtgttcaaggcggggaagtactcatctgaattttgctccacccccgcctgctctgaaggcaactcggattgctacttcggcaacggatcagcttatagggggacccactccctcaccgagagcggcgcgagctgtctcccttggaatagcatgattcttatcggcaaagtttacacagcacaaaatccgagcgcacaggctttgggtctgggaaagcacaattactgtaggaaccccgacggagacgcgaagccctggtgtcatgtgctgaagaatagaaggctgacttgggaatactgtgacgtgccttcttgtagcacatgcgggttgaggcaatactcccagccccagttccgaattaaaggaggactgtttgcagacattgcatcacacccatggcaggctgcaatcttcgcaaagcaccggagatccccaggggagcgttttttgtgtggcgggatcctgatatcgtcctgctggatcctatctgccgctcattgcttccaagaaagattcccaccgcatcaccttacagtgatccttggacggacatacagggttgtgcccggagaggaggagcagaagttcgaagttgagaagtatattgtccataaggagtttgatgacgatacatatgataatgacatagcactacttcagctgaagtccgatagctcaaggtgtgcccaggagtctagcgtcgtaagaacagtgtgtctgccccctgcagacctccagctacccgactggactgagtgtgaactttccggctatgggaaacacgaggccctatcccctttctattcagagagactgaaggaagcccatgtgcggctttatcccagcagcaggtgtactagccaacacttgctgaatcgtacggtgacagataatatgttgtgtgctggggataccagatcaggtggtccccaggccaaccttcacgatgcctgccagggagattctggtggcccgcttgtgtgtctgaatgacgggcggatgaccctggtgggaataattagttgggggttagggtgtggacagaaggacgtgccaggagtctatacgaaagtgaccaactatttggactggatccgggacaacatgagaccc

SEQ ID NO: 18285 - DNA, 1686 bp, Artificial Sequence
  Description of Artificial Sequence: Synthetic coding sequence
atggacgcgatgaaacgcggcctgtgctgcgtcctcctgctgtgcggtgccgtgtttgtgtccccttctcaggaaatccacgcacgcttccgccggggagccagatcataccaggtgatctgccgagacgaaaagacccaaatgatctaccagcagcatcagtcctggctccggccagtgctgagatcgaatcgggtggaatactgctggtgcaactccggtcgggcccagtgccactcggtgccggtgaagtcgtgctcggaaccgcggtgcttcaatggaggcacctgtcagcaagcactctacttcagcgacttcgtgtgtcagtgcccagaaggattcgcaggaaaatgctgcgagattgatacccgggccacttgctatgaggatcagggaatcagttaccggggaacctggtcaactgcggagtcgggcgcagagtgtactaactggaacagctcggcgctggcccagaagccatactccggcagacgacccgacgccatccggctgggcctcgggaatcacaactactgccggaatccagaccgggactccaagccttggtgctacgtgttcaaggccggaaaatactccagcgaattctgttccaccccggcctgttcagaaggcaactccgattgctacttcggaaacgggtccgcctatagaggcactcacagtctgaccgagtcaggagcctcgtgcctgccatggaacagcatgatcctgatcggtaaggtgtacactgctcagaatcctagcgcgcaagcactgggcctcggcaagcacaattactgccgaaatccagatggggacgcaaaaccgtggtgccatgtgctgaagaacaggcgccttacctgggagtactgcgacgtgccctcgtgctcgacctgcggcctgagacaatactcgcagccccagttccgcatcaagggcggacttttcgccgatatcgcgtcccatccgtggcaggcagccatcttcgccaagcatcgccgcagccctggagaacgctttctgtgcggaggaatcctcatctcgtcatgctggattctctccgcagctcactgcttccaggaaagatttccaccgcatcacctgacggttatcctcggccgcacttaccgggtggtgcctggagaggaagaacaaaagttcgaggtcgagaagtacatcgtccacaaggagtttgatgacgacacctacgacaacgacatcgctctgctgcagcttaagagcgattcgtcccggtgcgcccaggagtcctcggtggtgcgcaccgtgtgcttgccaccggcggatctccagctgccagattggactgagtgtgaactgtccgggtacggaaagcacgaggcgctgtcgccgttctactcggagcggctgaaggaggcccatgtgcggctgtatccgtcgtcacggtgtacctcgcagcatctcctgaacaggacggtcactgataacatgctttgcgccggagacactcgctcaggaggaccgcaggctaacctccacgatgcctgtcagggggactccggtggaccgctggtttgcctcaacgacggtcgcatgaccctcgtgggcatcatcagctgggggctgggttgcggacagaaggacgtgccgggagtgtacaccaaggtgactaactacttggactggattagagacaacatgcgcccg

SEQ ID NO: 18286 - DNA, 1686 bp, Artificial Sequence
  Description of Artificial Sequence: Synthetic coding sequence
atggacgccatgaagagaggcctgtgctgcgtgctgctgctgtgtggagccgtgtttgtgtctccttcccaagaaatccatgcacgattcaggcggggcgccagaagctaccaagtgatttgtcgggatgagaagacccagatgatctatcaacagcatcagagttggctgcgaccggtgctgcgaagcaatcgcgttgagtattgctggtgtaactccgggagagctcaatgccactctgtcccagtgaaatcttgtagcgagccccgctgttttaacggaggtacttgccagcaagccctgtactttagtgactttgtgtgtcagtgcccggaaggttttgcaggaaaatgctgtgagatcgacacccgcgccacctgctacgaggatcaaggcattagttatcggggcacatggagcaccgcagagtctggtgcggagtgcacaaactggaactcaagcgcactggcacagaagccttacagcggtcgcagaccggacgcaattcgcctgggcctgggtaaccacaactactgccgcaacccagatcgggacagtaagccctggtgctatgtcttcaaggctggtaaatattcctcggagttttgcagtacccctgcttgcagcgaaggcaactcagactgctacttcggtaacggtagtgcataccggggtacccacagtcttactgagtcgggtgcgtcatgtttgccctggaacagcatgattcttatcggcaaggtctacactgctcagaatccctcggctcaggctttaggccttggaaagcacaattattgccggaatccagacggcgacgccaaaccttggtgccatgtgctgaagaatcggagactcacgtgggagtattgcgatgtgccatcttgctcaacctgcgggctgagacaatactcccagcctcagtttagaataaaaggaggtctgttcgccgacatcgcttcccacccgtggcaggctgccatcttcgcaaagcataggcgatctcctggcgagcgcttcctatgtgggggaatcctgatatcttcttgttggatcttgtccgcggcccactgttttcaggagcgcttccctccccatcacttaacagtaatcctcggcagaacttatcgcgtggtcccaggtgaagaggagcagaaatttgaagtcgagaagtatatcgtccataaagaattcgatgatgacacctatgacaacgacatagcactcctgcagttgaagtccgatagttctagatgcgcccaggaatcctcggtggtgcgcaccgtgtgtctaccacccgcggatctacagctgcctgactggactgagtgtgaactatcagggtacggaaagcacgaggccctgtctccattttacagcgagcggctcaaagaggcgcacgtccggttgtacccctcttctcgatgcacctcacagcacttgctgaatcggaccgtgactgacaacatgctctgtgcaggggatactagatccggggggccccaggcaaacctgcacgatgcttgccaaggagactccgggggcccactagtatgcctgaatgatgggcgaatgacacttgtaggaatcatttcctggggtctgggctgtggacaaaaagacgttcctggggtgtatacaaaggtcaccaactatctggactggatccgggataatatgcgtccc

SEQ ID NO: 18287 - DNA, 1686 bp, Artificial Sequence
  Description of Artificial Sequence: Synthetic coding sequence
atggatgccatgaagaggggtctgtgctgcgtccttcttttgtgtggagcggtgttcgtcagtccgagtcaggaaatacatgccaggtttcgtcgcggagctcggtcttatcaggttatttgccgggacgagaagactcagatgatctatcagcaacaccagtcatggctgcggcctgttttgcgctccaacagagttgagtactgctggtgcaactcaggtcgagctcagtgtcattcagtgccagtgaagagctgctcagaaccaagatgttttaacggggggacctgtcagcaggccttgtatttcagcgactttgtgtgtcagtgcccagagggctttgcaggtaagtgctgtgaaatcgacactcgagccacttgctatgaggatcagggaatcagctaccgcggaacctggtcaaccgctgagagcggggctgaatgtacgaattggaattcgtcggccttggcccagaagccatactctggaaggagacctgatgctatccggcttgggctcgggaatcataactactgtaggaatcccgatcgtgatagtaagccatggtgctacgttttcaaagcaggcaagtactccagtgagttttgtagcacgcctgcatgttcagaggggaatagcgactgctatttcggtaacggtagcgcatatagaggcacgcactcgctcacagagtcgggagccagttgtctcccctggaatagcatgatccttatcgggaaggtatacaccgctcagaacccatccgctcaggcgctgggactggggaaacataactactgtagaaatcctgatggcgacgccaagccctggtgccatgtactgaaaaatagacggctcacctgggaatattgcgatgttcccagctgcagcacctgtggccttcgccagtacagtcagcctcaattccgcatcaaaggcggactgttcgcggacatcgccagccacccctggcaggcagcgattttcgctaagcacaggagatctcccggggaacggttcctatgcggcggtatcttaatcagcagctgctggattctgagcgctgcacattgtttccaggagagattccccccccaccacctcacagttatcctcggtcgcacctatagggtggtaccgggagaagaggaacagaagtttgaggttgagaaatacatagtccataaggagttcgacgacgacacatatgacaatgatatcgctctgttgcaactgaagtcagatagttcacgctgtgcacaggagtcatcagttgtaagaactgtgtgcctcccccccgctgacctgcagctgcctgattggaccgagtgtgagctgtctggctatgggaagcacgaggctctgtcaccgttttattcggagcggttaaaagaagcccacgtgaggctgtacccgtcgtctcggtgtacctctcagcacctgttgaatcgaacagtaacagataatatgctatgtgctggggatacccgcagcggtggcccacaggcaaacctacacgacgcctgccagggcgactccggggggcctttggtctgcctcaatgacgggcgcatgactctagtgggcattatctcttggggcttgggttgcggtcagaaggacgtaccgggggtgtatacaaaagtgacaaactatctggactggattcgggataatatgcgtcct

SEQ ID NO: 18288 - DNA, 1686 bp, Artificial Sequence
  Description of Artificial Sequence: Synthetic coding sequence
atggatgccatgaaacgcgggttgtgttgcgtgctgctgctgtgcggagccgtgtttgtttcaccgtcccaagaaatacacgcccggttccggcgaggagctcgcagctaccaggtgatttgcagggacgagaaaactcagatgatctaccagcaacatcagtcctggctgcggcccgtgctgcggtcgaaccgcgtcgaatactgttggtgtaactccggaagagcccaatgtcattccgtgcctgtgaagtcctgctccgagccccgttgctttaacggtgggacttgccaacaggcactgtacttctcagactttgtgtgtcagtgcccagagggattcgctggtaaatgttgtgagattgatactagagctacgtgttacgaagatcagggcatctcgtaccgcggaacctggtccacggcggaatccggtgccgaatgcaccaactggaattcatcagcccttgcccaaaagccatactcaggccggcgccccgacgccatacgcctgggactcggaaaccataactactgccggaatccagatcgcgattcaaagccatggtgctacgtgttcaaagcaggcaagtatagctccgaattctgctcgacccctgcttgctccgagggaaacagcgattgctactttgggaatggatcagcttaccgcggcacgcactccctcactgaatccggcgcctcgtgcctgccgtggaacagcatgatccttatcggcaaggtctacaccgctcagaacccctccgctcaggccctgggacttggcaagcataactattgccgcaatccggatggagacgcgaagccctggtgtcatgtcctcaaaaaccgtaggctcacgtgggagtattgcgatgtcccgtcatgttcaacctgtggattgcgacagtactcacagccgcagtttagaatcaagggcggactgttcgcggacatcgcatcgcacccgtggcaagcggccatcttcgcgaagcatcggcgcagcccaggagaacgcttcctctgtggcggcatcctgatctcgtcctgctggatcttgtccgccgcgcattgcttccaggagcggttcccaccccatcatcttactgtgatccttggacggacttaccgcgtcgtgcctggcgaagaagagcagaagttcgaggtggagaagtacatcgtgcacaaggaatttgatgacgacacttatgacaatgatatcgccctcctgcaactgaagtcggactcctcaagatgtgcacaagagtccagcgtcgtcaggaccgtgtgtctcccacccgcagacctgcaactgccagattggaccgaatgcgagctgtcggggtacgggaagcacgaagcgctgtcaccgttttactccgagagattgaaagaagctcatgtgcgcctgtacccttcgtcgagatgtacgtcccaacacctgctcaatagaactgtgaccgacaatatgctgtgcgcaggcgacacccgctcaggaggaccgcaggcaaacctgcacgatgcatgccaaggtgattcgggaggtccgctcgtgtgcctgaacgatggccgcatgaccctcgtgggaattatctcgtgggggttgggatgtggacagaaagacgtgccgggtgtgtacactaaagttactaactacctggattggatccgggataacatgcgcccg

SEQ ID NO: 18289 - DNA, 1686 bp, Artificial Sequence
  Description of Artificial Sequence: Synthetic coding sequence
atggatgccatgaagaggggcctgtgctgcgtcctgctcctatgcggagcggtgttcgtgagcccttcccaagagatacacgcaaggtttcggcgaggagcaagaagctaccaagtgatctgcagagatgagaaaacacagatgatctatcagcagcatcagagttggctgaggcctgttcttaggagtaatcgcgtagaatattgttggtgcaatagtggacgtgcacaatgccattctgtccccgtcaaatcgtgctctgaaccgcgctgttttaacggcggcacctgccagcaggcactgtatttttccgacttcgtctgccagtgccccgaagggtttgcgggcaaatgctgcgagatcgacactcgggcaacttgttacgaggatcaaggaattagctaccgaggcacctggagtaccgccgaatcaggggcagaatgtactaattggaatagttcggcactggcccagaagccatactctggtcgccgcccagacgctatccgcctgggccttggtaaccataactactgtcgtaaccccgaccgagactcgaagccatggtgctatgtgtttaaggccgggaaatattcttctgaattttgctccaccccagcctgttccgagggtaattcagattgctacttcgggaacggatcagcctatcgcggaacacactctctcacagagtcaggcgcaagttgtctgccttggaacagtatgattcttattgggaaagtttacactgctcagaacccgagtgcccaggcattagggctggggaagcacaattattgtcgaaaccccgacggcgacgcgaagccgtggtgtcacgtgttgaaaaatcgtcgtttgacctgggagtattgcgatgtcccctcctgctctacgtgtggacttaggcagtactcccaaccccagtttaggatcaaaggggggttgttcgctgatatagccagtcacccctggcaggccgcaatattcgccaagcatcggcgaagccctggtgagcggttcctatgtgggggcattctgatttctagctgttggatattgtccgccgctcattgcttccaggaacggttcccgccacaccacttaaccgtgatcctgggaagaacgtacagggtagttcctggggaagaagagcaaaaatttgaagtggaaaagtacattgtgcacaaagagtttgatgatgacacatacgacaacgacattgccctcctgcagctaaagagcgattcttcaagatgtgctcaggagagctctgtggtgagaacagtgtgcctgccaccggcagacctccaactccccgattggacagaatgcgaacttagcgggtatggaaagcacgaggccttgtcacctttttactctgaacgactgaaggaggcccacgtgaggctctatcccagctcgaggtgtactagccagcacctgctgaaccgcacagtcaccgataacatgctctgcgcaggggatacgaggagcggtggtccccaagctaacctgcacgatgcctgccagggcgattccgggggccccctagtatgcctcaatgatggccggatgaccctggtcggcataatttcctggggcctgggctgcggccagaaagacgttccgggcgtctacacaaaagtgactaactacctcgattggataagggataatatgcgacca

SEQ ID NO: 18290 - DNA, 1686 bp, Artificial Sequence
  Description of Artificial Sequence: Synthetic coding sequence
atggatgctatgaaaagaggtctctgttgtgtcctcctcctttgcggggcggtattcgtgagcccctcccaggagatccatgcccgctttagacggggcgctcggagttatcaagtcatttgccgggacgagaagacgcagatgatttatcagcagcaccagtcttggctcaggccggtacttcgctctaatcgagtggagtattgctggtgtaattctgggcgcgctcagtgccacagtgtgcccgtgaaatcctgcagcgaacccaggtgttttaacggaggaacctgtcagcaggccttgtatttctccgacttcgtttgtcagtgccctgagggcttcgctggaaagtgttgtgaaatagatacccgggcgacatgttacgaagaccagggaattagttaccgaggcacctggtctaccgcagaatcaggggccgagtgtaccaactggaatagcagcgctcttgcacagaaaccatattccggaaggaggcctgacgctattcggctgggccttggtaatcacaattactgtcggaacccagatcgagattccaagccatggtgctatgtgtttaaagccgggaagtacagcagcgaattctgctctacacccgcttgttccgaaggcaactctgattgttacttcggtaacggtagtgcctacagaggaactcactctcttacggaaagtggggctagctgtttgccttggaatagcatgatactgatcggtaaggtgtacacggcccagaacccctctgcacaagccttgggcctgggcaagcataactattgcaggaatcctgatggtgacgcaaaaccttggtgccacgttcttaaaaaccgacgcctcacctgggagtactgtgatgttccgagctgtagcacatgtgggctgcggcaatattcccagccacaattcagaatcaagggcgggctgtttgccgatatcgcgagtcacccttggcaggccgccatctttgcgaaacacagacgatctcccggggagagattcttgtgtggcggaatcctcatctctagctgttggatactcagcgcggcccattgctttcaggagcgatttcctccacaccatcttacagtcatcctcggccgaacgtaccgagtggtcccaggggaggaagagcagaaatttgaggtagaaaaatacatcgtgcataaggaatttgatgacgacacctacgacaacgatatagcactgctgcaactgaagtccgactcatcccgctgcgcacaagaaagctccgtcgtgcgcacagtttgtcttcctccagccgatctgcaactgcctgactggacagaatgcgagctgagtgggtacggtaagcacgaggccctgtccccgttttacagcgagcgccttaaggaggctcacgtgagactgtatcccagcagcagatgtacaagccaacatttgcttaaccgcacagtgaccgacaatatgctttgtgctggcgacactaggtccgggggaccacaggccaatcttcatgacgcttgccagggtgattccggaggtccactcgtctgtcttaacgatggaaggatgaccctggtaggaattattagctggggcctcggctgcggtcagaaggacgtgccaggcgtgtacaccaaggtaacaaactatctggattggatcagagacaatatgcggcca

SEQ ID NO: 18291 - DNA, 1686 bp, Artificial Sequence
  Description of Artificial Sequence: Synthetic coding sequence
atggacgcaatgaaaagaggattatgttgtgtattgctgctgtgcggggcagtgtttgtgtccccttctcaggagatacatgctaggttccgcagaggcgcaagatcataccaggttatctgtagggacgaaaaaacccagatgatttaccaacagcaccagagttggctgagacccgttctccggtcaaacagagtggaatattgctggtgcaactcagggcgtgcacagtgccattccgtgccggtgaaatcttgctctgagcccagatgttttaacggaggcacctgccaacaggcactgtacttttccgatttcgtgtgccagtgtcctgagggattcgctggaaagtgttgcgaaattgatacacgcgcaacctgctacgaagatcagggcatcagctacaggggcacatggagtactgcggagagcggtgctgaatgcacaaattggaactcaagcgctctcgcacaaaaaccgtactcaggaaggagacctgatgccatccgactgggactgggaaaccataattattgccggaatcccgatagagactctaaaccgtggtgttatgtgttcaaagctggtaagtatagctctgagttctgctccacccctgcctgctctgagggcaattcagattgctacttcggcaatggatcagcttatcgaggcactcacagtctgacagagtcaggagcatcgtgtctgccatggaacagcatgatcctcatcggtaaggtctacaccgcacagaacccctccgcgcaggccctgggattagggaagcacaactactgtcgcaaccctgatggcgacgcgaagccctggtgtcatgttctgaagaatagaaggctgacctgggaatactgcgatgtgccttcttgctccacctgcggcctgcggcagtatagccagccccaatttcgaattaaggggggtctgtttgccgatatcgctagccatccttggcaggccgcaatattcgctaaacaccgacgcagtccaggcgaacggttcttgtgcgggggaatcctcatttcctcctgctggatcctgagtgctgcacactgcttccaggaaagattccctccacatcatttaactgttattctcggcagaacataccgtgtggttcccggcgaagaggagcagaagttcgaagtggagaaatatatcgtgcacaaagagtttgatgacgacacctatgataacgatattgctttattgcaactgaagtcagactccagcagatgcgcacaagagagctctgtcgtgcggaccgtgtgcctccctcccgccgatctgcaactgcccgattggacagagtgcgagctcagcgggtacggcaagcacgaagcactatctcctttttactctgagcgcctgaaggaagctcacgttcgcctctaccctagctctaggtgtacgagtcagcacctcctgaaccggacagtaacagataacatgttatgtgcaggcgacacaaggagtggcgggccacaggcaaatctgcacgatgcctgccaaggagactcgggaggacctctggtttgcctgaacgacggtagaatgactctggtgggaatcataagctggggattaggctgcggccaaaaggatgtgcctggagtctacactaaagtcaccaattaccttgactggatcagggacaacatgagacct

SEQ ID NO: 18292 - DNA, 1686 bp, Artificial Sequence
  Description of Artificial Sequence: Synthetic coding sequence
atggatgccatgaagcgtgggctttgctgcgtgctcctgctgtgcggtgcagtgtttgttagcccatcgcaagaaatccatgcaaggttccgcagaggcgcacgctcgtaccaagtcatttgcagggatgaaaagactcagatgatttaccagcaacatcaatcgtggctgcgccctgtccttagatcgaacagggtggaatactgctggtgcaactccggccgcgcacaatgccatagcgtgcctgtcaaatcatgttccgaaccccggtgttttaacggaggaacctgtcaacaggcactgtacttttccgattttgtgtgtcagtgccctgaagggtttgcagggaaatgttgcgaaatcgacactcgcgcgacttgttacgaagatcagggtatctcctacaggggaacctggtccactgcagaaagcggtgcagagtgtaccaattggaattcctctgcactggcccagaaaccctattcgggtcgcaggccggatgccattcgcctcggacttggaaaccacaactactgtcgtaacccagatcgggatagcaagccttggtgttacgtgtttaaagcaggaaaatactcttcggaattttgctccacccccgcatgtagcgagggtaacagcgattgttactttggaaacgggagcgcataccggggaacccacagtctgactgaatcgggggcatcttgtctcccctggaattccatgatcctgatcggaaaggtgtataccgcccagaacccttcagcacaagcactgggtctgggaaagcacaactactgcaggaatccagacggtgatgccaagccctggtgccacgtgcttaagaaccgcagattgacctgggaatactgcgacgtaccctcatgcagcacctgcggcctccggcagtactcccagccacaattcagaattaagggaggcctgttcgcagacatcgcctcgcatccttggcaggctgcaatattcgccaagcatcgccgaagccccggggagcgttttctttgtggaggaattctgattagctcatgctggatcttgtcggctgcacattgctttcaagagcggtttccgccacaccatctgaccgtgatcctggggcgcacctaccgagtggtcccaggtgaggaagaacagaagttcgaagtggagaagtacattgttcataaagaattcgatgatgatacctacgataatgatattgcactgctccaactgaagagcgacagctccagatgcgcgcaagaaagctcggtcgtgcgcaccgtctgtctccccccggccgatctgcagctccctgattggacggagtgcgaactttcaggttacgggaaacacgaagcacttagccccttctactcggaaagactcaaagaagcacatgtgcgactttacccttcatcccggtgtacctcgcaacatcttctgaatcgtaccgtgacggacaatatgctttgtgctggggatacccggtcaggcggtccacaagcgaaccttcatgatgcctgccagggtgattcaggagggccactggtgtgcctgaatgatggcagaatgactctcgtgggtatcatttcctggggtcttggttgtggtcaaaaggatgtgcccggcgtctacactaaagtgaccaattaccttgattggatccgggataacatgcgtccg

SEQ ID NO: 18293 - DNA, 1686 bp, Artificial Sequence
  Description of Artificial Sequence: Synthetic coding sequence
atggacgccatgaagcgcggtttgtgttgcgtcctgctgctctgcggagccgtatttgtctcacctagccaagaaatccatgctcgcttcagacggggtgcgcgctcttaccaggtgatctgccgcgacgaaaagacccaaatgatataccagcagcaccagagctggctccgcccggtgcttcgcagcaatcgggtcgagtactgctggtgtaactccggacgggcccaatgccacagcgtgccggtgaagtcctgctcggaaccacggtgtttcaacggaggaacctgccagcaggcactttacttctcagactttgtgtgccagtgtcctgagggattcgctggaaagtgctgcgagattgacacccgcgcaacttgttacgaagatcaggggatctcctacagaggtacctggtcgacggccgagtcaggagcagagtgtaccaactggaatagcagcgcgttggcccagaagccgtattccggtcgtcgaccggacgccatcagactcggtctgggcaatcacaactactgccggaacccggatcgcgactcgaaaccttggtgctacgtctttaaggcaggaaagtactcgtcggaattctgctcgacgccggcttgttcagaaggaaattccgactgctacttcggaaatgggtccgcgtacaggggaacccactccctgaccgaaagcggagcatcgtgccttccatggaactcgatgatccttatcgggaaagtgtacactgctcagaacccttccgcgcaagccctcgggctcggcaaacataactactgccgaaacccggatggcgatgcgaagccgtggtgccatgtgctcaagaaccggagattgacttgggaatattgcgatgtccccagctgctcaacttgcggcctgcgccaatacagccaacctcagttccgtatcaaggggggcctgtttgcagacattgcgtcccacccctggcaggccgcaattttcgccaagcatagacgtagcccgggggagaggttcttgtgcggaggcatcctgatctcatcgtgctggatcttgtcagcggcacactgcttccaggaacggttcccaccccatcacctgacggtgatcctgggccgcacgtaccgggtggtgccaggcgaagaagaacagaagtttgaggtcgagaaatacatcgtccataaggaattcgacgacgacacttacgataacgatattgctcttttgcagctgaaatcagactcgtcgcggtgtgcccaggaatcatcggtggtgagaaccgtgtgcctgccgcccgcggatctgcagcttcctgactggaccgagtgcgaactgagtggctatggaaagcacgaggctctgtcgccgttctacagcgaacgcctgaaagaggcgcacgtccgtctgtacccgtcatcccggtgtacttcgcagcacctgctgaaccgcactgtgactgataacatgctctgtgccggagacacgcggtccgggggaccacaagcgaatcttcatgatgcctgccaaggagattcaggaggcccactcgtgtgtctgaatgacggtaggatgaccctcgtaggtatcatctcgtggggactcggttgtggccaaaaggacgtgccgggagtctacaccaaagttactaactacttggattggattagggacaatatgcgtccg

SEQ ID NO: 18294 - DNA, 1686 bp, Artificial Sequence
  Description of Artificial Sequence: Synthetic coding sequence
atggatgccatgaagcgaggactttgttgcgtgctgctgctttgcggcgcagtgtttgtgtcaccatctcaggagattcacgcaagattcagaagaggcgcgcgctcataccaggtgatttgtagggatgaaaaaacccagatgatttaccagcagcaccaatcgtggcttaggcctgtgcttcgatctaaccgtgtggaatactgttggtgcaactcgggaagagcacaatgtcattcggtgcctgtgaagtcctgttcagaacccaggtgtttcaatggtggaacctgtcaacaggccttgtacttttcagattttgtctgccagtgccctgagggattcgccgggaagtgttgtgaaatagacacgcgcgcaacttgttacgaggaccaaggaatttcgtacaggggaacctggtcgactgctgaatcgggagccgaatgtaccaattggaactcgtcggctctggcccaaaagccatactcgggtcgacgtcctgacgcaattaggctcgggcttggtaaccacaactactgtcgcaatcccgatcgcgattctaagccttggtgttacgttttcaaagcagggaaatactcctcagaattttgttcgaccccggcttgttcggaaggtaactcggactgttactttggcaacgggagcgcgtaccggggcacccatagcttgaccgaatcaggtgcctcctgcctgccctggaattcgatgatacttatcggcaaagtgtataccgcgcaaaatcccagcgcccaggcccttggacttggcaaacataactactgcagaaaccctgacggcgacgcaaagccgtggtgtcacgtgctgaaaaatcggcggctgacctgggaatactgcgacgtcccgagctgctccacttgtggtctgaggcagtacagccagccccagtttagaatcaaaggaggtctttttgcagatattgcttcacatccatggcaagcagccatcttcgccaaacataggagatcgccgggagaacgctttctttgtggaggaattttgataagttcgtgctggattctttccgctgcgcattgttttcaagaaagatttcctcctcatcaccttactgtgattttgggtagaacctacagagtggtcccgggagaagaggagcaaaagtttgaggttgaaaagtacatcgtgcacaaagagtttgatgacgatacttacgataatgacatcgcactcctgcaactgaaatcggactcatcaagatgtgcacaagaatcgtcggtggtgcggaccgtgtgcctgccaccagcagaccttcaactccctgactggaccgagtgtgagctcagcggttatggaaagcatgaagccctcagcccattttactccgagcgattgaaagaggcccacgttcggctgtatccatcctcgagatgcactagccaacatcttctgaatcgtactgttactgataacatgctgtgtgcaggtgatacccgttccggaggaccacaggcaaacctgcatgacgcgtgccaaggggattcgggtggaccactggtgtgtctcaatgacggtcggatgactctggtggggatcatctcgtggggtcttggctgcggacaaaaagatgtgcccggagtgtacactaaggtgaccaattacctcgattggattcgagacaatatgaggcca

SEQ ID NO: 18295 - DNA, 1686 bp, Artificial Sequence
  Description of Artificial Sequence: Synthetic coding sequence
atggatgcaatgaagagaggactttgctgcgtcttgctgctgtgtggggctgtgtttgtgtccccgtcccaggagatccacgcgcggttccggcggggagccagatcgtaccaggtgatctgtagagatgaaaagactcagatgatttaccagcaacaccagtcttggctgcgcccggtgctccgctccaatagggtggaatattgctggtgcaactcaggtcgagcccagtgtcactcagtgcccgtcaaatcatgcagcgagccgcggtgctttaatggcggaacttgtcagcaggccctgtacttctctgacttcgtctgccagtgtccagagggattcgcgggaaagtgctgcgaaatcgatacgagagctacttgttacgaagatcaaggaatcagctatcggggaacttggtccaccgccgaatccggggctgagtgcacgaactggaactcatccgcactcgcccaaaagccgtacagcggacggcggcctgacgcgatccggcttgggcttggcaaccacaactactgcaggaatccagaccgcgacagtaagccttggtgttacgtgttcaaggccggtaaatactcatcggaattttgctcgactcccgcttgctccgaggggaactcagactgctacttcggaaacggaagcgcgtaccgcggcacccatagcctgaccgagtcgggggccagctgtctgccgtggaatagcatgattctcatcggcaaagtctacaccgcccagaacccgtcagcgcaggcgcttggcttgggtaagcacaattactgtagaaacccggacggagacgcaaagccgtggtgccatgttctgaagaatcgccgcctgacctgggaatactgcgatgtgccctcctgctccacttgtggccttcgccagtactcgcagcctcagttccgcatcaagggcggactcttcgctgacatcgccagccacccttggcaagcagccatatttgcaaagcatcgacgctccccgggagaacggttcctctgcggaggcatcctgatttcgagctgctggattctgtcggccgcgcattgcttccaagaacgcttcccgccgcaccatttgaccgtgatcctggggagaacttatcgcgtcgtgcccggcgaggaagaacaaaaatttgaggtggagaaatacatcgtccacaaggagttcgacgacgatacctacgacaacgacatcgccctgctgcaactgaaatcagattcgtcgcgctgcgctcaagaaagctcggttgtgaggaccgtctgtctcccaccggccgacctccaactcccagattggaccgaatgcgagctctccggatacggtaagcacgaagcactcagtcctttctactccgagagactcaaggaagcccacgtgcgtctctacccatcgtcgaggtgcacttcacagcatctgctgaaccgcaccgtgactgacaacatgctgtgcgcaggagacactcggtccggtggcccgcaggcaaatctgcatgatgcgtgccagggagactcgggtggacctctggtatgcttgaacgatgggagaatgaccctggtgggcatcatcagctggggactgggatgcggacaaaaagatgtgccaggagtgtacacgaaggtcaccaactacctggactggatcagggataatatgcggcca

SEQ ID NO: 18296 - DNA, 1686 bp, Artificial Sequence
  Description of Artificial Sequence: Synthetic coding sequence
atggatgcaatgaagaggggactctgttgtgtccttctcttgtgtggagcagtgtttgtgtcaccaagccaggagatccatgcaaggtttaggcgaggcgctcgctcgtaccaagtgatttgccgcgacgaaaaaacgcaaatgatttaccagcagcaccagtcgtggttgcgtcctgtcttgcgctcgaatcgggtggagtactgttggtgtaactcgggtcgcgcacagtgtcacagtgtccctgtcaagagctgttccgaacctcggtgtttcaacggtggtacttgtcaacaggccttgtactttagcgacttcgtgtgtcaatgtccagaaggatttgcgggtaaatgctgtgagatcgatacccgggctacctgttacgaggatcaaggaatatcctacagggggacttggtcaactgccgagtcgggagccgaatgtactaattggaatagctcggcactggcgcaaaagccctacagcggaaggcggccagacgcgattcggctgggcttgggtaaccataactactgtcgtaacccagatcgagactcaaaaccttggtgctatgtgtttaaggcgggtaagtactcgagcgaattttgctcgactccagcctgtagcgaagggaactcggactgttacttcggtaatggttccgcttatagaggcacgcatagcttgactgaatcgggcgcaagctgtctgccgtggaactcgatgattctcattggcaaggtctacaccgcacaaaacccttctgctcaagcacttggcctcgggaagcacaattactgcaggaacccagacggagatgcaaaaccgtggtgtcacgtgctcaaaaatcgcaggctcacctgggaatactgcgatgtgcctagttgcagcacctgcggccttagacaatactctcagccccaattccgcataaaaggtgggctctttgcagacatagcatcccacccatggcaagctgcgatctttgcaaagcataggcgttccccaggtgaaagattcctttgcggaggaatccttatttcctcgtgctggatcctttcagcagcacattgcttccaggagcgatttcccccacaccaccttaccgtcatacttggaaggacgtatagagtcgtgccgggagaagaggaacaaaagttcgaagtcgagaagtacatcgtgcataaagaatttgatgatgacacttacgataacgatattgcactgctgcagttgaagtcggattcctcgcgatgtgcgcaggaatcatcagtggtgagaactgtttgtctgcctcctgcggatctgcaacttcccgactggaccgaatgcgagctgtccggctacggaaagcatgaagctctttctccgttttactccgagcgccttaaagaagcacacgtgcgactctacccatcctcaagatgtactagccaacatcttcttaataggactgtgactgataacatgctctgtgcaggtgacactcggtcaggaggaccacaagccaatctgcatgatgcctgccagggagacagcggagggcctctcgtctgtctgaacgatggtcggatgaccttggtgggcataatcagttggggactgggttgtggccaaaaggatgttccaggcgtgtacactaaagtgaccaactaccttgattggattcgggataacatgcgcccc

SEQ ID NO: 18297 - DNA, 1686 bp, Artificial Sequence
  Description of Artificial Sequence: Synthetic coding sequence
atggacgcaatgaaacgcggtctatgttgcgtcctattgctgtgtggggctgtattcgtttcccctagccaggagatccatgctcgttttaggaggggcgctaggtcctatcaagtgatttgccgtgacgagaaaacccagatgatttatcagcaacaccagtcgtggctgagaccagttctgcggtctaatagggtggagtattgttggtgcaactcaggacgtgcccagtgtcactcagttccagtcaagagctgtagcgaaccacgctgcttcaacggcggcacctgccagcaggcgctgtatttcagtgacttcgtgtgccagtgcccagaaggattcgccggtaaatgctgcgagatagacacccgggcaacctgctacgaagaccagggtattagctatcgcggtacatggtcgaccgccgaatcaggcgccgaatgtacgaattggaactcctccgcgctggcacagaagccatatagcggccgacgcccggatgcgattcgcctgggtctcggcaaccacaactactgccgcaatccggaccgcgatagcaaaccatggtgttacgtctttaaggcgggtaagtatagttccgaattctgctccactccagcttgttcggaaggcaactccgattgctacttcggtaatggaagcgcgtaccgcggcacgcacagcctgaccgagagcggcgcgtcgtgtctaccgtggaatagcatgatattgatcggtaaagtgtacaccgcgcagaatcctagcgcacaggcgctcggcctgggaaagcacaattactgcagaaatcctgacggtgatgcgaagccatggtgccatgtgctgaaaaaccgccgcctcacatgggagtactgcgatgttccgtcatgctccacctgtggccttcgccagtacagccaacctcagttccggattaagggcggtctgtttgccgatattgcatctcatccctggcaggccgcgatctttgcaaagcatcgccgcagtccgggcgagcggtttctgtgtggcggcatcctgattagctcgtgctggatcttgtctgcagcccactgcttccaggaacgcttcccgccacaccacctgaccgtgatactgggccgcacgtaccgcgtggtgcccggtgaagaagaacagaaatttgaggtggaaaaatacatcgtgcacaaggagttcgacgacgacacctatgacaacgatatcgcactcctgcaattgaagtctgacagcagcagatgtgcccaagaatccagtgtggttagaacggtgtgtctgccaccagcggacctgcagctgcccgactggaccgagtgcgagttaagcggttatggcaagcacgaagccctaagccctttctacagcgaacgcctaaaagaggcccacgtgcggctgtacccttcttcgcgctgcactagccagcatctgctcaatcgcactgttactgacaacatgctgtgcgcaggtgacacgcgtagcggtggcccacaagccaatctgcacgatgcgtgtcagggtgattccggtggcccgttggtttgtctgaatgacggccgtatgactctggtggggattatctcctggggcctgggttgcggccagaaagatgtgcccggtgtatataccaaggtgacgaattaccttgattggatccgggacaatatgcgtcca

SEQ ID NO: 18298 - DNA, 1686 bp, Artificial Sequence
  Description of Artificial Sequence: Synthetic coding sequence
atggacgctatgaagaggggactctgctgcgtgcttctgctgtgcggcgctgtcttcgtgagcccctcacaggagattcacgctcggttcagacggggggctagatcataccaagtgatatgcagagacgagaagacacagatgatctaccagcaacaccagagctggctgagacctgtgctcaggtccaacagggtggaatactgctggtgtaattccggcagggcccagtgtcactcagtgccagtcaaatcctgctccgagccgagatgcttcaacggcggaacatgccagcaagccttgtacttttcagactttgtgtgtcagtgtccggaagggtttgcaggcaagtgttgtgaaatcgacactagggctacctgctacgaagaccaggggatttcctaccgcggcacatggtccactgctgaatcaggagctgaatgcaccaattggaacagctcagccttggcccagaagccctattctggcaggcggcctgacgccatccgactgggtttgggaaaccacaactattgccgcaacccagatcgagatagcaagccttggtgttacgtgtttaaagctgggaaatattcatccgaattctgttccacacccgcctgttctgaaggaaacagcgattgctactttgggaatggttctgcttaccgcgggacccatagtctcacggagagcggggcctcatgcctcccgtggaatagtatgattctgatcggcaaagtatacactgcacagaatccatccgctcaggcccttggattgggcaagcacaattattgcaggaaccctgacggcgatgctaagccatggtgtcatgtcttgaagaaccgcagattgacctgggaatactgcgatgtgccttcttgctcaacctgcggtctgcggcagtactcccagccgcagttccggatcaaagggggtctgtttgccgacatcgcctcccacccttggcaggccgccatatttgccaaacacaggcggtctccaggcgaaagattcctctgcggcgggattctcatcagcagctgttggattctgtccgccgcccattgtttccaggaaagattccccccacatcacttgactgtaattctgggcaggacatacagagtggtgccaggagaagaagaacagaaattcgaggttgaaaagtacatagtgcacaaggaatttgatgacgacacgtatgacaacgatattgccttgctgcagctgaaaagcgactcctcacggtgcgctcaggaatcctctgtggtgcgaaccgtgtgtctccctcctgctgacctccagctccccgattggaccgaatgtgaactgagtggatatggcaagcacgaggcactctcccctttctatagcgaacgactcaaggaagcgcatgtgaggctttatcccagcagtcgatgtaccagccagcacctgcttaatcgaacagtgacagacaacatgctgtgtgctggcgatacccgaagcggagggcctcaagctaacctgcatgatgcatgccagggagacagcggcggcccgttggtctgtttgaatgatggaaggatgaccctcgtagggattattagctggggtctgggatgcgggcaaaaagatgtccccggggtctacactaaagtgactaactatcttgattggatcagagataatatgagacct

SEQ ID NO: 18299 - DNA, 1686 bp, Artificial Sequence
  Description of Artificial Sequence: Synthetic coding sequence
atggacgcaatgaaaaggggtttgtgttgcgtcttgttactctgtggagcagtctttgtttcgccatctcaggaaatccatgcccgattcaggcgaggtgcccggtcctatcaagttatctgccgcgacgaaaaaacacagatgatttaccagcaacaccaaagctggcttcgtccagtacttcgaagcaatcgagtagagtattgctggtgtaatagtgggagagctcagtgtcatagcgttcccgtgaagagctgtagcgaacctagatgtttcaatggtggcacgtgtcaacaagcactttactttagcgacttcgtctgccaatgtcctgaggggtttgccggaaagtgctgtgagatcgacacccgtgccacctgctatgaggaccaaggaatttcctatagaggtacgtggtccaccgcagaatcaggcgcagagtgcaccaactggaatagctccgcattggctcaaaagccttattctggaagaaggcctgatgctattaggctgggactcggtaatcataactactgtcgtaatcctgatagagactccaaaccctggtgctatgtgtttaaagcgggcaagtatagtagcgaattctgcagcactcctgcttgcagcgaggggaattccgattgctactttggaaacggaagcgcatatcgaggaacgcattccctcacagaatctggtgcttcatgtctcccatggaattcgatgatattgattggcaaggtgtataccgctcaaaatccatctgcacaagcattgggactgggtaagcacaactactgcagaaaccccgatggcgatgcaaagccttggtgccatgttcttaagaatagaagactcacttgggagtactgcgatgtgccgagttgttctacatgtggtttgagacagtactctcagcctcaattcaggattaagggtgggttgttcgcagatatcgctagtcacccatggcaagcggccatattcgctaagcatcgtaggagtccaggtgaacgattcttgtgtggtggtatcctaatctcctcatgctggattctcagtgctgctcactgctttcaagaaagatttcctccccatcatctgactgtgattcttgggaggacctatagagttgtacctggagaagaggaacaaaagtttgaagttgagaaatacatcgttcataaggagtttgatgatgatacctatgacaacgacattgcacttcttcagctaaagtctgattcatccagatgcgctcaagagagtagcgtggttaggactgtttgtctaccaccagcagacctacagctgcctgattggactgaatgcgaactatctggatacggaaagcatgaagctctgtctccattttattctgaacggctgaaggaagctcatgttaggctctatccttcgtcccgttgcacttcgcaacatctattaaatcgtactgttaccgataacatgttatgtgcgggagacactcgttcgggggggccccaagcaaaccttcatgatgcttgccaaggtgatagtggtggccctttggtatgtttaaatgacggtcgtatgacccttgttggaataatttcatggggattagggtgcggacaaaaagatgtgccaggtgtttatacaaaggtcacaaactatctagattggatccgtgacaatatgcgaccg

SEQ ID NO: 18300 - DNA, 1686 bp, Artificial Sequence
  Description of Artificial Sequence: Synthetic coding sequence
atggacgcaatgaaacgcggactgtgctgcgtcttgcttctgtgcggagcagtgtttgtgtccccgtcgcaggaaattcacgcaagattccgacgaggagctaggtcataccaggtcatatgtcgggacgaaaagactcagatgatttaccagcagcatcaatcatggctccggcccgtgttgaggtcgaatagggtggaatactgctggtgcaactcggggagagcacaatgtcactcggtgccggtcaagagctgctcggagcctcggtgttttaacgggggtacttgtcagcaagcattgtacttttcggattttgtgtgtcaatgccccgaagggtttgccggcaagtgctgtgagattgacactagggcaacttgctacgaagatcagggaatttcgtacagaggaacttggtcgaccgcagaatctggagcagaatgtactaattggaattcgtcagccctcgcgcagaagccctactccggccgccgtccagacgccatacggctggggctgggaaatcataactactgtagaaacccagatagagattccaagccttggtgctatgtgttcaaagcagggaagtacagctcggaattctgctctacgccagcctgttcagaaggtaactccgactgttactttggtaatggttcggcataccgaggaacgcattcactgactgagagcggagcatcatgccttccgtggaactcaatgatcctgatcggtaaagtctacactgcacaaaacccctccgcacaggcgctcggactgggtaagcacaactactgccggaaccctgatggcgatgcgaagccgtggtgtcatgtccttaagaacagacgtcttacttgggaatactgcgacgtgccctcgtgtagcacctgcggtctgcgtcaatactcgcagccacagttccggatcaagggtggactttttgccgacatcgcgtcgcatccatggcaggcagctatattcgctaagcacagaagatcacctggggagaggtttctttgcggaggtatactgattagctcatgttggattctgtcggccgcccactgttttcaagaaaggtttcctcctcatcacctgaccgtgattcttgggcgcacttaccgggtcgttcctggtgaggaagaacaaaagttcgaagtggagaagtatattgtgcataaagaatttgatgatgatacctacgataatgatattgcacttctgcaactgaagtctgattcatccaggtgcgcccaggagagttccgtggtgcgcacggtttgtttgccacccgcagacctgcaactccccgattggacggaatgtgagctgtccggatacggaaaacatgaggcactgagtcctttctactcagaaagacttaaggaagcacatgtgcggctctacccttccagcaggtgcactagccaacatctcctgaatcgtaccgtgaccgacaatatgctgtgcgcaggggatactcgttcagggggcccacaagcaaatctgcatgatgcgtgccaaggggatagcggaggcccgcttgtgtgtctcaacgacggtcgtatgacccttgtgggtataatctcgtgggggctgggttgcggacagaaggacgtgccaggagtctataccaaggtcaccaattatcttgactggattagggataacatgaggccg

SEQ ID NO: 18301 - DNA, 1686 bp, Artificial Sequence
  Description of Artificial Sequence: Synthetic coding sequence
atggacgcaatgaaaagagggctttgctgcgtgttgctcctgtgcggagcagttttcgtgtcaccctcccaagaaatccatgccagatttaggaggggggctcggtcataccaggtgatttgcagggacgaaaagactcaaatgatttatcagcagcaccaatcttggctccgcccggtgttgcgctcaaacagagtagagtactgttggtgcaattccggacgggctcaatgccactccgtgccagtgaagagctgctcggagccacgatgtttcaacggcggaacctgccaacaagccctgtatttctcggatttcgtgtgccagtgcccagaagggttcgctggcaaatgttgcgagattgacacccgcgcgacctgctatgaggaccagggaatctcgtaccgggggacttggtcgaccgccgaatccggagcggagtgcaccaactggaatagctccgccctggcgcagaagccttactccggccgcagaccggatgccatccgacttggattgggaaatcacaattactgcaggaacccggaccgggactcgaagccgtggtgctacgtgttcaaggcgggaaagtattcgtcagagttctgctcaacgcccgcgtgctcagagggcaattcggactgctactttgggaatggatcggcataccggggtactcactccctgactgaatcgggcgcctcgtgtctgccgtggaactctatgatcctgatcggaaaagtgtatactgctcaaaatccttcagcccaagccttgggactcggaaaacataactactgtcgcaacccggacggagacgccaagccttggtgtcatgtgctgaaaaaccgcagactgacttgggaatactgtgatgtgccgtcttgctctacctgcggcctgcggcaatactcgcagccgcaatttcggatcaagggaggactgttcgcagacatcgcgagccatccctggcaggcggcgatcttcgctaaacacaggcggtcgccaggcgaacggttcctgtgtggcggcatcctgatctcctcgtgctggatcttgtcggctgcgcactgcttccaggagcgcttcccgccgcatcatctgaccgtcatcctgggacgaacttatagagtcgtcccgggtgaggaagaacagaaattcgaagtggagaagtacatcgtacacaaggagtttgatgacgatacctacgataatgatattgcgctcctgcagctgaagagcgacagctcgcgctgcgcacaggaaagctccgtggtcagaaccgtctgcctgccgccagccgacctgcagctgccggactggaccgaatgcgaactgtccggatacgggaaacacgaagcgctgtcgcccttttactccgaacggctgaaggaagcacacgtccggctgtaccctagcagccgatgcacctcacagcatctgctgaaccgtaccgtgacggataacatgctgtgcgctggagacacccgctcagggggaccacaggcaaatctgcacgatgcctgtcagggtgattccggaggaccgctcgtgtgcctcaatgacggacgcatgactctggttggtataatcagctggggcctcggatgcgggcagaaggatgtccctggggtctacaccaaagtgaccaattacctggattggattcgcgacaacatgcgcccg

SEQ ID NO: 18302 - DNA, 1686 bp, Artificial Sequence
  Description of Artificial Sequence: Synthetic coding sequence
atggacgccatgaagagaggcctctgctgtgtgctccttctgtgcggagcggtgttcgtgtccccgagccaagaaatccacgctcggtttcgcagaggcgctcggtcctaccaggtcatctgtcgggatgaaaaaacccagatgatctaccaacaacaccagtcatggctccggcctgtcctgaggagcaaccgcgtggagtactgctggtgcaattccggaagggctcaatgccatagcgtcccggtgaaatcatgctcggaaccccgctgcttcaacggaggcacctgccagcaagccctgtacttctcggacttcgtctgccagtgcccagaaggattcgcaggaaaatgctgcgagatcgacacccgcgcgacctgttacgaggaccagggcatctcgtacaggggcacttggtctactgcggaaagcggagcagaatgcactaactggaactcaagcgccttggcccagaagccgtactcgggacgccggcccgacgcgatccgcctcggcctcggaaaccataactactgtcgtaaccccgaccgggacagtaagccttggtgttacgtgtttaaagccggcaagtactcgtcggagttctgcagcaccccagcgtgctcagaaggaaactcggactgttacttcggcaacggaagcgcgtaccggggaactcattccctgaccgagtccggcgcctcgtgcctgccgtggaactccatgatcttgatcggcaaggtctacaccgctcagaacccgtcggcccaagcgctggggctgggaaaacacaattactgtcgcaatccagatggagatgctaaaccgtggtgtcatgtgctgaaaaatcgacgcttgacctgggagtactgtgacgtcccgagctgtagcacctgtggactgcgccagtattcccaaccacagtttcgcatcaaggggggcctcttcgccgacattgcgtcacatccgtggcaggcggccatcttcgcgaaacaccgccgctcaccgggagagaggttcctgtgtgggggtattctcatctcatcctgctggatattgtccgcggcacattgcttccaggaaagattcccgccgcatcacctgactgttattctcggaagaacttaccgggtggtcccgggtgaggaagaacagaagttcgaggtggaaaagtacattgtgcataaggagttcgacgacgacacttacgacaatgatatcgccctccttcagttgaagtcggactcgtctcggtgcgcacaagaatcatcagtcgtccggaccgtttgcctgcctccagccgacctccagctgcctgactggactgaatgtgagctgtcgggttacggtaagcacgaggcactcagcccattttacagcgaacgcctgaaagaagctcacgtccggctgtacccgtcgagccgctgcacttcgcagcacctgttgaaccggactgtgactgacaatatgctctgcgctggggacactcgctcgggcggcccccaggccaacttgcacgatgcatgccagggggactccggaggaccgctggtatgtctgaatgacggccggatgactctcgtgggcatcatctcatggggcttgggctgtggccaaaaggatgtgccgggagtctacactaaagtgaccaactacctggactggatccgcgacaacatgcgccca

SEQ ID NO: 18303 - DNA, 1686 bp, Artificial Sequence
  Description of Artificial Sequence: Synthetic coding sequence
atggatgccatgaaacgtggactctgctgcgtgctcctcctgtgcggggctgtgttcgtgtctccctctcaggagatacacgctcgcttccgtcgaggcgctcgctcatatcaagtcatttgccgtgacgagaagactcagatgatctaccagcagcaccagagctggctccgcccagtcctccgctctaacagggtcgagtattgctggtgcaatagcggccgagcccagtgccattcggtccctgtcaagtcctgctctgagcctcgctgcttcaatgggggtacctgccaacaggcactctacttttctgacttcgtctgccagtgccccgaaggctttgccggtaagtgttgtgaaatcgatactagggcaacatgctacgaggaccaggggatttcatatcgcggcacctggtccaccgccgaatctggtgccgaatgcaccaactggaactcatctgcccttgcccaaaaaccttactctgggcggcggcctgacgccattcgcttgggactcggtaaccacaactactgccgtaatcccgaccgagactccaaaccgtggtgctacgtcttcaaggccggtaagtactctagtgagttctgctccacacccgcatgcagcgagggaaactcggactgctattttggtaacggcagcgcgtaccgtggcacccactcccttaccgaaagcggcgcttcctgcttgccttggaacagcatgatcctcatcggcaaggtctataccgcccaaaacccgagtgcccaagctttgggcctcggtaagcacaactactgtcgcaaccccgatggagacgctaagccctggtgccacgtactaaagaatcgtcgtcttacctgggagtactgcgacgtcccctcctgttccacctgcggcttgcgtcagtattcgcaaccccagttccggattaaagggggactgttcgccgacatcgcttctcacccttggcaggctgccatctttgctaagcaccgtaggtccccgggcgaacgtttcttatgtggtggcatcctcatctcgagttgttggattctcagcgctgcccattgctttcaggagaggttcccgcctcaccacctcaccgtcatcctggggcgtacctacagggttgttccaggtgaggaggagcagaagttcgaggttgagaagtatatcgtgcacaaggaattcgatgacgacacatacgacaacgacatcgctttgctccagctcaagtccgactcgtcacgatgcgcccaagagtcctctgttgtacgcacagtctgtttgcctcctgctgatctccagctcccagattggactgagtgtgagctttccggctacggtaagcatgaagccttgtccccattctatagcgagcgccttaaagaggcgcacgtgcgcctctaccccagctcgcgctgcaccagtcagcatctgcttaaccggactgtcaccgacaacatgctctgtgctggtgatacccggtctggaggcccccaggccaacttgcatgacgcctgccagggcgactccggcggccccctggtttgcctcaacgacggacgtatgacactagttggcattatctcttggggactcggttgtggtcagaaggacgtccccggcgtgtacacgaaagtcaccaattatctggattggatacgggataacatgcgtccc

SEQ ID NO: 18304 - DNA, 1686 bp, Artificial Sequence
  Description of Artificial Sequence: Synthetic coding sequence
atggacgcaatgaagagaggactttgctgtgtgcttctactctgtggtgccgtgtttgtgagcccgagccaggagatccatgctcgcttccggcgaggagctagatcctaccaggtgatttgccgcgacgaaaagactcagatgatatatcaacaacatcagagttggctgagacctgtgttgcgaagcaatcgagtggaatattgttggtgtaacagtggcagggcccagtgtcacagcgtgcccgtgaaaagctgcagtgaacctcgttgttttaacggcggcacgtgccagcaggctctgtacttttccgattttgtgtgtcagtgtcctgaaggctttgctgggaaatgttgcgagatagacactagggccacctgctacgaagaccaggggatatcctaccgcggaacgtggagcacggccgaaagcggtgccgagtgtacaaattggaacagtagtgcacttgcccaaaaaccttatagtgggcggcgcccagacgccatccgcctagggttgggcaaccacaactattgccggaatccagacagggactccaaaccatggtgctacgtctttaaggcagggaaatacagtagcgaattttgcagcactcccgcttgctccgagggcaattctgactgctactttgggaacggttcagcctaccggggcactcactcgctgaccgagtctggagcttcctgtcttccatggaatagcatgattcttataggcaaagtctacaccgcccagaacccttcagcccaagcgctcgggctaggaaagcacaactattgccggaatccggatggtgacgcgaaaccgtggtgtcacgttttgaagaaccgacgactcacatgggaatactgcgatgtgcctagctgcagtacttgcggactacggcagtacagtcagccccagtttagaattaaaggcggactcttcgcggacatcgccagtcacccctggcaggcggccatcttcgcgaaacatcggagatccccgggcgagaggttcctctgcggtggcatcctgatcagctcctgttggattctgtcggccgcccactgttttcaggagagatttccacctcatcacctgacagtgattctcggcaggacctaccgggtagtgccaggggaggaagaacagaagttcgaagtggagaaatacatcgttcacaaggaattcgacgatgacacctacgacaacgacatcgccctgctacagcttaagtctgattcaagccgctgcgcccaggaatcctcagtcgtgcggacagtttgtcttcccccagccgatctacagctacctgattggacggaatgtgagctgtctggctatggaaagcacgaggcactgagcccattttacagcgagagactcaaagaggcacacgttcggctgtatcctagctctcggtgtacatctcagcatctgttgaaccggaccgtaacggacaatatgctctgcgccggtgatacaagatctgggggccctcaggccaatcttcatgacgcctgtcagggagattctggaggtccattagtatgcctgaacgacggcagaatgacgttggtggggattatatcatggggcctcgggtgcggccagaaggatgtccctggggtgtatacaaaggtcacaaattatctcgattggatccgagacaacatgagacct

SEQ ID NO: 18305 - DNA, 1686 bp, Artificial Sequence
  Description of Artificial Sequence: Synthetic coding sequence
atggatgcaatgaaacgcgggttgtgctgcgtactactgctgtgtggagccgtgttcgtatcgccgagccaggagatccacgcgagatttcgccggggggccagatcctaccaggtgatctgtcgggacgaaaagacccaaatgatttaccagcagcaccagtcatggctgaggcctgtgcttaggagcaaccgggtggaatattgctggtgcaatagcggaagggcccagtgtcatagtgtgcctgtcaaatcctgctctgaaccacgttgcttcaacggagggacgtgccagcaggccttgtatttttcagactttgtgtgtcagtgtcccgaaggctttgccggaaagtgttgcgagatcgacacccgagccacctgttatgaggaccagggaatctcctatcggggtacatggagcaccgccgagagcggcgccgagtgtaccaactggaattccagcgctcttgctcagaaaccttacagcgggaggaggccagacgccatccgcctgggattgggcaaccataactactgtcggaacccagatcgggactcaaaaccctggtgctacgtcttcaaagccggcaaatacagctcagaattttgttcaactcccgcgtgcagtgaaggcaactcggactgctactttggcaatggaagcgcctacaggggaacccacagcttaaccgagagcggagcctcctgcctgccctggaacagcatgatcctgatcggtaaagtctatactgctcagaacccgtccgctcaggcgctgggtctaggaaaacataactactgtcgcaatcctgatggcgatgccaagccttggtgtcacgtcctcaagaaccgacgtctgacctgggaatactgcgatgtgccatcctgcagtacttgtggtctgcgccaatattcacagccacagttccgtatcaaggggggattattcgctgatatagcaagtcacccctggcaggctgctatatttgctaagcaccggcgcagccccggcgagcggttcctatgtgggggcatcctcataagttcctgctggatattaagcgcggcgcattgcttccaagagcgatttccccctcatcacctcacagtgatattgggaagaacataccgggtggtgcccggcgaagaggaacagaaattcgaggtggagaaatatatcgtgcacaaggagttcgacgacgatacctatgacaatgacatcgccttgttgcagctgaagagtgactcaagtaggtgtgcgcaggagtccagcgtggtcagaacagtatgcctgcctcccgcagacttgcagcttccagattggactgagtgtgaactgtctgggtatgggaaacatgaggctcttagccccttctactccgagcggctcaaagaagcacatgttcgactgtatccgtctagccgctgcacctcccagcatctgctcaaccgcacggttactgataatatgctgtgtgccggcgatacccgaagcggggggccacaggctaaccttcatgacgcctgccagggagactccggtggcccgctggtgtgcctgaacgatggccgcatgacgctagtgggcattatcagctggggactcggctgcggccagaaggacgttcctggtgtatacaccaaggtcacaaattatctggattggatcagggacaacatgagacca

SEQ ID NO: 18306 - DNA, 1686 bp, Artificial Sequence
  Description of Artificial Sequence: Synthetic coding sequence
atggacgctatgaaacgcgggctgtgctgcgtcctgctcctttgcggcgctgtctttgtgagcccgtcacaggagatccacgcgagattccgccggggagcacgctcataccaggtgatctgtcgggacgaaaaaactcaaatgatctaccagcagcatcaatcgtggctcaggccggtgctgcggtccaaccgcgtcgagtactgctggtgcaactcaggacgggcacagtgtcactccgtcccggtgaagtcatgctccgagccgcgctgctttaatggaggaacctgccaacaggccctctacttttcggatttcgtgtgccaatgccctgaaggattcgccggaaaatgctgcgaaatcgatacccgagcaacctgctacgaggaccagggcatttcctatcggggaacttggtcaaccgcagaatccggagctgaatgtactaattggaattcgtcagccctcgcccaaaagccgtactccggccgccgccctgacgctatccgcctgggcctggggaaccacaactattgtcgcaaccccgatagggattcgaaaccatggtgctacgtgttcaaagccggaaaatacagctcagaattctgcagcaccccagcatgctcggaaggcaactccgactgctacttcggaaacggatcggcctaccggggaactcactcgttgacggagtcgggtgccagctgcctcccctggaacagtatgatcctgatcggaaaggtgtacaccgctcagaacccgtccgcccaagcactggggctgggaaagcacaattactgccgcaatccagacggcgatgccaagccttggtgccacgtgctgaagaaccgcagactgacttgggaatattgtgacgtccctagctgctcgacctgcggactccgacagtactcgcaaccgcagttccggatcaaagggggcctgttcgccgacatcgcgagtcacccgtggcaagctgccatttttgcaaaacaccgccggagcccaggcgagaggttcctttgcggtggtattctgatttcgagctgctggatcctttctgcggcgcattgtttccaggagagattcccgccacaccatttgactgtgatcctgggtcggacctacagagtcgtgccgggcgaagaagagcaaaagtttgaagtggagaagtacatcgtgcacaaggaattcgatgacgatacttacgataatgatatcgccctgcttcagctcaaaagcgactcgtcaagatgcgcccaggaatcttccgtcgtcagaaccgtgtgcctgccgcccgctgaccttcagctgccggattggactgagtgcgaactgtccggctacggtaagcacgaagccctgtcgccattctactccgaacggctcaaggaagcgcatgtccgcctgtacccctcgagccggtgcacttcccagcatctcttgaacagaactgtgacggacaacatgctgtgcgccggagatactcggtcgggaggcccacaagcaaacctgcatgatgcctgccagggagattcaggtggcccattggtgtgtttgaacgacggccgcatgaccttggtggggatcatctcgtgggggctgggttgcggccaaaaagatgtgccaggcgtgtacactaaagtcacgaattacctcgactggatcagggacaatatgcgcccg

SEQ ID NO: 18307 - DNA, 1686 bp, Artificial Sequence
  Description of Artificial Sequence: Synthetic coding sequence
atggacgcaatgaaacggggtctgtgttgcgttctgctgctttgtggcgcagtctttgtctccccctcgcaagagatacatgcacgttttcgcaggggtgcccgctcataccaagtcatttgtagagatgaaaaaacccagatgatataccagcaacaccaatcgtggttgaggcctgtgcttaggagcaacagggtggagtactgttggtgcaattcgggccgtgcgcagtgccatagcgtcccagtgaaatcctgctccgaacctcggtgctttaacggcgggacctgccaacaagcactctatttctcagattttgtgtgtcagtgccccgaagggttcgcaggaaaatgttgtgaaatcgacactcgagcaacttgttatgaagatcaagggattagctataggggcacctggtccaccgcggaatccggagcagaatgcaccaattggaactcctccgcccttgctcaaaagccctactcggggcgccggcctgatgctattcggcttggcctcggtaaccataactactgtaggaatcccgatcgcgattcgaaaccttggtgttatgtgtttaaagcaggaaagtactcgtcggaattctgttcaacccccgcatgtagcgagggcaacagcgattgctatttcgggaacggtagcgcgtacaggggaacccatagcctcaccgagtcgggtgcgagctgtctgccatggaactcaatgattcttatcggaaaggtgtacactgcacagaatccctcggcccaggcgctcggtttgggaaaacacaattactgtcgtaacccggatggcgatgcaaagccctggtgtcatgtgctgaaaaacagacggcttacttgggagtactgcgacgtcccttcgtgttcgacgtgtggtctgagacaatactcacagccacaatttcgcatcaagggcggtttgtttgcagacattgcgtcacacccatggcaggcagcaattttcgcaaaacataggagaagccctggagagcgttttctctgtggcggtattctgatctcctcatgttggattctgagcgcagcgcattgctttcaagaaagatttccaccacatcacctgaccgtgatcctgggtaggacttaccgggtggtgccaggagaggaggaacagaagttcgaagttgagaagtacattgtgcataaggagttcgatgacgatacttacgataacgacatagcacttctccagcttaagtcggattccagtcggtgtgcacaagagtcatcagtggtgcgaactgtgtgtctccctcccgcagacctgcaactgcccgactggactgagtgcgagctctccggctacggaaaacacgaagccctttctcctttttacagcgaacggctgaaggaggcacatgtccggctttacccctcctcacggtgcactagccagcaccttttgaatcggactgtcaccgataacatgctctgtgccggagatacgagatcaggaggaccacaagcaaaccttcatgatgcatgtcagggagattcaggtggtccgcttgtctgcctgaatgatggtagaatgacgcttgtgggaattatctcctggggacttggttgtggtcaaaaagacgtgcccggcgtgtacactaaagtgaccaattacttggattggattcgtgataacatgcgccca

SEQ ID NO: 18308 - DNA, 1686 bp, Artificial Sequence
  Description of Artificial Sequence: Synthetic coding sequence
atggacgcaatgaagagagggctctgttgcgtcttgcttctgtgtggtgcagtgttcgtcagcccctcgcaggaaatccacgcaaggttccgcaggggcgccagaagctaccaggttatttgtcgggatgaaaagacccagatgatatatcagcagcatcaatcctggcttagacctgtcttgagatcaaaccgggtggaatactgttggtgtaattccggacgagcccagtgccacagcgtgcccgttaaatcttgctctgaaccacgttgctttaacggtgggacgtgtcagcaggcactgtatttcagcgattttgtttgccaatgtccggaaggttttgctggtaagtgctgcgagatagacaccagggcaacttgctacgaggatcagggtatttcttatcggggaacttggtccaccgctgaatctggggccgagtgcactaattggaactcctccgccctagctcagaagccgtatagcggtcgaagacctgatgccataaggctgggtctgggtaatcataattactgtcgtaaccccgacagggatagtaagccctggtgttacgtattcaaggccgggaagtacagcagcgagttctgctccaccccagcctgtagcgagggcaattctgactgctacttcggcaatggcagcgcctatcggggcacccactccctgaccgagtctggcgctagctgtcttccgtggaattccatgatcctgatcgggaaggtgtatactgcacaaaacccctcagcacaggccttgggcctagggaaacacaattattgccggaatccagacggagatgcaaaaccatggtgccacgtcttgaaaaaccgccggttgacttgggagtactgcgacgttccctcctgtagtacctgcggactgaggcagtattcacagccccagtttagaatcaaaggcggactgttcgctgacattgcctcccacccctggcaggccgctattttcgcaaaacatcgtagatctccaggtgagcgattcctgtgtggaggaatacttatctcttcatgctggattctatctgcagcccattgcttccaggaaagattccccccacaccatctgaccgtgatccttgggaggacctatagagtggtccccggggaggaggagcaaaagttcgaggtggagaagtatatagtccacaaagagtttgatgatgatacatacgacaacgacatcgccttgctccaactcaaaagtgatagcagccgttgtgcccaggagagtagcgtggtgaggactgtttgccttcctcccgcagatctgcagcttcctgattggactgaatgtgagttaagcggctacggcaagcatgaggccctgtcaccattttacagcgaaagactgaaggaggctcacgtacggctttaccccagctctcgctgcacctcacaacatctattaaacagaacggtcaccgataatatgctgtgcgcaggtgacaccagatccggagggccacaggccaacctgcacgacgcctgtcagggagattctggcggtccgctggtatgtctaaacgatggacggatgactctggtggggattattagttggggcctcgggtgcggacagaaggatgttccaggtgtttacacaaaggttacaaattacttggattggataagagataacatgaggcct

SEQ ID NO: 18309 - DNA, 1686 bp, Artificial Sequence
  Description of Artificial Sequence: Synthetic coding sequence
atggacgccatgaaaagaggactctgctgtgtgttgctcctgtgcggcgcggtgttcgtctcgccgtcacaggagatccacgcccggttcagacggggagcccgcagctaccaggtgatttgcagagacgaaaagactcagatgatctaccagcaacaccagtcctggctgaggcccgtcctgcgatcgaatcgcgttgagtactgttggtgcaactcaggcagagcccagtgccattccgtgccggtcaaatcatgctcggagcctcggtgcttcaacggtggaacttgtcaacaagccctgtacttctcggatttcgtgtgtcagtgccccgagggattcgcagggaaatgctgcgaaatcgacaccagagcgacttgttacgaggaccaaggaatctcctaccggggaacctggtcgactgcggaaagcggtgcagagtgcaccaactggaactcgtcagcgctcgcccaaaagccctactccgggcggcggccagacgcaatccggctggggctggggaatcataactactgtagaaatcctgaccgggacagcaaaccttggtgctacgtgttcaaggccggaaagtactcatcggagttttgctcgaccccggcctgtagcgaaggaaactcggattgctacttcggtaacggaagcgcctaccgcggcactcactcgctgactgaaagcggtgcttcctgcctcccatggaactcaatgatcctgataggtaaagtgtacactgcccagaacccgtccgcgcaggccctgggactcggcaagcacaactactgcagaaatccagatggtgacgcgaagccttggtgccatgtcctgaagaatcggcgcctgacctgggagtactgcgacgtgccgtcgtgctcaacctgtggacttcgacagtacagccagccgcagttccggatcaagggcgggctgttcgccgacatcgcctcccacccttggcaggccgctatctttgccaaacatcggcgctcgcctggggagcgcttcctgtgcgggggaatcctcatcagctcgtgctggatcctctccgcggcgcactgtttccaagaaaggttccctccacatcacctgactgtgatcctcggacggacttaccgcgtggtccctggagaagaagagcagaagttcgaagtggagaagtacattgtccacaaggagttcgacgacgatacgtacgataacgatatcgccctgttgcagctgaagtccgacagctcaaggtgtgctcaggagtcatccgtggtgaggaccgtctgcctcccgccggcggatctgcagctgcctgactggactgaatgtgaactgagcggatacggcaaacacgaggccctcagcccgttttactcagagcgcctgaaggaagcacacgtcagactctacccgtcatcgcgctgcaccagccagcacctcctgaaccgcaccgttaccgacaacatgctgtgcgcaggagacactcgctccggaggcccgcaggccaacctgcacgacgcatgccaaggggattcgggcggacccctggtctgcctgaacgatgggagaatgactctcgtgggaatcatctcctggggacttggctgcggacaaaaggatgtcccaggagtctacaccaaggtgaccaattacctcgattggatccgcgacaacatgcgcccg

SEQ ID NO: 18310 - DNA, 1686 bp, Artificial Sequence
  Description of Artificial Sequence: Synthetic coding sequence
atggacgccatgaagagagggctttgctgtgtgctccttctgtgtggtgctgtttttgtaagtcctagccaggagatacatgctcgatttcgtcggggcgcacgaagttaccaggtgatctgtagagatgagaaaactcaaatgatctatcagcagcatcagagctggcttcgcccggtgctccgctccaacagagtggaatactgttggtgtaactccggaagggctcagtgccactctgtgccggtcaagtcctgcagtgaaccccgctgtttcaacggaggcacctgccaacaagccctgtacttttctgattttgtgtgtcagtgccccgagggcttcgcagggaagtgctgcgagatagacacccgggctacctgctatgaggatcagggcattagctatcgcggaacatggtcgacagctgagagtggagccgaatgcacaaactggaattcctctgccttggcccagaaaccttacagcggcagacggccagacgccatcaggctggggctcggaaatcacaattactgcaggaaccctgaccgggacagcaagccttggtgctatgtttttaaggctggtaagtacagctcagagttttgctctacccctgcctgttccgaaggcaattcagattgctactttggaaatggcagcgcctatagaggtacccatagcttgacggaatctggcgcgtcgtgccttccttggaatagtatgatcctcatcggaaaagtgtataccgctcagaaccctagcgcccaagccttgggactgggaaagcacaactattgtaggaatcctgacggtgacgcgaagccatggtgtcatgtccttaaaaaccggaggctaacatgggagtactgtgacgttccaagctgttctacgtgtggattaagacagtactcccagccacaatttcgcatcaagggagggctgttcgccgacattgcttcccacccttggcaggccgctatctttgccaaacacaggaggtcacctggggagagatttctatgcggcggtatactgattagctcctgttggatcctgagcgccgcccactgttttcaggagagattcccgcctcaccatctgacggtgatccttggaagaacctatcgcgtggttcctggggaagaggagcaaaagttcgaggtggaaaaatatattgtccacaaggagttcgacgatgatacttatgataacgacatcgcgctgcttcagttgaagtccgatagcagcagatgtgcccaggagtcttccgtggtgcggacagtctgcctgccaccagccgacctgcagctgcctgattggactgaatgcgagctctctgggtatggcaagcacgaggctctttctcctttttattctgaacggttgaaggaagcccacgttcgtctgtaccccagttcgcggtgcactagtcagcacctcctgaataggacagttactgataatatgctgtgcgcgggagacacacgctccgggggaccacaagcgaatctgcatgacgcttgccaaggggactccggtggtcctctagtatgcttgaacgacggcaggatgaccctcgtgggaataatatcgtggggcttaggctgcggccagaaggatgttcccggagtgtacactaaagtcaccaattatttagactggatcagggataacatgcgccct

SEQ ID NO: 18311 - DNA, 1686 bp, Artificial Sequence
  Description of Artificial Sequence: Synthetic coding sequence
atggatgccatgaagcggggtctgtgctgtgtccttctcctttgtggagctgtgttcgtctcgcctagccaagagattcatgcaaggttcaggagaggtgcacgctcctaccaagtgatctgtcgggatgaaaagacccagatgatataccagcaacaccagagctggctccggcctgtgctgagatccaacagggtggagtactgttggtgtaattccggtcgtgcacaatgtcatagcgtcccagtcaagtcatgtagcgagccacggtgttttaacggaggaacttgtcagcaggcactgtacttcagcgacttcgtctgccaatgtccagaaggttttgctggtaagtgttgcgagatcgatacccgtgcgacttgttacgaggaccaaggaatctcgtacagaggaacttggtccactgcagaatccggagcggaatgtaccaactggaattcaagcgcccttgcacaaaagccttacagcgggcgtcgacctgatgcaattcgcctgggtctgggcaaccacaactactgtcgcaaccctgacagagattcgaagccgtggtgctacgtgtttaaagcaggtaaatacagcagcgagttttgttcgactcctgcatgttccgagggaaattccgactgctactttggaaatgggtccgcataccgtggtacccactcccttactgagtcgggagcaagctgcctgccttggaattcgatgatcctgatcggtaaggtgtacaccgcgcaaaacccttcggcacaagcccttggactcggaaagcataactactgcagaaaccctgatggtgacgcgaagccatggtgtcacgtcctcaaaaaccggagactgacttgggagtactgtgacgtgccctcgtgtagcacctgcggtctgaggcaatactcgcagccacaatttcgcattaaagggggactttttgcagatatagcatcccatccttggcaagccgctattttcgcgaaacatcgacggtcccccggagaacgatttctttgtgggggtatacttatctcgagctgttggattctgtccgcagcacactgctttcaggaacgatttcctcctcatcatctcaccgtgattcttgggcgcacctacagagtggtgccaggagaagaagaacagaagttcgaagtcgagaagtacattgtgcacaaggaattcgacgatgatacctatgacaacgacatcgcactcctgcagcttaaaagcgactcatcccgatgcgcacaggagagctccgtggtgcgtaccgtctgtctgccccctgcagatctccaacttccagattggaccgaatgcgaactgtccggatacggaaagcatgaggcactttccccattctactcggaacgcctgaaagaggcgcacgtgagactctacccatcgagccgatgtacctcgcaacacctgcttaacaggacggtcacggacaatatgctttgcgcgggcgataccaggtcaggtggtcctcaggcaaatctccacgatgcatgccaaggcgacagcggcggcccgctggtgtgtctcaatgatggtagaatgactcttgtgggcattatctcctggggactgggttgtggacagaaggatgtcccaggtgtctacactaaagtgaccaattaccttgattggataagagacaatatgcgcccg

SEQ ID NO: 18312 - DNA, 1686 bp, Artificial Sequence
  Description of Artificial Sequence: Synthetic coding sequence
atggatgccatgaagagggggctctgttgtgtcctgttgctttgtggtgcagtcttcgtctccccatcacaggagatccacgcacgcttcaggcggggagcgcggtcctatcaggttatctgcagagatgagaagacccagatgatctaccagcagcatcaatcctggttgcgccctgttctgcgaagtaatcgcgtggagtactgttggtgcaactctgggagagcgcagtgtcactccgtcccagtgaagtcctgctctgagccacgatgctttaatggtggcacctgccagcaggccttgtatttttcagatttcgtctgccagtgccccgaaggcttcgccggcaagtgctgtgagatcgacacacgcgcgacttgttatgaagaccagggcatatcatacaggggtacatggtccacagccgagtcgggagcggagtgcaccaactggaactcttcagccttggctcaaaaaccctactcgggacgacgcccagacgcgataagactggggttgggcaaccataactactgtagaaatcctgacagggacagcaagccgtggtgctacgtgtttaaggccggaaagtactcttccgagttctgttccactcccgcatgttccgaagggaatagcgactgttacttcgggaatggttccgcctaccggggtacccactcactgactgaaagtggtgcttcttgtctgccttggaactcaatgattctgattggtaaggtctacacggcccagaatcccagcgcgcaggcgctggggctgggaaaacataactattgtcgcaatccagacggcgatgcaaagccctggtgccacgttttaaaaaatcggaggctgacttgggaatactgtgacgtgccttcctgctcaacctgtggattgaggcaatactcccagcctcaatttcgtataaaggggggactgttcgccgatatcgcgagtcacccttggcaggcggccatttttgcgaaacacagaagaagcccaggcgaacggttcctttgtggaggcatcctgatctcctcctgctggatcctcagcgctgcccattgcttccaggagagattcccaccacatcatctgactgttattcttgggcgcacgtatcgagtcgtgccaggtgaggaggagcaaaaattcgaggtggagaagtatatcgttcacaaggaatttgacgatgatacctatgacaatgacattgctctgttacagctgaaatccgactcctctaggtgcgcgcaggagtcatcggttgttcggacagtgtgcctgccccccgccgacctgcaactgcctgattggacggagtgtgaacttagcggctatggcaaacacgaggctttaagccctttttattccgaacgtttgaaagaggcccacgtcagactgtacccgtccagccgctgcaccagccagcatctgcttaatcggaccgtaacagacaacatgttgtgcgcaggcgatacaagatccggaggccctcaggctaacctccatgatgcttgccagggagatagtggggggcccctggtctgtctgaatgacggacgaatgacgctggtggggattatctcttggggtttagggtgtggccagaaagacgtgcccggcgtgtataccaaagtgacgaattacttagactggattcgggataatatgagaccc

SEQ ID NO: 18313 - DNA, 1686 bp, Artificial Sequence
  Description of Artificial Sequence: Synthetic coding sequence
atggatgcgatgaaacgtggtttatgttgtgtattactattatgtggtgcggtttttgtttcgccgtcgcaagaaatacatgcgcgttttcgtcgtggtgcgcgttcgtatcaagtaatatgtcgtgatgaaaaaacgcaaatgatatatcaacaacatcaatcgtggttacgtccggttttacgatcgaatcgtgttgaatattgttggtgtaattcgggtcgtgcgcaatgtcattcggttccggtaaaatcgtgttcggaaccgcgatgttttaatggtggtacgtgtcaacaagcgctatatttttcggattttgtatgtcaatgtccggaaggttttgcgggtaaatgttgtgaaatagatacgcgtgcgacgtgttatgaagatcaaggtatatcgtatcgaggtacgtggtcgacggcggaatcgggtgcggaatgtacgaattggaattcgtcggcgttagcgcaaaaaccgtattcgggtcgacgtccggatgcgatacgtctaggtctaggtaatcataattattgtcgaaatccggatcgtgattcgaaaccgtggtgttatgtttttaaagcgggtaaatattcgtcggaattttgttcgacgccggcgtgttcggaaggtaattcggattgttattttggtaatggttcggcgtatcgtggtacgcattcgttaacggaatcgggtgcgtcgtgtttaccgtggaattcgatgatattaataggtaaagtatatacggcgcaaaatccgtcggcgcaagcgttaggtttaggtaaacataattattgtcgtaatccggatggtgatgcgaaaccgtggtgtcatgtattaaaaaatcgtcgtttaacgtgggaatattgtgatgttccgtcgtgttcgacgtgtggtctacgtcaatattcgcaaccgcaatttcgtataaaaggtggtctatttgcggatatagcgtcgcatccgtggcaagcggcgatatttgcgaaacatcgtcgttcgccgggtgaacgttttttatgtggtggtatactaatatcgtcgtgttggatattatcggcggcgcattgttttcaagaacgttttccgccgcatcatctaacggtaatactaggtcgtacgtatcgtgtagtaccgggtgaagaagaacaaaaatttgaagtagaaaaatatatagtacataaagaatttgatgatgatacgtatgataatgatatagcgttactacaactaaaatcggattcgtcgcgatgtgcgcaagaatcgtcggtagtacgaacggtatgtttaccgccggcggatttacaactaccggattggacggaatgtgaattatcgggttatggtaaacatgaagcgttatcgccgttttattcggaacgtttaaaagaagcgcatgttcgattatatccgtcgtcgcgatgtacgtcgcaacatttattaaatcgtacggtaacggataatatgttatgtgcgggtgatacgcgttcgggtggtccgcaagcgaatctacatgatgcgtgtcaaggtgattcgggtggtccgctagtttgtctaaatgatggtcgtatgacgttagttggtataatatcgtggggtctaggttgtggtcaaaaagatgtaccgggtgtatatacgaaagttacgaattatctagattggatacgtgataatatgcgtccg

SEQ ID NO: 18314 - DNA, 1686 bp, Artificial Sequence
  Description of Artificial Sequence: Synthetic coding sequence
atggatgccatgaagagaggcctgtgttgcgttcttctgctgtgcggtgctgtgttcgtttccccgagccaggaaatacatgctagattcaggagaggagccagatcctatcaggttatctgcagggacgaaaagacacagatgatttatcagcaacaccagtcatggctcagaccagtgctgagaagcaacagggtcgagtactgttggtgcaactctggacgcgcccagtgccattcagtacctgttaagtcatgttccgagccaagatgttttaatggcggcacctgccagcaggcgctgtatttctccgacttcgtatgtcagtgtcctgagggcttcgcgggaaaatgctgtgagatcgacaccagggccacatgttacgaagaccaaggcatttcttatcgcggaacctggagtacggctgagtctggcgcggaatgtacaaactggaactcttctgccttggcgcaaaagccatatagcggccgccgccccgacgccataaggttgggcttgggcaaccataattattgtagaaatcccgatcgcgactctaagccgtggtgttatgtgtttaaggcgggtaagtatagttcagagttctgctctacaccagcatgctccgagggtaacagtgattgctacttcggcaacggttctgcctacaggggcacgcattctttgaccgaatcaggagcgtcctgcctgccttggaatagcatgatccttattggcaaggtgtacactgctcagaacccctccgctcaagcactgggactgggtaagcataattattgcaggaatccggatggtgacgccaagccttggtgccatgtactgaaaaacaggcgcctcacctgggaatactgtgacgtgccctcctgcagtacctgtggactgcgccagtacagtcagccccagttcagaattaagggcggcctgttcgccgatattgccagtcacccctggcaggctgctatctttgccaaacaccgccgcagtccgggcgagaggttcctttgcggcggtatcctcatctcatcctgttggatcttgagcgcggcccattgtttccaggagaggttcccaccccatcacctgactgtcatccttggaagaacatatagggtcgtgcctggtgaggaggagcagaagttcgaagtagagaagtatatcgtgcacaaggaattcgatgatgacacctacgacaatgatatagcacttctgcagctgaagtctgactcttctcgctgcgcccaagaaagctccgtcgttcgcaccgtctgcttgcctcctgcggatctgcagctgcccgactggaccgagtgtgaactgagcggatacggcaaacacgaggcgctgtcccccttttacagtgaacgccttaaggaagcccacgttagattgtatccttctagtcgctgcacaagtcaacatttgcttaaccgcaccgtgaccgataatatgctgtgtgccggtgacacgcgctcaggcggacctcaagccaacctgcacgacgcctgccagggtgattcaggaggccctctggtctgtctgaacgatggaaggatgactttggtgggcatcatttcctggggactgggatgcggacaaaaggatgttcctggtgtgtacacaaaggtgaccaactacctggattggatcagggataacatgagacct

SEQ ID NO: 18315 - DNA, 1686 bp, Artificial Sequence
  Description of Artificial Sequence: Synthetic coding sequence
atggacgccatgaagagaggcctgtgctgcgtactactgctgtgtggggccgtgttcgtatccccaagtcaagagattcatgcccgatttcggcgaggagcccggagctatcaggtgatttgtcgggacgaaaagacccagatgatctatcaacaacaccagagctggctacgacccgtcctgcggagcaaccgtgtggagtactgctggtgtaactctggccgagcacagtgccactccgtaccggtgaagagctgtagtgaaccaagatgttttaatggagggacttgtcagcaggccctctacttttcagacttcgtgtgccaatgcccagaaggattcgccggaaaatgttgtgagattgacacacgggcaacctgctacgaggatcaaggtatttcatatcgcggtacgtggtctactgcagaaagcggtgcggaatgcactaattggaatagcagcgccctcgctcagaaaccttattctggaaggaggcccgacgccatcaggcttgggctgggaaatcacaattactgtaggaatccggatcgggattctaagccctggtgttatgtttttaaagccgggaagtatagcagtgagttttgcagcacccctgcctgttccgagggcaactctgactgttactttggaaacggttcagcctatcgaggcacacattctcttaccgaatccggtgctagctgcctcccctggaattctatgattctgatcgggaaggtatatacggcccaaaatccttctgctcaggcactgggactgggaaagcataattattgcagaaatcctgacggtgacgcaaaaccctggtgtcatgtgctgaagaaccggaggctgacctgggagtactgtgacgtaccttcatgttctacgtgcgggctgcggcagtacagccagccccagttccggattaaaggcggtctgttcgctgatatcgcatcccatccctggcaagccgccatcttcgcaaagcatcgtagaagtcccggagaacgcttcctgtgtggaggtatcttgatttcttcttgctggatactcagcgccgcccactgttttcaggagcgttttcccccacaccacttgacagttattctcggaaggacctaccgggtagttccaggtgaggaagaacaaaagttcgaggtcgagaagtacatagttcacaaggagtttgacgacgacacctacgacaacgacatagccttattgcaactcaagtctgattcttccaggtgcgctcaggagtcatcagtcgtgcgtaccgtctgtttgccccccgcagacctgcagctccctgactggactgagtgtgaactctccgggtacggaaagcatgaagccctgtcacccttctattcagaacggttgaaggaagcccacgtccggctgtacccctcaagcagatgcacgagccaacatctactgaaccgaacagttacggataacatgctttgcgccggagacacaaggagtggcggacctcaggccaacctgcacgatgcctgtcagggagactcaggaggcccactcgtgtgtttaaatgatggtcgcatgacacttgtgggcatcatttcatgggggctgggctgcgggcagaaggatgtgcccggcgtatacaccaaggttacaaactatctcgattggatccgcgataacatgaggcct

SEQ ID NO: 18316 - DNA, 1686 bp, Artificial Sequence
  Description of Artificial Sequence: Synthetic coding sequence
atggatgctatgaagaggggcctctgttgcgtgctgctgctgtgcggggccgtgttcgtgagcccatcacaagaaatccatgcacgctttaggaggggcgctcggtcctaccaggttatctgccgggacgagaaaacgcagatgatttaccaacagcaccagagctggctgcgtccagttctcagaagcaatagggtggagtactgttggtgtaactcgggacgggcacagtgccatagcgtgccggtgaagtcttgcagcgagcctagatgcttcaatggtggaacttgccagcaggctctctatttctcagatttcgtgtgccaatgtcccgaaggattcgcgggaaagtgttgcgaaatcgacactcgcgccacctgttacgaggatcagggaatatcgtacagaggtacttggagcaccgcggagagcggcgccgagtgtacgaactggaattcatccgctctggcacagaagccgtactcggggcggcgccctgatgctattagattgggactcggtaatcacaactactgccgaaacccggatcgcgattcgaagccatggtgctacgtgttcaaggcaggaaagtacagctcagagttctgcagcactccagcctgctccgaaggcaattcagactgctactttggcaacggatcggcctacagaggtacccattcacttactgaatcgggagcctcctgcctcccttggaattccatgattctgatcgggaaggtgtacaccgcacaaaatccgtccgctcaggcactggggctgggtaaacataactactgccgcaacccggacggagacgccaagccctggtgccatgtgctgaagaaccggcgcctgacctgggaatactgcgacgtcccgagctgctcaacttgcggactccggcaatactcccagccgcaattccgcatcaagggcggattgttcgccgacatcgcttcacacccgtggcaggccgccatctttgctaagcatcgtcgaagcccaggcgaacgcttcctgtgcggcggcatcctcatctctagctgctggatcctgtccgctgctcactgcttccaagaacggtttcctccccaccacttgaccgttatcctgggaaggacctacagagtcgtgcctggagaagaggaacagaaattcgaagtggaaaagtacatcgtgcataaggaattcgatgacgatacctacgacaacgacatcgctctcttgcagctgaaatcggactcgtcgcgctgcgcacaagagtcctcggtggtgcgcaccgtgtgcttgccaccggccgacctccagctgcctgattggaccgagtgcgaactgtcaggttacggaaaacatgaagcgctgagcccgttttactccgagagactgaaggaggctcatgtcagactgtatccgagctcacggtgcacttcacagcatctgctcaacagaaccgtcacggacaatatgctgtgtgccggagataccagatcaggagggccgcaggccaacttgcacgatgcctgtcagggcgattctggtggaccgctcgtgtgcctcaatgacggccgcatgactctcgtgggaatcatcagctgggggttgggatgtggacagaaggacgtgccgggagtgtacactaaggtgaccaattacctggactggatcagagataacatgcgcccg

SEQ ID NO: 18317 - DNA, 1686 bp, Artificial Sequence
  Description of Artificial Sequence: Synthetic coding sequence
atggacgccatgaaaaggggactttgctgtgtgttgctgctctgcggagcagttttcgtttccccctcacaggagatccatgcacggtttcgcagaggagcaagaagctaccaggtcatctgcagggatgaaaagactcaaatgatctaccagcaacaccagtcctggctgcgtccagtgctccggtcaaaccgtgtggagtactgctggtgtaactcggggcgtgcacaatgtcactcggtgccggtgaagtcctgtagcgaacctagatgtttcaacgggggtacctgccaacaggcactctacttttctgattttgtctgtcaatgtcccgaagggttcgccggaaaatgttgcgagatcgacacgagggcaacctgctacgaggatcaagggatctcgtaccgcgggacttggtccactgcagagtcgggagcagaatgtaccaattggaactcgtccgcactcgcacagaagccatactcgggacgaaggccagatgcgatccgactgggcctcgggaatcacaactactgtcgtaaccctgaccgcgattcgaagccttggtgttacgtgttcaaagccggtaaatacagctccgagttctgttccactcctgcgtgctccgagggcaactcagactgctattttggaaatggaagcgcataccgtggcacgcattcacttaccgaatccggcgcatcgtgccttccttggaatagcatgatactgattggcaaggtgtacactgcgcagaacccttcagcacaggcccttgggctggggaagcataactattgccgaaaccctgacggtgatgccaaaccatggtgccatgtcttgaagaaccgtagactgacttgggagtactgtgacgtcccctcatgttcgacctgtggtctgcgccaatattcacagccacagtttagaattaagggaggactttttgcagacattgcctcgcatccttggcaagcagccatctttgcaaagcacagaaggtccccaggagagagatttctctgcggaggaattctgatttcctcatgttggattctttctgcagcacactgcttccaggaacgctttccaccacatcacctgaccgtgatcctcggcagaacgtacagagtggtaccaggagaggaagaacaaaagtttgaagtggaaaagtacatcgtccataaggagtttgacgatgacacttacgacaacgacatcgctcttctgcaacttaagtccgacagctctaggtgtgcccaagaatcgtccgtggtgcggaccgtgtgccttcctcctgccgacttgcaacttccagactggacggaatgtgagcttagcggctacggaaaacacgaagccctttccccattctactcggagagacttaaggaggcacacgtccgcctctatccttcgagccgctgtacttcgcagcacttgcttaatcggaccgtgactgacaacatgctctgcgcgggagacactaggtcgggaggacctcaagcaaacctgcatgatgcttgccagggtgattccggcgggccacttgtgtgcctgaatgacggacgcatgactctggtcggaattatctcgtggggtcttggctgtggccagaaggatgtgccgggagtgtacaccaaggtgaccaactacctggattggattagggataacatgcggcca

SEQ ID NO: 18318 - DNA, 1686 bp, Artificial Sequence; identical to SEQ ID NO: 18279
  Description of Artificial Sequence: Synthetic coding sequence

SEQ ID NO: 18319 - DNA, 1686 bp, Artificial Sequence
  Description of Artificial Sequence: Synthetic coding sequence
atggacgcaatgaagaggggactgtgctgtgtgctgcttttgtgtggagccgtcttcgtttccccttcgcaagagatccacgctcgtttccgccggggagcacgcagctatcaggtgatttgcagagatgaaaaaacacagatgatctatcagcagcatcagtcgtggttgcggccagtcctgagaagcaaccgcgtcgagtattgctggtgcaacagtggcagggcccagtgccactctgtcccggtgaaatcttgttctgagcctcgctgcttcaatggcgggacatgccagcaggcactgtacttcagtgactttgtctgtcagtgtcccgagggatttgccggcaagtgttgtgaaattgatacacgagccacttgctatgaggaccagggaatttcgtatcgcgggacctggagcacagccgagtccggagccgagtgtacaaactggaacagcagcgccctcgcccagaaaccctatagcggtcggcgccctgacgcaattaggctcggcctcggtaatcacaattattgccgcaatcccgaccgggattctaagccgtggtgttacgtgtttaaggctgggaagtacagctcagagttctgctcaacgcctgcatgcagtgaaggcaactccgattgttactttgggaacggaagcgcttataggggtacacattcccttacagaatcgggcgcatcatgcctaccctggaactccatgatcctgataggcaaggtttacactgcacagaacccctcagcccaggcactgggtttaggaaagcacaattattgcagaaatcccgatggggacgccaaaccatggtgccatgtgttgaagaataggcggctgacatgggaatactgcgatgtaccttcatgcagtacgtgcggactaagacagtactcacagcctcagttccgcattaagggggggttgttcgccgatatcgcttctcacccgtggcaggctgccatattcgcaaagcatcgcagatcaccaggcgaacggttcctgtgtgggggcatcctcatctcctcctgttggatcctctcggcagcccactgttttcaagagagattccctccgcaccatcttacagttatcctggggagaacatacagagtggtgcctggcgaggaggagcaaaagtttgaggtggagaaatacatagtacataaggaattcgatgacgacacctacgataatgatatagctctgctgcagctaaagagcgattcttcccggtgcgcccaggagtcttccgtggtccggaccgtgtgtctacctcccgcggatttgcagctgcccgattggaccgagtgcgaacttagtgggtacggtaaacacgaggctctcagtcctttctattccgagaggttaaaggaagctcacgtccgcctgtacccatcaagtaggtgtacatcacagcacctgctgaatcgtaccgtgaccgacaatatgctctgcgcaggcgacacaagatctggcgggcctcaagctaatctgcatgatgcatgccagggggactccggaggccctctcgtttgtcttaacgatggacggatgacgctggtggggattatctcctgggggctcggatgtggacaaaaagacgtgcctggtgtctataccaaggtgaccaactacctggactggatccgcgataacatgagacca

SEQ ID NO: 18320 - DNA, 1686 bp, Artificial Sequence
  Description of Artificial Sequence: Synthetic coding sequence
atggacgcgatgaagaggggcctttgctgtgtgctgctgctgtgcggtgccgtctttgtcagcccgtcgcaggagattcacgctcgctttcggcgtggcgcccgttcctaccaggtgatatgccgagatgagaagacccaaatgatttatcaacagcatcagtcctggttaaggccagtgttgcgctccaaccgggtcgagtactgttggtgcaacagcggacgtgctcagtgccacagtgtgccagttaagtcctgcagtgaaccccgctgcttcaacggcggaacatgccagcaagctctgtatttcagcgacttcgtgtgccagtgcccggagggcttcgctggcaagtgttgcgaaatagacacccgggcaacctgctacgaggaccagggtataagctacaggggtacctggtctactgcggaatccggtgctgagtgtactaactggaattcctcggctctggcacagaaaccatatagcggaaggcgtcctgacgctattcgcttgggactgggtaatcataattactgccgaaacccagaccgcgatagcaagccttggtgctacgtattcaaggccggcaaatatagtagtgagttctgtagcacaccagcctgcagtgaaggaaactccgattgttatttcggcaatggctcggcttatcgaggcacccactctttaacggagtccggcgccagctgcctgccatggaattcaatgatattgattggcaaggtgtatacggcgcaaaacccatcggcgcaggctctgggactgggtaagcacaactactgccgcaacccggacggcgatgcgaagccctggtgccatgtcttgaaaaaccggcgattgacttgggagtactgcgatgttcccagctgttccacatgcggccttcggcagtatagccagcctcagttccgaattaagggggggctatttgcagacattgccagccatccctggcaggcagccatttttgccaagcaccgtcgtagccctggcgagcggttcctgtgcggtggaatcctgatttcgagttgctggatcctatcggcggcccactgtttccaagagcgattcccaccacatcatttaacagtcattctgggacggacctatcgggtggtaccgggagaggaggagcagaagttcgaggttgagaagtacattgtgcataaggagttcgacgacgacacgtatgacaatgacatcgcgctgctgcagctgaagtcggattcgagccggtgcgcgcaagagtcctcagtggtccgaacggtctgcctccctcctgccgacctgcaactgcctgattggactgaatgcgaattgagcggatatggaaagcacgaggccctaagccccttctactccgagcggctcaaggaagcccacgtgcgcctgtaccccagcagtcgttgcacgtcccagcatttgttgaaccgcacagtcacagataacatgctgtgtgcaggagatacgaggtccggcggcccgcaggccaacctgcacgatgcctgccaaggcgattccggaggtccgctagtatgcctaaacgatggaaggatgacacttgttggcattatcagttggggcctgggctgtggtcagaaggacgttccaggagtctacacaaaagtaacgaattacttggactggatccgcgacaatatgcgtcct

SEQ ID NO: 18321 - DNA, 1686 bp, Artificial Sequence
  Description of Artificial Sequence: Synthetic coding sequence
atggatgcgatgaagaggggattgtgttgcgtactactcctctgtggagcagtttttgtgtcaccaagccaggaaattcacgcgagattccgacgcggagcccggtcctaccaggtaatctgcagggacgaaaaaactcaaatgatatatcaacagcaccaatcctggctcagacctgtccttcggtcaaaccgcgttgaatattgctggtgcaattcagggcgcgcacaatgccactccgttcccgtaaagagctgttccgaaccccggtgcttcaatggcggtacctgtcagcaggcgttatatttctctgatttcgtgtgtcagtgcccagagggctttgctggcaaatgttgtgaaattgatacgagagccacatgttatgaagaccagggtatcagctatcggggaacctggtccacagcggaaagcggtgccgaatgtaccaattggaactcttccgcccttgctcagaagccctacagcgggcgtaggccagacgccatacgactggggttgggcaatcacaactattgcagaaatcctgatcgcgactccaaaccttggtgttacgtgttcaaagctggcaaatactcctcagaattttgttctactcctgcctgtagcgaaggcaacagcgattgctacttcggcaatgggtccgcatacagaggcactcattctctcactgagtccggagcctcttgtctgccctggaattcaatgatcctaatcggtaaggtgtacaccgcgcaaaacccttcagctcaggctctaggactcgggaagcataattactgtcggaacccggatggagatgcgaagccatggtgtcacgtgctcaagaatcgacgactgacatgggaatactgcgatgtgccgagctgctccacatgtgggcttagacagtatagccaaccccaattcagaatcaagggcgggctctttgctgatatagcttctcatccgtggcaggcagctatctttgcaaagcatcgccgaagtccaggagaacggtttctgtgtggaggaattttgatctcttcatgttggattctgagtgcagcgcactgcttccaggaacgatttcccccccatcacctcaccgtcatcctcggaaggacctacagagtcgtgcccggtgaagaggagcaaaaattcgaagtagaaaaatacattgtccataaggagtttgacgacgacacttacgataatgacattgcccttctgcagctgaagagcgactcttctaggtgtgcccaagaaagcagtgtagtccgtactgtgtgtctgccacctgcggaccttcagctgccagattggacggaatgcgaattgtcaggatacggtaagcacgaagctctgagtccattttacagcgagagactgaaggaggcacatgtcagattatatcccagttcaagatgcaccagtcagcaccttctcaaccggacagtgacagataacatgctgtgcgctggggacacaaggtctggtggccctcaggccaatctgcacgacgcctgccagggagattcaggcggtcctctggtctgcctaaacgacggccggatgacgttggtggggatcatctcttgggggctgggctgtggccaaaaagacgtgcctggtgtgtataccaaggttactaactatttggattggatccgggacaatatgcgtccc

SEQ ID NO: 18322 - DNA, 1686 bp, Artificial Sequence
  Description of Artificial Sequence: Synthetic coding sequence
atggatgcaatgaaacggggtctttgttgcgtgcttcttctttgcggagccgtgttcgtgtccccctcgcaggaaattcacgcgcgcttccgtcgcggcgctaggtcttaccaagtgatctgtcgcgatgaaaagacgcaaatgatttaccaacagcatcagagctggctgcggcctgtgctcagatcgaatagagtggagtactgttggtgtaattccggacgtgctcagtgccatagcgtgcccgtgaaatcctgtagcgaaccgcgctgtttcaatggagggacgtgtcaacaggcactgtactttagcgatttcgtctgtcagtgccccgaaggattcgccggcaagtgttgcgaaattgatacccgggctacttgttacgaagatcagggaatttcctacaggggaacttggtcaactgcagaatccggcgcagagtgtaccaattggaatagctcggccctcgctcagaagccttacagcggacgtcgaccggacgcaatccggcttgggctcggcaatcataactactgtagaaaccccgaccgggattcgaaaccatggtgttacgtgtttaaggcaggcaagtactcaagcgaattctgttcgacccccgcatgctccgagggaaactcagattgctattttggtaatgggtcggcttaccgcggaacgcattcccttactgaatcaggagccagctgcctgccctggaatagcatgatattgattggtaaggtgtataccgcacaaaacccttctgctcaggcacttggactgggtaaacacaattactgtaggaacccggacggagatgcaaagccttggtgtcacgtcctcaagaaccgcaggcttacgtgggaatattgtgacgtgccaagctgctcgacttgcggacttcgtcaatactctcagccccaattcagaatcaaaggcggtctgttcgccgatatcgcgtcgcatccatggcaagcggcaatctttgccaagcatagacggagccctggagaacgattcctttgtggtgggattctgatctcgtcctgctggattttgtccgccgctcactgttttcaggaacggtttcctcctcaccaccttactgtgatacttggacgcacttacagggtggtccctggagaggaagaacaaaagttcgaagtggagaagtacattgtccacaaagaattcgacgatgatacctacgacaatgacattgcccttctgcagcttaaatcggactccagcagatgcgcacaggaatcatccgtggtgagaacggtgtgtctgccacctgctgatcttcaactgcctgactggactgagtgtgagctttcaggttacgggaagcatgaagcactgtccccattttactccgaacgcttgaaggaggcacatgtgaggttgtacccttcctccaggtgtaccagccagcatctcctgaaccgaactgtgaccgataacatgctttgtgcaggagacacgagatcaggtgggccacaggcgaaccttcacgatgcatgtcaaggtgactcaggtgggcctcttgtctgccttaacgatggtcgaatgactttggtcggtatcatttcctggggccttggatgtggtcaaaaggatgtgcctggtgtctacactaaggttaccaattatcttgattggattagagacaatatgcggcca

SEQ ID NO: 18323 - DNA, 1686 bp, Artificial Sequence
  Description of Artificial Sequence: Synthetic coding sequence
atggatgcaatgaagcggggactctgctgcgtgcttctgttatgtggagcagtgtttgtgtctcccagtcaggaaattcatgccaggttccgccgcggcgccagatcgtatcaggttatctgccgggacgaaaaaacccaaatgatttatcagcaacatcagagctggctgagacccgtcttgaggagcaatagagtcgaatactgctggtgtaattccggtcgggcacaatgccattctgtgccagtgaaatcctgtagcgagcctagatgctttaacggagggacttgtcaacaggcgctgtacttttcggacttcgtgtgccagtgccctgagggtttcgctggtaagtgttgcgaaatcgacacaagggctacctgctacgaggaccagggcatctcctacagaggtacctggtccaccgccgagagcggtgccgagtgcaccaactggaatagctccgctctggcccagaaaccttactccggtaggcgccctgatgcaatacgtctgggcttgggtaaccataattattgtagaaaccccgatagagacagcaagccctggtgctacgtcttcaaagctggaaaatactccagtgaattctgctccactcccgcctgttctgagggcaacagcgactgctatttcggcaacggctcagcttaccgggggacgcattcattgaccgaaagcggagcaagctgcctcccttggaacagcatgattctcattggaaaggtttacacagcccaaaacccctctgctcaagccctggggctcggaaagcacaactattgcagaaacccagacggagatgcaaagccatggtgtcacgtgctgaagaacagacgcctgacctgggaatattgcgacgtgcctagttgcagcacctgcgggctcaggcaatatagccagccacaatttcggatcaagggagggttgttcgcagatattgcatcccatccttggcaggcagctatttttgcaaaacacagaagatcacctggcgaaagatttctgtgtggagggatcctgatcagctcctgttggatcctctctgctgcacactgctttcaggaacgctttcctccgcaccatcttaccgtgatcctgggccgcacctatagggtggtgcccggcgaggaagaacaaaaatttgaagtggaaaagtacattgtgcacaaagaatttgatgatgatacttacgataatgatatcgcactgctgcagctgaaatctgatagcagcaggtgcgctcaggagagctccgtggtgcgtactgtgtgcctccctcctgctgacctgcagttgcccgactggaccgagtgcgaattgagtggatatgggaaacatgaggcactgagccccttttactcagaacggctgaaggaagcccacgtgaggttgtacccttcaagtagatgcactagccaacatttactgaacaggaccgtaaccgataatatgctgtgtgctggagatacgcggagcggaggaccccaagccaatctgcacgacgcttgtcagggggacagcggcggccccctggtttgtctcaatgacggaaggatgaccctggtaggcataatcagctggggactcggttgcggccagaaggatgtgcctggagtctacaccaaggtgaccaactaccttgactggattagagacaacatgagacct

SEQ ID NO: 18324 - DNA, 1686 bp, Artificial Sequence
  Description of Artificial Sequence: Synthetic coding sequence
atggacgctatgaaaaggggcttgtgttgcgtattgctactatgcggcgccgtcttcgtatccccctctcaggaaatacatgctcggttccgccgaggggcacgatcataccaggtgatttgtagggacgagaaaacgcagatgatttatcagcagcaccagagttggctcagacctgtgctcaggagcaaccgtgttgaatattgctggtgtaattccgggcgggctcaatgtcattccgtgcccgttaagtcttgcagtgagccgcgatgctttaacggagggacctgccagcaggcactttacttttctgacttcgtatgtcaatgccctgaagggtttgccggcaaatgttgtgaaatcgacacccgggctacgtgttatgaggaccagggaatatcttatcgcggaacttggtctaccgccgagtcgggtgccgagtgcaccaactggaacagtagcgcactggcacaaaaaccctactccggacgaaggcccgacgcgatccgactgggtctgggtaatcacaattattgccgaaaccccgacagagacagtaagccatggtgctacgttttcaaagctggcaagtatagctccgagttctgtagcactcccgcgtgcagtgagggcaactccgattgctacttcggcaatggctccgcctacaggggcacccattcacttactgagtccggagcctcatgtctgccgtggaattcaatgatcctgattggcaaagtgtacaccgcccagaacccatcagcgcaggcactgggcttaggtaagcacaattactgtagaaatcctgatggcgatgctaaaccttggtgccacgtgcttaaaaatcgccggctgacatgggaatattgcgatgtgccatcctgctcaacatgcgggctaaggcagtactcccagccacagtttcgtatcaaaggtggtctcttcgccgacatcgcaagtcacccctggcaagcagcaatctttgccaagcatagacgttcccccggggagcgcttcctgtgcggagggattctgatcagttcatgctggatactgtccgccgctcattgctttcaggagcgcttccccccccatcatttgactgttattctaggccgaacctatcgggtggtcccgggggaggaagagcagaaattcgaagttgaaaagtatattgtgcataaagagtttgatgacgatacttacgataacgacatcgctttattgcagctaaagtctgacagctctcgctgtgcacaggaaagtagtgtagtcaggacagtatgcctgcctcctgccgatttgcagctacctgactggaccgagtgtgagttgagtgggtacggcaaacacgaggctctgtctcccttctattccgagagactgaaggaagcccacgtgagactatatccatcttcaaggtgcacaagccagcacctgctcaacaggaccgtaaccgacaacatgctgtgcgctggtgacacccgatccggggggccacaggcaaatttgcacgacgcttgtcagggcgacagtgggggccctctggtctgcctcaatgatgggagaatgaccttggtgggcattatcagctggggtctcggttgcgggcagaaggacgtgccaggcgtctacacaaaagtgactaattatctggactggattcgggacaatatgagacca

SEQ ID NO: 18325 - DNA, 1686 bp, Artificial Sequence
  Description of Artificial Sequence: Synthetic coding sequence
atggatgcaatgaaacgagggctgtgctgtgttttgcttctgtgcggggcagtgtttgtgtctcctagccaggagattcacgcaagattccgaaggggagctaggtcataccaagtaatatgtcgagatgaaaagacgcagatgatctatcagcagcatcaatcatggctgcgacccgtgctgagatcgaaccgggtagaatactgttggtgcaactccggaagggcccaatgccactctgtccccgtgaaaagttgcagcgagcctcgatgctttaacggcggcacctgtcagcaagccctctatttcagcgacttcgtctgtcaatgtcccgagggctttgcaggcaagtgttgtgagattgataccagggcaacatgctacgaagatcagggcatctcgtacagagggacctggagtactgctgagagcggcgctgaatgcacgaactggaattcctcggctttggctcagaagccctattccggacggaggcctgacgcgatccgactaggactcggaaaccacaattactgcaggaaccccgatagggatagcaagccctggtgttacgtcttcaaagccggcaaatattcgtccgagttttgctctacgcccgcttgttccgagggcaatagtgattgttacttcgggaatggaagcgcctatcgtggaacgcactcccttactgaatctggagccagttgtttgccctggaacagtatgatcctgatcggaaaggtctatactgctcagaatccatcagcacaggccctgggactcggcaaacacaactattgtcgaaatcctgatggtgatgccaaaccctggtgccacgttttaaaaaatcgaaggctaacctgggaatactgcgacgtgccctcctgctctacctgcgggctcaggcaatacagccagccacaattcagaattaagggaggtctgtttgccgatatcgcatcacatccatggcaggctgcaatttttgcaaagcacagaaggagccccggagagcgattcctgtgtggtggcatactgatttcatcctgttggattctctcggctgcacactgtttccaagagcgtttccctccccatcatcttaccgtgattctcggcagaacttatcgagttgtgcctggtgaggaagaacagaagtttgaggtcgaaaagtacatcgtgcataaggaatttgatgacgatacttacgacaacgatatcgcgctactgcagttaaaatctgactcgtccagatgtgcacaagaatcttccgttgtgcgcaccgtgtgtctcccccctgcagacctccagctgcctgactggactgagtgcgaactcagcggttacggaaaacacgaagccctctcgcctttctactctgaacgcctgaaagaggctcatgttcgactctacccttccagcaggtgcacatcacagcacctgttgaacaggactgtcaccgataatatgctatgcgccggcgatactcgatctggtggaccacaagcaaatctgcacgacgcctgccagggtgattcgggcggccccctggtgtgccttaatgacgggaggatgacccttgtcggcatcatcagctggggcttgggctgtggccagaaagatgtgcccggagtgtataccaaggtaaccaattatctggactggataagagataacatgcgacca

SEQ ID NO: 18326 - DNA, 1686 bp, Artificial Sequence
  Description of Artificial Sequence: Synthetic coding sequence
atggacgccatgaagagagggctttgttgcgtgctgctgctctgtggggccgtgtttgtgtctccaagccaggagattcatgcacgtttcagacggggtgcacgctcttaccaagtcatttgtcgcgacgagaaaactcagatgatctatcagcagcaccagtcctggctgagacccgtgttacgttctaacagagtggagtattgctggtgcaactctggcagggcccagtgtcactctgttcccgttaaatcatgtagcgagcctcggtgttttaacggaggcacctgccagcaggctctgtacttttctgattttgtctgccagtgccctgaggggttcgcgggaaaatgttgtgaaatcgatacgcgcgccacatgttacgaagaccagggtatttcttaccgtggcacatggtccaccgccgaaagcggcgctgagtgcactaattggaactcgagtgctctggcccagaagccatactcagggaggaggcccgacgcaatccgcttggggttaggtaatcacaactattgcagaaacccggaccgtgatagcaagccgtggtgttatgtctttaaggccgggaaatacagcagcgagttttgctccacccctgcatgtagcgagggcaactctgactgctactttggtaatggatcagcttataggggaacacattccctgactgagtcgggggcgtcttgtctgccctggaattccatgattctcataggtaaggtgtatactgcccagaatcccagtgcccaggcacttggactagggaagcataattactgccggaaccctgacggagacgccaagccatggtgccacgttctgaaaaacagaaggctcacatgggaatattgtgacgtcccttcttgctctacttgtggtttaaggcagtactcacagcctcagtttcggataaagggcgggctgttcgcggacattgcctcgcatccttggcaggcggctatttttgccaaacatagaagatcccctggtgaacgctttttgtgtggtggcatcctgatttccagctgttggatattgagcgccgcacactgctttcaggagagatttccaccacatcatttgaccgtgattctgggaaggacctatagagtggtacctggagaggaggaacaaaaatttgaggtcgagaaatacatagtgcacaaggaattcgacgacgatacctacgacaacgacattgcgcttctgcagctgaagtccgattcctcccgctgcgcccaggaaagctctgtggtccgtactgtttgcctgcccccggccgatttacagctgccagattggaccgagtgcgaattgtctggatatggtaagcatgaggctttgtcacccttttatagcgagcgcttgaaagaggcccacgtgcgtctataccccagttcacgttgtaccagccagcacctgttgaaccggacagtcactgataacatgttgtgtgccggcgatacccggtccggcggcccccaggctaacttacatgacgcttgtcagggagatagcggtggacccctcgtatgcttaaacgacgggcgtatgaccctggtcggcatcataagctgggggctgggatgcggacagaaggatgtgcctggggtgtacaccaaggtgactaactacctggattggattcgcgacaatatgaggcct

SEQ ID NO: 18327 - DNA, 1686 bp, Artificial Sequence
  Description of Artificial Sequence: Synthetic coding sequence
atggatgctatgaagcgcggactttgctgtgtccttctgctctgtggtgcagtctttgtctccccttcccaggagatccacgccagattcaggcgtggtgcacgttcctaccaggtgatctgcagggatgaaaagacccagatgatctaccagcaacatcagtcctggctcaggcccgtgctgcgcagcaaccgtgtggaatactgctggtgcaactctggtagagctcagtgtcactccgttcctgtcaagagttgcagcgagcctcgctgctttaacggtggcacttgtcagcaggccctctacttcagcgactttgtgtgccagtgccccgagggcttcgcaggtaagtgttgcgagatcgatactagggctacctgttatgaggatcagggcattagttataggggcacctggtccactgctgagtccggtgctgagtgcaccaattggaatagttccgccctggcccagaagccctactccggtcgtagacctgacgcaatcaggcttggtttgggtaatcataattattgccgtaaccccgatcgtgattccaagccctggtgctacgtgttcaaagctggaaaatactcttccgagttttgcagcacacccgcatgcagcgaaggtaactccgattgctactttggaaacggatcagcctacagaggtactcactctctcacagagagcggcgcatcctgtctcccctggaactctatgattctgatcggtaaagtgtacactgcacagaacccctctgctcaggccttgggcttgggaaagcataactactgccgcaacccagatggagatgccaaaccctggtgccacgttctgaagaatagacgtctgacctgggagtattgcgatgtaccttcttgcagtacttgtggtcttcgccaatacagccagccacagtttcgtataaagggaggtctgtttgccgatatcgcttctcacccttggcaggctgctatctttgctaaacacaggaggtcacctggcgaaagattcctgtgtggtggaattttgatctcttcttgttggatcctgtcagctgcccattgtttccaggagcgtttccccccacaccatctgaccgtgatccttggaagaacttacagggtggtgccaggtgaagaagaacaaaagtttgaggtcgaaaaatacattgtgcacaaggaattcgatgacgatacctatgacaatgatattgccctgttgcagctgaaatcagattcttctcgctgcgcccaggagtctagtgtggtgcgcacagtttgtctgcccccagccgatctgcagctccccgattggactgagtgcgaactcagcggatacggcaaacacgaggcattgtcccccttttattctgagcgtctgaaggaggctcacgtgcgtctgtatcccagctcacgttgcacctcacagcaccttctgaaccgtactgtgacagacaatatgttgtgtgctggagacaccagatcaggcggacctcaggcaaatctgcacgatgcctgtcagggcgattctggaggccctttggtttgcctgaacgacggtcgtatgacccttgtgggtataatctcatggggcctgggctgcggccagaaggatgttcctggtgtttacaccaaggtgaccaattacctcgattggatccgcgataatatgagaccc

SEQ ID NO: 18328 - DNA, 1686 bp, Artificial Sequence
  Description of Artificial Sequence: Synthetic coding sequence
atggatgccatgaagcgtggcctctgctgcgtcctcctgctctgtggagccgtgtttgtgtcgccgtcccaggagattcacgcaagatttcggaggggcgctaggtcctaccaagtgatctgccgagacgagaaaacccagatgatctaccaacagcaccagtcatggcttcggccggtgctgaggtccaatcgcgtggaatactgctggtgtaacagcgggcgggcacagtgtcattccgttcccgtgaagtcgtgcagcgaaccacggtgtttcaacggcgggacttgccagcaagccctctatttcagcgatttcgtttgtcagtgcccagagggcttcgctggtaaatgctgtgagattgatacccgcgcgacctgctacgaggaccagggaatctcataccgcggaacttggtccaccgcggaatcgggcgccgaatgcactaactggaactcctcggctctggctcagaaaccgtacagcggcaggcggccagacgctatcagacttgggcttggaaatcacaactactgtaggaacccggaccgcgactccaagccgtggtgctacgtgtttaaagcaggaaagtactcgtcggagttctgcagcacccctgcttgctccgaaggcaactctgattgctacttcggtaatggctctgcctaccgcggaacccattccctgactgaatcaggcgcgtcgtgccttccgtggaacagcatgattctcattggaaaggtctacactgcccaaaacccgtcagcccaggcgcttggattgggtaaacacaactactgccgcaatcctgatggagacgcgaagccgtggtgtcacgtgctgaaaaatcggcggctcacgtgggagtactgcgacgtcccttcatgctccacgtgtgggctcagacaatacagccaaccccagtttcgaatcaagggcggcctcttcgccgatatcgcgtcacacccttggcaggcggctatcttcgcgaaacatcgcagaagccctggcgaacgctttctgtgcggaggcatcctgatctcgtcatgctggatcctgtcggccgcccactgctttcaagagcggtttccaccgcaccacctcactgtcatcctcggacgcacttatcgagtggtcccaggagaagaggagcagaagttcgaggtggagaaatacatagtgcacaaagagttcgacgacgatacctatgacaacgacatcgccctgctgcagctcaagtcggactcgtcgcgatgtgcacaggaatcatctgtggtgcgaactgtgtgcctgccaccggcagatctccagcttccagactggaccgaatgcgaactgagcggatacggaaagcacgaagcgctgtccccattctactctgaacgcctcaaggaagcgcatgtgcgcctctacccgtcatcgcggtgcacttcccagcacttgctcaacagaactgtcaccgacaatatgctgtgtgcaggggacacccggtcaggtggcccacaagccaatctgcacgacgcctgtcaaggtgattcaggagggccgctcgtctgcctcaacgatggacgcatgaccctggtgggaatcatctcctggggcttgggatgcgggcagaaggacgtcccgggcgtgtacactaaggtgaccaactacctggactggatccgcgacaatatgaggcct

SEQ ID NO: 18329 - DNA, 1686 bp, Artificial Sequence
  Description of Artificial Sequence: Synthetic coding sequence
atggatgctatgaagaggggtttatgttgcgttttgcttttgtgtggagccgtcttcgtctccccatcccaagaaattcacgcccgattccgaaggggcgctagaagttatcaagtcatctgtagggacgagaagacccagatgatatatcaacaacaccagtcctggctccgacctgtgctgcgaagtaacagagttgagtattgttggtgcaactctggacgagcccagtgccatagtgttccagtgaagagttgtagcgagccccggtgctttaacggggggacatgtcagcaggccctctactttagcgacttcgtgtgccagtgtccggaggggtttgcaggtaagtgctgcgaaatagatactcgggcaacatgttatgaagatcagggcattagctaccgaggtacctggagtactgctgagagtggcgccgaatgtacaaactggaacagctccgctttggcccagaaaccctattcgggtcgtaggcctgatgctatcagactggggctggggaaccataactactgtaggaaccctgacagggactcaaagccatggtgttacgtgttcaaggctggtaagtactcttcggaattctgttcgacacctgcctgctcagagggtaactcggactgttattttggtaatggcagtgcatacagaggcacccactctctgaccgagtctggggcttcatgtttaccctggaacagcatgattctgatcggcaaagtatacacagcccagaacccctctgcacaggcactcggactcggtaagcacaattattgtaggaaccctgacggggacgctaaaccttggtgtcatgtgctgaagaataggcgcttgacgtgggagtattgtgacgttccctcatgctcaacatgtgggctcaggcagtactctcagccccaatttagaataaagggagggctctttgctgacattgcctcacacccctggcaggctgccatctttgcaaaacatcgacgatcacccggcgaacgatttttgtgcggtggcatattgatctcttcctgctggatcctctctgctgcacattgcttccaggaacgattcccgccccatcatttgacggtcattctggggcggacgtacagagtggtgcctggagaggaggagcagaagttcgaagttgaaaagtacatagttcataaagagtttgatgatgacacctacgacaatgatatcgcgctcctccagttaaagagcgacagctctcgttgtgctcaagaaagctctgtggtaaggaccgtgtgcctgccccctgcagatttgcagttgcccgattggactgaatgcgaactttccggttatggaaagcacgaagcactatctccattttactcggagagactcaaggaagctcacgttcggttgtatccatcctctcgatgtactagtcagcacctgctaaaccgaaccgtaacagacaatatgctgtgcgccggcgatacacggtcaggcggtccacaagccaacttgcacgacgcttgtcagggcgattccgggggtccgctggtgtgtctgaacgatgggagaatgaccctggtgggcattatttcttggggactcggctgtggacaaaaagatgtgcccggggtgtataccaaagttaccaattatctggattggattcgtgataacatgcgtcca

SEQ ID NO: 18330 - DNA, 1686 bp, Artificial Sequence
  Description of Artificial Sequence: Synthetic coding sequence
atggatgccatgaagagaggcctgtgttgtgtcttgctactctgtggggcagtgtttgtaagcccgtcccaagaaattcatgcgcgcttccgtcgcggggcccgcagttatcaggttatttgtagagatgagaaaacccagatgatctatcagcaacatcagtcctggctaagacccgtccttagatcaaatcgcgtggaatactgctggtgcaactcgggcagagctcagtgccactcagtgccagtaaagagctgctccgagcctagatgcttcaatgggggcacctgccagcaggccctatatttttccgatttcgtctgtcagtgccctgaggggtttgctggaaaatgctgtgaaatagacactagagcaacatgttacgaagaccaaggtatcagctatcgtggaacatggtccaccgcggaatccggggccgagtgcacgaattggaactcatctgcccttgcgcagaaaccctactcggggagacgaccagatgccatccgattgggtctaggcaatcataactactgccgcaaccccgatcgggactctaaaccctggtgctacgtgtttaaggccggcaagtactcctcggagttctgcagcacccccgcctgttcggagggcaacagcgactgttattttgggaatggctccgcataccgcggtacgcactcattgacagagtctggagccagttgtctgccatggaactcaatgatactaatcgggaaggtgtacaccgcccagaacccctcagcccaggccctaggattggggaagcataattattgcaggaatcccgatggcgacgccaagccatggtgccacgtgctgaagaatcggcggctgacgtgggagtactgcgatgttccaagttgttcaacttgtggcctgagacagtattcccaacctcagttcagaattaagggaggccttttcgccgacattgcgtcccatccctggcaggcagctattttcgcaaaacaccgtcggtcccccggtgaacgctttctgtgtggaggcatcctgatctcatcatgctggatcctcagcgccgctcactgctttcaggaacggttcccacctcatcacctcaccgtgattttgggccgtacttacagggtggtgcctggtgaggaggaacagaagttcgaggtagagaagtacatcgtgcataaggagtttgatgatgatacgtacgataacgacattgctctcctgcaattgaagtcagattcttctagatgtgctcaagaaagctcagtcgttagaacagtctgcctgccccctgccgacctgcagttacctgattggaccgaatgtgagctttccggatatggcaaacatgaagcgctctcccccttttactcagagcgtctaaaggaagcccacgtgaggttgtacccttcctctaggtgcacatctcagcaccttctcaacaggactgtaacagataacatgctgtgcgctggagatacccggtcaggaggccctcaggccaacttgcacgatgcttgtcaaggggacagtggcgggcctcttgtgtgtctcaatgacggccgcatgacactggtagggatcatcagctggggccttggatgcggtcagaaggatgttccaggagtgtatacaaaggtgacgaattacctggactggatcagagacaatatgcgacca

SEQ ID NO: 18331 - DNA, 1686 bp, Artificial Sequence
  Description of Artificial Sequence: Synthetic coding sequence
atggacgccatgaagcgcggactgtgctgcgtgttgctcctgtgcggcgccgtctttgtgtcaccctcgcaggagattcatgccagatttaggcggggcgcgcggtcatatcaggtcatctgtcgggatgaaaagacccagatgatctaccaacaacatcagtcgtggctgcgacctgtcctgcgttcgaaccgggtggaatactgctggtgcaactccgggcgggcacagtgccacagcgtgcctgtcaagtcatgctcagagccgaggtgctttaacggaggaacgtgccagcaggcactgtacttctctgacttcgtctgccaatgcccagaaggattcgcaggaaagtgctgtgaaatcgacacccgagcgacgtgctacgaggaccaaggaatcagctaccgcggcacctggagcaccgccgaatcaggagctgagtgcacgaactggaattcgtcagcgctggctcaaaagccatactcagggcgcagaccggacgcgatcaggctgggactggggaaccataactactgtaggaaccccgatcgcgactcaaagccctggtgctacgtctttaaggcaggtaaatactcgtccgaattctgctcaaccccagcctgttccgagggaaactcagactgttacttcggaaatggttccgcatacagaggaacccactcgctgaccgagtcgggagcgtcgtgtctgccgtggaactcgatgatccttattggcaaagtctacacggcacaaaacccgagcgcccaggctctgggccttggaaaacacaactactgccgcaacccagacggggacgccaagccatggtgccatgtgctgaagaatcgccgcctgacctgggagtactgcgacgtgccaagctgttctacctgcggtttgagacagtactcacagccgcaattccgaatcaaaggtggactgttcgcggatatcgcgtcccacccgtggcaagccgctatctttgccaagcatcgcagatcccctggcgaaagatttctgtgtggaggaatcctgatctcttcatgttggatcctttccgcagctcactgcttccaggagagattccctccccatcatctcactgtcatccttggccgcacctaccgcgtggtaccgggcgaggaggaacagaaatttgaggtcgaaaagtatattgtgcacaaggagttcgacgatgatacttatgacaatgatatcgcgctgctgcagttgaagtcggattcgagcaggtgtgcccaggaaagcagcgtggtgcgcaccgtgtgcttgcccccggcagacctccaactgccagattggaccgagtgtgaattgtcgggatatggaaaacatgaagcgctttcaccgttctactcggaaagactgaaggaagcacacgtccgcctctaccccagctcgcgctgtacttcgcaacacctcctgaacagaaccgtcactgataacatgctgtgcgccggagacacccgcagcggaggaccccaggcaaatctccacgacgcttgtcaaggtgattcaggcggaccattggtctgcctgaacgatggtcggatgaccctggtggggatcataagctggggacttggttgcggccagaaagatgtgcctggagtgtacactaaggtgaccaattacctcgattggatcagagacaatatgaggcca

SEQ ID NO: 18332 - DNA, 1686 bp, Artificial Sequence
  Description of Artificial Sequence: Synthetic coding sequence
atggatgcgatgaaaaggggcctgtgttgtgtccttctcctgtgtggggccgtgtttgtgagccctagccaagaaatacatgctcggttccgcagaggggcacgatcataccaggttatctgtcgagatgagaagacccagatgatttatcagcagcatcagagttggctgcgtccagtactgcggagtaacagggtcgagtattgctggtgcaattccggaagggcccagtgtcactctgtacctgtgaagtcatgctccgaacccaggtgttttaacggcggaacatgtcagcaggccctgtacttctccgatttcgtctgtcagtgccctgagggattcgcaggaaaatgctgcgaaatagacacaagagccacctgctacgaagaccagggtatctcgtatagagggacatggtcaacagcagaatccggggcggagtgcactaattggaactcatccgccctcgcgcagaagccttactcagggcgtagacctgacgctatcaggttgggtcttggaaatcacaattactgccgaaatcccgatcgggactccaagccctggtgttacgtctttaaagccggcaagtactccagcgaattttgttctacccctgcctgttccgaaggcaattcagactgttattttggcaacgggtccgcatatcgcggtacccactcattgaccgaatccggggcctcatgtttgccctggaatagcatgatcctgatcggaaaggtctacaccgcccagaatccttcagctcaggccctggggctgggaaaacacaattactgccggaatcctgacggcgacgccaagccatggtgccatgtgctgaaaaatcggagattaacgtgggagtattgcgacgttcccagctgtagcacatgtggactaaggcagtacagccagcctcaatttcggataaaagggggactgttcgctgacattgcatcgcatccatggcaggccgccattttcgccaaacataggagatccccaggggagcgttttctctgcgggggaattctgatctcaagctgctggatcctctctgctgcccattgctttcaggagcgcttcccccctcaccacctcacagtcattcttggtcgcacttaccgggtggtgccaggggaagaagaacagaaattcgaagtggagaagtacattgtacacaaagaatttgacgacgacacctacgacaacgatatcgcacttctccagctgaaaagtgatagctccagatgcgcccaggagtcctctgtagtgaggaccgtctgcttgcctcctgcagacctgcaactgcctgactggactgagtgcgagttatccgggtacggcaagcatgaggctctctcccccttttactccgagcgactgaaggaggcgcacgtgagactctacccatcttcacgctgtacctcccaacatcttctcaacagaaccgtgaccgacaatatgctgtgcgccggagacactagaagtgggggcccccaggccaatctacacgacgcttgtcagggcgattctgggggccctctcgtgtgcttgaacgacggacgaatgacactagtggggatcatttcctggggactcggatgtggacagaaagatgtaccgggtgtctacactaaggtcaccaattatctagactggattcgggataacatgcgccct

SEQ ID NO: 18333 - DNA, 1686 bp, Artificial Sequence
  Description of Artificial Sequence: Synthetic coding sequence
atggacgccatgaagcgagggttatgctgtgtcctgctcctttgtggcgccgtatttgtcagtccctctcaggagatacatgctcggttcagacggggggctcgcagctaccaggtgatctgccgcgatgaaaagactcagatgatctaccagcagcatcagtcttggctgagacctgtccttcggtctaatagagttgaatactgctggtgtaatagcggacgggcccagtgccacagcgtgccagttaagagttgcagtgagccacgctgcttcaatggtggaacctgtcagcaggccctctacttttccgattttgtgtgtcagtgccccgagggcttcgcaggcaagtgctgcgagatcgatactagggcaacttgctacgaggatcaggggatttcatacagaggcacatggtctaccgccgaatctggggcagaatgcaccaactggaattcaagtgccctggctcagaaaccatacagtggccgtaggccagacgcaattcgactgggcttaggcaatcataactattgtcgaaaccctgatagggacagtaaaccgtggtgctatgttttcaaagcaggtaaatacagctctgagttttgctccactccagcttgtagtgaaggcaattccgactgctatttcggcaacggcagtgcctaccgtggcacccactctctgacagaaagtggagctagctgtctgccctggaatagtatgattctgatcggaaaggtatataccgcccaaaacccgtctgcccaagcgcttgggctggggaagcataattattgccggaacccggacggcgatgctaaaccctggtgccacgtgctgaagaatcggcgcctgacctgggagtattgcgacgtgccctcttgctcaacatgtggtctcaggcagtactcccagcctcagtttcgaatcaagggagggctgttcgccgacatcgcttcacatccgtggcaggctgccatatttgcaaagcaccgccgcagtccgggggagaggttcctgtgcggcgggatactgatttcatcatgttggatcctttcggctgcacattgcttccaggagcgattcccaccacaccatttgactgtgatcttaggtcggacctaccgagtcgtccccggagaggaggaacaaaagttcgaagtagagaagtatattgtccataaggagtttgacgatgatacgtatgacaatgatatcgccctgctacagctgaagagtgacagtagcaggtgtgcacaggaatcctcagtggtcagaactgtctgcctccccccggcggacctgcagcttccagactggaccgagtgtgaactctctggatatggcaaacacgaggctctgtctcctttttatagcgaacgcctgaaggaagctcatgtgaggctgtacccatcatcccgatgtacatcacaacatctcttgaatcgaactgtgacagacaacatgctctgtgccggcgacacccgatcgggcggtccacaagctaaccttcatgacgcatgccagggagactccggagggcccctggtatgccttaacgatggacgcatgactctcgtggggataatctcgtgggggctggggtgtggtcaaaaggatgtccctggggtgtataccaaagtaaccaattacctcgattggatacgcgacaacatgcgacct

SEQ ID NO: 18334 - DNA, 1686 bp, Artificial Sequence
  Description of Artificial Sequence: Synthetic coding sequence
atggatgctatgaagagggggctgtgttgcgtgctcctcttgtgtggggccgtcttcgtaagcccaagccaagaaatacatgcacgtttcagacgaggcgctcgcagttaccaggtgatttgtagggacgaaaaaacacaaatgatataccaacagcaccaaagctggctgagacctgtgcttcgctctaatcgcgtagagtattgctggtgcaactccgggcgcgcccagtgtcatagtgtcccagttaagtcctgttctgagccacgctgcttcaacggcggcacatgccagcaggcactctacttttctgacttcgtctgtcagtgtccagaaggcttcgccgggaaatgctgcgagatagataccagagccacctgttacgaggatcagggaatttcgtaccgaggcacatggagcactgctgagtctggggccgaatgcacaaattggaatagctcagcattggcgcagaaaccctactctggccgccgaccggatgccatccgcctgggactgggaaaccacaattattgtaggaacccagacagagactctaaaccatggtgttacgtcttcaaggcggggaagtactccagcgagttctgctctaccccagcctgctccgaagggaattcagattgctacttcggcaatgggtcagcataccgggggacccactccttaactgagtcgggcgcttcatgcttgccttggaacagcatgatcctgatagggaaagtctataccgctcagaatccaagcgcccaggccctgggtctgggcaagcacaattactgcagaaaccccgatggcgacgccaaaccttggtgccacgtgttgaaaaacagaaggcttacatgggaatattgtgacgtacctagttgttccacctgcggcctgcgccagtattcccagccccagttccggattaaaggagggctctttgctgatatcgcctctcatccttggcaggcagctatcttcgcaaaacaccgcagatctccaggggagagatttctatgtgggggcatcctgatttcctcctgctggatcttgagcgccgcccactgttttcaggagcgtttccctccgcaccacctgactgtaattctcgggaggacctaccgagtggtacccggggaagaggagcagaaatttgaggtggaaaagtatattgtgcacaaggagtttgacgacgatacatacgacaatgatatagccttgctgcagttgaaaagcgattccagccgctgcgctcaggaaagcagtgtcgtgaggactgtctgtctccccccagcggacctccagctgcctgactggacagagtgcgagctgtcggggtacggaaagcatgaggccttgagccccttctacagtgagcgtctcaaagaggcgcatgttagactttaccctagctcacggtgtactagccaacatttgttgaaccgaactgtgaccgataatatgctttgtgctggggatacccgctccggcgggccccaggctaacctccacgacgcatgccagggggattctgggggcccactagtatgcttgaatgatggtaggatgactttggtgggaataatctcatggggcttaggttgcggacagaaggacgtgcccggggtatataccaaagttactaattacctcgactggattagagataatatgagaccc

SEQ ID NO: 18335 - DNA, 1686 bp, Artificial Sequence
  Description of Artificial Sequence: Synthetic coding sequence
atggatgcaatgaaaagaggactttgttgcgtgctgctgctctgtggcgcggtctttgtttctccgtcccaagagatccacgcccggtttagacgtggtgctaggtcctaccaggtaatttgtagggatgagaaaacacagatgatctatcagcagcatcagagctggctccgcccagtattaaggagcaatcgggttgaatattgttggtgcaattcaggccgcgcccagtgccattccgtgcccgtcaaatcctgctctgagccccggtgcttcaatggcggaacctgtcaacaggcgctgtacttctccgacttcgtgtgtcagtgtcccgagggcttcgccggcaaatgttgcgaaatagatacgcgcgccacttgttatgaagaccaaggtatttcctaccggggcacatggagtaccgcagagtctggggcagaatgcaccaattggaacagcagtgccctcgcacagaagccttacagtgggcgacggccagatgccatccgcctgggccttggcaaccacaattattgtagaaatccagatcgcgatagcaagccctggtgttatgtcttcaaggcgggaaagtattcaagcgagttctgcagcaccccagcttgctctgagggaaattctgactgttatttcggaaacggtagtgcatacaggggaactcacagcctaacagaatccggcgcttcatgtttgccctggaacagtatgatcctaataggcaaggtgtacacagctcaaaacccttccgcccaggcccttggcctagggaaacataactattgtaggaaccctgatggagatgcaaaaccatggtgccacgtgctgaagaaccggaggctgacttgggagtactgtgacgtgcctagttgtagcacatgtgggctgaggcagtacagtcagccacaattcaggataaagggtggcctgtttgctgatattgcctcacatccttggcaggctgccatttttgccaagcatcgtagatcaccaggcgagagattcttgtgtggcggcatcctgataagctcctgctggatcctttccgcggctcactgctttcaggaacggtttcccccacaccatctcaccgttatactaggacgcacatatagagtggtgcccggcgaggaggagcagaagtttgaagtggaaaagtacatagtccataaggagtttgatgatgatacctacgacaatgacatcgctttactacaactcaaaagtgattcttcccgctgtgcgcaagaatcttctgtggtcagaacagtatgccttccccctgctgacctgcagctccctgattggaccgagtgcgagctgtctgggtacggcaaacacgaagctctctctccattctactcagagcgtctgaaagaggcccatgtgcggctgtacccctcttccagatgcacctctcagcacctgttgaaccgcacagttactgataatatgttgtgtgccggtgacacccgtagcggcggtccacaggcaaacctccacgatgcatgccagggcgactcgggcggtcccttggtgtgcttaaatgacgggcgcatgaccttggtgggcatcatatcttgggggctaggctgtggtcagaaggacgtccctggagtttatactaaggtcactaattatcttgattggatcagggataatatgcggccc

SEQ ID NO: 18336 - DNA, 1686 bp, Artificial Sequence
  Description of Artificial Sequence: Synthetic coding sequence
atggatgcaatgaaaagaggtttgtgctgtgttcttttactttgtggagctgtttttgtttctccaagtcaagaaatacatgcaagattcagaagaggagctagatcataccaagttatttgtcgagatgaaaaaacacaaatgatatatcaacaacatcaatcttggcttcgacctgtattaagatctaacagagtagaatattgttggtgtaattctggtagagctcaatgtcatagtgttccagttaaatcatgttcagagccaagatgttttaatgggggaacatgtcaacaagctctttattttagtgatttcgtttgtcaatgtccagaaggattcgctggtaagtgttgtgaaattgatactagagcaacttgttatgaagatcaaggaatttcttatcgagggacatggtcaactgctgaatcaggagcagaatgtactaattggaactcatcagctcttgcacaaaaaccatactcaggacgtagacctgatgctattagactaggtttaggaaatcataactactgtagaaatccagatagagactctaaaccttggtgttatgttttcaaggcaggaaaatattcatcagaattttgcagcactcctgcttgtagtgaaggtaattctgattgttatttcggtaatggaagtgcttatagaggtacacattcattaacagagtcaggtgcaagttgtttaccatggaattcaatgattttaattggtaaagtttatactgcacaaaatccatcagcacaagcacttggattgggaaaacataattattgccgtaatccagatggtgatgcaaaaccatggtgtcatgttcttaaaaatcgtagattaacttgggaatattgtgatgttccaagttgttctacatgtggattaaggcaatattctcaaccacaattcagaattaaaggaggacttttcgctgatattgcttctcatccatggcaagcagctatttttgcaaaacatcgtagatctccaggagaacgattcttatgcggaggtattttaatttcatcttgttggattttatcagcagcacactgttttcaagaaaggtttccaccacatcatttaactgtaattttaggtcgtacatatagagttgtacctggtgaagaagaacaaaaatttgaagtcgaaaaatatatagtacataaagaatttgatgatgatacgtatgataatgatattgctcttttacaacttaaatcagattctagtcgttgtgctcaagaatcttcagttgttagaactgtttgcttaccaccagctgatcttcaattacctgattggacagaatgtgaactttcaggatacggaaaacatgaagctttaagtccattttattcagaaagattaaaagaagctcatgttagattatatccttcttctcgatgtactagtcaacatcttttaaatagaacagttacagataatatgctttgtgcaggtgatacaagatctggtggaccacaagctaatttacatgacgcatgtcaaggagattcaggaggtccacttgtttgtcttaatgacggaagaatgacacttgttggaataatttcatggggattagggtgtggacaaaaagatgtcccaggagtttatactaaagtaacaaattatttagattggattagagataatatgagacca

SEQ ID NO: 18337 - DNA, 1686 bp, Artificial Sequence
  Description of Artificial Sequence: Synthetic coding sequence
atggatgccatgaagaggggcctgtgctgcgtacttctactgtgtggggctgtgttcgtgtcaccatcacaggaaatccacgcccgattcagaagaggggcccgctcgtaccaggtcatctgtcgagatgaaaagacgcaaatgatttaccagcagcatcagagttggcttcgccctgtcctcaggtccaacagagtggagtattgctggtgtaatagcgggcgtgcccagtgccactcggtgccggtcaagtcttgcagtgaaccaaggtgctttaacggcggcacatgccagcaagctttgtacttctctgattttgtttgtcaatgtcctgaaggattcgctggaaagtgctgtgaaattgacactcgagcgacatgttatgaggaccagggcatatcctaccgggggacatggtctacagcagagtccggagcagaatgtaccaattggaacagtagtgctttagcacagaagccatactccgggcgcaggcctgacgcaattcgccttggactcggcaaccataactactgcagaaaccccgatcgggactccaaaccttggtgctatgtcttcaaagcaggcaagtatagcagtgagttttgcagtacgcctgcatgtagcgagggcaacagcgattgttatttcgggaatgggagcgcatacagaggaactcacagtcttactgagtcgggcgctagctgtcttccgtggaactccatgatcctgattgggaaggtgtacaccgcccaaaatccctcagcccaggcactgggactcggcaaacataactattgccgaaacccagatggggatgccaagccttggtgccatgtgctgaagaaccgtcgcctgacatgggagtactgtgatgtaccgagctgtagtacgtgcggactgcggcagtacagccagcctcagtttcggataaaggggggcttatttgcagatatagcctctcatccatggcaggctgcgatcttcgccaaacataggcgtagtccaggcgagagatttttatgcggcggcatcctaatatcttcatgctggatcctatcagccgctcactgtttccaggaaagatttcccccacatcaccttacagtcatcctgggcaggacctatcgggtagtacccggggaagaagagcagaagttcgaagtagagaagtatatcgtgcacaaggagtttgacgacgatacgtacgacaatgacatcgcacttcttcagctgaaaagtgattcttcaagatgtgcacaggagtcctctgtggtaaggacagtgtgtctaccgcctgcagatctacagctacccgattggaccgagtgcgaactgtccggatacggaaagcacgaggctctatcacccttttacagtgagagattgaaggaagctcacgtgaggttgtacccttcttcacgatgcacctctcagcatcttctaaaccggaccgtgactgacaacatgctgtgcgctggggacacccgctccggggggccccaggcaaacttgcacgatgcatgtcagggcgatagcgggggcccactggtatgtctgaatgatggccgaatgacgctcgtgggcattatatcatggggcctaggctgcggacagaaggatgtccctggcgtgtatacaaaagttacgaactacctggactggataagagataatatgcgtccg

SEQ ID NO: 18338 - DNA, 1686 bp, Artificial Sequence
  Description of Artificial Sequence: Synthetic coding sequence
atggacgccatgaaaagaggactgtgttgtgtgctgctgctgtgcggagccgtgttcgtgagcccgtcacaggagatccacgcaagattccggcggggggcccgctcataccaggttatctgccgcgatgagaaaacccaaatgatctaccagcagcaccaatcgtggcttagaccggtgttgaggtccaatagagtggaatactgctggtgtaactcgggacgcgcacagtgccactccgtcccagtgaaaagctgctcggagccacgttgtttcaatggaggcacctgtcaacaggcactctacttctcggacttcgtctgccagtgtccagagggcttcgctggaaaatgttgcgaaatcgacacccgggctacttgctacgaagatcagggaatctcgtaccggggcacttggtcaactgcagaatccggagctgaatgcaccaactggaactcctccgccttggcccagaagccttactccggtcgtagacctgacgcgatccgcctgggactcggaaaccacaattactgcaggaatccggatcgggactcaaagccgtggtgctacgtgttcaaggctggtaagtactcatcggagttttgctcaactcctgcatgcagcgaagggaacagcgattgctatttcggaaatgggtcggcctaccggggaactcattcccttaccgagtcaggcgcctcctgcctgccatggaacagcatgatcctgatcggaaaggtgtatactgcacagaaccctagcgcacaggcattgggactgggaaagcacaactactgcaggaacccggacggagatgcaaagccctggtgccatgtgctgaagaaccggcggttgacctgggaatactgcgacgtgccctcctgctctacctgcggactcaggcagtactctcagccacagttccggattaaaggaggattgttcgccgatatcgcttcgcacccatggcaggccgctatcttcgcgaagcacagaaggagcccaggggaacgtttcctgtgtggaggcattcttatttcgtcgtgctggattctcagtgccgctcattgttttcaggaacgcttcccgccacatcatctgaccgtgatcttgggacgcacctaccgggtcgtcccaggagaggaagaacaaaagtttgaggtggaaaagtatatcgtccataaagagtttgatgatgatacctacgacaatgatatcgctcttctccagctgaagtcggactcaagccggtgcgcccaagaatcctcggtggtccgcactgtctgtttgccgccggccgacctgcagctgccggactggaccgagtgtgaactgtccggatacggaaagcatgaagcactgagcccgttctattccgaacggctgaaagaggcccacgtgcgcttgtacccgtcgagccgatgtacttcgcagcacctcctgaaccgaacggtcaccgataacatgctttgcgccggagataccaggtcaggaggtccccaggccaacctgcacgatgcgtgccagggagactcaggaggcccgcttgtctgcctgaatgacggccgcatgactctggtcggaatcatctcgtggggactgggctgcggtcaaaaggacgtaccgggagtgtacaccaaggtgaccaattacctggactggatcagagataacatgcgcccg

SEQ ID NO: 18339 - DNA, 1686 bp, Artificial Sequence
  Description of Artificial Sequence: Synthetic coding sequence
atggacgcgatgaaacgcgggctctgttgcgtgctgctgctctgtggagcagtgtttgtgtccccatcccaggaaatacacgctcgctttcggagaggggcacgttcctaccaggtcatttgtagggacgaaaaaacccagatgatctaccagcagcatcagtcctggctgcgtcctgtgctcagatcgaatagagtggagtactgttggtgtaattcggggcgagcacagtgccattcggtgccggtgaagagctgttcagaaccacggtgttttaacggaggtacttgtcaacaagcactttacttctcggatttcgtgtgtcaatgccccgagggatttgccgggaaatgctgtgagattgatacccgagctacctgctacgaagatcaaggaatctcgtaccgaggaacttggtcgaccgccgaatcgggggcagaatgtaccaactggaactcttcagcactcgcccaaaagccatacagcgggagacgacctgatgcgatacgtctcggccttggtaaccacaattactgcagaaacccagacagagattcaaaaccttggtgctacgtgttcaaggcaggaaagtattcgtcagaattttgttcgactccagcatgttccgagggaaactcagattgctactttggtaatggttcagcgtaccgtggaacccatagcctgactgaatccggggcaagctgcctcccgtggaactccatgatccttattggtaaggtgtatactgcacagaacccctccgcccaggcacttggactgggtaagcacaactattgtagaaatcctgatggcgacgcgaagccttggtgtcatgtgcttaagaatcgacggctgacgtgggagtactgtgatgtgccctcctgctccacttgcggactgaggcaatactcgcagccccagtttcggattaagggaggcctctttgctgatatcgcatcacacccttggcaagcagcaatcttcgcaaagcaccgcaggtcgcccggagagagattcctgtgtgggggcattctcatctcctcctgctggattttgtcagccgcacactgttttcaagaacggttcccgccacatcatcttactgtcatactgggtcgcacctacagagtggtcccgggggaggaggaacagaagttcgaggtcgaaaagtatattgtgcataaagagttcgatgacgatacctacgacaacgatattgcgctgctgcaacttaagtcggactcctcccgctgcgcccaagaatcctcagttgtgagaactgtgtgtctgcctcctgccgatctgcaactgcctgattggactgaatgtgagctgtcggggtatgggaagcatgaagccctcagcccattttactccgagaggcttaaagaagcccatgtgaggctctacccatcaagccggtgtacttctcaacatcttcttaacagaacggttaccgacaatatgctttgcgcgggtgatactcgctcgggagggccacaggccaatctccatgatgcctgccaaggagattcggggggaccccttgtgtgcctgaacgacggccggatgaccctcgtcggtatcatttcctggggtcttggatgtggacaaaaagatgtgcccggcgtttacaccaaggtgaccaattaccttgattggattagggataacatgcgccca

SEQ ID NO: 18340 - DNA, 1686 bp, Artificial Sequence
  Description of Artificial Sequence: Synthetic coding sequence
atggatgccatgaagagggggctgtgctgcgtgcttttgctgtgcggcgcagtgtttgtgagccccagtcaggagatccacgcccgctttcggcgcggcgcaaggagttaccaggtcatatgcagggacgagaagacccagatgatctaccagcagcaccaatcttggctacgccccgtccttcgttccaacagggtagagtattgctggtgtaattccggcagagcgcagtgtcactccgtacccgtcaagtcctgctcagaacctcgctgtttcaacggcggtacgtgccaacaggcgctttatttctccgattttgtatgccagtgcccagagggattcgcagggaaatgctgcgagattgatacaagagccacatgctatgaggatcagggcattagttacaggggcacatggagtaccgctgagtcaggagctgaatgcacaaactggaattcttccgcgttggctcaaaaaccttattcgggtcgtaggcccgatgccattcgcctgggtctaggtaatcataactattgccggaaccccgatagagactccaagccctggtgctacgttttcaaagccggtaaatactccagcgagttttgttcaacccctgcctgttccgagggcaatagcgattgttactttggcaacggctccgcctacagggggactcacagcctgaccgagtctggcgcctcctgccttccatggaatagtatgatcctcataggcaaagtctacaccgcgcagaatccttccgcccaggctctgggcctcgggaagcataattattgtagaaatcccgatggtgacgcaaaaccatggtgtcatgtgctgaagaataggcgcctgacatgggaatactgcgacgtcccctcttgctcaacctgcggactgcggcagtatagtcagccccaattccgcataaaaggcgggctgtttgctgacatcgcttcccacccttggcaagccgctatctttgcaaagcatagacgcagccccggggagcggtttctttgtggcggcattctgatttcttcttgttggatcctctctgccgcccactgcttccaggaacggtttccaccacatcaccttacagtgatcctaggtagaacgtaccgcgtggtaccaggcgaggaagagcaaaaattcgaggttgagaaatacatcgtccacaaggaatttgacgacgatacctatgacaatgatatcgctctgctgcagctgaagagcgactcaagccgctgtgcccaggaaagcagcgtggtgcgtacagtgtgcctccctccagctgacctgcaactgcctgattggacagaatgcgaactgtcgggatatgggaaacacgaagctttgtctcccttttactctgagaggctgaaagaagcccacgttagactgtacccttcaagccggtgcacatcccagcacctccttaacagaaccgtcacagacaacatgctgtgcgccggggacacgcgttcaggcggaccacaggccaatttgcatgatgcttgtcagggcgattctggaggcccgcttgtgtgccttaatgatggccgtatgactctggtgggaataatctcttggggactcggatgcgggcaaaaggacgttcccggggtgtataccaaagtgaccaattatttggattggattcgcgacaatatgcgcccg

SEQ ID NO: 18341 - DNA, 1686 bp, Artificial Sequence
  Description of Artificial Sequence: Synthetic coding sequence
atggatgcaatgaagcggggcctttgttgtgtgctccttctgtgtggggcagtctttgtctccccttcccaagaaatccatgcacgcttcagacgcggagcccggtcataccaagtgatttgccgcgacgaaaagacgcagatgatctatcagcaacaccaaagctggctgcgcccggtgctgagatcgaacagagtggaatactgctggtgcaactcgggtcgtgcgcagtgtcattccgtacccgtcaagtcatgctcggaacctcgctgctttaacggaggtacttgccagcaagctctctactttagcgactttgtgtgtcagtgtcccgagggcttcgccggtaaatgctgcgaaatagatacgcgagccacttgttacgaagatcaaggcatctcatacagaggaacgtggtcaacggcggaaagcggtgctgagtgtaccaactggaactcaagcgcacttgcacaaaagccctactccggtaggcgcccagacgccatcagactgggactgggaaaccacaactattgtcggaatcctgatcgtgactcgaagccgtggtgttacgtgttcaaggcaggcaagtacagctccgagttttgttccaccccagcatgttccgaaggtaattccgattgttacttcgggaacggcagcgcctaccgcggaacccattcacttactgaatccggtgcatcttgtctcccatggaactcgatgattttgataggaaaggtctacaccgcacaaaacccttcggcgcaggcactgggtctgggaaagcacaattactgccgtaatcctgatggcgatgcaaagccctggtgccatgttttgaagaatagacgtcttacctgggaatactgcgatgttccttcgtgctccacctgtggtctgagacagtactcgcagccccaatttcggattaagggaggtctgttcgctgatattgcctcccatccttggcaagcagcaatcttcgccaagcatagacgcagccctggcgaaagatttctctgtggagggattcttatttcttcctgttggatcctgagcgcagcacactgctttcaagaacgttttcccccacaccaccttacggtgattctgggtcgaacctacagggttgtgcctggcgaagaagaacaaaagttcgaggtcgaaaagtacattgtccataaagagttcgatgatgatacctatgacaatgacatagctctcctgcagctgaaatcggatagcagccgctgcgcgcaagaaagctcggttgtgcgcaccgtgtgtctgccgcctgcagatttgcaacttccggactggactgaatgtgagcttagcggatacggaaaacatgaggcgctttcccccttttacagcgaacgcctgaaagaggcgcacgtgcgtctgtatccttcttcgcgatgtacgtcacaacatctcctgaaccgaaccgtgaccgataacatgctgtgcgccggagacactcggtctggtgggcctcaggctaatcttcacgacgcgtgtcaaggagactcgggtggaccgctggtgtgcctcaatgatggacggatgactcttgtgggtatcatctcgtggggactgggctgcgggcagaaggatgtgcctggtgtgtacaccaaggtgactaattacctcgattggatccgcgacaacatgcgacct

SEQ ID NO: 18342 - DNA, 1686 bp, Artificial Sequence
  Description of Artificial Sequence: Synthetic coding sequence
atggatgccatgaagcgggggctgtgttgcgttctgctcctgtgcggagcagtatttgtctcaccgtcacaagaaatccatgcaagattccgcaggggtgcgcggtcataccaggtgatctgtcgagacgaaaagacccagatgatctatcagcagcaccagagctggctccgacctgtgctccggtctaaccgggtcgaatactgttggtgcaattcgggtagagcccagtgccacagcgtgccggtgaaatcatgctcggagccacgctgcttcaacggcggaacctgccaacaggccctttactttagcgacttcgtctgtcaatgccctgagggatttgctggcaagtgttgtgagatcgatacccgcgctacctgctacgaggaccagggcatttcctacaggggtacctggtccaccgcagaatcaggcgcggagtgtaccaactggaactcctcagcgttggctcagaagccgtacagcggacgacgtcctgatgccatcagacttggactggggaaccacaattactgtcgaaacccagacagagatagcaagccatggtgctacgtctttaaggctggaaagtattcatccgaattctgctctacccctgcgtgctcagaaggaaactcagactgctactttggtaacggttccgcctaccgcgggacccacagcctgactgaaagcggcgccagctgcctcccgtggaactcgatgatcctgattggtaaggtgtacaccgcgcagaacccatcagcacaagcattgggcctcggcaagcacaattactgccggaaccctgacggagacgcgaaaccatggtgccacgtgctcaaaaatcggcgcctgacttgggaatactgtgatgtgccgtcgtgttcgacctgcggtctgcgccagtactcacaacctcagttccgaatcaagggtggcctcttcgcagatatcgcatcgcacccatggcaggcagctattttcgctaagcatagacggtcgcccggtgagcggttcctctgcggaggaattctgatctcatcgtgttggatcttgagcgccgcccattgcttccaagagcgcttcccgcctcaccatctcacggtgatcctggggcggacctacagagtggtgcctggagaagaagaacaaaagtttgaagtcgagaagtacatcgttcacaaggagttcgatgacgatacttacgataacgacattgccctgctgcaactgaagtccgatagctcgcgctgcgcgcaggaatcatccgtggtgagaacggtctgcctcccgccggccgacctccagttgcccgactggaccgaatgtgagctcagcggctacggaaaacatgaagcgctctcccccttctactccgagcgcctcaaggaagcccacgtccggctgtacccatcatccaggtgcacttcacagcacctgttgaaccggactgtcactgacaacatgctgtgtgctggagacacccggtcgggaggaccgcaggcgaatctgcatgacgcttgccaaggcgattccggcggtcctctcgtctgcctgaatgatggccggatgactctggtgggtatcatctcttggggcctggggtgcggacaaaaagatgtgccgggagtgtacacgaaagtcactaattacctggactggatccgcgacaatatgcgcccc

SEQ ID NO: 18343 - DNA, 1686 bp, Artificial Sequence
  Description of Artificial Sequence: Synthetic coding sequence
atggatgctatgaaaagggggttgtgttgtgtcctcctgctgtgtggagcagtgtttgtgagcccatcacaggagattcatgctcggtttcgccgaggtgcccggtcttaccaggtgatttgcagagatgaaaagacccaaatgatttaccagcagcatcaatcctggcttcgtccggtgctccgcagcaatcgggtcgaatactgttggtgcaattccggtcgcgcgcagtgccacagcgtccctgttaagtcgtgttccgagccgcggtgcttcaatggaggcacctgtcagcaggcactttacttttcagacttcgtgtgccaatgtcccgaagggtttgccggcaagtgctgtgaaattgacactagggccacctgctacgaagatcagggtatctcgtatagggggacttggtcgaccgctgagagcggagccgaatgtacgaattggaacagcagcgcacttgcacaaaagccctactcgggtaggcggcctgatgccatccgacttgggctcggcaaccataactactgcaggaatcctgaccgggatagcaagccctggtgctacgtctttaaggcgggtaaatactcgtcggaattttgctcgactcctgcctgttccgaaggaaactcggattgttactttgggaacggttcagcatatcgcggtacccattccttgactgagtcaggagcatcgtgtctgccttggaactctatgatactgattgggaaggtgtacactgcacaaaatccaagcgcgcaagcactcggactggggaaacataactactgtcgcaacccagatggtgacgcgaaaccttggtgtcatgtgcttaagaaccgacgcctgacttgggaatactgtgacgttccatcctgtagcacttgcggacttcggcaatactcccagcctcaattccggattaagggcgggctgttcgcggatattgcgtcgcatccttggcaagccgcaatctttgcaaaacaccggcgttcccctggcgagcgatttctctgcggaggtattctgatttcatcctgctggatcctgtccgcagcacattgtttccaagaaaggtttcctccccatcatctgaccgtcatcctgggccgcacgtatcgcgtggttccaggggaggaagaacaaaagttcgaagtggagaaatacatcgtccacaaggaatttgatgatgatacctacgataacgacattgctctgctgcaacttaagtcggactcttcaagatgcgcacaagagagctcggttgtgaggactgtgtgtctcccacccgccgatctgcagctgcctgactggaccgaatgtgaacttagcggctacggcaagcatgaagccctttcccctttctactcggaaagacttaaggaagcgcacgtgaggctctacccttcttcccgctgtacttcccaacacctcctcaaccggacggtgaccgacaatatgctttgtgcaggagatacccgctccggtggacctcaggcgaatcttcatgatgcatgtcaaggtgactccggaggtccactggtctgtcttaatgacggtcgtatgactctggtcggaatcatctcatggggacttggatgtggacagaaggatgtgccaggagtctacaccaaagtgaccaactacctggattggatccgcgacaacatgcgccca

SEQ ID NO: 18344 - DNA, 1686 bp, Artificial Sequence
  Description of Artificial Sequence: Synthetic coding sequence
atggatgccatgaaaaggggactgtgctgcgttctgctcctatgtggagctgttttcgtgagtcccagccaggagatacacgcccgctttcgaagaggggcaaggtcttaccaggtgatctgcagagacgagaagacacaaatgatctatcagcagcaccagtcctggctgcggcccgttctacggagtaatcgtgtggaatattgctggtgcaattccgggagagcccaatgtcacagtgtccctgtgaagtcctgtagcgaaccacggtgtttcaatgggggcacctgtcagcaggccctctatttcagcgatttcgtctgtcagtgtcctgagggctttgccggcaagtgctgtgaaattgacacacgagctacttgttatgaagaccagggaatcagctaccgcggcacttggagtactgcagagtcaggagctgaatgcaccaattggaattccagcgctctagcccagaagccatactccgggcgccgtcctgacgctattaggctgggattggggaaccataactactgcagaaacccagatagagattctaaaccctggtgctacgtgttcaaggccgggaagtactcatccgagttctgcagtacaccagcttgcagcgaagggaactctgactgctactttgggaatggcagtgcatatcggggcactcactctttgactgagagtggcgcctcttgcttgccctggaactctatgatattaatagggaaagtctacaccgctcaaaacccttccgcccaggcactggggctgggcaaacataattactgccggaaccccgacggagacgcaaagccctggtgtcacgtcctgaagaaccgacggctcacatgggagtactgcgatgtgccctcttgtagtacctgcggtttacggcagtatagtcagccccagttcaggatcaaaggaggcttgttcgccgacatcgctagccacccttggcaggccgctatctttgcaaagcaccgacggagccccggggaacggttcttgtgtggcggcatactgattagttcctgctggatactgtcagcagcccactgtttccaggaacgattcccaccccatcacttaacagtcattctggggaggacttatagagtcgtcccaggagaagaggaacagaagttcgaggtcgaaaaatacatagtgcacaaggagttcgacgacgacacctatgataacgacatcgcattgctgcagctgaaatctgattcctccaggtgcgcccaagagtctagtgtcgtaagaacagtttgtctaccacccgccgacctccaactacccgattggactgaatgtgaattgagcggctatgggaaacacgaggccctgagccccttctactctgagcgtctgaaagaagctcacgttcggctgtacccctcatctaggtgcacttctcagcacctgctaaatcggactgtgactgacaacatgctgtgtgcaggggataccagaagtggcggcccgcaggccaacctgcacgacgcttgccagggcgattctggcggtcctctggtgtgcctgaatgacggtaggatgacacttgttggcataataagctggggcctgggctgcggacagaaagacgtcccaggagtgtatactaaagtgaccaattacctggactggataagggataacatgcgccct

SEQ ID NO: 18345 - DNA, 1686 bp, Artificial Sequence
  Description of Artificial Sequence: Synthetic coding sequence
atggatgcaatgaaacgaggtctttgttgcgtgcttctcctgtgcggagccgtattcgtctcccccagccaggagatccacgcgcgtttcagaagaggagcccgatcctaccaggtgatttgccgagacgagaaaacgcaaatgatttatcaacagcaccagtcttggctcaggcccgtgctacgctccaacagagtggaatattgctggtgcaactccggcagggcccagtgccacagtgtgcctgtgaaaagctgcagcgagcccagatgcttcaatggcggcacttgtcaacaggcattgtacttttccgacttcgtgtgtcagtgccccgagggctttgctggaaagtgctgcgagatcgataccagggccacatgctatgaagaccagggaatttcttataggggcacatggtcaacagcagaatcaggcgctgagtgtactaactggaattcatcagcacttgctcaaaagccctactccgggcgtagaccagatgcaataaggctcggtctcggcaatcacaattactgtcgaaacccagacagagattccaagccatggtgctacgtgttcaaggccggaaaatactcttccgagttttgtagtacccctgcatgcagtgagggtaatagcgactgctacttcggcaacggctccgcataccgtggcacacactcactcactgagtccggcgcctcatgcctaccatggaatagcatgattctgatcggtaaagtgtatactgcacagaaccccagcgcacaggccttggggctgggaaagcataactactgcaggaaccctgacggcgatgcaaagccctggtgccatgttctgaagaaccggaggttgacttgggagtactgcgatgtgcccagctgctcaacttgtgggctaagacagtacagccagccacagttccgtatcaagggagggctattcgctgatatcgcatcccacccttggcaggcagcgatctttgccaagcaccgcagatctccgggagagcgctttctgtgtggtggcatcctgatttcctcctgttggatattatctgcggctcactgttttcaggagagatttcccccacaccacctcacagtcatcttgggccggacgtaccgagtcgtccccggtgaagaggaacaaaagttcgaggtcgaaaagtacatcgtacataaggagtttgacgatgatacctatgataacgatatcgcactacttcaactcaaatctgattctagccggtgtgcacaggaaagctcagttgtcagaacagtttgcctccccccagcagatctccaactgcctgattggaccgaatgtgagttaagcggatacggcaagcacgaagctctctcccccttctacagcgaacgcttaaaagaggcccatgtgaggctctatccttcctctcggtgtacttcccagcacctgctgaatagaacagtgaccgacaatatgctttgcgcaggggatacccggtcgggaggtcctcaggctaacttgcacgatgcatgtcagggcgactccggaggaccgctcgtttgcctgaatgacggtaggatgacactggttggtatcatttcttggggtctcggctgcggccaaaaggatgtgcctggtgtttacacaaaagtgaccaactacctggactggatccgggataacatgcggccc

SEQ ID NO: 18346 - DNA, 1686 bp, Artificial Sequence
  Description of Artificial Sequence: Synthetic coding sequence
atggatgccatgaagagggggctgtgctgcgtgctcttgttgtgtggagccgtttttgtctccccgtcccaagagattcacgctcggttccgtcgcggcgctcgctcctaccaagtgatttgcagggacgagaaaactcagatgatctatcagcaacatcaatcttggttacggcctgttcttcgatcgaatcgtgtcgaatattgttggtgtaactcgggccgtgcacaatgccactctgtcccagttaagtcgtgctccgagccccgctgcttcaacggggggacctgccagcaagctctttacttttcggactttgtctgccagtgtccggagggtttcgcgggcaagtgctgcgagattgataccagggcaacctgctatgaagatcagggtatcagttataggggcacgtggagtactgcagaatcgggagctgaatgtacaaattggaactcatccgccttggcgcaaaagccttattcgggaagacggcccgacgctataaggctgggtcttggcaaccataactactgtaggaaccctgatagggatagcaaaccctggtgttatgtattcaaggcaggcaagtacagttctgagttctgtagcactccggcgtgcagcgagggcaacagtgactgctacttcggaaacggttcagcgtatcgcggtactcattcgttaacagagtcaggtgcttcgtgcttgccctggaattccatgatattaatcggcaaagtctacactgctcagaatccttccgctcaagcgttgggtttgggtaagcacaactactgtcgaaacccggacggcgatgcgaagccatggtgtcatgtactcaagaaccgcaggctcacctgggaatattgcgacgtgccatcatgcagcacatgcggcctccgtcagtattcacaaccgcagttccgcattaaaggagggctattcgctgatatcgcaagtcacccctggcaagcggccatcttcgcaaagcatcgtcgtagtcctggagagaggtttctgtgtggcggaatcttaatctcctcatgttggatcctgagtgctgctcactgttttcaagagaggtttcctcctcatcacttgaccgtcatcttgggccgcacatacagagtagttcctggagaggaagaacaaaagttcgaggtggaaaagtatattgtgcataaggagttcgatgacgatacttatgataacgatatcgcgttgttacagctgaaaagcgactcgtctaggtgtgcccaagaatccagcgttgttcgtacagtttgtctcccccctgctgatttacagctgccagactggacagagtgtgaactgagtgggtatggaaagcacgaggcgttgagcccgttctatagcgagcgtctaaaggaagcacacgttcggctctacccaagcagtcggtgtaccagtcagcaccttctcaaccgtactgtcactgacaacatgttgtgtgccggggacacccgaagtggcggtccacaagcgaacctccatgatgcctgccagggcgacagcggcggtcctttagtctgtttgaatgatggccgcatgactctggtaggaattattagctgggggttaggttgcggtcaaaaggatgtgccaggggtctataccaaggttacgaactaccttgactggattcgcgataacatgcgtccg

SEQ ID NO: 18347 - DNA, 1686 bp, Artificial Sequence
  Description of Artificial Sequence: Synthetic coding sequence
atggatgccatgaagcgggggctgtgctgtgtgctcctgctgtgcggggcagtgttcgtgtctccaagccaggagatccatgcacggtttcggagaggtgctagatcatatcaggtgatctgtcgggatgaaaaaacccaaatgatctaccaacagcaccagtcctggctgagaccagtcttgaggtccaatcgcgtggaatattgttggtgcaattctggccgcgcccagtgccattctgtgccagtcaagtcatgttccgagcctcgatgctttaatggtgggacgtgtcagcaggctctgtacttttctgacttcgtttgtcagtgccctgaggggtttgccgggaaatgctgcgaaatagataccagagccacgtgctatgaagatcagggcatttcctaccggggcacatggagcaccgccgaatccggggctgaatgtacaaactggaattcctctgccctggcacagaagccctattcaggacgcaggcctgatgcaatcagactcggactgggaaaccacaattattgcaggaatccagatagagactccaaaccttggtgctacgtcttcaaggctgggaaatacagctcagaattttgtagcaccccagcttgcagtgaagggaacagcgactgttatttcggcaatggtagcgcctatcgagggacgcacagcctgacggaatccggtgcctcctgtctgccctggaacagcatgatcctcattggcaaagtctacactgcccagaacccgagcgcccaagccttgggcttgggcaagcacaactattgtcgcaacccagacggcgatgccaaaccctggtgccacgtgttgaagaacagaaggctgacctgggaatactgcgatgtgccctcctgcagcacatgcggccttaggcagtatagccagccacaatttcgaatcaaggggggactcttcgccgacatcgccagccatccctggcaagccgccattttcgcgaaacaccgacgctctccaggagagagattcctttgtgggggaattctgatcagcagctgttggatcctgagtgcggcccactgtttccaggaaagattccctccacatcatctgacagttattttgggaagaacatacagagtggtgccgggcgaagaggagcagaagtttgaggtagaaaagtacattgtgcacaaagaattcgatgatgatacctacgacaacgacatagccctcttgcaattgaaaagtgatagctctaggtgtgcccaggagtctagcgtggttaggaccgtgtgccttcctcccgccgatttgcagctcccagactggaccgagtgtgagctttccggctatgggaagcatgaggccctgtcccctttttattccgaaaggcttaaggaagcccatgtgagactctacccctccagcaggtgtacaagtcagcacctgttgaaccggacggttacagataatatgctttgcgcgggtgacacccgctctggtgggccacaagcaaaccttcatgacgcgtgccagggcgatagcggtggtcctctggtctgtctcaacgacggcaggatgactctggtgggaatcataagttggggactggggtgcggccagaaggacgttcccggggtctacacaaaggttaccaattacctggactggattcgcgataacatgaggcct

SEQ ID NO: 18348 - DNA, 1686 bp, Artificial Sequence
  Description of Artificial Sequence: Synthetic coding sequence
atggatgcgatgaaaagaggtctttgctgtgtgcttctgctgtgtggtgctgtgttcgtctccccctctcaagaaatccacgcacggttccggcggggagcacgctcctaccaggtcatctgcagagacgaaaagacccagatgatctaccagcagcaccagtcgtggctgcggccggtgttgagatcgaaccgagtggaatactgctggtgcaattcaggacgggcacagtgccactccgtacccgttaagtcatgttctgaaccaaggtgctttaacggtggaacttgtcaacaagcactctatttctccgatttcgtctgccaatgcccagaaggattcgccggaaaatgttgtgaaatcgatactcgcgcgacctgctacgaagatcagggcatcagctaccggggaacctggtccactgcggaatcgggagccgagtgtacgaattggaactcgtcggctctcgcgcagaagccgtacagcggccgtagacccgacgcgatccgccttgggctgggcaatcataactactgcagaaatcccgatcgcgacagcaagccctggtgctacgtgttcaaggccggtaaatacagcagcgagttctgctccacccccgcctgcagcgaaggcaacagtgactgctactttggcaacgggtccgcttacaggggcactcattccctcaccgaaagcggagcatcgtgcctgccgtggaactcgatgatcctcattggaaaggtctacacggcacagaatccgagcgctcaagcgctcgggttggggaagcacaactactgccgcaatcccgatggagatgcaaaaccgtggtgccatgtcctgaagaaccggaggctgacttgggaatactgcgacgtcccgtcgtgctcgacttgcggattgagacaatactcgcaaccgcagttcaggatcaagggaggactctttgcagacattgcgtcacatccgtggcaggcggcaatcttcgccaagcaccgccgctcgccaggggagagatttttgtgcggcggtatcctcatctcaagctgttggatcctctcggccgcacactgtttccaggagcgctttccgcctcatcatctgacggtcatcctgggccggacctaccgcgtggtgccgggagaggaagagcagaagtttgaagtggaaaagtacattgtgcacaaggaattcgatgacgatacttacgacaacgatattgccctcctccagttgaaaagcgactcctcgcgatgcgctcaagaatcatctgtcgtgcgcactgtgtgcctcccgccagcagacttgcagctccccgattggaccgagtgcgagctgtctgggtacggaaaacacgaagcactgtcccccttctattccgaaagacttaaggaagctcacgtccgcctgtacccatcctcgcggtgcacctcgcagcacctgttgaatcgcactgtgactgacaacatgctgtgtgcaggggacactcggtcgggagggcctcaggcaaacctgcacgatgcctgtcaaggagatagcggtggcccgctggtgtgccttaacgacggacgcatgaccctcgtgggaattatcagctggggcctgggatgcggacagaaggacgtgccgggagtgtacactaaggtcaccaactacctggattggatccgggacaatatgcggccg

SEQ ID NO: 18349 - DNA, 1686 bp, Artificial Sequence
  Description of Artificial Sequence: Synthetic coding sequence
atggatgctatgaagcgcggactctgctgtgtgctgctgctgtgcggcgcggtgttcgtgtcaccgtcccaggaaatacacgcccgcttccgccgaggagctcggtcttaccaagtcatatgccgggatgaaaaaacgcagatgatctaccaacagcaccagtcatggctgcgcccggtgttgcgcagcaatagagtcgagtactgttggtgcaattccggccgcgctcagtgccactccgtgccagtcaagtcctgttcggaaccgcgctgcttcaatggaggaacttgccagcaggccctctactttagcgattttgtgtgccagtgcccggaagggttcgctggaaaatgttgcgaaatcgatacccgtgccacctgctacgaggaccaaggaatctcataccgcggaacctggagcaccgcagagtcaggcgcggagtgcactaactggaactcctcggccctggcacagaagccatactccggtaggcggccagatgcaatcaggctcggcctgggaaatcacaactattgtcgcaaccctgaccgcgactcgaaaccatggtgctacgttttcaaggcaggaaagtactcgtccgagttctgctccaccccagcttgctcagaaggcaatagcgattgttacttcggtaacggatcggcataccggggaacccattcgttgacggaatccggagccagctgtctcccctggaactcgatgatcctgatcggtaaagtctataccgcacaaaatccatccgcgcaggccctcggactcggcaaacataactactgccgcaatccggacggcgatgctaagccttggtgccacgtgctgaagaaccgccgcttgacgtgggagtactgcgatgtcccatcctgttcgacttgcggcctgcgccagtatagtcaacctcaattcaggatcaagggtggactgtttgcggacatcgcctcgcacccatggcaggcggccatcttcgcaaagcacaggcggtccccgggcgagcgatttttgtgcggaggaattttgatctcatcttgttggatcctgagcgccgctcactgttttcaagagcgcttccccccacatcacctgactgtgatcctcggtagaacctaccgcgtggtgccaggagaagaggaacaaaagttcgaagtggagaaatacatcgtccacaaagaattcgacgacgatacttacgataacgacatcgcgctgctccagctgaagtcagattcttcgagatgtgcacaggaatcctccgttgtccggactgtctgcctgcccccggcggacctccaacttcccgactggactgaatgcgagctgtcaggctacgggaagcatgaggcgctctccccattctactccgaacggctcaaggaggctcacgtgcggctctacccaagctccagatgcactagccagcacttgctcaatcgcactgtgaccgataacatgctgtgcgccggagatactcggtcgggaggtccgcaagcaaacctgcacgacgcctgccagggcgactccggcggacccctggtgtgcctcaacgacggacgcatgaccctcgtggggattatcagctggggcttgggttgcggtcagaaggacgtgccaggggtctacaccaaagtgaccaactacctcgactggatccgggataacatgcggccc

SEQ ID NO: 18350 - DNA, 1686 bp, Artificial Sequence
  Description of Artificial Sequence: Synthetic coding sequence
atggacgcaatgaagcgcggcctctgttgtgtgcttttgctttgcggcgccgtgttcgtctcaccgtcgcaagagattcacgcacgctttcgccgcggggcacgcagctaccaagtgatctgccgggacgaaaagactcagatgatctaccagcagcatcagtcgtggctgcggccggtgctgcgctctaaccgcgtggagtactgctggtgtaatagcggcagagcccaatgccatagcgttcctgtcaaatcatgctcggaaccccggtgctttaacggcgggacttgtcaacaggccctctacttctccgacttcgtgtgccaatgcccagaaggcttcgccggaaagtgttgcgaaatcgacacccgcgccacttgctacgaagatcagggcatctcctaccgcgggacttggtcgactgcggagtccggagctgagtgcaccaattggaactcaagcgcattggcacaaaagccctactcgggacgccggccagatgcgatccgcctcggactgggaaatcacaactactgcaggaacccggacagagactcaaaaccctggtgctacgtgttcaaggcaggtaaatacagctcggaattctgctcaaccccggcatgttcagaaggcaacagtgactgctacttcgggaatggatccgcataccgcggaacccactcgctcactgagtccggcgcttcctgcctgccatggaattcgatgatcctgatcggaaaggtgtacaccgcgcagaacccgtcagcgcaggccctgggactgggaaagcacaattactgtcggaatcccgacggcgatgcaaagccgtggtgtcacgtcctgaagaaccggcgactgacctgggaatactgtgatgtcccttcatgctcaacctgcgggcttcgccagtactcccagccgcagtttcggatcaaggggggactctttgccgatatagcatcccacccgtggcaggccgcaatcttcgccaagcacagacgctccccaggagaacggttcctctgcggaggtatcttgatcagctcgtgctggatactgagcgcggcgcactgttttcaggagcgattcccgccccatcacctgactgtgatcctgggccgcacctacagggtcgtcccgggcgaagaagagcaaaagttcgaggtcgagaagtacatcgtgcataaggagttcgatgacgatacctacgacaatgacatcgcattgttgcaactgaagtcagactcctcccggtgtgcccaggaatcgtcggtggtgagaaccgtgtgcctcccgccagccgacctgcagctgcctgattggaccgaatgcgaactcagcggctacggaaagcacgaggcgctgtcaccgttttactcggaacgcctgaaagaggcgcacgtgcgactttacccgtcgagccggtgcacctcccaacatctgctgaaccggaccgtgacggacaacatgctgtgtgctggagatactaggtctggggggccccaagccaacctccacgacgcgtgccagggagactccggaggaccactggtgtgcctcaacgatggacgcatgactctcgtgggaattatctcgtggggcctggggtgcggccaaaaggacgtgccgggggtgtacaccaaagtgacgaattacctggactggatccgcgataacatgcggcca

SEQ ID NO: 18351 - DNA, 1686 bp, Artificial Sequence
  Description of Artificial Sequence: Synthetic coding sequence
atggacgccatgaagcgaggcctttgttgtgtgctgctactgtgtggagcggtcttcgtatcacctagccaggagatccacgcccgatttcgccgaggtgctaggtcataccaggtgatctgcagagatgagaagacccaaatgatctatcaacagcaccagtcatggttacgcccagtccttagatccaaccgcgtagagtattgttggtgtaattcggggagggcgcagtgtcattcagtgcctgtgaaatcttgctctgagccgcgatgcttcaacggcggcacctgccagcaagctctgtacttctcggacttcgtctgtcagtgcccagaggggttcgctggaaagtgttgtgagatagacactcgagcaacttgctatgaggaccaggggatctcatatcgcggcacatggagtacagccgagtcaggggccgagtgtacaaactggaactcatctgctcttgctcaaaaaccttactcaggccgccgccccgatgccatccggctgggactgggcaaccataactactgtcgaaaccccgatagagatagtaagccctggtgctatgtgtttaaggccgggaagtattcttcggagttctgttctactccggcttgttccgaggggaacagcgactgctatttcggcaatgggagcgcttaccggggaacacatagcctcaccgagagcggagcctcatgcctaccatggaatagcatgatcctcattgggaaggtttacacagctcaaaatccttctgctcaggcgctcgggctcgggaaacacaattattgtagaaatccggacggcgacgcaaagccatggtgccacgtgctgaagaaccggagactgacctgggagtactgcgacgttcctagctgctccacgtgtggtctgcggcagtactcccagccacagttccggataaagggaggcctattcgccgatatagcctcccatccttggcaggctgccatcttcgctaagcaccggcgttcccctggtgaacgtttcttgtgtgggggaatactcataagttcctgctggattttgagcgccgcccactgttttcaggagcggttcccgcctcaccaccttacagtgatcttagggaggacctaccgagtcgtgcctggtgaggaggagcagaaatttgaggttgaaaaatatatcgtgcacaaagaatttgatgatgacacatacgacaatgacattgctctgttgcagctgaagagcgactccagtagatgcgcccaagagtccagcgttgtccgcaccgtctgtctgccacccgcagatctgcagttgcccgattggaccgaatgcgaactgtcgggctatggcaaacatgaggcactctctcccttctactccgaacgcttaaaggaggcgcacgtgcgcctataccccagcagcagatgcacctcccagcacttgcttaacaggacagtgaccgacaacatgctgtgtgctggcgatacaagatccgggggtccccaggccaaccttcacgacgcatgccagggtgattcaggtggaccactggtgtgtctgaatgacggacgaatgaccctggtgggcataatttcctggggactgggctgcggtcagaaagatgttcctggggtgtatactaaggtgaccaattacttggattggattcgcgacaacatgcggcca

SEQ ID NO: 18352 - DNA, 1686 bp, Artificial Sequence
  Description of Artificial Sequence: Synthetic coding sequence
atggacgcaatgaaacggggactttgttgtgtgctgctgctttgtggagccgtgttcgtctccccgagccaggagattcatgctagattcagaagaggtgcaagatcgtaccaggtgatttgtagagacgaaaagacccaaatgatttaccaacagcaccagtcctggctgaggcctgtgctcagatccaatcgcgtggaatactgttggtgtaactccggtcgcgcacaatgtcattccgtgcccgtcaagagctgtagcgaacctcggtgttttaacggtggaacttgtcagcaagcactttactttagcgatttcgtgtgccagtgtcctgaagggtttgccggtaagtgttgcgaaatagacactcgagcaacctgctacgaggatcagggaatctcataccgcggtacgtggagcactgcagaaagtggagcagaatgtactaactggaattcctccgcgcttgctcagaagccctactctggaaggaggccagatgcaatccgtcttgggctgggaaaccataactactgtcggaatccagatcgagactccaagccttggtgttatgtattcaaagctggtaaatactcctcggagttttgttcaactcctgcatgtagcgaaggtaattcagattgctactttggtaatgggtcagcatatagaggaacccattcccttaccgaatccggcgccagctgtctcccctggaacagcatgatccttattggtaaagtctacaccgcgcagaacccatcagcacaggccctgggactgggtaagcataactactgccggaatcctgacggggatgcaaagccatggtgtcatgtgctgaagaaccggcggctgacctgggaatactgtgacgtgccatcgtgttcgacttgtggattgaggcagtactcccaaccccaatttcgaataaagggtggcctttttgcagatattgcctcacacccctggcaagccgccatttttgccaagcataggagatccccgggagaaaggtttctgtgcggaggtattctgattagctcgtgttggattctgagcgcagcccattgctttcaggagcgcttcccaccgcaccatctcacggtgattcttgggagaacttatcgcgtggtccctggagaagaggaacaaaagttcgaagtggaaaagtacatagtccataaagaattcgacgacgatacttacgataatgacatcgcccttctgcagctgaagtcagactcctcgcgatgcgcgcaggaatcgagcgtcgtgagaaccgtgtgcctgcctccagcagatctgcaactgcctgattggactgagtgcgaattgtccgggtacgggaaacacgaggctcttagccctttttactcagaacggctcaaggaagcacatgtgcgactttaccccagctcaaggtgtacttcgcagcaccttctcaacagaaccgtgactgacaacatgctttgtgctggagataccagaagcggcggcccccaagcgaaccttcatgatgcatgccaaggggattccggaggacctcttgtgtgtctcaatgatgggcgaatgaccctggtagggataatctcatgggggctggggtgtggtcaaaaagatgtgcccggcgtctacactaaagttactaactacttggactggattagggataacatgcgccca

SEQ ID NO: 18353 - DNA, 1686 bp, Artificial Sequence
  Description of Artificial Sequence: Synthetic coding sequence
atggacgcgatgaagcgggggctgtgttgcgtgctgctcctgtgtggtgcggtgttcgtgtctccttcccaggagatacacgcaagattccgcaggggcgcccggagctatcaggtgatctgtcgcgatgaaaagacccagatgatctaccaacagcaccagagctggctgaggccagtcctgcgtagtaaccgcgtggaatactgttggtgcaattcgggacgggctcaatgtcattccgttccagtgaagagctgctccgaaccacgctgcttcaacggcggcacgtgccaacaggccctgtacttttcggattttgtctgccagtgcccagaggggttcgctggcaaatgctgcgagatcgatactcgggccacgtgctacgaagatcaggggatcagctacagaggcacttggtctactgcagagtctggagccgaatgcaccaactggaattcttcagccttggcccaaaagccgtactccggacggcggccggatgctatccggctgggtctgggtaatcacaactactgccggaatccggaccgcgacagtaaaccgtggtgctacgtctttaaagccggaaagtacagctccgaattctgcagcacccccgcatgctcggaaggaaattccgactgttatttcggaaacgggagcgcctacaggggaacgcactcgctcaccgaatcaggagcgagctgcctgccgtggaacagtatgatcctgatcggcaaagtatacactgcccagaatccaagcgcgcaagccctcggactgggcaagcacaactactgtagaaacccggatggtgatgcgaagccgtggtgccacgtgctcaaaaacagacgcttgacctgggaatactgcgacgtaccgtcctgttccacctgtggactgcggcaatactcgcaaccgcagttcagaatcaagggagggctgttcgccgatatcgctagccatccttggcaggcagccatcttcgcaaagcaccgccgctctcctggagaaagattcttgtgcggtggcatcctcattagttcatgctggatcctttcggcggcgcattgctttcaggagcggttcccacctcaccacctgaccgtgattctcggccgaacttaccgtgtcgtcccgggagaggaagagcagaaatttgaagtggaaaagtatatcgtccacaaggagttcgacgacgatacttacgataacgacattgctctcctgcaactgaagtccgactcctcgagatgcgctcaggagtcaagcgttgtgcgaactgtctgtttgccccctgccgacctccaacttcccgactggactgagtgcgagctgtcaggctacggaaagcatgaagcgttgtcgcctttctactcggagcggcttaaggaagcccatgtgaggctgtacccgtcctcacggtgtacctcgcagcatcttctgaatagaactgtgaccgacaatatgctgtgcgccggcgatactcgctcgggtggaccgcaggctaacctccatgacgcatgccagggagactccggcgggccactcgtgtgcttgaacgacggacgcatgaccctcgtgggcatcatttcttggggactgggatgcggacagaaagatgtgccgggagtctacacgaaggtgaccaactaccttgactggatcagggacaacatgcgccca

SEQ ID NO: 18354 - DNA, 1686 bp, Artificial Sequence
  Description of Artificial Sequence: Synthetic coding sequence
atggatgccatgaagagagggctctgttgtgtgcttcttctttgtggagcagtgtttgtgagcccaagccaagagattcatgcaaggtttagaaggggagcgaggtcataccaagtcatttgcagagacgaaaaaacccagatgatataccaacagcatcaatcctggctcagacccgtgcttagaagcaaccgcgtggaatactgttggtgtaattcggggcgggcacaatgtcattccgtccccgtgaagtcatgtagcgaacctcggtgtttcaatggcggcacctgccagcaagccctgtacttttcggatttcgtgtgtcaatgtcccgagggctttgcaggaaaatgttgcgaaattgatactcgcgcaacttgttacgaagatcaggggatatcttacagaggaacttggtcaactgctgagagcggtgcagaatgcactaattggaactccagcgcacttgcacaaaagccatactccggacgtagaccagatgcaatcaggcttggacttggtaaccacaattactgcagaaacccagacagagattcaaaaccttggtgttacgtgtttaaggcaggaaagtatagctcagagttttgctccacccctgcctgctccgaaggcaacagcgattgctactttggtaatgggagcgcgtacagaggtactcacagcctgactgaatccggagccagctgtctgccttggaactcgatgattctgatcggtaaggtgtacaccgcgcagaatccttcggcgcaggcgcttgggctcggtaagcacaactactgtagaaatcctgatggtgacgccaaaccttggtgccatgtgttgaagaaccgccggctgacttgggaatactgtgacgtccctagctgctccacttgtggcctgagacaatattctcagccacagtttcgaatcaagggtggactgtttgcggatattgcaagccatccctggcaagcggctattttcgcgaagcatcgacgttcacctggggaaagattcctgtgtggtggtattcttatatcgtcatgttggatactttccgccgcacactgcttccaagagcgttttccaccacatcacctgaccgtcattctgggacggacttaccgagtcgtgcccggagaggaagaacagaagtttgaggtggaaaagtacatcgtccacaaggaatttgatgatgacacttacgataatgacattgcgcttctgcagctcaaatccgattcatcaagatgcgctcaggagagctcggtggtcaggactgtctgcctccctcccgcagaccttcagctccctgactggacggaatgtgaattgagcggctacggcaagcacgaggcattgtcccctttttactccgagagacttaaagaagcgcatgtgaggctgtacccttcgtcgcgttgtacttcccaacatctgctgaatcgaaccgtgacggacaacatgctttgtgcaggtgatactcgctccggggggccgcaggcaaacctccacgacgcctgtcaaggagatagcgggggacctctggtgtgtctgaatgatggtcggatgactctcgtgggtatcatttcttggggccttggttgtggacagaaagatgtgcctggagtctacactaaggtgactaactacctggactggattagggacaacatgcggccc

SEQ ID NO: 18355 - DNA, 1686 bp, Artificial Sequence
  Description of Artificial Sequence: Synthetic coding sequence
atggatgcaatgaaacgcggcctgtgttgcgtcttgctcctctgtggggccgtcttcgtgtcgccatcccaagagattcatgcacggttccgacgcggggcccggtcataccaagtcatttgtcgcgatgaaaagactcagatgatatatcagcagcatcaatcctggctgcggccagtgctgcggtcaaatagagttgaatactgctggtgcaactcaggccgcgctcagtgccacagcgtcccagtgaagagctgctcagaacctagatgctttaacggaggaacctgccagcaggcgctctacttctcggactttgtctgtcaatgtccagaaggatttgcaggaaagtgctgcgaaatcgacactcgagctacctgctacgaggaccagggaatcagctacagaggtacctggagcactgcggagtcaggtgcagaatgcactaattggaattcctccgcactggctcaaaaaccatactccggccggcgtcctgacgccattcgcctggggctcggcaaccataactactgtcggaatccggacagagatagcaagccgtggtgctacgtgttcaaagctggaaagtatagctccgagttctgctccaccccagcgtgctcggaagggaactcagactgctactttgggaatggctccgcctaccgaggaactcattccctcaccgaatcaggcgcatcatgcttgccttggaactctatgatcctgatcggcaaagtgtacactgcccaaaacccgtccgcgcaggcacttggactcggtaagcataattactgcaggaacccggacggtgacgccaaaccatggtgtcacgtgctcaagaacaggaggctcacttgggagtactgcgacgtgcccagctgctccacgtgtggtctgcgacagtacagccagcctcagttcagaatcaagggcggcctctttgcggatatcgcgagccacccctggcaagccgcaatcttcgcgaagcatcgccgctccccgggggaacgattcctgtgtggagggatcctgatctcgagctgctggatcttgtccgcagcccactgcttccaggaacggttcccgccccatcacctgaccgttatcctgggtcgcacttaccgcgtggtgccgggtgaggaggaacagaagttcgaggtcgagaaatacattgtgcacaaggagttcgatgacgacacctacgacaatgacatcgccctgctgcagctgaagagcgacagctcacggtgcgcacaggagagctcagtggtgcgcactgtctgcttgcccccggccgacctgcaattgccggactggactgagtgcgaattgtcaggatacggaaagcacgaagctctctcaccattctactccgaacgtctcaaggaagcccacgttcgcctgtacccgagcagcaggtgcacttctcagcaccttttgaacaggaccgtgaccgataacatgctgtgtgcaggagatactcgctcaggcggtcctcaagctaacctgcacgatgcttgtcagggtgattcgggaggaccgcttgtctgtcttaacgatggaaggatgactctcgtgggcatcatctcatggggacttggatgcgggcaaaaagatgtcccgggagtgtatacgaaggtcactaactacctggactggatccgcgacaacatgcgacct

SEQ ID NO: 18356 - DNA, 1686 bp, Artificial Sequence
  Description of Artificial Sequence: Synthetic coding sequence
atggatgccatgaagagagggttatgctgcgtccttttactctgcggagcagtctttgtaagtccatctcaggaaattcacgcccggtttaggcggggagcaaggtcctatcaggttatatgcagagatgaaaaaactcagatgatataccagcaacatcagtcatggctaaggcccgtcctccgctctaatagggtagaatactgttggtgtaacagtggaagggcccagtgtcactctgtccctgttaaaagttgttcagaaccccgctgcttcaatggaggaacatgtcagcaggccctctattttagtgattttgtctgtcagtgtcccgaagggtttgcaggaaaatgctgtgagatagatactcgcgctacttgctacgaagatcaggggatatcttatagaggaacatggtccacagcagaatccggagccgaatgcactaattggaattcgtctgctcttgcccagaaaccttattccggacggaggcctgatgctattcgccttggactcgggaatcacaattattgcagaaacccagatagagattcaaagccctggtgctacgtttttaaagcagggaaatattcttccgaattctgttctacacccgcatgctccgaaggaaactccgattgctattttggaaacggatctgcgtatagaggaactcattccctaacagaaagtggggcttcgtgcctgccttggaattctatgatccttatcggaaaagtgtatacagcacagaatccatccgcacaggccctcgggctggggaaacacaattattgccggaatccggatggggatgcaaaaccttggtgccacgttttaaaaaatcgacgcttaacatgggagtattgtgatgtgccctcttgctcgacttgcgggctcaggcagtattcacagccacagttcagaataaaagggggactttttgccgacatagcttcgcacccctggcaggcagctatattcgcaaaacacaggcggtcaccaggagaacggttcctatgtggaggaatcctgatctcctcatgttggatcctttctgcagctcactgttttcaggaacgctttcctccccatcacctcacagtgatattaggacgcacatatagggtcgtgcctggagaggaggagcagaagtttgaagtcgaaaagtatattgtacacaaagaatttgatgatgatacatatgataacgatattgccctgcttcagctcaaatcagattcgtcccgatgtgcgcaggaatcttctgtggtccggactgtgtgcttaccccccgcagatcttcagctccccgattggactgaatgtgaactctcaggatacggaaagcatgaagcactgtctcctttctattctgaacgacttaaagaagcccatgtcagactctatccctccagtaggtgcacttcacagcacttgcttaataggactgttacagataacatgctctgtgctggggatactcgatccggagggccacaggccaacttacacgatgcatgccagggggattccggaggacccctcgtgtgcctaaatgatgggcgcatgacattagtgggaatcatatcgtggggactagggtgtgggcagaaggatgtacccggagtctatacaaaagtgacaaattatctcgattggatcagagataacatgaggccc

SEQ ID NO: 18357 - DNA, 1686 bp, Artificial Sequence
  Description of Artificial Sequence: Synthetic coding sequence
atggatgcaatgaaaagagggttgtgctgtgtgcttctgctctgcggggcagtgtttgtgtcaccaagccaggaaatacacgcccggttcagacgcggagcaaggtcgtatcaggtgatctgtcgggatgaaaagactcagatgatttaccaacaacatcaatcctggttgcgtcccgtgctccgctcgaaccgtgtggaatactgttggtgtaactcaggacgcgcacaatgtcattcggtgcctgtgaaatcatgttccgaaccgcgttgctttaatggcgggacttgccagcaggctctctacttttcggatttcgtgtgccaatgcccagagggattcgcaggcaagtgttgtgaaatagacaccagagcaacctgttatgaggaccaaggaatttcataccgtggtacctggagcaccgctgagtcgggggcagagtgtactaattggaactcgtcggcactggcgcaaaagccctacagcgggagacgcccggatgcgatacgacttggccttggcaaccacaattactgccgaaaccccgaccgggattccaagccatggtgttacgtctttaaagcaggtaaatacagctccgaattttgttccactccggcatgctccgaaggaaattcggattgctacttcgggaacgggtcagcctaccgcggcacccattccctgactgagtctggtgcttcttgtctgccgtggaattcgatgattcttataggtaaggtgtacaccgcccagaacccttcggcgcaggcactggggctcggaaaacataactactgtcgcaaccctgacggagatgcaaaaccatggtgccatgtgcttaagaatcgtcggcttacctgggaatactgtgacgtcccgtcctgttccacttgcggacttcgccaatacagccagccacaatttaggattaaaggaggactctttgccgatatagcaagccatccctggcaggcagctattttcgcaaagcatcgacggtcccctggagaacgatttctttgtgggggaattctcatctcgtcctgttggatcctgtcggctgcacattgctttcaggaaagatttcccccacaccacttgaccgtgatcttgggccgcacgtaccgggtagtccctggcgaggaagaacagaagttcgaggtggagaagtacatagttcacaaggaatttgacgatgacacctacgataacgacattgcacttctgcaactgaagagcgattcatcccgttgcgctcaagagagctcagttgttcggaccgtgtgtctccctccagcagatttgcaactcccagactggactgaatgtgaacttagcggttacggaaagcacgaagccttgtcgccattctattcggagcggcttaaggaggcacatgtcagattgtacccgagcagtcggtgtaccagccagcacttgctgaacaggaccgtgaccgataacatgctgtgcgcaggtgatactcgatcgggtggacctcaagcgaatcttcatgacgcctgtcaaggtgattctggtggtcccctggtctgtctgaatgacgggcgtatgactctggtgggcatcatttcgtggggacttggttgtggccaaaaagatgtcccgggtgtgtacaccaaggtcactaactacctggattggattagggacaacatgcgccct

SEQ ID NO: 18358 - DNA, 1686 bp, Artificial Sequence
  Description of Artificial Sequence: Synthetic coding sequence
atggatgcgatgaaaagggggttatgctgtgtgctgctcttgtgtggagcagtatttgttagcccatcgcaggagattcacgctcggttccggaggggcgcgagatcttatcaggtcatttgtcgagatgagaaaacacaaatgatctaccagcagcatcagagctggctgagacccgttctgcgctctaatagggtggagtactgctggtgtaattccggacgcgcccagtgtcacagcgtgcccgtgaaaagctgttcggagccaaggtgctttaatggagggacatgccagcaggcactgtacttctcagacttcgtgtgccaatgtcctgaggggttcgctggcaagtgctgcgaaatcgacacacgggctacatgttatgaggatcaggggatcagttatagagggacctggagtacggcggaatccggcgctgaatgtactaattggaactcaagtgccttggcacagaagccttactctggccggcgcccggatgcaataagactggggctaggaaatcataattactgtagaaatcccgacagagatagcaaaccctggtgttatgtgtttaaagccggtaagtactcatccgagttctgctccactcccgcatgtagcgaaggtaattccgactgctacttcggcaatggatccgcgtacagaggcactcactctctgactgagagtggcgcgagctgcctgccatggaacagtatgattttgattggaaaggtgtacacggcacagaatccaagtgcccaggcactgggactcggtaaacacaattactgtagaaatccggacggcgatgccaagccttggtgtcatgtattgaaaaatcggcgccttacctgggaatattgtgatgtccctagctgctcgacctgcggactcagacagtattctcagccccagttccgtattaagggagggctgttcgctgacatcgcttcccatccatggcaggctgcaattttcgctaagcataggcgttcccctggtgaacggttcctttgtggggggattttgatcagttcctgctggattctgagtgctgcccactgctttcaggaacgctttcctccacatcatctgacagtcattctgggaagaacgtaccgcgtagtgcctggcgaggaggagcagaaatttgaagtggaaaaatatatagtgcacaaggaattcgatgacgacacttatgacaacgacatcgcattgcttcaactaaagtccgactcatccaggtgtgctcaggagagtagcgtggtgcgcacagtgtgtcttccacctgccgacttacagctacccgactggacagaatgtgaattatctgggtacggaaaacatgaagctctgagtccattctattccgagcggctgaaggaagcccatgtcagactgtatcccagttcgagatgcactagtcagcatctcctaaaccgcaccgtgacagataacatgctgtgcgccggggatactcggtccggtggaccacaagcgaacctgcatgatgcttgccagggagacagtggcgggccactcgtctgtctgaatgatgggaggatgaccctggtgggtataatctcgtggggactcgggtgtggacagaaggacgtgcccggtgtctacaccaaggtgacgaattaccttgattggatcagggataacatgaggcct

SEQ ID NO: 18359 - DNA, 1080 bp, Artificial Sequence
  Description of Artificial Sequence: Synthetic coding sequence
atggctggccacctggcctctgacttcgcattctcacctccacctgggggcgggggcgacggtccaggcgggccagagcccggctgggtggatcccaggacttggctctctttccagggcccaccaggtggacccgggataggtcccggagtgggaccaggcagcgaggtgtgggggatcccaccatgccctccaccttatgagttctgcggtggcatggcctattgtggacctcaagttggcgtgggtctggttccccagggcggcctcgagactagtcagcccgagggcgaagcaggcgtcggggtagaaagcaacagtgacggcgccagcccagagccttgcacagtaacccccggtgctgtgaagctggaaaaagaaaagttggagcagaaccccgaggagtcccaggatataaaagcattacaaaaggagctggaacagttcgccaaactgctgaagcagaaacgcatcacacttggatacacccaggctgatgtcggcttgaccctgggagtgctgtttgggaaagtcttttcccagacaactatttgccgttttgaggcactgcagttaagctttaagaacatgtgtaaactgcgacctttactgcagaagtgggtcgaagaggccgacaataatgaaaatttacaagagatctgcaaggccgagaccctggtgcaggcccggaaacgcaaaagaacatctattgagaaccgggtgagaggcaacctggaaaatctgtttctgcagtgtcccaaacccactctgcagcagatttcccacattgcacaacagttggggctggagaaggatgtggtgagagtttggttttgcaaccggaggcagaaaggcaaacgctccagttcagattacgctcaacgagaagacttcgaagccgccggctctcctttttctggtggccctgtgagttttcctctcgcccctgggccacacttcgggactcccggctatggctctccccatttcaccgccctttatagcagcgtgccattccctgagggtgaagcattccctccagtgtccgtaacaacactgggcagtccaatgcacagcaac

SEQ ID NO: 18360 - DNA, 1080 bp, Artificial Sequence
  Description of Artificial Sequence: Synthetic coding sequence
atggccggacacctggcttccgatttcgcattcagtccccctcctgggggtggaggggacggccccggcggcccagagcccgggtgggttgacccccggacatggttgtcgtttcagggccccccagggggacctggcataggacctggggtgggtccaggctccgaggtctggggtattccaccatgccccccaccatacgagttctgcgggggtatggcatactgcgggccacaagtgggcgtcggcctggtacctcagggtgggttggagacatcccaaccagagggtgaagccggtgtgggggtcgagagcaatagcgacggagcctcccctgagccctgcaccgtgacccccggcgcagtgaaactagagaaagaaaaactcgagcaaaatcccgaggaaagccaggatatcaaagcattgcagaaggagctggaacagtttgcaaaactgcttaaacagaagcggattactctcgggtacacccaagctgatgtgggattgacactgggcgtgctgttcggaaaggtgtttagtcagaccactatatgtcggtttgaggccttgcaactgagttttaagaatatgtgcaagttaaggccattactgcagaagtgggtggaggaggcagacaacaatgaaaatcttcaggagatctgcaaagcagaaaccctcgtgcaagcccgcaagcgcaaaaggacttcaatcgagaaccgagtcagaggaaacttggagaacctttttttgcagtgcccaaaacccactcttcagcagataagtcacattgcccagcagctgggactcgaaaaggacgtggtgcgagtttggttttgcaaccggcggcagaagggaaagaggagcagtagcgactacgctcaaagagaggactttgaggcagccgggagtccttttagtggtggccctgtgagcttcccacttgcccctggacctcattttggcacacccggctatgggagtcctcactttactgctctctattctagcgtgccatttcccgagggggaggctttccccccagtgagcgtcacgacactgggaagcccgatgcatagtaat

SEQ ID NO: 18361 - DNA, 1080 bp, Artificial Sequence
  Description of Artificial Sequence: Synthetic coding sequence
atggcgggacacctcgcttctgatttcgcatttagccctccaccaggcggtgggggagacgggcctggaggccccgagcccgggtgggttgatccccgaacttggctttcgtttcaaggacctcccggagggcctggtatcggaccaggcgtgggccctgggtcagaagtatggggaataccgccatgtcctcctccatacgagttttgcgggggcatggcctattgtggaccgcaagtgggggtagggctcgtgccccagggagggcttgaaactagtcagcccgaaggcgaggcaggggtcggcgtcgagagtaactccgacggcgccagtccagaaccttgcaccgtcactccaggcgcggtcaaattggaaaaagagaaactcgagcagaatcccgaggagagccaggatatcaaggcgctccagaaagaactcgaacagtttgccaagctgttaaagcagaagagaatcacactcggctatacccaggcagacgttggcctgactctaggggtgctgtttggcaaagtgttctcccagacaaccatttgccggtttgaagccttacagctgtcgttcaagaatatgtgcaagcttagacctctcctccaaaagtgggttgaggaggctgacaacaacgagaacctgcaagaaatctgtaaagccgaaacattagtgcaggccaggaaaagaaagagaacttccattgagaatagagtgcggggtaacctggaaaacctgttccttcagtgtcctaagcctaccttacagcagataagccacatcgcccagcagttgggactggaaaaagacgtcgttagggtctggttctgcaataggcgacagaaggggaagcgctccagttccgactacgcacagcgagaggattttgaggcggcaggctcccctttcagtggcggaccagtgagctttcctctcgcccccggtccccattttggtacccctggttacggctcgccacactttaccgcactctatagcagtgttccttttcccgaaggtgaagcctttcccccagtctccgtaaccacactcggaagtccaatgcactccaac

SEQ ID NO: 18362 - DNA, 1080 bp, Artificial Sequence
  Description of Artificial Sequence: Synthetic coding sequence
atggctgggcacctagctagtgactttgcgttcagccctccaccagggggggggggggatggtcccgggggccccgagcctggatgggtggatccgagaacatggttgtctttccagggacccccagggggcccagggataggcccaggcgtggggcccggaagtgaagtgtggggcattcccccctgccccccgccctacgaattttgcggcggaatggcttactgtggcccacaagttggcgtggggctcgtgcctcagggggggcttgaaacatctcagcctgagggagaggctggagtgggagtggagtccaattcagatggcgctagccccgagccatgtaccgtgacccccggagctgtgaagttagaaaaagaaaagctggagcagaaccctgaagaaagtcaggatatcaaagcgttacagaaggagcttgagcagttcgccaagctcctgaaacagaagcgaattactctgggctacacacaggcagacgtgggcctcaccctcggggtgctgtttgggaaagtgttttcgcaaactacaatctgcagattcgaggccctgcagttgtccttcaagaacatgtgtaaactgaggcctttgttgcaaaaatgggtggaggaagccgacaacaatgagaatctgcaggagatctgtaaggctgagacgctcgttcaggccagaaaaaggaagcgcacttccatcgaaaaccgcgtccgagggaatttagagaatttgttccttcagtgtccaaaacccactcttcagcagatttcacatatcgcccagcagctgggcttggaaaaagatgtagtcagagtgtggttctgcaatcgcaggcagaagggcaaacgaagcagctccgattacgcacaacgcgaagatttcgaggccgcaggttctcctttttcgggcggccctgtcagcttccctctcgcccctgggccccattttggaacccccggctatgggtcccctcacttcaccgcactatattcaagcgtgcccttccccgagggcgaggcatttccgcccgtctctgtcactactctcgggagcccaatgcactcaaat

SEQ ID NO: 18363 - DNA, 1080 bp, Artificial Sequence
  Description of Artificial Sequence: Synthetic coding sequence
atggccggacacctcgcctctgatttcgccttctcgcccccgccaggcgggggaggagatggccccggaggtccggaaccaggctgggtggacccacgaacctggctgagcttccaaggtccgccgggaggcccgggaatcggaccaggagttggtccgggatcggaagtgtggggcatcccaccgtgcccaccgccgtacgagttctgcggagggatggcttactgtggaccccaggtgggtgtgggactggtgcctcaaggcggactggagactagccagccggaaggagaggccggagtgggcgtcgaaagcaactcagacggagcatcgcctgaaccatgtaccgtgactccgggagccgtcaaactggagaaggagaaattggagcaaaaccctgaggagtcgcaggatatcaaggcgcttcaaaaggagctggagcagttcgcaaaacttctgaagcagaagcgcatcactctgggctacacccaagcagacgtgggcctgactctcggcgtgctctttgggaaagtctttagccagactaccatttgcagatttgaagctctccaactctcatttaaaaacatgtgcaaactgcggccgctgctccagaagtgggtggaagaggcggacaacaacgagaatctccaggaaatttgcaaggccgaaaccctggtgcaagcacggaagagaaagcggaccagcatcgagaatcgcgtgaggggaaacttggaaaatctgttccttcagtgtccgaagcctacgctgcaacagatcagccatatcgcgcagcagctgggcctggaaaaggacgtcgttagggtctggttctgcaatcgccggcagaagggaaagagatcctcctcagactatgcccagcgcgaagatttcgaagccgctggatccccgttctcgggtgggcctgtctcgttcccattggcgcctggtccgcactttgggacccccgggtacgggtcgcctcatttcacggctctgtactcctccgtgcctttccccgaaggagaagcgttcccgccagtctccgtgactaccctcggatcaccaatgcactcaaac

SEQ ID NO: 18364 - DNA, 1080 bp, Artificial Sequence
  Description of Artificial Sequence: Synthetic coding sequence
atggcaggccacctcgcgagcgacttcgctttcagcccgcctcccggtggtggcggcgacggcccgggcgggccggagcctggttgggttgacccccggacttggctttcgttccagggccctccgggtggcccaggtattggccctggggtcggacctggttccgaggtctggggtattcccccttgccctccaccctatgaattctgcggtggtatggcctactgcggtcctcaagtcggcgtcggcttggtcccacagggtgggctggagacctcccaacccgagggtgaggccggtgtgggtgtcgaatccaactccgatggagcttcacccgaaccttgtactgtcacccccggcgccgtcaagctggagaaggagaagctcgaacagaatcccgaagagtcccaggacatcaaggcgctgcagaaagagcttgagcagttcgccaagctgctcaagcagaagcgtatcacactgggatacacccaggccgacgtcggactgaccttgggagtgctctttggcaaggtcttctctcaaaccacaatctgcagattcgaagccttgcagctctcattcaagaacatgtgcaagctccgccccttgcttcagaagtgggtggaggaggccgacaacaacgagaatttacaagagatctgtaaggcggaaaccttggttcaggcccgcaaaagaaagcgaacatccatcgagaacagagtgcgcggcaacctggagaacctgttcttacagtgccctaagcccaccctgcagcagatctcgcatatcgcgcagcagttgggactggaaaaggatgtcgtgcgtgtgtggttctgtaaccggcgtcagaagggtaaacgctcgtcttctgattacgctcagcgagaggatttcgaggctgcgggctcgcccttttccggcggtccagtctctttccccctggcgcccggcccgcacttcggcaccccgggatatggcagtcctcatttcacagccctctactcgagcgtcccgttcccggagggcgaggccttcccccccgtttccgtcacaactctcggttcccctatgcattcgaac

SEQ ID NO: 18365 - DNA, 1080 bp, Artificial Sequence
  Description of Artificial Sequence: Synthetic coding sequence
atggcagggcacctggcatcggacttcgcgtttagccctccgccgggaggcggcggagatgggccgggcggccctgaaccgggttgggtcgatccacggacttggctttcttttcaggggccgcctggcggaccgggaatcggaccaggggtggggccgggatccgaggtgtggggaatccccccgtgcccacccccgtacgaattctgcgggggaatggcctactgcgggccccaggtgggagtgggcttggtcccgcaaggaggcctggaaacttcccagccggagggcgaggctggcgtcggagtggaaagcaactcagatggcgcttcaccagagccctgcactgtgactcctggagccgtgaagctggaaaaggaaaagctcgagcagaatccggaagaaagccaggatatcaaggcactgcagaaggagttggagcagttcgccaaactgctgaagcagaaaagaatcactctgggatacactcaggcggacgtgggactgacccttggagtgctgtttggaaaggtgttctcgcaaaccactatctgcagattcgaggccctccagctgtcgttcaaaaacatgtgtaagctgcggccgctcctgcaaaagtgggtggaagaagcggataacaacgaaaatctccaggaaatttgtaaggccgaaactcttgtgcaggcacgcaagagaaaacggacgagcatcgaaaaccgggtgcgcggcaacctcgagaacctgttcctccaatgcccgaagccgacgctccagcaaattagccacatcgcgcaacagctgggccttgaaaaggatgtcgtccgtgtgtggttctgtaataggagacagaagggcaagaggtcatcctccgattacgcccagcgcgaagattttgaggcggccgggtcgcctttctctggagggccggtgtcttttccgctcgctccgggaccacatttcggaactccaggatacggatcacctcacttcaccgccctgtattcctccgtgccgttccccgaaggagaggccttcccgccagtgtcggtcacgactctgggttccccgatgcattccaat

SEQ ID NO: 18366 - DNA, 1080 bp, Artificial Sequence
  Description of Artificial Sequence: Synthetic coding sequence
atggctgggcatctcgcgagcgatttcgcattctccccgccaccgggtggagggggagatggccctggaggaccagaaccaggatgggtggatccgcgcacttggctctctttccagggaccgccgggagggccggggatcggaccaggagtgggaccgggatcagaggtatggggcatcccgccatgcccgccaccgtacgagttctgtggaggaatggcttactgcggacctcaggtgggagtcggtctggtgccccagggagggctggagacgtcccagccagaaggagaggcgggagtgggagtggagagcaactcggacggagcaagcccggagccctgcaccgtgactccgggagccgttaagctcgaaaaagagaagttggagcaaaaccctgaggaatcacaggacatcaaggccctgcagaaggagctggaacagttcgcaaagctgctgaaacaaaagaggatcacccttggatacacccaggcagatgtcggactgactctgggcgtgctgtttgggaaggtgttctcccaaactactatctgcagattcgaggcgctccaactctcgttcaagaacatgtgcaagctcagaccactgctccagaagtgggtggaagaagccgacaacaatgaaaaccttcaagaaatctgcaaggctgaaaccctggtccaagcaagaaagcggaaacgcacttcgatcgaaaaccgcgtgagaggaaacctcgaaaatctgttcctgcagtgcccaaagcctaccctccagcagattagccacatcgcccaacaactgggtctggagaaggacgtcgtgagggtgtggttttgcaatagacgccagaagggcaagcgttcctcgagcgactacgcccagcgcgaggatttcgaagccgcgggatccccattctcaggcgggccggtgtcattcccccttgccccaggcccgcacttcggaactccgggttatggctcccctcacttcaccgctctgtactcgtcggtgccattcccggagggagaagcattcccacctgtgagcgtgactaccctggggtcacctatgcactccaac

SEQ ID NO: 18367 - DNA, 1080 bp, Artificial Sequence
  Description of Artificial Sequence: Synthetic coding sequence
atggctggccacctggcctctgacttcgctttttctcccccgccagggggtggcggggacgggcccggaggtcccgagccaggctgggtcgaccctcgcacctggttaagtttccaaggcccaccaggtggccctggtatcggccctggtgtggggcctggctccgaggtgtgggggatccccccctgcccgcctccctatgagttttgtggaggtatggcatattgtgggccccaggtgggggttgggctggttccccagggagggctcgaaacctctcagcccgagggagaggcaggcgtgggggtcgagtccaattccgacggggcctcacccgaaccatgtacagttacccccggcgccgtgaaactggagaaagaaaaactcgaacagaaccccgaagaaagtcaggacattaaggccctgcaaaaagagctggaacagttcgccaaactcctgaagcagaagcgcatcactctcggttacacgcaggctgatgtgggattgactctcggagtcctgttcgggaaggtatttagtcaaaccaccatttgccgattcgaggcattacagctgagcttcaaaaacatgtgcaagctgagaccactgctacaaaaatgggtggaagaagcggacaataatgaaaatctgcaagagatctgcaaggcagagacccttgtgcaggctcggaaaagaaaacgtacaagcatcgagaaccgggtccgtggtaacttggagaatctgttcctgcagtgccccaaaccaaccctgcagcagataagtcatatcgcacagcagctaggcctagaaaaggatgtggtgcgagtgtggttctgcaaccggagacagaaggggaaacggtcatcctctgactacgctcagcgcgaagactttgaggccgcagggagtccttttagtgggggcccggtgagttttccactcgcgcccgggccacacttcggaaccccagggtacggcagccctcacttcaccgccctgtacagcagtgtgccatttcccgaaggagaagcttttcctccagtgtctgtaaccaccctcggcagtcctatgcactctaat

SEQ ID NO: 18368 - DNA, 1080 bp, Artificial Sequence
  Description of Artificial Sequence: Synthetic coding sequence
atggccggtcacctcgctagcgattttgctttctcacctccccctggcgggggtggcgatggcccggggggtccagaacctggatgggtggacccaaggacttggctcagttttcagggcccacccggaggacccggcatcggcccaggcgtgggtcctgggtccgaggtgtgggggatccctccttgtcctcctccgtacgaattctgtggggggatggcatattgtgggccacaggtgggggtgggattggtgcctcaggggggcctagaaacttcccagcctgagggcgaggcgggagttggagttgagagcaattctgacggagcgagtccagagccttgcacagtcaccccaggggctgtgaagttggagaaggagaagctggagcaaaatcccgaggaaagccaggatatcaaggccctgcagaaggagctcgagcagtttgccaagctgctgaaacaaaaacgaattacactagggtacacccaagccgatgtgggtctaactctgggcgtgctgtttggtaaagtgttcagccaaactacgatttgtagattcgaggcgttgcaactgtctttcaaaaacatgtgtaagctgcggcccttactacagaaatgggtggaggaggctgataataatgaaaatctacaagaaatctgtaaagcagaaacgttggttcaagcaaggaagagaaagaggacaagcatcgaaaaccgcgtcagggggaatctggaaaacttattccttcaatgcccaaaacctaccctgcaacagattagtcacatcgcgcagcaattaggcctcgagaaggatgtggtcagagtgtggttctgcaacaggcgccaaaagggtaaacggagctcctctgattatgcacagcgggaagattttgaagctgccggatctccgttcagtgggggacccgtcagttttccgttggcccccggcccgcatttcggcactcccggctatggtagcccacatttcacggctctctactctagcgtgcccttccctgagggcgaagcgtttcctccagtctcagtaaccacccttgggagtccaatgcactcgaat

SEQ ID NO: 18369 - DNA, 1080 bp, Artificial Sequence
  Description of Artificial Sequence: Synthetic coding sequence
atggcgggccatcttgcttccgacttcgctttcagcccgccgccaggaggagggggcgatggacctgggggaccagaacctggatgggtggacccgagaacctggctctccttccagggacctccgggcgggccaggaatcggaccaggagtgggaccgggctcagaagtctggggaatcccgccgtgccctccaccttatgagttttgtggtggaatggcttactgtggaccccaggtcggcgtcggccttgtgccacagggaggcctggaaacttcccaacctgagggtgaagcgggcgtgggggtggagagcaactcggacggtgcctcccccgaaccgtgcaccgtgactccgggagccgtgaagctggaaaaagaaaagctcgagcaaaacccggaagaatcccaagatatcaaggctctgcagaaggagttggagcagtttgccaagctcctcaagcaaaaacggatcactctgggctacacccaggccgatgtcgggttgacgcttggagtccttttcggcaaggtgttcagccaaaccacgatctgcagattcgaagccctccaactgtctttcaaaaacatgtgcaagctgcgtcccctgctgcagaagtgggtggaggaagccgacaataacgaaaacctgcaggaaatctgtaaggccgagactctcgtccaggcacggaagcgcaagagaaccagcatcgaaaatcgcgtgagggggaacctcgaaaacctgttccttcaatgcccgaagcctactcttcagcagatctcgcatatcgcccaacaactgggactggaaaaggacgtggtgcgggtctggttctgcaaccggaggcagaagggcaaacggtcaagctccgattacgcgcagcgcgaggacttcgaagcagcgggcagccctttcagcggcggacccgtcagcttcccgctggctccaggaccgcatttcggaactccaggctacggatcgccgcattttactgcgctgtactcatccgttccttttccggaaggggaagcattccctccagtgagcgtgaccactctgggctcccctatgcacagcaat

SEQ ID NO: 18370 - DNA, 1080 bp, Artificial Sequence
  Description of Artificial Sequence: Synthetic coding sequence
atggccggacatcttgcatcggattttgccttttctcccccaccaggaggaggcggagatggtcccggtggacctgaaccaggttgggtggatcctcgaacttggctctcgttccaaggacccccgggcggacctggaattggaccaggcgtgggtcctggctccgaagtatggggtatcccaccatgtcctcctccttatgagttttgtggtggaatggcatactgcgggcctcaagtgggtgttggcctcgttccacaaggtgggttggaaacgagccaaccggaaggtgaagcaggcgtcggagtcgaatccaactcggatggagcgagtcctgagccatgcaccgtgaccccaggagccgtaaaactggaaaaggaaaagttggagcagaacccagaagaaagccaagacattaaagcccttcaaaaggaactggagcaatttgctaagctcctcaaacagaaaagaataactctggggtacactcaggcagatgtgggtctgactcttggggtgctctttgggaaggtgttctcgcagaccactatctgtaggtttgaggcattgcaactttccttcaaaaacatgtgcaagctcagaccattgctgcagaagtgggtggaggaggccgacaataatgaaaaccttcaagagatctgtaaggcagaaaccctggttcaagcacggaagagaaaacgcacttcgattgaaaacagagtgcggggtaacctcgaaaaccttttcctccagtgtcccaagccgaccctgcagcaaatttcgcatattgctcagcagctgggtcttgagaaggatgtggtccgcgtgtggttttgtaatcgtaggcagaagggtaaacgatcttcgagtgactacgcgcagcgcgaggactttgaggcagcagggtccccgttctccggaggacccgtcagctttccactggcgcccggtcctcacttcggcacccccggctacggatcccctcattttacggcactgtactcatccgtccccttccctgaaggagaagcgtttccgcccgtgtcagtgacgacccttgggagccctatgcacagtaat

SEQ ID NO: 18371 - DNA, 1080 bp, Artificial Sequence
  Description of Artificial Sequence: Synthetic coding sequence
atggctggacatctggccagtgatttcgccttcagtccaccaccgggaggggggggagacggaccaggggggcccgaacctggttgggtcgatcctcgaacctggctttcattccagggaccacctgggggacccggtatcggccccggagttggacctggctccgaagtgtgggggattcctccatgccctccaccatacgagttctgtggtgggatggcctattgcggacctcaagtcggagtgggcctagtgccccagggggggttagagacatctcagcctgagggagaagcgggcgtgggagtggaatccaactctgacggagcatcacctgagccttgcactgtgacgcccggagccgtcaagctggagaaagaaaaactggagcagaatcccgaagagtcacaggacattaaggccctacaaaaagaactcgagcagttcgccaagctgctaaagcaaaaacgcatcactcttgggtatactcaggccgacgtgggactgacactaggtgtgctcttcggcaaggtgtttagccagaccacgatttgcaggtttgaggccttgcaacttagtttcaaaaacatgtgtaagttgagaccacttctgcagaagtgggttgaagaggccgataataatgaaaacctccaagagatttgtaaagctgaaaccctggtgcaggccagaaagagaaaaagaactagcattgaaaacagagtgcgagggaatctagaaaacctttttttacaatgtcccaagcctaccctccagcagataagccacattgcacaacaactggggctggagaaggacgtggtgcgagtatggttctgcaacagaaggcagaagggtaagcgaagctctagtgattacgcacagcgagaggactttgaagctgctggctcacccttctcaggcggacccgtgagctttccactggccccgggcccccacttcgggacaccaggatatgggtcccctcactttacagctttgtactctagtgtgccttttccagagggtgaagcctttccccccgtgtcagttaccacgctcggatccccaatgcactcaaac

SEQ ID NO: 18372 - DNA, 1080 bp, Artificial Sequence
  Description of Artificial Sequence: Synthetic coding sequence
atggccggccatttggccagtgatttcgcttttagtcccccccctggtggggggggcgatggtcccggagggcccgaaccaggatgggtcgatccacgcacctggctctcttttcaaggaccccccggagggccaggaatagggccaggcgtaggaccaggctccgaggtttggggtattccaccgtgcccacccccgtacgagttctgcggagggatggcatattgcggaccgcaagtcggagtgggacttgtccctcaaggtggactcgaaactagccagccagagggagaagcgggggtaggcgtggaatccaactcagacggcgcctcacctgaaccatgtaccgtcacacccggtgccgtgaagcttgagaaagagaagctggaacagaatccagaggaatcccaggatattaaagcactccagaaagagctggagcagtttgcgaagctgctcaagcagaagcggatcaccctcggctacacccaggcggatgtgggtcttacccttggggtgctgtttggcaaggtgtttagccagacaacgatttgtaggtttgaggccttgcagctctcctttaaaaacatgtgtaagcttcgccccttgctgcagaaatgggtcgaggaagccgacaataatgagaacctgcaggagatttgcaaggccgaaactctggtccaagccaggaagagaaagcggactagcatcgaaaatagagtacgaggcaacctcgaaaatcttttcctgcagtgcccgaaaccaactttgcagcagatcagtcacattgcccagcagctgggcttggaaaaggacgtcgttagagtctggttttgcaatcgccggcagaaagggaagaggtcttcctcagactatgctcagcgcgaagacttcgaagccgccggctctccgttttccggcggcccagtgagtttcccactcgcgcccggtcctcactttggaacgccaggatatggctcaccacatttcacggcgttgtactcctcagtaccctttccggagggagaagcctttccgcctgtgagtgtcaccacactcgggtctcctatgcattctaac

SEQ ID NO: 18373 - DNA, 1080 bp, Artificial Sequence
  Description of Artificial Sequence: Synthetic coding sequence
atggccggacatctcgcatctgactttgcattctctcctccaccgggaggtggaggggacggaccaggaggtccagaacctggttgggtggaccccaggacctggctgagctttcaaggtcccccagggggtccagggattggaccgggcgtgggccctggatctgaagtctggggcattcccccgtgtcccccaccttacgaattttgtggaggcatggcttactgcggtccgcaagtgggcgttggcctggtcccacaaggaggtcttgaaaccagtcagccagagggagaggctggtgtgggtgtcgaatccaatagcgacggtgcctcgccagagccttgcactgtgacccctggggcagtgaaacttgagaaggaaaagctggaacaaaaccccgaagaatcccaggacataaaggcactccagaaggaactggagcaatttgcaaaattgctgaaacagaagcgtattaccctgggttacactcaggcagacgtaggtcttaccctgggtgtgcttttcggaaaggtgttttcccaaactaccatctgtcggtttgaagcgctgcaattgtcgttcaagaacatgtgcaaactcaggccactgctccaaaagtgggtggaggaagctgacaataacgaaaatcttcaagagatttgtaaggcggaaaccctcgtccaggcaagaaagagaaaacgaacgtccattgaaaacagagtccggggcaatctggagaacctgttccttcagtgtcctaaacctaccttgcagcagatttcacacatcgcccagcagctgggactcgagaaggatgtcgtgcgagtgtggttttgcaatcgtcggcaaaagggcaagagaagctcctcggactatgcccagcgcgaagattttgaagcagcgggttccccattttcggggggtcctgtttccttccccctggcaccagggccgcactttggtactcccggttacgggagcccccatttcacggctctctactcatcggtcccatttccagaaggtgaggcatttcctccagtgtccgtcaccactcttgggagccccatgcactcgaat

SEQ ID NO: 18374 - DNA, 1080 bp, Artificial Sequence
  Description of Artificial Sequence: Synthetic coding sequence
atggctggacatctggcatctgatttcgctttcagtccaccacctggcggtggcggggacggtccaggtggacccgagcctggctgggtggacccgagaacctggttgtcttttcaaggcccccccgggggccctggaatcggcccgggagtcggacccggatcggaggtatgggggatcccaccctgcccccccccctacgagttctgtggaggtatggcttactgcggaccacaggtgggcgtcggccttgtgccccagggcggtctggaaacaagtcagccagagggcgaagcaggggtgggcgtggagagcaactccgatggcgctagccccgagccatgcactgtaacccccggcgccgtgaaactggaaaaagaaaaactagagcaaaacccagaagagtcccaagacataaaagctctgcagaaagaactcgagcagtttgctaagctgctgaaacagaaacgcatcacattgggttacacccaggccgatgttggcctcactctgggggtgctgttcggcaaggtcttttcacagacaacaatctgccgattcgaggctctgcagttatcattcaagaatatgtgtaagctgcgaccactcttgcagaagtgggtggaagaagccgataacaacgaaaaccttcaagagatatgcaaagctgagacactcgtgcaggctcgcaaacgcaagcgtaccagtatagagaatagggtgcgggggaaccttgagaacctctttcttcaatgccccaaacctactctgcagcagatttcacacatagcacagcagctcggactggaaaaagatgtagtgagggtgtggttttgtaatcggagacagaaagggaagaggtcttctagcgactacgcccagagggaagattttgaagccgccgggagtccattttccgggggccccgtttctttccccctggcaccaggacctcatttcgggacccccggctacggatcccctcacttcacggcactgtatagctccgtcccttttcctgagggcgaggcttttccgcctgtctcagtgacaactcttggttcccccatgcacagcaac

SEQ ID NO: 18375 - DNA, 1080 bp, Artificial Sequence
  Description of Artificial Sequence: Synthetic coding sequence
atggcaggtcatcttgcatccgattttgcgtttagcccacctcccggaggtggcggggatggaccgggaggaccagagcctggttgggtggacccaagaacctggctctcatttcaaggtcctcctggcgggccgggtatcggacctggcgtggggccggggagcgaagtgtggggcatcccgccttgccccccaccttacgaattttgtggagggatggcatactgtggaccacaagtcggagtgggacttgtgccacaaggcggactcgaaacctcgcagcccgagggcgaagcgggtgtgggagtggagtcaaacagcgatggggcatcaccagaaccctgtactgttacgcctggagccgtgaaacttgaaaaggagaaacttgagcagaaccccgaggaatcccaggacataaaggcactgcagaaggagctggaacagtttgccaaattgctcaaacaaaagcggattacgctcgggtacactcaggcagatgtgggacttactctgggcgtgctgtttggtaaggttttcagccagacgactatttgtcgatttgaggcactgcaactctcgttcaagaacatgtgcaaacttcgaccacttcttcagaaatgggtggaagaagctgataacaatgagaatctgcaagaaatctgcaaggccgaaactctcgtgcaagcccgcaagcggaagagaacttcaatcgaaaacagggtcaggggaaacctcgagaatcttttccttcagtgtccaaagcctactctgcagcaaatttcgcatatcgcacaacagttgggccttgaaaaggacgtcgttagggtgtggttttgtaatcgccgccaaaagggtaagcgctcatcgtccgactacgcgcagcgggaggatttcgaggctgccggctcgcccttttccggcgggcctgtgtcctttccgcttgcacccgggccgcatttcgggactccaggttacggatccccccattttaccgcactctactcgtcggtgccgttcccagaaggtgaagcgtttccaccagtctcagtcactaccctcggtagccctatgcactccaac

SEQ ID NO: 18376 - DNA, 1080 bp, Artificial Sequence
  Description of Artificial Sequence: Synthetic coding sequence
atggctggacacctggcatccgatttcgcattcagcccgcccccgggcggcggaggagacggacctggcggaccggagccgggatgggtggatccccggacttggctgtcgttccagggacctccaggaggccctggaattggtcctggagtgggacctgggagcgaggtgtggggaatcccgccttgcccgccgccttacgaattttgcggggggatggcctattgcggaccccaggtgggagtgggactcgtccctcagggagggcttgagacttcgcagccggagggggaagcgggagtcggagtcgaatcgaactcagatggagccagcccagaaccgtgtacggtgactccaggggctgtcaaacttgaaaaggagaaactcgaacagaacccagaagaatcccaggacatcaaagccttgcagaaggagcttgaacaattcgcgaagctcttgaagcaaaaaaggatcacgttgggctacacccaagccgacgtgggactgaccctgggagtgctctttgggaaggtgttctcccagactactatctgccggtttgaggcactccagctgtcgtttaagaacatgtgcaaactgcggccactcctgcagaagtgggtggaagaggccgacaataacgaaaatctccaggagatctgtaaagctgaaaccttggtgcaagctagaaagagaaaacgaacctcaatcgagaaccgggtgaggggaaatctcgaaaatcttttcctgcagtgccctaaaccgaccctccaacaaatttcacatatcgcacaacaactgggtctggagaaggacgtagtgagagtgtggttttgcaaccgccgccagaaggggaagagatcaagctcagactatgcccaaagagaggatttcgaagccgcaggttcgcctttctccggtgggccggtcagtttcccattggccccgggtccgcattttggcaccccgggatatggcagccctcacttcactgccttgtactcctctgtccccttcccggaaggagaagccttcccgccggtgtcagttaccacgttgggctcgccgatgcactcaaac

SEQ ID NO: 18377 - DNA, 1080 bp, Artificial Sequence
  Description of Artificial Sequence: Synthetic coding sequence
atggctggacatcttgctagtgattttgctttctcaccaccacctggaggaggcggtgatggaccaggtggtccagaaccaggatgggtagatccaagaacttggctttcattccaaggaccgccaggaggaccgggtattggaccaggcgtaggtccgggatctgaagtttggggtattccaccatgcccacctccgtacgagttttgcggaggaatggcttattgtggcccacaagtgggcgtcggacttgtgccacaaggaggcttagaaactagtcaaccagagggagaagctggagttggagtggagtcaaattctgacggtgcctctccagagccatgtactgttacgccaggggcagttaagcttgaaaaagaaaaattggaacaaaatccagaggaatcccaagatataaaggctcttcaaaaagaattagagcaatttgccaaattgctcaagcaaaaaagaattacacttggttatacacaagctgacgtaggactaactctgggcgtgctctttggaaaagtcttctctcaaacaacgatctgcagattcgaagcactccagctttctttcaaaaacatgtgtaaacttcggcccctgttgcaaaaatgggtggaggaagcagataataacgaaaatcttcaggaaatctgtaaagcagaaacgctggtgcaggctagaaaacgaaagcgaacatccatcgaaaatagggttagaggaaacctcgagaatctgttcttgcagtgccctaaacccacactgcaacagattagtcacattgctcaacagttgggacttgaaaaggacgttgttagagtctggttctgcaatcggcgacaaaaaggcaaaagatcttcctctgattatgctcaaagggaggattttgaggctgctggttcgccattcagtggagggccggtttcgttcccactggcgccaggaccgcatttcggtacgcctgggtatgggtcgccacacttcacggcgctatactcctctgttccattcccggaaggagaggctttcccgccagtgtcagtgacaactctcggaagtccgatgcacagcaac

SEQ ID NO: 18378 - DNA, 1080 bp, Artificial Sequence
  Description of Artificial Sequence: Synthetic coding sequence
atggctggacacttggcttctgactttgcattctcgccaccaccaggcgggggcggagacgggcctggaggccccgaacctggctgggtagatccgaggacttggctcagcttccagggaccaccaggtggccccggaattggacctggagtagggcccggctctgaagtgtggggcatcccaccctgtcctcccccttacgaattctgcggaggaatggcctactgtggccctcaggtgggagtgggcctggtgcctcagggtggactggaaacttctcaacccgagggcgaggcaggcgttggagttgagagcaactctgatggagccagtcccgagccatgtacagtcactcctggagctgtcaagctcgagaaagaaaagctggaacagaatcctgaagaatcccaggacatcaaagcattacagaaagaactagaacaatttgctaagctcctcaagcaaaagagaatcactcttggctatacccaggcggatgttggactgactctgggcgtattgtttggaaaagtgttcagccagacaacaatctgcagatttgaagctcttcagctgagtttcaagaacatgtgtaagttacggccgctgctgcagaaatgggttgaggaagctgacaacaacgaaaacctgcaggagatctgtaaggctgaaactttagttcaggctcgcaagaggaagaggacaagcatagaaaacagggtgaggggcaacctcgaaaacctgttcctgcaatgtcctaaacccacattgcaacagatctcacatatcgcgcagcagctgggactggagaaagatgtcgtgcgcgtttggttctgcaaccgccgtcaaaagggcaaacggtctagctctgattacgcccaaagggaggacttcgaagctgccgggagtccattttccggaggacccgtttcctttcccctggcccctgggccacacttcggcacccccggatatgggagtcctcacttcactgccctgtatagctccgtgccctttccggagggagaggcttttcctcccgtgtcagtgacaacgttgggcagccctatgcactctaat

SEQ ID NO: 18379 - DNA, 1080 bp, Artificial Sequence
  Description of Artificial Sequence: Synthetic coding sequence
atggctgggcatctcgcttcggacttcgccttttccccgccaccaggaggaggcggagacggcccagggggcccagaaccggggtgggtggaccctagaacgtggctgtccttccaaggacccccgggtggccctgggatcggacctggagtgggaccgggatctgaagtctggggaatccctccctgcccgcctccttacgaattctgcggtggtatggcgtactgtggaccgcaggttggggtgggcctggtgccacagggcggactggaaacctcccagccggaaggcgaagccggcgtgggggtggaatctaactccgatggcgccagcccggagccgtgtaccgtcactccaggggcagtgaagttggagaaagagaagctggagcagaatccggaggagtcacaggacatcaaggcgcttcaaaaagaactggagcaattcgctaagctgctcaaacagaaacgaatcactctgggttacactcaggccgatgtgggactgaccctgggcgtgctgtttggaaaggtgttctcacaaaccactatttgccgcttcgaagctctccaactcagctttaagaatatgtgcaagctgcgtccgctgttgcagaagtgggtggaagaagctgacaacaatgagaaccttcaagagatctgtaaggcggagactctggtgcaagcgaggaagcggaagaggacctccatcgaaaaccgggtgagaggcaatctggaaaacttgtttcttcagtgcccaaaaccgaccctccaacagattagccacatcgctcagcaattgggactggaaaaagatgttgtccgggtttggttctgtaaccgccgccaaaagggaaagcgctcgtcgtcagactacgcccagagagaagatttcgaagccgccggtagccccttctccggagggccagtgtccttcccgcttgccccgggaccccatttcgggaccccgggttatgggtcgccacacttcacggcgttgtactcatctgtgccatttcccgagggtgaggcgttccctcccgtctccgttactactctgggtagcccgatgcactcgaac

SEQ ID NO: 18380 - DNA, 1080 bp, Artificial Sequence
  Description of Artificial Sequence: Synthetic coding sequence
atggcgggccatctggctagcgactttgcgttctcaccgccaccaggaggtggcggggacgggccgggcggaccggagccagggtgggtggacccacgtacctggctgtccttccaaggaccgccaggaggaccgggtattggcccgggtgtgggtccggggtcggaagtgtgggggatcccaccgtgcccgcctccttacgaattttgtggaggcatggcatattgcggaccgcaggtgggagtgggattggtaccgcagggaggcttggaaactagccagccagagggtgaagcgggagtgggtgtagaatccaattccgacggagcttccccagaaccctgcaccgtgacgccaggtgccgtgaagctggaaaaggaaaaactcgaacaaaatcccgaggaatcacaagatatcaaagcgctccagaaggaactcgaacaattcgctaaacttctgaagcagaagcggatcacccttggctacacccaagcggatgttggccttactctgggggtgctgttcggaaaggtgttttcgcagaccaccatttgccgcttcgaggccctgcagttgtcgtttaagaatatgtgcaagctgcgcccgctgcttcagaaatgggtcgaggaagcggataacaatgaaaacttgcaagagatttgtaaggccgagactctggtgcaggctcggaagcggaagagaacttccatcgaaaacagagtgagaggaaacctggagaacctgttcctccagtgtccgaagccgaccctccaacaaatcagccacatcgcacagcagctgggactggagaaagacgtcgtgagagtgtggttttgcaatcgccgacagaagggaaaacggtcctccagcgactacgcacagcgcgaggatttcgaggctgccggaagcccgttcagcggcggaccggttagcttcccgctggccccgggaccccatttcggaaccccaggatacggatctccccactttacggccctgtactcgagcgttccattcccggagggagaagcctttccacccgtctcggtcactaccctcgggtccccgatgcacagcaac

SEQ ID NO: 18381 - DNA, 1080 bp, Artificial Sequence
  Description of Artificial Sequence: Synthetic coding sequence
atggccgggcatctcgcgagcgattttgccttctctccaccaccagggggtggaggagatggtcctggaggtccggaaccgggatgggtcgatccacgtacctggctctccttccagggtccacccggaggtcccggaattgggccaggggtgggacctggatcggaagtgtggggaatacctccatgtccaccaccgtacgaattttgtggcggcatggcttactgtggaccacaagtgggagtgggcttggtgccacaaggaggactggaaacctcgcaacctgaaggcgaggcaggagtgggagtcgaatccaatagcgacggtgcatcccctgagccatgcacggtgaccccaggtgcggtgaaacttgaaaaagagaagctggaacagaatccagaagagagtcaggatatcaaggcacttcaaaaagaactcgaacagtttgcaaagttgctcaagcaaaaaagaatcacgctgggatacactcaggcagatgtgggtctgactctcggagtcctgtttggtaaagtgttctcacagaccaccatttgtagatttgaggcattgcagctgagctttaagaatatgtgcaagctcaggcccctgcttcagaagtgggtggaagaagctgacaacaacgaaaacctgcaggagatttgtaaagctgaaaccctggtccaagcacgcaagcgcaaaaggacttcaattgagaaccgggtcagagggaatctggagaacctctttctccagtgccctaagcctaccttgcaacaaatttcccatatcgcacaacagctggggttggaaaaggatgtggtgcgtgtctggttctgtaaccgccgtcagaaggggaagcgatcgtcatccgactacgcacaacgggaagattttgaggcggcaggatcaccattttcgggtggcccagtgagcttcccattggcgcctggacctcactttggcaccccaggctatggctcgcctcatttcaccgctctgtactcgtcagtcccatttcctgagggcgaggcctttcctcccgtgtccgtgacgaccctcggatccccgatgcattcgaac

SEQ ID NO: 18382 - DNA, 1080 bp, Artificial Sequence
  Description of Artificial Sequence: Synthetic coding sequence
atggcaggacacctggccagcgacttcgcctttagccctcctccgggagggggaggagatgggcccggagggccggagccaggttgggtggacccgagaacttggctgtccttccagggcccaccgggcggacctgggatcggccctggagtcggcccgggatcggaagtgtggggaattccgccatgtccgccaccgtatgaattctgcgggggaatggcttactgcggcccgcaagtcggtgtgggcctggtcccgcagggaggactggaaacctctcagcctgaaggggaggcgggagtgggagtggaatcgaactcggacggagcatcgccagaaccctgcaccgtcactccgggcgccgtgaaactggaaaaggagaagctcgagcagaacccggaagaatcacaggatatcaaggcccttcaaaaggagctggaacaatttgcgaaactgttgaagcagaaaagaatcaccctgggttacacccaggccgacgtcggactgactctgggggtgctgttcggaaaagtgttttcgcagaccacgatctgccgattcgaagcactgcaactctcttttaagaatatgtgcaaactgcgcccgctgctgcaaaagtgggtggaggaggccgacaacaatgagaacctgcaggagatttgtaaggcggaaaccctggtgcaagcacgcaagagaaagcggactagtatcgagaaccgggtgagaggaaacttggaaaacctgttcttgcagtgccctaaaccaactctccagcaaatcagccacatcgcccagcagctcggcctggaaaaagacgtggtgagagtctggttttgcaatcgacgccagaaggggaagaggtccagctcagactatgcgcagcgtgaggacttcgaggccgccgggtcgccattctcaggtggcccggtgtcattcccactcgccccaggaccgcacttcggcacccccggctacgggtcaccgcatttcactgctctgtacagctcggtgcccttccctgaaggagaagcgtttccgcccgtgtccgtgactactttgggatctccaatgcattcgaat

SEQ ID NO: 18383 - DNA, 1080 bp, Artificial Sequence
  Description of Artificial Sequence: Synthetic coding sequence
atggcggggcacctggcttccgacttcgctttttcgcctcctccgggtggcgggggcgacggccccggtggaccggaacctggttgggtcgacccaagaacctggctgtcattccaaggaccaccgggcggtccaggaatcggcccgggtgttgggccgggtagcgaggtttggggcattcctccgtgccctccaccatacgagttctgtggcggcatggcttactgcggacctcaggtaggcgtgggcttggttccgcaaggtggcctggagacttcacagccggaaggggaagcgggcgtcggtgtggagagcaacagcgacggagcctctccagagccgtgcacggttacgccgggtgccgttaagttggagaaagaaaagttggaacaaaatcctgaggaaagccaggacattaaagcacttcaaaaggaactagaacagttcgcgaagttgctgaagcagaaacgcatcacattggggtacactcaagcagacgtcggcctgactctcggcgtgttgtttgggaaagtgttttcccaaactaccatttgtcgcttcgaagcgctgcaactgtctttcaagaatatgtgcaagctgcgtcctctgcttcagaaatgggttgaagaagcggacaacaacgagaacctgcaggaaatttgtaaagccgagactctggtgcaggcccggaaacggaaacgcacctcaattgagaaccgcgttagggggaacctggagaacctgttcctgcaatgtcccaagccaaccctgcagcagatttcacatatcgcccagcagcttggcctggagaaggatgtggtgagagtgtggttctgtaaccggaggcaaaaaggcaaaaggagctctagcgactacgctcagcgagaagattttgaagccgctggaagcccgttcagcgggggcccagtaagcttccctctagcccctggtcctcacttcggtacgcctggttatggttcaccacactttaccgctctgtacagttcggtccctttccctgaaggtgaagcctttccaccagtcagcgtgacaacccttggtagtcccatgcatagcaat

SEQ ID NO: 18384 - DNA, 1080 bp, Artificial Sequence
  Description of Artificial Sequence: Synthetic coding sequence
atggccggtcatctggcgagcgacttcgcatttagcccacctcctggcgggggcggggacggccccggcggccctgaaccgggatgggtcgatcctaggacctggttgtcgttccagggaccacccgggggccctggcatcggccccggggtcgggccaggtagtgaggtctgggggatcccaccctgccctcctccatatgaattctgcggaggaatggcatattgcggcccacaggtgggggtcggactggtaccccagggcggcctcgaaacaagtcagcctgagggcgaggccggcgttggcgtcgagagcaacagcgacggcgcttctccagaaccctgcaccgtgacgccgggggccgtgaagctggagaaggagaaacttgaacagaatccggaagaatcccaggatataaaggctctccaaaaggaactggagcaatttgcaaaactactgaaacagaagcggattactctgggttacacccaagccgacgtggggttaaccttgggtgtcttgtttggtaaagtgtttagtcaaacgacgatctgtcggtttgaagctttacagcttagtttcaagaatatgtgcaagctccggccactgcttcagaagtgggtggaagaagccgataataatgagaatctgcaggagatttgtaaggccgaaacactcgtgcaagctcggaaacgtaagcgtacctccatagaaaacagggttaggggtaacttggaaaatctgtttctgcagtgccccaagccaactctgcagcagatatctcatatcgcacagcagcttgggcttgagaaggacgtggtgagggtatggttctgcaatagacggcagaagggtaaacggagttcgagcgactatgctcagcgcgaggattttgaggcagccggaagtccctttagcggaggacccgtatctttccctctcgcacctggaccccatttcgggacccctggctacgggagtcctcattttacagctttgtatagcagtgtcccttttccggaaggtgaagcgttccctcccgtttcggtaaccacactgggaagccccatgcattcgaat

SEQ ID NO: 18385 - DNA, 1080 bp, Artificial Sequence
  Description of Artificial Sequence: Synthetic coding sequence
atggcaggccacctggcatccgactttgctttctcccccccccctggcggaggaggagatggtccaggggggccagagcccggctgggtggacccacggacctggctctcgtttcaaggcccccctggcggaccaggtattggaccaggggtgggcccgggctccgaagtctggggaatcccaccatgccctcccccttacgagttctgcggaggtatggcctattgcggtccgcaggtgggcgtaggtctagtgccacagggcggtctggagacatctcagccggaaggggaggcaggtgttggtgtagagagcaacagcgatggagcgagccccgaaccttgcaccgtgacacccggggctgttaaactcgaaaaggagaaattggaacagaaccctgaggagtctcaagacattaaggccctgcagaaggagttggagcagttcgctaaactgttgaaacagaagcgtatcaccctggggtatacccaggctgatgtcggccttacactgggagtgctattcggcaaagtgttctcccaaacaaccatctgccgatttgaggctcttcagctttcctttaagaatatgtgcaagctgaggccccttctacagaaatgggtggaagaggccgataataatgaaaaccttcaagagatctgtaaggccgagactctcgtccaggcccgcaaacgcaaacgcacctctatcgaaaatagggtgcgaggcaacctggagaatttatttctgcagtgcccaaagcctacactgcaacaaattagccacatagctcagcaactcggcctcgaaaaggacgttgtgcgcgtttggttttgcaaccggcgccagaagggaaaacggtcttcctctgactatgcccagagggaagacttcgaggccgctggctcgcccttctccgggggacctgtgtcattccccctggcccctggcccgcatttcgggactcccggctatggcagcccccactttactgccctatatagtagtgtcccttttcctgaaggcgaagctttccctccagtctccgtgacaactctggggtcacctatgcattctaat

SEQ ID NO: 18386 - DNA, 1080 bp, Artificial Sequence
  Description of Artificial Sequence: Synthetic coding sequence
atggcgggacatctcgcatcagatttcgccttttcgccgcctccaggaggaggaggagacggccctggagggccggaacctggctgggtggacccacgcacgtggctgagcttccagggaccccctggaggaccggggatcggccctggtgtcggaccgggatcagaggtctggggtatccctccatgcccgcctccttacgaattctgcggaggaatggcgtactgcgggcctcaggtgggggtcggactcgtcccccaaggaggccttgaaacgtcgcaaccggaaggtgaggcaggggtcggggtggagagcaattccgacggggcgtcaccggagccatgcactgtgactccgggggccgtcaagctcgaaaaagagaagctggagcagaacccggaagagagccaagatatcaaggccctgcagaaggaactggaacagttcgctaagttgcttaagcagaaaaggataactctcggatacactcaggctgatgtgggtctgactctcggagtgctcttcggaaaggtgttctcccagaccactatctgtaggtttgaggctctccaactgtcgttcaaaaacatgtgtaaactgaggcccctgctgcagaaatgggtcgaggaggccgacaacaacgagaaccttcaagaaatttgcaaggcagaaacgttggtgcaagccagaaaacgcaagcggaccagtatcgagaaccgagtgaggggcaacctggaaaacctgttcctgcagtgcccgaagcccaccctccagcaaatttcacatatcgcccagcaacttggattggagaaggacgtggtccgcgtatggttctgtaaccgcagacagaagggcaagcggtcgtcatccgactatgcccagcgagaggattttgaagctgcaggcagccctttctcaggggggccggtgtcattcccgctggccccgggtccacactttggcacccctggatatggtagcccgcactttactgccctgtactcgagcgtgccttttcctgaaggcgaggcgttccccccagtcagcgtgaccaccctgggttcgccgatgcactccaat

SEQ ID NO: 18387 - DNA, 1080 bp, Artificial Sequence
  Description of Artificial Sequence: Synthetic coding sequence
atggccggacatctcgcttccgacttcgctttctctccccctcccgggggggggggggatgggcccggaggacctgaacctggatgggtggaccccaggacatggctttcctttcagggacctcctgggggacccggaatagggccaggagtggggccaggatctgaagtttggggaatacccccttgtcctccaccctatgaattctgcggagggatggcctattgcgggcctcaggtgggagtagggctagtccctcagggaggacttgagacaagtcagcctgaaggggaagccggagtaggggtggaatcaaatagtgatggagcctcacccgagccttgtacagtcactcctggagccgttaaactggaaaaagaaaaactggaacagaatccagaagaatcacaagacataaaggcacttcagaaagaattggaacagttcgccaagctgctgaaacagaaacgaataacattagggtatacacaggccgatgtggggctaacattgggggtgttatttggaaaagtgttttcacaaactactatctgtcgattcgaggctctccagttatcattcaaaaacatgtgtaagctaagaccactattacagaaatgggtggaagaagctgataataatgaaaatctccaggaaatctgtaaagcagaaacactcgtgcaggccagaaaacggaaacgcacttctatcgaaaatcgagtacgcggaaacctggaaaacctctttctgcaatgcccaaaaccaacactccagcagatttctcatatcgcacagcagcttggactggagaaagatgtggtcagagtgtggttctgtaaccgcaggcagaagggaaaaaggtcttcttccgattatgcgcagcgcgaagattttgaggctgcagggtcccctttcagtggggggcctgtatccttccctctagcaccagggccgcattttggaactcccgggtatgggtccccacattttacagcactatacagttcagtgccttttccagaaggggaagcttttccccctgtttctgtcacaacactggggtctcccatgcactccaat

SEQ ID NO: 18388 - DNA, 1080 bp, Artificial Sequence
  Description of Artificial Sequence: Synthetic coding sequence
atggctggccacctggcctccgactttgcgttttccccgccacctggcggagggggagatggtccggggggccctgagcccggttgggtggatccccgaacttggctttcgtttcagggacccccgggcggacctggaatcggcccaggtgtaggacccggatccgaagtgtggggaatccccccttgtcctccgccgtatgaattctgcggaggtatggcctactgcggtcctcaggtgggtgttggacttgttccacaaggtggcctggaaaccagccagccggagggagaagcgggcgtgggagtcgagagcaatagtgacggagcaagccctgaaccatgcaccgtgaccccgggagctgtcaagctggaaaaagagaagttggagcagaacccggaagagtcccaggacataaaggccctgcaaaaagagttggaacaattcgccaagctcctcaagcaaaagagaatcaccctgggctacactcaggcggacgtgggactgacccttggcgtactgttcggaaaggtcttttcgcagaccacgatctgtcggttcgaggctttgcagctgtcatttaagaacatgtgcaaattgcggcctcttcttcaaaagtgggtggaggaagcggacaataacgagaacctccaggaaatctgcaaggctgagacgctggtgcaagctcgcaagcggaaaagaacttcaatcgaaaaccgcgtgaggggtaatctcgagaatctgttcctgcagtgcccgaagccgactctccaacagatttcccatatcgcacaacaactgggactggagaaagacgtggtccgggtgtggttctgcaacagacgccagaaggggaagcgctcgtcgagcgattacgcgcagagagaagatttcgaggccgcaggatcgccattctcgggagggccggtcagctttcccctggcacctggaccacatttcgggactccaggctatggctcgccgcacttcaccgccttgtactcgtcagtgccgttccccgaaggcgaggccttcccaccagtgtccgtgacgactctgggctcaccgatgcactcaaac

SEQ ID NO: 18389 - DNA, 1080 bp, Artificial Sequence
  Description of Artificial Sequence: Synthetic coding sequence
atggccggccatctcgccagcgattttgcgttctctcccccaccagggggaggtggtgacggccccggcgggccggagccaggatgggttgatcctcgaacttggctttcgttccagggaccacccggtgggccggggattggccccggagtgggccctggctccgaggtgtggggtatacctccctgccctcccccatacgagttctgcggaggtatggcctactgtggaccgcaggtcggcgttggtctggtaccacagggcggactggagacatcccagcctgaaggagaagcaggcgtaggcgtggagtctaatagcgacggagcctcgccggagccctgtacagtcacccccggcgctgtaaaactagaaaaggaaaaactcgaacaaaatcccgaggaaagtcaagacattaaggcattacagaaagaactcgagcagttcgctaagctcttgaaacagaaaaggatcacactcggctacacccaagctgacgtaggcctgaccctgggcgttttgttcgggaaagttttttcccaaacgactatatgcagattcgaagccctgcagctgagcttcaaaaacatgtgcaaacttcgacccctgctgcagaaatgggtggaggaggcggataacaatgaaaatctgcaggaaatttgcaaggcggaaacactggtgcaagccagaaaacgaaaacggacatcaattgaaaacagagtcaggggaaacctcgagaacctgttcttgcagtgtcccaaaccaaccctgcagcaaatctcacacattgcacagcagttagggctggagaaggatgttgtccgggtgtggttctgtaaccggagacagaaggggaaaaggtctagctccgattatgctcagagagaggattttgaagccgcgggctcccctttttcgggcggcccagtctcttttcctctagcgcccgggccccactttggaacccctggatacggatcccctcactttactgctctgtattcttccgtgcccttccccgaaggagaagcttttccccccgtgtctgtaacaacactcgggagtcccatgcatagcaac

SEQ ID NO: 18390 - DNA, 1080 bp, Artificial Sequence
  Description of Artificial Sequence: Synthetic coding sequence
atggcgggccacctggcatcagacttcgctttctcgcccccacctggtgggggcggcgatggccccggtggtcctgaacctgggtgggtagaccctaggacctggctcagcttccaaggtcctcctgggggcccgggaattggcccgggggtcggccccgggtccgaggtgtggggcatcccaccttgccctcccccctatgagttctgcggaggtatggcctactgcggcccacaagtcggggtggggctggttccgcagggcggcctagaaacgtcccagcccgagggggaagctggcgtcggagtcgagtctaattctgatggggcctctccggaaccctgcacagtcacccctggagccgtgaagctggaaaaggaaaagctcgagcaaaaccccgaggagagtcaggacatcaaggcactgcagaaagagttagagcagttcgctaagctgcttaaacagaagcgtataaccttggggtacacccaggccgatgtgggtttgaccctgggcgtcctatttggcaaggttttctctcagaccaccatttgtaggttcgaagctcttcaactctcatttaaaaatatgtgtaaattgaggcccctcctacagaagtgggtggaggaggccgacaataatgagaatctccaagagatctgtaaagctgaaacattggtgcaggctaggaaaagaaaaaggacgtcgatagagaatagggtaagaggcaatcttgagaatctgtttcttcagtgtcctaagcctacactgcagcagatcagtcatattgcccagcagctcggcttggagaaggatgtggttagggtctggttttgtaacagacgccagaaggggaagagatcctcttctgactacgctcagcgcgaagatttcgaagctgccggatcaccattttccggtggccccgtgagctttcccttggcccctgggccacacttcggcacacctggatacggcagcccacacttcaccgccttgtacagtagtgtcccattccctgagggcgaagctttccccccagtatctgtgaccacgctggggtctccaatgcacagcaac

SEQ ID NO: 18391 - DNA, 1080 bp, Artificial Sequence
  Description of Artificial Sequence: Synthetic coding sequence
atggcaggacatttagcctcagactttgctttttcgccaccacccggcggaggcggagatggcccagggggtcccgaacccggttgggtggatccccgcacttggcttagtttccaaggccctcccggcggccctggtatcggcccaggggtaggcccgggcagtgaggtctggggaattccaccctgccccccaccttatgaattttgtgggggtatggcgtactgcggccctcaggtgggagtcggcctcgtcccgcagggtggtctggaaacctcgcagcccgaaggggaggccggagttggagtggaaagcaacagcgacggtgcatcccctgagccttgtactgtcacacctggggcagttaagctagagaaggagaagctcgaacagaatcccgaggagagtcaagacatcaaggcattgcagaaggaactcgaacagttcgccaaactgctcaaacagaagcgaatcacgttgggatacactcaggcagatgtggggctgactctaggggtcctgtttggcaaggtattttctcaaaccacaatctgtagattcgaggccctccagctgtctttcaaaaacatgtgtaagcttcgcccccttctacagaagtgggtggaagaggcagacaacaacgagaacctccaagagatctgcaaggcggagacattggtgcaggctcggaaacgcaagcggacatccatcgagaaccgggtgcgggggaaccttgagaatctatttcttcagtgtccaaaacccactctacagcagatttcccacatcgcccaacagcttggtctggagaaagacgttgtgcgggtgtggttctgcaaccgccggcagaagggcaaaaggtcctcttcagattacgcccaaagagaagactttgaagccgccggctcaccgtttagtggcgggccagtctcctttccattagctccggggccccacttcgggactccgggatatgggagtccccatttcaccgcactgtactcttcagttccctttcctgaaggagaggcgttcccccctgtatcggtgaccactctcggctcaccaatgcattctaat

SEQ ID NO: 18392 - DNA, 1080 bp, Artificial Sequence
  Description of Artificial Sequence: Synthetic coding sequence
atggccgggcatttggcgtcggattttgcttttagtccgccgcctggtggcggaggcgatggaccgggtggtccggagcctggctgggttgatcctcgaacgtggttatcttttcagggaccccccggtggtcctggtattgggccgggagtcgggccgggctcggaagtctggggcatcccaccttgtccgccaccttatgaattttgtggaggtatggcttattgtgggccgcaagttggtgttggacttgtgccacaaggtggcttagaaacatctcaaccagaaggagaagctggagtcggagtagaatcaaatagcgatggtgcgtcgccagagccctgtaccgttacaccgggagcagttaaactggagaaggaaaagcttgaacaaaaccctgaagaaagccaagatatcaaagccttgcaaaaagaactcgagcaatttgctaaattgcttaaacaaaaaaggattactttgggctacacgcaagcggacgttggattaactctcggtgttttgtttgggaaagttttttcacagacaacgatttgtagatttgaggcattgcaactttcctttaaaaatatgtgtaaactccggcccttgttacagaaatgggtggaagaagcagataataacgaaaacttgcaggaaatatgcaaagcggaaacactggttcaagcccgcaagagaaagcggacatcaattgagaatcgagtccggggtaatctggaaaacctttttctgcaatgcccaaagccgaccttacaacagatttcccatattgcgcagcagctgggtctcgaaaaagacgtcgttcgtgtgtggttttgcaatcgtcggcagaaaggaaaacgttcaagctctgactatgctcaacgtgaggattttgaagctgctggatcaccattctcaggtggtccggtgtcattccctttagcaccggggccgcattttggcacaccaggttacggttcaccgcattttaccgcactatatagctcggtaccgtttcctgaaggagaagcatttccgccggtttccgtgacaacgctggggtcacctatgcacagtaat

SEQ ID NO: 18393 - DNA, 1080 bp, Artificial Sequence
  Description of Artificial Sequence: Synthetic coding sequence
atggccggccaccttgcatccgatttcgccttctcccctcccccgggggggggcggagacggcccaggcggccctgagcccgggtgggttgacccgagaacttggctatcgttccaggggcccccaggcgggccaggaatcggccccggggtagggcccggttctgaggtttggggaatcccaccttgcccccctccttatgagttctgcggtggcatggcctactgtggtccccaggtcggcgtgggtctcgtccctcaaggtggcctcgagacctctcagccagagggggaggccggagttggagtggagagcaatagtgacggtgcctcccctgaaccgtgcacggtgacccctggagccgtgaaactggagaaggagaagctcgagcagaaccctgaggagtcccaagatatcaaagccctccagaaggaactcgagcagtttgcgaaactcctaaagcagaaacggattactctcggttatactcaagccgatgttgggctcactctaggcgtgcttttcggcaaagtcttcagtcagactacaatctgtcgtttcgaggctctgcaattgagctttaaaaatatgtgcaagttaagacccctcctacagaaatgggtagaggaggctgataacaatgaaaacctgcaggagatctgcaaggccgagaccctggtacaggcaaggaaacgcaagcgcaccagtatcgagaacagagttagaggaaaccttgagaatctgtttctgcagtgtcccaagcctacgctacagcagatctcccacattgcacaacagctaggcctggagaaagatgtagtaagggtgtggttctgcaaccgtcggcagaagggcaagcgctcctcctctgactacgctcagagggaggacttcgaagctgctgggtctccctttagtggcggtccagtgtcattccccctggcaccgggcccacatttcggaaccccgggctacggcagtcctcacttcacagcgctttattcaagcgtgccgtttccagagggcgaagcctttccgccagtcagtgtgaccactctcggatcgcctatgcattctaac

SEQ ID NO: 18394 - DNA, 1080 bp, Artificial Sequence
  Description of Artificial Sequence: Synthetic coding sequence
atggccggacacctggcctctgattttgcttttagcccacccccgggaggcggaggtgacggacccggcggccccgaaccaggttgggtggatcctcggacctggctgtctttccaaggaccacctgggggacctgggataggccccggtgtaggaccaggatccgaggtgtggggcattccaccatgtcctcctccttatgaattttgcgggggcatggcttactgcgggccacaggtcggcgtaggactcgtgccccaaggcgggcttgagaccagtcagcctgagggggaggcaggtgtgggggtggaatccaactcagacggggcttcgcctgagccatgcacagtaactcctggggctgtgaagctggaaaaggagaagttggaacagaaccctgaagaatcacaggatatcaaagccctgcagaaggagctggaacagttcgcaaagctgctgaaacagaagagaatcacactggggtacacgcaagccgacgtcggattgaccctgggcgtcttgttcggaaaggtgttctcccagaccaccatctgcaggttcgaggctctgcaattgagtttcaagaacatgtgcaaactgaggccgctgctgcagaaatgggttgaggaagcagataataacgaaaacctccaggagatttgcaaggctgagacccttgttcaggcccgcaagcgcaaaagaacaagtatcgaaaatagagtgagaggcaacctggagaacctgttcctgcaatgcccaaagccgacactgcagcaaatctcgcacatcgcacaacagctgggcttggaaaaggacgtggtaagagtgtggttttgcaaccgccgccaaaaaggcaagaggtcgagcagtgattacgcacagcgggaagatttcgaagcagctggcagtccattcagtggcggcccagtttcctttccactggcaccaggcccccactttggcaccccaggctatggttccccccacttcacagctctctactcttctgtgccatttccagaaggcgaggctttcccccccgtctcagtgacaacattaggctctccaatgcacagcaac

SEQ ID NO: 18395 - DNA, 1080 bp, Artificial Sequence
  Description of Artificial Sequence: Synthetic coding sequence
atggccgggcacctcgcctcagattttgcgtttagccctccaccggggggcggaggtgatggaccaggtgggcctgaacctggttgggttgatcctagaacctggctttcctttcaaggtcctcctggtggtccaggaattggaccaggcgtgggacctggctccgaagtgtggggcattccgccttgcccccctccctacgaattctgtggaggtatggcatactgtggacctcaagtgggcgtcggcctggtgcctcagggaggccttgaaaccagccagccagaaggagaagctggtgtgggtgtggaatcaaacagcgatggcgcatcccccgaaccttgtactgtgacccctggagcagtgaagctcgaaaaggaaaaacttgagcagaatccagaagaatcccaagatatcaaggccctgcagaaggaactggagcagtttgcgaagctgctgaaacaaaaacggattacccttggctacactcaagcggacgtgggacttacccttggtgtcctgtttgggaaggttttttcacaaaccaccatttgccgtttcgaagcacttcagctttccttcaagaatatgtgtaagctgaggcccctcctgcaaaagtgggtggaggaagcagataacaatgagaacctgcaagaaatctgcaaggcggaaacccttgtgcaggccagaaagcggaagagaacgtccatcgagaatagagtgcgcggcaacctggagaacctgttccttcagtgtcctaaaccgactctgcaacaaattagccacatcgctcaacaattgggactggagaaggacgtggtgagggtctggttttgtaataggaggcagaaggggaaaaggagttcttccgactacgcgcaacgagaggacttcgaggcagcgggttccccatttagcgggggcccagtgagcttccctctcgcaccaggacctcattttggtaccccagggtacggatcgccacattttactgcgctgtattctagcgttccctttcccgagggtgaggcctttccacccgtcagtgtaaccactctggggtcgccgatgcattccaac

SEQ ID NO: 18396 - DNA, 1080 bp, Artificial Sequence
  Description of Artificial Sequence: Synthetic coding sequence
atggcggggcacctcgctagcgattttgcatttagccctccccctggcgggggaggggatggccccggtgggcctgagccgggttgggtggatccaagaacctggctcagctttcaaggacctccaggaggccctggcatcggacctggagtcggccccggatcggaagtttggggtatccctccctgtcctccaccatacgaattctgcggaggaatggcctactgcgggcctcaagtgggcgtcggtctggtccctcagggtgggctggaaactagccagcccgagggtgaggctggagtgggcgtggagtctaactccgacggtgcatcgccggagccatgtaccgtgactcctggagcagtcaaactggagaaggagaagctcgagcaaaaccccgaggagtcccaagatatcaaagcactgcagaaggaacttgaacagttcgcaaaactcctgaagcagaagaggataacccttgggtacacccaagcagacgtggggcttacgttgggcgtcctcttcggaaaggtcttttcccaaactaccatctgccggtttgaagcacttcagctcagctttaagaatatgtgtaagctgcgtcctcttcttcaaaaatgggtggaggaggcagataacaatgagaatctccaagaaatttgtaaggcagaaactcttgtgcaggcgaggaagcgcaagcggacctccatcgaaaaccgggttagagggaaccttgagaacctttttctgcaatgtccaaagcctactttgcaacaaattagccacattgcccagcagctcggtcttgaaaaggacgtggtgcgagtgtggttttgcaatagacggcagaaagggaaaagatcatcctcggattacgcacaaagagaggacttcgaagcagccggctctcctttttccggtggtcccgtctcctttcctcttgccccggggcctcatttcggcactcccggctacgggtcgccgcactttactgctctctactcctcggtgccatttcctgaaggtgaagcatttccacctgtctcagtgactaccttgggatcgcctatgcatagcaat

SEQ ID NO: 18397 - DNA, 1080 bp, Artificial Sequence
  Description of Artificial Sequence: Synthetic coding sequence
atggccggacacttggcgtcggattttgcttttagcccaccgcctggaggagggggcgatggcccaggcgggcctgagcctggctgggtggatcccagaacttggctctccttccagggccccccaggagggcctgggataggcccgggagtcggaccaggaagtgaggtttggggcatccccccgtgccctcccccgtatgaattttgcgggggcatggcctattgcgggccgcaggtcggggttggcctggtgccacaaggtgggctggagacatcacagccggaaggcgaagcaggggtaggggtggagtccaattctgacggcgcgtctccagaaccctgcaccgtcacacccggtgctgtaaaactcgaaaaagagaagctggagcaaaatcccgaggagtctcaagatatcaaggcattacagaaggagcttgagcaatttgctaaattactgaagcagaagcggatcaccttggggtatactcaggctgacgtcggcctgactctgggagtactcttcggcaaagtgttctcacagaccaccatctgtcgtttcgaagcactacaattgtcgtttaagaatatgtgtaagctcagacccctgctccagaagtgggtcgaggaagctgataataatgagaatttacaggaaatctgcaaagcagagactctcgtacaagcccggaagcgaaaaaggacaagcatcgaaaatagggtccgaggcaacctagaaaacctttttttacaatgtcctaagcctactctgcagcagatcagtcacattgcacagcagcttggcctggaaaaagacgtcgtacgggtctggttttgcaatcgccggcagaaaggaaagaggtcttctagcgactatgcccagagggaggactttgaagctgctgggagcccattctccggaggtccggtttcattcccactcgccccgggcccccacttcgggacacctggatatggctctcctcacttcacagcactttactcctcagttcccttccccgagggtgaggcctttccccccgtgagcgtcactacactgggtagtccaatgcacagtaac

SEQ ID NO: 18398 - DNA, 1080 bp, Artificial Sequence
  Description of Artificial Sequence: Synthetic coding sequence
atggctgggcatctggcctcagactttgccttctcaccccctccaggagggggcggagatggacctggcggaccggagcccggctgggtcgacccgcggacttggctgtccttccaaggcccgccaggcggtccaggtatcgggccgggcgtgggtcccggctccgaagtctggggcatcccgccctgcccaccaccgtacgaattctgcggaggcatggcctactgcggaccacaggtcggggtggggttggtgccacaaggcggtctggaaacctcgcagccggagggagaggcaggtgtgggcgtggaatccaactcagacggagcgtcgccggaaccctgcactgtaaccccaggtgccgtgaaactggagaaggaaaagctcgaacaaaacccagaggaatcacaggacattaaagcgctgcaaaaggaacttgaacaattcgcgaagctgctgaaacagaagaggatcacgctcggatacacccaagcagacgtcggtctgactctcggagtgcttttcggaaaagtgttctcgcaaaccaccatttgtagattcgaagctctgcagctttcgtttaagaatatgtgtaagctgcgcccgctcctgcaaaaatgggtcgaagaggccgataacaatgagaacctgcaggagatctgcaaggctgaaactctcgtgcaagcgcgcaagcgcaaaagaacctcaatcgagaatcgggttcggggcaatctcgaaaatctgtttctgcaatgcccgaagccgaccctgcagcagattagtcatatcgcacaacaactcggactcgaaaaagatgtggtgagagtgtggttctgcaaccgccggcaaaagggtaaaagaagctcatccgactacgcacagcgggaggacttcgaggccgccggatcgccattttcgggtgggccggtgtcattcccgctcgcgccgggacctcacttcggcacccccggatatgggagcccacactttactgcactctacagctcagttccgttccccgaaggagaggcgtttccgccggtgtcagtgaccactctgggttcaccgatgcactctaac

SEQ ID NO: 18399 - DNA, 1080 bp, Artificial Sequence
  Description of Artificial Sequence: Synthetic coding sequence
atggcaggtcatctcgcatctgatttcgcgttttcccctcctccaggaggtggtggagatggaccaggagggcctgaacccggatgggtggaccctaggacttggctgtcgtttcaaggaccaccaggcgggcctggcattggccctggggtgggtcctggctccgaagtgtggggaattccaccatgtccaccaccatacgagttttgcggaggtatggcttactgtggaccccaagtgggagtcggtctggtgcctcaaggaggacttgaaaccagccagcctgagggagaagcaggagtcggagtggaatccaactcggatggagcatcgccagagccctgtaccgtgacgccgggggccgtgaaacttgagaaggaaaagttggaacagaaccccgaagaatcacaagatatcaaagcactgcaaaaggaactcgagcagttcgcaaagctgctcaagcagaagcgcatcaccctcggatacactcaagcagatgtgggtctgacgcttggtgtgctctttggaaaagtgttttcacaaactaccatttgccgcttcgaagcactgcaactgtcattcaaaaacatgtgtaagctccggccacttctccaaaagtgggtggaagaagcagacaataacgagaaccttcaggaaatttgtaaggcagaaactcttgtgcaggcaagaaagcgaaagcgcacctccatagaaaacagagtgaggggcaatctcgaaaatctcttcctgcagtgccctaagccgacccttcaacagatttcccatatagctcaacagcttgggctcgaaaaagacgttgtgcgggtgtggttttgtaaccggcgacaaaaagggaagcggagcagctcggactacgcacaacgtgaggactttgaagcagcaggatcgccttttagcggtggaccggtcagctttccacttgcacctggtccacactttggtactcccggatacggttcaccacacttcactgcattgtactcgagcgtgcccttccctgaaggtgaggcattcccgcctgtgtcggtcaccacccttggatcgcctatgcattccaat

SEQ ID NO: 18400 - DNA, 1080 bp, Artificial Sequence
  Description of Artificial Sequence: Synthetic coding sequence
atggccggacacctggcgtcagattttgctttctccccacctcccggtggaggcggcgatggcccaggagggccggaaccaggttgggttgaccctcgaacttggttgagcttccaggggccacccggtggccctggaataggccctggtgtcggccccggcagcgaagtgtggggcattcctccctgcccaccaccttacgaattctgcggaggcatggcctattgcgggcctcaggtaggtgtgggcttagtgcctcaaggaggattggaaacctcacaacctgagggagaggccggcgtgggagtggaaagcaattctgacggtgcatcaccggagccttgcactgttacgccaggtgccgtgaagctggagaaggaaaagctcgagcagaatcccgaagaaagccaggatattaaggcactgcagaaagaactggagcagttcgcaaagcttcttaagcagaagaggattaccctgggctatactcaggcagacgtgggactgacactgggggtgctcttcggtaaggtttttagccaaacaaccatctgtcgttttgaagcactccagctatcattcaagaacatgtgtaagctgaggcctcttttgcagaaatgggtagaggaagctgacaacaatgaaaacctgcaggagatttgcaaggcagagacattggtgcaggcgaggaagcggaagcgcacttcaattgagaatagagtcagaggaaacctcgagaatctgtttttgcaatgcccaaagccaacgctgcagcagatcagtcacattgcgcagcagttgggtttggaaaaagatgtcgtccgggtgtggttttgtaatagaagacagaaggggaagcgaagctcaagtgactatgcccagcgagaggatttcgaagctgccggaagcccattcagcggcggtccagtaagtttcccgctcgcaccagggccgcattttgggaccccagggtacggctcccctcacttcacagcgctttactcatcggtgccattccccgagggagaagccttccctcccgtgagcgtaaccacgctgggctccccaatgcattccaac

SEQ ID NO: 18401 - DNA, 1080 bp, Artificial Sequence
  Description of Artificial Sequence: Synthetic coding sequence
atggccggacacctcgcctcggattttgccttctcgcccccacctggcggaggtggggacggccccggaggtcccgagccaggatgggtggacccacgaacttggctcagctttcagggtccgccagggggacccggaattggtccaggggtgggaccggggtccgaagtgtggggaatcccaccgtgtccgccgccgtacgaattctgcggcggaatggcgtactgcggcccccaagtcggagtgggcctggttccgcaagggggattggaaacttcccagcctgaaggcgaggccggcgtcggagtggaatccaactcggatggggcctcgccagagccgtgcactgtgacgccgggagccgtgaagctggagaaggagaaacttgaacagaacccagaagagtcgcaggacatcaaggctctccaaaaagaactcgagcagttcgcgaagctcctgaagcaaaagcgcatcacgctggggtacactcaggccgatgtcggcttgactctgggagtcttgttcggcaaagtcttttcgcagaccaccatctgcaggttcgaggcacttcaactgtcgttcaagaatatgtgtaagctgcggccactgctgcaaaaatgggtagaagaagctgacaacaacgaaaacctgcaggagatctgcaaggctgaaaccctggtgcaggcacgcaagcgcaaacgtacctcgatagagaatagggtaaggggcaaccttgaaaatcttttcctgcaatgcccgaagcccactctgcagcaaatctcgcatattgcccaacagctcggcctcgaaaaggacgtggtgagagtctggttctgtaaccggcgccaaaagggcaagcgctcctcaagcgactacgcacagcgggaggattttgaagccgccggctcgccgttctcaggaggcccggtgtcgtttccgctcgcgccgggtccgcacttcggaacccctggatatggttccccgcatttcaccgccctctactcctcagttccgttcccggagggagaagcattcccaccagtttcagtgactaccctgggatcaccgatgcactccaac

SEQ ID NO: 18402 - DNA, 1080 bp, Artificial Sequence
  Description of Artificial Sequence: Synthetic coding sequence
atggcaggacacttggcgtccgacttcgctttctccccaccgccgggaggtggtggggatggaccaggaggaccggagccgggctgggtggaccctagaacctggctgtccttccaagggcctccgggagggccgggaatcgggcccggcgtcggcccaggttccgaggtgtgggggattcctccatgccctcctccctacgaattttgtggcggtatggcctattgcgggccacaggtcggtgtgggactggttcctcagggaggactggaaacctcacagcctgaaggcgaagcgggagtgggagtggagtccaatagcgatggagcttcgcctgaaccctgcactgtgactcctggggcggtgaagctggagaaggaaaagctcgagcagaatccggaagagtcccaggatatcaaggcccttcaaaaggaacttgagcagtttgctaagttgctgaagcagaaaaggatcacccttggctacacgcaggcagatgttggactcactctgggcgtgctctttggaaaggtattctcacagacgaccatctgtcgcttcgaagccttgcagctttcttttaagaacatgtgcaagctgcgcccgctgctgcagaagtgggtggaggaagcagacaacaacgagaacctgcaggaaatctgcaaggccgagactctggtccaagctcgcaagcggaagaggacctccattgagaaccgggtgcgcggcaacctggagaacctgttcctccagtgccctaaacctactctccagcagatatcgcatatcgcccagcaactcggcctggaaaaggacgttgtgcgggtgtggttctgcaacagacggcaaaaaggaaagagatccagctcagattacgctcaacgggaggacttcgaggcggccggctcaccgttcagcggaggaccggtgtccttcccgcttgcaccgggcccacacttcggcaccccaggatacgggtccccccattttaccgccctttactccagcgtgccctttccggaaggagaggcgttccctccagtgtcagtgaccactctgggatcaccaatgcactccaac

SEQ ID NO: 18403 - DNA, 1080 bp, Artificial Sequence
  Description of Artificial Sequence: Synthetic coding sequence
atggctggacacctggcaagtgacttcgctttcagtcctcccccaggcggcgggggggacggccccggcggtccagaacctggctgggtagatcctcggacatggctgagcttccagggaccacccggcggccctggaattgggccaggcgttgggcccggctctgaggtctggggtatccctccatgtcccccgccttacgagttttgtgggggaatggcttactgcgggcctcaagttggagtcggacttgtaccccagggtggcttggagacaagtcagcccgaaggcgaagccggtgtgggagttgagtctaatagcgatggcgctagtcccgaaccgtgcacagtgacgcccggcgctgtgaagctagaaaaagagaagctggagcagaacccagaggagtcgcaggatatcaaggccctgcaaaaggaattagaacagttcgctaaattattgaagcagaaacggatcactttaggatatacccaggctgacgttggtctcacgttgggcgtcttgtttggcaaggtgttctcacaaactaccatctgcaggttcgaggcacttcagctgtcctttaaaaacatgtgcaaactccgccccctgctgcagaagtgggtcgaggaagcggataataacgagaatctgcaggaaatttgtaaagccgagaccctcgtgcaggcaagaaaacggaagaggacgagtattgaaaacagagtgcgtgggaacttggagaacttgttcctccagtgcccaaaaccaactcttcagcagatctcgcatattgcccagcagttggggttagaaaaggacgttgtccgggtgtggttttgtaaccggcgccagaagggcaagcggtcatcgtccgattatgcacagcgagaggacttcgaagctgctggatcccctttcagtgggggaccggtgagcttccctcttgccccggggcctcattttgggactcctggctacggatccccccacttcactgctctgtactcttctgtaccattcccggagggggaggccttcccacccgtttctgtgacgacactcggttcccctatgcacagcaac

SEQ ID NO: 18404 - DNA, 1080 bp, Artificial Sequence
  Description of Artificial Sequence: Synthetic coding sequence
atggccgggcatcttgcttcggatttcgccttctcccctcctcctggaggaggaggagatggccccggcgggcccgagcccggatgggtggaccctaggacctggctctcctttcaggggccacctggtggtcccggtattggccccggagtcggccctggaagcgaagtctgggggatcccaccttgtccgccaccatatgagttctgcggcgggatggcctactgcggaccccaggtgggcgtgggactagtgccacaggggggactggagacatcccaacctgagggagaggcaggagtgggggtggaatctaactccgacggtgctagtcccgaaccttgcactgttactcctggggcagtcaagctcgagaaggagaagcttgaacagaatcccgaagagagccaggacatcaaggctctgcagaaggaactggagcagttcgccaaactgctgaagcagaagcgcattacactggggtacacacaggctgacgtgggtctgaccctgggtgtgctgtttggaaaggtctttagccagacaacgatctgtcgctttgaggctttgcaactctcgtttaagaatatgtgcaagctcaggccattattgcaaaaatgggtggaggaggcggataacaatgagaatctacaggagatctgcaaggcggagactctggtgcaggcccggaaacgcaaaagaacttccatcgaaaaccgcgtgcgtggtaatctagagaacctgtttcttcagtgtcctaagcccaccctgcagcagataagtcacattgcccagcagctggggctggagaaggatgtcgtgcgagtctggttttgcaaccggagacagaagggcaaacgttctagcagcgattatgctcaacgggaggactttgaagccgcaggcagccccttctccggtgggcccgtgtcttttccattggcgcctggtccccacttcggtactccaggatacggctcacctcacttcaccgcattgtattccagcgtaccgtttcccgagggcgaggcatttccaccagtcagtgtgaccactttagggtctcccatgcacagtaat

SEQ ID NO: 18405 - DNA, 1080 bp, Artificial Sequence
  Description of Artificial Sequence: Synthetic coding sequence
atggccggacacttagccagcgacttcgccttctctccgccccctggcggcgggggtgacggaccagggggacctgaacctggatgggttgatccacgtacttggctgagttttcaggggccaccaggcggcccagggatcggccccggggtggggcccggctctgaggtttggggaattcctccgtgcccacccccttacgaattctgcggaggtatggcctactgcggtccgcaggtgggcgtgggcctggtccctcaaggtgggttggagacctcacaacctgagggtgaagctggagtgggagtagagtccaatagtgacggcgcttcaccagaaccgtgtacggtgacccccggcgcagtgaagctagaaaaagagaagctggaacagaatcccgaggagagtcaggacatcaaagcccttcaaaaagagctggaacaattcgccaaactgctgaagcagaaacgcattactttgggttacacgcaggccgatgtcggcctcacgctcggcgtcctctttgggaaggtgttctcgcagactaccatctgtagattcgaagcgctgcaactgtcattcaagaatatgtgtaagctgagacccctgctccagaagtgggtggaggaggcagataacaacgagaacctccaagaaatatgcaaggctgagacccttgtgcaagcacgcaaacgcaagcgtacttctatcgagaatcgggtgcggggcaatctggaaaacctctttttacagtgtccaaagcccactttgcaacagatctctcacatagcccagcaacttggtctagaaaaagacgtggtgagagtctggttttgcaatagacgccagaaggggaagcgttcttcttcggactacgcccagagggaggattttgaggccgcgggctcaccattctctggcgggcccgtgtctttccctctcgcccccggcccgcactttgggaccccaggatacggtagcccacacttcaccgcgctttactcctcagtcccgttccccgaaggagaagccttcccacctgtgtcagttactactctgggctcccccatgcactctaat

SEQ ID NO: 18406 - DNA, 1080 bp, Artificial Sequence
  Description of Artificial Sequence: Synthetic coding sequence
atggccgggcacctggcgtccgattttgcattctcaccccctcctggaggagggggagatgggccaggggggcctgaacccgggtgggtagatcccaggacttggctctccttccaggggccccctggagggcctggaatagggcctggggtgggacctggatctgaagtctgggggatacctccatgcccacccccctatgagttctgcggggggatggcctattgtggaccccaggtcggggtcgggttggtaccacaagggggacttgagacttcccagcctgaaggggaagctggggtgggggtagaatcaaactccgatggggcctcccccgaaccatgcacagtgactcctggagcagttaaactcgaaaaagagaaactagaacagaatcccgaagaatcacaggatatcaaagccctccagaaggaactagaacagtttgcaaaattgctcaaacagaaaaggatcactcttgggtatactcaggccgacgtgggactcacattgggagtgctctttgggaaggtgttttcacaaacaactatctgtagattcgaagccctgcaactttcttttaaaaatatgtgcaaacttaggccccttctacaaaaatgggttgaagaagccgacaacaacgaaaacttacaggaaatatgcaaagcagaaacactagtccaggcaaggaaaaggaaacgaacttctattgagaatcgggtccgcggaaacctggaaaatttatttctacagtgccccaaacccacactgcaacagattagtcatatcgcacagcagcttgggttggaaaaagatgtagtgcgcgtttggttttgcaacagacgacagaaagggaagcgctcgtcttccgattatgcacagcgcgaggatttcgaagcagctgggagtcctttttcaggagggcccgtgtcatttcccctagctcccggaccacatttcgggactcctggatatggatcaccccacttcactgctctttattcttccgtcccattcccagagggggaagcctttcctccagtctctgtaactactctggggtctcctatgcacagtaat

SEQ ID NO: 18407 - DNA, 1080 bp, Artificial Sequence
  Description of Artificial Sequence: Synthetic coding sequence
atggctggccacctggcatccgacttcgcgtttagcccccctcctggaggaggaggagacggcccgggaggacctgagccaggttgggtggatccaaggacttggctgtcgtttcaaggaccccctggcgggcctggtatcggaccaggagtgggtcctggatcagaggtctggggaattccaccttgccctcctccatacgaattctgtggcggaatggcctactgtgggccgcaagtgggtgtgggacttgtgccgcaaggaggtcttgagacttcccagccagaaggtgaggcaggtgtgggtgtggaatcaaattccgacggcgcaagccccgaaccatgtactgtgacccctggagccgtgaaactcgaaaaggagaagctcgaacagaatccggaggagagccaggatatcaaggcactgcagaaagagcttgagcagtttgcgaagctcctgaagcagaagagaattacgctcggatacactcaagcagatgtcggacttaccctgggtgttctgttcggtaaagtattcagccaaactaccatctgtcgtttcgaagcgttgcaactcagctttaagaacatgtgtaaactgcggccactgctgcaaaagtgggtggaagaagcagacaataacgagaatctgcaagaaatttgcaaagccgaaactttggtgcaagcacggaaacgtaagcgtacttcgatagaaaacagggtgcgaggcaacctggaaaacctttttcttcaatgtcctaagcctaccctccagcaaatttcacatatcgctcagcagctcggtctggaaaaggatgtggtgcgggtgtggttctgtaatagacggcaaaagggtaagcgttcaagctcggactatgcccagcgtgaagattttgaagcagcgggatcgccattcagcggagggcctgtgtcgtttcctctcgcaccaggaccccattttgggacccctggttacggaagcccacattttaccgcactttactcctccgtcccattcccagaaggtgaagccttccctccagtgtccgtgaccaccctcggatcacctatgcactctaat

SEQ ID NO: 18408 - DNA, 1080 bp, Artificial Sequence
  Description of Artificial Sequence: Synthetic coding sequence
atggccggacatctggcatcagattttgcgttcagcccacctcccggtggaggcggtgacgggcctggcggcccagaaccaggatgggtggatccgaggacttggttgagctttcaaggaccaccaggagggcctggaattggtccaggtgtcggaccaggatcggaagtctggggaattcctccctgccccccaccttacgaattctgcggtggtatggcatactgtggaccccaggtgggagtgggactcgtgccacagggtggtctggaaacctcccaaccagaaggtgaggctggagtgggcgtggaatcgaattccgatggtgcgagccctgagccctgtaccgtcacccccggtgcggtgaagttggagaaggagaagctggagcaaaatcccgaagagtctcaagacataaaggcgctgcaaaaggagctcgaacaattcgcaaagctgctcaaacaaaagcggatcactctcggatacactcaggcagatgtaggactcaccctgggagtgttgttcggcaaagtctttagccagaccaccatttgtaggtttgaggcactgcagctgtcgtttaagaacatgtgtaagctcagaccactgcttcaaaagtgggtggaagaagcagacaacaatgaaaatcttcaagaaatttgtaaggcggaaactctggtgcaggcgcgcaagagaaagcgaacctcaatcgagaacagagtccggggaaacctggaaaatctgttccttcaatgtccaaaaccaactctgcaacagatttcacatattgcacaacaacttgggctcgaaaaggacgtggtccgggtgtggttttgtaataggagacaaaagggaaagaggtcctcaagcgattacgcacaacgggaagatttcgaggccgcaggatcaccgttttccggcggacctgtcagctttccgctcgcccctggcccacatttcggcacccccggctacggttcccctcactttactgcactttactcctccgtccctttcccggagggagaagcatttcctcctgtctccgtgaccactcttgggtcacctatgcactcaaac

SEQ ID NO: 18409 - DNA, 1080 bp, Artificial Sequence
  Description of Artificial Sequence: Synthetic coding sequence
atggccgggcacttggccagtgacttcgccttcagcccacctcctggaggggggggggacggccccggaggtcctgagccgggctgggtcgacccccgaacatggctgtctttccaagggccacccggtggcccagggatcggcccgggtgtgggacccggatctgaggtatggggcatacccccatgtcccccaccttatgagttttgtggaggcatggcctactgcggcccgcaggtgggcgttgggctggtgccacagggcggactggaaacttcccagccagagggagaagccggggttggtgttgaatctaacagtgatggtgcatcgcctgaaccttgcacggtcacccccggtgccgtcaaactagaaaaagaaaagctggagcagaatcctgaggagagccaggatatcaaggccctccagaaagaattggaacaatttgccaagttattgaagcagaagaggataactcttgggtacacacaggctgacgtgggtctgactctaggcgtgctttttggtaaggttttctcacagaccactatctgtaggttcgaggccctgcagctttcctttaaaaacatgtgcaaactgcggcccctgttacagaaatgggttgaggaggcggataataatgagaatctgcaggagatctgcaaggccgaaacactcgtccaggctaggaagaggaaacgcacatctattgaaaaccgggtcagaggcaatctggaaaatctgtttctccagtgccccaagccaacccttcagcagatcagtcacatcgcgcagcagcttggcttggagaaggacgttgtaagggtgtggttctgcaaccggagacagaagggaaaacgcagttctagcgattacgctcaacgagaggatttcgaggcggctggatcgcccttttctggtggtccagtgtcatttcctctcgcccctggccctcattttggcactccaggctacggtagtccccattttaccgctttgtattcttccgtgcctttcccagaaggagaggcatttcctcctgtctcggtgacaactctaggttcccctatgcacagtaat

SEQ ID NO: 18410 - DNA, 1080 bp, Artificial Sequence
  Description of Artificial Sequence: Synthetic coding sequence
atggccggtcaccttgctagcgattttgcgttctcccctccaccaggcgggggaggagacggacccggcgggcccgagccaggatgggtcgatcccaggacctggttaagcttccagggtccgccagggggacccggaatcggccccggcgtgggccctgggagcgaagtctggggaatccccccgtgccctcctccttacgagttctgtggtggaatggcgtattgcggcccccaggtgggggtcgggctcgtaccccaaggagggctggagacaagccagcccgaaggtgaagcaggggttggagtggagagcaactctgatggagcttctcctgaaccttgcacagttacccccggtgccgtgaagctggagaaagagaagctggagcagaaccccgaagaatcgcaggacattaaggcgctacagaaggaactggaacagttcgccaaacttctgaagcaaaaaagaattaccttggggtatacacaagctgacgtgggcctgactctgggagtgctgttcggtaaagttttttcacagacaaccatttgtaggttcgaagccctgcagttgagttttaagaacatgtgtaaactccgccctctcctacaaaagtgggtcgaagaggccgacaataacgaaaacctacaggagatctgtaaggccgaaacgctagtgcaggcacggaaacgcaaacgaacaagcattgaaaatcgcgtgcgcggtaacctggaaaacctgtttctccaatgccctaaacctacactccaacaaatcagccatatagctcagcagctggggctagaaaaagacgtagtgcgcgtctggttttgcaatcgccgacagaagggcaaaaggagtagttctgactacgcacagcgtgaagactttgaagcagcgggcagcccctttagtggtggtcccgtgtccttccctctcgctcccggcccacatttcggaacacccggctacgggagccctcactttaccgctctgtacagctccgtgccatttcccgagggcgaggcctttccccccgttagcgttactaccctcggtagccccatgcattccaat

SEQ ID NO: 18411 - DNA, 1080 bp, Artificial Sequence
  Description of Artificial Sequence: Synthetic coding sequence
atggcaggacacctggcatctgacttcgctttttccccccctcccggcggcggtggcgatggacctgggggaccggagccagggtgggtggaccctcgaacttggctgagttttcaaggacctcctggaggcccaggtatcggcccaggtgtggggccaggctcggaggtttgggggatccctccatgcccgcctccctatgaattctgtgggggcatggcctactgcggtccccaggttggagttgggcttgtgccacagggcgggctggagacgagccagccggagggcgaggctggagtgggagtggagtctaacagtgatggggcttcccccgagccgtgtaccgtgacacccggcgcagtgaaactcgagaaggagaaactggaacagaatcccgaggaatcccaggacataaaggccctgcagaaggagttggagcagttcgcaaagctgctgaaacagaaaaggataaccctcgggtacactcaggctgatgtcggcctgaccctgggcgtcctgtttgggaaggtattctcccagacaaccatctgcagattcgaagcactccagctgtcttttaagaacatgtgcaaactccgcccactgctccagaagtgggttgaagaagccgataacaacgaaaaccttcaggagatctgtaaagctgaaactctcgttcaagccaggaagagaaagcgtacatcgatcgaaaacagggtcagggggaatctggagaacctcttccttcagtgtcccaagcccacgctgcagcagattagtcatatcgcacaacagttaggtctcgagaaagatgtagtgagggtgtggttctgtaaccgtcgtcagaaaggcaagagatctagctccgattacgcgcagagagaagacttcgaggccgcgggatcacccttctccggaggtccagtgtctttccccttggcccccggtccccactttggaactcccgggtatggttccccccactttacggccctgtactcaagtgtcccgtttcccgagggcgaagcttttccaccggtgtcggtgaccaccctcggatcacctatgcattctaac

SEQ ID NO: 18412 - DNA, 1080 bp, Artificial Sequence
  Description of Artificial Sequence: Synthetic coding sequence
atggctgggcacctggcatctgatttcgcattctcaccaccacccgggggtgggggtgacggcccagggggccctgaaccaggctgggtggacccgaggacatggctgtcgttccagggcccgccaggaggacccgggattgggccaggcgtgggcccaggatctgaggtatggggcatcccaccttgcccccccccctacgagttctgcgggggaatggcctactgcggacctcaagtcggcgtaggtctcgtcccccaggggggcttggagacctctcagccggagggtgaagcgggcgtgggggtggaaagtaatagtgacggcgctagtcccgagccctgcacagttacacccggtgccgtgaagttggagaaagaaaagttagaacaaaatccggaggagagccaggacatcaaggctttacagaaagaactggaacagtttgcaaaacttttgaaacagaagcgcatcaccctggggtatacccaggcggacgtcggcctgaccctcggggtgctgtttggcaaggttttttctcagacaaccatctgcaggttcgaggccttgcagctctcctttaagaacatgtgcaaactgcggccactgctccagaagtgggtggaagaagcagataataatgagaatttgcaggaaatttgcaaagcagaaaccctggttcaggcgaggaagcggaagagaacctcaatcgaaaatcgagttagaggaaaccttgaaaacttatttctgcagtgcccgaagcccaccttacagcaaattagtcacatcgctcaacagcttggtctcgagaaagacgttgtgcgggtgtggttttgtaatcgccggcaaaaaggaaagcggagcagttctgactacgcccaaagggaagacttcgaggccgctggttcaccatttagcggaggaccagtgtcattcccgctcgcacccggccctcactttggcacccctggatatggaagtcctcactttaccgccctctacagctcggtgccttttcccgaaggagaggcgtttccccctgtttccgttacgacattaggttctcctatgcacagtaac

SEQ ID NO: 18413 - DNA, 1080 bp, Artificial Sequence
  Description of Artificial Sequence: Synthetic coding sequence
atggccggtcacctggcctccgactttgcattctctccgccaccgggtggaggaggcgatggccctggcgggcctgaaccgggatgggtggatccgcgcacgtggctgtcgtttcaagggccccccggtggcccaggtatcggtcccggagtggggccgggttccgaagtgtggggaatcccgccatgtccgccgccatatgaattctgcggggggatggcatactgcggcccacaagtgggagtgggcctggtcccccaaggaggtctggagacttcgcagccggagggtgaagcgggggtcggcgtggaatccaacagcgatggcgctagcccggagccatgcaccgtcacgccgggagcagtgaagttggagaaggagaagctcgaacagaacccggaagagtctcaagacattaaggctctccagaaggagctggaacagttcgctaaactgctgaagcagaaacgcattaccttgggatacacgcaggccgacgttggcttgacccttggagttctcttcggcaaggtcttttcccagaccactatttgccgcttcgaggctctgcagctctcgttcaagaacatgtgtaaactccggccgctgcttcagaaatgggtggaggaagctgacaataacgagaatctgcaagaaatctgcaaggccgaaaccttggtccaggcgagaaaacggaagaggactagcatcgaaaaccgagtgcgcggaaatcttgaaaatctgtttctgcaatgcccgaaaccaacgctccaacagatctcccacatcgctcaacaactgggacttgagaaggacgttgtgcgggtgtggttctgcaaccgccgtcaaaaaggaaagagatccagctccgactacgcgcagagagaagattttgaggccgcgggcagcccgttctccggaggcccagtgagcttcccactggccccaggaccgcattttggcactccgggttacggctcacctcacttcaccgccctttactcgtcagtgccattccccgagggcgaagcgttccctcctgtttcagtgaccactctcgggagcccaatgcattcgaac

SEQ ID NO: 18414 - DNA, 1080 bp, Artificial Sequence
  Description of Artificial Sequence: Synthetic coding sequence
atggccggccacctggcctcagattttgcattctcaccaccccccggcggggggggagacggtccaggtgggccagagcctgggtgggttgaccctagaacgtggctgtcctttcagggacctcccgggggaccgggtattggaccaggtgttggccccgggtccgaggtgtggggcataccaccctgcccacctccttacgaattttgcgggggcatggcatattgcggccctcaggtcggagtcggactcgtcccccaaggcggccttgaaacaagtcagccagagggtgaggctggcgtgggggtggagagtaacagcgacggcgcaagtccagaaccttgcactgtgaccccaggagcggtcaagctggaaaaggagaaactggaacagaatcctgaagagagtcaggacatcaaggctctccaaaaagaacttgagcagttcgccaaattgctgaagcaaaagaggataacccttggatacacacaggccgacgtaggactaactctgggcgtcctattcgggaaagtgttttcccagactacaatctgtaggttcgaggcactgcaactctcctttaagaacatgtgtaagttgagaccgttgctccagaagtgggtcgaagaagcagataacaatgaaaatctccaagagatctgcaaggcggagacactggtgcaggccagaaagcgcaaaaggacctctatcgaaaatagggtgagaggcaacctggaaaacttgttcctacagtgtcctaaaccaacactgcagcaaatttcccacatcgctcagcagttgggacttgaaaaggacgtggttcgtgtatggttctgcaaccgcaggcaaaaaggcaagcggtcctccagtgactacgctcagagagaggatttcgaggcggctggcagccccttctctggaggccctgtatcatttcccctggcacccgggcctcacttcggtacccctggatatgggagtcctcactttactgcactgtatagttctgttccctttccagaaggggaagcattccccccagtttctgtaacaaccctgggctcccctatgcacagtaat

SEQ ID NO: 18415 - DNA, 1080 bp, Artificial Sequence
  Description of Artificial Sequence: Synthetic coding sequence
atggctggtcatttagctagtgattttgcttttagtccaccaccaggaggaggaggagacggaccaggaggtccagaacctggatgggttgatccaagaacttggctttctttccaaggaccaccaggaggtcctggtattggaccaggtgttggtccaggatcagaagtttggggaattccaccatgccctccaccatatgaattttgtggtggaatggcatattgtggtccacaagtcggtgttggtttagttccacaaggagggttagaaacaagtcaaccagaaggtgaagcaggagtaggagttgaatctaatagtgatggagcatctccagaaccatgtactgtaactccaggagctgttaaattagaaaaagaaaaattagaacaaaatccagaagaatctcaagatattaaagctttacaaaaagaacttgaacaatttgcaaaattactaaaacaaaaaagaataactcttggatatactcaagcagatgttggattaacgctaggagttttatttggaaaggttttctctcaaactactatttgtagatttgaagctttacaacttagtttcaaaaatatgtgtaaacttagaccattgttacaaaaatgggtagaagaagcagataataacgaaaatttacaagaaatttgtaaagcagaaactttagttcaggcaagaaaaagaaagcgaacttccattgaaaatagggtaagaggaaatcttgaaaatttattcttacaatgtccaaaacctactttacaacaaatttctcatattgcacaacaattaggtcttgaaaaagacgtagttagggtatggttctgtaatagacgtcaaaaaggtaagagatcatcatcagattatgctcaaagagaagactttgaagctgcaggatctcctttttctggaggaccagttagtttcccattagcacctggaccacattttggaacacctggatatggttcaccacattttacagcattatattctagtgtaccattcccagaaggagaagcatttccaccagtttccgttactactttaggatcaccaatgcattcaaat

SEQ ID NO: 18416 - DNA, 1080 bp, Artificial Sequence
  Description of Artificial Sequence: Synthetic coding sequence
atggcgggacatctggcatctgacttcgcattctcgcctccgccaggaggaggtggagatggacctggagggccagaacctggatgggttgatccccgcacgtggctcagcttccaaggaccacctggaggaccgggcatcggaccgggtgtgggacccgggagcgaggtgtggggcattccgccttgtcctcccccgtacgagttttgtggcggcatggcctattgcggcccccaggtgggagtgggactggtgccgcaaggaggactcgaaacttcgcagccggagggtgaagctggcgtcggcgtggagtcgaactccgacggggcttccccggaaccgtgtaccgtgactccgggagccgtgaagctggaaaaagagaagctggaacagaaccctgaggagtctcaggatatcaaggccctccagaaagaactggaacaattcgcgaagctgctcaagcagaaacgcatcaccctcggatacacccaggccgatgtgggactcaccctgggagtgctgttcggaaaagttttctcgcagaccactatctgtagatttgaagcgctgcagcttagctttaagaatatgtgcaaactgcgccctctgctccaaaaatgggtggaagaggccgataacaatgaaaacctgcaagagatctgcaaggccgagactctggtgcaggcacggaagcggaaacggactagcattgagaatagggtcaggggaaatctggaaaatctcttcctgcagtgtccgaaacccacccttcagcaaatcagccacattgcgcaacagctcgggctggaaaaggacgtcgtgcgcgtctggttctgcaaccgcagacagaaagggaagcgctcctccagcgactacgctcagcgcgaggatttcgaagcggcgggatcgcctttctcaggcggacctgtcagcttccctctcgcgccaggccctcactttggtaccccgggatatggatcgccgcattttacggctctctactcatccgtgccgttcccggaaggggaggctttcccccctgtgtctgtcaccactttgggcagcccgatgcactcaaac

SEQ ID NO: 18417 - DNA, 1080 bp, Artificial Sequence
  Description of Artificial Sequence: Synthetic coding sequence
atggccggtcatctggcctctgatttcgcttttagccctccacctggtggtggtggggatgggccaggcggaccagagcccggttgggtcgatccgcgcacatggctctctttccaggggcctcccgggggacctgggattggtcctggcgttgggccggggagcgaagtttggggaatacccccttgcccgccaccatacgaattctgtggcggtatggcttattgcggaccacaagtcggtgttggattggtcccacaaggtggtttggaaacttcacagcctgagggcgaagccggagtgggcgtcgaatccaatagtgatggtgcctctccggagccatgtacagttacacctggtgcagtaaaactggaaaaggagaagctagagcaaaatccagaggaatctcaagacatcaaagctttgcagaaggagttggagcaatttgctaagttgcttaagcagaaacgaataacgttggggtacacccaggcggatgtgggactcacgctcggagtccttttcgggaaggttttttcacagaccactatctgtagattcgaagcactccagttatcatttaagaatatgtgcaagctgaggccactgcttcaaaagtgggtggaggaagcagacaacaatgagaatctacaggaaatctgcaaggctgagactttagttcaggcacgtaaacgaaagcgaacctctatcgagaacagagttagagggaatcttgagaatctcttccttcagtgccctaagcctactttacaacagataagtcatatcgctcaacaattaggacttgagaaggatgttgtgagggtgtggttctgtaatcgtagacaaaaaggtaaaagatcaagctcagattacgctcagagagaggatttcgaggctgccggtagtcctttctcaggtggcccagtttcattcccgctggcccctggccctcacttcggcaccccagggtatggtagtccacacttcacggctctctattcatctgtgcccttccccgaaggcgaggcgtttcctcctgtcagcgttaccacacttggatctcctatgcactctaac

SEQ ID NO: 18418 - DNA, 1080 bp, Artificial Sequence
  Description of Artificial Sequence: Synthetic coding sequence
atggccggacacctggcaagcgacttcgcattttccccaccaccgggtggcggaggcgacggaccaggaggaccggagccaggatgggtggaccctcggacctggctctcctttcaaggccctccaggcggacctggaattggaccaggtgtcggtccaggaagcgaagtctgggggatacctccctgccctccaccttatgaattctgcggcgggatggcctactgtggtccacaagtcggcgtgggccttgtcccccagggtggactggaaaccagccaaccagaaggtgaggcgggcgtgggagtggaatccaacagtgacggcgcgtcccccgaaccttgcacggtgactccaggagcggtcaaacttgagaaggagaagttggaacagaaccccgaagaaagccaagacattaaggccctgcagaaggaactggaacagtttgcaaagctgttgaagcaaaagcggattacgctgggttacacgcaagcagacgtcgggctgacgctcggtgttctgtttggtaaggtgtttagccaaaccaccatctgtagatttgaagcacttcaattgtcgttcaagaatatgtgcaagctccgaccacttctccagaagtgggtggaagaggccgacaataatgagaatctgcaagaaatttgtaaagcagaaaccctggtccaggcacggaagaggaaaagaactagcatcgaaaatcgggtgcgggggaacttggaaaacctgtttctgcagtgcccaaagccgaccctgcaacagatttcacatatcgcacaacagctcggactggaaaaagatgtggtgagagtgtggttttgcaacagacgccagaagggtaaaaggtcatcgagcgattacgcacagagagaggattttgaagcggcaggctccccgttctcaggaggcccagtttcatttcctcttgcacccggaccccatttcggtactcccggatacggatcgcctcatttcactgctctgtactcctcagtgcccttcccggaaggagaagcattccctcccgtgtccgtgaccacgcttggatcgcctatgcactcaaac

SEQ ID NO: 18419 - DNA, 1080 bp, Artificial Sequence
  Description of Artificial Sequence: Synthetic coding sequence
atggcaggccatttggcatccgactttgcctttagccccccacctggtggtggaggggacggacctgggggccctgaaccaggttgggtggacccacgaacctggctttcctttcagggtccaccgggtggaccggggattggaccaggtgtgggtcctggatccgaggtgtggggtattcccccctgtcctcctccatatgagttctgcggtggtatggcgtactgtggacctcaagtcggtgtcggcctcgtgccgcaaggcggactggagacttcgcaacctgaaggggaagccggagtgggtgtagaatccaactccgatggagcatcgcccgagccttgcactgtcactcctggggccgtcaaacttgaaaaggaaaagctggagcaaaaccccgaggagtcgcaagatatcaaggcattgcagaaggagcttgagcagtttgcaaagttgctgaagcaaaaaaggattacccttggatacacgcaagcagatgtgggtctgacccttggcgttcttttcgggaaagtcttttcgcaaaccacgatttgtcgttttgaagcgttgcaactttcctttaagaacatgtgtaagctgcgcccccttctgcaaaaatgggtggaggaagccgacaataacgaaaacctccaggaaatatgcaaggcagaaaccctggtccaggcccggaagcgtaaaagaacctcaatagagaatcgggtgcgcggcaatcttgagaatcttttccttcaatgtccaaagccgactctccagcagatctcgcatatcgctcagcagctgggactggaaaaagatgtcgtgagggtgtggttttgcaaccgcagacaaaagggcaaacgttccagctcagattatgcacaacgggaagatttcgaagcggcaggcagtcccttcagcggtggtccagtctcatttccactggcgccagggccacacttcggcaccccgggatacggctcacctcactttactgccctctactcgagtgtgcctttcccggagggagaggcctttcctcctgtctcggtgactactctgggttcacccatgcattccaat

SEQ ID NO: 18420 - DNA, 1080 bp, Artificial Sequence
  Description of Artificial Sequence: Synthetic coding sequence
atggctggtcaccttgccagcgacttcgcattttcgccgccgccaggaggcgggggcgacggacctggcggcccggagcccggctgggttgacccgcgaacatggttaagcttccagggcccccctggtggtcccgggattggtcctggtgtaggacctggatcagaagtttggggtatcccaccctgcccccccccatacgagttctgtggaggcatggcctactgcggcccacaagtaggcgttggcctggtgccacaaggcggtttggaaacatcccagccagaaggtgaggctggagtgggcgtcgagtcgaatagtgatggagccagtcccgagccctgcacagtcacgccaggggcagtcaagctggagaaagagaagctggagcagaaccctgaggagtcccaggacattaaagcgctgcaaaaggagttggagcagttcgctaagctgctgaagcagaagagaatcacccttgggtatacgcaggccgatgtgggactaacacttggcgtgctattcggcaaggtattcagccagacgacaatttgccgttttgaggctttgcagctctcattcaaaaacatgtgcaagcttcgccctttgctccagaagtgggttgaggaggccgacaacaacgagaacctgcaggaaatctgcaaggccgagactctggtgcaggcgcgaaaaaggaaacgcacctcgattgagaatcgcgtcaggggaaatctagagaacctgttcttgcaatgcccgaaaccaaccttgcagcagatctcgcacatagcacagcagttgggactggagaaggacgtggttcgagtgtggttttgcaaccgtcgccagaagggcaagcgatccagctcggactatgcccagcgagaggacttcgaggcagcaggatcgccattcagtggcggtcccgtgtcattccccttagcccccggtccacactttggaaccccgggctacggctcgccgcactttaccgccttgtactctagcgtccctttccccgaaggagaggccttcccaccggtgtcggttaccaccttgggatcgcccatgcactctaac

SEQ ID NO: 18421 - DNA, 1080 bp, Artificial Sequence
  Description of Artificial Sequence: Synthetic coding sequence
atggccgggcacctggcctcagattttgccttctctccaccgccagggggcggtggtgatggacctggagggccagagccaggttgggtggacccgagaacatggctttccttccaggggccgccagggggtccaggtatcggtcccggggtgggaccagggagtgaggtctggggcattccaccctgtccaccaccgtacgaattttgtggcggaatggcctattgcggtccccaggttggagttggcctggttccccagggagggcttgaaacttcacaaccagaaggagaggcgggggtaggcgttgagagtaattccgacggtgcaagtcccgagccatgcaccgtgacccctggggctgtaaaactcgaaaaagaaaaacttgagcagaaccccgaagagagccaggacattaaggccctgcaaaaggagttggagcaatttgccaaacttctgaaacaaaaacggattaccctgggctacactcaggcagacgtcggacttaccttgggtgttctgtttggtaaggtgttttcacagaccaccatttgccgattcgaagcactgcaacttagcttcaagaacatgtgcaagctccgcccactgctccagaagtgggttgaggaggctgataataatgaaaatctccaggagatctgcaaagccgagactctggtgcaagctcggaagaggaagaggacgtctattgaaaacagagttcgagggaatctggagaacctgtttcttcagtgcccaaagcctaccctccagcagatttctcatatcgcccagcagctggggttggaaaaagatgtggtgcgcgtctggttttgcaacaggcgacaaaaagggaaaagaagctcttccgactacgcgcaaagagaggactttgaggctgctgggagccctttcagcgggggccccgtttcctttcctttggcccctggacctcactttggtacacccggctatgggagccctcacttcacggcgctgtactctagtgtgccattccctgaaggagaggcattcccaccagtctctgtgacgacactcggctctcccatgcactccaac

SEQ ID NO: 18422 - DNA, 1080 bp, Artificial Sequence
  Description of Artificial Sequence: Synthetic coding sequence
atggccggtcacctggctagcgatttcgcgtttagcccgccacctgggggcggcggcgacggacctggcggcccggaacccggatgggttgacccaagaacttggttgtcctttcaaggaccgcccgggggtcctggtattggtccgggcgtgggacctggctcagaagtctggggaatccccccatgcccacccccgtatgaattctgtggaggcatggcatactgcgggccacaggtgggagtcggactggtgccacaggggggactcgagacttcgcagccagaaggagaagccggagtgggtgtcgagtccaatagcgatggcgcatcgcctgaaccgtgcaccgtgacgccaggcgcggtcaagctcgaaaaggaaaaactggaacaaaacccggaggaatcccaggatatcaaggcacttcagaaggagcttgagcagttcgcaaagctgctgaagcaaaaaaggatcaccctcggatacacccaagcggacgtgggcctgacgctgggggttctgttcgggaaggtgttcagccagaccactatttgccggtttgaggcccttcaactgtcgttcaaaaacatgtgtaaactcagaccgcttctccagaaatgggtagaagaagccgacaataatgagaacctccaggaaatttgcaaggcagagactctggtccaagctcgtaagcgcaagcggaccagcatcgagaaccgggtgcgcggaaatctcgagaacctctttctgcaatgcccgaagccaactctccaacagatctcgcatatcgcccaacagctgggactggagaaagacgttgtgagggtgtggttttgtaaccgcagacagaaagggaagcgctcttcgtcggactacgcccagcgggaagatttcgaggcggctggatccccgttctcggggggacctgtgtcattccccctcgcgcccggcccacatttcgggactccaggatacggttcccctcacttcacggcactgtactcttccgtacccttccccgagggcgaagccttcccgccagtctccgtgaccaccctgggtagtcctatgcactctaac

SEQ ID NO: 18423 - DNA, 1080 bp, Artificial Sequence
  Description of Artificial Sequence: Synthetic coding sequence
atggctggacatttggcttctgactttgccttctcaccccctccaggaggcggcggagatggccccgggggaccagaaccaggctgggtggacccccgaacatggctgtcctttcagggaccccccggaggcccgggcatcggtcccggggtgggccccggctctgaggtgtggggaatccccccatgcccgcccccatacgaattctgtggcggaatggcctattgtgggccccaagtgggagtaggactggttcctcagggtggcctcgaaacctcccagccagagggggaggctggcgtcggagttgagtcaaattcagatggcgcatctccagaaccctgtacagtgactccgggggcagtgaagctggaaaaggagaagcttgaacaaaatcctgaggaaagccaagatatcaaggcccttcagaaagaactcgaacagtttgcgaagcttctgaagcagaaaaggattacattgggatacacccaggcagacgttggtctaaccctgggtgtactgttcgggaaagtcttttctcaaactacaatatgccgcttcgaggccctccagctgtccttcaagaacatgtgcaaacttagacccctgttgcagaagtgggtagaggaggccgacaacaatgagaatctgcaggaaatctgcaaggccgagacacttgtccaggctcggaaaaggaaaagaacatctatcgagaacagggttagaggcaacctggagaacctgtttctgcagtgtcccaagcctaccttacagcagatctctcatatcgcccagcaattaggtctggagaaggatgtggttagggtctggttctgtaataggaggcagaagggaaaaagatctagtagtgactacgctcagcgggaggactttgaggctgcaggttcacccttctctggtgggccggtatccttcccgttggctccaggccctcacttcggaactcccgggtacggctctccacatttcacagcactatattcttccgtgccgtttcccgaaggtgaggcgttccctcccgtctccgttactactctagggagccctatgcactcgaac

SEQ ID NO: 18424 - DNA, 1080 bp, Artificial Sequence
  Description of Artificial Sequence: Synthetic coding sequence
atggccggacaccttgccagcgactttgcctttagcccgccaccgggtggcggcggggacggaccaggtgggccagagcccggttgggtggacccccgtacatggctgagtttccagggaccccccggcggccctggcattggtccgggtgtcggccccgggtcggaggtatgggggatccctccttgtccgccgccctatgagttctgtggggggatggcttattgcggaccccaagtgggcgtcggcctggtccctcaaggtggcctcgaaacctcccaacctgagggcgaagccggcgtcggcgtcgaatctaatagtgatggtgcatctccagagccttgcactgtgacccccggggccgttaaactggagaaagaaaaattggaacagaacccggaagaaagccaggatataaaagcactccagaaagagctggaacagttcgctaagctacttaagcaaaagcgcattacactgggatacacacaagcggacgttgggctgactcttggtgtccttttcggtaaagtattctcccaaacaacaatttgtaggtttgaagctcttcaactgtctttcaagaatatgtgtaagttgaggccacttttgcagaagtgggtggaagaagctgacaacaacgagaatcttcaggaaatctgtaaggctgagacactcgtgcaagctaggaagcgtaaacgtacatccatcgagaatcgggtccggggcaacctggagaacctatttctccaatgtcctaagcctacccttcagcagatctctcacatcgctcaacagctcggtcttgaaaaggatgttgtacgggtttggttttgcaaccgacggcagaagggcaagcgaagcagctctgactacgcccagagggaagatttcgaggcggccggttctcctttctcggggggccctgtttcgttccctttggcccccggaccccatttcggcactcccggctacggtagcccccattttacggctctgtattcttctgtcccctttccagaaggcgaggcattcccacccgtttcagttactacacttggctctccaatgcattctaat

SEQ ID NO: 18425 - DNA, 1080 bp, Artificial Sequence
  Description of Artificial Sequence: Synthetic coding sequence
atggcgggtcatcttgcatcggactttgcgttctcgccgccaccggggggcggtggcgacggtcctggtggcccggaacctggctgggtggatcctcggacctggctgagctttcaagggccacccggggggcccggcattggacccggagtgggtccaggctccgaagtgtggggaatccctccgtgcccgcccccatacgagttttgcggcggtatggcttactgtgggccacaggtgggagtgggactcgtccctcaagggggtttggaaacgtcgcaaccggaaggagaagcgggcgtgggggtcgagtcaaatagcgacggcgcgtcccctgaaccttgtactgtcacgccaggggcagtgaagctggagaaggaaaaacttgaacagaaccccgaggaatcccaggatatcaaagcactgcagaaggagcttgaacaatttgcaaagttgcttaaacaaaaaaggataactctcggttatacccaggccgacgtgggattgaccctcggagtcctttttggtaaagtgttttcccagacgacgatttgtcgcttcgaagcacttcagctgtcgttcaagaacatgtgtaagctgcgtccccttctgcaaaaatgggtggaggaggccgataacaacgagaacttgcaagagatttgtaaggccgaaacccttgtgcaggctcggaaaaggaagcgaacttccattgaaaaccgcgtccgaggaaatctcgaaaacctttttctgcagtgccccaagccgactctgcaacaaatcagccatattgcacaacaacttggccttgaaaaggatgtcgtgcgcgtgtggttttgtaatagacgtcaaaagggaaagagaagcagcagcgattacgcacaaagagaagatttcgaggcagcagggtccccgttttccggaggaccggtttccttccctcttgcaccaggcccacattttggaacgcccggatacggatcgccacactttactgctctttactcatcagtgccttttccagaaggagaagcattccctccagtgtcggttaccaccctgggttccccaatgcacagcaac

SEQ ID NO: 18426 - DNA, 1080 bp, Artificial Sequence
  Description of Artificial Sequence: Synthetic coding sequence
atggcaggacaccttgcctctgatttcgctttttcaccacccccagggggaggaggggatggcccagggggccctgaacccggctgggtggacccacgcacgtggttgtcgttccaggggcccccgggggggcccggcattggcccgggggttggcccaggctcagaagtgtggggcatacccccctgcccacccccctatgagttctgtgggggaatggcatactgtggtcctcaggttggcgtgggcctcgtgcctcagggcggtttagagacctctcaacccgagggggaggccggagtgggtgtagagagcaactctgacggggcatcccctgaaccctgcaccgtgaccccgggtgccgtaaaactcgaaaaggagaagctggagcagaacccagaagaatcccaggacataaaggccctgcagaaagaactggaacagttcgccaaattgttgaaacagaagagaatcactctgggctatacccaggccgatgtgggcttgacactaggggtcttatttgggaaggtattttctcagactactatctgtaggttcgaagcacttcaactgtcgtttaagaacatgtgtaagctccggcccttgctccaaaagtgggtcgaagaagcagacaataatgaaaacctgcaagaaatttgtaaggcagagaccttggtgcaggctcgcaagcggaaaaggacttctatagagaatagagtccgcgggaatctggaaaatctgtttctgcaatgcccgaaacccaccctgcagcaaatttctcatattgcccagcagctcggcctcgaaaaagacgtggtcagagtgtggttctgtaaccgaaggcaaaaaggcaagcgatcttcgagcgactatgcccagagggaggatttcgaagctgcggggtcacctttttccggcggccccgtgagctttcctctggcccccggccctcacttcggcacccccggctatggctccccccattttacagccctttattcgtcagttccattccctgaaggggaggcatttccacctgtgtccgttaccacattggggagcccaatgcactcaaat

SEQ ID NO: 18427 - DNA, 1080 bp, Artificial Sequence
  Description of Artificial Sequence: Synthetic coding sequence
atggccggccacctggcatctgactttgctttcagcccccctcctggcggcggaggcgacggcccaggggggcccgagccaggctgggtggatccaaggacctggctgtcctttcagggccctccgggaggaccaggtatcggccctggggtgggccctggctcagaggtgtggggcattcctccctgccctcccccatacgaattttgtggcggcatggcctattgtggcccccaggtgggagtggggctggtgccgcagggtggactggagacatcacaacctgaaggcgaggctggggtgggagtggagtccaattcagacggcgcaagtcccgagccttgcaccgtgacgccgggggcagttaagctggagaaggaaaagctcgagcagaacccagaagaatcccaggacattaaagccctgcaaaaagaattggaacaattcgcaaagctgctaaagcagaagcgtattactctcggatatacccaggcggacgtaggcctaacactcggggtgctcttcgggaaggtattctctcaaacaacgatctgtaggtttgaagccctccagttgtcctttaagaatatgtgtaagctgaggccacttctgcagaagtgggtggaggaagccgacaataacgagaaccttcaggaaatatgcaaagccgaaactttagtgcaggcccgcaagagaaagagaacctccatagaaaatagggtcagaggaaacttggaaaatctctttctgcaatgcccaaagcccacgttgcagcagatttctcacattgctcagcagctgggtttagagaaggatgttgtgagggtttggttttgtaaccgccgccaaaaaggcaaacgcagctcctccgactacgctcagcgggaggactttgaggccgccggcagtcccttttctggtggaccagtgtcatttcctctggcccctggtccccactttggaacccctggatatggtagcccccatttcacggccctgtacagttccgtgccgttcccagagggtgaggccttcccacccgtgtctgttactactctgggctcgccgatgcactccaat

SEQ ID NO: 18428 - DNA, 1080 bp, Artificial Sequence
  Description of Artificial Sequence: Synthetic coding sequence
atggcgggacacttggcgtccgattttgcatttagcccccctccaggagggggcggtgacggtcctggtggtcctgaaccaggctgggttgaccctcgcacctggctgagctttcaaggtcctccaggcggaccgggcattggacccggagtcggaccaggatcggaggtctggggaatccctccctgtccccctccatatgagttttgcggcggtatggcatactgtggtccccaagtcggagtgggactggtgcctcagggtggccttgaaacttcgcaacctgaaggcgaagcgggcgtgggagtggagtccaactcggatggggcatcgccggagccgtgcaccgtgactcctggtgccgtgaagctcgaaaaggaaaaacttgagcaaaacccagaagaatcccaagacataaaggcactgcagaaagaactggagcaatttgcaaaactgctgaagcagaagcgtatcactcttggttacacccaggcagatgtgggcctgaccctgggggtgctctttggcaaggtgttttcacaaactacgatttgccgttttgaggcacttcagctttccttcaagaacatgtgtaaactccggccgcttctccaaaaatgggtggaagaagcagacaacaatgagaatctgcaggaaatttgtaaggcagaaaccctcgtgcaggcgagaaagagaaagcggacttccattgaaaacagagtgcgtggaaatctggaaaacctgttcctccaatgtcctaagcccactctccagcagatttcacatatcgcccaacaactgggactggagaaggatgtcgtgcgcgtctggttctgtaatagacgccaaaagggcaagagatccagctccgactacgcacagagagaggatttcgaagctgcaggttcccctttttccggcggtccagtttcatttcctttggcacctggcccacattttggaacgccaggttacggatcgcctcattttaccgcactgtatagctcggtcccttttcctgagggcgaggccttcccacccgtcagtgtgaccaccctgggatctcctatgcactcgaat

SEQ ID NO: 18429 - DNA, 1080 bp, Artificial Sequence
  Description of Artificial Sequence: Synthetic coding sequence
atggcaggacatctggcttcagactttgcattttcacctcctccaggaggcggaggtgacggacctggaggcccggaaccaggatgggtggacccgcgcacttggctctcgtttcaaggtcctccgggtggcccaggtattggtccgggagtgggtccaggaagcgaagtgtggggaataccaccatgtcccccgccctacgagttttgcggagggatggcatactgcggtcctcaagttggtgtcgggctcgttccgcaaggaggactcgaaaccagccaacctgagggcgaggctggtgtgggtgtggaatcgaactcagacggggcttcacccgaaccctgtacggtcaccccaggggcagtcaagctggagaaggaaaagctggagcagaacccagaggaatcacaggacatcaaagcacttcagaaggaactggagcagttcgccaagctgcttaagcaaaagcggattaccctggggtacacccaagcagatgtcggattgactctgggagtgctgttcggaaaggtgttttctcagaccaccatttgtaggtttgaagcattgcaactgagctttaagaacatgtgtaagctccgcccactgcttcaaaaatgggtggaagaggcggacaataatgagaacctgcaagagatttgtaaggcagagactcttgtccaggcacgaaagagaaaaagaacctcgattgaaaaccgtgtgcgcggaaacctggaaaacctgtttcttcaatgtcctaagccaaccctgcaacaaatctcccatattgcacaacaactgggacttgagaaggatgtggtgcgggtctggttctgcaataggcgtcaaaaaggcaagcgctcttcgtcggattacgcgcagcgagaagattttgaggcagcaggatcaccattcagcggtggtcctgtgtccttccctctggcaccgggaccacactttggcacccctggatacggctcccctcattttactgcactctattcaagcgtgccgtttcccgaaggtgaagccttccccccagtgtccgtgactactctgggctctccgatgcattccaac

SEQ ID NO: 18430 - DNA, 1080 bp, Artificial Sequence
  Description of Artificial Sequence: Synthetic coding sequence
atggcgggtcatttagcgtcggattttgcgttttcgccgccgccgggtggtggtggtgatggtccgggtggtccggaaccgggttgggttgatccgcgtacgtggctatcgtttcaaggtccgccgggtggtccgggtataggtccgggtgtaggtccgggttcggaagtatggggtataccgccgtgtccgccgccgtatgaattttgtggtggtatggcgtattgtggtccgcaagttggtgttggtctagttccgcaaggtggtctagaaacgtcgcaaccggaaggtgaagcgggtgtaggtgttgaatcgaattcggatggtgcgtcgccggaaccgtgtacggtaacgccgggtgcggttaaattagaaaaagaaaaactagaacaaaatccggaagaatcgcaagatataaaagcgttacaaaaagaactagaacaatttgcgaaattattaaaacaaaaacgtataacgctaggttatacgcaagcggatgtaggtttaacgctaggtgtactatttggtaaagttttttcgcaaacgacgatatgtcgatttgaagcgctacaactatcgtttaaaaatatgtgtaaactacgtccgttactacaaaaatgggtagaagaagcggataataatgaaaatctacaagaaatatgtaaagcggaaacgttagttcaagcgcgaaaacgaaaacgtacgtcgatagaaaatcgagtacgaggtaatctagaaaatttatttttacaatgtccgaaaccgacgctacaacaaatatcgcatatagcgcaacaattaggtctagaaaaagatgttgtacgtgtttggttttgtaatcgtcgtcaaaaaggtaaacgttcgtcgtcggattatgcgcaacgagaagattttgaagcggcgggttcgccgttttcgggtggtccggtttcgtttccgctagcgccgggtccgcattttggtacgccgggttatggttcgccgcattttacggcgctatattcgtcggtaccgtttccggaaggtgaagcgtttccgccggtatcggttacgacgttaggttcgccgatgcattcgaat

SEQ ID NO: 18431 - DNA, 1080 bp, Artificial Sequence
  Description of Artificial Sequence: Synthetic coding sequence
atggccggacacctcgcctctgatttcgcctttagcccaccacctggcggaggaggcgatggaccaggtggacccgagccggggtgggttgacccccgaacctggctgagctttcaggggccgcctggtggccccgggattggcccgggagtggggccagggagtgaggtttgggggatccccccttgtcctccaccatacgaattctgcggtgggatggcctactgcggaccgcaggtcggggtcggccttgtgccacagggtggcctggagacgtcccagcccgaaggagaagcgggagtgggagtagagagcaattctgacggggctagccccgagccctgcaccgtgacgcctggcgcagttaagctggagaaagaaaagctggaacagaatccggaggagagtcaggatatcaaggccctgcaaaaagagcttgagcagttcgccaaattactgaaacagaagcggattacactggggtatactcaggctgacgtgggactgacactaggcgtgttattcgggaaggtgttctcccagaccacaatctgccgttttgaagctctgcagctttcatttaaaaatatgtgcaagctgaggcctcttttgcagaagtgggtggaagaggccgataacaacgaaaaccttcaggaaatttgtaaggccgagacattggtgcaagcacgaaagcggaaacgtacctccatcgagaatagagtaaggggcaatctggaaaatctttttctgcagtgccccaaaccaaccttacagcagatctctcacatagcacagcagctaggcctggagaaggatgtggtccgcgtctggttctgcaatagacggcagaaaggtaagaggtccagctccgactacgctcagcgagaggattttgaggccgctgggtctcccttttccggaggcccagtttcttttccattagcccctggaccacattttggcactcctgggtacgggtctccgcacttcacggcactctacagttccgtgccatttcctgaaggggaagctttccctcccgttagtgtgaccacactgggaagtccgatgcactctaat

SEQ ID NO: 18432 - DNA, 1080 bp, Artificial Sequence
  Description of Artificial Sequence: Synthetic coding sequence
atggccggacacctggcgtccgactttgccttctccccgcctcctggaggcggcggagacggaccggggggacctgaaccgggatgggtggatccgcgcacctggctctcattccagggaccgccgggaggaccagggatcggaccaggagtgggaccggggtccgaggtctggggaatccccccttgcccgccgccatatgagttctgcggaggaatggcatactgcggaccgcaggtgggagtgggactggtgccgcagggaggcctcgaaacgtcgcaaccggagggagaagcaggtgtgggagtggaatcaaactcggatggagcatcacccgagccctgcaccgtgaccccgggagcagtcaaactggaaaaggaaaagctggaacaaaacccggaggagtcgcaggacattaaggcactgcaaaaagaactggaacagttcgcgaaactgctcaagcaaaagagaatcaccctgggctacactcaggcagatgtgggactcaccctcggggtgctgttcggaaaggtgttcagccaaacgactatatgccggtttgaagcgctgcaactgtcatttaagaatatgtgtaaacttagaccactgcttcagaagtgggtggaagaagccgacaataacgaaaatctgcaggaaatctgcaaggccgagactctggtgcaagcacgcaaacgcaagagaacttccattgaaaaccgggtgaggggcaacctcgagaacctgtttctgcaatgcccaaagccaactttgcaacagatctcccatatcgcacagcagcttgggctggagaaagacgtggttcgggtgtggttttgcaaccgcaggcagaaaggaaagcgctccagcagcgactacgcccaaagagaagattttgaggccgcgggctccccgttctccggaggaccggtgtcgttcccgctcgctccgggtccacactttggcactcctgggtacgggtcaccacattttactgccctctactcatctgtgcctttccctgaaggggaagcgttcccacctgtgagcgtgacgaccctggggtcgcctatgcactcgaac

SEQ ID NO: 18433 - DNA, 1080 bp, Artificial Sequence
  Description of Artificial Sequence: Synthetic coding sequence
atggccggccatcttgcttcggactttgccttctcccctcctcccggcgggggcggcgatggtcctggaggtccagagcccggctgggtggatcctcggacatggctgagcttccagggaccccccggcgggccaggaattgggcctggagtgggacctggtagcgaagtgtgggggatacctccatgtcctcctccatacgagttctgtggaggaatggcctattgcgggccgcaagtgggagttggcttggtgccacagggcggactcgagaccagtcaaccagagggggaggccggagtcggcgtggaaagtaattccgatggcgccagcccagagccttgtacggtgaccccgggcgccgtgaagctggaaaaagaaaagttggagcaaaatcccgaggaatctcaggatataaaggctctgcagaaggaacttgaacagtttgccaaactgcttaagcagaaaaggataaccctgggctatacacaggccgatgtagggttgacgctaggcgtgctgtttggcaaagtcttctctcagacaacaatctgtcgtttcgaggccttacaattgtcttttaagaacatgtgcaaactccgaccgctattgcagaagtgggtagaggaagctgataataacgagaacctccaagagatctgcaaggcagagaccctggtgcaggctcgaaaacgaaaacggacatctatcgaaaacagggtgcggggtaacctggaaaatctgttcctccaatgtcccaagcccacattgcagcagatttctcatatcgcacagcagctgggtctggaaaaagatgtagtgcgggtgtggttttgtaatagacggcagaagggcaaacggagttcgtctgactacgctcagcgggaagattttgaggcagcggggagccccttctcaggtggtcctgtgtccttcccactcgccccaggcccccactttggtacacctgggtatgggtcaccccacttcacagcactgtacagctcagttccttttcctgagggtgaagcttttccacctgtctcagtcaccacacttggatcccctatgcattctaac

SEQ ID NO: 18434 - DNA, 1080 bp, Artificial Sequence
  Description of Artificial Sequence: Synthetic coding sequence
atggcagggcatttggcaagcgacttcgcattttcacctcctcctgggggaggaggtgacggtcccggtggaccggagccgggatgggtcgatccacggacctggcttagcttccagggtccacctggtggaccaggtatcggtccaggggtggggcctggctccgaagtctggggaattccgccatgtcctcctccttacgagttttgtggtggtatggcatactgcggaccccaggtgggtgtgggtctggtgccccagggaggtctggagactagccaacctgagggggaagctggtgttggagtggagagcaacagcgatggggctagcccagagccctgtaccgtgacgccaggagcagtgaaactcgagaaagaaaagttggaacagaatcctgaggaatcccaagatatcaaggccttgcaaaaggagctcgaacaatttgcaaagctccttaaacagaaaaggattactctgggatacacccaggcggacgtggggcttacccttggagtgcttttcggcaaggtgttctcgcagaccacgatctgccgctttgaagccctccagctgagcttcaagaacatgtgcaaactgcggcctcttctgcaaaagtgggtggaagaagctgacaataacgaaaaccttcaagagatctgcaaggcagaaacccttgtccaggcgcgcaagcgaaagagaacctcgatagaaaacagagtgagaggaaatttggagaacctttttctgcaatgtccaaagccaaccctgcagcaaatctcgcatatcgcccagcaattgggacttgaaaaggatgtagtcagagtgtggttctgtaacaggcggcaaaaaggtaagcgaagctcgagtgattacgcgcagagagaggattttgaagcagcaggatctcccttttccggaggaccagtgtctttccccctggcacctggccctcatttcggcacgcccggatatggttcgccccattttacggccctttactcctcggtgccgtttcctgagggagaagcatttcctccagtgtcggttaccactctcggatcccctatgcactctaac

SEQ ID NO: 18435 - DNA, 1080 bp, Artificial Sequence
  Description of Artificial Sequence: Synthetic coding sequence
atggctggccacctggcttcagatttcgctttctcgccaccccctggcgggggaggcgacgggcctgggggaccagagccagggtgggtcgacccccggacctggctgagttttcagggacctccaggcgggccagggatcgggccgggggtgggccccgggagcgaagtgtggggaatccccccctgccctccaccgtatgagttctgcgggggaatggcctattgcggtccccaagtgggcgtcggcctggttcctcaaggcggtctcgaaactagtcagcccgaaggagaagccggggtaggcgtagaatccaattccgacggggcttccccggagccatgcaccgtgactcccggagcagtcaaattagagaaggagaaactcgaacagaaccccgaggagtcgcaagacattaaggctctgcagaaggagcttgagcagtttgcgaagttgttgaaacagaagagaatcaccctaggatatacccaagcggatgtaggcctcactctcggcgtgctttttggaaaggtgttttctcagactactatatgcaggtttgaggcacttcaactgagcttcaaaaacatgtgtaaattaaggcccctgctgcaaaaatgggtagaggaggcagacaacaatgaaaatctgcaggaaatttgcaaagcagaaactctggtccaagctaggaaaagaaaacggacctctatcgagaacagagtacgaggcaatctggagaatctgtttctacagtgcccaaagcccactctgcagcagatctcacacatagcccaacagttggggttggagaaggatgtagtcagagtgtggttttgcaaccgacgacagaagggaaagaggtcatccagtgattacgcccaacgcgaggacttcgaagcagccggaagtccgttctctgggggtccagttagctttcccctggccccaggaccgcattttggcacgcccggctacgggtccccgcactttacagccctgtattccagcgtacctttccccgaaggcgaggcatttcccccagtgtccgtgaccaccctggggagccccatgcattctaat

SEQ ID NO: 18436 - DNA, 1080 bp, Artificial Sequence
  Description of Artificial Sequence: Synthetic coding sequence
atggcaggccatcttgcctctgacttcgccttttccccacccccgggtggcggcggggacggacccggtggaccagagcccggatgggtggatcctaggacatggctgagctttcagggccctcccggtggacctggaattgggcctggagtcggaccgggatctgaagtgtggggaatccccccctgcccaccaccgtatgagttttgtgggggtatggcatattgtggtccccaagtgggcgtggggctggtcccccagggaggtcttgagactagtcaacctgagggggaggccggtgttggggtggagtcaaactccgacggcgcctcccctgaaccctgtaccgtgactcctggagctgtaaagctggaaaaggagaagctggagcagaaccccgaggaatctcaggatatcaaggcccttcagaaagagctggaacagttcgctaagctgctgaagcaaaagagaatcacacttggctacacccaggcggatgttggacttaccctgggcgtgttgttcgggaaagtgttttcacagacgacgatctgcagatttgaggcactgcagctgagcttcaaaaacatgtgtaagctgcggcccctgctccagaaatgggttgaggaagcagacaacaacgagaatctgcaggaaatctgcaaagctgagacccttgtgcaggcaaggaagaggaaacggacatcaatcgaaaatagagtacgcggcaatctcgaaaacttgtttcttcagtgtcccaagcccaccctgcagcagataagccacattgcccaacagctcggactcgaaaaggacgttgtgagagtttggttctgcaacaggcgccagaagggaaagagatcaagttcagattatgcacagcgcgaggattttgaagctgccgggtcccccttttcaggcggtcccgtctcattcccactggctcctggaccccactttggcactccgggctatggttcccctcactttaccgcactttattctagcgtgcctttccccgaaggtgaggcgttcccaccagtatctgtgaccacccttggatctcccatgcactcaaat

SEQ ID NO: 18437 - DNA, 1080 bp, Artificial Sequence
  Description of Artificial Sequence: Synthetic coding sequence
atggcgggacacctggcatcagatttcgccttctcgccgccaccaggcggaggcggcgacggtcccgggggtcctgagcccgggtgggtggacccgaggacctggcttagcttccaggggccgccaggcggccccggaatcggtcccggagtggggccaggaagcgaggtgtgggggattccgccgtgcccgccaccgtacgaattttgtgggggaatggcatactgcggacctcaggtgggagtgggactggttccgcaaggcggcctcgaaactagccagccggagggagaggccggggtgggagtcgagtcgaactccgatggagccagtcccgagccatgcactgtcactcccggcgccgtgaagctggagaaagaaaagctcgaacagaatccggaagaatcgcaagacatcaaagccctgcagaaggagctggagcagtttgcaaaacttctcaaacaaaagcggatcacccttggatatacccaagccgacgtgggattgacgctgggcgtcctgttcgggaaggtattctcccagacgaccatctgcagattcgaagcgctccagctgagcttcaagaacatgtgcaagctccgaccgttgcttcagaagtgggtggaagaagccgataacaatgaaaacctgcaggaaatttgcaaggcggaaaccctggtgcaagcgcggaaaagaaaacggacttcgatcgaaaaccgcgtcaggggaaacctggagaatctcttcctgcagtgcccaaagccaaccctgcagcagatttctcatatcgcccagcaattgggattggagaaggacgtggtgcgcgtgtggttttgtaaccggagacaaaagggaaagcgttcctcctcagattatgcacagcgcgaggactttgaagcagccggaagccctttctccggagggccggtgtcgtttcccctcgcgccaggaccgcacttcggaactcctggctacgggagccctcattttaccgcattgtactcctcagttccctttccagaaggagaagccttccctccggtgtcggtgactaccctggggagcccaatgcattcgaat

SEQ ID NO: 18438 - DNA, 1080 bp, Artificial Sequence
  Description of Artificial Sequence: Synthetic coding sequence
atggctggacacctggcttcagatttcgcatttagcccccctccaggtggtggcggtgacggccccggaggtcctgagcctggctgggtggaccctcgcacctggttgtcctttcagggtccaccaggtggcccgggtattggacccggtgtcggcccaggttccgaagtttggggaattccaccatgtccacctccatacgaattctgtggaggtatggcttattgcggccctcaggtgggagttggtctcgtcccacagggtggcctcgagacatcacaaccagaaggtgaggctggtgttggtgttgagtctaacagcgatggagcatccccggaaccttgcaccgtgaccccaggtgccgtcaagctggaaaaggaaaagctcgaacaaaaccctgaagaatctcaggacattaaggccctgcagaaggaacttgagcaatttgctaaactgttgaagcagaagaggattacgttgggatatacccaggccgacgtaggtcttacccttggcgttttgttcggaaaagtgttctcacaaacaaccatttgcaggtttgaggccctgcagcttagtttcaaaaatatgtgcaagcttaggcctttgctgcaaaaatgggtcgaagaagcggacaataacgaaaatttgcaggagatctgcaaagctgagactctcgtgcaggcccgcaagcgcaagaggacctctatcgagaacagggtaagaggaaatttggagaacctctttctccagtgtccgaagccaaccctgcaacaaatctctcacatagctcagcaattgggactcgaaaaagacgtggtaagggtatggttttgcaaccgccgccaaaagggaaaacgcagctcctcagattacgctcaaagggaagattttgaggctgccggctctcccttctcaggcggcccagtgagttttcctctcgcccccggaccccattttggaacccccggttacggctctcctcactttacagccctgtacagtagtgttccgtttccggaaggcgaggcatttccaccagttagcgtaaccacgctgggctcacccatgcactccaat

SEQ ID NO: 18439 - DNA, 1080 bp, Artificial Sequence
  Description of Artificial Sequence: Synthetic coding sequence
atggctggacatcttgcatccgactttgcattctcccccccacctggaggaggtggtgacggtccaggtggtcctgagcccggctgggtcgatcctcgcacctggctgtcctttcagggtccacctggcggacccggtattggacctggagtcggcccaggaagcgaggtttggggcattcccccttgcccccctccctacgaattttgcggtggaatggcttattgcggtcctcaggtcggagttggcctggtgccccagggaggcttggagacctcccaaccagaaggagaagccggcgtaggtgtggagagcaattccgatggagcatcccctgaaccctgcaccgtgacacccggagcagtgaaactggaaaaagagaagttggagcaaaatccagaggaatcccaagacataaaggctctgcagaaagaactggagcagttcgctaagctcctcaaacaaaaaagaattaccctgggatacacccaggccgacgtgggacttacccttggcgtgttgttcggcaaggttttttcccagactactatctgcaggttcgaggctctccagctgtctttcaagaacatgtgtaagctccgccccctcctgcagaaatgggttgaagaagctgacaacaacgagaaccttcaggagatctgcaaagccgagaccctcgttcaagcacgcaagagaaagcgcaccagcatagaaaacagggtgcgtggaaacctcgagaacctgtttctccagtgcccaaagccaaccttgcagcaaatcagtcacattgcacagcagctgggcctggagaaggatgtggtccgcgtgtggttctgcaatagacgccagaagggaaaaaggtcatcatccgactacgctcagagagaggatttcgaggctgccggctctccctttagcggcggcccagtgagtttccctctcgcacccggaccacactttggtacccccggttacggatcacctcatttcacagctctgtactcctccgttccttttcccgaaggagaagctttccctcctgtgtctgtgaccactctcggttcccccatgcacagcaac

SEQ ID NO: 18440 - DNA, 1080 bp, Artificial Sequence
  Description of Artificial Sequence: Synthetic coding sequence
atggcaggacatctggcatcagatttcgcattttcccctccacctggtggaggcggggacggaccgggtggtccagaacccggatgggtggacccgcggacttggctctcgttccaggggccacccggcgggccgggaattggaccgggagtgggcccgggatcggaggtctggggaatcccgccctgtccgccaccatatgagttctgcggtggaatggcctactgtggtccgcaggtcggggtgggccttgtaccacaggggggattggaaacttcgcaaccggaaggagaagctggggtgggcgtcgagagcaactctgacggagcgagcccagagccttgcaccgtgactccaggagcagtgaagctcgaaaaagagaaactggagcagaatccggaagagtcacaagatatcaaggcccttcagaaggaacttgagcagtttgctaagctgttgaagcagaagcgtataacgctcggatacactcaagccgatgtcggcctgaccttgggagtgctgtttggaaaggtgttctcgcaaactactatctgtcgattcgaagcgctgcagctgtcctttaagaacatgtgtaaactccggcccctcttgcaaaaatgggtcgaggaggctgacaacaacgaaaatctgcaagaaatctgcaaagcggaaactctggtgcaggcccggaagcgcaagcggacttcaatcgaaaaccgcgtgcggggaaacctggaaaatctcttcctgcagtgcccaaagccaaccctgcagcaaatctcccatatcgcgcagcagctgggcctggagaaagacgtggtgcgggtgtggttttgtaacagaaggcagaagggaaaaaggtcatccagcgattacgcccagagagaggactttgaagccgccggctcgcctttctcaggaggaccggtatcattcccgctcgcgccgggcccacacttcggtaccccgggatacggttccccacacttcaccgccttgtacagctcggtgccttttcccgagggagaggccttcccgccggtgtccgtgactaccctgggctcacctatgcactcgaac

SEQ ID NO: 18441 - DNA, 1080 bp, Artificial Sequence
  Description of Artificial Sequence: Synthetic coding sequence
atggctggacatttggcctcggattttgcgttctccccacccccgggcggtgggggcgatggccctggaggtcctgaaccaggttgggtggatcctagaacctggctgtcatttcaaggtccaccgggaggacctggtatcggaccaggagtgggtcctggaagcgaagtttggggtattcccccgtgcccacccccttacgagttttgcggcggtatggcttactgcgggccccaagtcggggtgggacttgtgcctcagggcgggctcgaaacgtcgcaacctgaaggagaagcaggtgtgggtgtggaatcgaattcggatggtgcatcgcccgaaccttgcaccgtgactcccggtgcagtgaagctggagaaagagaagctcgaacagaatccagaagaaagccaggacattaaggctctgcagaaagaacttgagcaattcgcaaaattgttgaagcaaaaacgtatcactctgggctacacccaggctgacgtcggccttacccttggggttttgtttggtaaggtcttttcacagaccactatttgtcgcttcgaggcactgcaactgtccttcaagaacatgtgtaagctgcggcctcttcttcaaaagtgggtcgaagaggccgacaacaacgaaaaccttcaagaaatttgtaaggcagaaaccctggtgcaggcaaggaagcgaaaacgtacctccatcgaaaaccgagtgagaggaaacctggaaaacctgtttctgcagtgtccaaagccaacgcttcagcagatatcccatattgcacagcaacttggactggagaaggatgtggtgagggtgtggttttgtaacagacgccaaaaagggaagcggtcctcgtccgattacgcacaacgcgaggacttcgaggcagccggatctccgttttcgggcgggccggtgtcgtttcctcttgcaccaggacctcattttggaaccccgggctatggctcacctcactttaccgcactctacagctccgtgccctttccagaaggtgaagcgttccctccagtgtcggtgaccacgcttggatcgcctatgcactccaac

SEQ ID NO: 18442 - DNA, 1080 bp, Artificial Sequence; identical to SEQ ID NO: 18374
  Description of Artificial Sequence: Synthetic coding sequence

SEQ ID NO: 18443 - DNA, 1080 bp, Artificial Sequence
  Description of Artificial Sequence: Synthetic coding sequence
atggccggacatctcgcatctgacttcgctttctcaccccctcctggaggaggtggtgatgggcctggcggacctgaacccggttgggtggaccctaggacctggctgagcttccagggaccacctggtggacctggcataggtccgggagtgggccctggttccgaggtgtggggaatccctccttgcccaccaccatacgagttttgcggaggtatggcctactgtggtccacaagtcggggtgggactcgtcccgcaggggggtcttgaaacctcgcaacccgagggagaggccggggtgggcgtcgagagcaacagcgatggagcatccccagaaccttgtaccgtgactcctggagcagtgaagctggaaaaggaaaaacttgagcaaaacccagaagaatcccaggatatcaaggcactgcagaaggaactggaacaatttgcgaagttgctgaagcagaagcggatcaccctggggtacactcaggccgatgtgggactgaccctcggagttctttttggtaaagtgtttagccaaaccaccatatgtcggtttgaggcactgcaactctcgttcaagaacatgtgcaagttgaggccactgcttcaaaagtgggtggaggaagcagataacaatgaaaacctgcaggaaatttgtaaagcagagactctggtccaggcgaggaagcgtaagagaacctccattgagaaccgcgtccggggaaatctggagaacctgtttctgcaatgtccaaagccaactcttcagcagatttcccatatcgcccagcagctgggactcgaaaaggatgtggtgcgagtgtggttttgtaataggcgacagaagggaaaaagatcctcaagcgactacgcacagcgggaagattttgaagccgccgggtcgccattttccggaggccctgtgtcgtttcctctggcaccaggcccccacttcgggacgcctggttacggatccccgcattttacggcactgtactcgagcgtgccttttccagaaggcgaagcatttcctcctgtgtccgtcaccacgctggggtcgcctatgcacagcaac

SEQ ID NO: 18444 - DNA, 1080 bp, Artificial Sequence
  Description of Artificial Sequence: Synthetic coding sequence
atggccgggcacctggcatccgattttgccttttcacctcccccaggcgggggaggcgacggccccggcggccccgagcccgggtgggtggacccacggacgtggctgtcattccaggggcctccgggcgggcccgggattggtccaggggtgggcccaggatcagaggtgtgggggatcccaccttgccctcccccgtacgagttctgtggaggaatggcctactgtggcccacaggtcggcgtggggctggtaccacagggggggctcgagacatcacagcctgaaggggaggccggtgtgggcgtcgagagcaatagtgacggcgccagtccagagccgtgcaccgttactcctggcgccgtgaagttagagaaggaaaagctcgagcaaaaccccgaagagtcacaagacatcaaggcgctgcagaaggaactggaacagtttgccaagctcctgaagcagaagagaatcacgctggggtacacgcaggcagatgtgggcctcactctgggcgtactgtttgggaaagttttctcccagacaaccatttgccgattcgaggcactgcagcttagctttaagaacatgtgcaagttgcgtccgttactgcagaagtgggtggaggaggccgataataatgagaatcttcaggaaatctgcaaggctgaaacactggtacaggccagaaagcgcaagaggacatcgatcgaaaatagagtgagggggaatctggaaaatctcttcctgcagtgtccaaaacccactctgcagcagatctcacacattgcgcagcaattaggactagaaaaggacgtcgttcgcgtatggttttgtaaccgccgccagaaggggaagagaagtagcagtgactatgcacagagggaggatttcgaggccgcggggtctcccttttctgggggccctgtctcattccctctggcccctgggccgcatttcgggaccccaggatacggctctcctcactttaccgcgttgtacagctcagtgcccttcccggaaggagaggctttcccaccagtgtctgtcactaccctagggagtcccatgcactcaaat

SEQ ID NO: 18445 - DNA, 1080 bp, Artificial Sequence
  Description of Artificial Sequence: Synthetic coding sequence
atggccggccatctggcttctgatttcgcctttagcccaccaccaggaggaggtggcgatggccctggaggcccagaacccgggtgggtggaccctagaacatggctcagcttccagggaccacctggtggccctgggataggacctggcgttgggcccgggagtgaagtctggggtatccctccctgcccacctccgtatgagttttgcggcggaatggcatattgcggaccccaggtcggggtgggtcttgtaccgcagggaggtctcgaaacctctcagccagagggcgaggccggtgtcggagtggaaagcaactccgacggagcttcccctgagccgtgtacagtgactcctggtgccgtaaagctggaaaaggaaaaattggagcagaaccccgaagaatctcaggatatcaaggcattgcagaaagagctcgagcaatttgcgaagctgctgaagcagaagaggatcacattgggctacacacaggcagatgtggggctgactcttggcgttctttttggcaaagtatttagtcaaacaacgatttgtaggttcgaggcattgcagctgagttttaagaacatgtgcaagctgcggcccctgctccaaaaatgggtcgaagaggccgataataatgagaacctgcaagaaatttgtaaggccgaaacccttgtgcaggccagaaaacgaaagcgcacaagtatcgagaatagagtccgagggaaccttgaaaacttgtttctccagtgtcctaagcccaccctccagcagataagccatattgcgcagcaactcggactggaaaaggacgtcgtacgggtttggttctgtaaccgtcgccagaagggcaagcggagctcatcagactacgctcagagagaagactttgaagccgcgggaagtccatttagcggtggtcccgtatcgttccctctggccccaggacctcacttcgggactcccggatacgggtcccctcacttcactgcactgtacagttcagttcccttccccgaaggtgaggcattccctccagtcagcgtgactacacttggcagtccaatgcattcgaat

SEQ ID NO: 18446 - DNA, 555 bp, Artificial Sequence
  Description of Artificial Sequence: Synthetic coding sequence
atgcccagactctttttcttccatctgttaggcgtgtgtctcctgctgaatcaattctccagagcagttgcagattcctggatggaagaggtcataaaactttgcggacgggagctggtaagggctcagattgctatatgtggcatgtccacttggtcaaagagatcgcttagccaagaagatgcaccccagacccctcgtccagtggccgagatagttccgagctttataaacaaggacacagagaccatcaacatgatgtccgaattcgtcgccaatttacctcaggaattgaagctcacattgagtgagatgcaacccgctctaccgcagttgcaacaacatgtgcccgtgctgaaggatagctccctactgtttgaagaattcaaaaagcttatccgcaatcgacagagcgaggcagcggactccagcccttccgagctcaaatatttgggtttagatacccatagtcggaagaagagacagctctattccgccctcgctaataagtgttgccatgtcggttgtaccaagcgctcccttgcccgtttttgt

SEQ ID NO: 18447 - DNA, 555 bp, Artificial Sequence
  Description of Artificial Sequence: Synthetic coding sequence
atgccaaggctgttcttcttccatctcctgggcgtgtgccttcttctgaatcagttctccagagccgtcgcagattcctggatggaggaagtcatcaagctatgtggcagggaactggtgagagcccagatcgctatatgtggaatgtctacctggtcaaaacgcagcctgtcccaagaagacgctccacagacccctcgtccagtggcggagatcgttcccagctttattaacaaagacacggaaactataaacatgatgtccgagtttgtcgcgaatctcccgcaggagcttaagctgactctctctgagatgcagcctgctctccctcaactgcagcagcacgttcctgtactcaaggactctagcttgcttttcgaagaattcaaaaagttgattagaaatcgacagtctgaggccgccgattcctcaccttccgagctgaagtatctgggcctggatacccatagcagaaaaaagagacaattatactccgctcttgctaacaagtgctgtcacgtgggctgtacaaaacgaagtctggcacggttttgt

SEQ ID NO: 18448 - DNA, 555 bp, Artificial Sequence
  Description of Artificial Sequence: Synthetic coding sequence
atgccacgcttgtttttcttccatctcctgggggtatgcttgcttctgaatcaattttcccgtgccgtcgccgacagctggatggaggaggtgatcaagttgtgtggacgcgaattggtgcgcgcacagatagcaatttgtggtatgtccacctggagcaagcgctccctgtcgcaggaggacgcacctcaaactcctaggcctgtggcggaaattgtgccctcctttatcaataaggataccgaaacgattaacatgatgtcggaatttgtggcgaacctcccacaagagcttaagctgaccctgtcggaaatgcagccagcactcccacaactgcaacagcacgtgccggtacttaaagattcgagcctgcttttcgaagaattcaagaaactgattcggaatcgtcagtcagaggcagcggatagctcgccctccgaacttaagtacctgggcctcgatactcacagtcgaaagaagcgacagttgtactccgccctcgcaaacaagtgttgccatgtcggatgtactaaacggtcgctcgcaagattttgc

SEQ ID NO: 18449 - DNA, 555 bp, Artificial Sequence
  Description of Artificial Sequence: Synthetic coding sequence
atgccgagacttttcttttttcacctccttggagtttgcctgcttctgaatcaattttcgcgtgctgtggccgatagctggatggaagaggtaatcaaactgtgtggaagagagctggtccgcgcacagatcgctatctgcggtatgtctacatggtccaagagatccctcagtcaggaagacgcacctcagacccccagacctgtcgccgagatcgttccgtcctttatcaacaaggacacagagaccatcaatatgatgtccgaatttgtcgcaaacctgcctcaagagctgaagctgaccttgtccgaaatgcagccggcccttccacagctgcagcagcacgtaccagtcctcaaggattcgtctctgctcttcgaagaattcaaaaagctcatcaggaatcgccagtcagaggcagcagactcaagcccttccgaactgaagtacctcggcctggacacacacagtaggaaaaagcgacagttgtattcagctcttgctaataagtgttgccatgtgggctgtacgaagagatccctagccaggttctgt

SEQ ID NO: 18450 - DNA, 555 bp, Artificial Sequence
  Description of Artificial Sequence: Synthetic coding sequence
atgcccagactattttttttccacttgctgggcgtctgtcttttgctgaatcaattttccagggccgtcgcagactcatggatggaggaggtcatcaaactctgtgggagagaactagtgcgcgcacagattgctatttgtggtatgagcacctggtctaaacgctcactcagtcaggaggacgctcctcagaccccccgccccgtggctgaaatcgtgccgtcattcataaataaagacacagagaccatcaacatgatgtcggagttcgtagcgaatctacctcaggagctgaaacttacactgtctgaaatgcagccagctttgccacagctccagcagcatgtacctgtgctcaaagattcgtcacttcttttcgaggagtttaaaaagttgatccggaacagacaaagtgaggcggccgattcatcccccagcgagctgaagtacctcggcctagatacgcactcccgcaagaagagacagctctactcggcgcttgctaacaagtgctgccacgtaggctgtactaagaggtccctggcccggttctgt

SEQ ID NO: 18451 - DNA, 555 bp, Artificial Sequence
  Description of Artificial Sequence: Synthetic coding sequence
atgccgcgtctctttttctttcatctacttggtgtgtgtttgcttttaaaccagttttctagggctgtggctgattcctggatggaagaagttatcaagctttgcggaagagagttggttagagctcagatagccatatgcggtatgtctacatggtcaaagaggagtctctctcaagaggatgcaccccaaacacccaggcctgttgctgagattgttcctagcttcattaacaaggatactgaaactattaacatgatgagcgaatttgttgccaaccttcctcaggaacttaaactgaccctatcagagatgcagccggcccttccacagttgcagcaacatgtgccagtgctcaaagatagttcactactcttcgaggagttcaaaaagctcataagaaaccgacaaagtgaggctgctgattccagtccttcggaattaaagtatctgggtttggatacccactcacgaaagaagcgacagttatactctgcattggcaaacaagtgctgtcacgtgggttgtactaagcgtagccttgcaaggttctgt

SEQ ID NO: 18452 - DNA, 555 bp, Artificial Sequence
  Description of Artificial Sequence: Synthetic coding sequence
atgccacggctctttttcttccacttgctgggagtgtgcctgctcctgaaccaattttcaagagcagtcgcagattcgtggatggaagaagtcattaaactttgcggccgtgaactcgtgcgtgcacagatcgccatctgtggaatgtccacgtggtcgaagcgctccctcagtcaggaagatgctccacaaactcctcggccagtggccgagatcgtcccctctttcattaacaaggacactgaaacgattaacatgatgtcggagtttgtggctaacctgccacaagaactgaaactgactctgtctgagatgcaacctgcgcttccacaactgcaacaacatgtgcctgtgttgaaggattcatcgcttctttttgaggagtttaagaagttgattagaaatcgccagtcggaggcagcggattcaagcccatccgaactgaaatacctgggtcttgatacgcacagcagaaagaagaggcaactctactccgcactggcaaacaagtgttgccacgtgggatgtactaagaggtccttggcccgattttgt

SEQ ID NO: 18453 - DNA, 555 bp, Artificial Sequence
  Description of Artificial Sequence: Synthetic coding sequence
atgccaagattatttttttttcatcttttaggagtttgtttattattaaatcagttttcaagagcagttgctgatagttggatggaagaagttataaaattatgtggaagagaactagtaagagctcaaattgcaatatgtggtatgagtacatggtctaaaagatcacttagtcaggaggatgctccacaaactccacgaccagttgctgaaattgttccatcatttattaataaagacacagaaactataaatatgatgtctgaattcgtagctaatttaccacaagaattaaaacttactctttctgaaatgcaaccagcattaccacaattacaacaacatgtaccagtattaaaagattcaagtcttcttttcgaagaatttaaaaaacttattcgtaatagacaatctgaagctgcagatagttccccttctgaacttaagtatttaggtttagatacacattcgagaaaaaaacgtcaattatattcagctttagcaaataagtgttgtcatgttggatgtacgaaaagatctcttgcaagattctgt

SEQ ID NO: 18454 - DNA, 555 bp, Artificial Sequence
  Description of Artificial Sequence: Synthetic coding sequence
atgcccagactgttcttttttcacctgctgggtgtgtgcctgctgctgaatcagttttcgagagctgtggcagatagctggatggaagaggtgatcaagctgtgtgggcgagagctcgtgcgcgcacaaatcgccatttgtgggatgtccacctggtcaaaacgatcgctttcccaagaagatgcaccgcagactccaagacctgtcgccgaaattgttcctagcttcataaacaaggataccgaaactattaacatgatgtcggagtttgtggccaaccttccacaggaactgaagctcaccctctccgaaatgcaaccagccctgccacaacttcaacagcatgtgccagttcttaaggattcatcgctgctctttgaggagtttaagaaactcattcgaaatcggcaatcagaagcagccgatagctccccttcagaactgaagtacctcggtcttgatactcactcgagaaaaaagcgccagctgtattcggcgcttgcgaacaagtgctgtcatgtgggttgcaccaaacgctccctcgcgcgtttctgc

SEQ ID NO: 18455 - DNA, 555 bp, Artificial Sequence
  Description of Artificial Sequence: Synthetic coding sequence
atgccgcgcctgttctttttccatcttcttggagtgtgccttctcctcaaccagttctcccgcgccgtggcggattcctggatggaggaagtcataaagctgtgtggaagggagctggttcgcgcccagattgccatctgcgggatgtccacctggtcgaaacgttctctgtcacaggaggacgcgccgcagacgccgcgccctgtggcagagatcgtgccgagcttcatcaataaggatactgagacgatcaacatgatgagcgagtttgtcgccaacctcccacaggagctcaaactgaccttgtcagagatgcaacccgccctcccacagttgcaacagcacgtgcccgtgctcaaggatagcagcctcctgtttgaggagttcaagaaactcatccgcaatcggcaatctgaagcagccgattcgtccccgtcagaactcaagtacctgggccttgatactcattcccgcaagaaaagacagctgtactcggctctggcaaacaaatgctgccacgtcggatgcactaagcgctcactcgcccgcttctgc

SEQ ID NO: 18456 - DNA, 555 bp, Artificial Sequence
  Description of Artificial Sequence: Synthetic coding sequence
atgcctcgcctgttcttcttccacctcctgggagtgtgcctcttgttgaaccagttttctagggcggtcgcggacagctggatggaagaggtcattaagttgtgcggccgcgagcttgtgagagcgcagatcgctatttgcggcatgtctacttggtctaaacgttcgcttagccaagaggacgccccccaaaccccgcgcccagtggccgaaatcgtgccgtcgttcatcaataaagacactgaaactatcaatatgatgagcgaattcgtggccaacttgccgcaagagctgaagctcaccctgtcagagatgcagccagcccttccgcaacttcagcagcacgttccggttctgaaagactcgtctctgttgttcgaagagtttaagaagctgatcagaaacagacagtcggaggccgctgatagctccccatccgaactgaagtaccttggcctggatacccactcccgcaaaaagcgccagctctacagcgcgctggccaacaagtgctgtcacgtgggatgtacgaagaggtcgctcgcacgattctgc

SEQ ID NO: 18457 - DNA, 555 bp, Artificial Sequence
  Description of Artificial Sequence: Synthetic coding sequence
atgcctagactgttcttttttcaccttctgggcgtctgccttctgctgaatcagttcagcagggcagttgccgattcttggatggaggaggtcattaaactgtgcgggcgcgagctggtgcgagcgcagatcgctatttgtggcatgagtacatggtccaaacgctctctgtctcaggaagacgcacctcaaacccccagaccagtagccgagatcgtgcccagctttattaacaaggacactgagactatcaacatgatgagcgagttcgtcgccaacctcccacaggagctgaagcttacacttagcgagatgcagcccgctcttccccaattgcaacagcacgttccagtcctgaaagatagcagtcttctcttcgaggagtttaagaagctgattcggaatagacagagcgaggccgccgatagcagcccgtcagaactgaagtacctggggctcgacactcatagcaggaaaaagaggcagctttattccgcactggcaaataaatgctgtcacgtgggttgtactaaaaggagcctcgcccgcttttgt

SEQ ID NO: 18458 - DNA, 555 bp, Artificial Sequence
  Description of Artificial Sequence: Synthetic coding sequence
atgccgcgcctgttcttcttccacctcctgggcgtgtgtctgttgctcaaccaattctccagagcggtggcagattcttggatggaagaggtgatcaaactgtgtggaagggaactcgtgagggcgcaaatcgctatctgcggaatgtcaacttggtcgaagcgcagcctgtcgcaggaggacgctccccaaacgccaaggccggtcgccgagattgtgccttcctttatcaataaggacaccgaaaccatcaacatgatgtcggaattcgtcgcaaacctccctcaagaactgaagctgaccctcagcgagatgcagcctgcattgccgcagctgcaacaacacgtgccagtgctcaaggactcgtcgctgctgttcgaggagtttaagaagctcatccgcaaccggcagagcgaggctgccgattcgtcgccgtcggaactgaagtacttgggactcgacactcatagccgcaaaaaacgccaactgtactcggcattggcgaataagtgctgccatgtgggctgcaccaagcggtccctcgctcggttctgc

SEQ ID NO: 18459 - DNA, 555 bp, Artificial Sequence
  Description of Artificial Sequence: Synthetic coding sequence
atgccacgcctctttttctttcaccttctaggcgtctgtttgctgctaaatcaattttctcgggccgttgcggatagctggatggaggaggtaattaagctgtgcgggcgggagctggtcagagcgcaaatcgctatctgcggaatgagcacatggtcaaagaggtccctatctcaagaagacgctccccaaaccccacgccctgtggctgagatcgtgccaagctttatcaataaggataccgagaccattaatatgatgagcgagttcgtggccaacctaccccaggagctgaagttaaccttatccgagatgcagcccgcgctgccccagctccagcagcacgtgcctgtccttaaggacagctccctgctctttgaagaatttaagaagttgattcgaaaccgccagagcgaggccgcggattcaagtcctagcgaattgaagtacctggggctcgacacccattccagaaagaagagacagctgtatagcgcgttggccaacaagtgctgccacgtggggtgcactaaacgtagcctagcaagattctgt

SEQ ID NO: 18460 - DNA, 555 bp, Artificial Sequence
  Description of Artificial Sequence: Synthetic coding sequence
atgcctcgcctgttcttttttcatctgctgggggtgtgccttctcctgaaccaattttccagagcagtggccgattcatggatggaagaggtgattaagctgtgcggacgggagctggtccgagctcagattgcaatatgcggtatgagcacctggagcaagcggtcgctttcacaagaggacgcgccacagaccccacgccctgttgccgaaatcgtgccttcctttatcaataaagacactgaaacgatcaacatgatgtccgagttcgtggccaacctcccccaagaattgaaacttactctttcggaaatgcagcccgcactgcctcaacttcagcagcatgtcccagtgcttaaggactcatcgcttctctttgaggagtttaagaaacttattagaaacagacaatctgaggcagcagattcgtcgccgtcggaacttaagtacttggggctggacactcattcgagaaagaaaagacagctttactcagctttggcaaataagtgttgtcatgtcggctgtaccaaacgctccttggcacggttttgt

SEQ ID NO: 18461 - DNA, 555 bp, Artificial Sequence
  Description of Artificial Sequence: Synthetic coding sequence
atgccacggctgttcttcttccatctcttaggcgtgtgcctgctactgaatcagttctctcgggcagttgctgactcctggatggaagaggttatcaaattatgtggcagagagctggttcgcgcccagatcgccatctgtggaatgtccacttggagcaaacggagcctgtctcaggaagatgcaccccagaccccgaggcccgtcgccgaaatagttccctcctttattaacaaggacacagagacgatcaatatgatgtcggaatttgtcgccaacttgccacaggagctgaagttgactctgagcgagatgcagcccgctctgccccagctacagcaacacgtgcccgtccttaaggattcaagcttactgtttgaggaatttaagaagctgatccgaaaccgacagagtgaggcagccgatagcagcccctccgaattaaagtaccttggtttagacactcattcccggaaaaagagacagctttactctgccctggccaataaatgctgccatgtgggctgcaccaaaagatcattggcaagattctgt

SEQ ID NO: 18462 - DNA, 555 bp, Artificial Sequence
  Description of Artificial Sequence: Synthetic coding sequence
atgccacgcctgttctttttccatctgctcggggtgtgcctcttgctgaaccagtttagcagagcggtggccgactcctggatggaggaagtgatcaagctctgcggaagggaactcgttagggcccagatcgccatctgcggaatgtcaacgtggtccaagcggtctttgtcccaagaagatgcacctcagactcccagaccggtggctgagatcgtccctagcttcatcaataaagacacggagactatcaatatgatgagcgaattcgtggctaatctgcctcaggaactcaaactcaccctgtcggagatgcaaccggcgcttccgcagctgcagcagcatgttccggtgctgaaggactcctctctgctgtttgaagaattcaaaaagttgatccggaatcggcaaagcgaagctgccgattcctcgccgagcgagctcaagtacctgggactggatacccatagtcggaaaaagcgccaactgtacagcgcgttggccaacaagtgctgccacgtgggctgcactaagagatcgctcgctcgtttctgc

SEQ ID NO: 18463 - DNA, 555 bp, Artificial Sequence
  Description of Artificial Sequence: Synthetic coding sequence
atgccgcgattgttctttttccacctgttaggcgtctgcctgctcttaaaccagtttagccgagctgtggccgactcctggatggaagaagtgataaaactgtgcgggcgagagctagtgcgagcccagatcgcaatttgcggaatgagcacctggtccaagaggagcctgtcccaggaggacgctccccagacccctaggcccgttgccgagattgtgccgagcttcattaataaggacacagagactatcaatatgatgagtgaattcgttgccaatctgccccaggaacttaaattgacactgtcggagatgcagccagcgctgccccagcttcagcagcacgttcccgtcctcaaggattccagcctcctcttcgaagagttcaaaaagctgatcagaaatagacagtcagaggccgccgatagctctccctcagaactcaaatatctggggttagacacccattcccgaaagaaacggcaactttactccgccctcgcaaacaagtgttgccatgtgggctgtacgaagcgtagccttgcgaggttctgc

SEQ ID NO: 18464 - DNA, 555 bp, Artificial Sequence
  Description of Artificial Sequence: Synthetic coding sequence
atgccacgtctcttcttcttccacctgctgggagtgtgcttgcttctcaaccagttctcgagggctgtggcggattcttggatggaggaggtcatcaaattatgcgggagagaattagttagggcccagatagctatctgcggaatgagtacctggagtaaaaggtccctgagccaggaggacgctccccagactcctcggccagtggctgagatcgtgccgtcctttatcaataaggatacggaaactatcaatatgatgtcagagttcgtcgcaaatctccctcaggaactgaagctgacgctgtccgaaatgcagcctgcactccctcagctgcagcaacacgtgcctgtcctcaaagactcgtctctcctgtttgaagaattcaaaaagctgatacgcaacaggcagtctgaagcagccgatagcagccctagtgagctcaagtatctgggccttgatacacactcgagaaagaagcgccagctgtattccgccctggcaaacaagtgctgtcacgttgggtgtactaaacgatccctcgcaaggttctgc

SEQ ID NO: 18465 - DNA, 555 bp, Artificial Sequence
  Description of Artificial Sequence: Synthetic coding sequence
atgccccgccttttcttcttccatcttctcggggtgtgcctactcctcaatcagttttcccgtgctgttgcggactcctggatggaggaagtgatcaagctgtgtggccgcgagctggttcgggcccaaatcgccatctgcggcatgtccacttggtctaagaggagtctctcccaggaggacgccccgcagactccccggccggtcgcggagattgttccaagtttcattaacaaggacactgagaccatcaacatgatgtctgagttcgttgctaatttgccccaggaactcaagctcacattgtccgagatgcagcccgcgctgccccagctacagcagcatgtgcccgtgcttaaagactccagtctccttttcgaggagtttaagaagctgatccggaatcgacagtcggaggccgctgactctagtccttccgaacttaagtacctgggtctcgatacgcactctcgcaagaaacgacagctgtacagcgccttggcgaacaagtgctgccatgttggctgtactaagagatcgcttgcacgcttctgt

SEQ ID NO: 18466 - DNA, 555 bp, Artificial Sequence
  Description of Artificial Sequence: Synthetic coding sequence
atgcctagactgttcttttttcaccttctcggcgtgtgccttttgctgaatcagttcagtcgcgccgttgcggattcatggatggaggaagtaatcaaactgtgtggcagagaattagtccgagcccaaatcgccatatgcggcatgagtacatggtcaaagagatctctcagccaggaggatgctcctcagacaccacgccctgtggccgaaatcgtgccatccttcatcaataaggacaccgagactatcaacatgatgtcagagttcgtcgctaatctgccccaggagttgaagctgaccttgagtgaaatgcagcctgctcttccccagctgcagcagcacgtgcccgtcctcaaggatagcagtttgctcttcgaagaatttaagaaactcattcgcaatcgccaatctgaggcggccgactccagtccctctgagctcaagtaccttggcctcgatacacactccaggaagaagcggcagctctacagtgcactagccaacaaatgttgtcacgtaggatgcaccaaaagatcattagctaggttttgc

SEQ ID NO: 18467 - DNA, 555 bp, Artificial Sequence
  Description of Artificial Sequence: Synthetic coding sequence
atgccacgcctttttttctttcacttgctgggcgtctgcctgcttctgaaccagttctcaagggccgtggccgactcctggatggaggaggtgatcaagctgtgtggcagggagcttgtgagggcacagatcgcaatttgcggcatgtctacatggagtaagagatcactgagtcaggaggacgcccctcaaactccacgccctgtggctgaaatcgttcccagcttcatcaataaggacaccgagacaattaacatgatgtcagagttcgtggccaatcttccccaggagttgaagcttactctttccgagatgcagcccgccctgccccagctccagcagcatgttccagttctcaaggactctagtctgttgttcgaggagtttaaaaaacttataagaaatcgccagtccgaggcagccgattcatctcctagcgaactcaagtacttgggcctggatacccattctcgcaaaaaacgccagctctatagcgctctcgccaacaagtgctgccatgttggctgcacaaaacgctccctggctcgcttttgc

SEQ ID NO: 18468 - DNA, 555 bp, Artificial Sequence
  Description of Artificial Sequence: Synthetic coding sequence
atgcctcgtttgttcttttttcatctcttgggagtgtgtctcctccttaatcaattctctagagcggttgccgactcgtggatggaggaagtcattaagttgtgcggaagagaactcgtgagagctcagattgctatttgtggaatgagtacttggtctaaacgatcgttatcgcaagaggatgccccacaaactcctagaccggttgcggagattgttccatcatttattaataaggatacagaaaccattaacatgatgtctgagttcgtggcgaatttgccgcaagaacttaagttgacactttcagagatgcaaccagcacttccacaactccagcagcatgtacctgtcctcaaagattctagtctgcttttcgaagagttcaaaaaacttatacgcaatagacagtccgaagcagctgactcgtctccaagcgagctgaaatatttaggactagacactcattcacgaaaaaagcgccaattatactctgcgctcgcaaataagtgctgccacgtcggatgtacaaaacgaagcttagcacgtttctgc

SEQ ID NO: 18469 - DNA, 555 bp, Artificial Sequence
  Description of Artificial Sequence: Synthetic coding sequence
atgcctagactcttcttcttccaccttctgggggtatgtttacttctgaaccagttttctcgggcagtggcggattcttggatggaagaagtgataaaactctgtgggcgggaacttgtgcgggctcagattgccatctgcgggatgtccacttggtcaaaacggtcactttctcaggaagacgcaccccagacaccaaggccagttgctgaaatagtgccatctttcataaataaagacacagaaacaataaacatgatgagtgaatttgtagccaacctgccacaggaattaaaactcacactctctgaaatgcagccggcgcttcctcagctccagcagcatgttcccgtactcaaagattcctctttattattcgaagaatttaagaaactaatcaggaaccgacagtctgaagccgctgattcctccccttctgaactcaaatatcttgggcttgatacacattccaggaagaagcggcagctgtattccgccttagctaacaaatgctgtcacgtgggatgcacaaaaaggtcacttgcccgattctgc

SEQ ID NO: 18470 - DNA, 555 bp, Artificial Sequence
  Description of Artificial Sequence: Synthetic coding sequence
atgcctagactgttcttctttcaccttctgggagtgtgcctcctcctgaaccagtttagccgggcggtcgccgattcgtggatggaggaggtcattaagctgtgtggacgcgaactcgttcgcgcccaaatcgcaatctgcgggatgtccacgtggtcgaaacggagcctgtcgcaggaggacgccccgcagacgccgcggcccgtggctgaaattgttccttcgttcatcaacaaggatacggaaaccatcaacatgatgagcgaattcgtggcaaatctgccccaggaactgaaacttaccctctcggaaatgcaaccggcgcttccacagctccagcagcatgtgccggtcctgaaggactcttcgctgctgttcgaagagtttaagaagctgatcagaaaccgacagtccgaagcggcagactcatccccatccgagctgaagtacctgggtttggacactcactccagaaagaagcgccaactttactccgctctggccaataagtgctgccatgtcggatgtaccaagcgcagcctggcaagattctgt

SEQ ID NO: 18471 - DNA, 555 bp, Artificial Sequence
  Description of Artificial Sequence: Synthetic coding sequence
atgccacgccttttcttcttccacctgcttggtgtttgtctgctccttaaccaattttcacgcgctgtggcagattcctggatggaagaggtcattaaactgtgtggtcgggaactggtccgcgcacagatagcaatctgcggcatgtcgacctggagcaagagaagcctttcgcaagaagatgccccacagactccacggccagttgctgagattgtgccctcattcataaacaaggataccgaaactattaacatgatgtctgaatttgtggcaaacctgcctcaagagcttaagttgaccctgtcggaaatgcagcccgctctgcctcagcttcagcagcatgtccctgtgctcaaggacagctcactgctgttcgaggagttcaagaagctgattcgaaatagacaatcagaagccgccgattcatccccgtccgagctcaagtacctgggactcgacactcatagccggaagaaaaggcaactttactcagcgctcgccaataagtgttgccatgtggggtgtaccaaacggtccctcgcgaggttttgt

SEQ ID NO: 18472 - DNA, 555 bp, Artificial Sequence
  Description of Artificial Sequence: Synthetic coding sequence
atgccccgccttttctttttccatcttcttggagtctgcctcctcctgaaccagtttagccgggcggttgccgacagttggatggaggaggtcattaaattgtgtggtagagagttggttagagcccagattgcgatttgtggcatgagtacctggtctaagcgctccttgtcacaagaagacgcgcctcagactcctcggcctgtggcggagattgtgccatcatttatcaacaaggataccgagacaattaacatgatgtcagaatttgtggccaatctgcctcaggaactgaagctgacccttagtgaaatgcagccagccctgccccagctgcaacagcatgtccctgtgctgaaggattcttccctgctatttgaggaattcaaaaaactgatccgcaatcgtcagtccgaggctgcagactcctccccatcagagctgaaatacctggggctggatacccactcgcggaagaaacgacagttgtatagcgccctcgcgaacaaatgttgtcacgtgggttgtacgaaaaggtctctggcaagattttgt

SEQ ID NO: 18473 - DNA, 555 bp, Artificial Sequence
  Description of Artificial Sequence: Synthetic coding sequence
atgcctcgtcttttcttctttcaccttcttggcgtgtgtcttttgctgaatcaattttcaagagcagtcgcagactcctggatggaagaagtcatcaaactgtgcggtagagagctggtgcgtgcacagatcgctatttgtggaatgtctacctggtcgaaacggtcactgagccaagaagatgcgccccagacccctcggccagtggctgagatcgtgccttcttttatcaacaaggatacggaaactataaacatgatgtccgaattcgtggcaaaccttcctcaggagctcaaactgactctgtcggaaatgcaacccgcgctgccgcaattgcaacagcacgtgcctgtcctgaaagattcatccctcctctttgaagagttcaagaagctcatcagaaaccgccaatcggaggccgcggatagcagcccgtccgaactcaagtacctcggtctggacacccactcgcggaaaaagcgccaactctactccgcactggccaataagtgttgtcacgttggctgcaccaaaagatccctcgcaaggttttgt

SEQ ID NO: 18474 - DNA, 555 bp, Artificial Sequence
  Description of Artificial Sequence: Synthetic coding sequence
atgccaaggttgttcttctttcatttgctaggcgtgtgcctcttactcaatcagttcagcagggccgtcgccgacagctggatggaggaggtcataaagctttgcggaagggagctcgtgcgggcccaaatcgcgatctgcggcatgagcacttggagtaaacgctccctatctcaggaggatgctccgcagactccaaggcccgtcgctgaaattgtgccctcttttatcaacaaggacacagagacaatcaatatgatgagcgagtttgtcgctaacctgccgcaagaattgaagcttacgctgagcgaaatgcaaccagcgctgccacaactgcagcaacacgtgccagtgctaaaggattcctctttactgtttgaagagtttaagaagttgatccgtaatagacagtctgaagcagccgattcctccccctcagaattgaaataccttggcctggacacccacagccgtaagaagcgtcagctctacagcgctctcgctaataagtgctgccacgtgggctgcaccaagcgatcactagcgcgattctgc

SEQ ID NO: 18475 - DNA, 555 bp, Artificial Sequence
  Description of Artificial Sequence: Synthetic coding sequence
atgcccaggttgtttttcttccacttgcttggagtctgcctgctgttgaatcagttctcccgcgctgttgctgatagttggatggaggaagtgataaagttgtgtgggcgcgaactggtcagagcacagattgctatctgcggtatgagcacgtggtcaaagaggtcactctcacaggaagacgcaccccagacccctcgacctgtggccgaaattgtccctagctttatcaacaaggataccgagaccatcaacatgatgtcagagttcgtggctaatcttcctcaagagctgaagcttacgttgagtgagatgcagccggcactcccacagctccaacagcatgtgcccgtcctgaaagatagctctctgcttttcgaagaattcaaaaagctgatccgaaatcggcagtccgaagcggctgacagcagccctagtgaattgaaatatcttgggctcgacacccacagtaggaaaaaaagacagctctattctgccctggccaacaagtgctgtcacgtcggctgtactaagagaagtctcgcgcgattttgt

SEQ ID NO: 18476 - DNA, 555 bp, Artificial Sequence
  Description of Artificial Sequence: Synthetic coding sequence
atgccgagactctttttcttccatcttcttggggtctgcctgttgctgaatcaatttagccgtgccgtggccgatagttggatggaagaggttataaaactgtgtggacgggagctggtccgggcacagattgcgatctgtggaatgtctacctggagtaagcgcagcctctcgcaggaggacgcccctcagactcctaggcccgtggcggaaattgtcccctcttttataaataaagatacagagacaattaacatgatgagcgagttcgtcgctaacctgccccaggaattaaaactgaccttaagcgaaatgcagcctgccctccctcagctccagcagcacgtgccggtcctgaaggattctagtttactgttcgaggaattcaagaagcttatcaggaaccggcagtccgaggctgccgatagctcaccaagtgagttgaaatacctgggccttgacacccacagtcgcaaaaagaggcagctgtatagcgcccttgctaataagtgttgccacgttggctgtacgaaaagaagcctggcaagattctgc

SEQ ID NO: 18477 - DNA, 555 bp, Artificial Sequence
  Description of Artificial Sequence: Synthetic coding sequence
atgccaaggttattcttctttcatctgctgggggtgtgtctcctgttgaatcagttttctcgagcggtcgcagatagctggatggaggaagtgatcaaactttgcggacgagagcttgtacgggcacagatcgctatttgcggcatgtccacctggtcaaagcggtcgttgtcccaggaagatgccccccagactcccagaccagtggctgagatcgttcccagcttcattaacaaggatacagagactattaacatgatgtcagagtttgtggcgaatttgccacaggagctaaagctcactttaagcgagatgcaaccagcactgcctcagctccagcaacacgtcccggtactgaaggattcgtcgctactcttcgaagaatttaaaaaactcatcaggaatcgtcaatcggaagccgcggactccagtcccagtgagctgaaatatcttgggcttgatactcattcccgtaagaaacgccagctgtactcggctctcgctaacaagtgttgtcatgtcggatgcaccaagcgatccttagcacgcttttgc

SEQ ID NO: 18478 - DNA, 555 bp, Artificial Sequence
  Description of Artificial Sequence: Synthetic coding sequence
atgccaaggctgtttttttttcacttacttggggtctgcctcctcctgaatcagttttctcgggccgtggctgatagttggatggaagaagtgatcaagttgtgcgggcgcgaattagttcgcgcccagattgccatctgtggcatgagtacctggtctaaacgctccttgagtcaagaagatgcaccccaaacccctcgacctgtggccgagatcgtcccatccttcataaataaggatacggaaacaatcaatatgatgagcgaattcgttgccaatctgccgcaggagttgaaactgacgttgtctgaaatgcagcctgcgttaccacagctgcaacaacacgttcccgtgctaaaggacagctcactactattcgaggagttcaagaaattgattaggaataggcaatctgaggctgccgacagcagcccatccgaacttaagtatttaggacttgacactcatagcaggaaaaagcgccagctgtactccgccttggctaataaatgttgtcacgtgggctgcacaaaacggagtctggcccgtttttgc

SEQ ID NO: 18479 - DNA, 555 bp, Artificial Sequence
  Description of Artificial Sequence: Synthetic coding sequence
atgccgcggctgttcttcttccacctgctgggagtgtgcctgctcctcaatcagttctcccgggcagtggccgactcatggatggaagaggtcatcaagctgtgtggccgggaactcgtcagagcccagattgccatctgtggcatgtcaacctggtccaaacgctccttgagtcaggaagatgcgcctcagacgccacgtcccgtggcggaaatcgtgccgtcgtttatcaacaaagatactgaaaccatcaatatgatgtcagaattcgtggctaacctgcctcaagagctgaaacttaccctctcagagatgcagcctgccctgccacagcttcagcagcacgtgccggtgttgaaggactcctcgctccttttcgaagagttcaagaagctgatccggaaccgccaatcggaggcggccgacagcagcccttcggagctgaagtacctcgggctggacactcactcacggaaaaagcggcagctttactccgccctggctaataagtgctgtcacgtcggatgcacgaaacggtcgctggcccggttctgc

SEQ ID NO: 18480 - DNA, 555 bp, Artificial Sequence
  Description of Artificial Sequence: Synthetic coding sequence
atgccgcggctcttcttctttcatttgctcggcgtctgcctcctacttaatcagttctctcgagcagtcgcggactcttggatggaggaagtgatcaaattgtgtgggcgcgagcttgtgcgagctcagatcgccatctgtggcatgtctacctggtcgaagcgatctctatcacaggaggatgcccctcaaacgccgaggcctgtcgctgagatcgtcccatcgttcatcaataaagacaccgagacgatcaatatgatgtccgagttcgttgctaatctgccccaggaactcaaactcaccctcagtgaaatgcagcccgcgctccctcaactgcagcagcacgtccctgttctgaaagacagctcgcttttgttcgaggagttcaagaagttaatccgaaaccggcagtctgaagcagctgattcttccccgagcgagctgaaatacttaggtctcgatacacattcacgaaagaagaggcagctgtattcagcgctcgcaaataagtgctgccatgttggatgcacgaagcgatcgcttgcccggttttgc

SEQ ID NO: 18481 - DNA, 555 bp, Artificial Sequence
  Description of Artificial Sequence: Synthetic coding sequence
atgccgcgactgtttttcttccatcttcttggtgtctgtctgctgctgaaccaattctcgcgcgccgtggcggattcctggatggaagaagtgatcaagctgtgtgggcgagaactcgtgcgggcacaaatcgctatttgcgggatgagcacgtggtctaagcggagcctgtcgcaagaggatgccccccaaactcctcgtccggtggcagaaatcgtgccgtcctttatcaacaaggacaccgaaactatcaacatgatgagcgaattcgtcgctaaccttccacaagaactcaagctgacgctttcagagatgcagcccgcactgccacaactgcagcagcatgtccctgtgcttaaggattcctcgttgctgtttgaagaattcaagaagctcattaggaacagacagagcgaagccgcagatagctccccttcagagctcaagtacctgggacttgacacccattcgagaaagaagagacagctctactccgcactggcaaataagtgttgtcacgtgggttgcaccaagaggtccctcgcacgcttttgt

SEQ ID NO: 18482 - DNA, 555 bp, Artificial Sequence
  Description of Artificial Sequence: Synthetic coding sequence
atgcctagactgtttttctttcatctcctgggggtgtgcttgcttctcaaccagttcagccgggccgtcgccgacagctggatggaggaagtgatcaagttatgcgggagggaacttgttcgcgcacagatcgccatctgcggaatgtctacatggtcaaaaagatcactctcccaggaggatgctccccaaacaccccgtccagtggctgaaattgttccttcttttatcaacaaggatacagagaccatcaacatgatgagtgagtttgtagctaatctgcctcaagaattgaaactgactctgtctgagatgcaaccggcattacctcagttacagcagcacgtgcctgtgctcaaggatagcagcctgctttttgaggaatttaagaagttgatacgcaatagacagtccgaagctgctgatagctctccatctgagctcaaatacctcgggctggatacacattccagaaaaaagcggcagttatacagcgcgcttgccaacaagtgttgccatgtaggatgtaccaaacgatccctcgcgagattttgc

SEQ ID NO: 18483 - DNA, 555 bp, Artificial Sequence
  Description of Artificial Sequence: Synthetic coding sequence
atgccaagactgttcttttttcacctgcttggagtttgcttgctactgaaccagttctcccgcgccgtcgccgattcctggatggaagaggttatcaaattgtgcggtcgggagctggtgcgggctcagatagcaatatgtgggatgagtacgtggagtaaacggagtctctcacaggaagacgccccccagacaccccgcccggtggccgaaatcgttcccagcttcatcaacaaagacactgaaactataaacatgatgagcgagtttgtcgcaaacctgccacaggagttgaagctgaccctctccgaaatgcagcctgctctaccccaattacagcagcatgtcccagtgctgaaggactcttctctgttgtttgaggaattcaaaaagttgattcgaaacagacagtccgaggccgcggactcatcgcccagtgagcttaaatacctgggccttgacacgcactcacggaaaaagcggcagctctacagtgccctagctaacaaatgttgtcatgtagggtgcacaaagagaagcctagctcgattttgt

SEQ ID NO: 18484 - DNA, 555 bp, Artificial Sequence
  Description of Artificial Sequence: Synthetic coding sequence
atgccccggttgttcttctttcaccttctaggagtgtgcctgctccttaatcagttcagccgggccgtggcagattcgtggatggaagaggtgatcaaactatgtggccgagagctcgtcagggcccagattgcaatctgtggcatgtctacctggagtaaacgctcgttgtctcaggaggacgccccacagacacctaggcccgtggccgagattgtcccctcttttattaacaaagacactgaaacgattaacatgatgagcgagttcgttgctaacctgcctcaagagcttaagttaaccctcagtgagatgcagcccgcgcttccccaactgcaacagcatgtccctgtccttaaggattctagcctgctgtttgaggaatttaagaagctcatacgcaaccggcagtccgaagcggctgattccagtcctagcgaactgaagtatctgggtcttgacacccatagcagaaagaagcgccagctgtatagcgcgctggcaaacaagtgttgccatgtcgggtgtacaaagaggagcctggcacggttttgc

SEQ ID NO: 18485 - DNA, 555 bp, Artificial Sequence
  Description of Artificial Sequence: Synthetic coding sequence
atgccgcgcctgttctttttccacttgctgggagtgtgtttgctcctgaaccagtttagccgggccgtcgccgactcctggatggaagaggtgatcaagctctgcggaagagaactcgtccgagctcaaatcgccatctgtgggatgagcacctggtccaagaggtcgctgagccaagaagatgcaccccagaccccgcgcccagtggcggaaatcgtgccatcgttcatcaataaggacaccgagactattaacatgatgtcagagttcgttgctaatctcccgcaggaactgaaactgacgctgtccgagatgcagccagccctccctcagttgcagcagcacgtcccggtgctgaaggattcgagtctgctcttcgaggagttcaagaaactcatccgtaaccgccaatctgaagcagcggactcatccccctcggaattgaagtacctcggcctggacactcatagtcgcaagaaacgccaactctactccgccctcgcaaacaaatgctgccatgtgggatgcactaagcgctctctggcacggttttgc

SEQ ID NO: 18486 - DNA, 555 bp, Artificial Sequence
  Description of Artificial Sequence: Synthetic coding sequence
atgccaaggctttttttcttccatttgcttggagtatgcctgctgcttaatcagttcagcagagcagtggcagacagctggatggaggaagtcatcaagctctgtggccgggaactcgttagggcccagatcgcgatctgcggcatgagcacctggtctaagcgctcgctgtcacaagaagatgccccccaaaccccaagacctgtggcagagatcgtgccttccttcattaacaaggataccgagacaatcaatatgatgagcgaatttgtagcaaatcttccccaggaactgaagctgacactctctgagatgcagcccgccctgccacagttgcaacaacacgttcctgtgctaaaagactcctccctgctattcgaagaattcaagaagttgatccggaaccgacagagtgaggccgccgacagttccccttccgaactgaaatacctgggactggacactcacagcagaaagaagagacagctctattccgcccttgcaaataagtgttgccacgttggctgtacaaagagaagcctagcaaggttctgc

SEQ ID NO: 18487 - DNA, 555 bp, Artificial Sequence
  Description of Artificial Sequence: Synthetic coding sequence
atgcctcggctgttcttctttcatctgcttggggtctgccttctccttaaccaattcagcagagcagtcgcggattcatggatggaggaagtgataaagttgtgtgggcgcgagctggtgagagcacaaattgccatttgcggcatgagcacttggtcgaagagatcgttgtcgcaagaggacgcaccacagacccccaggcctgtggcagaaattgtcccatcgttcattaacaaggacaccgaaactattaacatgatgtccgaatttgtggcaaaccttcctcaggaactgaagctgactctctccgagatgcaacctgccctcccgcagctccaacagcatgtccctgtccttaaagactcgtcgcttctctttgaagagttcaaaaaacttattagaaaccgacaatcagaagccgcagattcgtcgccaagcgaacttaagtacctgggactggacactcattcccgtaagaaaaggcaactttactcggcactggccaataagtgttgccatgttggatgtacgaaacgctccctggctcgcttctgc

SEQ ID NO: 18488 - DNA, 555 bp, Artificial Sequence
  Description of Artificial Sequence: Synthetic coding sequence
atgccccgtttgtttttctttcacctgctcggagtgtgtctcttgcttaatcagttcagtcgtgctgtcgcagattcatggatggaagaggtaatcaaactctgcgggcgtgaactcgtccgggcccaaatcgccatttgcggcatgtccacctggagcaagaggtccttgtctcaggaggatgcaccacagacaccgcgccctgtcgccgaaattgttccttctttcatcaacaaagatacagagacgattaacatgatgagcgaatttgtagccaatctacctcaggaactgaagctgacactatcggaaatgcagcctgcattgcctcagctgcaacaacatgtgccagtgctaaaggactcctccctgctattcgaagagtttaagaaactgatcaggaatcggcagagtgaggccgccgatagctctccgagcgaacttaagtatctgggactggatacccattcacgaaaaaaacgccagctctactctgctctggctaataaatgctgccacgtgggatgcacaaaaaggagcctggcgcgtttctgt

SEQ ID NO: 18489 - DNA, 555 bp, Artificial Sequence
  Description of Artificial Sequence: Synthetic coding sequence
atgccaaggctattcttcttccacctgctgggagtgtgtctgctgctgaaccagttctcgcgtgcagtcgcagattcctggatggaagaagtcatcaaattgtgcggtcgggagttggtccgcgcacaaatcgcaatttgtggtatgagcacatggagtaagcggtcactcagccaagaggatgcgccacagacaccccgtcctgttgcagagatcgttccatccttcataaataaagacaccgagacaattaacatgatgtccgaattcgtagctaacctgccacaggagctgaaactgaccctgagtgagatgcaaccagccctccctcagctacagcagcatgtgcccgtgttgaaggacagctctctgctgtttgaggagtttaagaagcttattagaaatcggcagagcgaagccgccgattctagtccaagtgaactgaagtacctgggtctcgatacccatagccgaaagaagcgccagctgtattccgccctggccaacaagtgctgtcatgttggttgcaccaagaggtctctggcgcggttctgc

SEQ ID NO: 18490 - DNA, 555 bp, Artificial Sequence
  Description of Artificial Sequence: Synthetic coding sequence
atgccccgtctgtttttctttcatctccttggtgtctgtctgctgctcaaccagttttcccgggcagtcgcagatagctggatggaagaagtgattaagttgtgcgggcgggagcttgttcgcgcccaaatcgccatttgtggaatgtccacctggtccaagaggtcactctcgcaagaagatgctccacagacccctcgacctgtggctgagattgtgcccagcttcataaacaaggacacggaaaccattaacatgatgtcagaattcgtggccaacctgccgcaggaactgaagctcaccttgtccgaaatgcagccagctctcccacagctgcaacaacacgtgccagtgcttaaggattcctcactgctttttgaagagtttaagaagctgatcaggaacagacaatcggaagcagcagactcctcgccatccgagctgaagtatctgggattggatactcattcgaggaaaaagcgacagctttacagcgcattggcaaacaaatgctgtcatgtcggatgtactaaaagatccctggcacgcttttgt

SEQ ID NO: 18491 - DNA, 555 bp, Artificial Sequence
  Description of Artificial Sequence: Synthetic coding sequence
atgccccgactgttcttttttcacctcctgggagtgtgcctccttttgaatcaattcagcagagctgtcgcagacagttggatggaggaagtgattaagctgtgcggacgggagctcgtgagagcgcaaattgcgatatgtgggatgtcgacttggtcaaagcgttcactctcgcaggaagatgcacctcaaactcctagacctgtggcagaaatcgtcccgtcttttatcaacaaggataccgaaactattaacatgatgtcagagtttgtcgcaaatctgccccaggaacttaaacttaccctttccgagatgcaaccagcactgccgcagttgcaacaacatgttccagtactgaaagattcctcccttctgtttgaagaattcaaaaagttgattcggaacagacagagcgaagccgcagactccagccctagtgagctgaagtacctgggcttggatacgcacagccgaaagaaacgacagctttactcggccctcgctaacaagtgttgccatgtaggttgtaccaagcgctcactggcccgcttttgt

SEQ ID NO: 18492 - DNA, 555 bp, Artificial Sequence
  Description of Artificial Sequence: Synthetic coding sequence
atgccccgtcttttcttcttccacctgctgggtgtgtgtctgctccttaatcaattcagccgggccgtcgcggattcatggatggaggaagtgattaagttgtgcggaagggaactggtgcgggcacagatcgccatctgcggcatgtctacgtggtcaaagcggtcgctgtcgcaggaggatgcgccacagacgccaagaccggtggcagaaatcgtaccatcgtttatcaacaaggacaccgaaactatcaacatgatgtcggagtttgtcgcgaatttgccgcaagaactcaagctgactctgagcgaaatgcagcctgcactccctcaactgcagcagcatgtgcccgttctcaaagacagcagtctgctgttcgaagaattcaaaaaactcatccgcaatagacagtcggaggcagcggattcctcaccgtctgagcttaaatacctgggtctggacacccacagcagaaaaaagcgtcaactctacagcgctctggctaacaagtgttgccatgtgggatgcaccaagcgatccctcgcccgcttttgc

SEQ ID NO: 18493 - DNA, 555 bp, Artificial Sequence
  Description of Artificial Sequence: Synthetic coding sequence
atgccacgccttttctttttccatctcctgggagtgtgccttctgctgaaccagttcagcagagctgtggcagattcctggatggaagaagtgattaaactttgtggaagagaactggtccgcgcacagatcgcaatatgtggcatgtcgacttggtccaagcggtcgctctctcaggaggatgcgcctcagactccaagaccagtcgcagagattgtgccatccttcattaacaaggacaccgagacgatcaacatgatgtcggaatttgtggccaatctgccccaggagttgaagctgacgctttcggagatgcaacctgccctcccccaattgcaacagcacgtccccgttctcaaagattccagccttttgtttgaggagttcaaaaaacttattcgcaaccgacagagcgaagccgcagattcatcccctagcgaactcaaatacctgggtctggatacccactctaggaagaaacgacaactctactcggcgttggccaataagtgttgccacgtggggtgtactaaacgtagcttggccagattctgc

SEQ ID NO: 18494 - DNA, 555 bp, Artificial Sequence
  Description of Artificial Sequence: Synthetic coding sequence
atgccaagactgttctttttccaccttcttggagtgtgtctgctccttaaccaattttcgcgcgctgtggctgactcttggatggaagaagtcattaagttgtgcggccgggagctggtgcgcgcccagattgctatatgtgggatgtcgacatggagcaaacgctccctcagccaggaggacgccccccagactcctaggcccgtagccgagattgttccaagttttatcaataaggatacggaaaccatcaacatgatgtcagaatttgttgccaatcttccacaggagttgaagttgaccctttccgagatgcaacctgcgctcccacagttgcagcagcatgtccctgttctgaaggacagtagcctgctcttcgaggagttcaagaaattaatccgaaaccggcagagcgaagcagcagactcaagcccctcagaacttaaatatttaggtctcgacactcattcaaggaaaaagagacaactttactcagctctcgccaataaatgttgccatgttggttgcactaaacggagtcttgcgaggttctgt

SEQ ID NO: 18495 - DNA, 555 bp, Artificial Sequence
  Description of Artificial Sequence: Synthetic coding sequence
atgccccgcttgttcttttttcatcttttaggcgtgtgcctccttttaaaccaattcagtcgggctgtggcggattcctggatggaagaagttataaagctctgcggtcgtgaactggtacgggcgcagatcgccatctgcggcatgtccacctggtcaaaaaggtcattatcccaggaggatgcaccgcaaactcctagacctgtagctgaaatcgtgccttctttcatcaataaagacacagaaacgattaacatgatgtcagagttcgtggccaaccttcctcaggagctgaaactgacactgagtgagatgcaaccagccttgccacagctgcaacagcacgtgccagtgctgaaggattcctcactcctgttcgaggaattcaaaaagctgattcgcaatagacagtctgaggccgccgactcatcgccgagcgagctaaagtacctcgggctggacacacattctcgcaaaaaacggcagttatatagtgctctcgccaataagtgttgtcacgtcggctgcaccaaaagaagcctggctcggttttgc

SEQ ID NO: 18496 - DNA, 555 bp, Artificial Sequence
  Description of Artificial Sequence: Synthetic coding sequence
atgccacgattgttctttttccatcttctgggagtctgtcttttgctcaaccagttttccagagcagtcgcagattcgtggatggaggaagtgataaagctctgtgggcgtgaacttgtgcgggctcagattgcgatttgtgggatgtccacgtggtccaaacggtccctgtcacaggaagatgcaccacaaactccaaggccggtggcagaaatcgtgccatcgtttatcaataaagacactgaaactatcaacatgatgtccgaatttgtggcaaaccttccacaagaacttaaactgacgctctcggaaatgcagcccgccctcccacagcttcaacagcatgtgcctgtcctcaaggatagctcgctcttgttcgaagaattcaaaaagctgatcagaaacagacaatccgaggccgcagattcgtcgccgtccgagctcaagtacctgggcctggacacccattcccggaagaagagacaactgtactcagccctggcaaacaaatgctgccacgtggggtgtaccaagaggtcactggcacgattctgc

SEQ ID NO: 18497 - DNA, 555 bp, Artificial Sequence
  Description of Artificial Sequence: Synthetic coding sequence
atgccacgcctgttctttttccacttgcttggagtgtgcttgctgcttaaccagttctcgcgtgctgtggctgactcctggatggaggaagtcattaaactttgtggacgggaactggtgcgagcgcaaatcgcgatttgcggaatgtccacctggagtaagcgctcgctatcccaggaggatgcaccgcaaacaccacgcccagtggctgagatcgtgccatcgttcattaacaaggataccgaaacgataaacatgatgagcgagtttgtggcaaacctgccccaagagcttaagctgacgctgagcgaaatgcagcccgcccttccccagctgcagcagcacgtgcccgtcctgaaggatagttcgttgctgttcgaagagttcaaaaagctgatccgcaatcgccagtccgaagcggccgattcttctccaagcgagctaaagtacctcggcctggatacacactcccgcaagaaacgccaactgtactcggcattggcgaacaaatgttgtcacgttggatgtacaaagcgttcgttggcgagattttgt

SEQ ID NO: 18498 - DNA, 555 bp, Artificial Sequence
  Description of Artificial Sequence: Synthetic coding sequence
atgcctagactctttttcttccatctccttggagtttgccttcttcttaaccagttttcacgggccgtggccgattcctggatggaagaggtcattaaactctgtggtagagagctcgtgcgagcgcagattgcaatttgtggaatgtccacttggtccaagagatcattgtcgcaggaagatgctcctcagacccctaggccggtcgccgaaatcgtgcccagcttcatcaacaaggataccgaaaccataaacatgatgtcagaattcgtcgcaaatctgccacaagaattgaaacttaccctgtccgagatgcaacccgcattgccacagctgcagcagcatgtgcctgtgctcaaggacagttcgctcctgtttgaggagtttaagaaacttattcgtaacagacaatccgaagcagcagatagctcgccatcagaattgaaatacttgggactggacacccatagccgcaagaagagacagctctactccgctctcgcaaacaagtgttgtcatgttggctgcaccaaaagaagcctcgcccgcttttgt

SEQ ID NO: 18499 - DNA, 555 bp, Artificial Sequence
  Description of Artificial Sequence: Synthetic coding sequence
atgcctaggctgttcttttttcacctgcttggtgtgtgcctgcttctgaaccagttcagccgcgccgttgcggatagctggatggaagaagtcatcaagctctgtgggcgggaacttgtgagagctcagattgcaatatgtggaatgtcaacctggtccaaaaggtcgctctcccaagaggatgcaccccagacgcctcgtccagtcgcggaaattgtgccgtcgttcattaacaaagataccgagacgatcaatatgatgagcgaattcgtcgctaacttgccacaagagctgaagctgactttgtcagaaatgcaacctgccctcccacaacttcaacaacatgtgccggtcttgaaagactcatcgcttctttttgaagaattcaagaagctcatccgcaatcgtcaatcagaagccgctgatagctccccttccgaattgaagtaccttggtcttgatactcacagcagaaagaagcgtcaactgtactccgcactcgccaataagtgttgtcacgtgggctgcaccaagagatcactggcaagattctgc

SEQ ID NO: 18500 - DNA, 555 bp, Artificial Sequence
  Description of Artificial Sequence: Synthetic coding sequence
atgccaagactgtttttttttcacctcttgggagtgtgtctgctcctaaaccagtttagccgcgccgttgccgattcctggatggaggaggttattaagctttgcggtcgtgaactggtgagagctcagattgctatatgtgggatgagtacctggtctaagagatctctttcgcaggaagacgcaccccagacgcctagacctgttgctgagatcgtgccctcttttatcaataaagatacggaaacgataaatatgatgtcagaatttgtggcaaacctgcctcaggagcttaagttgactttgtcagaaatgcagccagcactgcctcaactacagcagcatgtgccggtgttgaaggattccagcctcctctttgaggaatttaaaaagctgatcaggaaccgacagtccgaggccgccgacagttccccttccgagctgaagtacctcggcttggacacccattccagaaagaaaaggcagctgtactctgccctggctaacaaatgctgccacgtgggatgcaccaaacgcagtctggccaggttctgc

SEQ ID NO: 18501 - DNA, 555 bp, Artificial Sequence
  Description of Artificial Sequence: Synthetic coding sequence
atgcctagactctttttctttcacctcctgggagtttgcctgctccttaaccagttctctcgcgcggtcgcggactcctggatggaggaggtgatcaagctctgtggccgagaacttgtcagggcccaaattgccatctgcggaatgtctacctggtcaaagcgaagcctctcccaggaggacgccccgcaaacccctcgcccggtcgccgaaattgtgccttcctttatcaacaaggatacggaaactatcaacatgatgagcgagttcgtcgcgaatctgccgcaggagctgaaactgaccctgtcagaaatgcaaccggcactgccacagttgcaacagcacgtcccagtgctgaaggattccagcttgctgttcgaagaattcaaaaagctgatccgcaaccggcagtccgaagcagcagatagcagccctagcgaacttaagtacctgggactggatacccacagcaggaaaaagagacagctgtacagcgccctcgccaacaaatgctgtcatgtgggatgtactaaaagatcactcgctcggttctgc

SEQ ID NO: 18502 - DNA, 555 bp, Artificial Sequence
  Description of Artificial Sequence: Synthetic coding sequence
atgccaagactgttctttttccatttgctcggagtgtgccttcttttgaatcagtttagcagagcagtggccgattcatggatggaagaggtcattaagctgtgtggaagagagctggtgagggcacaaattgcgatctgcggcatgagcacttggtctaagaggagcctgtcccaggaggacgctcctcagacgcccaggccggtggccgagatagtgccgagctttatcaacaaagacaccgagactataaacatgatgagtgaatttgtcgcaaacctcccccaagaactcaagctcaccctctccgaaatgcaacctgccctgccccaattgcagcagcatgtgccagttcttaaagattcctccctgctgttcgaagaattcaagaaacttattcgcaatagacaatcggaagcagcagatagtagcccctccgaacttaagtacctcggtctggatacccactcacgcaagaagaggcaactctacagcgcccttgcaaacaaatgctgtcatgtaggttgtactaagcgctcgctggctagattttgc

SEQ ID NO: 18503 - DNA, 555 bp, Artificial Sequence
  Description of Artificial Sequence: Synthetic coding sequence
atgccccgtttattttttttccatcttttgggcgtttgcttactgctcaatcagttctcgagggccgttgccgattcatggatggaggaagtcataaaattatgcggcagagaattggtgcgagcacagatcgcgatatgcggaatgtcgacctggtcaaagaggtcgcttagccaggaggacgcgccacagacaccacgaccagtggcggaaattgttccttcctttataaacaaggataccgaaacaatcaacatgatgtccgaatttgtggcgaacctaccacaggaactgaaactcactctatcggaaatgcagcctgcactgccccagctgcaacaacatgtccctgtcctcaaggacagtagtttgctgttcgaggagttcaaaaagcttataagaaacaggcagtccgaagccgcggactcttctccttccgaattgaagtacttggggctggatacacactctaggaagaagcgtcagctttacagtgcattggctaacaagtgttgccacgtgggatgtactaaacggtcgctggctaggttctgt

SEQ ID NO: 18504 - DNA, 555 bp, Artificial Sequence
  Description of Artificial Sequence: Synthetic coding sequence
atgccgcggctgttcttcttccaccttctcggcgtgtgtctcctccttaaccaatttagcagggccgtggcggacagctggatggaggaggtcatcaaactgtgcggtcgcgagctggtgcgggcccagattgcgatctgcggaatgtcgacctggtccaaacgctccctgagccaggaggacgccccacagacccctaggccagtcgctgaaattgtcccttcattcatcaataaggacaccgaaactatcaatatgatgtctgagtttgttgctaacctgccgcaggaactgaaactgactctgtcagaaatgcaaccggcactcccccagctgcagcaacacgtgccagtgctgaaggattcctccctcctgttcgaagaattcaagaagctgatcagaaacagacaatcggaagcagcggattcgtcgccgtccgagttgaagtacttgggacttgacacgcattcgcgaaaaaagcggcagctctactcagccctcgccaacaagtgctgccatgtggggtgtactaagcgcagcttggcacgcttttgc

SEQ ID NO: 18505 - DNA, 555 bp, Artificial Sequence
  Description of Artificial Sequence: Synthetic coding sequence
atgccgcggctcttcttcttccacctcctcggggtctgcctgttgctgaatcagttctcgagagccgtcgccgattcctggatggaggaggtgatcaaactgtgcggacgcgaactggtgcgtgcacagatcgcaatttgcgggatgtccacctggtccaagagaagcctgtcgcaagaagatgcacctcagaccccgcgcccggtggccgaaatcgtcccatccttcatcaataaggacactgaaactatcaacatgatgtcggagttcgtcgccaaccttccacaagaactgaagctgaccctgtcggagatgcagccagccctgccgcagcttcagcaacacgtgccagtgctcaaggactcgagcctgctctttgaagaattcaagaagctgatccgcaaccgccagtccgaggccgctgactcctccccttcagaattgaaatacttgggactggacacccattcgagaaaaaagaggcaactctactcggcgctcgcgaacaagtgttgtcacgtgggatgtaccaagcgctcgctggcgcgtttttgc

SEQ ID NO: 18506 - DNA, 555 bp, Artificial Sequence
  Description of Artificial Sequence: Synthetic coding sequence
atgccccggctcttcttcttccatctccttggggtttgcctcctgctgaatcaattctctagggcagtcgccgactcctggatggaggaagtgatcaagctgtgcggacgagagctcgtgcgcgcacaaatcgccatttgcggcatgagcacttggagcaaaagatcattgtcccaggaggacgcgccgcagacgccgcggccggtggcggagatcgtgccttcttttatcaacaaggacactgaaaccatcaatatgatgtcggaattcgtggccaacctgccacaggaactcaagctgactctgtccgaaatgcagccagccctgccgcaactgcaacaacacgtgcctgtccttaaggattcatctctcctgtttgaggaattcaaaaagctcattaggaacaggcagtccgaagccgcagattcatcaccatcggagctcaagtacctcggactggacacccactcccgcaaaaagcggcagctctactcggcccttgctaacaagtgctgccacgtcggatgtaccaaacgctcacttgctcggttctgt

SEQ ID NO: 18507 - DNA, 555 bp, Artificial Sequence
  Description of Artificial Sequence: Synthetic coding sequence
atgcctagactgttcttttttcatctgctcggggtttgtctactgctgaaccagttcagccgagccgtagcggattcttggatggaagaggtgatcaagttgtgtggccgcgaactggtacgcgcccagattgctatctgtgggatgtctacctggagcaaacgtagcctcagccaggaagacgccccccagacgccccggccagtggcggagatcgtgcccagttttattaacaaagacactgaaactataaacatgatgagtgagttcgtggccaaccttccacaggaacttaaacttaccttaagcgagatgcaaccggcattaccccagctccagcaacatgtgcccgtgcttaaagattcttccctcctgttcgaggagtttaaaaaacttattcggaacagacagagtgaggcagcagacagctcaccatcagagctcaaataccttggcctcgacactcatagccgaaaaaagcggcaattgtattctgccctggcaaacaagtgttgtcacgtagggtgtactaaacggtcccttgcaagattctgc

SEQ ID NO: 18508 - DNA, 555 bp, Artificial Sequence
  Description of Artificial Sequence: Synthetic coding sequence
atgccaaggctattcttctttcaccttcttggagtatgtctgcttctgaaccagttttcacgggccgtcgctgatagttggatggaagaagtcataaaattatgcggacgggaactcgtgagggcacagattgcaatctgcggaatgagtacatggagtaaacgaagtctttcacaggaggacgcacctcagacacccagacccgtagcagaaatagtcccttctttcattaacaaagacacagaaacaattaatatgatgtcggaattcgtagctaatctccctcaggaactgaaattaactttatctgagatgcagccagccctcccccagctccagcagcatgttcccgtactcaaagatagttcccttcttttcgaagaatttaagaaactcatacgcaatcgccagtccgaagcggctgattcgtctccttcagagctcaaatatctcggacttgatactcattctagaaaaaaaagacagctatatagtgccctcgcgaacaaatgttgtcatgtagggtgcactaagcggtccctcgctagattctgt

SEQ ID NO: 18509 - DNA, 555 bp, Artificial Sequence
  Description of Artificial Sequence: Synthetic coding sequence
atgccgaggctgtttttctttcacttgctgggagtgtgcctgctgctgaaccagtttagccgcgctgtcgcggactcctggatggaggaggttatcaagctctgtggacgcgagttggtccgggcgcagatcgctatctgtggaatgtcgacgtggtcaaaacggtcgctgtcccaggaagatgccccccagactcctcggccagtggctgagattgtgccatcgtttatcaacaaggacaccgagactatcaatatgatgtcagaattcgtcgcgaatctgccacaggaactgaagctgaccctgtcggaaatgcagcccgcattgcctcaactccaacagcacgtgcctgtcctcaaggacagctcgctgctgttcgaagagttcaaaaaactcatccgcaataggcagtcggaggcagcagattcttcgccgtcagagcttaagtacttgggcctcgacacccatagcagaaagaaacggcagctgtactccgctctggcgaacaaatgctgccatgtgggatgcactaagagatccctggcccggttctgt

SEQ ID NO: 18510 - DNA, 555 bp, Artificial Sequence
  Description of Artificial Sequence: Synthetic coding sequence
atgccaaggctcttttttttccatctgcttggagtgtgtctcttgcttaatcagttttcacgcgcagtagccgattcatggatggaggaggtgatcaagttgtgtggacgcgagctggtgcgtgcccagattgctatctgtggtatgtcaacttggtccaaaaggtcactgagtcaggaagatgcccctcagactccaaggcctgtcgctgagattgtacccagctttattaacaaggacactgagacaatcaatatgatgtccgaattcgtggcaaatctcccccaggagcttaaattgactctgtctgagatgcagccagcattgcctcaactgcaacagcacgtacccgtcctgaaagactctagccttctttttgaggagttcaagaagctgatccgtaatcgtcagtctgaagctgcagacagctctccctccgagttgaaatacctgggattggatacacactcccgtaagaaacgtcagctgtacagcgctttggcaaacaagtgctgccacgtgggatgtaccaagaggagtttggcccgcttctgt

SEQ ID NO: 18511 - DNA, 555 bp, Artificial Sequence
  Description of Artificial Sequence: Synthetic coding sequence
atgccgcgactatttttttttcatttattaggtgtatgtttattactaaatcaattttcgcgtgcggttgcggattcgtggatggaagaagtaataaaactatgtggtcgagaattagtacgtgcgcaaatagcgatatgtggtatgtcgacgtggtcgaaacgttcgttatcgcaagaagatgcgccgcaaacgccgcgtccggttgcggaaatagtaccgtcgtttataaataaagatacggaaacgataaatatgatgtcggaatttgttgcgaatttaccgcaagaactaaaattaacgctatcggaaatgcaaccggcgctaccgcaattacaacaacatgttccggttctaaaagattcgtcgctattatttgaagaatttaaaaaattaatacgtaatcgacaatcggaagcggcggattcgtcgccgtcggaattaaaatatctaggtctagatacgcattcgcgtaaaaaacgtcaattatattcggcgttagcgaataaatgttgtcatgttggttgtacgaaacgttcgctagcgcgattttgt

SEQ ID NO: 18512 - DNA, 555 bp, Artificial Sequence
  Description of Artificial Sequence: Synthetic coding sequence
atgccccggctttttttttttcacttgttgggtgtctgccttctcttgaaccaattttcaagggcagttgctgacagctggatggaagaagtgatcaaactctgcggtagggaattggtgagagctcagatagcgatctgtggaatgagtacatggagtaaaaggtctctctcccaagaggacgcacctcagacccctcggcctgtggccgagatcgtgccaagcttcattaacaaggacaccgagacaatcaatatgatgagtgagttcgttgcaaatttaccacaggagttgaaacttacactgagcgaaatgcagcctgctctgccccaacttcagcaacacgtccccgtgctgaaagattcatctttgctgttcgaagaatttaaaaagttgattagaaaccgacaaagtgaagctgcggacagcagcccatctgaactgaaatatctgggtctggatacgcactctagaaagaaaaggcaactgtacagtgctctggcaaacaagtgttgtcacgtggggtgcaccaagaggagtctggccaggttttgc

SEQ ID NO: 18513 - DNA, 555 bp, Artificial Sequence
  Description of Artificial Sequence: Synthetic coding sequence
atgccacgactgtttttcttccacctgctcggggtgtgtctgctgctcaaccaattctcacgtgctgtggcggacagttggatggaagaagtaatcaagctgtgtggcagagaattagtgcgcgcacagatagctatctgtggcatgtcaacctggtccaaacggtccctgtctcaggaagacgctccccagacgccaagacctgtcgccgaaatagtgcctagcttcatcaataaagacaccgagaccattaatatgatgtctgagttcgtcgccaatctgccccaggagctgaagctcacactgagtgaaatgcaaccagctttaccacaactccagcagcacgtgccagtgctcaaagattcctccctcctttttgaagagtttaagaagctgatcaggaatcgccagtccgaagccgccgattccagcccgtcggagcttaaatatctggggctggatactcatagtcggaaaaagagacaactatattcagcccttgcaaataaatgctgccacgttggctgcaccaaacgctctcttgcccggttctgt

SEQ ID NO: 18514 - DNA, 555 bp, Artificial Sequence
  Description of Artificial Sequence: Synthetic coding sequence
atgcctagactgttttttttccatctactcggggtatgtctcctcctcaatcagttcagcagggccgtggcagacagttggatggaggaggtaatcaaactgtgtggccgcgagctcgtgagggcccaaattgccatatgtgggatgtcaacttggtcaaagcgtagtctgagccaggaggatgctcctcagaccccaaggccagtggccgaaattgttccctctttcataaataaggatactgagaccataaacatgatgagcgagttcgtggctaaccttcctcaggaactgaagctgacactaagtgaaatgcagcctgcactgccacagttacagcagcatgtgcccgtccttaaggactccagtttactgttcgaggagttcaaaaagctgatccggaataggcaatcagaagccgccgatagcagcccaagcgagctcaaatatttgggcttggatacccattccaggaaaaaacgccaactctattccgccctcgcaaataaatgttgccacgtggggtgtactaaaaggagcctggcaaggttctgc

SEQ ID NO: 18515 - DNA, 555 bp, Artificial Sequence
  Description of Artificial Sequence: Synthetic coding sequence
atgccaaggctgttttttttccacctgctgggcgtttgtctcttgcttaaccaattctctagagccgtcgccgacagttggatggaggaggttatcaaactgtgtgggcgagaactggtcagagcccagatagcgatttgcgggatgagcacctggtctaaacggagcctgtcccaggaagacgccccccagacccctcggcccgtcgccgagatcgtaccttcctttataaataaggacaccgagactattaatatgatgtctgagtttgtggcaaatcttccgcaggaactgaagctgactctctccgaaatgcagcctgccttgccgcaactgcagcaacacgtgcctgtgctgaaggactcctcactgttgttcgaggaattcaaaaagctgatccgcaacaggcagagcgaggccgccgactctagtccgtctgagcttaaatatctgggcctggacacacactcacgaaaaaagagacaactgtacagtgccttggctaataagtgctgccacgtggggtgcacaaaaagatccttggctcgcttctgc

SEQ ID NO: 18516 - DNA, 555 bp, Artificial Sequence
  Description of Artificial Sequence: Synthetic coding sequence
atgcctcgcctatttttctttcaccttctcggcgtgtgtctgctgctcaaccagtttagccgagctgttgctgattcctggatggaggaggtgatcaagttatgcgggcgggaacttgtacgggcgcaaattgcgatctgcggaatgtctacctggtcaaagaggagcctaagccaggaggacgcaccacaaacaccacgccctgtcgccgaaattgtcccctccttcattaataaagataccgaaactattaacatgatgagcgaatttgtagctaatttgccacaggagctgaaactgaccctaagcgagatgcagcctgcccttccgcagcttcagcagcacgtgcctgtgcttaaggactcctccctgttgttcgaggagttcaagaaactgatccggaataggcaaagtgaagccgccgattcttcaccaagcgagcttaagtatctgggacttgacacccactccagaaagaagcgccagctgtactccgctctcgctaacaaatgttgccatgttggctgcacaaaaaggagtcttgcgagattctgt

SEQ ID NO: 18517 - DNA, 555 bp, Artificial Sequence
  Description of Artificial Sequence: Synthetic coding sequence
atgccaagactgttctttttccacctcctgggagtgtgtctgctcctgaaccagttcagtcgggcggtcgcagactcgtggatggaggaggtgatcaagttgtgcggccgtgaactcgtccgcgcacaaatcgctatctgtggtatgagcacttggtcaaagcggtcgctctcacaagaggacgcgccgcagactccgcgccctgtcgccgaaatcgtgccatccttcatcaacaaggataccgaaaccatcaacatgatgtccgaattcgtggcgaatctcccgcaagaactcaagctcactttgagcgaaatgcagcctgcactgccccagctgcagcagcatgtcccggtgctgaaggacagctcgctcctgtttgaggaattcaaaaagctgatccgcaatcggcagtcggaagccgctgactcgagcccgtcagagctgaagtacctgggactggacacccacagccggaagaagcgccaactctatagcgcgctggcgaacaaatgctgccacgtgggatgcactaagcggtccctggcgcggttctgt

SEQ ID NO: 18518 - DNA, 555 bp, Artificial Sequence
  Description of Artificial Sequence: Synthetic coding sequence
atgccgaggctattcttcttccatctgctgggagtctgcttgcttctcaatcagttcagccgggctgtcgccgatagctggatggaggaagtgattaaactgtgtggacgtgagcttgttcgggcccagatcgcaatctgcggaatgagtacatggagtaagagatcactatcccaggaggacgccccccagacccccaggcctgtggccgagattgtgccgtccttcattaacaaggacacagagacaatcaacatgatgagcgagttcgtagcaaacctgccacaagaacttaagctgacactgtccgaaatgcagccagcactccctcaacttcaacagcatgtacccgttctgaaggatagcagccttctatttgaggagtttaagaagctcatccgtaatcggcagtccgaggcagctgactcaagccctagcgaattaaagtacctgggtctagatactcattctaggaagaaaagacagctctatagtgctttggctaacaaatgttgtcatgtcggatgcactaagagaagcttagcccgcttttgt

SEQ ID NO: 18519 - DNA, 555 bp, Artificial Sequence
  Description of Artificial Sequence: Synthetic coding sequence
atgccgcggctgttcttcttccacctgctgggggtgtgcctgctgctgaaccagttttcgagagccgtcgccgactcgtggatggaagaggtgatcaagctgtgcggtcgagaacttgtcagggcccagatcgcaatatgtggaatgtccacttggtccaagaggtccctctcacaggaggatgctcctcaaacgcctagaccggttgcggaaatcgtgccgagctttatcaataaagacaccgagactatcaacatgatgtcagaattcgtggcaaatctcccgcaggaactgaagctcactctcagcgagatgcaacccgccctgccacagttgcagcagcacgtgcccgtccttaaggattcatccctgttgttcgaggaattcaagaaattgattcgcaacagacaatccgaagcagccgactcgtcaccgtctgaactgaaatatctgggcctcgacacccacagccggaagaagaggcagttgtactcggcactggcaaacaagtgttgccatgtaggatgcaccaaacgtagccttgcgcgcttttgc

SEQ ID NO: 18520 - DNA, 555 bp, Artificial Sequence
  Description of Artificial Sequence: Synthetic coding sequence
atgcctcgactgtttttttttcacttactcggtgtgtgccttttactgaaccagttctcccgcgccgtagccgacagctggatggaagaggtgatcaagctctgtggtcgagagctggtgcgcgcgcagatcgcgatttgcggtatgtccacctggtctaaacgctcactgtcacaggaggacgccccgcagacaccgaggccagttgccgagatcgtgccttccttcattaacaaagacactgagacaattaatatgatgagcgagttcgtggcaaatctgcctcaggagctgaagttgaccctgagcgagatgcaaccagctctgccacaactgcagcagcacgtgccagttctgaaggatagctctcttcttttcgaggaatttaagaagctgatccgtaacaggcaaagcgaggcagccgattctagccccagcgagctgaaatacctgggcctggacacccacagtcggaagaagcgacagctgtacagcgcactggctaataagtgctgtcacgttggctgtactaaacgcagcttggcacgcttttgc

SEQ ID NO: 18521 - DNA, 555 bp, Artificial Sequence
  Description of Artificial Sequence: Synthetic coding sequence
atgccgagattgtttttcttccaccttctgggagtttgtttgctcctcaatcagtttagccgagcagtagctgactcctggatggaggaagtcatcaaactgtgtggccgggagctagtgcgcgctcagatcgccatctgcggtatgtctacgtggagtaaaagatccctttcgcaggaagatgcccctcagacaccgagacctgtcgctgagatcgtaccgagcttcatcaacaaagatactgagacgataaacatgatgtccgaatttgtcgccaatctgcctcaagagctgaagctaacactgtccgaaatgcagccagctcttcctcagctccagcaacacgtgccagtcctaaaggacagcagtctactgttcgaagagtttaaaaagcttattaggaacaggcagtccgaggccgccgattcctccccctcagagctaaaatacctaggtctggacactcattccaggaagaaacgccagctttactctgctctggcaaataagtgctgccacgtggggtgcacaaagcggtccctagcccgcttctgc

SEQ ID NO: 18522 - DNA, 555 bp, Artificial Sequence
  Description of Artificial Sequence: Synthetic coding sequence
atgccgcgactattcttctttcatctccttggcgtttgtttgctgcttaatcagttttctagggcagttgcagacagctggatggaagaggtgatcaagctctgcggacgggagctcgttagggcacagatcgcgatatgcggcatgtcaacctggtctaagcgatctctgagtcaagaggatgccccgcagacccccaggccagtcgctgagatcgttccgtccttcatcaataaggacacggagacaatcaacatgatgtccgagtttgtggccaaccttcctcaggagttgaagctaacgctttcagagatgcagcccgccctccctcaactgcagcagcacgtgccagtgcttaaggactcgtccctgctattcgaagaatttaagaaactgattaggaacaggcagtccgaggccgccgatagcagtcccagcgagctgaaatacttagggctggacacgcacagccgtaagaaacggcaactatactctgccttggcaaataagtgctgtcatgtggggtgtaccaagcgaagtcttgcacgcttctgc

SEQ ID NO: 18523 - DNA, 555 bp, Artificial Sequence
  Description of Artificial Sequence: Synthetic coding sequence
atgcctagactcttcttttttcacttgctcggagtgtgtctgcttcttaaccagttcagccgcgcagtggccgacagctggatggaggaagtgattaaactttgtggcagggaactggtgcgcgcccagatagctatttgcggaatgtcgacttggtcgaagagatcactcagccaagaggacgcgcctcaaacccctcgccctgtcgccgaaatagtgccatccttcattaacaaagatacggaaactattaacatgatgtccgaatttgtcgcaaatctgccacaggaactgaagctgactctttctgagatgcagccagcactgccacagctccaacaacatgtgccagtgctgaaggattcctcgctgctgtttgaagaattcaaaaaacttattagaaacaggcagtcggaggcagcagattcaagcccaagcgaactgaagtacttgggactggacactcatagcagaaagaaaagacaactttactcagcacttgcgaataagtgctgtcatgtgggatgcactaagcgcagccttgccagattttgt

SEQ ID NO: 18524 - DNA, 555 bp, Artificial Sequence
  Description of Artificial Sequence: Synthetic coding sequence
atgccccgccttttctttttccacctgctgggagtgtgcctccttctgaaccaattctcacgcgctgtcgccgatagctggatggaggaagtgattaagctgtgcggtcgcgaactggtccgggcccagatcgctatatgcggcatgagcacttggtcgaaaagatcgctctcgcaagaggacgcgcctcagactcctagaccagttgctgaaatcgtgccttcattcattaacaaagacactgaaaccatcaatatgatgtcagaattcgtagctaacctgccgcaggagctgaaactcaccctgagcgagatgcagccggcgctgccccaattgcaacaacatgtgccagtcctcaaagattcctccttgctctttgaagaattcaagaagttgatcaggaatagacagagcgaagcagcggactcgagcccatccgagctgaagtacctgggtcttgacacccattcacggaagaagcggcagctgtactctgccctggccaataagtgctgtcacgtgggatgcacgaaacgctcactcgcgcggttctgc

SEQ ID NO: 18525 - DNA, 555 bp, Artificial Sequence
  Description of Artificial Sequence: Synthetic coding sequence
atgcctaggctattcttttttcacctcctgggcgtgtgtctcctactaaatcaattctccagagccgtagcagacagctggatggaggaggtgattaaactttgcggaagggaactggtgcgcgcacaaattgctatctgtggaatgagtacgtggtctaagcggagcttatcacaggaggatgctccccaaacccctcggcccgttgcagaaatcgtaccatctttcattaacaaggatacggaaaccataaacatgatgtcagagttcgttgcaaatctgcctcaagaactcaagctgaccctcagcgagatgcagcctgcactgccacagctccagcagcacgtgccggtgctaaaggacagtagtctgttgttcgaagagttcaagaagcttattcgcaacagacagtccgaagcagcagattcatctccatcagaattgaagtacttagggcttgatactcactctagaaagaaaagacagctatatagcgcactggcgaataaatgctgccacgttggttgcaccaagcgctctcttgctcgattttgt

SEQ ID NO: 18526 - DNA, 555 bp, Artificial Sequence
  Description of Artificial Sequence: Synthetic coding sequence
atgccgagactgttctttttccatctgctgggggtgtgcctgctcctgaaccagtttagccgcgcggtggcggattcgtggatggaagaagtcatcaaactgtgtggaagggagctcgtgagagcacaaattgcgatctgtggaatgtcaacctggagcaagaggtccctgtcccaggaggacgcaccccagactccccggccggtcgcggagattgtgccttcattcatcaacaaagatacggaaactatcaatatgatgtccgagtttgtggccaacctgccgcaggagctcaagttgactctgtcggaaatgcagccggccctgcctcaactgcagcagcatgtgccggtgctcaaagatagcagcctgctttttgaagagttcaagaagttgatccggaacagacaatcggaggccgctgatagctccccgtcagagctgaagtacctgggcctggacactcattcacgcaagaagcgccaactgtacagcgccctggccaataagtgctgccacgtgggatgcactaagagatcgctcgctcgcttctgc

SEQ ID NO: 18527 - DNA, 555 bp, Artificial Sequence
  Description of Artificial Sequence: Synthetic coding sequence
atgccgcgtttattcttcttccacctgcttggtgtatgtctgctgttgaaccagttttctcgcgcagttgccgactcgtggatggaggaagtaatcaaattgtgtggccgagagttagtccgggcacaaatcgctatctgtggaatgtcaacatggtctaaaagaagtctgtctcaagaggatgctccacaaacaccgcgaccggtggcggagattgttccttcgtttattaacaaggacacagagactatcaatatgatgtcagaatttgtcgctaacctgccacaagaattgaaattgacgctctcggaaatgcaacctgcactgccccagttgcagcaacatgtgccggtgctgaaagatagttctttattatttgaagagtttaaaaaactcatcagaaatcgccagtccgaagcggcggattcgtccccgtcggaattaaaatatctcggccttgacacacattcgagaaaaaaacgtcagttgtattccgctttagcaaacaaatgttgtcacgtaggatgtacgaaacgttccttagcaaggttttgt

SEQ ID NO: 18528 - DNA, 555 bp, Artificial Sequence
  Description of Artificial Sequence: Synthetic coding sequence
atgccgcgcctgttcttctttcacctcttgggagtgtgcctgctgctgaatcaattctcgcgggctgtggccgactcttggatggaggaggtgattaagctctgcggcagagaactggtgcgggcccaaatcgccatctgtgggatgtccacttggagcaagagatcgctttcccaggaagatgcgccgcaaacccctcggcctgtcgccgagatcgtcccatcctttatcaacaaggacactgaaaccatcaatatgatgtcggagttcgtcgccaacctcccgcaagagctcaaactgacgctcagcgagatgcagcctgcgttgccccaactgcaacagcatgtccccgtcctcaaggacagctcgctgctgttcgaagaattcaagaagctgatcagaaaccggcaatcagaggccgcagacagctcgccgtccgaactcaagtacctgggcctggatacccactcacgcaaaaagagacaactctactccgcactcgccaacaaatgctgccacgtgggatgcaccaagaggtcactggcacgcttctgc

SEQ ID NO: 18529 - DNA, 555 bp, Artificial Sequence; identical to SEQ ID NO: 18459
  Description of Artificial Sequence: Synthetic coding sequence

SEQ ID NO: 18530 - DNA, 555 bp, Artificial Sequence
  Description of Artificial Sequence: Synthetic coding sequence
atgccgcgcctgttcttctttcatctgctgggagtctgcctgctgctgaaccagttctctcgagcggtcgccgattcctggatggaagaggtgatcaaactgtgtgggcgggaacttgtgcgcgcgcaaattgccatctgcggtatgtcgacttggtcgaagcggtcgctgtcccaggaagatgcgccgcagactccgcgccctgtggctgagatcgtcccttcgtttatcaacaaggataccgaaactatcaatatgatgtcagaattcgtggcaaatctcccgcaagagctgaagctcactctgagcgagatgcaaccggcgttgcctcagcttcaacagcatgtgccagtgctgaaggatagctcgctgctctttgaggagttcaaaaagctcatcagaaatcgccaatccgaggcggctgactcatcgccgtcggaactgaagtacctcggactcgacactcactcacgcaagaaacggcagctgtactcggccctggcaaacaagtgctgccacgtcggctgcacgaagcgctcactggcccgcttttgc

SEQ ID NO: 18531 - DNA, 555 bp, Artificial Sequence
  Description of Artificial Sequence: Synthetic coding sequence
atgcctaggctgtttttctttcaccttctgggtgtttgccttcttctgaaccagttttcaagagccgtggcagattcgtggatggaggaagtgataaagctctgtggcagggagctcgtccgagctcaaatagccatttgcggcatgtccacctggtcaaagcgatctctgtcgcaagaggatgcgccgcaaacccctagaccagtggcggagatcgtcccttcgttcatcaataaagacaccgaaaccatcaacatgatgagcgaatttgtggccaaccttccgcaagaactgaaacttactttgtccgagatgcaacctgcacttccacagcttcagcagcatgtgccggtgctcaaggacagctctctcctgttcgaagaattcaaaaaacttatcagaaatcggcagtcggaggcagcagattcatcgccctctgaacttaagtacctcggacttgacactcatagtcggaagaagagacaactttacagcgcattggctaataagtgttgccacgtggggtgtaccaagcgttcacttgcaaggttttgt

SEQ ID NO: 18532 - DNA, 555 bp, Artificial Sequence
  Description of Artificial Sequence: Synthetic coding sequence
atgcctcgattatttttttttcatctgctcggagtgtgcttgctccttaatcagttttctcgggcggttgcggattcttggatggaggaggtcattaagctgtgtgggcgggagttggtccgcgcacaaatcgcaatttgtggaatgtctacctggagcaagcgcagcttgtctcaggaagatgctccgcagaccccacgacccgtcgccgagatcgtcccaagtttcataaacaaggatactgagaccattaacatgatgagcgagttcgtggctaacttgccccaggagctgaagcttacactttccgagatgcagccagcattaccacaactgcaacagcatgttcccgtgctaaaggattcatccctcctgttcgaagagttcaagaaactgatcagaaatcgccaaagcgaggccgcagactccagcccttcggagctgaaatatttgggtctggatacacacagcagaaagaagcggcagttgtactccgcactagcaaataagtgttgccacgtaggctgcacgaagaggtctctggcgcgattttgt

SEQ ID NO: 18533 - DNA, 1044 bp, Artificial Sequence
  Description of Artificial Sequence: Synthetic coding sequence
atgaatggcacagaaggaccaaacttttacgttccattctctaatgcaacgggagtagtgagatccccattcgaatacccacaatactatcttgccgagccgtggcagttttctatgctcgccgcatacatgtttttactgattgtgttgggattcccaattaatttccttacattgtacgtgactgtgcagcacaaaaaacttagaacgccgctcaattatatcttgctgaatctggctgtggcagatttgttcatggttctgggaggttttacaagtaccctctacacttctttgcatgggtacttcgtatttggtcctacgggatgcaatctagagggatttttcgctacacttgggggtgaaatagcattatggtccctcgtagtgctggctatcgaacgatacgttgtggtgtgcaaacccatgtccaatttcaggtttggggaaaaccatgctattatgggagtagctttcacatgggttatggccctagcctgcgcagcccctcccttagcaggttggtcacgttacataccggaaggtttgcaatgttcatgtggaattgattactacacactcaaaccagaggtcaacaacgagagttttgtaatttacatgtttgtggtgcactttactataccgatgatcattattttcttttgctatgggcaattggttttcactgtaaaggaagctgcagcccaacaacaagagtcggctaccacgcaaaaagctgaaaaagaagtcactagaatggtaataattatggtaatcgcttttcttatttgctgggtcccgtacgcatcagtcgctttctatatcttcactcatcaaggttccaatttcggtcctatctttatgacaataccagccttttttgcgaagtcagctgccatctacaatcctgttatttacatcatgatgaataagcagtttcgaaactgcatgcttacgaccatatgctgtggaaaaaacccacttggagacgatgaagcgagcgctacagtgtctaagacagagacgagccaggttgctcccgct

SEQ ID NO: 18534 - DNA, 1044 bp, Artificial Sequence
  Description of Artificial Sequence: Synthetic coding sequence
atgaatggaaccgaaggaccaaacttttacgttcctttttcgaatgcgacgggggtggtgaggtccccatttgaatatccacagtactacctggcagagccttggcagttttcaatgcttgcagcatacatgtttcttcttatagtcctgggattccctattaactttcttaccctgtacgtcactgtccagcataagaagctgagaacccccctgaattacattcttctgaatctggcagttgcagatcttttcatggtcttgggagggtttacctcaacgctctacacctcgcttcatggatacttcgtgtttggaccaaccggatgtaatcttgagggtttctttgctacccttggaggcgaaattgctctgtggtccctcgttgtgcttgcaattgaaaggtacgtggtggtgtgcaaacccatgtccaatttccgattcggagaaaaccacgcgattatgggggtcgcgtttacctgggtgatggcgctggcgtgtgcggcacctccactcgcaggatggagcaggtacatcccagaaggactgcaatgttcctgcggtatcgactattacaccctgaagcccgaggtgaacaacgaatcatttgtgatttacatgtttgtcgtgcactttaccattcccatgatcatcatattcttctgttacggtcagctggtctttaccgtgaaggaagcagcagcccaacaacaagaaagcgctactactcaaaaggcagaaaaggaagtcactcggatggtcatcattatggtgatcgcctttctgatttgttgggtgccatatgcaagtgttgcgttctacattttcactcaccagggttcgaactttgggccgatcttcatgaccattcctgccttctttgcaaagtcagcagcaatttacaaccccgtcatctacattatgatgaacaagcagtttcgcaattgtatgcttactacgatttgctgtggcaagaaccctttgggagatgatgaggcatcggcaaccgtcagcaagactgagacttcccaggtcgcacctgcg

SEQ ID NO: 18535 - DNA, 1044 bp, Artificial Sequence
  Description of Artificial Sequence: Synthetic coding sequence
atgaacggaactgagggacctaacttctacgtcccattcagcaacgcaacgggcgtggtgcggtcaccctttgagtacccgcagtattacctggctgaaccatggcagttctctatgctggcggcatacatgttcttacttatcgtgttgggattcccaattaattttctgactttgtacgttacagtgcaacacaagaagctgcggacacccctgaattatatccttctaaatctggcagtggcggacttgttcatggttctgggaggattcacaagcactttgtataccagcctccacggttacttcgtgtttggtccgaccgggtgcaaccttgagggctttttcgctacactgggaggagagatcgccctatggtccttagtggtactcgccattgagcggtacgtagttgtgtgcaaaccaatgtccaactttcgatttggcgaaaatcacgctattatgggagtcgccttcacatgggtaatggcccttgcatgtgctgcacctccattagcggggtggagcaggtatatccctgaggggctgcagtgtagctgtggaatagattactacaccctgaaaccagaagtcaataatgagtcattcgttatttatatgtttgtcgtgcactttaccatcccaatgattattatttttttttgttacggacaactggtgtttaccgtcaaggaggccgctgcgcaacagcaggaatccgctaccactcagaaggcggagaaagaggtcacaagaatggtgatcatcatggtcatcgccttcctgatatgctgggtaccctacgccagcgtcgccttttatattttcacacaccagggttctaactttgggcctatatttatgacaatccctgcattcttcgcaaagtccgccgccatttataatccagtgatttacattatgatgaacaagcagtttaggaactgcatgctgaccaccatttgttgcgggaagaatcctctgggtgacgacgaagcatccgccacagtgtcaaagacagagacctcgcaggtagccccagct

SEQ ID NO: 18536 - DNA, 1044 bp, Artificial Sequence
  Description of Artificial Sequence: Synthetic coding sequence
atgaatggaacagagggacctaacttctacgtccccttctctaacgctacaggcgtagttcggtctccctttgagtacccacaatactacttggcggagccttggcagttctcaatgttggcagcctatatgttcctgttgattgtcctgggattccctataaatttcctgacgctctacgtcacagtccagcataagaaactccggacccccctgaactatattttgctgaacttggcagtagccgatctatttatggtcctgggtggattcacgtctactctgtacacatctttacatggctacttcgtgttcggtccgaccgggtgtaacctagagggtttcttcgctacactgggcggcgagatagctttgtggtccctcgtggtcctcgctatcgagaggtatgtcgtggtgtgtaagccgatgtccaattttagattcggggaaaaccacgctattatgggggtcgcattcacatgggtaatggcccttgcgtgcgccgccccccccctggcgggctggagccggtacattcccgaggggctacagtgttcgtgcggtatagactactacactctcaaacccgaggtgaacaacgagagctttgtgatctacatgttcgtggtgcactttactattccgatgatcattattttcttttgttacggtcaactagtgtttacagtcaaggaagcggctgctcagcaacaggagtccgccaccacacagaaagctgaaaaagaggtgacaaggatggtcattatcatggtcattgcctttctgatctgctgggtgccttacgcgtcggttgccttctatattttcacccaccaaggctccaatttcgggcccatctttatgacaatcccagccttctttgctaagtccgcggccatttacaatccagtgatatacattatgatgaataaacaattccgaaactgcatgttaaccaccatttgttgtggaaaaaatcctctgggggatgacgaggcatccgctacagtatccaagacggagacttcccaagtggcccctgca

SEQ ID NO: 18537 - DNA, 1044 bp, Artificial Sequence
  Description of Artificial Sequence: Synthetic coding sequence
atgaacggcacggaggggcccaacttttatgttcccttttcaaacgccacaggcgtagtgcggtcaccttttgagtatccacaatactatttggccgagccctggcagttctcgatgcttgccgcttacatgttcttgctaatcgtcctgggattcccaatcaacttcctgactctgtacgtaacagtccagcacaagaaactcagaacccccctaaactacattctcctgaatcttgccgtggccgacctatttatggtgctgggcgggtttacatccaccctgtacacctctctgcatgggtattttgtgttcgggcccactggctgtaacctggaggggttcttcgctactctgggcggcgaaatcgccctgtggagtctggtggtccttgctatcgagcgctacgtggtcgtctgtaaacccatgagtaacttccggttcggcgaaaaccacgccataatgggggtagcatttacatgggtgatggctttggcatgtgccgctcctccgctcgcagggtggtccaggtatatccccgaaggacttcagtgttcatgtgggatcgattactatactctgaagcccgaagtcaacaacgaatcctttgttatttacatgttcgtggtccactttactatccctatgatcattatctttttctgctacggtcagctggttttcacagtcaaggaggccgccgcgcaacagcaggagtctgccacaactcaaaaggccgagaaagaggtcacccgtatggtcattatcatggtaatcgctttcctgatttgttgggtgccatacgccagcgttgcattttatattttcacacaccaaggcagtaatttcggcccaatatttatgacaatccctgctttcttcgccaaaagtgccgcaatttataacccagttatctacatcatgatgaataagcagttccggaactgtatgctcaccaccatatgttgtggcaaaaatcccttgggagatgacgaagccagcgctactgtgagcaagaccgagacttcccaggttgccccagcc

SEQ ID NO: 18538 - DNA, 1044 bp, Artificial Sequence
  Description of Artificial Sequence: Synthetic coding sequence
atgaacggaacagaggggcccaacttttatgtcccttttagcaatgccactggtgtcgtgaggagcccttttgagtatccacaatactacctcgcagaaccatggcagttcagtatgctggcggcctatatgttcctgctgatcgtcttggggttccctatcaactttcttacgctctacgttaccgtgcagcacaaaaagctacggacacctttaaattacattctgttaaatttagccgtggcagacttgtttatggtactagggggctttacttccactctgtatactagccttcatgggtattttgtattcggccccaccggctgtaacctggaaggcttcttcgctacgctgggaggggagatcgccctatggtcactggtagtactggctattgagagatacgtggtggtgtgtaaacctatgagcaacttcagatttggcgaaaatcatgccattatgggcgtagcgttcacatgggtaatggcacttgcgtgcgctgcccccccgctggccggatggagtcgttatatccccgaagggcttcagtgttcctgcggcatcgactattacaccttgaagcccgaggttaataatgaaagcttcgtcatctacatgttcgtggtgcattttaccattccgatgatcattatctttttttgttacgggcagctcgtgttcacagttaaggaggccgcagcacagcaacaagaatccgcaaccactcagaaggcggagaaggaggtaactcggatggtcattatcatggttattgcatttctgatatgctgggttccatatgcaagcgtcgctttctatattttcactcaccaagggtcaaacttcggtcccatctttatgactatccccgcgttttttgcgaagagcgccgctatttacaacccagttatctacatcatgatgaataaacagtttcgtaactgcatgttgaccactatttgttgcgggaaaaaccccctgggcgacgatgaggcgtccgccaccgtgtcaaaaaccgaaacttcccaagtcgcccccgcc

SEQ ID NO: 18539 - DNA, 1044 bp, Artificial Sequence
  Description of Artificial Sequence: Synthetic coding sequence
atgaacggtactgaaggtcctaatttctacgtccctttctcgaacgccactggggtggtgcgctcaccgttcgaataccctcagtattacctggctgagccatggcagttcagcatgcttgcagcgtacatgttcctcctgatcgtgcttggattccccatcaactttctcaccctgtacgtcaccgtgcagcacaagaagctgagaaccccgctgaactacatcctgctgaatcttgcggtggccgacctcttcatggtgctgggaggcttcacctccacgctgtacacttccctgcatggctacttcgttttcggaccaaccgggtgcaatctggaaggattcttcgcaaccctgggaggcgagatcgcactgtggagcctggtggtgttggccatcgagcgctacgtggtggtttgcaagccaatgagcaacttccggtttggggagaaccatgcaatcatgggagtggcatttacctgggtgatggcccttgcgtgcgcggctccgccgctcgcgggttggtcgaggtacatcccagaaggactgcaatgcagctgcggaatcgattactacactctcaagcctgaagtgaacaacgagtccttcgtaatctacatgttcgtggtccacttcaccatcccaatgattatcatctttttctgctatggtcagctggtgtttactgtcaaggaggcggctgcccaacaacaagaatcggccactactcagaaggctgagaaggaagtgacccggatggtgatcatcatggtcattgcctttcttatctgctgggtcccgtacgcctcggtcgccttctacatcttcactcatcaggggtccaactttggcccgatcttcatgaccataccggcgttcttcgcgaagtccgcggctatctacaatcccgtgatctacatcatgatgaataaacagtttcgcaattgcatgctgaccaccatctgttgcggtaagaaccctctcggcgatgacgaggcctcagcaaccgtgagcaagactgaaactagccaggtggcaccagca

SEQ ID NO: 18540 - DNA, 1044 bp, Artificial Sequence
  Description of Artificial Sequence: Synthetic coding sequence
atgaatgggacagaaggcccaaacttttatgtccctttcagtaatgctacaggcgtggttaggagcccatttgaatacccgcagtactacctggccgaaccttggcagtttagcatgctcgcagcctatatgttcctgttgattgtgctcgggtttcctattaatttccttaccctgtacgtcactgtgcaacataaaaaattacgaacaccgctgaattatatcctgctaaatcttgccgtggctgacctgttcatggtgttaggtggattcaccagcaccctgtacacgtctcttcatgggtactttgtgtttggccctaccggctgtaatttagagggattttttgcaacactgggaggagaaatcgccttgtggtcccttgtggtgttggcgatagaacgttacgtcgtcgtttgcaaaccaatgtcaaattttcgctttggagagaaccatgccatcatgggagtcgctttcacctgggtcatggcactggcgtgcgcggctccaccactcgctggatggtccaggtatatcccagaaggcctacagtgtagttgcggaatcgattattacaccctgaagcctgaagtgaacaatgagtcattcgttatctacatgttcgtcgtccattttacgatccccatgattataatcttcttctgctacggacagcttgtatttaccgtaaaagaagccgcagcccagcaacaagagagcgcgaccacacagaaagccgaaaaggaggtcacacgtatggtgattataatggtgatcgccttccttatctgctgggtcccttacgctagcgttgcattctacatctttacccatcaggggagcaactttggacctatctttatgaccattccagctttctttgcgaagtccgctgctatctacaacccggtgatctacataatgatgaataagcagtttaggaactgtatgctgactacaatctgttgcggtaaaaatcccttgggagatgatgaagcgagcgccaccgttagcaaaacagagacttctcaggtcgcccccgcc

SEQ ID NO: 18541 - DNA, 1044 bp, Artificial Sequence
  Description of Artificial Sequence: Synthetic coding sequence
atgaacggtactgaaggacccaacttttacgtccccttttcgaatgcaaccggagtggtgcgttcgccttttgaataccctcaatactacctcgcagaaccttggcaattcagcatgcttgcggcctacatgtttcttctgattgtgctgggatttcctataaactttctcactctctacgtgactgttcaacacaaaaagctgcgaactccacttaactacatccttctcaacctggcggtggctgaccttttcatggtgctggggggcttcacctccaccctttacacctcactgcacggttactttgtctttggaccgactggatgtaaccttgaaggtttctttgcaactctgggaggcgaaattgcactgtggagccttgtggtgcttgcaatcgagagatacgtggtggtgtgcaagccaatgagcaattttcgttttggtgagaatcatgctataatgggtgtggcctttacttgggtgatggcccttgcatgcgcagcaccaccacttgctggttggtcacgatacattccggaggggctgcagtgttcgtgtggtattgactactacaccctgaagcctgaggtgaacaatgaatcctttgtcatttacatgttcgtcgtgcactttacgatcccaatgatcattatcttcttctgttacggtcaattggtgtttaccgtgaaagaagctgccgcccagcaacaagagtctgccactactcaaaaggccgaaaaagaagtgaccaggatggtgatcattatggtaatcgcctttcttatttgttgggtcccctatgcatcagtggccttctacatctttacccatcagggatcgaacttcggccccattttcatgaccataccggcatttttcgccaagtcagcagcgatttacaatcctgtgatctatatcatgatgaataagcaattccggaactgtatgctgactactatatgttgcggaaagaaccccctgggtgacgatgaggcgtccgcgaccgtgagcaaaaccgagactagtcaagtggccccagca

SEQ ID NO: 18542 - DNA, 1044 bp, Artificial Sequence
  Description of Artificial Sequence: Synthetic coding sequence
atgaatggcaccgaaggcccgaatttttacgtgccctttagcaacgcaacaggcgtggtgcgctccccctttgaatatcctcagtactaccttgcagagccatggcagttttctatgctggccgcctatatgtttttgcttatcgtcctgggattcccaattaatttcctgaccttgtacgttacagtgcagcacaagaagttgaggaccccactgaactacatactgctcaaccttgctgtagcggatttgtttatggtgctcggaggatttacatccactctctacacatctctacatgggtactttgtgttcggccctacagggtgtaacctagaaggcttcttcgctaccctcggaggcgaaattgccctctggagcctagtcgtcctggcaatcgaaagatacgtggtggtgtgcaaaccgatgagcaacttccgtttcggcgagaaccacgccatcatgggagttgccttcacatgggttatggctctggcatgtgcagcccccccgctagccggctggtctagatacatacctgagggactgcaatgttcttgtgggatcgactattatacacttaaaccagaggtaaacaacgaatctttcgtcatctatatgttcgtagtgcacttcacaataccaatgataataatctttttctgctatgggcaactggtgttcaccgtaaaggaggcagcggcacagcagcaagaatcggctaccactcagaaggccgagaaggaggtaacccggatggtgattattatggttatcgccttcctgatctgctgggttccctacgcttccgtggccttctacatcttcacacaccagggatccaattttgggcctatcttcatgaccatccccgcgttttttgccaagtctgctgccatttataatcctgtcatctatataatgatgaataaacagtttcggaattgtatgcttactacgatctgctgcggtaagaatccccttggcgacgatgaagcctcagcaaccgtcagcaagaccgagacgagccaggtcgcgccagcc

SEQ ID NO: 18543 - DNA, 1044 bp, Artificial Sequence
  Description of Artificial Sequence: Synthetic coding sequence
atgaatggtaccgaaggacccaacttttacgtgccgttttccaacgccaccggcgtggtccggtcgccctttgaatacccccaatactacctggcagaaccttggcagttctcgatgctggcagcctatatgttcctgcttattgtgctcggttttcccataaactttcttaccctgtacgtgactgtccaacataagaaactcagaacgcctctgaactacatactgttgaacctggccgtcgccgatcttttcatggtcctgggcggctttacttcaactctctacacctccctgcatggatacttcgtgttcggaccaactggctgtaatctggaagggttttttgccacccttgggggtgagattgccctgtggtccctcgtggtccttgcaattgagcgatatgtcgtggtgtgcaagcctatgagcaactttcgcttcggtgaaaaccacgccattatgggtgtcgccttcacgtgggttatggcactcgcatgcgctgccccacctcttgcgggttggtcccgatacatcccggaaggactccagtgttcttgcgggatcgattactataccctgaagccggaagtcaataacgagagctttgtgatttacatgttcgtggttcactttactatcccaatgatcatcatcttcttctgctacggtcagttggtgttcactgttaaggaagcagccgcgcagcaacaagagtcggccactacccagaaggcggaaaaagaggtgaccaggatggtgatcattatggtcattgccttccttatttgttgggtgccatacgcaagcgtcgcattttacatctttacccaccagggaagcaactttggacctatctttatgaccattccagcgtttttcgcaaaatcggccgcgatctacaatccagtgatctacataatgatgaataagcaattcagaaactgtatgctgactactatttgttgcggcaagaacccactcggtgacgacgaggcatcagccaccgtgagcaagactgaaacctcccaagtcgcaccagcc

SEQ ID NO: 18544 - DNA, 1044 bp, Artificial Sequence
  Description of Artificial Sequence: Synthetic coding sequence
atgaatggaacggaaggaccaaatttctacgtacctttttcgaatgccaccggagtcgtcaggagcccgttcgaatacccccaatactacctggcagaaccctggcaattcagtatgctggctgcatacatgttcctgctgattgtcctcggattcccgataaactttctgactctgtacgtcactgtgcaacacaagaagctgcggactcctctcaactacatcctgcttaacttggccgtggcggatttgtttatggtcctggggggtttcacttcgaccctgtacacctcactccatggatacttcgtgtttggaccgaccggctgcaacctcgaaggtttcttcgccacgttggggggcgaaattgctctgtggtccctggtggtcctggccatcgaaagatatgtcgtggtctgcaagccgatgtccaacttccggtttggtgagaatcacgcgatcatgggagtggcattcacctgggtgatggccctggcgtgcgcggcgccgccactggcggggtggtcccggtacatcccggagggactgcaatgctcgtgtggaatcgattactacacccttaagccggaagtcaacaatgagtcgttcgtcatctacatgttcgtggtgcacttcactattccaatgatcatcatcttcttctgttacggacagctggtgtttaccgtgaaagaggcggccgcccagcagcaggagtcagccaccactcaaaaagccgagaaggaggtcacccggatggtgatcatcatggtgatcgccttcctgatctgctgggtgccatacgcgtctgttgccttctacattttcacccatcagggaagcaatttcggcccgatctttatgaccatcccagccttcttcgcgaaatcagccgccatctataacccagtgatctacattatgatgaacaaacaattcaggaattgcatgctcaccaccatctgttgcggaaagaacccgctgggggacgacgaggccagcgccaccgtctcaaagaccgagacttcacaggtggccccagct

SEQ ID NO: 18545 - DNA, 1044 bp, Artificial Sequence
  Description of Artificial Sequence: Synthetic coding sequence
atgaacggcaccgaaggtccaaacttctatgtgccattttctaatgcaacaggcgtcgtccggtcgccatttgagtatccccaatattatcttgcggagccttggcagttctcaatgttggccgcctacatgttcctgctgatcgttctggggtttcctattaactttctcaccctttacgtcacggtccagcacaagaagctgcgtactccactgaactacatccttctcaatcttgcagtggccgatctcttcatggtattaggcggcttcacttctaccttgtatacctcattgcacggctatttcgtcttcgggcctacgggctgcaacctggaaggcttctttgccacactggggggcgagattgctctgtggagcctggttgtgcttgctatcgaacgttacgtcgtagtatgcaaaccaatgagtaactttaggtttggagagaaccatgccatcatgggggttgcctttacctgggtcatggctttggcctgcgccgcaccgccgctggcaggctggagccgttatatacctgaaggcttgcagtgctcgtgcggcatcgattactatacactgaagccggaagtgaacaatgagtcattcgtcatctacatgttcgtggtccactttaccattccaatgattattattttcttctgttacggccagcttgtctttaccgtcaaggaagccgcagcacaacaacaagaaagcgcaacaacccaaaaggcagaaaaagaggttacccgaatggtcattataatggtgattgcatttttgatttgttgggtgccttatgcttctgtggccttctatattttcactcatcaaggaagcaacttcggcccaatcttcatgaccatcccagcatttttcgcaaaaagcgctgctatctataatccggtaatatatatcatgatgaacaagcagtttagaaactgcatgttgactactatctgctgcgggaaaaatccactgggagatgacgaggctagcgccactgtcagtaagactgagacctctcaggttgctcccgca

SEQ ID NO: 18546 - DNA, 1044 bp, Artificial Sequence
  Description of Artificial Sequence: Synthetic coding sequence
atgaacggaaccgagggccccaatttttatgtccctttcagcaacgcaactggcgtggtgaggagtccctttgaatacccgcagtattaccttgcagagccatggcaatttagcatgctggcagcctatatgtttctgctaatcgtcctgggttttccgattaacttcttgacgctgtatgtgactgtgcagcataaaaaattaagaacccccctaaattacatactactcaatttagctgtggcggacctattcatggtcctagggggatttacgtcaaccctgtatacatccctacacggctatttcgtctttgggcctaccgggtgcaacttagagggattttttgccacgctgggcggtgagattgctctgtggtcactggtcgtcttagccattgaaaggtacgtggttgtgtgtaaacccatgtccaattttaggtttggagaaaatcacgctatcatgggggtggctttcacctgggttatggctctagcatgcgccgccccgccgcttgccggatggtcccgctatattcctgagggcttgcagtgctcttgcggaatagactattacactctgaagccagaggtgaacaatgagagtttcgtcatttacatgtttgttgtccacttcaccatccctatgatcatcatatttttctgctacggccagctggtgttcactgtgaaagaagccgccgctcagcaacaggagagtgccactacccagaaggctgagaaggaggtcaccaggatggtcattataatggtcatcgcttttctgatctgttgggtgccgtacgcctcagttgctttttacatatttactcaccagggcagcaacttcggccctatttttatgacaatacccgcttttttcgcaaagtcggcagctatctacaaccccgtaatttacatcatgatgaacaagcagttccgaaattgcatgttaactacgatttgttgtggaaagaaccctctcggagatgatgaagctagcgccaccgtaagtaaaacggagacaagtcaggtcgcgccagcg

SEQ ID NO: 18547 - DNA, 1044 bp, Artificial Sequence
  Description of Artificial Sequence: Synthetic coding sequence
atgaacggaactgaaggcccaaacttttacgtcccattttccaacgctaccggcgtggtcaggagccccttcgaatacccgcaatactacctcgccgaaccgtggcagttctcgatgctggccgcgtacatgtttctgctcatcgtgctggggttcccgatcaactttcttactctttacgtgaccgtgcagcacaaaaagttgcgcactcctttgaactatatcctgctgaatcttgcggttgctgatttgttcatggtcctcggagggttcacctccactctgtacacctcattgcacggatacttcgtgttcggaccgaccggttgcaatctcgaaggattctttgcgactctgggtggagagatcgctctgtggtcgcttgtggtcctggccatcgaacgctacgttgtggtctgtaagccaatgagcaactttcggtttggagaaaatcatgccatcatgggagtggccttcacttgggtcatggcacttgcctgtgcggcacctcctttggctggctggtcgcggtatattccagaagggcttcagtgtagctgcggcatcgactactacaccctgaaaccggaagtcaacaacgagtcattcgtgatctacatgttcgttgtgcacttcaccattcctatgatcataatcttcttctgttacggacagctggtgttcaccgtcaaagaggcagcagcccaacagcaagagtctgctaccacccaaaaggcggagaaggaagtgacgcgcatggtcataatcatggtgatcgccttcctgatctgctgggttccctatgcgtcggtggccttctacatctttactcatcagggctctaacttcggaccgatcttcatgactattcctgccttctttgcgaagagcgctgctatctacaacccggtgatttacatcatgatgaacaagcaattcaggaattgcatgttgactaccatctgctgcggaaagaatccgctgggtgatgatgaggcctcagccactgtgtcaaagaccgaaacgtcccaggtggccccggca

SEQ ID NO: 18548 - DNA, 1044 bp, Artificial Sequence
  Description of Artificial Sequence: Synthetic coding sequence
atgaacggcaccgaaggtccaaatttttacgtgcctttctcaaacgccactggagtcgtccgtagccctttcgagtacccacagtactacttggccgagccttggcaattctctatgctggctgcttacatgttccttctcattgtgctcggtttccctattaactttttgaccctgtacgtcaccgtgcagcacaagaagctccgcacacctctcaactatatcttgctcaacctggctgtcgctgacctgtttatggtcttgggtggttttaccagcactctgtataccagccttcacggttacttcgtgttcggccccactggttgcaacctcgagggtttctttgccacactgggaggtgaaattgctctttggtccctggtggttttggctatcgagcgctacgtcgtcgtttgtaagcccatgagcaatttccgctttggcgaaaaccatgccatcatgggtgtagccttcacttgggtgatggcactcgcttgtgccgccccacctcttgcaggttggtccaggtatattccagagggtctccagtgttcatgcggcatcgactattacaccctgaagccagaggtgaataacgagtccttcgtcatctacatgtttgtggttcacttcactatccccatgatcattatctttttttgctacggacagctcgtcttcactgtgaaggaagccgctgctcagcagcaagagtccgccaccactcagaaggctgagaaggaagtaaccaggatggtaataatcatggtaattgccttcctgatctgctgggtgccttacgcttctgtggctttttatatttttacccaccaaggatctaatttcggtccaatttttatgactattcccgccttcttcgctaagtccgcagccatctataacccagtaatttacattatgatgaacaagcaatttagaaattgcatgttgactactatatgctgcggcaaaaaccccctgggcgacgacgaggcttcagccacagtaagcaaaactgagacaagtcaggtggctcccgct

SEQ ID NO: 18549 - DNA, 1044 bp, Artificial Sequence
  Description of Artificial Sequence: Synthetic coding sequence
atgaacgggaccgagggtcccaatttctacgtgccattctcaaatgcaactggcgtcgtacggagcccctttgagtacccacagtactacctggccgaaccttggcagttctcaatgttggcggcctatatgttcctgctgattgtgctgggatttcctatcaacttccttactttgtatgtgactgtgcagcataagaagctgcggaccccactgaactacatcctccttaacctggcggtggcagaccttttcatggtcctgggaggcttcacctccaccctgtacacctcgctccacggatacttcgtttttggaccgactggttgcaatctggaaggctttttcgccactctggggggtgaaatcgccctctggagcctcgtcgtcttggctatcgagcgctacgtcgtggtctgcaagccgatgtccaactttagattcggagaaaaccacgcgatcatgggggtcgcctttacttgggtgatggcactcgcctgtgcagcaccacccctcgccggatggtcgcgctacattccggaagggctgcagtgttcctgcggaatcgactactacaccctcaaaccggaagtcaacaatgaatcctttgtgatttacatgttcgtggtgcacttcaccattccgatgatcattatcttcttttgttacgggcagttggtgttcaccgtgaaggaggcggccgcacaacaacaggaatcggccactactcagaaggctgaaaaggaggtgactaggatggtcatcatcatggtcatcgctttcctgatctgctgggtgccttacgccagcgttgcgttttacatctttactcaccaggggtcaaactttggtccgattttcatgaccatccctgcattctttgcaaagtccgcagcgatctacaaccctgtgatctacatcatgatgaacaaacagtttagaaattgtatgttgacgacgatctgttgcgggaaaaatcccctcggggatgatgaagcatcagcaactgtgtcaaaaaccgagacttcgcaggtggccccggct

SEQ ID NO: 18550 - DNA, 1044 bp, Artificial Sequence
  Description of Artificial Sequence: Synthetic coding sequence
atgaacggaaccgaaggacctaacttctacgtcccattttccaacgcaacgggggtggtgagatcgccattcgagtaccctcagtattacttggcggagccctggcagttttccatgcttgcggcttacatgttcctgttgattgtgctgggattccccatcaatttcttgactctctacgtaactgttcaacataagaaactgcggactccgctgaactacatcctcctcaaccttgccgttgcagatctgttcatggtgcttggaggattcacctcgaccctttacacttcgctgcatggatactttgtgttcggtccgaccggctgcaacctggaaggatttttcgccaccctcggcggagaaatcgcgctgtggtcgctggtggtcctggctatcgaacgctacgtggtcgtgtgtaaacctatgagcaacttccggttcggagaaaaccatgcgatcatgggtgtggcattcacttgggtgatggcactggcttgcgcagcgccaccgttggcaggatggagccgctacatcccggagggcctccaatgctcgtgcggaatcgactactacactctgaagccggaggtcaacaacgagtcctttgtcatttacatgttcgtcgtgcacttcaccatcccgatgatcatcatcttcttctgttacggccagctggtgttcactgtcaaggaggccgccgcccaacaacaggaatccgccaccacccagaaagccgaaaaggaggtcactagaatggtgattatcatggtcattgcgttcctgatctgctgggtgccttacgcgtcagtcgccttctacatcttcacgcaccaaggatccaacttcggaccgatcttcatgaccatccccgccttttttgccaaatctgccgcaatctacaatccggtgatctacatcatgatgaataaacagttccgcaactgtatgctgactactatctgttgcggaaagaatccgttgggagacgatgaagcatccgccaccgtgtccaaaaccgaaacttcacaggtcgctcctgcc

SEQ ID NO: 18551 - DNA, 1044 bp, Artificial Sequence
  Description of Artificial Sequence: Synthetic coding sequence
atgaacgggactgaagggcctaatttctacgtccctttctccaacgcgaccggcgtggtgcgcagcccattcgaatacccgcaatactaccttgcagaaccgtggcagttcagcatgttggccgcgtacatgttcctgttgatcgtcctgggcttccccatcaactttttgaccctctacgtgacggtccagcacaagaaactgagaaccccgctcaactacatcttgctgaatctggccgtcgcagacctgttcatggtcctgggaggttttacgtcaactctctacacttcgctgcatggttacttcgtgttcggcccgaccggatgcaatctggaaggatttttcgcgactctcggcggagagatcgccctgtggtcgctggtcgtgctggccatcgagcggtacgtcgtggtgtgcaagccaatgtcaaatttcagatttggggagaaccacgctattatgggggtggcgttcacgtgggtgatggcgctggcgtgcgccgcgccacctctggccggatggagccggtacattcccgaaggactccaatgcagctgtggaatcgactactacactctcaagccggaagtgaataacgaatcattcgtcatctacatgtttgtcgtccacttcaccatccctatgatcatcatcttcttttgttacggacaactggtgttcactgtcaaggaggccgcggcgcagcagcaggaatcggcaactacccaaaaagcggagaaggaagtgactagaatggtgataatcatggtcatcgccttcctgatttgttgggttccgtacgcttccgtggccttctacatctttactcaccagggaagcaactttggccccattttcatgaccatcccagcatttttcgccaaatccgccgccatctacaatccagtcatctacatcatgatgaacaagcagtttcgcaactgcatgctgaccactatctgctgcgggaagaacccgctcggtgacgacgaggcatcggccaccgtctccaagaccgaaacctcgcaggtggcgcccgcc

SEQ ID NO: 18552 - DNA, 1044 bp, Artificial Sequence
  Description of Artificial Sequence: Synthetic coding sequence
atgaacggcacagagggacctaacttttacgtgcccttttccaatgctaccggcgtggtgaggtcaccattcgagtaccctcaatattatctcgctgagccttggcagttttccatgctcgccgcttacatgtttctgttaatcgttttggggttccctatcaatttcttgaccctatacgtgactgttcagcacaagaagctgcgaacgcccctgaactacatactgctgaatctcgcggtggccgacctgtttatggtgctaggtgggttcacatccactctgtacacatccctgcacggttactttgtctttggccctacaggttgtaaccttgaaggttttttcgctacgctgggcggagagattgcattatggtccttggttgtactcgctattgaaaggtacgtagtggtgtgtaaaccgatgtctaattttaggtttggtgagaatcatgccattatgggagttgctttcacctgggttatggcactggcttgcgccgctccacccctggctggatggagccgatatattcccgagggcctgcagtgctcatgcggaatagactactacactctgaaacctgaggtcaataacgagagctttgtcatttacatgtttgtggtccacttcaccattccaatgataataatctttttttgctacggccagctcgtcttcactgtgaaggaagctgccgcacagcagcaagagtccgccacgactcagaaggctgaaaaagaggttactagaatggttataatcatggtgatcgcatttcttatctgttgggtgccttatgctagtgtcgctttttatattttcacccaccaggggtccaacttcgggccaatttttatgaccattcctgcctttttcgcaaagtctgctgcaatttacaacccagtgatatacatcatgatgaacaagcagtttcgtaattgcatgcttacaacaatttgctgcggaaaaaacccgctcggggatgacgaagcatctgccacagtgagcaaaacggaaacctcacaggtagcacctgcc

SEQ ID NO: 18553 - DNA, 1044 bp, Artificial Sequence
  Description of Artificial Sequence: Synthetic coding sequence
atgaacggaaccgaaggccctaacttctatgttcccttctcgaatgcaaccggtgtggtgcgatccccgtttgaatacccacaatactacctggcagagccttggcaattttccatgctggcagcatacatgtttctcctgattgtgctcggctttcccataaactttcttaccctttatgtgactgtgcagcacaaaaagttgagaacgcccctcaattacattctgctgaatcttgcagtcgcggatttgttcatggtgctgggtggattcacgagcactctttacacttccctgcacggatacttcgtctttggtcctacgggatgcaatctggagggtttctttgcaaccctggggggtgagatagccctctggtccctggtggtccttgccattgagagatacgtcgtggtttgtaaacctatgtcaaactttaggttcggagagaatcatgccatcatgggtgtggcatttacttgggtcatggcccttgcgtgcgcagcaccccccttggcgggctggtcgagatacattcctgaagggctccagtgtagctgtggtattgattactacacccttaagccagaagtgaacaacgaatccttcgtgatttacatgttcgtggtgcatttcactatccctatgatcattatcttcttttgctacggacagcttgtgtttactgtgaaggaagctgcggcacaacagcaggagagcgctactacccaaaaggctgaaaaggaagtgaccagaatggtcattatcatggtgattgcattccttatctgctgggtcccttacgccagcgtggctttctacatctttactcaccagggatcgaactttggtccaattttcatgactattcccgcctttttcgcaaagtcagcagctatttacaaccccgtgatctacattatgatgaacaagcagtttagaaactgcatgctgacgaccatatgttgtggaaagaacccactcggagatgatgaggcatcggcaaccgtcagcaagaccgaaacctcccaggtggcacctgca

SEQ ID NO: 18554 - DNA, 1044 bp, Artificial Sequence
  Description of Artificial Sequence: Synthetic coding sequence
atgaacgggaccgaaggcccaaatttctacgtgcctttctctaacgccaccggcgttgtcagatcaccgtttgaatacccgcagtactacctggccgaaccttggcagttctcaatgctcgctgcctacatgtttttactgattgtgctcggcttccctatcaactttctgactctgtatgtaacagttcagcacaaaaaattgaggactccgctgaattacatcctgttaaacctagccgttgccgacttgttcatggtactgggcgggtttacttccaccttgtacacaagcctgcacggctactttgtattcggccccacagggtgcaacctggaaggcttctttgccacactcgggggggagatagctttgtggtctctggtggtgctcgcgatcgagcgatatgttgtcgtttgtaagccgatgtcgaactttcgcttcggcgaaaatcacgccataatgggggtggcctttacctgggtgatggcacttgcatgtgccgcaccgcccctagcaggctggtcccgctatattccagagggacttcagtgttcttgtggcatcgattattacaccttgaagcccgaggtaaacaatgaatctttcgtgatttatatgtttgtggtgcatttcacaattcccatgatcattatcttcttttgctacgggcagcttgttttcaccgtgaaagaggcagctgcccagcagcaggagagtgccaccacacagaaggctgagaaagaggtgacccggatggttataataatggtaatcgcgtttctaatttgttgggtgccctatgcttcagtggccttctacattttcacacatcagggcagcaacttcggcccaatcttcatgacaattcccgcctttttcgcaaaatccgccgcgatatacaaccctgttatctatatcatgatgaacaagcagtttaggaactgcatgctgaccacaatctgttgcggaaagaatcccctgggcgacgacgaggcctccgctacagtttcaaagactgaaacctcccaggttgctcctgcc

SEQ ID NO: 18555 - DNA, 1044 bp, Artificial Sequence
  Description of Artificial Sequence: Synthetic coding sequence
atgaacggtaccgaaggaccgaacttctacgtccctttttccaatgctactggtgtggtgagatcgccgttcgaatacccacagtactaccttgcagaaccatggcaattttccatgttggcagcatacatgtttcttctgatcgtgctcgggtttcccattaacttcctcacgttgtacgttaccgtgcaacacaagaagctgcgcaccccccttaactacatcctgcttaaccttgcagtcgccgacctgttcatggtgctgggaggatttaccagcactctgtacacctccctccatggttactttgtattcggtcctactggctgtaacctcgaggggttttttgcaacccttggtggcgaaattgcactgtggtcgctggtggtgctcgcaattgaacgttacgtcgttgtctgcaagcctatgagcaattttcggttcggagagaaccacgccattatgggcgtggcttttacttgggtcatggctctggcttgtgcggcacctcccctggccggttggtcccgttacatccctgaagggctccaatgcagctgcggcatagactactacacccttaagcctgaagtgaacaatgaatcgtttgtgatttacatgtttgtggtgcattttactattccaatgattatcatctttttctgttacggacagctcgtgttcaccgtgaaggaggcagcagcccaacagcaagaatccgccaccacccaaaaggccgaaaaggaagtgactagaatggtgattatcatggtgattgcattccttatctgctgggtcccttacgcatcggtggcattctacatattcactcaccaggggtcgaactttgggccgattttcatgactatacctgcatttttcgctaagtcggccgcaatctacaatccagtcatctacatcatgatgaataagcaattccggaactgtatgctgactactatttgttgtggaaaaaacccgctgggtgatgacgaggcctccgcaactgtgagcaagaccgaaacctctcaggtggcacctgca

SEQ ID NO: 18556 - DNA, 1044 bp, Artificial Sequence
  Description of Artificial Sequence: Synthetic coding sequence
atgaacggcaccgagggaccgaatttctacgtcccttttagcaatgccacgggagtggtccgctcaccatttgaatatccgcaatactacctggcggagccctggcaattctcgatgctggcagcctacatgttcctcctgattgttctgggattcccaatcaacttccttactctgtacgttacggtgcagcataagaagttgcggaccccattgaactatattcttctgaatcttgccgttgcggatctgttcatggtgctgggaggatttaccagcactttgtataccagcctgcacggatacttcgtgttcggaccaaccggctgcaacctggaaggattcttcgcgaccctgggaggagagatcgctctgtggtcgctggttgtgctcgctatcgaaagatacgttgtggtgtgcaaaccgatgagcaatttccgcttcggagagaaccacgcgatcatgggcgtcgcattcacttgggtgatggcgctcgcctgcgcagcaccgcccctggcgggatggagccgctacatcccggaaggactccaatgtagctgcggaatcgactactacaccctcaaacctgaagtgaataacgagtcctttgtgatctacatgttcgtggtccatttcactatccctatgataatcatcttcttttgctacggacagctcgtctttactgtcaaggaagccgccgcacagcagcaggagtccgcgaccactcagaaggctgagaaggaagtcactcgcatggtgatcatcatggtcatcgctttcctcatttgctgggttccttacgcctccgtggccttttacatcttcacccaccagggaagtaatttcggaccgattttcatgaccatccccgctttctttgcgaagtctgcggccatctacaaccccgtgatctacatcatgatgaacaagcaatttcggaactgcatgctcaccactatctgctgtggcaagaaccctctgggcgatgacgaggcttcggcgacggtgtccaagactgaaaccagccaggtggctccggcc

SEQ ID NO: 18557 - DNA, 1044 bp, Artificial Sequence
  Description of Artificial Sequence: Synthetic coding sequence
atgaatgggactgaagggccaaatttctatgtccctttcagtaacgcgacgggagtggtcaggtctcccttcgaatatccgcaatattacctcgctgagccctggcagtttagtatgcttgctgcttatatgtttcttttgatagtcttggggtttcctatcaatttccttacattgtatgttaccgtacaacataaaaaacttagaactccattaaactatattttgcttaatcttgccgttgcagatttgtttatggttcttggtggttttaccagtactttgtatacaagcttgcacgggtatttcgtttttggaccaacgggatgcaacttggaaggattcttcgccactttgggaggcgagatagctttatggtcgttggttgtcctcgccattgaaaggtatgtggttgtctgcaagcctatgtcgaattttcgcttcggagagaaccatgcaattatgggggttgcttttacatgggttatggctttggcttgcgctgcaccaccgcttgctggatggtccagatatattccagagggccttcagtgctcatgcggtattgattattacactctaaaaccggaggttaataatgaatcatttgtcatctatatgttcgtggtacatttcaccatccccatgattattatatttttctgttatggacagctcgtgttcaccgtgaaggaagctgctgcccaacaacaggagtccgcaacaacccagaaagctgagaaagaggttactagaatggtcattataatggtcattgcttttcttatatgctgggtcccatacgcctctgtggctttttacattttcactcaccaaggttctaacttcggtccaatttttatgacaatcccagcttttttcgcaaaatcagctgcaatttataatccagttatttatataatgatgaataagcaattccgtaactgtatgttgactactatatgctgcggaaaaaaccccttgggggatgatgaagcgtccgcaaccgtgtctaagactgaaaccagccaagtcgccccagca

SEQ ID NO: 18558 - DNA, 1044 bp, Artificial Sequence
  Description of Artificial Sequence: Synthetic coding sequence
atgaacggcacggagggtccaaatttttatgtcccgttcagcaacgctaccggggtagtgagatccccgtttgaatacccacagtactatctggcagaaccctggcagttctctatgttggcagcttacatgttcctgctgattgtcttgggctttccaattaatttcctgacgctctatgtcaccgtgcagcacaagaagctgaggacacccttaaattacatccttctaaatttggcagtcgcggatttgtttatggttcttggcggctttacctccactctgtataccagtttgcacgggtatttcgtattcgggccaaccggatgcaatctggaagggttcttcgctaccctcggcggtgagatagctctgtggtccctcgtggtgttggctatagaacggtacgtcgtggtgtgcaagccaatgtccaactttcgatttggagagaaccatgccattatgggggtggccttcacttgggtgatggctctggcctgtgccgctccacccctggccgggtggtccaggtacatacccgaaggattacagtgtagttgtgggatcgactattacactcttaaacctgaggtgaataatgaatcattcgtaatttatatgtttgttgttcattttaccattccaatgataataatcttcttttgctacggacagctagtctttacggtaaaggaggctgcagcccagcaacaggagagcgccacgacacagaaggcagaaaaggaggtcaccagaatggtcatcatcatggtgattgcattcctgatctgctgggtaccatacgcttcagtggcattttacatctttacccaccagggaagcaacttcggccctatattcatgacgattccagcttttttcgcaaaatcggccgcaatctataatcccgtcatatacatcatgatgaacaagcaatttagaaactgtatgctcacaacaatctgctgtggaaagaaccccctgggggacgatgaggcgtcagccacagtcagtaaaactgaaactagccaggtagctccagcg

SEQ ID NO: 18559 - DNA, 1044 bp, Artificial Sequence
  Description of Artificial Sequence: Synthetic coding sequence
atgaacggaaccgaaggacccaatttctacgtaccattcagcaatgcaaccggagtcgtcaggtcgccgtttgaatacccccagtactacctggcggagccatggcagttcagcatgctcgccgcttacatgtttttgctcatcgtcctgggatttccgattaacttcctgactctctacgtgaccgtgcagcataagaagctgcggaccccgttgaattacatcctgttgaacctcgcagtcgcagatctgtttatggtcttggggggatttaccagcactctgtatacttccctgcacggatacttcgtgttcggacccacgggttgcaaccttgaaggtttcttcgcgacgctgggaggcgagattgcgctctggtccctggttgtgctggcgatcgagagatacgtggtggtgtgtaagccgatgtccaacttccggttcggagaaaaccatgccatcatgggcgtggctttcacttgggtgatggccctggcatgtgcggcgcctccacttgcaggatggtcacgctacatcccagagggactccagtgctcctgcggcattgactactacactctgaaaccggaggtgaacaacgaatccttcgtcatctacatgttcgtggtccacttcacgatcccgatgatcatcatcttcttttgttatggacaactcgtctttactgtgaaggaggcagccgcgcagcagcaggagtcggccaccacccaaaaggcggagaaggaggtcactaggatggtgatcatcatggtgatcgcttttctgatctgctgggtgccgtacgcctcggtcgccttctacatcttcactcaccaaggaagcaatttcggaccaattttcatgaccatcccggccttcttcgcgaaatcggcggccatctacaatccggtgatctacataatgatgaacaaacaattccgaaattgcatgctcactaccatctgctgcggcaaaaatcccctcggtgatgacgaggcctcggcaactgtctcgaaaaccgaaaccagtcaggtggctcccgct

SEQ ID NO: 18560 - DNA, 1044 bp, Artificial Sequence
  Description of Artificial Sequence: Synthetic coding sequence
atgaatgggacagagggacctaatttctatgtaccttttagtaatgcaacgggcgtagtgaggtcacccttcgaatatccacagtattacctggcggagccgtggcagttcagtatgctggcagcctatatgttccttctgatcgtactagggtttcctatcaacttcttgacattgtatgtgacagttcagcacaagaagcttaggactcctttgaactatatacttttgaacctcgccgtcgcggacctgttcatggtgctggggggattcacgtcaacactttacacttcgttacacggctacttcgtctttggcccaactggatgcaaccttgaaggcttcttcgctacactgggaggcgagattgcgctatggagtttggtggtgttggccatcgagcggtatgttgtcgtgtgcaaacccatgagcaacttcaggttcggggagaatcacgcgatcatgggcgtcgcctttacatgggttatggctcttgcttgtgcagcaccccccttggccggttggtcgagatatatacctgagggtctgcaatgctcctgcgggattgattactacacacttaaaccagaggtcaataacgagtccttcgtgatctacatgttcgtggttcactttaccattcccatgattatcattttcttctgctatggtcagctcgtgtttacagtgaaagaggccgcagcccaacagcaggaatctgcaacaacgcagaaagcagaaaaggaggtgactaggatggtcattataatggtgatagcctttctgatatgctgggttccctatgcatcagtagctttctacatcttcactcatcaggggagtaatttcggacctatcttcatgacaatccccgctttttttgccaagtcagccgctatctacaacccagtaatttacattatgatgaataaacaatttaggaattgtatgctaactactatttgctgcgggaagaatcctctgggggacgacgaggcctctgcaaccgtgtcaaaaaccgaaacgagtcaggtggctccggcc

SEQ ID NO: 18561 - DNA, 1044 bp, Artificial Sequence
  Description of Artificial Sequence: Synthetic coding sequence
atgaacggtactgaggggcctaatttctacgttccattcagtaatgcaacgggagttgtgcggtcccctttcgagtacccccaatattatttggcagagccttggcagttctctatgcttgccgcctacatgttcctcctaatcgtactgggatttccaatcaacttcctgaccttatatgtcaccgtccaacacaagaaacttcggactcctcttaactatatcctgctgaacttagcggtcgctgatctgtttatggtgttgggcggctttaccagcactctttacacaagcctccatggctactttgttttcgggcctactggctgcaacctggaaggtttctttgctacactggggggcgaaattgcgctgtggtccctcgtggtcctggccatcgaaaggtatgtggtcgtgtgtaaacctatgagtaacttcaggttcggagagaaccatgccataatgggagtcgccttcacttgggtgatggcactggcctgcgccgccccaccactcgccggttggtccaggtacattcctgaaggcctgcagtgttcttgcgggatcgactactacacactgaaacccgaagtcaataatgagtcctttgtgatttatatgttcgtagtccactttacgattcctatgatcatcatctttttctgctatgggcagcttgtgttcaccgtcaaggaggcggctgctcaacaacaagaatccgccacaacacaaaaagccgaaaaggaagtcacaaggatggtgattatcatggttatcgcgttcctaatctgctgggtcccgtacgcctcggtggctttttatatcttcacgcaccaggggagcaacttcgggcccatttttatgacgatacccgctttcttcgcaaagtcagccgccatctacaatcccgtgatttacatcatgatgaataagcagtttagaaactgcatgttaactaccatttgttgtggcaagaatcccttaggggatgatgaagcctccgccaccgtgtccaagaccgagacgagccaggtggcaccagct

SEQ ID NO: 18562 - DNA, 1044 bp, Artificial Sequence
  Description of Artificial Sequence: Synthetic coding sequence
atgaatgggactgaaggtcccaatttctatgtgcctttctccaatgcaactggagtggtgagaagcccgtttgaataccctcaatactaccttgccgagccttggcagttctccatgttggcagcttatatgtttctgcttattgtgctgggttttcctatcaattttctcaccctgtacgtgactgtccaacacaagaaacttcggaccccactgaactacatacttcttaaccttgctgtcgcagatctctttatggtgttgggtggattcacttcaactctgtacacctcgctccatggttacttcgtgtttggtccaaccggctgcaatctcgagggtttcttcgccacccttgggggagaaattgcactgtggagcctggttgttctggcaattgaacgttacgttgtggtgtgtaagccaatgagcaactttcgatttggagaaaatcatgcaattatgggagtggcatttacttgggtgatggcgctggcatgtgcggcaccgcctctggccgggtggtcgagatacatcccggaaggactccaatgttcctgtggaattgactactacactttgaagccagaggtgaataacgagtcctttgtcatctacatgtttgtggtgcatttcaccatccctatgattatcattttcttctgttatgggcagctcgtgtttacggtgaaagaagcagccgcacagcagcaagaatccgcaacgactcaaaaagcagagaaagaagtgactagaatggtgatcatcatggtgatcgcattccttatatgttgggtgccctacgcctcggtggccttctacatattcacgcatcaagggtcgaattttgggccaatctttatgacgatcccagcattcttcgcaaaatccgccgcaatatacaacccagtcatctacattatgatgaataaacaatttaggaattgtatgctgaccaccatttgttgcggcaagaatccactgggtgacgatgaggcatcagccaccgtatcaaagaccgaaacttcgcaggtcgcacctgcc

SEQ ID NO: 18563 - DNA, 1044 bp, Artificial Sequence
  Description of Artificial Sequence: Synthetic coding sequence
atgaacggaactgaaggaccgaacttctacgtgccattctccaatgccaccggtgtggtcagatcaccgtttgagtatcctcagtactacctggcagagccatggcagttctccatgctggcagcatacatgtttctgcttattgtgttggggtttccaattaactttctgactctctacgtgaccgtccaacataagaagctccgcactccgcttaactatattctgcttaatctggcagttgccgatctcttcatggtgcttggaggattcactagcaccctttacacgtcacttcatggctattttgtgtttgggcccaccggatgtaaccttgagggatttttcgccaccctcggtggggaaattgctctgtggtcactggtcgtgctggcgattgaaaggtacgtggtggtgtgtaaaccaatgagcaatttcagatttggtgaaaaccatgctatcatgggagtggcgtttacgtgggtcatggccctcgcatgtgccgcacctcctcttgccggatggtcaagatacatcccagaggggcttcagtgttcgtgcggaattgattactacacgctgaagcctgaagtcaacaacgaatcattcgtgatttacatgtttgtggtgcattttaccattccgatgatcatcattttcttttgttacggacaactggtttttaccgtgaaggaagcagctgctcagcaacaagaaagcgcaaccactcaaaaagcagaaaaggaggtgactcggatggtgatcataatggtcatcgcctttctcatctgttgggtgccatacgccagcgtggcattctacattttcactcatcaagggtcgaacttcggcccaatctttatgaccatacctgcatttttcgcaaaaagcgcagccatctacaatcctgtcatttacattatgatgaataagcaattcaggaactgcatgcttactactatttgttgcggaaagaatccgcttggcgacgatgaagctagcgcaactgtgagcaagactgaaacttcccaagtggcgcctgcc

SEQ ID NO: 18564 - DNA, 1044 bp, Artificial Sequence
  Description of Artificial Sequence: Synthetic coding sequence
atgaacggaacagaagggcccaacttctacgtcccattttccaatgccactggcgtggtgaggagccccttcgaatatccccagtactacttggcagagccttggcagttctcgatgctggcagcgtatatgtttctgttaattgtgttaggtttccctatcaatttccttactctgtatgtcacagtgcaacacaagaagttacggaccccgctgaactatattcttctcaacctagcagtcgccgacttgttcatggtccttggaggcttcacatccactctttacacatctctgcatggttactttgtgtttgggccgaccggttgcaatctagagggcttttttgccacccttggaggtgaaatcgcgctatggtcgttagttgtgttggctatcgaaagatacgtggtcgtgtgtaaaccaatgagtaatttcagatttggcgaaaatcacgccattatgggcgtagcgttcacttgggtgatggcattggcctgcgccgcccccccgctagcaggctggtcccgatacatccctgagggactccagtgtagctgtggcatcgactactatacgctgaagcccgaggttaataacgaatcatttgtaatttatatgttcgtcgttcactttaccatccccatgataatcatctttttttgttacggccagctggtctttacggtaaaagaggccgcagcccaacagcaggaatcagctaccacgcaaaaggcagagaaggaagttacgagaatggttatcataatggtgattgcttttcttatctgttgggtaccgtacgctagcgtggcgttctacatttttacacaccaaggttccaacttcggacccatcttcatgacaattccagccttcttcgcaaaaagcgccgcgatctacaacccagtcatctacattatgatgaacaaacaatttaggaactgcatgttaaccacaatttgctgcgggaagaatccccttggtgacgatgaagcctcggctaccgtgtcaaaaaccgagactagccaggtggcaccagct

SEQ ID NO: 18565 - DNA, 1044 bp, Artificial Sequence
  Description of Artificial Sequence: Synthetic coding sequence
atgaacggaactgagggcccgaatttctacgttccattctcaaacgcgactggagtggtgaggtcccccttcgagtacccgcagtattacctggcagagccttggcagttttccatgctggccgcctacatgtttctgttgatcgtcctcgggtttccaatcaatttcttgaccctgtacgtgaccgtgcaacataagaagctgcggactccgctgaactacattctgctgaatctcgctgttgccgacctgttcatggttctgggaggattcacgagcacgctgtacaccagcctgcatggatactttgttttcggaccaaccggttgcaacctcgaaggattcttcgccacgctgggcggcgaaatcgctctgtggtcgttggtcgtcctcgccatcgagaggtacgtggtcgtgtgtaagcccatgtcgaacttcagatttggtgaaaatcatgccatcatgggagtggcttttacctgggtcatggccctggcatgcgcggccccgccgctggctggatggtcacgctacatcccggagggactgcaatgcagctgcgggatcgactactacactcttaagccagaagtcaataacgaatcgtttgtgatctacatgttcgtggtgcactttacgatcccgatgatcatcatcttcttttgctacggccaactggtctttaccgtgaaggaagccgcagcccaacagcaagaatccgcaacgacccagaaagcagagaaggaggtgacccggatggtcattatcatggtgattgcgttcttgatttgctgggtgccgtacgcttccgtcgctttttacatctttacccaccaggggagcaatttcgggcccatcttcatgactatccccgctttcttcgccaagtcggccgccatctataaccctgtgatttacattatgatgaataaacaattcagaaactgtatgctgactactatctgctgcggaaagaaccctctcggggacgacgaggcctctgcgactgtgtccaagaccgaaacctcccaggtggccccagct

SEQ ID NO: 18566 - DNA, 1044 bp, Artificial Sequence
  Description of Artificial Sequence: Synthetic coding sequence
atgaacggaaccgaaggcccgaatttctatgtcccgttttcgaatgcgactggagttgtgcggtccccatttgaatacccgcagtactacctcgcagagccgtggcagttctccatgttggcagcatacatgtttctgcttattgtgcttggatttcccatcaactttctgaccctgtacgtgaccgtgcaacataagaaactccgtactcccctgaactatatcctgttgaacctggccgtggcggatttgttcatggtgttgggagggtttacctctaccctttacactagtctccatggatacttcgtctttggcccaacgggctgcaatcttgaaggatttttcgccaccctcggaggagaaattgccctctggagcctggtggtgctggctatcgagcgctacgtggtggtctgcaaacctatgtccaacttccgcttcggcgagaaccacgctatcatgggggtggcgttcacctgggtcatggccctggcatgcgccgctcctccccttgctggatggtctaggtacatccctgaagggctgcagtgctcgtgtggcatcgactactacaccctcaagccagaggtcaataacgagtcgttcgttatctacatgttcgtggtccacttcactattccgatgatcatcatattcttctgctacggtcagctggtgttcactgttaaggaagccgccgcccagcaacaagagtcggcaacgacccaaaaggctgaaaaagaagttactagaatggtgatcatcatggttatagctttcctgatctgttgggtgccttatgcgtcggtggcgttctacatcttcacgcaccagggatccaacttcggcccaatcttcatgaccattccggcgttcttcgccaagagcgcggccatctacaacccggtgatttacattatgatgaacaagcagttccgcaattgcatgctgacgactatctgttgcggtaagaatccattgggagacgatgaggcgagcgcaactgtaagtaagaccgaaacttcgcaggtcgctcctgcc

SEQ ID NO: 18567 - DNA, 1044 bp, Artificial Sequence
  Description of Artificial Sequence: Synthetic coding sequence
atgaatggtactgagggcccaaatttttatgttccattcagtaatgccactggcgtggtacgctcaccgtttgaataccctcagtattatctcgcagaaccttggcaattctccatgctggccgcatatatgtttctcctgatagttctaggctttccgattaactttctgacattgtatgttacggtgcagcacaagaagttacggacgcccctgaattatatcctgctgaatctagcagtggctgacctctttatggtactggggggttttacgtctaccctctacacctccttgcacggctatttcgtcttcgggcccaccgggtgcaatctggaaggattctttgccaccctcggaggtgagattgctctgtggagcttagtcgtcctggccatcgaacgatacgttgtggtttgtaagcccatgtctaacttccgttttggcgagaatcacgcaatcatgggcgtcgcctttacttgggtgatggccttggcctgtgctgcaccccctctcgccggatggagcagatacattcctgagggtctgcaatgctcttgcggcattgactactacactctcaagcccgaggtgaacaatgaaagttttgtcatctatatgttcgttgtacacttcactattcctatgatcattatcttcttttgttatggtcagttggttttcactgttaaggaagcagctgcacagcagcaagaatctgccactacccagaaagccgagaaggaagtgacccggatggttatcattatggtcattgccttcctcatctgctgggttccctacgcctctgtagccttttacatttttactcaccagggctccaacttcggaccaattttcatgaccatccccgccttcttcgccaagtctgcagctatttacaatccggtgatctacattatgatgaataagcagtttcgcaattgcatgctgacaaccatctgttgcggcaaaaatccgctcggagacgacgaggcctccgcgaccgtttctaagacagaaacctcacaagtggctcccgcc

SEQ ID NO: 18568 - DNA, 1044 bp, Artificial Sequence
  Description of Artificial Sequence: Synthetic coding sequence
atgaatggaacagagggtcctaacttctacgtgccattctccaacgccacgggcgtggtgaggtccccttttgaatatccacagtattacctagcagaaccttggcagttcagcatgcttgccgcctacatgttcttactcatagtccttgggtttccaatcaatttcctgactctgtatgtgactgtgcagcacaagaaactgcggacccctctcaactacatcctacttaacctggcggtggcggatctgttcatggtactgggtgggttcacgagcactctttataccagccttcacgggtactttgtttttggcccaactgggtgcaacctggaagggttctttgccactcttgggggggaaatagcactttggtcactcgtggtactagcaattgagcgctacgtggtggtttgcaaaccaatgtctaattttcggttcggggagaaccacgcaataatgggggttgccttcacctgggtaatggccctagcctgtgccgcacccccccttgccgggtggagtagatacataccggaaggtctgcagtgttcatgtggtattgactattacaccctcaagcctgaggtcaacaacgaatcttttgtgatttacatgtttgtggtccacttcactattcccatgataataatttttttttgctacggtcagctcgtgtttactgtaaaggaggcagctgctcagcagcaggagagtgctacaacacaaaaagccgagaaagaggtcactcgcatggtgatcattatggtgattgctttcctcatttgctgggtaccctatgcctccgttgcattttatattttcacacaccagggaagcaatttcggaccgatatttatgacgattccagcattcttcgccaaatccgctgcgatctataaccctgttatctatatcatgatgaacaagcagtttcgcaattgcatgctaactactatctgttgcggcaaaaaccctttgggggacgatgaggccagtgctaccgtctccaaaacggagactagccaggtagcacctgca

SEQ ID NO: 18569 - DNA, 1044 bp, Artificial Sequence
  Description of Artificial Sequence: Synthetic coding sequence
atgaacggaacggaggggcccaacttttatgtgcccttctctaatgcaaccggagttgttagaagcccctttgaataccctcaatactatctcgccgagccctggcagttcagtatgcttgcggcatacatgtttctccttatcgtgctagggttcccgattaattttctgacactctacgtcactgtacaacacaagaaactgaggacccccctgaactacatccttctaaatttagcagtcgccgatctctttatggtcttgggcgggttcacctcaactttgtacacatctctgcacggttacttcgtgtttggcccaactggctgtaacttagagggattttttgctacgcttggaggagagattgccctctggagtctggtggtcctggctatcgagagatatgtggtcgtttgcaagccgatgtcgaacttccgctttggagagaatcatgcaatcatgggggtcgcgtttacttgggtcatggcactcgcctgcgccgctccgcctctggctgggtggagccgatacattcctgagggactgcaatgttcctgtggtatcgattactacacattaaagccagaagttaataatgaatcattcgtcatatatatgtttgtggtacatttcactatacctatgatcataatttttttctgctatggccagctggtgtttacagtcaaggaagcggcggcacagcaacaagagagcgccacgacccagaaagccgagaaggaagtcacaagaatggtgattattatggttattgctttcctgatctgttgggttccgtatgcctcagttgctttttatatcttcacccaccaggggtccaactttggacctattttcatgacaatccccgcgttctttgctaaatccgccgcgatatacaatcccgtgatttatatcatgatgaataaacagttccgaaactgcatgcttaccacaatatgctgcggaaagaatcctctgggcgacgacgaagcatctgcaaccgtctctaagacagaaactagccaggttgcccccgcg

SEQ ID NO: 18570 - DNA, 1044 bp, Artificial Sequence
  Description of Artificial Sequence: Synthetic coding sequence
atgaacggaactgaggggcccaatttctacgttcctttctcaaatgcaactggcgtggtgcggtcgccattcgagtacccgcagtactacctggcggaaccttggcagtttagcatgctggccgcgtacatgttcttgctgatcgtgctgggcttcccaatcaatttcctgactctgtacgtcaccgtccagcacaagaaacttcgcacccccctcaactatatacttctgaatctggccgtggcagatctcttcatggttttgggaggctttacctccactctttacacttcactgcatggatacttcgtgtttggtccgactgggtgtaatcttgaaggcttctttgccaccctcggaggagaaatcgccctctggtcactggtggtgctggccatcgagcggtacgtggtggtgtgcaagcccatgtcaaacttccggttcggggagaaccacgcaatcatgggtgtcgctttcacctgggtgatggccctggcttgcgccgctccgccgctggctgggtggtcccgttacatcccggaaggccttcagtgttcgtgcggaatcgactactatacccttaaaccagaagtgaacaacgagtcctttgttatctacatgttcgtggtccatttcaccatcccgatgatcattatcttcttctgctacggccagttggtctttacggtcaaagaagctgccgcgcagcagcaggagtcggccactacccagaaggcggaaaaagaagtcaccagaatggtgatcatcatggtgatcgccttccttatctgctgggtcccgtacgcctctgttgccttctacatcttcacccaccaaggatcgaatttcggacccatcttcatgaccatccctgcgttctttgcaaaatcggcggccatctacaaccctgtgatctacattatgatgaataagcaattcaggaactgcatgctgaccaccatttgctgcggcaagaatccgctcggggacgatgaggcctcggccaccgtgtccaagaccgaaacttcccaagttgcgcctgct

SEQ ID NO: 18571 - DNA, 1044 bp, Artificial Sequence
  Description of Artificial Sequence: Synthetic coding sequence
atgaatggtaccgaaggcccaaacttttacgtgccatttagcaacgcaactggtgtggtgcgctccccatttgaataccctcaatactatctggcagaaccttggcagttttcgatgctggcagcatacatgttcctccttattgtcctgggttttcccatcaatttccttacgctgtacgtgactgtgcagcacaagaagctgcgaactcccctcaattacattctgcttaatctcgccgtggcagacctctttatggtactgggaggttttacttcaactctctacaccagccttcatgggtacttcgtctttggcccaactggttgtaacttggagggattctttgctactcttggtggagaaatcgcgctgtggtcactggtcgtgctggccattgaaaggtacgtggtagtgtgtaagcctatgtcgaacttcagattcggagaaaaccatgcgattatgggtgtcgcatttacttgggtcatggcactggcatgcgccgcaccccctctggccggttggtcaagatacataccggagggcctgcagtgcagctgtggcattgactactacaccctcaagcctgaagtgaataacgaatcattcgtgatttacatgtttgtggtgcactttaccatccctatgataatcatattcttttgttacggccagctcgtttttaccgtcaaagaggcggcggctcagcagcaggaatcggcaaccactcaaaaagcagaaaaggaagtcaccaggatggtgattatcatggtcatagcttttttgatctgctgggtgccttacgcatccgtggcattttacatctttacgcatcagggatccaactttgggcccatattcatgactatacctgcgtttttcgcaaagtcggccgccatatacaaccctgtcatttacatcatgatgaacaagcaatttcgcaattgtatgcttactaccatttgctgtgggaaaaatccactcggagatgatgaggcttctgccaccgtgagcaaaactgagacttcccaggtggcccccgca

SEQ ID NO: 18572 - DNA, 1044 bp, Artificial Sequence
  Description of Artificial Sequence: Synthetic coding sequence
atgaacgggaccgaagggccgaacttttacgtccccttttccaacgccaccggggtcgtgcgatctcccttcgagtatccacagtattatctcgccgaaccatggcagttttcaatgcttgccgcgtacatgttcttgttgatcgtccttggcttccctatcaattttctgaccctgtatgtcactgtgcagcacaaaaaactgagaaccccgctaaattacatactgctcaacttagccgttgccgaccttttcatggttctcgggggctttaccagtactctgtacacttcgctgcatggatatttcgtctttggaccgactggttgcaatctcgaaggctttttcgcaacattggggggagagatcgcattatggagcctggttgtcttggccatcgaacggtatgtcgtggtatgcaagccaatgagcaacttccgcttcggggagaaccacgcgatcatgggggtagcatttacctgggtgatggctttggcctgtgccgccccaccactcgctggctggtcaaggtacatccctgaggggcttcagtgcagttgcgggatcgactactacacactcaagccggaggtcaacaacgagagcttcgtaatttatatgtttgtggttcatttcaccatccccatgatcatcattttcttctgttatggacagttggttttcaccgttaaggaagctgcggcccagcaacaggagtccgcaacaacccagaaggccgagaaagaggttacacgtatggtcatcatcatggtgattgctttcctgatctgctgggtcccctatgcaagcgtagccttctacatcttcacccaccaggggagcaactttggcccgatctttatgacaattcccgcgtttttcgccaagtccgcagcaatttataatcccgtaatctacattatgatgaataaacagtttcgcaactgcatgctcaccaccatatgttgcggcaagaaccccctgggggatgacgaggcgagcgccactgttagcaagactgagacgtcccaggtcgccccagct

SEQ ID NO: 18573 - DNA, 1044 bp, Artificial Sequence
  Description of Artificial Sequence: Synthetic coding sequence
atgaatgggacagaagggcccaacttttatgtgccattcagtaatgccactggggtagtccggtctcccttcgaatacccacaatattatctggctgaaccctggcagttctcaatgctcgccgcttacatgtttttacttatagtgctcgggtttccgataaatttcttgacactgtacgtcactgtgcagcataaaaaattacgcacacctctgaattatatcctcctcaacctggccgtggcggatctttttatggtcctcggagggttcacatcaacactctatacttcattacatggatatttcgtgtttgggcctacaggatgtaatctcgagggattctttgctactctcgggggggaaatcgcactgtggtctctcgtggtcctcgccattgaaagatatgtagtggtgtgtaaacctatgagtaattttcgcttcggagaaaaccacgccataatgggggttgccttcacatgggtgatggccctcgcatgtgcagctcctcctcttgctggatggtcccggtacatcccagaagggctgcagtgctcctgtggaattgattactatacactgaaaccagaggtcaataatgaatcttttgttatatacatgtttgtggttcacttcacaatccccatgataatcatctttttctgttacggacagctcgtgttcacagttaaagaagcagccgctcagcagcaggaatcagccacaactcagaaagctgaaaaagaagttacgcggatggtgataattatggtgatcgctttcctaatctgctgggtgccatacgcctctgtagctttctacattttcactcaccaggggtcaaatttcggacccatcttcatgacaatccccgctttttttgccaagtccgcagccatatataaccccgttatatatattatgatgaacaaacagttcaggaattgcatgctcacaacaatttgttgtggaaaaaaccccctcggagacgatgaagcttccgctacagtgtcaaaaactgaaacatctcaggtcgccccagca

SEQ ID NO: 18574 - DNA, 1044 bp, Artificial Sequence
  Description of Artificial Sequence: Synthetic coding sequence
atgaacggaaccgagggaccgaatttctacgtgcctttcagcaacgcgactggagtcgtgcgctccccattcgaatacccccagtactacctggccgagccatggcaattctcaatgctggcggcatatatgttcctgctgatcgtgttgggattcccgattaactttctgaccctgtacgtgaccgtccaacacaagaagctgagaactccgctgaactacatcctgcttaatctggccgtcgccgacctgttcatggtgctgggagggttcacttcgactctctacacttccctccatggatactttgtgtttggaccaaccggctgtaacctcgaggggttcttcgccactctgggtggagaaatcgctctctggtcgctggtggtcctggccatcgagcgctacgtggtggtgtgcaagccgatgtcgaactttaggttcggcgaaaatcacgcgattatgggcgtggcctttacttgggtgatggctctggcctgcgccgcccctcccttggcgggatggtcgcggtacatcccagaagggctgcaatgttcgtgtggaatcgattactacactctgaagcccgaagtgaacaacgaatccttcgttatctacatgttcgtcgtccattttacgatccctatgatcattatcttcttctgctacggccagcttgtctttactgtgaaagaagccgccgcacaacagcaggaatccgccaccactcagaaagcggaaaaagaggtgaccaggatggtgatcattatggtgattgccttccttatctgctgggtgccttatgcgagcgttgcattttacatcttcacccaccaaggatcaaacttcggcccaatcttcatgaccatacctgctttcttcgccaagtcggccgcgatctacaaccctgtcatctacattatgatgaacaagcagtttcgcaactgtatgctcaccactatatgttgtggcaagaatccgctgggagacgacgaagcatcggccactgtgtcaaaaaccgaaaccagccaagtggctccagcc

SEQ ID NO: 18575 - DNA, 1044 bp, Artificial Sequence
  Description of Artificial Sequence: Synthetic coding sequence
atgaatggaacagagggaccaaacttctatgtacccttctcaaacgctactggtgtcgtaagaagtcccttcgagtatcctcagtattaccttgctgagccctggcaattctccatgctcgccgcatatatgttcttgcttattgttctaggcttccctattaacttcctcaccctgtacgtgacagttcagcataagaagttgagaacccctctgaattatatcctgcttaatctagctgtcgccgatcttttcatggtcctaggtggctttaccagcacgttgtacacgtctttacatggatactttgtgttcgggcctacaggctgtaatctggaggggtttttcgccaccctcggaggtgaaatcgccctctggagcctggtggtcttggccatcgaaagatacgttgtggtgtgtaaacctatgtcgaactttaggtttggcgagaatcacgcgatcatgggtgtcgcatttacctgggtgatggcgctagcgtgtgccgctccccctttggcgggatggtcccggtatatcccggaggggctgcagtgttcttgtggtatagattattacacactgaagccagaagtgaacaacgagtccttcgtgatctacatgtttgtggtccacttcacaataccgatgatcataattttcttttgttacggacaattagtgtttacagtgaaggaggccgctgcacagcagcaggagagtgcaactactcagaaggccgaaaaggaagtgacccgaatggtaataataatggttattgctttcctcatctgctgggtgccctacgcgagcgtcgcgttttatattttcacccaccagggcagtaatttcgggccaatctttatgactatcccggccttcttcgctaagagcgcggccatttataaccctgtgatttatatcatgatgaataaacaatttagaaattgcatgctcacaacaatctgttgtggcaagaatcctttgggagacgatgaagcttcagccactgtgtccaaaacggaaacttcccaagttgcccccgct

SEQ ID NO: 18576 - DNA, 1044 bp, Artificial Sequence
  Description of Artificial Sequence: Synthetic coding sequence
atgaatggtacagaaggccctaatttttacgttccgttctcaaacgcaacaggcgtggtgcgctcaccattcgaatacccccagtattatcttgctgaaccttggcagtttagcatgctggctgcttacatgttcctgttgattgtccttgggtttcctatcaacttcctcactctctatgtgacggtccaacacaaaaagcttagaactcctctcaattatatcctgcttaacttggccgtggctgatctgtttatggtactcgggggctttacctctactctgtacacatctttgcacggatactttgtgtttgggccaactggctgtaacctggaggggttttttgcaaccctcggcggggaaatcgctctgtggtctctagtggtactggctatcgagcgctacgtggtggtatgcaagcctatgagcaacttcaggtttggtgaaaatcatgccatcatgggggtcgcatttacgtgggtaatggctctggcatgcgccgccccacctcttgccggatggtcaaggtacatacccgagggtttgcagtgctcctgtggtattgattactacacgcttaagcccgaggttaacaacgaaagcttcgtgatttacatgttcgtggtgcatttcacaatccccatgatcataatttttttctgttatggccagctggtcttcactgtcaaagaggctgccgcccagcagcaagaatccgctacgacccagaaggcagaaaaggaagtgacaaggatggtcataatcatggtaattgcgtttctcatctgctgggtaccatacgcaagtgtcgcgttctatattttcacccaccagggatcgaattttggtcccatatttatgacaatacctgccttctttgccaaaagcgctgctatttacaacccagtgatttacatcatgatgaacaaacagtttaggaattgcatgctgacgactatctgctgcggaaaaaaccctttgggcgatgatgaggccagcgcgaccgtgtcaaaaaccgagacaagccaggttgcaccggca

SEQ ID NO: 18577 - DNA, 1044 bp, Artificial Sequence
  Description of Artificial Sequence: Synthetic coding sequence
atgaatggaaccgaaggacctaacttctacgtgccattttcaaacgccacgggagtggtgaggagcccgttcgagtacccccaatactacctggccgaaccgtggcagttctcgatgctggcggcttacatgttcctgctgatcgtgctcggattccctatcaacttcttgacgctctacgtcactgtgcagcacaaaaagctgaggacgccgctgaactacatcctgctgaacctggcggtcgccgatctcttcatggtgctgggcggcttcacctcaaccctctacacgtcgctccacggttacttcgtctttggcccgactggatgcaacctggaaggatttttcgcgaccctgggcggagaaatcgcactgtggtcattggtcgtcctcgcgatcgagagatacgttgtggtgtgcaaaccaatgagtaacttccgattcggcgagaaccacgcaattatgggagtcgcatttacctgggtgatggcccttgcatgcgctgctcctccactcgctggatggtcacgctacatcccggaaggactgcaatgcagctgcgggatcgattactataccctcaaacctgaagtcaacaatgaatcgtttgtcatctacatgtttgtggtgcatttcaccatccctatgatcattatctttttctgctacggtcagctcgtgttcaccgtgaaggaggccgcagcgcaacagcaggaatcggcaaccacgcaaaaagccgaaaaggaagtgactagaatggtgattatcatggtgatcgccttcctgatctgctgggtgccgtacgctagcgtcgcattttacatcttcacccaccaagggtcgaactttgggcccattttcatgactatcccggccttctttgcgaaaagcgccgccatctacaatcctgtgatttacatcatgatgaataagcaatttcggaactgtatgttgactaccatttgctgcgggaagaacccgcttggagatgacgaagcgtccgcaaccgtgtccaagaccgaaacttcacaagtggctccggcg

SEQ ID NO: 18578 - DNA, 1044 bp, Artificial Sequence
  Description of Artificial Sequence: Synthetic coding sequence
atgaatggaactgagggacctaatttctacgtaccattctccaacgccaccggggtcgttcgtagcccatttgaatatccgcagtactacctggctgaaccatggcaatttagtatgctggccgcctatatgttcctgctgatagtcctcggttttcctataaacttcttaaccttgtatgttaccgtccagcataagaagttgcggactcctctgaattacatcctgctgaacctggcagtggccgacctattcatggtactgggtggctttaccagtaccctgtatacaagtctgcacgggtactttgtgttcggcccgactggctgcaatctggaaggctttttcgctaccttgggaggagagattgccctgtggtccctcgtcgtgctggccatcgagcgctacgtggtagtatgcaagccaatgtcgaatttcagatttggcgaaaaccatgcaatcatgggcgtggcgtttacttgggtgatggcccttgcctgcgctgctcctcctttagccggctggtcacggtatatccccgaaggactccagtgctcgtgtggtattgattattatacccttaaacccgaagtaaataacgagtccttcgttatatacatgtttgtggtgcatttcaccattcctatgataatcatatttttctgttacgggcagctggtgttcacggtgaaagaagctgctgctcagcagcaggaatctgctaccacacaaaaggctgagaaggaagttactagaatggtcatcatcatggtgatcgcctttttgatttgctgggtgccttatgcatccgtagccttttatatattcacacatcagggttccaatttcggacccattttcatgacaatccccgcctttttcgccaaatcggctgccatatataatcctgtgatctacatcatgatgaacaaacagtttcgcaactgcatgttgaccaccatatgttgcggtaaaaacccccttggagatgatgaggcctccgcaactgtatccaaaacagaaaccagtcaggttgccccagct

SEQ ID NO: 18579 - DNA, 1044 bp, Artificial Sequence
  Description of Artificial Sequence: Synthetic coding sequence
atgaatggtactgagggccccaatttttatgtcccattctccaatgccacgggagtcgtgaggagtccatttgaatacccacaatattacctggcagaaccatggcagttctccatgctggcggcctacatgttcctcttgatcgttctggggttcccgatcaacttcctgacactctatgtaacggtacagcataaaaaattgagaactcctttgaactacattctgttgaatctggcagtcgcagatctgtttatggtcctcggaggatttacctccaccctctacacaagtctgcacgggtatttcgtgttcggtcccaccggctgtaacctggaaggtttcttcgccacgctgggtggggagatcgccctctggagcctggtcgttttggctattgagcggtacgtggtggtgtgtaagccaatgtctaattttcggtttggagagaaccacgccataatgggcgtggcgttcacatgggtaatggctctggcttgtgcagccccacccttggccgggtggagtcgatacatccctgaaggactgcagtgctcttgtggaatcgattattatacacttaagcctgaggtgaacaacgaaagttttgtaatttacatgttcgtggttcacttcaccatacctatgataatcatctttttctgctatggtcagctggtgtttaccgttaaagaggctgctgcacagcagcaggagtcagcgaccacccaaaaagcagagaaggaagtgacaagaatggttatcatcatggtcatcgctttcttgatatgctgggttccctatgccagcgtggcattctatatcttcacccatcaaggcagtaacttcgggccaatctttatgacgatccccgcctttttcgccaagagcgctgcaatttataatcccgttatttatattatgatgaataagcagtttcgaaattgtatgctgaccacgatttgctgtgggaagaaccccctgggcgatgatgaagcgtctgcgacggtgagcaagactgagacaagtcaggtcgcaccagcc

SEQ ID NO: 18580 - DNA, 1044 bp, Artificial Sequence
  Description of Artificial Sequence: Synthetic coding sequence
atgaacggtaccgaaggccctaacttctacgtgcctttttcaaatgctacgggagtcgtgaggtccccattcgagtacccgcaatactacttggccgaaccatggcagttttcaatgcttgcggcctacatgttcctgctgatcgtgctgggctttccgattaacttcctcaccttgtacgttactgtgcaacataagaaacttcggaccccgctcaattacatcctgctgaacctggccgtcgccgatctcttcatggtgctcggcggattcacctcgactctgtatacttccctgcatgggtatttcgtctttgggccgactggctgtaacctggagggattctttgcgaccctgggcggtgaaatcgccctgtggtccctcgtggtcttggccatcgagcgctacgtggtggtttgcaagccgatgtcgaactttagattcggagagaatcacgcgatcatgggggtcgctttcacttgggtcatggcgctcgcatgcgcagcaccgccacttgcaggctggagccgctacataccagaaggactgcagtgctcgtgtggaatcgattactatacccttaaacctgaagtgaacaacgaatcattcgtgatctacatgtttgtagtgcacttcaccatcccaatgatcatcatcttcttctgctacggacagttggtattcactgtgaaagaggccgccgcccaacaacaggagtcagcaaccacgcagaaggcagagaaggaagtgacccgcatggtgattatcatggtgatcgccttccttatatgctgggtgccgtacgccagcgtggccttttacatcttcactcaccaggggagcaatttcggccctatctttatgaccatccctgcctttttcgcgaagagcgcggcgatctacaatccggtgatttacatcatgatgaacaaacaattcagaaactgcatgctgactaccatctgctgtggaaagaatccgctcggagacgacgaggcctctgccaccgtgtcaaagactgaaacctcgcaggtcgcgcctgcg

SEQ ID NO: 18581 - DNA, 1044 bp, Artificial Sequence
  Description of Artificial Sequence: Synthetic coding sequence
atgaacggcaccgagggtcccaatttctatgtaccctttagcaatgcaactggtgtcgtgcggtctccctttgagtacccccagtattaccttgcagagccatggcagttctccatgttagccgcttacatgttcctgctgattgttttggggttcccgatcaactttttgacgttgtacgtcaccgtgcagcataagaagctgcggacgccgctgaactatatccttctcaaccttgccgtagcagatttgttcatggttttaggtggttttacgtccaccttgtacacctcgcttcacggatacttcgttttcggcccgacgggctgcaatctggagggcttttttgccacgctgggtggcgaaatcgcactttggagtttggtcgttttggcgatagaacgctacgtggtggtctgcaagccgatgtccaactttcgctttggcgagaatcatgccattatgggagtcgcgttcacgtgggtgatggcactggcctgcgcagcgccacctctagcaggttggtctcgatacatcccggagggcttgcagtgttcgtgcggtatagattattatacgctgaaacccgaggtgaacaatgagtcgttcgtgatctacatgttcgtggttcacttcactatcccaatgataatcatatttttttgctatggccagctggtgttcacagtgaaagaagccgccgcgcaacagcaggagagcgcaactacccagaaggctgagaaggaggtgacacgaatggtgattataatggttattgcgtttctgatttgctgggtaccctacgcctcggtggccttctatatatttacacaccaaggaagcaatttcgggcctattttcatgacgatcccggccttctttgcgaagagcgccgcgatctacaacccggtgatctatattatgatgaacaagcaattccggaattgtatgctgacgaccatttgctgcggaaagaatcccctgggagacgacgaggccagtgcaacagtttctaagaccgagacatcacaggtggcccccgca

SEQ ID NO: 18582 - DNA, 1044 bp, Artificial Sequence
  Description of Artificial Sequence: Synthetic coding sequence
atgaatgggaccgagggaccaaacttctacgtgccatttagcaatgctaccggggttgtacgttctccatttgaatatccgcaatactacctggccgaaccatggcagttttcaatgttggcggcttatatgttcctgttaatagtgctggggtttccaatcaatttcctgaccctatatgtgacagttcaacacaagaagctccgcactcctttgaactacattctgctcaaccttgctgttgccgacctgttcatggttctgggtggcttcaccagtacactctatacttctctgcatgggtacttcgtcttcggccctacaggctgcaacctggagggatttttcgcgacgctcggcggcgaaatagccctctggagtcttgtggtcctcgccattgaacgctatgtggttgtgtgtaagcctatgagtaacttcagatttggagaaaatcatgccatcatgggagtagcattcacatgggttatggctctggcctgcgccgccccccccctggcaggctggagtcggtacatccccgaaggcttgcagtgttcttgcggcatcgattactacaccttaaaaccagaggtgaacaacgagagctttgtgatctacatgtttgtggtccatttcaccatacccatgataatcatcttcttctgctacggtcaattagtgttcacagtgaaggaggctgcagctcagcagcaggagtccgctacgacccagaaggcggagaaagaagtaacacgtatggtgattatcatggtgatagcttttctgatttgttgggttccctatgctagcgtggccttttacattttcacacatcagggaagtaacttcggccctatttttatgacaattccagcgttttttgctaagtcggcggccatttacaaccccgtgatttatatcatgatgaacaagcagttcagaaattgtatgctgaccacaatctgctgtggaaagaatcctctgggcgacgacgaagcttccgctacagtttccaagaccgagaccagtcaggtggcacctgca

SEQ ID NO: 18583 - DNA, 1044 bp, Artificial Sequence
  Description of Artificial Sequence: Synthetic coding sequence
atgaacggaacagagggacccaacttttacgtgccattttctaatgcgactggggtggtccgttccccgttcgagtacccgcagtactatctggctgagccttggcaattttcaatgctcgcagcctatatgtttctcctcattgtgttgggcttcccaatcaactttctgacattgtatgtaactgtgcagcacaaaaagttgcgcacgccactgaactacatactgctcaacctggctgttgcggatctgttcatggtactgggaggattcactagcaccctgtacacttctctccacggttactttgtatttggtccgaccgggtgcaatctcgagggatttttcgccactttaggtggagaaatcgccctttggtcactggttgtgctggctatcgaaaggtacgtcgtggtctgcaagcctatgtctaattttcgattcggggaaaatcacgccatcatgggagttgcattcacctgggtaatggcccttgcatgtgcagctcctccgctcgcagggtggagcagatatattccagaggggctccagtgcagctgcgggatcgattattacacccttaagccggaagtcaataatgaaagcttcgttatctacatgtttgtggttcacttcaccatcccaatgataatcatctttttttgctacgggcagctggtgttcactgtaaaggaggccgcggcccagcaacaagagagcgccacaacccagaaggccgaaaaggaggtcacacgtatggtgattattatggttatcgcgttcctgatctgctgggtgccctatgcctcagttgcattttacattttcacccatcagggcagcaacttcggtcccatcttcatgacaatccccgcatttttcgctaaaagtgctgcgatttataatcccgttatctatatcatgatgaataaacagtttcggaactgcatgctcacaaccatttgttgcgggaaaaatcccttaggcgatgacgaggcctctgcaacggtttctaagacagaaacctcgcaggtggcccccgct

SEQ ID NO: 18584 - DNA, 1044 bp, Artificial Sequence
  Description of Artificial Sequence: Synthetic coding sequence
atgaatggaaccgaggggcctaatttttatgtgccattctcgaacgcaacaggggtggtaaggagtcctttcgaatatcctcaatattacctggctgagccgtggcagttctctatgttggccgcctatatgttccttttgatcgtgctggggtttccgatcaactttctcactttatacgtaacagtccagcataagaaactcagaactccgttaaactacattcttctgaacctcgctgtcgccgacctttttatggttctgggtgggtttacgagcacgttgtacacgtcacttcatggatactttgtattcggcccaaccggctgtaacctggaaggctttttcgcgacacttggtggcgagatcgccctttggtcactggtcgtgctcgcaatagaaaggtatgtcgttgtttgtaaacctatgtccaattttcggttcggtgagaaccatgctattatgggcgtcgcatttacctgggttatggccttggcctgcgccgcgccaccgttggctggttggagccgctacataccagaaggactgcagtgctcctgtggcattgactactacacattgaagcctgaagtcaacaatgagagcttcgtgatctatatgttcgtggttcactttacaatccctatgatcattattttcttctgttacgggcaactggttttcactgtgaaagaagccgccgcacagcaacaagagagcgcaactacccaaaaagccgagaaagaggtcacacggatggtcataatcatggtcatcgcattccttatatgttgggttccctacgcttccgtggccttttatatattcacgcatcagggatccaacttcgggcctatcttcatgaccatcccagctttcttcgccaagagtgccgccatctataatcctgttatctacattatgatgaacaagcaattccgcaattgcatgcttactacaatttgttgcggcaaaaatccgttgggcgatgatgaggcctctgctaccgtctccaagactgagacctctcaggtcgcaccagcc

SEQ ID NO: 18585 - DNA, 1044 bp, Artificial Sequence
  Description of Artificial Sequence: Synthetic coding sequence
atgaatgggactgaaggacccaatttctacgtgcccttctccaatgcaaccggcgtggtgcgctcccccttcgagtatccccagtattatctggcagagccttggcagttcagcatgctggcagcctacatgtttttacttatagtactgggctttcctataaatttccttaccctgtacgtaacggtgcaacacaaaaagctgaggacaccgctgaactacatactgctgaacctggctgtggcagatcttttcatggtccttggaggtttcacgtctaccttgtacacgagcctgcacggatactttgtgttcggccccaccggctgcaatctggaaggcttctttgctaccctcggaggagagatcgctctgtggtcactcgtagtgttggctatcgagcgatatgttgtagtctgcaaacctatgtctaacttccggtttggtgaaaatcacgccataatgggggtcgctttcacctgggtgatggccctggcatgcgccgcaccccctctggctggttggtcgcgttatatcccggagggccttcagtgtagttgtggaatcgattactacaccctgaagcctgaagtcaacaatgaaagttttgtgatctacatgttcgtcgtccatttcaccatccctatgatcatcatttttttctgttacggacagctggtattcaccgtcaaagaggcggccgctcagcaacaggaatctgccacgacacagaaggctgaaaaggaagtcacccgtatggtgataattatggtgatcgcatttctcatctgttgggtcccctacgcaagcgtcgccttctacatttttactcaccaaggatccaattttggtcccatttttatgaccatccctgcctttttcgccaagtccgcggctatctataaccctgtgatctacattatgatgaataagcagtttaggaactgtatgctgaccactatttgctgcggcaaaaacccactgggagacgacgaggcatcggctactgtgtccaagaccgaaacaagtcaggttgcgcctgca

SEQ ID NO: 18586 - DNA, 1044 bp, Artificial Sequence
  Description of Artificial Sequence: Synthetic coding sequence
atgaatggaactgaaggccctaacttttacgtgcctttttccaacgccaccggagtggtccggtcgccctttgagtatccacaatactacctggctgaaccctggcagttttccatgctcgcagcatacatgtttctgcttatagtgctggggtttccaattaacttcctgactctgtacgtgaccgtgcaacacaaaaagttgagaacccccttgaactatattctgcttaatcttgccgtggcggacctgtttatggttcttggcggttttactagcactctgtacaccagccttcatgggtacttcgtgttcggccccaccggctgcaaccttgagggattctttgctaccctgggtggggaaatcgcattgtggtcgctggtcgtgctcgcaatagagcgctacgttgtggtgtgtaagcctatgtcgaactttaggtttggcgagaaccacgccattatgggggtggctttcacctgggttatggcactggcatgtgcagcccctccgctggcagggtggtcgagatatatccccgagggattgcaatgctcatgtggtattgattactacactcttaagcccgaagtcaataacgaatcgttcgtgatttacatgttcgtcgtccattttacgattcctatgataatcattttcttttgctacggtcaactcgtgttcaccgtgaaagaagcggccgcccaacaacaggagagcgcgactactcagaaggccgaaaaagaggtgactaggatggtcatcatcatggtcatagcgtttctgatttgttgggtgccatacgcaagcgtggccttttacatctttacccaccaaggttctaatttcggacctatattcatgacgatccccgcctttttcgctaagtcggcagcaatttacaatcctgtgatctacatcatgatgaacaaacagtttaggaattgcatgcttaccactatctgctgtggtaagaacccactcggtgatgatgaagcatcagcgaccgtctctaagacggaaaccagccaggtggcaccagcc

SEQ ID NO: 18587 - DNA, 1044 bp, Artificial Sequence
  Description of Artificial Sequence: Synthetic coding sequence
atgaatggaacagagggacccaacttttatgtgcctttcagtaacgcgactggcgtcgttcgttccccgttcgagtacccccagtactacctggctgagccgtggcagttcagtatgttagccgcctacatgttcttgctcatcgtcctgggcttcccaatcaacttcctcactctctacgtcaccgtccagcacaagaagctccgtacccccttgaactacatcctgttgaaccttgctgtggccgacctctttatggttctcggcggcttcacgtccaccttgtacacgtctcttcacggttactttgtgttcggccccaccggctgcaacctggagggtttttttgcaacacttggaggcgagatcgctctatggtccctggtcgtcttggccatcgagcgctacgtcgtggtctgcaagcccatgtctaatttccgttttggtgaaaaccacgcgattatgggtgtcgcgttcacttgggtgatggcgttggcttgtgctgcaccccctctcgccggttggagcaggtacatccctgagggtctgcagtgcagctgtggtatcgactactacacactcaagcccgaggttaacaacgagtctttcgtaatttacatgttcgtggtccatttcaccattcctatgatcatcatctttttctgctacgggcaactcgtcttcaccgtgaaggaggccgctgcacagcaacaagagtccgcaaccacgcagaaggccgaaaaggaggtcactcgcatggtcattattatggtgattgcgttccttatttgctgggtgccgtacgcgtccgtcgctttctacatcttcactcaccaaggctccaacttcggtcccatctttatgactattcccgccttcttcgctaagagcgccgcaatctataaccccgtcatctacatcatgatgaacaagcagttcaggaactgtatgctcacgaccatttgctgtggcaagaaccccttgggcgatgacgaggcctctgccaccgtctccaaaaccgagacgagccaagtcgccccggcg

SEQ ID NO: 18588 - DNA, 1044 bp, Artificial Sequence
  Description of Artificial Sequence: Synthetic coding sequence
atgaacggcaccgagggaccaaatttctacgtgcctttcagcaatgctactggagtggtgaggtccccttttgaataccctcaatactacttggcagaaccctggcaattctccatgcttgcagcatatatgtttcttctgattgtcctgggattcccgatcaacttccttactctttacgtgaccgtccagcataagaagctgcgaacccccctcaactatattctgctgaacctggcagtcgcggaccttttcatggtccttggtggttttacttcgaccctctacacctccctgcacggctactttgtgttcggaccaaccggttgtaaccttgagggtttctttgcaacgttgggaggagagattgcactgtggtcactcgtggtgctggcaattgagcgctacgtggtggtctgtaaacctatgtccaatttccgttttggagaaaaccacgcaataatgggagtggcttttacctgggttatggcactggcgtgtgccgcgccccctcttgcgggttggtcgagatacattccggagggactgcagtgttcatgcggcattgattactatacccttaagcctgaagtcaataatgagagttttgtcatttacatgttcgtcgtgcactttaccattcctatgatcattatctttttctgttacggtcagctcgttttcactgtgaaggaagccgcagcacaacagcaagaaagcgccacgacccagaaggcagagaaggaggtgacccgcatggtcatcattatggtgattgccttccttatttgttgggtgccatacgcttcggtggccttctacatcttcacccaccagggcagcaactttggacccatattcatgactattcctgccttctttgcaaagtcggccgcgatctacaatccagtcatttacattatgatgaacaagcaatttaggaactgcatgcttaccaccatttgctgtggaaagaacccactgggggacgacgaggcatcagcaacggtgagcaagacggaaacctcgcaggtggcacccgcg

SEQ ID NO: 18589 - DNA, 1044 bp, Artificial Sequence
  Description of Artificial Sequence: Synthetic coding sequence
atgaacggtaccgaggggcctaacttctacgtccctttcagcaatgcaaccggtgtggtccgtagcccgttcgaatacccgcagtactacctggcagaaccctggcaattcagcatgcttgcagcgtatatgtttcttctgatcgtcctgggcttcccgattaactttctcactctgtacgtgacggtccaacacaagaagctgcggactcctctgaactacatactcctcaacctggctgtcgcggacctgtttatggtcctcggagggtttacctcgaccttgtacacttcgcttcatggctacttcgtttttggacccaccggttgtaaccttgagggatttttcgccaccctcggaggtgaaattgcactgtggtcactcgtcgtactggcaatcgagcgctatgtcgtggtctgcaagcctatgtccaactttaggttcggcgaaaatcatgccatcatgggagtcgcatttacttgggtgatggcactggcatgcgctgcaccgcctctcgcggggtggtcaaggtatatacccgaaggcctccaatgttcgtgcggaatcgattactacactctgaagcctgaagtgaataacgagtcgtttgtgatttacatgtttgtcgtgcactttaccattccgatgattatcatattcttttgttacggccagctggtgtttaccgtcaaggaagcagcagcccagcagcaagaatccgccactacccaaaaggccgaaaaggaggtgaccagaatggtcattatcatggtcatagcctttctgatttgctgggtgccctacgcttctgtggccttctacattttcactcatcagggatccaactttggccccattttcatgactatccctgcattctttgcaaagtccgccgctatttacaatcctgtgatctacataatgatgaacaagcagttcaggaattgcatgcttacgactatttgttgtgggaaaaatccccttggggatgacgaggcttccgcaactgtgagcaagaccgaaacctcccaagttgccccagcg

SEQ ID NO: 18590 - DNA, 1044 bp, Artificial Sequence
  Description of Artificial Sequence: Synthetic coding sequence
atgaacgggactgagggcccaaatttctacgtcccattctctaacgccaccggcgtggtcaggtcccccttcgaatacccccaatattacctggccgagccttggcagttctcaatgttggctgcctacatgtttctcttgatcgttttggggtttccaataaacttcctcaccttgtacgtgaccgtgcagcataaaaaattgaggacaccactgaattacatacttcttaacttggcggtcgccgatcttttcatggtgttaggggggttcacgagcaccttgtataccagcttgcacggatactttgtatttggccctacaggatgtaatcttgaggggtttttcgcaacgctcggcggcgaaattgccttgtggtcgttagttgtgctggctatcgagcgctacgttgtggtgtgtaagcctatgagcaacttccggtttggcgagaatcacgccattatgggcgtcgcatttacctgggttatggcactggcatgtgccgccccccctctagccggatggagcaggtacatcccagaaggactacagtgctcctgtgggatcgattattatactctcaaacctgaggtgaacaacgaaagttttgtgatttacatgttcgtggtgcactttaccatcccaatgatcatcatctttttttgttatggccagttagtatttactgttaaagaggcggcagcgcagcagcaggagtccgccactacacagaaggcggaaaaagaggtgacacggatggtgattattatggtgatagcatttctgatctgctgggtgccatatgcgagcgtagcattctatattttcacacaccagggcagcaatttcgggccaatctttatgactatacccgccttttttgcgaagtcagccgctatttataaccccgtcatctatatcatgatgaataaacagtttcggaattgcatgcttaccacgatttgttgcggaaagaacccacttggtgatgatgaggcctctgctaccgtttctaagacagagacttctcaggtagctcccgca

SEQ ID NO: 18591 - DNA, 1044 bp, Artificial Sequence
  Description of Artificial Sequence: Synthetic coding sequence
atgaatggaaccgaaggaccgaatttctacgtgccattctccaatgccaccggggtggtcagatccccgttcgagtacccgcagtactacctggcagagccgtggcagttctcgatgcttgcagcgtacatgttcttgctcatcgtgctgggcttcccgatcaatttcctcactctctacgtcaccgtgcaacacaaaaagctccggacgccactgaactacatcctgctgaatctggccgtggccgatttgttcatggtcctcggaggcttcacctcgactctctacacttcccttcacgggtactttgtgtttggacctactggatgtaatctggaaggcttttttgccactctgggaggggaaatcgccctttggtcccttgtcgtgctcgcgatcgagaggtatgtcgtggtttgcaagccgatgtcgaacttccgctttggtgagaaccatgcgatcatgggagtggcctttacctgggtcatggcactggcatgtgctgcccctccgctggctgggtggtcacggtacatcccggaaggactccagtgttcgtgcggaatcgactattacactctcaagccagaggtgaacaacgaatcgttcgtcatttacatgtttgtggtgcatttcaccatcccaatgatcattatcttcttttgctacggccaactggtgttcaccgtgaaagaggccgctgcacagcaacaggagtcggccactactcagaaggccgaaaaggaggtgactcgcatggtgatcatcatggtgatcgcgttcctcatctgctgggtgccgtacgcatcagtcgcgttttacatctttacccatcagggctcaaatttcggacccatctttatgactatcccagcgttcttcgccaagtcggctgctatctacaaccctgtgatctacatcatgatgaataagcagttccggaattgtatgctcaccactatctgctgcggcaagaacccactgggtgatgacgaagcatccgcgactgtgagcaagaccgagacttcccaagtcgcgccggcc

SEQ ID NO: 18592 - DNA, 1044 bp, Artificial Sequence
  Description of Artificial Sequence: Synthetic coding sequence
atgaacgggacggagggacctaatttctacgtccccttcagcaatgcaacaggagtagttcgctcccccttcgaatatccccagtattatctggccgagccatggcagttcagtatgttggcagcttacatgtttctgctgatagttctgggctttccaattaacttcctgacgttgtacgttaccgtccaacacaagaagcttcgtaccccgctgaactacatccttttaaacctagcagtagccgatcttttcatggtcttaggcgggttcacctctactttatatacctcccttcacggctattttgtattcgggcctaccggttgtaatctcgaaggcttcttcgctacgcttgggggagaaatcgcgttgtggtctctcgtggtgctggccatagagcgatacgtcgtcgtttgcaaacccatgtcgaattttcggttcggcgaaaaccatgcaattatgggagttgcctttacatgggttatggccttggcatgcgctgcgccacctttagctggatggtcaagatacattccagagggccttcaatgcagttgcggaatcgactactataccttaaagccagaagtaaacaacgaatcctttgttatctatatgttcgttgtgcacttcactattccgatgataatcatatttttctgctacggccaactggtcttcactgtcaaagaggccgctgcgcagcaacaagagagtgccacgacccaaaaagcggaaaaggaggtcacacgcatggttatcatcatggtcatcgcctttctgatctgctgggtcccatatgcatccgttgcgttctacattttcacccaccaaggatccaatttcgggccaatcttcatgacaattccagcgttcttcgcgaagagcgcggctatttacaatcctgtaatttatatcatgatgaataagcagttccgtaattgcatgcttactaccatctgctgtggtaagaacccgttaggggatgacgaagcgtctgcgactgttagtaagaccgagactagccaggtcgcgccagct

SEQ ID NO: 18593 - DNA, 1044 bp, Artificial Sequence
  Description of Artificial Sequence: Synthetic coding sequence
atgaatggaaccgagggaccaaacttctacgtccctttttcaaacgcaactggggtcgtgaggtccccttttgagtacccgcagtactaccttgcagaaccatggcaattttccatgctcgccgcatacatgtttctcctgatcgtccttgggtttcccattaacttccttaccttgtacgtgaccgtgcaacataagaaattgcgtactccacttaactacatcctgctgaacctcgcagtggcagatcttttcatggtcctgggaggatttacttccaccctctacacctccctgcatggatactttgtgtttggacctaccggatgtaacctggaaggttttttcgcgactctcggtggggaaattgcactttggagcctggttgtccttgccattgagcgctacgtggtggtgtgtaaacccatgtcgaattttcgcttcggagagaaccatgccataatgggcgtggcattcacttgggtgatggcgctggcatgcgcagcacctcctctggcaggatggtcccggtatattcctgaaggactgcaatgctcgtgtggtatagactactatactctgaaaccagaagtgaataacgagtcatttgtgatttacatgttcgttgtgcattttacgatccctatgatcatcattttcttttgctatggtcagctggtgtttaccgttaaggaggcagcggcacaacaacaggaatcggcaactactcaaaaggcagagaaagaagtgactcgcatggtgataatcatggtgattgccttcctgatatgctgggtgccctacgcatcagtggcattctacattttcacccaccagggatcgaactttggccctattttcatgaccattccagcattcttcgctaagagcgcggcgatttacaacccagtgatctacattatgatgaacaaacagtttagaaattgtatgctgactaccatatgttgtggtaagaacccactcggcgacgacgaagcgtcggctaccgtctctaagactgaaacctcgcaagtcgcgccagcc

SEQ ID NO: 18594 - DNA, 1044 bp, Artificial Sequence
  Description of Artificial Sequence: Synthetic coding sequence
atgaatggaacagagggtccaaatttttatgttcctttctccaatgcaacaggagttgtaagatcaccatttgaatatccacaatattatttagctgaaccatggcaattcagtatgttagcagcatacatgtttttacttattgtacttggttttcctataaattttcttactctttatgttactgttcaacataagaaattacgtactcctttgaattatattttacttaaccttgcagttgctgatttgttcatggttcttggaggatttacatctactctttatacaagtttacatgggtatttcgtttttggaccaacaggttgtaatcttgaaggattttttgcaacattaggaggagagattgctttatggagtttagtcgttttggctattgaaagatatgtagtagtatgtaaaccaatgtctaactttcgtttcggagaaaatcacgcaattatgggagttgccttcacttgggtaatggctttagcttgtgctgcacctccacttgcaggatggtcacgatatatcccagaaggacttcaatgttcatgtggaattgattattatacactaaaaccagaagttaataatgaatcattcgttatatatatgtttgtagtacattttacaattccaatgattattattttcttttgttatggtcaattagtttttacagtaaaggaagcagctgctcaacagcaagaatcagctacaacacaaaaagctgaaaaagaagttactagaatggtcataattatggttattgcttttcttatatgttgggttccatatgcttcagtggctttctatatttttacacatcaaggaagtaattttggtcctattttcatgacaattccagccttttttgcaaaatcagctgctatttataatccagttatttatataatgatgaataaacaatttagaaattgtatgttaactactatttgttgtggaaaaaatccattaggagatgatgaagcaagtgcaacagttagtaaaacggagactagtcaagtagctccagct

SEQ ID NO: 18595 - DNA, 1044 bp, Artificial Sequence
  Description of Artificial Sequence: Synthetic coding sequence
atgaacggtaccgagggccctaacttctacgtgccattctccaacgctactggcgtcgtgaggagcccgttcgaatatcctcaatattaccttgccgagccctggcagttttccatgctagcagcatacatgttcctgctgatcgtgcttggattccccattaacttccttacgctctacgtgactgtccaacacaagaaactcaggacccctttaaactacatactgctgaatctcgcagtagccgatcttttcatggtcctcggtggcttcacctccaccctctatactagtctccatggttacttcgtctttgggcctacagggtgtaatctggaggggttcttcgccacactgggcggggaaatcgcgctatggtctctggtggtcctcgctatcgagcgctacgtggttgtgtgcaagccgatgtccaatttcaggtttggggaaaaccacgccataatgggcgtcgccttcacctgggttatggccctggcatgcgctgcacctccacttgctgggtggagtaggtatatccccgaaggtctgcagtgctcttgcggaattgactattatacccttaaacctgaagtgaacaacgaatcattcgtcatatatatgtttgtcgtgcactttacaatacccatgatcataatttttttctgctatgggcaactggtctttacggtgaaagaggccgcagcccagcagcaagagagtgcaaccacccagaaagccgaaaaggaagttactcgaatggttatcatcatggtaatcgcctttctgatctgctgggtgccatatgccagcgtggccttctacattttcactcaccaaggatctaatttcgggcctatttttatgaccattcccgcgttctttgcaaagagcgcagctatttataatccagttatttatataatgatgaacaagcagtttagaaattgcatgttgacaactatctgttgtggcaagaaccctctgggagacgacgaagcatcagctacggtgagcaagacagaaacttcgcaggtggctccagcg

SEQ ID NO: 18596 - DNA, 1044 bp, Artificial Sequence
  Description of Artificial Sequence: Synthetic coding sequence
atgaacggcaccgaaggccccaatttctacgtacctttctccaacgccaccggagtcgtacgctctcctttcgagtatccgcagtactatctggctgagccctggcaattctctatgctggcagcttacatgtttctgttgattgtcctgggattcccaatcaactttctgaccctttatgtgactgtgcagcacaaaaaactccgcacaccgctcaactatatcctgctcaatctggccgtcgcggacttgttcatggtgctcggcggattcacgtcaacattgtacacaagcctgcacggttacttcgtgtttggtccaaccggttgtaacctggagggtttcttcgcaaccctgggcggtgaaatagcgttgtggtcactcgttgtgcttgctatagagagatacgtggtggtgtgcaaacccatgtccaactttaggtttggcgaaaatcacgctatcatgggagtagcattcacctgggtgatggcccttgcttgtgccgcccccccactcgcgggatggagtaggtacattcctgaaggtcttcagtgcagctgcggcatcgactattacactctcaaaccggaagtgaataacgaaagctttgtgatatatatgttcgtggttcattttacaatccctatgatcattatcttcttctgttacggtcaactggtcttcaccgtgaaggaggccgccgcccaacaacaggagagcgcgaccactcaaaaagctgagaaagaggtcactcgcatggtcatcattatggttattgcttttctgatttgctgggtcccatacgcttctgtcgccttctatatcttcactcatcagggctctaattttggccctatctttatgactatccccgcattctttgccaagtccgccgctatatataatcctgtgatttacatcatgatgaataaacagtttagaaactgtatgcttaccactatctgctgcggcaagaatccattgggtgacgatgaagcatccgccaccgtgtctaagacagagacctcccaagttgcgcctgcg

SEQ ID NO: 18597 - DNA, 1044 bp, Artificial Sequence
  Description of Artificial Sequence: Synthetic coding sequence
atgaatgggactgaagggcccaacttttacgtaccgttctctaatgcaactggagtcgtgaggtctccattcgagtaccctcagtactatctcgccgaaccttggcaattttctatgctggccgcatatatgtttttactcatcgtgcttggatttcccatcaattttttaactttatatgtaacagtacagcacaaaaaactgcgaactcctctgaattatatccttctgaacctagcggttgccgacctgtttatggtgttagggggatttactagtactctctacacttcacttcacgggtatttcgtattcggacccacagggtgtaatctggaaggattcttcgctactctggggggggagatcgctttatggtctttagtggtgcttgctatcgaacgttacgtggtagtctgcaagcccatgagtaactttcgattcggagaaaaccatgctattatgggggtagcatttacttgggtaatggcattagcctgtgctgcccctccactggctggatggtctcgctatatccccgaaggactgcagtgctcatgtggaattgattactatacactaaagcccgaagtgaacaacgaatctttcgtgatctacatgtttgtggtgcacttcacaatacccatgattatcatctttttctgctatggacagttagtgttcacagtgaaggaagccgccgctcagcagcaggagtcagctactacacaaaaagccgagaaagaagtcactaggatggtgatcattatggtcatcgctttcctaatttgttgggtaccctatgcctccgtggccttttatatcttcactcaccaggggtccaattttggacccattttcatgactatccccgccttctttgccaaatccgcagccatctataatccagttatatacatcatgatgaacaagcagttccggaactgtatgcttactactatttgttgtgggaagaacccactaggggatgacgaagcatccgcgacagtgagtaaaactgagacaagtcaggtagcaccagct

SEQ ID NO: 18598 - DNA, 1044 bp, Artificial Sequence
  Description of Artificial Sequence: Synthetic coding sequence
atgaatggtacggaaggtccgaatttttatgtaccgttttcgaatgcgacgggtgttgtacgatcgccgtttgaatatccgcaatattatctagcggaaccgtggcaattttcgatgttagcggcgtatatgtttctattaatagtactaggttttccgataaattttctaacgttatatgttacggttcaacataaaaaactacgtacgccgctaaattatatactattaaatttagcggtagcggatttatttatggttctaggtggttttacgtcgacgctatatacgtcgttacatggttattttgtttttggtccgacgggttgtaatttagaaggtttttttgcgacgctaggtggtgaaatagcgctatggtcgctagtagtattagcgatagaacgttatgtagtagtatgtaaaccgatgtcgaattttcgatttggtgaaaatcatgcgataatgggtgtagcgtttacgtgggtaatggcgttagcgtgtgcggcgccgccgttagcgggttggtcgcgttatataccggaaggtttacaatgttcgtgtggtatagattattatacgctaaaaccggaagtaaataatgaatcgtttgtaatatatatgtttgttgtacattttacgataccgatgataataatatttttttgttatggtcaactagtttttacggtaaaagaagcggcggcgcaacaacaagaatcggcgacgacgcaaaaagcggaaaaagaagtaacgcgaatggttataataatggtaatagcgtttctaatatgttgggtaccgtatgcgtcggtagcgttttatatatttacgcatcaaggttcgaattttggtccgatatttatgacgataccggcgttttttgcgaaatcggcggcgatatataatccggtaatatatataatgatgaataaacaatttcgtaattgtatgttaacgacgatatgttgtggtaaaaatccgttaggtgatgatgaagcgtcggcgacggtatcgaaaacggaaacgtcgcaagttgcgccggcg

SEQ ID NO: 18599 - DNA, 1044 bp, Artificial Sequence
  Description of Artificial Sequence: Synthetic coding sequence
atgaacggtaccgaagggcctaacttttacgtccctttttcgaacgcaaccggggttgtcagatccccattcgaatatcctcaatactacctcgcggaaccttggcaattctcgatgctcgcagcctacatgttcctgttgatcgtgcttggttttccaataaacttcctgactctttacgtgactgttcaacacaagaaactgcgcacccccctcaactacattctgttgaatcttgcagtggcagatctgtttatggtccttggtggatttacttcaaccctttatacttcacttcacgggtacttcgtctttgggcccactggttgtaatctggaaggatttttcgccaccctcggaggagaaatagcactttggagcctggtggtgctggccattgagcgctacgtggtggtttgtaagcctatgtcgaactttagatttggagagaatcacgcaattatgggagtggccttcacttgggtgatggccttggcgtgcgccgcacccccgctcgctggctggagccggtacattcctgaaggcctgcaatgtagctgtggtatcgactactacactcttaagccggaggtgaataacgagtcgtttgtgatttacatgtttgtcgtgcactttaccattccaatgataatcatcttcttttgctacggtcagttggtctttactgtgaaagaggccgcggcccaacaacaggaatcggcaacgactcagaaagcagaaaaggaagtgactaggatggtcatcattatggtgatagccttcctgatttgctgggtgccttacgccagcgtggccttttacattttcactcatcagggttcgaacttcggtccaatcttcatgaccattccagccttctttgccaagtcagccgccatctacaatccagtgatttacattatgatgaacaagcagtttcgaaattgcatgctcaccaccatctgttgtggaaaaaacccactcggtgatgatgaagcatccgcgaccgtctcaaagaccgagactagccaggtggctcccgca

SEQ ID NO: 18600 - DNA, 1044 bp, Artificial Sequence
  Description of Artificial Sequence: Synthetic coding sequence
atgaacggaacagaagggcccaacttctatgtaccattctccaacgccaccggggtggtacgttccccattcgaatacccacagtattacttggcggaaccttggcagtttagcatgctggccgcctatatgtttctccttattgtgctgggcttccccattaatttccttacgctctatgtgacagtgcagcacaaaaaattaaggacgcctctgaattacatattgctgaacttagccgttgccgacctgttcatggtcttgggcggctttacatcaactctgtatacgtctctgcatggctacttcgtcttcggacccaccgggtgtaacttagaggggttctttgctaccttggggggagagattgcactgtggagcctagtagttctggctatcgaacgctacgtcgtggtgtgcaagcctatgagcaatttccgattcggagagaaccacgcaatcatgggtgtagccttcacctgggtgatggctctggcctgtgccgcgcctccactcgccggttggagccggtacatccccgagggactgcagtgttcctgtggcattgactactataccctcaagccggaggttaataatgaatccttcgttatctacatgttcgttgtgcatttcacaattccaatgataattatcttcttctgctatggccagctggtttttaccgtgaaagaagctgcagctcagcagcaggagagtgctactactcagaaggccgagaaagaggttactcggatggtgataatcatggtgatcgccttcctcatctgctgggtgccctacgcatctgttgcgttctatatcttcacccatcagggctccaacttcggccctatctttatgacaatacctgcattctttgctaaatccgcagccatctataatcctgtgatatatattatgatgaataaacagtttagaaattgtatgctcaccaccatctgctgcggaaaaaatccccttggtgatgacgaggctagtgctaccgtgtccaaaacagagacatcccaagtcgccccagcc

SEQ ID NO: 18601 - DNA, 1044 bp, Artificial Sequence
  Description of Artificial Sequence: Synthetic coding sequence
atgaacggtaccgaaggaccaaacttttacgtccctttctccaacgcgaccggtgtggtgcgcagtccttttgagtatcctcaatactacttggcagaaccatggcagttttcaatgctggcagcctacatgtttctgctgatcgtgctggggtttccaataaacttcttgacgctgtacgtcactgtccaacataagaagctccgtacccctttgaactacattctgctgaatcttgcagtcgcagatctgtttatggttctgggcggttttacctcaaccctttacacgtcacttcatggatacttcgtgtttggtcccactgggtgcaatctggaaggctttttcgccaccctgggtggggaaattgccttgtggtccttggtagtgctcgcaatcgagcgctacgtggtagtgtgtaagcctatgtccaactttaggttcggcgaaaatcacgcaattatgggagtggcatttacgtgggtgatggccctcgcgtgtgcagctcctccgctcgctggatggtcaagatacattccagagggactccaatgtagctgcggaattgattactacactcttaagcccgaagtcaacaatgagtcgtttgtcatttacatgtttgtggtgcacttcaccatccctatgataatcatctttttctgctacggacagcttgtgtttactgtgaaagaagcagcagcacagcagcaagaatccgccaccactcaaaaagcggaaaaggaggtcactcggatggtgatcataatggtcatcgctttccttatctgttgggtgccctatgcgtcggtggcgttctacattttcactcatcaaggaagcaacttcgggccgatctttatgaccattccagcatttttcgcaaaatcagcagcaatatacaatcccgtcatttacattatgatgaataagcaattcagaaactgtatgcttacgaccatctgttgcggaaagaatcccctcggagacgatgaggcatcagcgacggtgagtaaaaccgaaacttctcaggttgcccccgca

SEQ ID NO: 18602 - DNA, 1044 bp, Artificial Sequence
  Description of Artificial Sequence: Synthetic coding sequence
atgaacgggaccgaaggtccaaatttctacgtgcccttctcaaacgccactggggtggtgcggtcaccattcgagtacccacaatactacttggccgagccatggcagttctccatgctggccgcctatatgttccttctgattgtcctggggttcccaattaacttcttgacgctgtatgtgaccgtgcagcacaaaaaactgcgcacgcctctgaattacatcctcctcaacctcgcggtggcggatctcttcatggtgttgggtggattcacttcgacgctgtacaccagcctgcatggctatttcgtgtttggcccgactggatgcaacctggaagggttcttcgcgacccttggcggcgaaatcgccctgtggtcgctggtggtcctggcaatcgagagatacgtcgtcgtctgcaaacccatgtcaaactttcgctttggagagaaccatgcaattatgggggtggcgtttacttgggtgatggccctggcatgcgcggctccgcctttggcgggatggagtagatacatccctgaaggactgcaatgctcgtgtgggatcgattactacactctgaagccggaagtgaacaacgaatcgttcgtgatctacatgtttgtcgtgcacttcaccatccctatgatcatcatcttcttttgttacgggcaactggtctttaccgtcaaggaagccgccgcacagcaacaagagtcggccactactcagaaggcggagaaagaggtaacccgaatggttatcatcatggtcatagcgttcctgatctgctgggtcccgtacgcttcagtggccttctatatctttacccaccagggaagcaacttcggaccgatcttcatgactatcccagcattcttcgcgaaaagcgccgcaatttacaatccagtgatttacatcatgatgaacaagcagttccgcaattgcatgttgacgacgatctgttgcggcaaaaatccactcggtgacgacgaggcttccgccaccgtttccaagacggaaacctctcaagtagcaccagcg

SEQ ID NO: 18603 - DNA, 1044 bp, Artificial Sequence
  Description of Artificial Sequence: Synthetic coding sequence
atgaacggcaccgaggggcctaatttctacgtgccattctccaatgccaccggcgtcgttaggagccccttcgagtaccctcaatattatcttgctgaaccttggcagttttctatgctggccgcttacatgtttttgctgatagtactggggtttcccatcaatttcctgacgctgtacgtgacagtgcaacataagaagctccgcacgcctctgaactacattctacttaatctcgcagttgctgaccttttcatggtactcgggggctttacatctaccctttacacctcgctgcacggatactttgtgttcggccctactggatgcaatctggaaggattttttgctactctcggaggagaaatcgccttgtggtcactggttgttctggccatagaacggtacgttgtggtttgtaagccaatgtcgaacttccgcttcggtgaaaaccacgcaatcatgggggtggcctttacctgggttatggccctggcctgcgcagcccctccacttgcaggctggtcccggtatatcccagaaggactgcaatgctcgtgtgggatagattattacaccctgaagcctgaagtgaacaacgagagtttcgtaatctacatgtttgtggtgcacttcactattcccatgattataatcttcttttgctacggccagctcgtgttcactgtaaaggaggcagcagcacagcagcaggaatcagccacgacccagaaagccgaaaaggaagtgacacgcatggtgataataatggtgatagcatttctgatttgctgggttccctatgcgtccgtcgcattctacatcttcacacaccaggggagcaatttcggacctatcttcatgaccatccccgcctttttcgctaagagcgccgccatttacaaccctgtgatttacatcatgatgaataagcaattcagaaactgcatgctcacaaccatttgctgcggaaaaaatcctctgggcgacgatgaggcctctgctaccgtgagtaaaactgagacttcacaggtggcaccagct

SEQ ID NO: 18604 - DNA, 1044 bp, Artificial Sequence
  Description of Artificial Sequence: Synthetic coding sequence
atgaatggcactgaaggaccgaacttctatgtgcccttctccaacgccaccggcgtcgtaagatctcctttcgagtatcctcagtactacctggctgaaccatggcaatttagcatgttggccgcctatatgttccttctcattgtgctcggctttccaatcaatttcctgacactgtatgtaacggtgcagcataaaaagctgagaactcctcttaactatattctgcttaatttggccgtggccgatctgttcatggtgctcggggggttcacatcaaccctttacacctccctgcacggatattttgtctttggtcccactggttgtaatttggagggattcttcgctactctgggaggcgaaattgccctgtggtcacttgtggtgcttgccatcgagcgatacgtggtggtgtgcaagccaatgagtaactttaggttcggtgagaaccacgccatcatgggcgtggccttcacgtgggtgatggcccttgcatgtgccgccccacccctggcgggttggagtcgttatatccccgaaggcctgcagtgctcatgtggaatcgactactacactctcaagccagaagtgaacaatgaatctttcgtgatttatatgtttgtagtacatttcacaattcccatgattatcatcttcttttgctatggtcagctcgtctttacagtgaaggaggccgccgcacagcagcaagagagtgcgacaacccagaaagccgagaaggaagtcacccggatggtcatcataatggtcatcgcctttctcatctgttgggtgccatacgcaagtgttgccttttatatttttacccaccagggcagtaactttggccctatttttatgaccattcctgccttctttgctaaaagtgctgccatctacaaccctgtgatttatatcatgatgaacaaacagttccgaaattgtatgttgacaacaatctgttgtggcaaaaaccccctcggagatgatgaagcctcagcaacagtctcaaaaactgaaacctctcaggtggctccagcc

SEQ ID NO: 18605 - DNA, 1044 bp, Artificial Sequence
  Description of Artificial Sequence: Synthetic coding sequence
atgaatgggaccgaaggccccaatttctatgtgccgttttcaaatgcaaccggggtggtgcgctcaccctttgaatatcctcagtattacttggcagagccttggcagttctccatgctcgcggcttatatgtttctactaatcgtgctggggtttcctataaactttctcactctgtacgtaaccgtgcagcacaaaaagctgagaacccctcttaattatatcctgctaaatctcgccgttgctgatctattcatggtgctgggaggctttactagtaccttgtacaccagcttgcacggctatttcgtatttggcccaactgggtgcaatcttgagggattctttgccaccctcgggggtgaaattgccctgtggtccctggtggtgctcgccattgaacggtacgtcgtggtctgtaaacccatgtccaatttccgattcggcgaaaaccacgctattatgggcgtggccttcacatgggtgatggcactagcttgcgctgcccccccgctggccggttggtctagatacattcccgaagggctgcaatgttcctgtggaatagactactacacactcaaacccgaagtgaacaatgagtccttcgtcatctacatgtttgtcgtccacttcacaattcccatgatcattattttcttttgctacgggcaactggtctttactgtgaaagaggccgctgctcagcaacaggaatccgctaccacccaaaaagctgagaaggaggtcacaagaatggtgattataatggtgatcgcattcttaatctgctgggtcccctatgcttctgttgcattctatattttcacacaccaggggtccaactttggacccatctttatgacaattcctgcctttttcgccaagagtgcagcaatttacaaccctgtaatctacataatgatgaacaagcagtttaggaactgcatgttaaccactatttgctgcggaaagaacccccttggcgatgacgaggcctcggccaccgtgtccaaaaccgagacctcccaagtcgcccccgcc

SEQ ID NO: 18606 - DNA, 1044 bp, Artificial Sequence
  Description of Artificial Sequence: Synthetic coding sequence
atgaatggaacagagggcccgaatttttatgttcccttcagtaatgccacaggcgtggttaggtccccatttgagtacccacagtactatctggctgagccctggcaattttcaatgctggccgcatatatgttcctgctgatcgtgttgggctttcccattaacttcttgaccctgtatgtgaccgtgcagcataagaagctgcgtactcccctaaattacatcctgctgaacctggctgtggccgatctctttatggttctaggcggatttaccagcactctgtatacttctctgcatggctacttcgttttcggccctacaggatgcaacctggaaggttttttcgccactctgggcggcgagatagctctgtggtctctcgtggtcctggcaattgaacggtatgttgttgtgtgtaaaccaatgagtaattttcgattcggcgaaaaccacgctatcatgggggtagcttttacctgggtgatggccctggcttgtgccgctcccccactagcaggatggtctaggtacattccagagggcctacagtgctcctgcggcatcgactactataccctgaagcccgaggtgaacaatgagagtttcgtgatctatatgtttgttgtgcacttcaccattcccatgataattatattcttctgctatggacagctggtctttactgtgaaagaagctgctgctcagcagcaggaatccgctacaactcaaaaggccgagaaagaagtgacccgcatggtgataatcatggtgatagccttcctcatatgttgggtcccctacgctagtgttgccttttacattttcacccaccagggaagcaactttggtcctattttcatgaccattcccgcttttttcgccaagagcgccgcaatttataatcccgtgatctacatcatgatgaataagcagttcaggaactgtatgctcacaaccatctgttgcgggaaaaatcctctgggtgacgatgaagcatctgctaccgtgagtaaaacagaaactagccaggtggctcctgcc

SEQ ID NO: 18607 - DNA, 1044 bp, Artificial Sequence
  Description of Artificial Sequence: Synthetic coding sequence
atgaacggaactgagggcccgaatttctacgtgccattctccaatgccacgggagtcgtgcgctcgcccttcgagtaccctcagtactacttggccgaaccttggcaattctcgatgctggctgcgtacatgttcctgctcattgtcctcggtttcccgatcaattttctgaccctctacgtgaccgtgcaacataagaagctgcggacccctctgaactacatcctgctgaacctcgcggtcgcagatctcttcatggtcctcggaggatttacttcaaccctttataccagcctgcacggctacttcgtgttcggtccgacgggctgtaacctggaaggattttttgccaccctgggcggcgagatcgcactttggtcccttgtggtgctggccatcgagcggtacgtggtcgtgtgcaagccgatgtcgaatttcagatttggagaaaaccacgccatcatgggagttgcattcacctgggtcatggcgctggcttgcgcagctccaccattggctgggtggtcccgctacatccctgagggcctccagtgctcatgcggtatagactactacactttgaagcccgaagtgaacaacgagtcattcgtcatctacatgttcgtggtgcacttcaccatcccaatgatcatcatcttcttctgctacgggcagctggttttcactgtgaaagaagcggccgcacaacagcaggaatcggccactactcagaaggccgaaaaggaagtcactcgaatggtgatcattatggtgatcgccttcctgatctgctgggtgccgtacgcctcggtagcgttctacatttttactcatcaggggagcaactttggacccatcttcatgaccattccggcgttctttgccaaatctgcggcaatctataatccggtgatctacattatgatgaacaaacagtttaggaattgtatgctcactacgatctgttgcggaaagaacccactgggagacgatgaggcctccgctaccgtgagcaagaccgaaactagccaagtcgctccggcc

SEQ ID NO: 18608 - DNA, 1044 bp, Artificial Sequence
  Description of Artificial Sequence: Synthetic coding sequence
atgaatggcaccgagggacccaatttttatgtaccctttagcaacgctaccggggtagtgaggagccctttcgagtatccacagtattatctggccgagccatggcagttctcaatgctggctgcctacatgttcctgcttattgtgctgggattcccaatcaattttctcaccctgtacgtgacagtacaacataaaaagctccgcaccccccttaattacatattgttaaacctcgctgtggccgatctattcatggttctgggtggattcacctcaacattgtatacttccctgcacggctactttgtctttggacccactggatgtaacttggaaggattcttcgctaccctgggtggcgaaattgcactttggagcttagttgtgctggcgatagaacggtacgttgtggtttgtaagcctatgagtaattttagattcggcgaaaaccacgcgatcatgggagtagcgttcacctgggttatggccctggcctgcgcggctccccccctggcaggatggtcccggtatatacccgagggactccaatgctcttgtggcatcgattattacaccctgaaaccagaggtgaacaacgagtccttcgttatttatatgttcgtggtgcactttaccataccaatgattatcatatttttctgctatgggcagcttgttttcaccgttaaagaggccgccgcgcagcagcaggagtccgccacaacccagaaggctgagaaggaggtgacgagaatggtcattatcatggtgattgcattcctgatttgctgggttccctacgcatccgtcgcattctatatattcacccatcaaggatctaattttggacccattttcatgaccatacccgcatttttcgcaaaaagcgcggctatttacaacccagtaatctatattatgatgaataagcaattcagaaactgcatgcttactacaatttgctgcggaaaaaatccgctgggcgacgatgaagcaagcgcaaccgtgtctaaaactgagacttcacaggtggcgccagca

SEQ ID NO: 18609 - DNA, 1044 bp, Artificial Sequence
  Description of Artificial Sequence: Synthetic coding sequence
atgaacggaactgaaggccctaacttttacgttcctttttccaacgcaaccggagtggttcggtcaccttttgaatatccccagtactacctcgcggagccttggcaattcagcatgcttgcggcatacatgttcctgttgatagtgctcggcttcccgattaactttcttactttgtacgtgaccgtgcagcataagaaactgcggaccccacttaactacattctgcttaatcttgcagttgcagatctgttcatggtcctcggaggattcaccagcactctctacacgtccctccatggttactttgtgtttgggccaaccggatgcaatcttgaaggattctttgccaccttgggaggagaaattgcactttggagccttgtggtgctggccatcgaacggtacgtcgtggtctgtaaacctatgagcaactttagatttggggaaaatcatgccattatgggtgtggcctttacttgggtgatggcactggcatgtgcagcccctccgctcgctgggtggagcagatacattcctgaaggactgcaatgttcctgcggtatcgactactacacccttaagccggaagtgaataacgagtcctttgtgatatacatgttcgtggtccattttactatccctatgataatcatcttcttttgctacgggcaactggtctttactgtgaaggaagccgccgcacagcagcaggagtcagcaactactcagaaggcagaaaaagaagtgacccggatggtgatcattatggtcattgcattccttatatgttgggtgccatacgcctcagtggccttctacatattcacgcatcaaggatcaaactttggtcctatcttcatgactatccccgcgtttttcgcgaagtcggcggccatatacaacccagtcatttacattatgatgaataagcagttcagaaactgtatgcttaccacgatctgctgtgggaaaaatccactgggagatgatgaggcttccgccactgtgagcaagactgaaacgtctcaagtcgcacccgca

SEQ ID NO: 18610 - DNA, 1044 bp, Artificial Sequence
  Description of Artificial Sequence: Synthetic coding sequence
atgaacggtacagaaggcccaaacttctatgtacctttctccaatgccaccggtgtagtaagatctccgtttgagtaccctcagtattaccttgccgaaccatggcaattctcaatgctggctgcgtatatgttccttcttatcgtcttggggtttcctatcaatttcttgaccttatatgttacagtccaacacaaaaaattacgtaccccgttaaactacattcttttgaatctggcagtggcggacctattcatggtcctcggaggttttacctcaacgttatatacctcacttcatggctattttgtctttggcccaactggatgcaatcttgaaggatttttcgcgacgctaggcggtgaaatagccttgtggtcgttagtagtcctggcaatcgagcggtatgttgtagtatgtaaacctatgtccaacttcaggtttggagagaatcatgcgattatgggtgtggcatttacgtgggtaatggccctggcatgcgccgccccgccactggccggttggagtagatacattcctgaaggcctgcagtgtagctgtggtattgactattacactctgaaacctgaagtcaacaacgaatcatttgtaatttatatgtttgtggttcattttactatcccaatgattattatttttttttgctatggtcaattggtgtttacggtgaaagaagcagctgcgcagcagcaggaatcagcaaccacgcaaaaagccgaaaaggaagttacccgcatggtaatcattatggttattgcttttttgatttgttgggtaccatatgcctctgtcgcattttatatctttactcatcagggatccaattttggtccgatttttatgacgattcctgcattctttgcaaagtcagctgccatatataacccagtaatatacattatgatgaacaaacagtttaggaattgtatgctgacgacgatatgctgtggtaaaaatccgctgggggatgatgaggcgtcggctacagttagtaaaactgaaactagccaagtggcacccgcc

SEQ ID NO: 18611 - DNA, 1044 bp, Artificial Sequence
  Description of Artificial Sequence: Synthetic coding sequence
atgaacggcaccgaaggccccaacttctatgtacccttctcaaacgcaactggggttgtgcgaagccccttcgagtacccccagtactacctggccgaaccatggcagtttagcatgcttgcggcctatatgtttttgcttatagtgctcgggttccccattaatttcctgacactgtatgtgaccgtgcagcacaaaaaactgaggactcccttgaactatattctcctgaacctggctgtggctgatctctttatggtgctggggggatttactagtaccctctacacgtctttgcacggctacttcgtgttcggtcccaccggatgcaacctcgagggattctttgccactctgggtggagaaatagccctctggagcctggttgtgttggctatcgaaagatacgtcgtagtatgcaaaccaatgtcaaactttaggttcggcgagaaccatgcaattatgggagtagcttttacatgggtaatggccctcgcttgtgccgcgcccccccttgcgggctggagtaggtatatccctgaggggctgcaatgcagctgcggtatcgactattatacactcaaaccagaggtcaacaacgagtctttcgtcatctatatgtttgtcgtccacttcaccatccccatgatcataattttcttctgctacggccagctcgtttttaccgtgaaggaagcggcagcccagcagcaggagagcgcaacaacccagaaggcagagaaagaggttaccagaatggtgatcatcatggtcatcgcattcctgatctgttgggtcccctacgccagcgttgcattttatatttttacccatcaaggcagcaactttggtcccatttttatgactatccctgctttctttgccaaatcagccgcaatctataatcccgtgatctacattatgatgaacaaacaatttcgcaactgcatgttgacaacgatctgttgtggtaagaaccctcttggcgacgacgaagcttctgcaacagtcagcaagactgaaactagccaggtggcacctgcg

SEQ ID NO: 18612 - DNA, 1044 bp, Artificial Sequence
  Description of Artificial Sequence: Synthetic coding sequence
atgaacggcaccgaggggcccaatttctacgtgcctttcagcaacgctaccggagtcgtgagatccccattcgaatacccccaatactatctggcggagccgtggcagttcagcatgttggccgcctacatgtttcttcttatagtactcggttttccaataaacttcctgaccctctacgtgacggtccaacataagaaactgcgtactccattgaactacatcttgctcaacctggctgtggcggatctcttcatggtgctcggaggatttacttcgaccctctacacttcgcttcacggttactttgtctttggtccgactgggtgcaatctggagggcttctttgccactctgggcggtgagatcgcactgtggtcactcgtcgtgctggcaatcgaacgctacgtcgttgtgtgcaagccgatgtcaaatttccgcttcggggaaaatcacgccatcatgggagtggcgtttacctgggtgatggcgttggcttgcgcggccccgccgctcgcaggttggtcacggtacatcccggaaggactccagtgttcgtgcggaatcgactactacactctcaaaccagaggtcaacaacgagagcttcgtgatctacatgttcgtagtgcatttcactatcccaatgatcatcatctttttctgctacggacagctggtgttcaccgttaaggaagcagcagcccaacaacaggaaagcgccactacccagaaagccgaaaaggaggtgacccggatggttatcatcatggtgattgccttcctgatctgctgggtgccctacgcctcggtggcattctacattttcacccaccagggcagtaatttcggacctatctttatgacgatccctgcctttttcgcgaagtccgcggcaatctataacccggttatctacatcatgatgaataagcagtttcgtaactgtatgctgactaccatttgctgtggaaagaatccgctgggggatgacgaagcctccgctactgtcagcaagacggaaacgtcacaggtggcgccggcc

SEQ ID NO: 18613 - DNA, 1044 bp, Artificial Sequence
  Description of Artificial Sequence: Synthetic coding sequence
atgaacgggacggaaggacctaacttctacgtcccattcagcaacgcaactggggtggtccgcagccctttcgagtatccgcagtactacctggccgaaccatggcaattctcaatgctcgcggcctatatgtttttgctgatcgtgctgggcttcccaatcaatttcctgaccctctacgtcactgtgcaacataagaagctcagaacgcctctcaactatatcttgctcaacctggctgtggctgacctgtttatggtgcttggtggattcacttccaccttgtacacctcgctgcacggctattttgtgttcggcccgactggatgcaatttggaaggatttttcgcgaccctgggcggagaaatagcgctctggtccctggtggtcttggccattgaaagatacgtggtggtgtgcaagccaatgagcaacttccggttcggggagaatcacgctattatgggcgtggcgttcacctgggtgatggcacttgcgtgcgctgccccgccgcttgccggctggtcgcggtacattcctgaaggactgcagtgctcctgcggaattgattactacaccctcaagcctgaggtcaacaacgagtcgttcgtgatctacatgtttgtggtccattttacgatcccgatgatcatcatcttcttctgctacggacagctggtgttcaccgtcaaggaagccgcggcccagcagcaggaatccgctaccacccagaaggctgagaaagaagtcactcggatggtgattatcatggtgatcgccttccttatctgctgggtcccatacgcctccgtggcattctatatcttcacccatcagggaagcaacttcggaccaatcttcatgactattccggctttcttcgcaaagagcgccgcaatctacaatccggtgatttacatcatgatgaataagcaattcaggaattgcatgctgaccaccatctgctgcggaaagaacccgttgggagatgacgaagcctccgcaactgtttcgaaaactgaaaccagccaggtcgccccagca

SEQ ID NO: 18614 - DNA, 1044 bp, Artificial Sequence
  Description of Artificial Sequence: Synthetic coding sequence
atgaatgggactgaaggacctaacttttacgtgccgttttcaaatgcaactggagtggtgcgctcgccctttgaatacccccagtactaccttgcggaaccttggcagtttagcatgctcgccgcatacatgtttcttcttatagtgcttggttttcccattaacttcctgacgctttacgtgaccgtccagcacaagaaactcagaaccccgctgaactatatcctcctgaacctggccgtcgcagatctgtttatggtgcttggtggctttacctccactctgtacacctcccttcatggttactttgtctttggaccaactggatgcaatctggagggcttttttgctacccttggtggagaaattgcactttggtcactggtggtcctggccattgaacggtacgtggtggtgtgtaagccaatgtcgaatttcagatttggagagaaccacgcgataatgggagtggcgttcacctgggtcatggcgcttgcatgtgccgcaccccctctggccggttggtcacgatacatcccagaaggcctgcaatgtagctgtggcatcgactactacacccttaagccagaagtgaataatgaatcatttgtgatttacatgtttgtggtgcactttactatccctatgattatcattttcttttgttacggccagctggtgtttactgtgaaagaagcagcagctcaacaacaagagtccgcaactacgcaaaaggcagaaaaagaagtgactcggatggtcattatcatggtgattgcatttctcatttgctgggtgccatacgcatccgtggcattttacatctttacccatcaaggctcaaatttcggtcctatctttatgacgatccccgcgtttttcgcaaagtccgcagccatatacaaccctgtcatttacatcatgatgaataagcagttcagaaattgcatgcttactacgatctgttgcgggaagaatcctttgggagatgatgaggcctctgctaccgtgtcaaaaacggaaacgtcgcaagtggcacctgcc

SEQ ID NO: 18615 - DNA, 1044 bp, Artificial Sequence
  Description of Artificial Sequence: Synthetic coding sequence
atgaacgggactgaggggccgaatttctatgtcccgttctctaacgctacaggagtagtccggagccctttcgagtaccctcagtactatctggcagagccatggcaattcagcatgcttgctgcttatatgttcttactcatagtgcttggatttcctattaacttccttactctgtacgtgaccgtccagcacaagaaactaagaacccctttgaactacatattgttaaacctagcagtagctgaccttttcatggtgctgggcggcttcaccagcaccctctacacctccttgcatgggtacttcgtgtttggccctacaggctgtaatttggaagggttcttcgcaactctgggcggcgaaattgcactgtggagtctagtcgtgctggccattgagaggtacgtcgtggtgtgcaaacccatgagcaacttccggttcggcgaaaaccacgcaataatgggcgtagcttttacttgggtgatggctctggcctgtgcggctccccccctggctgggtggtcaaggtacattcccgagggactgcagtgtagctgtggaatagactactatactctgaaacctgaagtgaataacgagagctttgtgatttacatgtttgtagtccacttcacgattcccatgataattatctttttttgctatggccagctggtcttcacggtgaaagaggctgcggctcagcaacaagagagcgccactacacagaaagccgaaaaagaagtgacaagaatggtcatcatcatggtgattgccttcctgatttgttgggtgccatatgcctccgtggccttctacatttttactcatcaaggctccaacttcggtcctatttttatgactatccccgcttttttcgccaaatccgccgccatctacaaccctgtgatttatatcatgatgaataaacaatttagaaattgtatgctgaccacgatttgctgcgggaaaaaccccctgggagatgatgaagcaagcgccacagtgagcaaaactgagaccagtcaggttgcccctgcc

SEQ ID NO: 18616 - DNA, 1044 bp, Artificial Sequence
  Description of Artificial Sequence: Synthetic coding sequence
atgaatgggaccgaagggccaaatttctatgtgcctttttccaacgcaactggtgtcgtccggtcgccattcgaatacccccaatactaccttgcagaaccctggcaattttcaatgctggctgcctacatgttcctgctgatcgtcctcggttttccgatcaattttctgactttgtacgtaactgtgcaacataagaaactcagaactccacttaactatatactccttaatcttgcagtggcggatctgtttatggtactgggtggatttacctcaaccctttacacctcccttcacggctactttgtgttcgggcctacgggatgtaacctcgaggggtttttcgcgacccttggaggagagatagctctctggtcactcgtggtgttggcaatcgaacgctacgtggtggtgtgtaagcctatgtcgaactttcgatttggcgagaatcatgcgattatgggagtggcatttacgtgggtgatggcgctcgcatgcgccgcaccaccattggccggatggtccagatacattccagagggcttgcagtgttcgtgcggaattgattactataccctcaagcctgaggtcaacaacgaatcgtttgtcatttacatgtttgtcgtgcacttcaccatcccgatgattatcattttcttctgttacggacagcttgtattcactgtgaaagaagcagctgcccagcagcaagagagcgcaaccacgcagaaagcagaaaaggaagtgaccaggatggtgataatcatggtgatcgccttcctgatctgttgggtcccctacgcttcagttgccttttacattttcacccatcaaggtagcaattttggccctatctttatgactattcctgcgttctttgctaagtccgcggcaatttacaacccagtgatttacatcatgatgaacaagcagttccgcaactgtatgctgactaccatttgctgcgggaagaaccccctgggagatgacgaagcaagcgcaacggtgtctaagacggaaacttcccaagtggcacctgcg

SEQ ID NO: 18617 - DNA, 1044 bp, Artificial Sequence
  Description of Artificial Sequence: Synthetic coding sequence
atgaatggaaccgagggtcccaatttctatgtcccattttctaacgcgacaggggttgtgagatctcccttcgagtatccacagtattacttggctgagccctggcagttctccatgcttgctgcttatatgttcctcctgatagttcttggctttccaatcaatttcttgaccctctacgtgaccgtgcagcataagaagctccgcactccattgaattatatcctgctgaatctcgccgtggccgatctgtttatggtgctgggagggtttaccagtacactttacacctccctccacggctatttcgttttcggcccaaccggatgcaacctcgaagggttttttgctacacttgggggagaaattgccctctggagccttgtagtgctcgccatagagcgatatgttgtagtgtgcaagcccatgtccaacttccgatttggcgagaaccacgccatcatgggggttgctttcacgtgggtgatggctcttgcttgcgctgctccaccgctggccggctggagcagatatattcctgagggcctccagtgctcttgcgggatcgattactacactctgaagcccgaggtgaataacgaaagttttgtgatttacatgttcgttgttcattttaccatccccatgatcattatctttttttgttatggtcaactggtgttcacagtcaaagaggctgctgcgcagcagcaggagtccgccacaacgcaaaaggcagagaaggaagtgactaggatggtgatcatcatggtgattgctttcctgatttgctgggtcccatatgccagcgtcgcattctacattttcacacaccagggctccaacttcggacccatcttcatgactatccccgccttcttcgctaaaagcgcagccatttacaaccccgtgatatatatcatgatgaataagcagttccgcaactgtatgctcacaactatatgctgtggcaaaaaccctctcggggatgatgaagctagtgcaacggtgagtaaaaccgagacgagccaagtggctcccgcc

SEQ ID NO: 18618 - DNA, 1044 bp, Artificial Sequence
  Description of Artificial Sequence: Synthetic coding sequence
atgaacggaactgaaggtccgaatttttacgttcctttctctaacgccaccggggtggtccgtagccccttcgaatatccgcagtattaccttgcggagccatggcaattctctatgctcgccgcttatatgtttctgctcatcgttctgggtttcccgatcaacttcctgacactgtacgtgactgttcaacataaaaagctgcggaccccgctgaattatattctgttgaacttggccgttgcggacctgttcatggttcttggtggctttacaagcaccttgtacacttctctgcacggctatttcgtgttcggtccaactgggtgtaacctagaaggttttttcgctactctgggaggtgagattgcactgtggagcctggtggtcctggcgatcgaacgctatgttgtggtgtgtaaacccatgagcaactttcgatttggagaaaatcacgcgattatgggcgtggcatttacctgggtgatggctttggcctgtgcagctccgcctctggctggctggtcgaggtatatccctgagggcctgcaatgctcctgcggaattgactactacactctgaaacctgaggtgaacaacgagagcttcgtgatctatatgttcgtcgttcacttcaccattccaatgattatcatctttttctgttacggtcagctggtcttcaccgttaaggaagccgctgcgcagcagcaggagagcgccacgacgcaaaaagccgagaaagaggtgacacgcatggtcatcatcatggtgatcgcttttctcatctgttgggttccttacgcgagcgttgcattctatattttcacccaccagggtagcaattttggtccgatattcatgaccattccagcgttcttcgcgaagtccgctgccatttacaatccggtcatttacatcatgatgaataagcagtttcgcaattgcatgctaaccactatttgctgtggtaaaaatccactgggcgatgacgaagctagcgcgaccgtgtctaaaacggagactagccaggtggctccggct

SEQ ID NO: 18619 - DNA, 1044 bp, Artificial Sequence; identical to SEQ ID NO: 18560
  Description of Artificial Sequence: Synthetic coding sequence

SEQ ID NO: 18620 - DNA, 1254 bp, Artificial Sequence
  Description of Artificial Sequence: Synthetic coding sequence
atgcctagttcagtatcctggggaatcctgctcctggccgggctgtgttgtctggtgcctgttagtctggctgaagacccccagggggatgctgctcagaagacggacacatcccaccacgaccaagatcatcccacgttcaataagataactcccaacctggcggaattcgcatttagtctctataggcagctggcgcaccagagcaatagtacaaatatttttttctcaccggtgagtatcgccaccgccttcgcgatgttaagcctgggaaccaaggccgacacccatgatgaaattttagaaggattgaattttaacctcaccgaaattcctgaggctcaaattcacgaaggattccaggagttgcttcggaccctgaatcagccggattcgcaactgcaacttaccacaggtaatggtcttttcttaagtgagggcctgaaactagtggataaatttctggaagacgtgaagaagctgtaccactcagaggcttttacagtgaatttcggcgacacggaggaggccaaaaaacagattaacgactatgtggagaaggggacccagggaaagattgtggacttggtgaaggagctcgaccgggacacagtcttcgcattggttaattatattttctttaagggtaagtgggagaggccctttgaggtgaaagataccgaagaagaggacttccacgtagaccaggtgaccacggtgaaggtgcctatgatgaaaaggttagggatgtttaacatccagcattgcaagaagttgtcaagctgggtcttgctgatgaagtatctcggaaatgctactgccatattcttcttacctgacgaaggcaaactgcaacacctcgagaatgaactgactcacgatatcattacaaaatttcttgaaaacgaggatcggaggtcagccagcctgcatctaccgaagttatctatcaccggtacgtatgacctcaagtctgtgttgggccagctcggaattactaaggttttttccaacggcgctgacctctccggcgtgacagaggaggcaccactaaagttgtccaaagcggtgcataaggctgtcctcactatcgacgaaaaaggcacggaagcagctggagctatgtttctcgaagctattcctatgagtattccacccgaggtgaagtttaacaaaccttttgtgttcttaatgattgagcagaataccaagtcccccttgttcatgggcaaggtggtaaacccgacacagaaa

SEQ ID NO: 18621 - DNA, 1254 bp, Artificial Sequence
  Description of Artificial Sequence: Synthetic coding sequence
atgccctcgtcggtgtcctggggtatattgcttctcgctggtctttgttgtctggtgccagtgtcgcttgccgaggacccacaaggagatgcagcacaaaagaccgatactagccatcatgatcaagaccatcctactttcaataagattactcctaatcttgcagaatttgcctttagcctgtacagacaacttgcgcatcagtccaactcgaccaacattttcttctctcccgtgtcgattgcaactgcgttcgcaatgctgtcgctcggtaccaaggctgatacgcatgacgaaatcctcgaaggccttaacttcaacctcaccgaaatcccagaagcgcagattcacgaaggatttcaggagctccttcgcacgcttaatcaacctgattcacagctccagctcacgaccggaaatggtctgtttctgtcagaaggactcaaactggtcgacaagtttcttgaggacgtcaaaaagctctaccacagcgaagcgttcaccgtcaacttcggagacaccgaagaggcaaagaagcagattaacgattacgtggaaaagggaactcaagggaaaattgtggaccttgtcaaggagctggaccgtgatactgtgtttgcgctggtgaattacatattctttaagggtaagtgggagcgaccgtttgaggtgaaagataccgaagaagaggactttcatgtggatcaagttaccacggttaaggttccaatgatgaagcgcttgggtatgttcaatattcagcactgcaagaaactgtcgagctgggtgctgcttatgaagtacctggggaacgcaaccgccattttctttctgcctgacgaggggaaacttcaacacctggagaacgaacttacccatgatatcataaccaaatttctggaaaacgaagataggcgctcggcatccctgcatcttcctaaactctcgatcaccggaacttatgatctgaagtccgtcctggggcagcttggcattaccaaggtgtttagcaacggagccgatctttcgggcgtcactgaagaagccccgctcaagttgtccaaggcagtacacaaggccgtgttgactattgacgaaaaagggaccgaagccgcaggcgcgatgttcctcgaggcaatccccatgtccattcctcctgaagtaaagttcaataagcctttcgtctttcttatgatcgaacagaacaccaaatcaccactgttcatgggaaaggtcgtcaacccaactcagaag

SEQ ID NO: 18622 - DNA, 1254 bp, Artificial Sequence
  Description of Artificial Sequence: Synthetic coding sequence
atgcccagctccgtgagttgggggatcctgctgctggcagggctgtgctgtctggtgcccgtttctctggcggaagatccgcagggtgacgccgctcagaagacggacacaagtcaccatgatcaggatcaccctaccttcaacaaaatcacacctaacctcgcagagtttgcctttagcctctatcggcagttggcgcatcagagcaatagtactaacatctttttttccccggtttctattgcgacagcgttcgccatgctgtccctcggtaccaaggctgatacgcacgatgaaatcttggaaggtctgaattttaacttgactgagatcccagaggctcaaattcatgagggttttcaggagttgctccgcactttgaaccagcccgacagccaattgcaattgaccactggcaatggtttgtttctgtctgagggtttgaagcttgtggataagttcctggaagacgtgaaaaagttgtaccattctgaggctttcacagtgaattttggggacactgaggaagcaaagaagcagatcaacgattatgtcgagaaaggaactcaggggaagattgttgatttggtgaaagagctggatcgggacactgtcttcgctctggtaaactatatcttcttcaaaggcaagtgggagagaccgtttgaagtgaaggatactgaggaggaggactttcacgtggaccaggtgacaaccgtgaaagtgcccatgatgaaaaggctgggcatgttcaacattcagcactgtaagaaactgagctcatgggtcctgcttatgaagtacttgggtaacgcaactgcgatattcttccttcccgatgagggaaaactgcagcacctcgagaacgaactgactcacgacattattaccaaattcctggaaaacgaggacagacggtccgctagcctccatttgcccaaactctctataacaggtacctacgaccttaaatctgttctcggacagctggggattacaaaggtgttttctaatggcgctgatttgtctggggtgacagaagaggcgcccttgaaactgtccaaagcagtgcacaaggctgtgctgacaattgacgaaaaaggcaccgaggccgccggagctatgttcctggaggccatccccatgtccatccctccagaagtgaaatttaataaaccctttgtcttccttatgatcgaacagaacactaaatcccctttgttcatgggcaaggtcgtgaatccgactcagaag

SEQ ID NO: 18623 - DNA, 1254 bp, Artificial Sequence
  Description of Artificial Sequence: Synthetic coding sequence
atgccgagctctgtgagctggggaattcttctgctggcaggactgtgttgcctggtgccggtgagcctggccgaagatccgcagggggatgccgctcagaaaactgatacttcgcatcacgaccaggaccatcccaccttcaacaagatcacccctaacctggccgagtttgccttctccctgtaccggcaactcgcccaccagagcaactccaccaacatctttttctctcctgtctccattgcgactgcttttgccatgctgtccctggggactaaggccgatacccatgacgagatccttgagggactgaacttcaacctcaccgaaatcccagaagcacagatccacgagggctttcaggagttgttgcgcactctgaatcaaccagacagtcaactgcagcttactaccggaaacgggctgttcttgtccgagggcttgaaactggtcgacaaatttctggaagatgtgaaaaagctgtaccactccgaagcgttcaccgtcaacttcggcgacaccgaggaggcgaagaagcaaatcaacgattacgtggagaaaggaacccaaggtaagattgtcgacttggtgaaagaactcgatcgggacaccgtgttcgcgctggtgaactacatctttttcaaaggaaagtgggaacgcccattcgaagtgaaggacactgaagaggaggactttcatgttgaccaggtcaccactgtgaaggtgcctatgatgaagcgcctggggatgttcaatattcagcactgcaaaaagctgtcgagctgggtcctgctcatgaagtacttgggaaatgctaccgccatctttttcctgccggatgaaggaaagctccaacatctggagaacgaattgactcacgacatcattaccaagttcctcgagaacgaggacaggagaagcgcgagcctgcacctcccgaagctcagcatcacgggcacttacgatctcaagagcgtgctcggtcaacttggaatcactaaggttttctcgaatggcgcagacctgtcaggcgtcacggaagaagcgccgctcaagctctccaaggccgtgcataaggctgtgctcaccattgatgagaaaggaacggaagccgcgggagctatgttcctggaagcaatcccaatgtcaatcccaccagaggtcaagttcaataaacctttcgtgttccttatgatcgaacaaaataccaaatcgcctctgttcatgggaaaggtggtgaaccccacccaaaag

SEQ ID NO: 18624 - DNA, 1254 bp, Artificial Sequence
  Description of Artificial Sequence: Synthetic coding sequence
atgccttcatcagtgtcctggggcattctcctcctcgcggggttgtgttgtctggtgccagtctccctcgcagaggatccacaaggtgacgctgcacaaaagaccgatacctcccatcatgatcaagatcatccaacgttcaataagattacccctaacttggccgaatttgcctttagcctgtacagacaacttgcacaccagagcaactcgactaacattttcttttcccccgtcagcatagctactgccttcgcaatgctttcactgggcaccaaggcagatactcatgacgaaattcttgaggggctcaacttcaatctcacggagatccctgaagcacagatccatgaaggtttccaagagctgttgagaaccctgaaccagcccgatagccaattgcaacttacgactggcaacggactgttcctttcggaggggttgaaacttgtcgacaaatttctggaggacgtcaaaaaactctatcattccgaagcctttaccgtcaattttggcgataccgaggaagcaaagaaacaaatcaacgattacgtggaaaaggggacccagggaaagattgtcgacctggtgaaggagctggatagggacactgtctttgcactggtgaactacattttcttcaaggggaagtgggagcgtccgttcgaagtcaaagatactgaagaagaggactttcacgtcgatcaagtcactacggtgaaggtgccaatgatgaagcgacttggtatgttcaatattcagcattgcaaaaaactcagtagctgggtgctcctcatgaagtacctgggtaatgcaaccgcaatcttctttctgccagacgaaggaaagctccagcacctggagaacgaacttactcatgacattatcaccaagtttcttgaaaatgaggaccggcggagcgcctcgctccacctgcctaagttgagcatcaccggaacctacgacctgaaaagcgtccttggacagctcggaattactaaagtcttttccaacggtgcagacctttcgggtgtcaccgaagaagcaccactgaagctctcaaaggccgtccataaggccgtgctgaccatcgatgaaaagggaactgaagcagcaggtgcaatgtttcttgaggctatccctatgtcaattccccccgaagtgaagtttaacaagccttttgtgttcctgatgattgagcaaaatactaagtcgcccctctttatgggtaaggtcgtgaacccaacccaaaag

SEQ ID NO: 18625 - DNA, 1254 bp, Artificial Sequence
  Description of Artificial Sequence: Synthetic coding sequence
atgccctccagcgtgagctggggcatcttgcttcttgcgggactttgctgtctggtgcccgtgtccttggctgaggacccgcaaggagacgccgcccaaaaaaccgacacctcgcaccacgaccaggatcacccaacttttaacaagattacccctaatcttgcagaattcgcgtttagcctgtaccgccaactcgcccaccaatctaactcgactaatatcttcttctcacccgtttctatcgccacggctttcgcaatgctgtctctgggaactaaggctgatactcatgacgagatcttggagggactcaacttcaacctcaccgagatcccagaagcccaaatacatgaaggattccaggagctgctgcgcactctgaaccagccggacagccagctgcaactgactacgggcaatggtctgtttctcagcgaaggactcaagctcgtggataagttcttggaagatgtcaagaaactgtaccactccgaggcattcactgtgaattttggggacactgaagaggcgaagaaacagataaatgattacgttgagaagggaacccagggtaaaatcgttgatctggtcaaggaactggaccgcgatacggtctttgcgctcgtcaactatatctttttcaaagggaagtgggagaggcctttcgaggtgaaggacaccgaagaagaggacttccacgtcgaccaggtgactactgtgaaggtgccgatgatgaagcgcctgggcatgttcaatatccaacattgcaaaaaactctcctcctgggtgttgttgatgaagtacctgggcaacgccaccgctatcttcttcctcccggatgagggaaagctgcagcatctggaaaatgagcttacgcatgatatcatcaccaagttccttgagaacgaggacagacgcagcgcctcgctccacctgccaaagctctcaatcaccggcacctacgatctgaaaagcgtgcttggacagctgggcattactaaggtgttttccaacggagctgatttgtcgggtgtcactgaagaagctcctctgaagctctcaaaggcagtgcacaaggccgtcctcaccatcgacgagaaggggaccgaagccgccggtgcaatgtttctggaggccatcccaatgtcgattcctccggaagtgaagttcaataagccgttcgtgttcctgatgatcgaacaaaacacgaaatcaccgctctttatgggaaaagtcgtcaacccgacccagaag

SEQ ID NO: 18626 - DNA, 1254 bp, Artificial Sequence
  Description of Artificial Sequence: Synthetic coding sequence
atgcctagtagcgtctcctggggaattctcctcctggcaggcctgtgctgcttggtccccgtgagtctagctgaggatccccagggagatgcggctcagaagaccgacacaagccaccacgaccaggatcaccccacttttaacaagatcacacctaatcttgctgaatttgcgttctccctctatcgtcagctcgcccaccagagtaattcaaccaatatttttttcagccccgtatcaattgctacggccttcgcaatgctgtccctgggcacaaaggcagacactcacgatgaaatcctcgagggactgaacttcaatttgaccgagatccctgaggctcagattcatgagggctttcaggaacttctgcgcactctcaaccaacccgactcccagctccaactcacaaccggaaatggcctgtttctgtccgaagggctcaaactcgtggacaaattcttagaggatgtgaaaaagttgtatcactccgaagcttttacagtgaattttggtgacaccgaagaagccaagaaacagataaatgattatgttgagaagggcacgcaggggaaaattgtcgacttggtgaaggagctggacagagacacagttttcgcacttgtgaattacattttctttaagggaaagtgggagagacctttcgaggtgaaagatacagaggaggaggactttcacgtggatcaagtgacaaccgttaaagtgcccatgatgaagagactggggatgttcaatattcagcattgcaagaaactgtcttcatgggtgttactcatgaagtatctgggaaatgccactgccattttctttctcccagacgagggaaagttacagcacctggagaatgaattgacacatgatatcatcacaaaatttctggagaacgaggacagacgaagtgctagtctgcacttgccaaagctttccattactggcacctacgacctgaaatccgtactggggcagctgggcatcactaaggtgtttagcaacggagccgacctgtctggtgtgaccgaggaggcccccttgaagttgtcaaaggccgtccataaagccgtgttgaccatagatgaaaaaggtacagaggcggcgggcgcgatgttcctggaggctatacccatgtccatcccaccggaggtcaaattcaataagcctttcgtgttcctgatgatagaacagaatactaagagtccgctgtttatgggtaaggtggtgaatccaacccagaaa

SEQ ID NO: 18627 - DNA, 1254 bp, Artificial Sequence
  Description of Artificial Sequence: Synthetic coding sequence
atgccgagctcggtgtcctgggggatcctcctcctggctggactttgttgcttggttcctgtgtccctcgccgaagatccacagggcgacgctgcccaaaagacggacacgtcgcatcatgaccaggaccaccccaccttcaacaagattacccctaatttggcggaattcgccttctctctttaccgacagctggcccaccagagcaactcgactaacattttcttcagccccgtctcgatcgccactgcattcgcaatgctgtcactggggactaaggctgatacccatgacgagatactcgagggcctcaacttcaatctgaccgagatccctgaggcccagatccacgaagggtttcaagaactgctcaggactctcaatcagcccgactcgcaactgcaattgactacgggaaacggactttttctgtccgaaggactgaagctggtcgataagtttttggaggacgtgaaaaaactgtaccatagtgaagccttcacggtgaacttcggagataccgaggaagccaagaaacagatcaatgactacgtagagaagggaactcagggcaaaatcgtggacctggtaaaggaactggacagagatactgttttcgccctggtcaactacatcttcttcaaaggtaaatgggaaagaccatttgaagtgaaggacactgaagaggaagattttcacgtcgatcaggtgaccaccgtaaaggtgcccatgatgaagcgcctcggtatgttcaatatccaacactgcaagaagctctcctcctgggtgttgctgatgaagtatctcggcaatgcgactgccattttctttctcccggatgaaggaaaactccaacacctggaaaacgaacttacccacgatatcatcaccaaatttctggagaatgaggacagacggtcggccagcctgcatcttccaaaactgtcgattaccggaacctacgatcttaagtcagttctgggtcagctgggcatcactaaggtgttctcaaacggcgcggacctgagcggggtcaccgaggaggccccgctgaagctgtcaaaggccgtgcataaggcggtgttgacgatcgacgaaaagggaaccgaagcggcgggcgcaatgtttctggaggctatcccaatgtcgattccgccggaagtgaagttcaacaagccgttcgtgtttctcatgatcgagcaaaacactaaaagtccgctgttcatgggaaaggtcgtgaacccgactcagaaa

SEQ ID NO: 18628 - DNA, 1254 bp, Artificial Sequence
  Description of Artificial Sequence: Synthetic coding sequence
atgccttcgtccgtgtcatgggggatactgctgctggcggggctgtgctgcctggtgccggtgtctctggctgaggatccacagggagacgcagcccaaaagactgacacttctcaccatgaccaggaccatccaactttcaacaaaatcactcctaaccttgcagaatttgcattctccctgtacaggcagctcgcgcatcaatcgaattcaaccaacatcttcttcagccccgtttccatcgcaaccgccttcgccatgctgtcgctggggaccaaagccgacacccacgacgagatcctcgaaggactgaatttcaatcttacggaaatccctgaagcccagatccatgaggggtttcaagagttgttgcggacgcttaaccagccggatagccagttgcagcttacgaccggcaatggactgttcctttccgaagggctcaagctggtggacaaattcttggaggatgtgaaaaaactgtaccactcagaggcgttcacggtgaactttggagataccgaagaggctaaaaagcagatcaatgattatgtcgaaaagggcacccaaggaaagatcgtggatcttgtgaaggagttggacagagacactgtctttgctctggtcaactacatctttttcaagggaaagtgggaacgccctttcgaggttaaggatactgaagaagaggacttccacgtagaccaagtgaccactgtgaaggtgccaatgatgaagcggctcggaatgttcaacatccaacattgtaagaaactgtccagctgggtgctgctcatgaagtacctgggcaacgccaccgcaatcttcttcctgccagacgaaggaaagctgcagcacctggagaatgagctcacccatgacatcattactaaattcttggaaaacgaggacagacgcagcgcgagtttgcacctgccaaagctctcgatcactggcacgtacgacctcaagtccgtgctggggcagctgggtattactaaggtcttttcgaacggagccgatctctcaggggtcactgaagaggcccctcttaaactgagtaaggcggttcacaaggccgtgctcaccattgatgaaaagggtaccgaggcggctggcgcgatgtttctggaagctatcccgatgtccattccgccagaagtcaaattcaacaagcccttcgtgttcctcatgattgaacagaacaccaagtccccgctgtttatgggaaaagtagtgaaccccacccaaaag

SEQ ID NO: 18629 - DNA, 1254 bp, Artificial Sequence
  Description of Artificial Sequence: Synthetic coding sequence
atgccgtcgagcgttagttggggcattttactgctcgctggcttatgttgccttgtgccggtctctctggcggaggatcctcagggcgatgccgcgcagaaaaccgatacttcacaccacgaccaagatcacccaacgttcaacaaaatcactcccaatcttgcggagtttgccttctctctgtacaggcagctggctcatcagagtaatagtacaaatatctttttttcaccagtaagtatagcgacagccttcgcaatgctaagcctcgggaccaaagctgacacgcacgacgagatactagaaggcttaaactttaacttaacagagattcccgaagcccagattcacgaaggcttccaagaactgctgaggaccctgaaccagccggattcccagttacagctgactacaggtaatggcctttttctttcggaggggctgaaactcgttgataagttcttggaagacgtcaaaaaactctaccattcggaagccttcactgttaactttggcgatactgaagaggccaagaagcagattaatgactatgtggagaaggggacccaggggaagatcgtggacctggtgaaagagctggatcgggatacagtgtttgccctggttaactacatctttttcaagggaaagtgggaaagaccctttgaggtaaaagataccgaagaggaggattttcatgtggatcaggttaccactgtaaaggtccccatgatgaaacgcctgggcatgtttaacatccagcactgcaaaaaactgtcatcttgggtgctccttatgaagtatctgggcaacgcgactgcgattttcttcctgcctgatgaagggaagctgcagcatctggagaacgaattaacccacgatatcataactaaatttctggagaacgaagaccgcagatctgcgtccctgcatctgcctaagctctcaatcactgggacctatgaccttaagagcgtgttggggcaactaggcattaccaaagttttctctaacggcgcagatctctccggcgtgaccgaagaggcgcctctgaagctgtctaaggccgtacataaagctgtgctgactattgacgaaaagggcacggaggcggctggggccatgttcctggaagccattccaatgagcattccgccggaggtgaagttcaacaagccgttcgtgttcctgatgattgagcagaacaccaagagccctctgttcatgggcaaagtcgtgaatcctacccagaaa

SEQ ID NO: 18630 - DNA, 1254 bp, Artificial Sequence
  Description of Artificial Sequence: Synthetic coding sequence
atgccatcatccgtatcttggggaatcctgcttctggcagggctgtgctgtctggttccagtgtccctggctgaagatccccaaggggatgcggcccagaagactgatacctcccatcatgatcaggaccacccaacttttaataagattactcctaatttagctgagttcgcctttagcctctacagacaattagcccatcagtccaacagcacaaacatcttcttctctccagtcagcatcgccaccgccttcgctatgctctctttgggtacaaaagcagacacccacgacgaaatcctcgaaggcctgaactttaaccttaccgaaatacctgaggcccagattcacgaaggtttccaggagttactcagaaccctgaatcagcccgactcccagctgcagctgaccacggggaatggtctgtttttgtcagaaggcctgaaactcgtggacaagttcctagaggatgtgaaaaagctgtatcactccgaggcttttacggtgaattttggggatacagaagaagccaagaagcagatcaacgactatgtggagaaggggacacaaggaaagatcgtcgacctggtgaaagagttggacagagataccgtgttcgcacttgttaactatattttttttaaaggcaagtgggagcgtccctttgaggtgaaagacaccgaggaggaggacttccacgtggatcaagtcacaaccgtcaaagtgcccatgatgaagagacttggcatgtttaacattcagcattgcaagaaattgtcctcctgggttttactgatgaaatacctgggtaatgctaccgcaattttctttctcccggatgagggaaaattacaacatttggaaaacgagctgacccatgacatcatcaccaagttcctagagaacgaggatcgccgctcggctagtttacacttgccgaaactttccatcacaggcacctacgacctaaagagtgtcctaggacagctagggatcactaaggtgttcagcaatggagccgatctatctggcgtgacagaagaagccccactgaagctgagcaaagcagtgcacaaagcagtgctgactatcgatgagaagggcacagaagccgcaggggccatgttcttggaagctattcctatgtccatccctcctgaagtgaagttcaacaaaccatttgtgttcctaatgatcgagcagaatactaaatcacctctattcatggggaaggtggttaaccctactcagaaa

SEQ ID NO: 18631 - DNA, 1254 bp, Artificial Sequence
  Description of Artificial Sequence: Synthetic coding sequence
atgccgtcgtccgtgtcgtggggcatccttctcctggctggactgtgttgtctggtgccggtgtccttggcagaagatccgcagggagatgcagcccaaaagactgacacttcgcatcacgaccaggatcacccaaccttcaataagatcaccccgaacctggccgagtttgctttctccctctacagacaactggctcatcaatccaactccaccaacattttcttctcccccgtctccattgccaccgctttcgccatgttgtcactgggtactaaggcagacactcatgacgaaatcctggagggactcaacttcaatctgaccgagattccggaggcgcagatccatgaaggattccaggagctgctccgaacgctcaaccaaccagactcgcagcttcagctcactaccggaaatggactgttcctctccgaaggattgaagctggtggacaagtttctggaggacgtgaagaaactgtaccactcggaggcctttaccgttaactttggagatactgaggaagccaagaaacagatcaacgactatgtagagaagggaactcagggaaaaatcgtggatctcgtcaaagagctggaccgcgacaccgtgtttgcgttggtcaattacatattcttcaagggaaagtgggagcgcccttttgaggtaaaagacaccgaagaggaggacttccacgtcgaccaggtgacgaccgtgaaggtcccgatgatgaagcggctgggcatgttcaacatccagcactgcaagaaactgtcatcttgggtcttgttgatgaagtacctcggtaatgcgaccgccattttcttccttccggatgaggggaaactgcaacacctggaaaacgaactcacgcatgatatcatcaccaaattcctcgaaaatgaagatcggcgctcggcgtcccttcacctcccaaaactttcgatcaccggaacgtacgatctgaagtccgtcctgggacaactgggaatcaccaaggttttttccaacggggcagacttgtcgggggtcactgaagaagcgccgctcaaactcagcaaagcagtgcataaggcagtgctgacgatcgacgaaaaagggaccgaggccgccggggcaatgtttctggaggctatcccgatgtcaatcccacccgaagtgaagttcaacaagccttttgtgttcctgatgattgaacagaataccaagtcgcctctcttcatgggtaaggtggtgaacccaacccaaaaa

SEQ ID NO: 18632 - DNA, 1254 bp, Artificial Sequence
  Description of Artificial Sequence: Synthetic coding sequence
atgccgagctcagtctcctggggcatcctgctgctggccgggctctgctgtctggtgcctgtgtccctggcagaggacccgcagggggatgcagcccaaaagaccgatacgtcacaccatgatcaggaccatcctaccttcaacaaaatcaccccgaatctggccgaattcgcattcagcctgtaccggcagctcgcccaccaatccaactcgaccaacatcttcttcagcccagtttcgatcgctaccgcgttcgccatgttgtctctgggcaccaaggcagatacccatgacgagatactcgagggcctgaatttcaatttgaccgaaatacccgaagcacagattcacgaggggttccaagagctccttcgcaccctgaaccagcctgacagccaactccagctcacgaccgggaacggtctgttcctgtcagaaggactgaaattggtggataagttcctggaggacgtgaagaagctgtaccatagcgaagcattcactgtcaacttcggagacaccgaagaagccaaaaagcaaatcaacgattacgtggaaaagggcactcagggcaagatcgtggatctcgtgaaagaactggatagagacaccgtctttgctctggtgaactacatcttctttaaaggtaaatgggagcggccttttgaggtcaaggataccgaggaagaagatttccatgtcgatcaggtgacgactgtgaaggtcccaatgatgaagcgcctgggaatgttcaatatccaacactgcaagaagctgtcgtcgtgggtgctgctgatgaagtacctgggtaacgccactgccatctttttcctgccggacgagggcaagctgcagcatcttgaaaacgagttgacccacgacattatcacgaagttcttggagaacgaggaccgcagatcagccagcctgcacctgccgaagctgagcatcaccggaacctacgatctcaagtcggtgctgggacagttgggaattaccaaggtgttctcaaatggagcggacctctcgggtgtgactgaggaggctcccctcaagctcagcaaggccgtgcacaaagccgtgcttactatcgacgaaaaaggaacggaagcggcaggagccatgttcctggaagccatcccaatgagcatcccgcctgaagtgaagttcaacaaacctttcgtgtttctgatgatcgagcaaaataccaagtcacccctgttcatgggcaaggtggtgaatccaacccagaaa

SEQ ID NO: 18633 - DNA, 1254 bp, Artificial Sequence
  Description of Artificial Sequence: Synthetic coding sequence
atgccttcctctgtaagttggggcattttactgttggccggcctgtgttgcctcgtccctgtttccttggccgaagatccacaaggtgatgcggcgcagaaaacagatacgtcccaccatgaccaagatcaccccaccttcaacaagattacccccaatctggccgagttcgcattttccttgtaccgtcagttggcccaccagtcaaattcaaccaatattttcttctcaccggtgtcaatagctacggcattcgcgatgctttctctaggcaccaaggcagatacacacgacgagatacttgaggggttaaacttcaacctgaccgagatccctgaagcacaaatccacgagggttttcaagaactgctcagaacactgaaccaacccgactcacaattgcagctgaccacaggcaatggtctgttcctgtctgagggacttaaactcgttgacaagtttcttgaagacgtaaagaagctctaccactccgaagccttcacagtgaactttggtgatacggaggaagctaagaaacagatcaatgattacgttgagaagggtacccagggcaagattgtggatctggtgaaggaactcgatagggacactgtctttgcactggtcaactatatcttttttaaagggaaatgggaacgtccctttgaggtgaaagacacagaggaagaagactttcatgtggatcaggtgaccacggttaaggtccctatgatgaagaggttgggcatgttcaacattcagcattgcaagaagctgtcatcctgggtgctactgatgaagtacctcggtaatgccacagccatattttttttgccagacgaaggcaaacttcaacatctggagaacgaactgacccatgatatcattaccaaatttctcgaaaacgaggatcgcaggtctgcctctctgcatctgccaaagctctctattacaggcacatatgacttgaagagcgtgctggggcagctcggcatcacaaaagtgttcagcaacggggcagacctgtccggggtgaccgaggaagcccccttaaaactcagtaaggccgtacacaaggcagtcttaacaatcgatgagaaaggaactgaggccgcgggagccatgtttctggaggccatcccaatgtccattcctcccgaggtaaagttcaataagcctttcgtgtttctgatgatcgaacagaataccaagtcccctttgtttatgggcaaggttgtgaatccaacccagaaa

SEQ ID NO: 18634 - DNA, 1254 bp, Artificial Sequence
  Description of Artificial Sequence: Synthetic coding sequence
atgcccagttctgtcagctggggtattctgcttctcgcaggtctttgctgtctcgtgcctgtgagcctggcagaggatccccagggcgatgcagcacaaaaaaccgataccagccatcatgatcaggaccatcccacttttaacaagattacccctaacctcgctgaattcgctttttccttgtaccgacaactggcccaccaatcgaactcgacgaacattttcttttcccccgtgagcatcgcgacggcgtttgcaatgctttcgcttggcactaaggcggatacccacgatgagatcctggaggggcttaactttaacctcaccgaaataccagaggcacagatccatgaaggatttcaagaactgctccgaactcttaaccagccggattcgcaacttcaactgactaccggcaacgggttgtttttgagcgaggggctgaagctggtcgataagttccttgaagatgtcaaaaaactttaccattcggaagccttcaccgtgaactttggagatactgaggaagcaaagaagcagattaatgactacgtggaaaagggtacccagggaaagattgtggacctggtcaaggaactggatcgcgacaccgttttcgcacttgtgaattacattttctttaaagggaagtgggagaggccattcgaggtcaaggacaccgaggaggaggacttccatgtggatcaggtcaccactgtcaaagtgccgatgatgaagagactcggaatgtttaacatccaacattgtaagaaactgtcgtcttgggtgcttcttatgaagtaccttggaaacgcaacggctatctttttcctgcctgatgaagggaaacttcaacatctggagaacgagcttactcacgacattatcactaaattcctggaaaacgaggatagacgttccgcatcgctccatctgcctaaactttcaattaccggaacttacgatctgaaatcggtcctcggacaacttggaattactaaagtgttttccaacggagcagatctttccggcgtgactgaagaagcgccactgaagctgagcaaggccgtgcacaaagctgtcctgactatcgatgaaaagggcaccgaggcggcaggtgcaatgttccttgaggctattccaatgtccattcctccagaggtcaagttcaataagccctttgtgttcctgatgatagaacaaaacacgaaatcgcccctgtttatggggaaggtggtgaaccccacccaaaag

SEQ ID NO: 18635 - DNA, 1254 bp, Artificial Sequence
  Description of Artificial Sequence: Synthetic coding sequence
atgccatctagcgtgagctggggaatcttactcctcgcaggactgtgttgtctggtgcccgtgtcactggcagaagatccgcagggtgacgccgcacagaagaccgatacctctcatcacgatcaggaccaccccaccttcaataaaattacccccaatctcgccgagttcgccttcagtttatacagacagctagcccatcagtcgaattcaaccaacatttttttttcgcccgtcagtatcgccactgcctttgccatgttgagtctggggaccaaggccgacacccacgacgaaattctcgaaggccttaactttaacctaacagaaatccccgaagcccagatacatgaggggttccaagagctgttaaggactttaaaccagcccgattcccagttgcagttgacaactggcaatgggctgttcctgtccgagggactaaagcttgttgacaagttcctggaggatgtcaagaagctgtatcactccgaagccttcaccgttaattttggtgatacagaagaggctaaaaaacagatcaatgactatgttgagaagggaacacaaggtaaaatagtagacctggtcaaagagctcgatcgcgacacagtgtttgcactggtgaattacatcttcttcaagggtaaatgggagcgtcctttcgaagtgaaagatactgaggaggaggacttccacgtggaccaggttactactgttaaggttccaatgatgaagaggctgggaatgttcaacattcaacactgtaagaagctctcttcttgggtgttgttgatgaagtacttgggcaacgccactgccattttctttctgccagatgagggtaagctccaacacctggagaacgagttaacccatgacattataacaaaattcttggaaaacgaggatcggaggagcgcttccctgcacctgccgaagctgagcattaccggcacttacgatctgaagtctgtgctgggccagttgggcataactaaagttttcagcaatggagccgacctcagcggcgtcaccgaggaggctccgcttaagctttcgaaggctgttcacaaggcagttctgaccattgacgaaaaggggaccgaggcagccggcgccatgttcttagaggcaattcccatgagcatccctcccgaagtgaaattcaataaacccttcgtgttcctgatgatagagcagaatactaaatccccactctttatgggaaaagtggttaatcccacccagaaa

SEQ ID NO: 18636 - DNA, 1254 bp, Artificial Sequence
  Description of Artificial Sequence: Synthetic coding sequence
atgcctagctccgtctcctggggaattcttctgcttgccggcttgtgttgtctggttccggtgagcctggccgaagatccgcaaggcgatgcagcgcaaaagaccgacaccagccatcacgatcaagaccatcctactttcaacaagataacccctaacctggcggaatttgccttctccctctaccggcaacttgcacatcaatcgaacagcaccaacatctttttctcccctgtgtccatcgccaccgcgtttgccatgctgtcgcttggtactaaggccgatacccatgatgaaatcctcgaaggacttaactttaatctgactgagattccagaagcacagatccatgaaggttttcaagagctcctgcgaacgttgaaccagcctgattcccaacttcaacttaccaccggtaacggcctctttcttagcgaaggccttaagttggtggataagttccttgaggacgtcaaaaaactttatcacagcgaagcctttactgtgaattttggtgacaccgaggaagcaaagaagcaaatcaatgattacgtggaaaaaggtacccaaggaaaaatcgtcgatcttgtgaaagagctggacagagatactgtgtttgcactggtcaactacatcttctttaaaggtaaatgggagaggccttttgaagtgaaggacactgaagaggaggattttcacgtggatcaagtgaccactgtgaaggtgcctatgatgaagagactcgggatgttcaatattcaacactgcaagaagctctcatcgtgggtgctgctgatgaagtaccttgggaatgccactgccatcttttttctgccagatgaaggcaaacttcagcatcttgagaacgaacttacccatgacattatcaccaagttccttgaaaatgaagataggcgttcggcatcactccatcttccaaagctctcaatcactggaacctacgatctgaagagcgtcctgggacaacttggaattaccaaagtgttctcgaacggcgcagatctctccggggtcaccgaagaagcgcctctgaaacttagcaaggcagtgcataaagcagtgctgactattgacgagaaaggcaccgaggcagcaggggcaatgtttctggaggctatcccgatgtccataccaccagaagtgaagttcaataaaccgttcgtctttctgatgattgaacaaaataccaagtcgcctctcttcatgggaaaggtggtgaatcccactcaaaag

SEQ ID NO: 18637 - DNA, 1254 bp, Artificial Sequence
  Description of Artificial Sequence: Synthetic coding sequence
atgcccagcagcgtgagttggggcatcctcctgctagccggcctttgctgtcttgttcctgtgagcctggcggaggaccctcagggggacgctgcccagaagacggacaccagccaccacgatcaggatcatcctacattcaataaaatcaccccaaacctggctgaatttgcgttttccctttatagacagctcgcacatcaatctaacagcaccaacatctttttctcccctgtgagcatcgctacagcgttcgccatgctgagtttaggcaccaaggccgacacccatgacgagatcctagagggcctaaatttcaacctgacagagatccccgaagcacagatacatgagggtttccaggagctccttagaacgctcaaccagcccgattcccaactgcaattgacgacgggcaatggcctgtttctcagcgaggggctaaagctggttgacaaatttctggaagatgtgaaaaagctttatcatagcgaggccttcaccgtgaattttggtgacacagaggaggctaagaaacaaataaacgattacgtagaaaagggaactcagggcaaaatcgtggatctggtaaaagagctcgacagggataccgtgttcgcgctagtgaattatatcttcttcaaaggtaagtgggaaagaccatttgaagttaaggatacagaggaggaagatttccatgtcgatcaggtgactaccgtgaaggtgcccatgatgaagaggcttgggatgtttaacatacagcattgtaaaaagttaagtagctgggtcctgctgatgaaatatctcggaaatgccacagctatcttctttctacctgacgaagggaaattgcagcatctcgagaacgagttaacgcacgacattataactaaattccttgaaaatgaagataggcggagtgcttctctccatttgcccaagctctccatcacaggtacttacgacttgaagtcagtgctcggacagctgggtatcaccaaggttttttcgaatggcgccgatctaagcggcgtgacggaggaggcgcccttaaaactcagcaaggccgtgcataaagccgtactgaccatcgatgagaaaggaactgaggccgcgggtgctatgttcttggaagccatccctatgtccataccaccagaagtgaagttcaataaaccttttgtgttcctgatgattgaacagaacacgaagtctcccttattcatggggaaggttgttaatccaacacagaaa

SEQ ID NO: 18638 - DNA, 1254 bp, Artificial Sequence
  Description of Artificial Sequence: Synthetic coding sequence
atgccctcgagcgtgtcatggggaatcctgctgcttgcaggactttgttgtctggtgccagtgtcgctggcggaggacccacaaggggacgcagcacagaaaaccgatacttcccatcatgatcaggatcatcctactttcaacaagattaccccgaacctggcagaatttgcattcagcctgtaccgtcagttggcacatcagtcaaacagcactaatatcttcttttccccagtgtccattgcaaccgcatttgcgatgctgagcctgggcactaaagctgacactcatgacgagattcttgaaggccttaactttaacctgacggaaattccagaagcgcaaatccatgaaggttttcaagagctgctgaggaccctgaaccaacccgattcccagcttcaactgaccaccgggaacggactctttctgagcgaggggttgaaactggtggacaagtttcttgaggatgtgaagaaactctaccacagcgaagcatttacggtcaacttcggagatactgaggaagcgaagaagcagattaacgactacgtcgaaaaaggaactcagggcaagattgtggatctcgttaaggagttggatagagacaccgtctttgcactggtgaactacatcttctttaagggtaagtgggaacggccttttgaggtcaaagacaccgaagaagaggacttccacgtcgatcaagtcactactgttaaggtgcccatgatgaagaggcttggcatgtttaacattcaacactgtaagaagctctcctcgtgggtcctcctcatgaagtacctcggaaacgcaaccgcaatctttttcctgcctgatgaagggaaacttcagcatctggagaacgaacttacccatgacatcattaccaagtttctggaaaacgaggatagacggtccgcctctctgcacctgcctaaactttcgatcaccggaacctacgatttgaaatctgtcttgggccaacttggaatcactaaagtgttctccaatggtgctgacctctcgggagtgaccgaggaagcccctctcaaacttagcaaagcagtccacaaggctgtgctgactattgatgagaaggggacggaggccgcaggggccatgttcctcgaagcaatcccaatgtccatcccaccagaagtcaagtttaacaagccattcgtgtttctgatgattgagcagaacactaagtcccctctgtttatgggaaaagtcgtcaacccaacccaaaag

SEQ ID NO: 18639 - DNA, 1254 bp, Artificial Sequence
  Description of Artificial Sequence: Synthetic coding sequence
atgccatctagtgtttcttggggaattttattgttagcaggactttgttgtttggttccagttagtttagcagaagacccacaaggagatgcagcacaaaaaacggacacttcacatcatgatcaagatcatccaacttttaacaaaattacgccaaatttagcagaatttgcattcagtttatatagacaacttgcacatcaaagtaattcaacaaatattttctttagtccagtatcaatagcaactgcatttgcaatgttatcattgggaacgaaagctgatacacatgatgaaattcttgaaggattaaattttaatttaacagaaattccagaagcacaaattcatgaaggttttcaagagcttttaagaacacttaatcaaccagattcacaattacaacttacaactggaaatggattattcttatctgaaggacttaagttagtcgataaattcttagaagatgttaaaaagttatatcatagtgaggctttcactgtaaattttggtgatactgaagaagctaaaaaacaaattaacgattatgttgaaaaaggaacacaaggaaaaattgttgatcttgtaaaagaactagatagagatactgtttttgcattagttaactatattttcttcaagggaaaatgggaaagaccttttgaagttaaagacacagaagaagaagactttcatgttgatcaagtaactacagtaaaagttccaatgatgaaacgacttgggatgtttaatatacaacattgcaagaaattatcaagttgggttttacttatgaaatatttaggaaatgcaacagctattttcttccttccagatgaaggtaaattacaacatttggagaatgagcttactcatgatattatcactaaattccttgaaaatgaagatagaagatcagcatcattacatcttccaaaactttctatcacaggaacatatgatcttaagtctgtcttaggacaacttggaataactaaggttttctcaaatggagctgatttaagcggagttacagaagaagctccattaaagctatctaaagcagttcataaagctgttctaactattgacgaaaagggaactgaggctgctggagctatgtttttagaagcaattccaatgtcaattcctccagaagttaagtttaataaaccattcgtttttctaatgattgaacaaaatactaaatcacctttatttatgggaaaagttgttaatccaacacaaaaa

SEQ ID NO: 18640 - DNA, 1254 bp, Artificial Sequence
  Description of Artificial Sequence: Synthetic coding sequence
atgcccagtagcgtatcatggggaattttgcttttagcaggcctgtgctgtctggttcccgtcagcctggccgaagatccgcagggcgatgccgcacagaagacagatacatctcaccatgaccaagatcaccccacctttaataagattaccccaaatctggccgaatttgctttttcattgtataggcagttggcacatcagtctaattccacaaacatctttttttctcctgtgagcatcgccaccgcgtttgcaatgctaagcctcgggaccaaagccgacacccatgatgagatcttggagggcctgaatttcaatctaactgaaatcccagaggcccagatccacgagggcttccaagaactactccggacactaaaccagcccgacagccagctgcagctgactacagggaacggcctgttcttatccgaaggactgaagctggtcgacaaattcttggaggatgtaaaaaagctgtaccatagcgaagcattcaccgttaatttcggagataccgaggaagccaagaagcagatcaacgattatgtggaaaaaggcacacaggggaaaattgtggacttggtgaaagagctggacagggacacggtattcgcactcgtaaattacatcttctttaaaggaaagtgggaaaggcccttcgaagtgaaagacaccgaggaggaggatttccatgtggatcaggtcacgacagtcaaggttcccatgatgaagcgcctcggcatgttcaatattcagcactgcaagaaattaagctcctgggtgctcctgatgaagtatctggggaacgccacagccatattcttcctgccagacgaggggaagctgcagcacctagagaatgagttgacccacgacatcatcaccaaatttcttgagaacgaagaccgcagatcagcatctctgcatctccctaagctgtccattaccggtacttacgacttgaagagtgtactgggacagctgggtattacgaaggtctttagcaacggggccgatctctcaggagtgaccgaggaagctcccctgaagctctcaaaggccgtgcataaagcggtgttgacaatcgacgagaaggggaccgaagcagccggcgccatgtttctcgaggcaattcctatgagcatcccacccgaggtaaaatttaacaaaccatttgtcttcttgatgattgagcagaacaccaaaagcccgttgtttatgggaaaggttgtcaatccgactcagaaa

SEQ ID NO: 18641 - DNA, 1254 bp, Artificial Sequence
  Description of Artificial Sequence: Synthetic coding sequence
atgccgagcagcgtgtcctggggcatccttttgcttgcaggattatgttgtttggtgcccgtgagcctggctgaagacccacaaggggacgcggctcaaaagaccgatacaagccatcacgaccaggaccacccaacctttaataagattactccaaacctggcagagtttgccttctcactgtaccgccaactcgcacaccagtccaatagtacgaacattttcttttctcccgtgtccattgctaccgcattcgctatgctcagtctcgggaccaaggcggacacacatgacgaaatcctggaaggcctgaactttaacttgaccgaaatcccggaggcccaaatccacgagggattccaagaactgctgcgaaccttgaaccagcccgactcgcagctgcagcttaccaccggaaatggcctattcctgtccgagggactcaaactagttgacaagttcctggaggatgtgaagaagctgtatcatagtgaggcatttaccgttaactttggcgataccgaggaagccaagaagcagattaacgactatgtggaaaagggtactcagggaaagatcgtggacctggtgaaagagctggatcgggacactgtgtttgcgctagtgaattatatatttttcaaaggcaaatgggaacgccccttcgaagtaaaggacaccgaggaggaggatttccacgtagaccaggtaaccacagtgaaggtaccaatgatgaagaggctaggcatgttcaacatacagcactgtaagaagttgtcatcctgggtactgcttatgaagtacttggggaacgctaccgccatatttttcctgccagacgagggcaaattgcagcacctggagaacgagttaacccacgatattattacaaagttcctggaaaacgaagatcggcggtcggcctctcttcatcttcccaagctgagcatcacggggacttacgacctcaagtcagtcttgggtcagctgggcattaccaaggttttctccaatggagccgacttgagcggggtgaccgaggaggctccactgaagctctcgaaagccgtgcacaaggcagttttaacgattgatgagaaggggacagaagccgcaggcgccatgtttttggaggctatcccaatgtctattccccccgaggtgaagttcaataaaccattcgtgttcctgatgatcgaacagaacaccaaaagccccttgtttatgggtaaggtcgtaaaccccacacaaaaa

SEQ ID NO: 18642 - DNA, 1254 bp, Artificial Sequence
  Description of Artificial Sequence: Synthetic coding sequence
atgccgtcatcagttagttggggaattcttttgctcgcaggtttgtgctgcctcgtaccagtctcgttggcggaggatcctcaaggagatgcagcacagaaaactgatacctcccaccacgatcaagatcatccaacattcaataaaattaccccgaaccttgcagaattcgcattctctctctaccgacaattagcccatcaatcaaattctactaatatttttttctcaccagtgtccatcgctactgcgttcgcaatgctgtcccttggcacgaaagctgatacgcatgacgagatactcgagggactcaatttcaatctaacagaaatcccagaagctcaaatacatgagggttttcaagagttattaagaactttgaatcagccggatagtcaacttcaactgacgaccggcaatggactttttctgtcagaaggcttgaagttggtggataagttcttggaggatgtgaaaaaactgtatcatagcgaggcttttacggttaattttggagatacagaagaggcaaaaaaacaaattaacgattatgttgaaaaggggacacagggtaagattgtagatcttgtgaaggagctagatcgagacactgtgtttgccctagtaaattacattttttttaaaggaaaatgggaacgtccatttgaggtcaaggacactgaagaagaagacttccacgtcgatcaagtaaccacggtaaaggttccaatgatgaagaggctgggaatgtttaatattcaacactgcaaaaagctttcttcttgggttttgctcatgaaatatctcggaaatgcaacagccatctttttccttccggacgaaggaaaacttcaacacttggaaaatgaactaacacacgatatcattacaaaattcctcgaaaatgaggatcgtcgatctgcttctcttcacctaccaaaactttctattaccggtacttatgatcttaagtcagtattgggtcaactcgggattacaaaagtctttagtaacggagctgacttgtctggcgtgactgaagaggctccgctcaaacttagtaaggccgtccataaagcagttttgaccatagatgaaaaaggaactgaagctgcgggcgcaatgtttcttgaggcgattccaatgagcattcccccagaagtcaagtttaataaaccgtttgttttcctcatgatcgaacaaaatacaaaatcaccattgtttatgggtaaagttgttaatccgacacaaaaa

SEQ ID NO: 18643 - DNA, 1254 bp, Artificial Sequence
  Description of Artificial Sequence: Synthetic coding sequence
atgccctcatcagtcagctggggtattctcctgctggccggactgtgctgcctggtgcccgtgtccctcgcggaggacccgcaaggagacgcggctcaaaagaccgacacttcacaccacgaccaagatcacccaaccttcaacaagattaccccgaatctcgccgaattcgcattttccctgtacagacaacttgcccatcagagcaactcgactaacatcttcttctcgccggtgtccatcgccactgcgttcgccatgctctccctgggaactaaggctgacactcacgacgaaatcctggagggactgaacttcaatctgaccgagatcccagaagcccaaatccatgagggttttcaggagttgttgcgcaccctgaaccagccagacagccagctgcagttgacgaccggcaatggcctgtttctgagcgaaggactgaagctcgtcgataagttcctggaggacgtgaagaagctgtaccacagcgaagccttcacggtgaacttcggcgacacggaagaagcgaaaaagcagatcaacgactacgtggaaaaaggaactcaaggtaaaatcgtcgacctggtgaaggagctggacagagataccgtgtttgcgctggtgaactatatcttcttcaaaggaaaatgggaaaggccattcgaagtcaaggatactgaagaagaggatttccacgtggaccaggtgactaccgtcaaggtgccgatgatgaagcgcctggggatgttcaatatccagcactgtaagaagttgagctcgtgggtgcttctcatgaaatacctcgggaatgctacggcaatcttctttctgccggatgaagggaaactgcagcacctggaaaacgagctcacccatgacatcatcaccaaatttcttgaaaatgaggaccgccgctccgccagtctgcacctgccgaagctgtcgatcaccggcacttatgacctgaaatccgtgttgggacagcttggaatcaccaaagtctttagcaatggtgctgacctgtccggagtgactgaggaggcgccactcaagttgtcaaaggcagtgcataaggccgtgctgacgatcgatgaaaagggcacggaagctgcgggagcaatgttcctggaagcaattcctatgtctatcccgccagaggtcaagtttaacaaacccttcgtgttcctgatgatagaacaaaacacgaaatccccccttttcatggggaaagtggtgaacccgactcaaaaa

SEQ ID NO: 18644 - DNA, 1254 bp, Artificial Sequence
  Description of Artificial Sequence: Synthetic coding sequence
atgccatcgagcgtctcatgggggatcctgctcctcgcgggtctttgctgccttgtgcctgtctcgttggcagaggatccgcaaggagatgcagcccaaaagacggatacctcgcaccacgaccaagaccatccgacgttcaacaagattaccccaaacttggccgagttcgccttctcattgtaccggcagctcgctcaccagtcgaactccaccaacatcttcttctcgccagtcagcatcgccaccgcattcgccatgctcagcttgggtacgaaggcggacactcatgatgagattctggaaggcctgaatttcaacctcaccgaaatcccggaggcccagatccatgaaggcttccaagagctgctgcgtaccctcaatcagcccgactcccaacttcagctcactaccggaaatggactctttctgagcgaaggactgaaactggtggacaagttcttggaggacgtgaagaagttgtaccactcggaggccttcaccgtgaatttcggcgacaccgaggaagcgaaaaaacaaatcaatgactacgtggagaagggaacccagggcaagatcgtcgaccttgtcaaggaactggaccgcgatactgttttcgcacttgtcaactacatcttctttaaagggaagtgggaaaggccatttgaagtgaaggatactgaagaagaagatttccatgtggaccaggtgaccactgtgaaggtgcccatgatgaagcgcctcggcatgttcaacattcagcattgtaaaaagctgagctcgtgggttcttttgatgaagtacctgggtaatgcgaccgccatctttttcctgccagacgagggcaagctgcagcacctcgaaaatgagctcacgcatgacatcatcaccaagtttctggagaacgaggatagacggtcagcaagcctgcacctgccaaagttgtccataacgggaacctacgacctgaaatcggtcctgggtcagctcggaatcaccaaagtcttttctaacggggccgatctgtcgggcgttactgaagaagccccgctgaagctgagcaaggcggtgcacaaagccgtgcttactattgatgagaagggaactgaagctgctggagccatgttcctcgaagcaattcctatgtcgatccctccggaagttaagtttaacaagccgttcgtgttcctgatgatcgaacaaaacactaaatcacctctgtttatgggaaaagtcgtgaatccgacgcagaag

SEQ ID NO: 18645 - DNA, 1254 bp, Artificial Sequence
  Description of Artificial Sequence: Synthetic coding sequence
atgccaagttccgtgtcgtgggggatactgcttctcgccgggctctgctgtctcgttcccgtgtcattggcagaggatcctcagggggatgctgcacagaaaacagatacatcgcatcatgatcaggatcatccaacttttaacaaaattactccaaatctcgcagaatttgcattctctctttatagacagctggcccaccagtccaattctacaaatatattcttctctccagtttccatagcgacagcctttgccatgctctctctaggaactaaagccgatacacatgatgagattctcgagggactgaattttaatctcactgaaattcctgaagcccagatacatgaggggtttcaggagctgctccgtactctgaaccagcccgattctcagctccagctgacaacgggaaatggactcttcctgtcagagggacttaaactggtcgataaattcctggaagatgtgaagaaactataccattccgaggctttcacagtgaattttggagatactgaagaggccaaaaaacagataaacgattacgtggaaaaaggaactcagggaaagatcgtcgatcttgttaaagaactcgacagggatactgtgtttgcccttgtaaactatatattctttaaaggaaaatgggagagaccttttgaagtaaaggatactgaagaagaggacttccatgtcgatcaggtcacaactgtgaaagtgccaatgatgaaaagactcggaatgtttaatattcagcattgtaagaaactctcctcttgggtcctactgatgaaatatttgggaaatgccacagctattttctttcttcctgatgaagggaaactccagcaccttgagaacgaactaacacatgacattataactaaattcctggagaatgaagatcggcggtccgcttccctgcaccttcctaaattgtcgattacaggaacttatgaccttaagtccgtgctcggacagcttgggataactaaagtgttctctaatggagcagacctgtccggggttactgaggaagcccccctaaaactcagtaaagctgtccataaagccgtgctaactatcgacgagaaaggaactgaggccgctggggccatgtttcttgaggccattcctatgagtataccccctgaggttaaattcaacaaaccttttgtgttccttatgatagaacagaacactaaatccccattgtttatggggaaagtagtgaaccccacacagaaa

SEQ ID NO: 18646 - DNA, 1254 bp, Artificial Sequence
  Description of Artificial Sequence: Synthetic coding sequence
atgccttcttctgtctcttggggaatcctcctgcttgctggcctgtgctgtctggttccggtttctcttgctgaagaccctcagggcgacgcagcccagaaaacggatacatcccatcacgatcaggatcaccccacctttaacaaaatcacacccaatctcgcagaattcgcgtttagcctgtatagacagcttgctcaccagtccaattctactaatatcttcttttcccccgtgtccatcgcgacagcgtttgctatgttgtccctgggaacaaaagccgatacacacgatgaaatcctagaaggcctaaatttcaatctcaccgaaattcccgaggcacagatccacgagggttttcaagagctgttgaggacattaaaccagcccgatagtcagctgcagctgaccactgggaacggtctgtttcttagtgaagggctaaagcttgttgataaattcctggaggatgtgaagaagctgtaccacagcgaggccttcaccgtgaactttggcgataccgaggaagccaagaagcagataaacgactacgtggagaaaggtacgcagggaaaaatcgtggacctggttaaggagctggatcgcgataccgtctttgcgcttgtgaactacatctttttcaaagggaaatgggagcggccttttgaagtgaaagacactgaggaggaggactttcatgtggatcaggtgacaacagtcaaagttccaatgatgaagcgcctcggaatgttcaacattcagcactgcaagaagttgtcctcatgggttctgctgatgaaataccttgggaacgccaccgcaattttcttcttgccagatgaggggaagctccagcatctagagaatgagctcacacatgatattatcactaaatttttagagaacgaggaccgaaggtcagcctctcttcatctgcccaagctttcaatcacggggacatacgatctgaagagcgtgctcggacaactgggaatcactaaggtctttagcaacggggcagacctgtccggtgtgacagaagaggcgccattgaaactgtcgaaggcagtgcacaaagcggtgctgaccatcgacgaaaaaggtacagaagccgctggtgccatgtttctcgaggcaatccccatgtcgatacccccagaggtcaagttcaataaaccattcgtgttcctcatgatcgagcagaatacaaagtccccactatttatgggcaaggttgtgaaccctacccagaag

SEQ ID NO: 18647 - DNA, 1254 bp, Artificial Sequence
  Description of Artificial Sequence: Synthetic coding sequence
atgcctagtagcgtctcgtggggcatcctgctgctcgccggactttgttgcctggtgccagtctcgctcgcggaggacccacaaggagatgcagcacaaaaaactgacacgagccaccatgaccaggaccaccctaccttcaacaagatcacgccaaatctggccgagttcgcgttctcactctacaggcagctcgcgcaccagagcaactcaactaacatctttttctctccagtgtccattgccaccgccttcgcgatgttgtccttggggaccaaggcagacacccatgacgaaatcctggaaggccttaatttcaacctcaccgaaatccccgaggctcagatccacgaaggattccaggaactgctgcggaccctgaaccaaccggacagccaactgcagctgactaccggtaacggtctgttcctgtccgagggactgaagctcgtggataaatttttggaggacgtgaagaaactgtaccactccgaggcttttaccgtgaattttggagacacggaagaagccaagaagcaaatcaatgattatgtcgaaaaaggaactcagggaaagattgtggaccttgtcaaggagctggatcgggataccgtgttcgcgctggtgaactacattttctttaagggcaaatgggaaagaccgttcgaagtgaaggataccgaggaagaagatttccatgtggaccaggtgactactgtgaaggtgcccatgatgaagagactggggatgttcaacatccagcactgcaagaagctgtcgtcctgggtgctcctcatgaagtacctgggaaatgcgactgctatcttcttcttgccggacgaaggaaaactgcagcatcttgagaacgaactcacccatgatataatcactaagttcctcgagaatgaggaccgccgctccgcttccctgcacctgccaaagctgagcatcaccggcacctacgatttgaagtcagtcctcgggcaactcggcatcactaaagtgttttcgaacggagcagatctctcgggtgtcaccgaagaagccccgctgaaactctcaaaggcagttcacaaggccgtccttactatcgacgaaaaagggacggaggccgctggagccatgttcctggaggccattccgatgtcgatcccgccggaggtgaagttcaacaaaccgtttgttttcctgatgatcgaacagaacactaagtcgcctttgtttatgggcaaagtcgtgaatcctactcaaaag

SEQ ID NO: 18648 - DNA, 1254 bp, Artificial Sequence
  Description of Artificial Sequence: Synthetic coding sequence
atgccctcctccgtgtcctggggaatccttctgctggccggcctctgttgtcttgtccccgtgtcactggcagaggatccacaaggggatgcggcccagaaaaccgatacttcacatcatgatcaagatcacccaactttcaacaagattaccccaaacctggcagaatttgcattctcgttgtacaggcagcttgcccatcaatcaaattctactaacatcttctttagccccgtgtcgattgccaccgcgttcgccatgctttcgttggggaccaaggccgatacgcatgatgagattttggaagggctcaacttcaatctgactgagattccagaagctcagatccatgaaggttttcaagaactccttcgcacgctcaaccaacctgactcccaacttcagctcacgaccggaaacggccttttcctgtctgagggactcaaacttgtggataagtttctcgaagatgtcaaaaaactgtaccattcggaggcatttactgtgaactttggcgatactgaagaggcgaaaaagcagattaacgattacgtcgaaaagggaactcaaggcaagatagtggatcttgttaaggaactcgacagagacaccgtgtttgccctcgtgaactacatctttttcaagggaaaatgggaaagaccttttgaggtgaaagataccgaagaggaagattttcacgtggatcaagtgacgactgtgaaggtgccaatgatgaagagactcggaatgtttaacattcagcactgcaaaaaactttcatcgtgggtccttcttatgaagtacctcggtaatgccaccgccatcttctttcttccagatgagggaaagctgcaacatctggagaacgaactcacccatgatatcatcactaagttcctcgaaaatgaagatcggcggtcggcctccctccatctgccgaaactttccataactggaacttacgacctgaagtcggttcttggccagctgggcataaccaaggtgttttcgaatggagcagatctctcgggtgtgactgaggaagcaccgcttaagctgagcaaggcagtgcataaggcagtcttgaccatagatgaaaaaggtactgaagcggccggagcaatgttcctggaggcaatccctatgtccatacctcccgaggtgaagttcaacaagccatttgtctttttgatgatcgaacagaatacgaaatcccccctgttcatggggaaagtagtgaatcctacccagaaa

SEQ ID NO: 18649 - DNA, 1254 bp, Artificial Sequence
  Description of Artificial Sequence: Synthetic coding sequence
atgccctcttccgtgagctggggaatcctgctcctagccggcctctgttgtcttgtgcctgtgtctttggctgaagacccgcagggggacgcagcgcaaaagacagacactagccaccacgatcaggaccatcccacctttaacaagataactcccaacttggccgaatttgcattttctctatataggcagctcgctcatcagagcaactccaccaatattttcttttctccggtgtctattgccacggcgttcgcgatgctgagtctcggcaccaaagccgacacccacgacgaaatcctggaaggactgaattttaatctgaccgaaatacccgaggctcagatccacgaaggcttccaagagttgctgagaaccctcaatcagcccgactctcagctgcagttgacaactggcaacggacttttccttagtgaagggctcaaactagtcgacaagtttctggaggacgttaagaagctttatcattccgaggcctttactgtgaatttcggcgatacggaagaggcaaaaaagcagatcaacgattacgtggagaaggggacacaaggcaaaatcgtagacctggtgaaggagcttgatcgcgataccgtgttcgctctggttaattacatattttttaagggtaaatgggaacggccattcgaggtgaaagacacagaggaggaagattttcacgtcgatcaggtcacgaccgtcaaggtaccaatgatgaaaagattgggaatgtttaatatacagcactgcaagaaactgagttcatgggtgctcctgatgaaatacctgggcaatgcaaccgcgatctttttcctgcccgacgagggaaagttgcagcacttggagaacgagctcactcacgacattatcactaaattccttgagaatgaggatcgtcggagcgcatctctgcacctgcccaaactgtccatcactggaacatatgatttgaaaagtgtgttggggcagcttggcatcactaaagtgttctcaaacggcgcagacttgagcggggtgacagaagaagctcccctgaaactatctaaagcagtccataaggccgtgctgactatcgacgaaaaaggaactgaggccgccggcgctatgtttctcgaagctatcccaatgagcattccaccagaagtgaaattcaacaagccattcgtctttctgatgatcgagcagaacacgaaaagcccccttttcatgggtaaggtggtcaatcctacgcagaag

SEQ ID NO: 18650 - DNA, 1254 bp, Artificial Sequence
  Description of Artificial Sequence: Synthetic coding sequence
atgccctcgtcggtgagctggggtatcctccttctggccgggctgtgttgcctggtgccagtcagccttgcagaagatcctcaaggtgatgcagctcaaaaaactgatacgagccatcatgatcaggaccatcctacttttaacaagatcactccaaatctggcagaattcgctttttccctgtacagacaacttgctcatcagtcgaactcgaccaacattttcttttcgcctgtgtcgatagccaccgcctttgcaatgctttcgctgggaaccaaagcagatactcacgacgagatccttgaaggactgaactttaacctgaccgagattccagaagcacagatccatgaaggatttcaagaactcctgagaaccctgaaccaaccagattcacagctccagctcactaccggaaatggattgttccttagcgaaggcctgaagctggtggataagttccttgaagatgtgaagaagttgtaccactcggaggcatttacggtgaattttggtgatacggaggaagcgaaaaagcaaatcaacgactacgtggaaaagggaacccaaggtaaaatcgttgatttggtgaaagaattggacagagacactgtgttcgcacttgtgaactacatctttttcaagggcaaatgggagcgaccgtttgaagtgaaggacaccgaggaggaggattttcatgtggatcaggtcacgactgtgaaggtgcctatgatgaaacggcttggtatgtttaacatccaacattgtaaaaagctgagctcgtgggtgctgctgatgaagtacttgggcaatgccaccgcaatattcttcctgcctgacgagggaaagctgcagcatctcgaaaatgaattgactcatgacatcattactaaattcctggaaaacgaggatcgtaggtccgccagcctccatcttccaaagctctcaatcacgggaacttacgatcttaagagcgtcctcggccagctgggtataactaaggtgttcagcaatggagcagatctctcgggggtgaccgaagaggcaccgctgaaactgtctaaggcagtgcataaggccgtgcttaccattgatgagaagggaaccgaagccgccggagcgatgttcctcgaagccattcctatgagcatccctcctgaagtcaaattcaataagccatttgtgtttctcatgattgaacaaaacaccaagtcgcccctgttcatgggcaaggtggttaaccctacccaaaaa

SEQ ID NO: 18651 - DNA, 1254 bp, Artificial Sequence
  Description of Artificial Sequence: Synthetic coding sequence
atgccctcatctgtgagctggggcatcctgctactggctggcctctgctgtctggttcccgtgtctctcgctgaggacccacagggggacgcagcacagaagacagatacgtcgcaccatgatcaggatcaccctacatttaacaaaatcactcccaacctcgccgagtttgcattttcactttaccggcaactggcccaccagagcaactctaccaacatttttttttctccagtctctatcgctactgctttcgcaatgttgagcctcggtaccaaggccgacacacatgacgagattttggagggcctcaactttaacctaactgagatccccgaggcacagattcacgagggattccaggagctattacggacccttaaccagcctgactcacagctgcaattgacaacgggaaatggactgtttttgtctgagggactgaaattggtcgataaattcctggaggacgtgaagaagctgtatcactctgaggcgtttaccgtgaatttcggcgacacagaagaagcaaagaaacagattaatgattacgtggagaaaggcacgcaaggaaaaattgttgatctcgtaaaagaattggacagagataccgtctttgccctcgtgaattatatcttcttcaaagggaagtgggagcgcccattcgaggttaaggacacggaagaagaggactttcacgtcgaccaggtgaccactgtcaaggtgccgatgatgaaaagactcggaatgtttaacatccagcattgcaaaaagctcagctcatgggtgctgctgatgaaatacctcggaaacgctaccgcgattttcttcctgcctgacgaaggcaaactgcagcaccttgagaatgagctgacccatgacatcataaccaaatttctggagaacgaagatagacgcagtgccagtctgcacctgccgaagctaagtattacggggacttatgacttgaaatccgtgttggggcagctggggattactaaggtgtttagtaatggggccgatctgtcgggagttaccgaggaggcgccgctgaagttgtcaaaagccgttcataaagcagtattgactattgatgaaaagggcacagaagccgccggtgctatgttcctcgaagccatcccaatgtccatccctccagaagttaagtttaacaagccattcgtgtttctgatgatagagcagaataccaaatcccctctcttcatgggtaaggtggtgaacccaacccagaag

SEQ ID NO: 18652 - DNA, 1254 bp, Artificial Sequence
  Description of Artificial Sequence: Synthetic coding sequence
atgccgagtagtgtcagttggggaatcctgctcctcgccggcctgtgctgtctcgtgcctgtgtctctcgcagaagacccacagggcgatgctgcacagaaaaccgacaccagtcatcacgaccaggaccacccgaccttcaacaaaatcacacccaacctggctgaattcgctttctctctgtataggcaactggcgcaccagtcaaattccacgaacatcttcttttcgcccgtgagcatcgccacggctttcgcgatgctttcgctgggtaccaaggccgatacgcatgacgagatcctggaggggctaaacttcaatttaacggaaatcccagaggcccagatacacgaggggtttcaggaactgctcaggaccctcaatcagccagactcacaactgcagttgactacaggaaacgggttgttcctgtcggagggtttgaagctggtcgataagttcctggaggacgttaaaaaactttaccattcagaggctttcacagtgaattttggcgacacggaggaggctaaaaaacagattaacgattacgtggaaaaggggacccaaggcaagattgttgatctcgtgaaggaactggatcgcgacactgttttcgcccttgtcaattacatcttctttaaggggaaatgggaacggccatttgaggtgaaagatactgaggaagaagattttcacgtcgatcaagttaccactgttaaggtacccatgatgaagcggctgggtatgtttaatattcagcattgcaaaaaactctcctcttgggtcctgctgatgaaatatctgggcaatgccaccgctatcttcttcctgcccgacgaagggaaactgcagcaccttgagaatgagctgacccacgacataattaccaaattcctcgagaacgaggaccgcagaagcgctagcctccacttgccgaagctatccatcactggcacatacgacctgaaatccgtattgggacagctgggcatcaccaaggttttctctaacggagctgaccttagcggagtcacagaggaggcacccctcaaactgtcaaaggcagtccacaaagctgtgctaaccatcgacgaaaagggtacagaagcagccggagctatgtttctggaagcaatccccatgagcattccacccgaggtgaagttcaataaaccattcgtctttttgatgattgagcagaacaccaaatctccactatttatgggcaaagttgtaaatcccactcagaag

SEQ ID NO: 18653 - DNA, 1254 bp, Artificial Sequence
  Description of Artificial Sequence: Synthetic coding sequence
atgcctagctctgtgagctggggtattttgctgctggccggcctgtgctgcttggtgccggtgagcttggcggaagatccacagggcgacgctgcacaaaagactgacacttcccatcatgatcaggaccacccgaccttcaacaagatcacgccaaacctcgccgagtttgcgttcagcctctacagacaactggcccaccagtcaaatagcactaacatcttcttctccccggtgtcaatcgcgacggcattcgcgatgctgtccctgggcactaaagctgatacccatgacgaaatcctggaaggcttgaacttcaatctgactgaaatcccagaggcccaaatccacgagggtttccaagaactcctgagaacgctgaaccagccagacagccaactccaactgaccaccggaaacggacttttcctgtcggaaggcctcaaactggtggataagtttctggaggatgtgaagaagctgtaccactcggaagccttcaccgtcaacttcggagacactgaagaggccaagaagcagatcaatgactatgtggagaaggggactcaagggaaaatcgtggacctcgtcaaggaacttgatagagataccgtgttcgccctggtgaactacattttcttcaaaggaaagtgggagcgcccgttcgaggtgaaggataccgaggaggaagatttccatgtggaccaggtcacgacggtgaaggtgccgatgatgaaacgcttgggaatgttcaacattcaacattgcaagaagctctcgagctgggtattgctgatgaaatacctcgggaacgctaccgcaatattcttcctcccggacgagggaaaactgcaacacctcgaaaacgaattgactcatgatatcatcactaagttcctggaaaatgaggacagaaggtccgcgtcccttcatctgccaaagttgtcgatcactggcacttacgacctgaaatccgtcctcggacagctgggaatcactaaggtgttctccaacggggcggacctttcaggtgtcaccgaagaagcccctctcaaacttagcaaagccgtgcacaaggccgtgctgaccattgacgagaaaggaactgaagccgcgggagcgatgttcctggaggccatccctatgtccatccccccggaagtgaagtttaacaaaccctttgtgttcctgatgatcgaacagaacaccaaatcaccactgttcatgggaaaagtggtcaaccccacccagaag

SEQ ID NO: 18654 - DNA, 1254 bp, Artificial Sequence
  Description of Artificial Sequence: Synthetic coding sequence
atgccatcctcagtctcttggggtattcttctcctggcaggactctgttgcctggtaccagtgtcgctagccgaggacccacagggggacgccgcacagaaaaccgatacatcacaccatgatcaagatcatccgacttttaataaaataacccctaacctcgctgaatttgcctttagcctgtaccggcagctggcgcaccaatctaactcgactaacatttttttttcgcctgtgagtatcgctacagcctttgctatgctgtccctgggaactaaagcggacacacacgacgagatactagaggggctgaactttaatttaacagaaattccagaagcccaaattcacgagggcttccaggagcttttgcgcaccctgaaccaaccggattctcaacttcaactgactacaggaaacgggctgtttctgtcggagggactgaagctggtagacaaatttcttgaagacgttaagaaactctaccacagtgaggcgttcactgtcaatttcggcgatacagaggaagcaaagaagcagattaatgactacgttgaaaagggcactcaagggaagattgtggatctggtgaaagagctggacagagatacggtgttcgcgctcgtcaactatatctttttcaagggaaaatgggagcgccccttcgaggtgaaagataccgaggaggaggactttcatgtggaccaggtgactacagtgaaagtgcccatgatgaaacgattgggaatgttcaacatccagcattgcaaaaagcttagttcatgggtcctacttatgaagtacttaggcaatgcaacagcaattttcttcctgcctgacgagggaaaactgcaacacctggagaatgaacttactcacgatatcatcacaaagtttttagagaatgaggacagacgtagcgcgtctctccatctgcccaaattgtcaatcactgggacatatgacttgaaatccgtgctcggccagctgggcattacaaaagtgttctcaaatggcgcagatctgtcaggtgtgaccgaggaggccccactcaaactttcaaaagcggtgcataaagcagtgcttacaattgacgaaaaggggacagaagcagccggagccatgttcctggaggcgatccctatgagtattcctcccgaggttaagttcaataagccattcgtattcctgatgatcgagcagaatactaagtcgcccctgttcatggggaaggtggtgaacccaactcagaag

SEQ ID NO: 18655 - DNA, 1254 bp, Artificial Sequence
  Description of Artificial Sequence: Synthetic coding sequence
atgcccagctcggtgagctggggaatactgctgctggccggattatgctgtctggtgcccgtttccctggccgaggatccgcagggcgacgctgcgcagaaaacagacacttcgcaccacgaccaggaccatcctactttcaataagatcactccgaatctagcggagtttgccttctcactgtaccgtcagctggcccaccagagcaactcaaccaatattttcttttcgccggtgtcgattgctaccgctttcgcgatgctttcactcggcacgaaggccgacacacatgacgaaatcttggagggtctgaacttcaacctcaccgagattccggaagcccaaattcatgagggattccaggaactgctccgtacgctgaatcagccggatagccaactacaactcaccacgggtaatggtctgtttctgtcggaaggactgaagctggtggacaagttcctcgaagatgtgaagaaactctaccacagtgaggcctttacggtgaacttcggcgacacggaggaggccaagaagcagataaacgactacgttgaaaagggcactcagggcaagatcgttgatctcgtcaaggaactcgatcgagataccgttttcgctctggtgaattacatattcttcaagggcaagtgggagagaccgtttgaggtcaaagatacggaagaggaggacttccatgtagaccaggtcaccacagttaaggtacctatgatgaaacggcttggaatgttcaacattcagcattgcaaaaagttgagttcctgggtcctgcttatgaagtacctgggtaatgcaaccgctattttcttcctgccggatgagggaaaactgcagcatcttgaaaatgagctgacacacgacatcattaccaagtttctggagaacgaggacaggagaagcgcctccctgcacttaccgaagcttagtatcaccggcacctacgatctgaaatccgtcctcggccagctgggaatcaccaaggtgttttcgaatggcgctgacctgtcaggagtcacggaggaagccccgttgaaactgtcgaaggccgtgcataaggcggttctcacgatcgacgagaagggcacggaggcagccggggccatgttcctcgaggctatcccaatgagcataccacctgaggtaaagttcaataaacccttcgtgttcctgatgatcgagcagaataccaagtctccactgttcatgggtaaagtagttaacccaacgcaaaaa

SEQ ID NO: 18656 - DNA, 1254 bp, Artificial Sequence
  Description of Artificial Sequence: Synthetic coding sequence
atgcctagcagcgtgtcatggggtatactgcttctggcaggattgtgttgcctcgtgccagtgagccttgcggaagatccgcagggcgatgcagcacaaaaaactgatacctcgcatcatgaccaggaccatcctactttcaacaagattactccgaacctggcagagtttgccttttctctttatagacaacttgcccaccaatccaactcgaccaacattttcttttcccctgtgtcgattgcaaccgcatttgccatgctttccctgggcactaaggccgatactcatgatgagatccttgagggcctgaactttaacctcactgaaatcccagaggcccagattcatgaaggctttcaagaacttctgcggaccctgaatcaacctgactctcagcttcaacttacgaccggtaatgggctctttttgtccgaagggctgaaacttgtcgataagttccttgaagatgtcaagaagctctaccactcagaagcatttaccgtcaattttggagataccgaggaggcgaagaaacagattaacgattacgtggagaagggtactcaaggtaagatcgtcgaccttgtgaaagaacttgatagagacaccgtattcgccctcgtgaattacatattctttaagggtaaatgggaacgcccttttgaagtcaaggataccgaagaggaggactttcatgtggaccaagtcactaccgtgaaagtgccgatgatgaagaggctgggtatgttcaacattcagcactgtaagaaactttcaagctgggtgctgctcatgaaatacctggggaacgcgactgccatctttttccttcctgatgaaggaaaacttcagcatctggagaatgagctgacgcacgatatcattacgaagttcctggaaaacgaagatcgtcgttcggcgagcttgcatttgcccaaactgtcaattaccgggacctacgatctcaagtcagtgctcggtcagctcggtatcactaaggtgttctcaaatggtgcagatctgagcggtgtgactgaagaagcgccgctgaagctgtcgaaagccgtgcataaagcggtgttgaccatcgacgaaaagggcaccgaggccgctggagcaatgttccttgaggccatacctatgtccattcctcccgaagtgaagttcaataagcctttcgtgttcctgatgatcgagcaaaacactaagtcgcccctgtttatgggaaaggtcgtgaaccctacccaaaaa

SEQ ID NO: 18657 - DNA, 1254 bp, Artificial Sequence
  Description of Artificial Sequence: Synthetic coding sequence
atgccttcctcggtgtcctggggtatcctgttgctggccggtttgtgttgtctggtccccgtctcactcgcagaggacccccaaggagacgccgcccaaaagaccgacacttcccaccatgatcaagatcatcctaccttcaacaagataacccccaacttggctgaatttgcattttcactgtacagacagcttgcacatcagtcgaacagcaccaatatcttcttctcgccggtcagcatcgcaaccgcttttgcgatgctttccctcgggacgaaggccgacacccacgatgagattcttgagggactgaactttaaccttaccgaaatccctgaagcccaaattcatgaaggatttcaggaactgctgcgaacccttaaccagccagacagccaacttcagctgactaccggaaacggtctgtttctctcggagggcctgaagctcgtggacaagtttcttgaggatgtgaagaagctctaccactccgaggcattcaccgtcaatttcggtgatactgaggaagccaagaaacaaatcaacgactacgttgagaagggaacccaaggcaaaattgtggatctggtgaaggagcttgatagagatacggtgttcgctctggtgaattacatctttttcaagggtaaatgggaaagaccatttgaggtgaaagacaccgaagaggaagatttccatgtggaccaagtgactactgtgaaggtccctatgatgaaaaggcttgggatgtttaacattcagcattgcaaaaagctgagctcatgggtgctgcttatgaagtacctgggcaacgcgaccgctatcttttttctgcctgatgaaggaaaattgcagcatctggaaaacgagcttacgcatgatatcattaccaaatttcttgaaaatgaggaccgccgctcagcatctcttcaccttccaaagctctcgataaccggtacctacgatctcaagtcggtgctcggacaactgggtattaccaaagtgttttctaacggagccgatctttccggtgtcaccgaagaagcaccattgaagctgtcaaaggcggtgcataaggcagtcttgaccattgacgaaaaaggcactgaagcagccggcgcaatgtttttggaggcaattcctatgtccatccctcctgaagtgaaattcaataagcccttcgtgttcctcatgatagagcaaaatactaaatcccctctctttatgggcaaagtggtcaatcctacccaaaaa

SEQ ID NO: 18658 - DNA, 1254 bp, Artificial Sequence
  Description of Artificial Sequence: Synthetic coding sequence
atgccctcctccgtgagctggggaatcctcctcttagctgggctttgctgcctggtgcccgtctccctggccgaagatccccaaggggacgcggcacaaaagaccgatacatctcaccacgatcaggatcatcccaccttcaataagattactcccaatttggcggagtttgctttctctctgtacagacagttggcccatcaaagtaactcaactaacatcttcttcagcccagtgtccatcgccactgccttcgctatgctcagtttaggcaccaaagccgacactcatgacgagatcctggaggggctcaactttaacctcacagagatacctgaagcgcagattcacgaggggtttcaggaactcctaagaacccttaaccagccagattcccaattgcaactgaccacgggcaatggccttttcctctcggaaggactaaaactggtcgacaagttcctggaagatgtcaagaagttataccatagcgaagccttcacagtgaatttcggtgatactgaagaagctaaaaagcagattaatgactacgtggagaagggcacacagggcaagatcgtggatctggtcaaggagctggatcgggacactgtgttcgctcttgtcaactatatcttcttcaagggaaagtgggagagaccatttgaagttaaagatacagaagaggaggacttccacgtcgatcaggtgacgaccgtgaaagtgccaatgatgaaaaggctcggtatgttcaacatccagcattgcaagaaactgtcctcttgggttcttctgatgaagtatctagggaacgcgaccgccatatttttcctaccagacgagggtaagttgcagcacctggagaatgagttgacccatgatattatcaccaaatttctggagaacgaggataggcgatctgcctccctgcacctgcctaagttatcgataaccgggacgtacgatctcaagtccgtactcggtcagttaggaatcacaaaagtgttctccaacggcgccgatctgagcggtgtgactgaagaagcgcctctcaagctgagcaaggccgttcataaggctgtgctgaccatagacgaaaagggcacagaagccgcaggagccatgtttttagaagctatcccaatgagtatacctccagaagtaaagtttaacaaacctttcgttttcttgatgattgagcaaaacactaaatcacctttattcatggggaaggtagtcaatcccacccaaaaa

SEQ ID NO: 18659 - DNA, 1254 bp, Artificial Sequence
  Description of Artificial Sequence: Synthetic coding sequence
atgccgtcgtccgtctcgtggggtatcctgctcttggcgggactgtgctgtcttgtgcctgtgagcctggccgaagatccgcaaggcgacgccgcacagaaaacggatacctctcatcacgaccaagatcatccgacgtttaacaaaatcacgcccaatttggcggagttcgcgttcagcctgtacagacagttggcgcaccagtctaactcaactaacatcttcttctctccagtttcgatcgccactgcgttcgcaatgctgagcctgggtacgaaggccgatactcatgacgagatcctcgagggcctcaacttcaacctgactgaaatcccggaagcacagatccacgagggatttcaagagctgctccgcaccctcaatcagccggattcccagcttcaactcaccaccggtaatggattgtttctgtctgaaggtctgaagttggtggacaagttcctggaagatgtgaagaagctctatcactcggaagccttcactgtgaactttggagatactgaagaagctaaaaagcaaatcaacgactatgtcgagaaaggaactcagggcaagatcgtggaccttgtgaaggagctggaccgggataccgtgtttgcgctggtgaattacatattctttaaaggaaagtgggaaagaccgttcgaagtcaaggacaccgaagaggaagatttccacgtggatcaagtgaccactgtcaaggtgcctatgatgaagcggctgggaatgttcaacatccaacactgcaagaagctgtcatcctgggtgctgctgatgaagtacctcgggaatgccaccgccatctttttcctcccagacgaagggaagctccaacacctcgaaaacgaactcacccacgatatcatcactaagttccttgagaacgaggacagaagaagtgccagcctgcacctgcctaagctgtcaattaccggaacgtacgacctgaagagcgtgcttggacaactcggcatcactaaagtgttcagcaatggcgcagacctgtcgggcgtgactgaggaggcacctctcaagttgtcaaaagctgtccataaagccgtgctgaccattgacgaaaagggcaccgaagccgctggagctatgttcttggaggccatcccaatgtcaatccccccggaagtgaaattcaataagcctttcgtctttttgatgatcgaacagaataccaagtcgccactgttcatgggaaaagtcgtgaacccgacgcagaag

SEQ ID NO: 18660 - DNA, 1254 bp, Artificial Sequence
  Description of Artificial Sequence: Synthetic coding sequence
atgccgtcgtcggtatcgtggggtatactactactagcgggtttatgttgtttagtaccggtatcgctagcggaagatccgcaaggtgatgcggcgcaaaaaacggatacgtcgcatcatgatcaagatcatccgacgtttaataaaataacgccgaatttagcggaatttgcgttttcgctatatcgacaactagcgcatcaatcgaattcgacgaatatatttttttcgccggtatcgatagcgacggcgtttgcgatgctatcgttaggtacgaaagcggatacgcatgatgaaatattagaaggtttaaattttaatttaacggaaataccggaagcgcaaatacatgaaggttttcaagaattactacgtacgttaaatcaaccggattcgcaactacaattaacgacgggtaatggtctatttttatcggaaggtctaaaattagttgataaatttctagaagatgtaaaaaaattatatcattcggaagcgtttacggttaattttggtgatacggaagaagcgaaaaaacaaataaatgattatgttgaaaaaggtacgcaaggtaaaatagtagatttagttaaagaattagatcgtgatacggtatttgcgttagtaaattatatattttttaaaggtaaatgggaacgtccgtttgaagtaaaagatacggaagaagaagattttcatgtagatcaagttacgacggttaaagttccgatgatgaaacgtttaggtatgtttaatatacaacattgtaaaaaactatcgtcgtgggttctattaatgaaatatctaggtaatgcgacggcgatattttttttaccggatgaaggtaaattacaacatctagaaaatgaattaacgcatgatataataacgaaatttctagaaaatgaagatcgacgttcggcgtcgctacatctaccgaaattatcgataacgggtacgtatgatttaaaatcggtattaggtcaactaggtataacgaaagtattttcgaatggtgcggatttatcgggtgttacggaagaagcgccgttaaaattatcgaaagcggttcataaagcggttttaacgatagatgaaaaaggtacggaagcggcgggtgcgatgtttttagaagcgataccgatgtcgataccgccggaagtaaaatttaataaaccgtttgtttttttaatgatagaacaaaatacgaaatcgccgttatttatgggtaaagtagtaaatccgacgcaaaaa

SEQ ID NO: 18661 - DNA, 1254 bp, Artificial Sequence
  Description of Artificial Sequence: Synthetic coding sequence
atgccgtcatccgtgagctgggggattctgctgctggcaggactttgttgtttggtgcccgtatccttggccgaggatccccaaggcgatgccgcgcagaagactgacacaagccatcacgaccaggaccaccccacgtttaataaaatcaccccaaatctggccgaattcgctttttcactgtaccgacagctggctcaccaatcaaattcaactaatatcttcttttcccctgtttcgattgcaacggcattcgctatgctgagccttggaactaaggccgacactcacgacgagatattggagggattaaacttcaatctgaccgagatccctgaagctcagatccacgaagggttccaggaactcctgcggacactgaatcagcccgattctcagctgcagctgaccaccgggaacggactttttttaagtgaaggtctgaaactagtggacaaattcctcgaggacgtcaagaaactttaccactccgaagcctttaccgtgaacttcggtgacactgaagaagccaagaagcagataaatgactatgtcgagaaggggacccaggggaagatagtggatctggtaaaggagttggacagggacaccgtgttcgccctcgttaactatatatttttcaaaggcaagtgggaacggcccttcgaggtgaaggacacagaagaggaggattttcatgtggatcaggtcactaccgtaaaagtgcccatgatgaaaagattggggatgttcaatatacagcattgtaaaaaactttcctcgtgggtgctgttgatgaagtatctgggcaacgcaaccgcgatcttcttcctgcctgatgaaggaaagcttcaacacttagagaacgagctgacacacgatatcattacaaagtttttggagaatgaggacaggcgaagtgccagtttgcatctgcccaagctcagcatcacgggtacctacgatctgaaaagtgtcttggggcaactgggaattactaaggtgttttctaatggggccgacctgtccggggtcaccgaggaggcccccctgaagttgtctaaagcggtgcacaaggctgtgttaacaattgacgagaagggtaccgaagcagcgggagcaatgtttctcgaggccatccccatgtcgataccgcctgaggtcaaattcaacaagccgttcgtctttcttatgattgagcagaacactaaatccccattgttcatgggtaaagtggtaaaccccacgcaaaag

SEQ ID NO: 18662 - DNA, 1254 bp, Artificial Sequence
  Description of Artificial Sequence: Synthetic coding sequence
atgccatcgtccgtcagctggggaattctgcttctggccggtctttgctgtcttgtccctgtctctcttgctgaggatccacaaggagacgcagcgcagaaaaccgatacctcacaccacgatcaagaccacccaaccttcaacaagattacgcctaacctcgcagaattcgctttctcactgtaccgtcagctggcccatcagtcgaactccaccaacattttcttttccccagtgtccatcgcaactgcatttgccatgctgtccctgggaactaaggcagacacccacgatgaaatacttgaggggctcaacttcaatcttactgagattcccgaagcccaaattcatgagggcttccaagaacttcttagaaccctgaatcaacctgattcccaactgcaacttaccacgggaaatggtctttttctctccgaaggacttaagctggtggacaagtttctcgaggacgtgaagaaactgtaccattccgaggccttcactgtgaattttggagatactgaggaagcaaagaagcaaatcaatgattacgtggagaagggaacccagggaaagattgtggatcttgtgaaggagcttgatagagatactgtctttgcgctggtgaactacattttctttaagggaaagtgggaacggccttttgaggtgaaggataccgaggaggaagattttcatgtggatcaggtcaccaccgtcaaagttccaatgatgaagagactcggaatgtttaacatacaacactgtaagaaactttcgtcgtgggtgctgctgatgaagtaccttggaaatgcaacggccatctttttcctcccggacgaaggaaaattgcaacacctcgaaaatgagcttacccacgacatcattactaagttcctcgaaaacgaggacaggcgctcggcatctctccatctccctaaactctcgatcaccggaacgtacgacctgaaatccgtcctcggccagcttggcatcactaaggtcttttcaaatggcgctgacctctcgggagtgaccgaagaggcgccccttaaactttcaaaggcagtgcacaaggcagtgcttaccattgatgaaaaaggtactgaagcagcaggtgcaatgtttctggaggccatcccgatgtcgattccacccgaagtgaagttcaataagccctttgtctttctcatgatcgagcaaaacaccaaatcgcctctgttcatggggaaagtggtgaaccctacccaaaaa

SEQ ID NO: 18663 - DNA, 1254 bp, Artificial Sequence
  Description of Artificial Sequence: Synthetic coding sequence
atgccatcctcagtgagctggggtatcctgttacttgcgggtctgtgttgtctggtgccagtgagcctggccgaggatccgcaaggtgatgctgcacagaagaccgacacttctcaccacgatcaggatcatccaacattcaacaagattacgccaaaccttgccgagttcgccttttccttataccgccaattggcccaccagagcaacagcacgaacatttttttttctccagttagcattgccacggcgtttgccatgctgtccttaggcaccaaggcggacactcacgatgaaatcctggaggggctgaactttaatctgactgaaatcccagaggctcaaatccatgaggggttccaggagctgctgaggaccttgaaccagcctgattcccaattgcagctgacgaccggcaatggtctgttcctcagcgagggtctgaaactggtggataaattcctggaggacgtcaaaaagctgtatcatagcgaagccttcaccgtgaatttcggtgatacggaggaggcgaaaaagcaaatcaatgactacgttgaaaagggtacccaaggaaagatcgtggacctggttaaggaactagacagggatacagtcttcgcactggtcaattatatttttttcaaaggtaagtgggagcgtccttttgaggtcaaggacacggaagaagaagattttcatgtggaccaagtgaccacggtgaaggtgcctatgatgaagcgcttgggtatgtttaacattcaacactgtaaaaaactctcatcgtgggttctgctgatgaaatatctgggaaatgctacggctattttttttctccctgacgagggcaagctgcaacacttggagaatgagctgacgcacgacattatcaccaagttcctggagaacgaagacagacgcagcgccagcctccacctaccgaaactgagcattactggtacgtacgatctgaaatccgtcctgggccagttaggtatcaccaaggtatttagcaatggtgccgacctcagcggggtcaccgaggaggcgccactcaagctgtccaaggccgtgcataaggcggtgctgaccatcgatgaaaaggggaccgaagccgccggcgcgatgttcttggaggcaatccctatgtcaatcccgccagaggtcaagttcaataaacctttcgtgtttctaatgatcgagcagaacactaaaagccctctgttcatgggtaaggtcgttaacccaacgcagaag

SEQ ID NO: 18664 - DNA, 1254 bp, Artificial Sequence
  Description of Artificial Sequence: Synthetic coding sequence
atgccgtctagcgtctcgtggggtatcctgctgctcgcaggattgtgctgcttggtccctgtgagcctcgccgaggacccgcagggagacgccgcccaaaagaccgatacgtcccaccacgaccaggaccatccgaccttcaacaaaatcacgccaaacctggcagaattcgctttctcgttgtatcgccagctggcacaccagtccaactctaccaacatctttttctcgccggtgtcgatcgcgaccgctttcgctatgttgtctctcggtactaaggcagatactcatgatgagattctggagggacttaactttaatcttactgagatcccagaagcgcaaatccatgaaggcttccaagagctgctccggaccctgaatcagccagactcgcagctgcaactgaccaccggaaatggcttgtttctgtccgaaggcctgaaactggtcgacaaattcctggaggatgtgaagaagctgtaccactccgaagccttcactgtcaacttcggcgataccgaggaagcgaaaaaacagattaatgactacgtggaaaagggaacccaggggaagatcgtggacctcgtgaaggaattggaccgggatacggtgttcgcgctggtgaattacatcttctttaaaggaaagtgggagcgcccattcgaagtgaaagacaccgaggaagaggactttcacgtcgatcaggtgactacggtcaaggtgccgatgatgaagcgtttgggaatgttcaacatccaacactgtaagaagctgtcatcttgggtgttgctcatgaaataccttggaaatgcgaccgccatcttcttcctgccagacgagggcaaactgcagcatctggaaaacgaattgacccatgacatcatcactaagttcctggaaaacgaggaccgcaggtcagcatccctccacctgccaaaactgtcgatcactgggacgtacgatctcaaaagcgtgctggggcagctgggaatcacgaaggtgtttagcaacggagcggatctgagcggcgtgaccgaagaggcacctctgaaactgagcaaggccgtccacaaagcggtcctgactatcgacgagaagggaactgaggccgctggagcaatgtttctcgaggcaattcctatgtctattccgcccgaggtgaagtttaacaagccgtttgtgttcctcatgatagagcaaaatactaagtccccgctcttcatggggaaggtggtcaatcccacccaaaag

SEQ ID NO: 18665 - DNA, 1254 bp, Artificial Sequence
  Description of Artificial Sequence: Synthetic coding sequence
atgccctcttcggtgtcatggggaattttgctcctggctgggctttgctgcttagtgcccgtgtctctcgccgaagacccacagggagatgcagcacaaaaaactgatacatcacatcacgatcaggatcaccctacatttaacaaaatcacacctaatttagcggaatttgccttttctctatatcggcagttagcacatcagagtaattctacaaatatcttcttttctcccgtgtccattgcgactgctttcgccatgctctctctcgggactaaagcagatactcacgatgaaatacttgaaggactgaattttaatctcactgaaattcctgaagcacagatccatgaagggttccaggaactactgaggactctcaatcagcctgattcacagttgcaactgacaactgggaacggactgttcttatctgaggggctcaaactcgtggataaatttctggaggatgtcaaaaaactctatcactcagaggccttcacagttaatttcggggatacagaagaagcaaaaaagcagataaatgattatgttgagaaaggaacgcagggaaaaatcgtggatctcgtcaaggaactggatcgagatactgtgttcgcactcgtgaattatatcttttttaaagggaaatgggaaagacccttcgaagtgaaagatactgaggaagaagatttccatgttgatcaggtgactactgtgaaagtgcctatgatgaaaagattgggaatgttcaatatacagcattgcaagaaactcagttcttgggtgcttcttatgaaatatctgggaaatgccacagccatcttcttcctccccgacgaagggaagttacagcacttagaaaatgaactgactcatgatataataactaaattcctggaaaacgaagatcgacggtccgcttctctgcaccttcccaagctctctatcacaggaacatatgatctcaaatcagtgctgggacagctaggaattacaaaagttttcagtaacggggctgatttatctggagtaacagaagaagctccactcaaactttctaaagcagtccacaaagctgtacttacgattgacgagaaagggactgaagcggccggagctatgtttttagaagccatacccatgtcaatcccaccagaagtgaagttcaacaaacccttcgtcttcctaatgatcgaacagaatacaaaatcgcctctatttatgggaaaagtagtgaacccaactcagaaa

SEQ ID NO: 18666 - DNA, 1254 bp, Artificial Sequence
  Description of Artificial Sequence: Synthetic coding sequence
atgccatcatcagtgtcctggggaattctcctcctcgctgggctctgctgcctggtgcccgtgtcactggccgaggacccgcagggggatgcagcccagaaaactgatacttcccaccacgaccaagaccatccaacctttaacaagatcactccgaatctggccgaattcgccttctccctctaccgccaattggctcaccagagcaattcaaccaacatcttcttctcacccgtgagtatcgcgaccgcattcgctatgctgtccctgggtacgaaggcggatacccacgacgaaatccttgaaggactgaacttcaacctgaccgagatcccggaggcccagattcatgaaggattccaggagctccttcgcaccctcaatcagccagatagccaactgcagcttaccaccggcaatggcctgttcctttccgaaggactgaaattggtcgacaagttcctcgaggatgtgaaaaaactgtaccattccgaggcgttcaccgtaaacttcggagatacggaggaggcgaagaaacagatcaacgactacgtggagaaggggactcagggaaaaatcgtggatctggtgaaggagctggatagagatactgtgttcgccctggtcaactacatctttttcaaggggaagtgggagcgccctttcgaggtgaaggacaccgaagaggaggacttccacgtcgaccaggtgactactgtgaaggtcccaatgatgaaacgccttggcatgttcaatatccagcactgtaaaaagctcagttcctgggtgctgctcatgaagtacttgggaaacgccaccgctatcttctttttgccggacgagggtaaactccaacacctggagaatgaactgactcacgacatcatcactaagtttctcgaaaatgaagatagaagatcggcatccctgcatctgcccaaactgtccattaccggtacctatgatcttaaaagcgtcctcggacagctgggtattactaaggtcttttcaaacggagcggacctctcgggagttactgaagaggccccgctgaaactgtccaaggcagtgcataaggccgtgttgactatcgacgagaagggcactgaagccgcgggagcaatgttcctggaagcgatcccgatgagcatccctcctgaagtgaagttcaacaagccgtttgtgtttctgatgatcgaacagaatactaaatcgcctcttttcatgggaaaagtggtgaatcccactcagaag

SEQ ID NO: 18667 - DNA, 1254 bp, Artificial Sequence
  Description of Artificial Sequence: Synthetic coding sequence
atgccttcgtcggtgagctggggtattctccttcttgcaggtctgtgctgtttggtccctgtgtcgctcgcagaggaccctcaaggggatgctgcgcagaaaacggacacctcacatcatgatcaggatcatcctacctttaacaagattactccgaacctggcagagtttgcattttcactgtatcggcaacttgctcatcaatcgaactcgaccaacatctttttctctccagtcagcatcgcaactgcattcgcaatgctttccttgggtactaaagccgacacccacgacgaaatcctggaaggtctgaactttaacttgactgagattcctgaagcgcagatacacgaaggattccaagaactccttcgtactttgaaccagcctgattcgcagcttcagcttactactggcaacggtttgtttctgagcgaaggcctgaagctggtcgataagtttttggaggacgtgaaaaaactgtaccatagtgaagccttcactgtgaattttggagatactgaagaggcaaagaaacaaatcaacgattacgtggagaaaggaacccaaggtaagatagtggacctggtgaaggaactggaccgagataccgtgttcgcactggtcaattacatctttttcaagggtaagtgggaaaggccatttgaagtgaaagatacggaggaggaagatttccatgtcgaccaggtgactactgtgaaggtgcccatgatgaagcggcttggcatgttcaatatacaacactgcaagaagctctcgagttgggtgcttctgatgaagtatttgggtaatgcgactgcgattttctttctcccggatgaagggaaacttcagcacctggaaaatgagcttacccatgacattatcaccaaatttctggagaatgaggatagacgctcagcgtcacttcatctccctaagctgtccatcactggaacctacgatcttaagtccgtgcttggccagttggggatcaccaaggtgttctccaacggtgccgatctctcgggagtgaccgaagaggccccactgaaactttccaaagcagtgcacaaggcagtgcttactattgacgaaaagggaaccgaagcagcaggcgcgatgtttcttgaagcgataccaatgtcgattccacccgaagtcaagttcaataagcctttcgtgttcctcatgattgaacagaacaccaagtcccctctgtttatgggaaaggtagtcaatcccactcaaaag

SEQ ID NO: 18668 - DNA, 1254 bp, Artificial Sequence
  Description of Artificial Sequence: Synthetic coding sequence
atgcccagcagcgtgtcctggggcattctgctactagcaggtctctgctgtttagtgcccgtcagccttgccgaggacccgcagggagatgccgcacagaagaccgacactagccatcacgaccaggatcatccaacgtttaataagattacaccaaatctggccgaattcgcattctccctctaccgccagttagctcaccagagcaattctacaaatattttcttttcccccgtctcaattgccaccgcatttgccatgctgtccctgggaaccaaggcagatacccatgatgagatactggagggactgaacttcaaccttacagaaattccagaagcccagatccacgaaggcttccaggagctgttaagaaccttgaaccaaccagattctcaactgcagctcacgaccggcaacgggctatttctgtccgaaggccttaaactggttgacaagtttctcgaagatgtcaagaagctgtatcattcggaagctttcaccgtgaacttcggagacaccgaagaagccaagaagcagatcaacgactatgtcgagaagggtacgcagggaaaaatcgtggatttggtgaaagaactggaccgggacacggtgtttgcgctggtgaattacatcttcttcaaagggaaatgggaaaggccctttgaagtgaaagataccgaggaggaggacttccacgtggaccaggttaccactgtgaaagtcccaatgatgaagaggcttggtatgttcaatatccagcattgtaaaaagcttagttcctgggtcttgttaatgaaatatttgggaaatgcgactgcgatcttttttctcccggacgaggggaaactccagcatttggagaatgagctcacccacgacataattacaaaatttctggagaatgaagacagaaggtcagccagcttacatctacctaaactatccattaccgggacctacgacctcaaaagcgtcctgggacaactaggcattacgaaagttttttctaacggtgcggacttgtctggggtgacagaggaggccccgctgaaactctcaaaggcagtgcataaagccgtgttaactatagatgagaaaggaaccgaggccgcaggcgctatgtttctggaagctattccgatgagcatccccccggaagtcaagtttaataaaccgttcgtgttcctgatgatcgaacagaacacaaaatctcccctcttcatgggaaaggtggtgaaccctacacagaag

SEQ ID NO: 18669 - DNA, 1254 bp, Artificial Sequence
  Description of Artificial Sequence: Synthetic coding sequence
atgcctagtagcgtttcctggggcatcctgttactggcaggcctctgctgcctggtgccagttagtttagccgaggatcctcaaggggatgccgcccagaaaaccgataccagccaccacgaccaggaccatcctacgtttaataaaattactcctaatttagccgagttcgcgtttagcctgtatcggcagttggcacaccaatctaactcaaccaacatcttcttctctcccgtcagcatcgctactgcatttgccatgctcagtctgggtactaaagcagacacccacgacgaaattctcgagggcctgaactttaacctcacagagatacccgaagcccagatccacgagggcttccaggaactattgaggacactcaatcaacccgactcacagctccagttgaccacaggcaacggactgttcctgagtgaaggattgaagctggtagacaagttcctcgaggacgtgaaaaagctctaccactcagaagcctttacggtgaacttcggcgacacggaagaagctaaaaaacagattaatgattacgtggaaaaggggactcaaggcaaaatcgttgacctggttaaagagctggatcgtgacacagtgtttgctcttgtgaattacatctttttcaagggcaagtgggaaaggccctttgaggttaaggacacagaagaggaggactttcacgtcgaccaagtgacaaccgtcaaagtgcctatgatgaagcgcttgggaatgttcaatatccagcactgcaagaagctgtcctcatgggtgctgctgatgaaatatctcggaaacgccacagcaatcttttttctgcccgacgagggcaaactccaacacctagagaatgaactcacccatgatataattactaagttcctcgagaacgaggaccgcaggtcagccagcctacaccttccaaaactctcaattaccggaacttatgacctcaaaagtgtgttgggccagctcggaataactaaggtcttctctaatggagcagatttatccggcgtgactgaggaggcccccctgaagctttccaaagccgtacacaaggcagtactcaccatcgacgagaaagggacagaggctgctggcgctatgtttttggaggctatccctatgagtatcccccccgaagttaaattcaacaagccctttgtttttttgatgatcgaacagaacactaagtcaccgctttttatgggaaaggtggtgaacccaacgcaaaag

SEQ ID NO: 18670 - DNA, 1254 bp, Artificial Sequence
  Description of Artificial Sequence: Synthetic coding sequence
atgcctagttctgtttcatggggtatcctcctcctcgcaggtctatgctgtctcgtcccagtctcacttgcagaagatccacaaggggatgctgcgcaaaagacggatactagtcaccatgatcaagaccaccctacgtttaacaagatcacccccaatctagcagagtttgctttctccctgtatcgtcagttagcgcatcagtccaattccacaaacatttttttttcgccagttagtatcgccacggcatttgctatgctcagcttggggacaaaggccgatacacacgacgaaatactggaaggtttgaacttcaaccttacggaaataccagaagcccaaatccacgagggctttcaggagctgttgcgaacgcttaaccaaccagattctcaacttcagcttacaacaggaaacggcctcttccttagcgaaggcttgaagctcgtcgacaagttccttgaagacgttaaaaagctgtaccatagtgaggcgttcaccgtcaacttcggagacacagaagaggcaaagaaacagatcaatgactatgtcgagaagggtacacagggaaagatcgtggatttggttaaagaactcgatcgggacacggtattcgctcttgttaactatatctttttcaagggcaaatgggagcgtccgttcgaggtaaaagacaccgaggaggaagacttccatgtcgaccaggtcaccactgttaaggtgccgatgatgaagcggctcggaatgttcaacattcagcattgtaaaaaactgtctagttgggtactcctgatgaaatacctaggcaacgcgacagctatcttttttctccccgacgaaggtaagctgcaacatttagaaaacgaattgacgcacgacataatcacgaagttccttgaaaacgaagatcgccgaagtgcgtccctgcaccttccgaagctatccatcaccggtacttacgatttgaagtcagtgctcggccagctcggaatcaccaaggtgttctcaaatggcgccgatctgtccggtgtgacggaagaggcccctttgaagctctctaaagcggttcacaaagctgtcttgaccattgacgagaaaggtacagaggccgcaggtgcaatgttcctggaggctatcccaatgagcatcccacctgaagttaaattcaataaaccgtttgttttccttatgattgaacagaatactaaatcccctttgttcatgggcaaggttgtcaatcctacccagaag

SEQ ID NO: 18671 - DNA, 1254 bp, Artificial Sequence
  Description of Artificial Sequence: Synthetic coding sequence
atgccttcgtcagttagctgggggattcttctcctggccggcctttgttgtctcgtgcccgtgagccttgccgaagatccacagggagatgcagcccaaaagaccgatacttcacatcatgaccaagatcacccgacgtttaacaaaatcactcctaaccttgccgaattcgctttcagcctttaccgccaacttgcacaccagtcaaactcgaccaatatcttctttagcccagtctcaattgccacggcgttcgccatgctttcactgggcaccaaggctgatactcatgatgagattctcgaggggcttaacttcaatctgacggaaatccccgaggctcagatccatgaaggttttcaagaattgctgcggaccctgaaccaacccgattcgcaacttcagctgaccaccggtaacggtttgtttcttagcgaagggttgaaactggtcgacaagtttcttgaagatgtgaagaagctctaccactcggaagcattcactgttaactttggtgacacggaagaggcaaaaaagcagataaacgactacgtggaaaaaggtactcaaggtaagattgtcgatctggtcaaagaactggaccgggataccgtgtttgcactggtcaactacattttctttaagggcaagtgggaacgcccattcgaagtgaaggataccgaggaggaagattttcacgtggaccaagtgacgaccgtgaaggtgcccatgatgaagcggctgggaatgtttaacatccaacactgcaaaaaactttcaagctgggtacttcttatgaaatacctcggcaatgctaccgccattttctttcttccagacgagggaaagctgcaacacctcgaaaacgagctcacccacgatatcattactaagtttctcgaaaatgaggatcggagatccgcatcccttcatctgccaaagctctcaattaccggtacgtatgatctgaaaagtgtgcttggacagctcggaattaccaaggtgttttccaacggagcagacctttccggagtgaccgaagaggctcctctcaaactgtctaaggctgtccataaggccgtgcttacgattgatgagaaaggcactgaagcagcaggtgcaatgttccttgaggcaattcctatgtctattccgccagaggtgaaattcaacaagccttttgtgtttctgatgatagaacaaaataccaaatcccctttgtttatggggaaggtggtcaaccctactcagaag

SEQ ID NO: 18672 - DNA, 1254 bp, Artificial Sequence
  Description of Artificial Sequence: Synthetic coding sequence
atgccatcctctgtgtcatggggcattctgctgctcgctgggttatgttgcttagtccctgtatctctggccgaggatcctcagggcgacgcagcacaaaagacagacacatcccatcacgatcaggaccatcccactttcaataagatcacacctaacctagccgagtttgccttttccctttacagacaactggctcaccagagtaactccactaatatattcttcagccccgtgagcatcgctaccgctttcgccatgttgagcttggggaccaaggccgatacccacgacgaaatcctggaaggcctgaacttcaacctaaccgaaattccagaggcccagattcacgagggcttccaggagctactgaggacactaaatcagcccgactcccaattgcagctgacaaccggcaacggcctgtttctgtcagagggcctgaaactggtcgataaattcctggaggacgtgaagaaattgtaccatagcgaagccttcacagtcaactttggggacactgaggaggccaagaagcagattaatgactacgtagagaaaggcacccaaggaaagattgtcgatctggttaaggaattagaccgggataccgttttcgctttagtgaactatatcttcttcaaaggaaagtgggaacgaccatttgaagtcaaggacaccgaggaggaagactttcatgtggatcaggtgaccaccgtgaaggtgcctatgatgaagagactcggcatgtttaatatccagcactgcaaaaaactctcaagttgggtactgctgatgaaatatctgggcaatgctaccgcaattttctttctccccgacgagggtaagttacagcatctggagaacgagctaacccatgacattataacaaagtttctggagaacgaagatcgccgatccgcttcattacacctccctaaactgagcattaccggcacctacgatttgaagagcgtgctgggccagctgggcatcactaaagtcttctcaaatggagccgacctgtccggggtgaccgaagaggcaccactaaagttatccaaagctgtacataaagcagttctgacaattgacgaaaaaggcaccgaggccgctggtgcaatgttcctggaggccatacctatgtcaatacctccagaagtgaaattcaataagccttttgtatttcttatgatcgagcagaacaccaaatctcctttattcatgggcaaggtggtcaatcccacccaaaag

SEQ ID NO: 18673 - DNA, 1254 bp, Artificial Sequence
  Description of Artificial Sequence: Synthetic coding sequence
atgccatcatcagtttcatggggaatcctactcctcgctggactttgctgcctcgtcccagtaagtttggctgaagatccacaaggagatgccgctcaaaagacagatacatctcatcacgatcaagaccatccaacatttaataaaatcactcctaatctcgccgaatttgcttttagtttgtatagacagttggcgcatcaatcaaactcaactaacatatttttttcaccagtctctatcgcaaccgccttcgctatgttaagcttgggtaccaaggcagatacgcatgatgaaatcctcgagggactgaacttcaaccttacggagatcccagaagcgcaaatacatgaggggttccaagagcttctgcgtactttgaatcagccagattcacagcttcagctcaccacaggaaacggacttttcttgtcggaaggattaaagcttgttgataaatttcttgaagatgtaaaaaaattgtatcactctgaagcgtttaccgttaatttcggagataccgaggaagctaaaaaacagatcaatgattatgtggaaaagggtacgcaggggaaaatcgtcgatctggtaaaggagctcgatcgtgataccgtgttcgcgcttgttaactacattttctttaagggtaagtgggagagaccttttgaagtgaaggataccgaagaggaagattttcatgttgatcaggtgactaccgtcaaggtcccaatgatgaagagactgggtatgttcaatatccaacattgcaaaaaactttcttcttgggtactccttatgaagtacctgggtaacgccactgccattttcttccttcctgacgaagggaaacttcagcatctggaaaatgaactcacacatgatatcataacaaagttcctagagaatgaggatcggcggtcagcgtccttgcatcttcctaagctctctattacgggtacctatgatcttaaatccgtcctcggtcaactgggaataacaaaggttttttcaaacggtgctgatctgagtggtgttacagaggaagcacccctgaaactatcgaaggctgtgcataaggccgttttgaccatagatgaaaagggaacagaggccgccggagctatgtttttggaggctattcctatgagcattcctccagaagttaaatttaacaaaccatttgtttttttgatgatcgaacaaaataccaagtcccctttgtttatgggcaaggtcgttaatccgacacaaaag

SEQ ID NO: 18674 - DNA, 1254 bp, Artificial Sequence
  Description of Artificial Sequence: Synthetic coding sequence
atgccctcctcagttagttgggggattttgctcctggcagggttgtgctgcctagtgccagtgtccttagccgaggatcctcagggggacgcagctcagaagacagatactagccaccatgatcaggatcaccccactttcaataagatcaccccgaatctggcagagttcgctttttccctctatcgccagctggcccaccagagcaatagtacgaacatatttttctctcccgtgtcgattgctaccgccttcgctatgctgagcctggggacaaaagctgacacccatgatgagattctcgaaggtctgaattttaatctcactgagataccagaggcccaaatccacgaaggcttccaggaattgctgcggactctgaaccagccggatagccaactacaattgacaaccggaaacgggcttttcctgagcgaggggctgaagttggtggataaattcctcgaagacgtgaagaaactttaccattccgaggcttttactgtaaattttggggataccgaagaagccaaaaagcagataaacgattatgtggaaaagggtactcagggcaagatcgtagacttggtgaaagagttggatcgagacacagtgtttgccctggtgaactacatattctttaagggtaagtgggagagaccatttgaagtgaaagataccgaggaagaagattttcacgtggaccaggtgactacggtaaaggttcccatgatgaaaaggttgggcatgtttaatatccagcactgtaaaaaattgtcttcttgggtactactgatgaaatatctggggaacgctacagctattttttttttgcctgatgagggaaagctccagcatctggagaacgaactaacccacgacatcatcacgaagttcctggaaaacgaggaccgtcgatcagcatcgttacacttgcctaagctctcaattactggaacatatgatcttaagtctgttcttggacaactcggcatcactaaggttttcagcaatggggctgacctgtccggcgtgaccgaggaggcccccctaaaacttagcaaggcggtgcataaagccgtcctgaccatagacgaaaagggcacagaagccgccggggcaatgtttctcgaagctatccccatgtccattccgcccgaagtcaagttcaacaaaccattcgtttttctgatgattgaacagaataccaaaagcccacttttcatgggaaaggtggtgaatcccacccagaaa

SEQ ID NO: 18675 - DNA, 1254 bp, Artificial Sequence
  Description of Artificial Sequence: Synthetic coding sequence
atgccctcatcggtgtcgtggggcatccttctgctggcaggcttgtgctgtctggtcccggtgagcctcgccgaagatccacagggagacgcggcgcaaaagaccgacacgagccaccatgaccaggaccatccgaccttcaataagattactccgaacctcgccgagttcgctttcagcctgtaccgccaactcgcccatcagtcaaactcaacgaatatcttcttcagcccggtaagcatcgccactgccttcgcaatgctgtcgcttggcacgaaggctgatacccacgacgagatcctggagggactcaactttaacctcaccgaaattccagaggcccaaattcatgaagggttccaggagcttttgcggaccctgaaccagccagattcgcaattgcagttgaccaccgggaacggcctcttcctgtccgaaggactcaaactggtggacaaattcctggaagatgtcaagaagctgtatcactccgaagcgttcactgtgaactttggagacaccgaggaggcaaagaagcagatcaatgactacgtcgaaaagggaacccaaggcaagatagtagacctcgtcaaagaactggacagggatactgtattcgccctggtcaactacatctttttcaagggtaagtgggaaagaccgtttgaagtgaaggataccgaggaggaagatttccacgtcgaccaggtgacgaccgtcaaagtgccaatgatgaaacgcctgggaatgttcaatattcagcattgcaaaaagctgtcctcatgggtgctgctcatgaaatacctcggaaacgcgactgctatattcttccttccggacgaaggcaagctgcagcacctggaaaacgagctcactcacgatatcatcacgaagtttctggagaacgaagataggagatcggcttcactgcatctgcctaagttgtccatcaccggcacttacgacctgaagtccgtgttgggacagctcggaatcactaaagtgttctccaatggggcggacctttctggcgtgactgaggaagcaccccttaagctgagcaaagccgttcacaaggccgttctgactatcgatgaaaagggaactgaagccgcgggggcaatgttccttgaggcgatcccgatgtcgatcccgcccgaggtgaagttcaacaaacctttcgtgtttcttatgattgagcagaatactaagtcccctctctttatgggaaaagtggtgaatccaacccaaaag

SEQ ID NO: 18676 - DNA, 1254 bp, Artificial Sequence
  Description of Artificial Sequence: Synthetic coding sequence
atgccaagcagcgtctcatggggaatactcctgctggctggcctttgttgcctggtgccagtgtctctggctgaggacccccagggagatgctgctcaaaagactgacacctcccaccacgaccaagaccatcccacctttaacaagatcaccccgaatctggcggagttcgccttttccctttacagacagttggcgcaccagtccaactcaactaatatcttcttttcgccggtgtccatcgccacggcctttgcaatgctgagcctgggaaccaaggcagacactcatgatgagatccttgaagggctcaacttcaaccttacggaaatcccggaggctcagatccacgaagggttccaggaactgctgcggacccttaaccagcctgactcacagctgcagctcaccactggaaacggactctttctctccgagggactgaagctggtcgataagttcctggaagatgtcaaaaaactctaccacagcgaggcctttaccgttaacttcggcgatactgaagaggcaaaaaagcaaatcaatgactacgtggagaagggtactcagggaaagatcgtggatctggtgaaagaactggatcgggacacggtgtttgccctcgtgaactacatcttctttaagggaaagtgggaacggccctttgaggtgaaggatactgaggaagaggatttccatgtcgatcaagtgaccactgtcaaagtcccgatgatgaagcgactgggaatgttcaatattcaacattgcaaaaagttgtcatcgtgggtgctcctgatgaagtacctggggaacgccactgcgatcttctttctgccagacgaaggcaagctccagcacctggaaaatgagcttacccatgacatcatcaccaagttccttgagaacgaggaccgccggtcggcctcgctccacctgccgaagctgtcgattaccggcacctacgatctgaagtccgttctgggacagctgggaatcactaaagttttctccaacggagccgatctgagcggagtgactgaggaagctcccctgaagctgagcaaagcagtgcataaggcagtgctcaccatagatgaaaaaggcacggaggccgccggtgcgatgttcctggaagcgatcccaatgtccatcccgccagaggtgaagttcaataagccgttcgtgttcctgatgatcgagcaaaatactaagtccccactgtttatgggcaaagtcgttaacccgacccagaag

SEQ ID NO: 18677 - DNA, 1254 bp, Artificial Sequence
  Description of Artificial Sequence: Synthetic coding sequence
atgccatcgtcagtgtcgtggggaatacttctcctggcaggactgtgctgtcttgtgcctgtgtcgcttgcagaagatccccaaggggacgcagcacaaaaaactgacacctcacatcacgatcaggaccaccctacttttaacaagatcacccctaatctcgccgagtttgccttctcattgtaccgccagctcgcgcaccagtcgaactccactaatatctttttcagcccagtctcaatagcaactgcgtttgcaatgctttccctgggaactaaagccgatacccatgacgagattcttgaaggccttaactttaacctgacggaaatcccagaggctcaaatccatgaggggtttcaggagctgcttcggacccttaaccaacctgactcccaacttcaactgaccactggaaacggtctgttcctgtctgagggactgaaactggtggacaagtttctggaagatgtcaagaagctgtaccactcggaggcatttactgtgaactttggcgataccgaagaggcaaagaagcagataaatgattacgtggaaaagggaacccaggggaagattgtcgatcttgtgaaggaactcgaccgcgatactgtgttcgcactcgtcaattacatctttttcaagggaaaatgggaacgcccttttgaagtaaaggatacggaagaagaggatttccacgtcgatcaggtgactaccgtcaaagtgcctatgatgaagaggcttggtatgttcaacattcaacactgtaaaaagctgtcatcctgggtcctgctcatgaagtacctgggtaacgcgactgcaattttcttccttcccgatgagggaaaactgcagcacctcgaaaacgaacttactcatgatatcataactaaattccttgaaaatgaagatcgccgctccgcctcgcttcatctgccgaagttgtcaattaccggaacttatgacttgaagagcgtcttgggtcagctgggtatcactaaggtgttttcaaacggtgcagacctgagcggtgtcaccgaagaagcgcctctcaagctgtcgaaggccgttcacaaggcagtccttacgatcgatgaaaagggcactgaagcagctggggcaatgtttcttgaagcaatcccaatgtctattccccccgaagtcaaattcaataagccatttgtctttctcatgattgagcagaacacgaagagccctcttttcatgggaaaggtggttaatcctacccaaaag

SEQ ID NO: 18678 - DNA, 1254 bp, Artificial Sequence
  Description of Artificial Sequence: Synthetic coding sequence
atgccttccagcgtctcttggggtatcctgcttctggctggtctgtgttgcctggttcctgtgtcactggctgaagatcctcagggagacgccgctcaaaagacagatacatcccaccatgatcaggatcaccctaccttcaacaagatcacacctaaccttgctgaattcgccttctccctctacagacagctggcccaccaatcaaactccaccaatattttcttctctcccgtgtccatcgcaactgctttcgctatgctctctctgggtactaaggccgatacacacgacgagatccttgaaggccttaatttcaatcttacagagattcccgaggcccagatccacgagggattccaagagctgctgaggaccctgaatcagcctgattcacaactgcagctgacaaccggaaacggtctcttcctctcagagggtttgaaactggtcgataaattccttgaggacgtcaagaagctgtatcacagtgaggcctttactgtgaacttcggtgataccgaggaggctaagaaacaaatcaacgactacgtggaaaagggaactcagggtaagatcgttgacctggtcaaagaattggatcgtgacaccgtattcgctctggtgaattacattttcttcaagggcaagtgggagagaccctttgaggttaaagataccgaggaagaggattttcacgttgaccaggtaactaccgtgaaggttcctatgatgaaaaggctgggcatgttcaatatccaacactgcaagaagctgagctcttgggttctgctcatgaaatacctcggcaatgctaccgctattttcttcttgcccgatgagggtaagcttcagcatttggagaatgagcttactcatgacatcatcacaaagtttcttgagaacgaggacagaagatctgcaagtctgcatctgcccaagctctcaattactggtacctacgatctgaagtcagtgctgggccagctcggcatcaccaaagtgttttccaatggcgctgacctgagtggcgtgactgaagaggcccctctgaagcttagcaaggccgttcacaaagcagtactcacaattgacgaaaagggtaccgaggccgccggtgccatgttcctggaagccattcctatgagtattcccccagaggtcaagtttaacaaacccttcgttttccttatgatcgagcaaaacaccaagtccccactgttcatgggaaaggttgtgaatcccactcagaaa

SEQ ID NO: 18679 - DNA, 1254 bp, Artificial Sequence
  Description of Artificial Sequence: Synthetic coding sequence
atgcctagcagcgttagttggggtatcttgcttttggcaggcctatgctgtctggtgcctgtcagtctggctgaagatccacagggggatgctgcccaaaaaaccgatactagccaccacgatcaggaccatcccacttttaataagataacccccaatcttgccgaattcgctttctccctgtaccgccaacttgcccatcagagcaactcgaccaatatttttttcagtccggtgtctatcgctacagcctttgctatgctatccttaggaactaaagccgacactcatgacgagatccttgagggattaaattttaatcttaccgagatccccgaagcacagattcatgaaggctttcaggaactcttgagaaccctgaatcagccagattcacagctgcagttgaccacaggtaatggtctgtttctttcggagggcttaaagttggtggacaagtttctggaggacgtaaagaaactttatcactcagaagctttcacagtgaattttggagacaccgaggaagcgaagaagcagattaatgactatgtagagaagggcacccaaggtaagattgttgacctagtcaaggaattggaccgggatacagtgttcgctctggtaaattacatattttttaaaggcaagtgggagcggcctttcgaggtcaaggataccgaggaggaggacttccacgtggatcaagtgaccactgttaaggtacccatgatgaaacgcctagggatgttcaacatccagcactgtaagaagctgagctcatgggtgctgctcatgaagtatctaggaaacgcgacagctatctttttcctgcccgacgaggggaaattgcagcatctggaaaatgaattaacacatgacataataacgaagttccttgagaatgaggaccgcagaagtgcctcattgcacctgcccaaactgtctattacgggcacttacgatttaaagtccgtattaggacagctgggcataacaaaggtcttctctaacggcgcggatcttagtggtgtcaccgaggaggccccgctaaagctcagcaaggccgttcataaagctgttctgaccatcgatgaaaaagggacggaagctgcaggcgctatgttccttgaggccatcccaatgagcattccccccgaggttaaattcaataagcctttcgtcttcctaatgatagagcagaacaccaagagtccgctgtttatgggaaaggttgtgaatccaacccagaag

SEQ ID NO: 18680 - DNA, 1254 bp, Artificial Sequence
  Description of Artificial Sequence: Synthetic coding sequence
atgccatcaagcgtctcttggggaattctcctgctcgccggactgtgctgcttagtgccggtttcactggctgaagacccccagggagatgctgcccagaagacagatacctcacaccacgatcaagaccatcctacttttaacaagattacccccaaccttgcagagttcgcatttagcctctacaggcagctggcacaccaaagcaattctaccaatatcttcttcagcccagtctccatcgcgacagcatttgctatgttgagcctgggaacaaaagcagatacacacgatgaaattctagagggtctcaacttcaacctgacagaaatcccagaagcacagatccacgaaggttttcaagaattgttgagaactctgaatcaacccgattcacaactgcagctgaccacagggaacggactctttcttagcgaaggactgaagctggtggataaatttctggaagacgtgaaaaaactttaccactccgaagcttttacagtcaacttcggggatacagaagaagctaaaaagcaaattaatgactatgttgaaaagggaacccagggaaaaatcgtcgatttggttaaagaactggatcgggatacagtgttcgcattagttaattacattttctttaaaggcaaatgggagaggccttttgaggtcaaggacacggaagaggaggactttcacgtagatcaagtgacaaccgtcaaggtcccaatgatgaagaggttaggaatgtttaacatccagcattgcaaaaaacttagttcctgggtccttctgatgaagtaccttgggaatgcaaccgctatcttctttctgcctgacgaggggaagttgcagcacttggagaacgagttgacccatgatatcattacaaagtttcttgagaacgaggaccgtcggtcagctagtctgcatctccccaagctgagcattacaggcacttacgatctgaaaagtgtgctgggacagctgggtatcacaaaagtcttctctaatggagcagacttatccggagtcacagaagaagctccactcaagctgtctaaagcagttcataaagctgtccttaccattgatgagaagggtactgaagccgcaggcgccatgttcctagaagctatccccatgagtattcctcccgaggtaaagtttaacaagccgttcgtgttcctcatgatcgaacagaacaccaagagccctctgttcatgggcaaggttgtgaatccaacacaaaaa

SEQ ID NO: 18681 - DNA, 1254 bp, Artificial Sequence
  Description of Artificial Sequence: Synthetic coding sequence
atgcctagcagcgtgtcgtggggcattctgcttctggcgggactgtgctgtcttgtgccggtgtcgctcgccgaggacccgcagggggacgccgctcaaaaaaccgacacgtcccaccacgaccaagatcaccctaccttcaacaagatcaccccgaacctcgccgagttcgccttttcactgtaccggcagttggcgcaccagtctaattcgactaatatctttttcagccctgtgtcgatcgcgacggccttcgcaatgctctcgctgggtactaaagccgatacccatgacgaaatcttggagggactcaacttcaatctcaccgaaatcccagaggcgcagatccacgaaggattccaagagctcctgcgcacccttaaccaaccggacagccaactccagctgactaccggaaacgggctctttctgtcggaaggactgaagctcgtggataagttcctggaggacgtaaagaaactgtaccatagcgaagccttcaccgtcaattttggagacacggaggaagccaagaaacagatcaacgactacgtggagaagggcacgcagggcaagattgtggacttggtgaaggaactcgatagggataccgttttcgccttggtgaactacattttcttcaaagggaaatgggaaagaccatttgaagtcaaggacaccgaagaagaggacttccatgtggaccaggtcaccactgtgaaagtcccgatgatgaagcgcctgggcatgtttaacatccaacattgcaagaagctgtcatcctgggtgctgctcatgaaataccttgggaatgcgactgcgatcttttttctcccggatgaaggcaagttgcagcacctcgaaaatgaactcactcatgacataatcacgaagttcctggaaaacgaggaccgcagatccgcgtcactgcatctcccaaagttgtcaatcactggtacttacgatttgaaaagcgtcctcggacagctcggaatcactaaggtctttagcaatggagcagacctctccggcgtgactgaagaagctccactgaaactgtccaaggccgtgcacaaggccgtgctcaccattgatgaaaagggaactgaagctgcaggcgctatgttcctggaggctatccccatgagcatcccgccggaagtgaagttcaataagcctttcgtctttcttatgatcgagcaaaacactaagtctcctcttttcatgggcaaagtggttaaccccactcaaaag

SEQ ID NO: 18682 - DNA, 1254 bp, Artificial Sequence
  Description of Artificial Sequence: Synthetic coding sequence
atgccttcctccgtcagttggggcattctgctgttggcagggctgtgttgtctggtgcctgtatcccttgctgaggaccctcaaggtgatgccgcacagaaaacagatacgtctcaccacgaccaggatcatccaacctttaataagattactcccaacttagcggaatttgccttctcactgtaccggcagcttgcacatcagtctaatagcacaaacattttttttagtccggtatccattgcgactgcatttgctatgttgagcttgggaacaaaagcggatactcatgacgagatcctggaaggcctgaacttcaaccttactgagattccagaagcacagatacacgagggcttccaggaacttctgcgtactctaaatcagccagactctcagttgcaactgaccacaggaaacggactcttcctgtccgaaggtcttaaactggtcgacaaatttttggaggatgtcaagaaactatatcactccgaagcatttaccgttaatttcggggacacagaagaggctaagaagcagataaacgactacgtggagaaaggaacgcagggtaaaatcgttgatctcgtcaaagagcttgatcgcgataccgtgttcgcactggtcaattacattttcttcaaaggcaaatgggaacgaccctttgaggtaaaggacaccgaggaggaggatttccacgtcgaccaagttacgaccgtgaaagtcccaatgatgaagagactgggtatgttcaacatccaacattgcaaaaaactctccagttgggtgctgctaatgaaatatctcgggaatgccaccgctatcttttttctgccagatgagggaaagctccaacacctggaaaatgagttgacccatgatataatcacgaaatttctggaaaatgaggaccgcaggagcgccagcctgcatttacctaagctgagtataaccggcacctacgatctcaagtcggtcctgggccagctcggaatcacgaaggtttttagcaacggcgctgacttgagcggcgtgacggaggaagccccattgaagctgtctaaggccgttcacaaagcagttctcactatagatgaaaaaggaaccgaagccgcaggcgcaatgttcctggaagctatccccatgtcaatacccccagaggtgaagtttaacaaacccttcgtattccttatgatcgagcagaatacaaagtctcctctcttcatggggaaggtcgtgaacccaactcagaag

SEQ ID NO: 18683 - DNA, 1254 bp, Artificial Sequence
  Description of Artificial Sequence: Synthetic coding sequence
atgcccagctcagtgtcatggggcatcctgctccttgccggactgtgctgcttggtgcccgtgtccctcgcggaagatcctcaaggtgacgcggcccaaaagaccgatacctcgcaccacgaccaagatcaccccactttcaacaaaatcacgccaaaccttgctgaattcgctttctccctgtatcgccagctggctcaccagtccaactccaccaatatcttcttcagcccagtgagcatcgcgaccgcgttcgcgatgctgtccctcggaaccaaggcggacactcatgacgagatcctggaaggactgaacttcaatctgaccgaaatcccggaagcacagatccacgagggatttcaagagctgctccgcactctcaaccaacctgatagccagctccagttgaccactggaaatgggcttttcttgagcgagggcttgaagctcgtggacaagtttctggaggacgtgaagaagctctaccattccgaggccttcaccgtgaactttggcgacaccgaggaagcaaagaagcaaatcaacgactacgtggagaaaggaactcaaggaaaaatcgtggacctggtgaaggagctcgaccgggacactgtgttcgcgctggtgaattacatcttcttcaagggaaagtgggagcgcccattcgaagtgaaggataccgaggaggaagatttccacgttgatcaggtgactactgtcaaggtgcctatgatgaaaaggctcggtatgttcaacatccagcactgcaagaaactgtcctcatgggtcttgctcatgaaatacctgggtaatgccactgctatcttcttccttcctgacgaaggaaagctccaacacttggaaaatgagctgactcacgacatcatcaccaaattcctcgaaaatgaggatagacgctcagcgtcgctgcacctcccaaagctctcaattactggaacctacgacctgaagtcggtgctgggacaactgggaatcactaaggtcttttcaaatggcgcagacctgtcgggggtgaccgaagaagccccactcaaactctccaaagccgtgcacaaggcggtccttaccatcgacgagaaaggaaccgaggccgcaggcgccatgttcctggaagcgatccccatgtctatcccaccggaggtgaagtttaacaagccgttcgtgttcctgatgatcgagcagaacaccaagtccccactgttcatgggaaaagtagtgaacccgacgcagaag

SEQ ID NO: 18684 - DNA, 1254 bp, Artificial Sequence
  Description of Artificial Sequence: Synthetic coding sequence
atgccaagcagcgtctcctggggtattttgctgcttgcgggattgtgctgtctcgtgccagttagccttgccgaagacccgcagggcgatgcagcccagaaaacggatacgtcccaccatgaccaagatcacccaacattcaacaagatcacccctaatctggccgagtttgcattttcgctatacagacagctcgcccatcagtcaaattccactaacatctttttctctccagtctctattgccacagccttcgcaatgctcagtcttggtaccaaagcagacacccatgacgaaattctggagggtctcaactttaatctgacggaaatccccgaagcccagatccacgaagggttccaggagttattaagaaccctgaaccagcccgactcccagcttcagctgaccacagggaacggcctgttcctgtctgaaggactgaagcttgtggacaaatttctggaagacgtgaaaaagctttatcattcggaagcatttacggtgaatttcggcgacaccgaggaggccaaaaagcaaataaacgactacgtcgaaaaggggactcaagggaaaatcgtggatttggtgaaggaattagatcgcgacactgtgtttgctttggtcaactacatattttttaaaggcaagtgggaaagacctttcgaagtcaaggatacagaggaggaagatttccacgttgaccaagtgacgacagtcaaagtgcctatgatgaagcgactggggatgtttaacatacagcattgtaaaaaactgtcttcatgggtgcttctgatgaagtatctgggaaacgcaactgcgatttttttcttacctgacgaaggcaagctccagcacctggaaaatgagctaactcatgatattattacgaaattcctggagaacgaggatcgaaggtcagcctctcttcaccttccgaaactgagcatcacagggacctatgatttgaaatccgtgcttggacagctgggaatcacaaaggtcttttctaacggcgctgatctttctggggtcacggaggaggcaccactaaaattatctaaggctgttcataaagctgtcctgaccatcgatgaaaaagggactgaggcggccggtgccatgttcctcgaggccatcccaatgagtatacctcccgaggtcaagttcaacaaaccttttgtcttcctcatgatcgaacagaacaccaaatcccccctgttcatggggaaggttgtgaatcctacccagaag

SEQ ID NO: 18685 - DNA, 1254 bp, Artificial Sequence
  Description of Artificial Sequence: Synthetic coding sequence
atgccgagtagcgtcagctggggcatcctgctcctcgccggtctgtgctgcctcgtccctgtgtcgctggccgaggacccccagggagacgcggcacaaaagaccgacacttcgcatcacgaccaagaccaccctaccttcaacaagatcacccccaacctggcagagttcgccttcagcctgtaccgccagttggcccaccagtccaattctaccaacatcttcttctcgccggttagcatcgctaccgcattcgcaatgctgtccctcggaactaaggcagacactcacgatgaaatcctggaaggacttaacttcaacttgactgagattccggaagcacagatccatgagggcttccaagaattgctgcgcactctgaatcagccggacagccagctccagctgactaccggcaacggactttttctgtcggaggggcttaagctggtggataagttcctggaggacgtgaaaaaactctaccacagcgaagcatttactgtgaacttcggtgataccgaagaagctaagaagcagattaacgattacgtcgagaagggaacgcaaggaaaaatcgtcgatcttgtcaaggaacttgatcgggatactgtgttcgcgctcgtgaactacatcttcttcaaggggaagtgggagcgacctttcgaggtgaaggatactgaagaggaggactttcacgtcgatcaagtcaccaccgtgaaggtcccgatgatgaaaaggctggggatgttcaacatccaacattgtaagaagctctcatcgtgggtgctgctcatgaaatatctcggaaacgccactgcaatcttcttcctcccagatgagggaaagttgcagcatctcgaaaacgaactcactcatgatatcattaccaaattcctggagaacgaggaccgccgctcagcctccctgcatctgcctaaactctccatcaccggaacttacgacctgaaatcagttctcggacaactgggaatcacgaaggtattctccaacggagcagacctgtcgggagtgaccgaggaagcacctctgaagttgtctaaggcggtccacaaggcagtgctcaccattgacgaaaaggggactgaagcggctggagctatgttcttggaagcgatcccgatgtcaatcccgccggaggtcaaattcaataaacctttcgttttcctgatgatcgagcagaacaccaagagcccactgtttatgggcaaggtcgtgaacccaacccaaaaa

SEQ ID NO: 18686 - DNA, 1254 bp, Artificial Sequence
  Description of Artificial Sequence: Synthetic coding sequence
atgccctctagtgtttcatggggaatcttacttttggctgggctctgctgtctggtgccagtgtctctcgccgaagatccacagggggatgccgcacaaaaaacggacacaagccatcacgatcaggaccatcccacttttaacaagataacccccaacctcgctgagtttgccttcagcctctatcggcagctggcccatcaatccaacagcaccaacattttctttagccctgtcagcatcgctaccgcttttgcaatgctctctttaggaactaaggccgacacccacgatgaaattctggaggggcttaacttcaaccttacagaaatcccagaggctcagatacatgaggggttccaggagctgctgagaacattgaaccaacctgattctcagctgcagctcaccactggcaacggcctgtttctgtccgaagggctgaaactggtggataaatttctggaagatgtcaagaagctctaccacagcgaggcctttacagtgaactttggggacaccgaggaggctaagaaacagatcaacgactacgtcgaaaaaggaactcaggggaagatcgtcgatctggtcaaagaactcgaccgagatacagttttcgccttggttaactacatatttttcaagggcaaatgggagagacctttcgaggtgaaggacaccgaggaagaagattttcatgtggatcaggtaactaccgtgaaagtgcctatgatgaagcgcctgggcatgttcaatattcaacattgtaaaaaactctcttcgtgggttttactgatgaagtatcttggcaacgccaccgctatcttcttcctgcctgatgaaggcaaactgcagcacttagagaacgagctcacccatgacattatcactaaatttttggaaaatgaggatcgtcgcagcgcatccctgcacctgcccaagctgtccatcaccggaacatacgatttgaagagcgtcctgggacagttgggcattacaaaggtgtttagtaacggagccgatctcagcggagtgaccgaggaggcccctctgaagctctctaaggcagtccacaaagcagttctgacgattgacgaaaagggcaccgaagcagctggagccatgtttcttgaggccataccgatgtcaattccaccagaggtcaaatttaacaaacctttcgtctttttgatgattgagcaaaacaccaaatcaccgctgttcatgggtaaggtggtgaacccgacccagaag

SEQ ID NO: 18687 - DNA, 1254 bp, Artificial Sequence
  Description of Artificial Sequence: Synthetic coding sequence
atgccgtcttctgtttcttggggcattctgctcctggcagggctgtgttgtctagtgccagtgtccctggccgaggaccctcagggcgacgcggctcaaaaaacagatacctctcaccacgatcaagatcatccgactttcaataagattacccccaatctagctgaatttgcattcagtttgtatagacagctcgcccaccagtcaaattccacgaatatattctttagtccggtcagcatagctacggccttcgctatgctgtctctgggaaccaaggcagacacacatgacgagatccttgaagggctaaactttaacttaacagagatccccgaggcacaaatccacgagggctttcaggaactcctgcgcactctgaaccagccagacagccagttgcagctcaccaccggaaatgggctctttttgagtgaggggctcaagttggttgataagtttctagaggacgtgaaaaagctctaccactcagaggctttcaccgttaatttcggagacacggaggaggctaaaaaacagataaatgactatgtggagaaaggtacccaaggcaagattgtggatctcgtaaaagagcttgatcgcgatacggtttttgctctggttaactacatcttctttaagggaaagtgggaacgtcctttcgaggtgaaagataccgaggaggaggatttccacgtggaccaggtgacaactgtgaaggtgcctatgatgaaaaggctggggatgtttaacattcagcactgtaagaagttgtcttcttgggtgctgcttatgaagtacttggggaatgcgactgctattttcttcttgcccgatgagggtaagctgcaacacctggagaatgagcttactcatgacatcattacaaaatttctcgaaaacgaggaccgcaggagtgcgtccctacacctgccaaagctgtccattacggggacatacgacctgaagagcgtgttagggcagttgggcatcactaaagtattttcaaatggtgcagacttatccggagtgaccgaggaggccccgttgaaactgtctaaagctgttcacaaagcagtgctgacgatcgacgaaaaggggactgaagcagcaggtgccatgtttctggaggctatcccaatgagcatcccccccgaggtgaagttcaacaaaccattcgtcttcctgatgatcgagcagaacaccaagagtccactctttatgggtaaagtggtcaatccaacccagaag

SEQ ID NO: 18688 - DNA, 1254 bp, Artificial Sequence
  Description of Artificial Sequence: Synthetic coding sequence
atgccttcgtccgtgtcctggggaatccttctgttggcagggctttgctgtcttgtgcctgtgtccctggcagaggatccccagggggatgcggcgcagaaaactgatacttcccatcatgaccaagaccatcccacgttcaacaaaatcaccccgaacctggcagaattcgcattttcgctttacagacaacttgcccaccaaagcaatagcacgaacatattctttagcccagtgagcatcgcgactgcattcgcaatgctttccctcggtaccaaggcagacacccatgatgaaatactggaaggacttaactttaacctgactgagattccagaagcgcaaattcacgaaggattccaagaactgctgagaactctgaaccaacctgattcccaactgcagctgactactggaaacggactgttcctgagcgagggtcttaaacttgtcgataagttcctcgaggatgtgaagaaattgtaccacagcgaggcgttcaccgtgaatttcggcgatactgaggaagcaaaaaagcagataaatgactacgtcgagaagggaacgcaaggtaagatcgtggatctcgtcaaggaactggatcgagatactgtgtttgcgcttgtgaattacatcttctttaaaggaaaatgggaaagaccttttgaagtgaaagacaccgaggaagaggactttcacgtggatcaggtgacgactgtcaaggtgccaatgatgaaacggcttgggatgtttaacattcagcactgtaagaagctgtcatcctgggtgctgctgatgaagtacctggggaacgcaaccgccattttctttctccccgatgaaggcaagctgcaacatcttgagaatgagctgactcatgacataatcaccaagttcctggaaaatgaagataggagatccgcatccctccatctcccaaagctgtccataaccggaacttacgatcttaagagcgttctgggacagttgggaattacgaaagtcttttcgaacggcgcagatctgtcaggagtgaccgaagaagcgcctcttaagctctcaaaggccgtgcataaagcagtgctcactattgatgaaaagggaaccgaggcagcaggcgcaatgtttctcgaagcaatccccatgtccatccctcccgaagtgaagtttaacaagccttttgtgttcctgatgatcgaacaaaacaccaagtctccgctcttcatggggaaggtagtcaatccaactcagaag

SEQ ID NO: 18689 - DNA, 1254 bp, Artificial Sequence
  Description of Artificial Sequence: Synthetic coding sequence
atgccctctagtgtgtcctgggggatcttgctgctggccggcctctgctgcttggtgcccgtgtccctcgctgaagatccacagggggatgctgctcagaagaccgatacctcccaccatgatcaagaccaccctacgttcaacaagattacacctaacctggcagagttcgccttttccctttatcgacaactggcccaccagtccaattccactaatatctttttttcccctgtaagcattgcaaccgccttcgcaatgctgagcctgggtacgaaagcggacacccacgacgagatactggagggcctgaacttcaatcttacggagattcctgaggcccagattcacgaggggtttcaggaactgctgagaactcttaatcagccagactctcagctccaactaaccacaggtaacggtctctttctcagcgaggggctcaagctggtggacaagttccttgaggacgtaaagaagctgtatcacagcgaagctttcactgttaacttcggagacacagaggaggcgaaaaaacagattaacgattacgtggagaaaggaacccaagggaagattgtcgatctagttaaagagctggatcgggataccgtcttcgccttagtgaattatatcttcttcaagggtaagtgggagcgaccgtttgaagtgaaagacaccgaggaagaggattttcatgtggaccaggttaccacagttaaagttcctatgatgaaacgcctgggcatgtttaacattcagcattgcaaaaagctgagctcctgggtcctcttgatgaaatatctgggcaacgctaccgccatcttcttcctgcctgacgaaggtaaattgcagcatctcgagaacgagttaacacatgacataattacaaaatttctggagaatgaggatagaaggtccgcttctctgcacctcccgaagctcagtataacagggacttacgatcttaaaagcgtgcttgggcagttgggcataacaaaggttttctccaatggagccgacctttccggggtgacagaggaagcccctctcaaactctccaaggcagtgcacaaggcagtgctaaccattgatgagaagggaactgaagctgcaggtgcaatgttcctggaagcgataccaatgtctattcccccagaggtcaaatttaataaaccattcgtgtttctgatgattgagcagaataccaagtcccctctttttatggggaaggtcgtcaatccgacgcaaaag

SEQ ID NO: 18690 - DNA, 1254 bp, Artificial Sequence
  Description of Artificial Sequence: Synthetic coding sequence
atgccttcaagcgtgagctggggtattctgttgctagcaggcttgtgttgtctggtgcctgtgtccctcgctgaagatccacagggagacgccgcccagaaaacggatacatcacatcacgaccaggaccaccccactttcaataaaattactccaaacttggcagaattcgccttcagtctctatcggcaacttgcccaccagagcaatagtacgaatatattcttctccccagttagcatcgcaacggcttttgcaatgctgtctctgggcaccaaggccgacacccatgatgaaattctcgaaggcttgaatttcaatctaaccgagattcctgaggctcagatccacgaggggtttcaagaactattgcgcaccctgaaccagcctgacagtcaactccagctaaccactggtaatggactcttcctatcagaaggccttaagcttgtcgataagttcttggaagatgtcaaaaagctttatcacagcgaagccttcacagtcaacttcggcgatacggaggaggcaaagaagcaaattaacgattacgtagaaaaagggactcaagggaaaatcgttgacctggtgaaagaattggatcgagatacagtgtttgcccttgttaactatattttttttaagggtaaatgggaaagacctttcgaggtaaaggatactgaagaggaagatttccatgtggatcaggtcaccacggtgaaggtccccatgatgaaacgcctggggatgttcaacatccagcattgcaagaagctgagctcatgggtgctcctgatgaagtacttaggaaatgccacagcaatattctttctgcccgatgagggcaagctacagcatctagaaaacgaattgactcatgacatcatcactaagtttctcgagaacgaggacagaagaagcgcctctctgcacctgccaaaattgtccatcacggggacttacgaccttaagtcggtcctcgggcagttaggcatcaccaaggttttcagcaatggagccgatctgagcggcgtgactgaagaggcaccgctcaagctgagcaaagccgtgcacaaggccgtgttaactatcgatgagaaaggtactgaagccgcaggcgcaatgtttctggaagcgatccctatgagtattcccccggaagtgaagtttaacaagcccttcgtctttttaatgatagagcagaacactaaatctccactgttcatggggaaggttgttaacccgacacagaaa

SEQ ID NO: 18691 - DNA, 1254 bp, Artificial Sequence
  Description of Artificial Sequence: Synthetic coding sequence
atgccttcctctgttagctggggtatactactgctggcgggactttgttgtctagtgccagtgagtttggcagaggatccgcaaggggacgctgcccagaagaccgacacatcccatcacgaccaggaccatcctacattcaataagataacaccaaacctggcagagtttgccttctctctgtacaggcaactggcgcatcagagtaattccaccaacatcttcttttctccagtgtcgattgctacagcattcgccatgctttcattggggacaaaagccgacacacacgacgagattctagagggcctaaactttaatctcactgaaatacctgaagctcagattcacgaagggtttcaggagttacttagaacactgaatcagccagactcacagctacagcttacaacaggaaatgggttattcctctccgaaggactgaaactggtggacaagttcttggaagatgtcaaaaaactgtatcattctgaggcttttacggtcaatttcggggacacggaagaggctaagaagcaaattaacgattatgttgagaagggaacacagggaaaaattgtggatctcgtcaaggagctggatcgagatacagtgttcgccctagttaactacatcttcttcaaggggaaatgggaacgccctttcgaggtaaaagacactgaagaggaagatttccatgtcgaccaggtgactacagtgaaagtcccaatgatgaagcgtctgggtatgttcaatattcagcattgcaagaagctgtcctcctgggtcttactgatgaagtacctcgggaatgcaaccgctatattctttttacctgatgaaggcaaactgcagcacctggagaatgaactgacccacgatatcataaccaagttcttggaaaatgaggaccgcagaagcgcctccctgcatctgccaaagctgtcaatcactggaacttatgacctcaagagcgtgctgggacagttgggcataacaaaagtgttctctaatggtgccgatctgtccggcgtcaccgaggaagcaccactgaagctgagtaaggctgttcataaagccgtgctcacaatcgatgagaaagggactgaagccgccggggctatgttcctagaagccatcccgatgtctatcccccccgaggttaaatttaacaagccctttgtgtttttaatgatcgaacagaacacgaaatctcccctcttcatgggaaaggtcgtgaaccccacccagaaa

SEQ ID NO: 18692 - DNA, 1254 bp, Artificial Sequence
  Description of Artificial Sequence: Synthetic coding sequence
atgccttcatccgtctcatgggggattctcctgctggcgggcctctgctgtttagtgccagtgtcactagcggaggatccacagggggatgcggcccagaaaacagacacaagccatcacgaccaagatcatccgaccttcaataaaattacccctaatcttgccgaatttgctttttctttatataggcaactcgctcatcaaagcaactctacaaacatctttttttctccagtgagcatagctacggctttcgccatgttgtctttgggcactaaagccgatacgcatgacgagatactcgagggtcttaattttaatctgaccgaaattcctgaggcgcagatccatgaaggctttcaggaattgctgcgcactctgaaccagccagactctcagttacagcttactacgggaaatgggttatttctgtccgaaggattaaaattagtggacaaatttcttgaagacgttaaaaaattatatcatagcgaagcatttaccgtgaattttggcgacacagaagaagcgaaaaagcagataaatgactatgtggaaaaagggacacaggggaagattgtcgatttagtcaaggaattagaccgggataccgtttttgccctggtgaactacatcttttttaaaggaaaatgggaacgcccgtttgaagtaaaggatacggaggaagaagactttcatgtagatcaagttacaacggtcaaagttccaatgatgaaacgcctgggaatgttcaacattcaacattgtaagaaacttagctcctgggtactgctgatgaaatacttaggaaatgcgacagccattttctttctgccagacgaaggcaaacttcaacatctagaaaatgaacttacgcacgatattatcacaaaattcttggaaaacgaagatcgccgaagcgcatctcttcacctgccgaaactttctatcacaggtacgtatgatttaaagtctgttctgggtcaactcgggattacaaaggtcttttcgaatggcgctgacctgtctggggtgactgaagaagcgccgttgaaactttctaaagccgtccacaaagcagttctgacaattgacgaaaagggcacagaggccgctggcgcgatgtttctggaagctattcccatgagcattccaccagaagtaaagttcaataaaccgtttgtatttcttatgattgaacagaacacgaagtcaccactttttatgggcaaagtcgttaacccaacacaaaaa

SEQ ID NO: 18693 - DNA, 1254 bp, Artificial Sequence; identical to SEQ ID NO: 18635
  Description of Artificial Sequence: Synthetic coding sequence

SEQ ID NO: 18694 - DNA, 1254 bp, Artificial Sequence
  Description of Artificial Sequence: Synthetic coding sequence
atgccaagtagcgtgagttggggaatcctcttacttgccggtctatgttgtctggttccagtatcactggccgaagacccgcaaggcgatgcagcacaaaagaccgatacatcccaccatgatcaggaccatcctacattcaacaagataacccccaacctcgccgagttcgccttttcactataccgccagctcgcacaccagagcaattccactaacatattcttttcgcctgtaagcattgctaccgcttttgcaatgttaagcctcggaaccaaggctgacacccacgatgagattttagagggactgaatttcaacctcaccgaaatccctgaggcacagatacatgagggcttccaggaactgctgagaaccctcaatcagcctgatagccaactccaattgactactggcaacgggctctttctttccgagggattaaaactggttgataagtttttagaggacgtgaaaaaattatatcactccgaggccttcactgttaattttggtgacaccgaagaggccaaaaagcaaatcaacgattacgtggaaaagggaacccagggcaaaattgttgacttagtcaaggaacttgatagggacacagtgttcgccttggtgaattacatattctttaagggcaagtgggaaagaccatttgaggtgaaggacactgaagaagaagatttccacgtggatcaggtgacgacagtaaaggtcccgatgatgaaaagactgggcatgtttaacatccaacattgtaagaaactgtcctcatgggttctgctgatgaagtaccttggcaatgccactgccattttctttcttcccgacgaaggaaagctccagcacctggagaacgagctcactcacgacatcatcaccaaattcctggagaacgaggaccgccggagcgcatcacttcacctgcccaagcttagcattactggaacatatgatcttaaaagtgtcctcggacagcttggtatcactaaggtgttcagcaacggcgccgatctgagtggagttacagaagaggcacccctcaaactgagcaaagccgttcataaagctgttctgaccatagacgagaaggggactgaagccgcaggagccatgtttttggaggcaatccccatgagcattccccctgaggtgaagtttaacaagccgttcgtattcttgatgatcgagcagaacaccaagtcgccactcttcatgggtaaggtcgtcaaccccacccagaag

SEQ ID NO: 18695 - DNA, 1254 bp, Artificial Sequence
  Description of Artificial Sequence: Synthetic coding sequence
atgccaagtagtgtgagctgggggattttgctgctggctgggctgtgctgtttagtgcctgtatccttggctgaagaccctcagggtgacgctgctcaaaagacggacacatctcatcacgatcaggaccatccaacatttaacaagattactcccaatcttgctgagttcgcattctcgctctaccggcagctggctcatcaatccaacagcacaaacatttttttctctccggtcagtattgccacggccttcgccatgctttcactgggaactaaggctgacacccacgacgagatccttgagggactgaattttaaccttactgagatcccagaagcccagatccacgaagggttccaggagttgcttaggacactgaaccagcctgattcacagcttcaactgactacgggcaatggcctctttctctctgaaggcctcaaactcgtggacaaatttcttgaagacgtgaagaaactctatcattccgaagcctttaccgttaattttggggatactgaagaggccaagaagcagatcaacgattacgtggagaagggaacccagggcaaaatcgtggatctagtcaaggagctggatcgagacactgtctttgccctagtcaactacatctttttcaaaggcaagtgggaaaggccgtttgaggtgaaagacaccgaagaggaggattttcacgtcgatcaggttacaactgtcaaagtgccaatgatgaagcgtctgggaatgtttaacatacaacattgcaagaagctatcttcgtgggtgctcttaatgaagtatctcggaaacgccaccgccatcttctttctgccagatgaagggaagctacagcacctggagaacgagcttacccacgacatcatcacgaagttcctcgagaacgaggaccgtcgctctgcttcactccatcttcctaagctgagcatcaccggcacttacgatttgaagtccgtactgggccagctgggaattactaaggttttcagtaacggggccgacctcagcggcgtcactgaggaggccccactcaaattgagcaaagctgtccacaaggccgtgttaactatcgacgagaaaggaacggaggctgcaggcgctatgttcctggaggcaatccccatgtcgattcctcctgaagtgaaatttaacaagccctttgttttcctgatgatcgagcagaacaccaagagtcccctcttcatgggtaaggtggtaaatcccacccagaag

SEQ ID NO: 18696 - DNA, 1254 bp, Artificial Sequence
  Description of Artificial Sequence: Synthetic coding sequence
atgcctagctcggtcagctgggggattctgctgctggccggtctttgctgtttggttcctgtgtcgcttgccgaagatcctcaaggagatgcggcacaaaagaccgatacgtctcatcatgaccaggatcatcctacttttaacaagatcactcctaacctggccgagttcgcatttagcctgtaccgtcagctcgcccatcagagcaactcaaccaacattttcttctcgccagtgtcaatcgcaactgcatttgcgatgctgtcacttggtaccaaagcagacactcacgatgaaattctcgaaggactgaatttcaacttgaccgaaattcctgaggctcaaatacatgaaggtttccaggagctgttgagaaccctcaaccaaccagactcgcaactgcaactgaccactggaaacggactgtttctttcggagggtcttaagctggtggataagttcttggaggacgtgaagaaactttaccactccgaagcatttactgtcaattttggagacactgaagaggcgaagaagcaaatcaatgattacgtggagaaaggcactcaaggcaaaattgtcgaccttgttaaggaacttgatcgtgatactgtctttgcccttgtcaattacatattctttaaaggaaagtgggaacggcctttcgaagttaaggacaccgaagaggaagattttcacgttgatcaggtcactactgtcaaggtccccatgatgaaaaggctcgggatgtttaacattcagcattgtaagaaactcagctcatgggtcctgttgatgaaatatctgggcaatgcaaccgccatattcttccttccggatgaaggaaaacttcaacacctggaaaacgaactgacgcatgatatcatcactaagtttcttgaaaacgaagatcggagatcggcttctctgcatcttcctaagctgtcaattacgggaacttacgacttgaagtccgtccttggtcaacttgggattactaaggtgttctcaaacggagctgacctgtcgggagtcaccgaagaagcaccgctcaagctctccaaggccgtccacaaggcagtgctcaccatagacgaaaaaggtaccgaagcagcaggtgcgatgtttcttgaagcaatcccaatgtcaattcctccagaggtgaagtttaacaagccttttgtctttctgatgatagagcaaaacaccaaaagcccgctcttcatgggcaaggtagtcaatccaacccaaaaa

SEQ ID NO: 18697 - DNA, 1254 bp, Artificial Sequence
  Description of Artificial Sequence: Synthetic coding sequence
atgccttcctcggtgagctggggcatccttttgctggcaggtctgtgttgtcttgtcccggtgtccctcgcagaagatcctcaaggtgacgcagcccaaaaaactgacaccagccatcatgatcaggatcaccctacctttaacaagattacgcccaatctggcggaattcgcattttcgctgtatcgccaactggcccaccagtcgaactcaaccaatatcttcttctcccctgtgtccattgccaccgcatttgcaatgctttctcttggtaccaaagccgacacccatgacgaaatcctcgagggactgaatttcaacctcaccgaaataccagaggcccaaatccacgaagggtttcaagaactgctgcgtaccctgaaccagccggattcacaactgcagcttaccaccggaaatggtctttttctctctgaaggccttaagctcgttgacaagtttcttgaagatgtgaagaaactttaccattcggaggcattcaccgtcaactttggtgatactgaggaggcaaagaaacagataaatgactacgtggaaaagggcacccagggaaagattgtcgatcttgtgaaagaacttgatcgagacaccgtgttcgcactcgtgaattacatattcttcaagggcaagtgggaaagacctttcgaagtcaaggataccgaagaggaggattttcacgtggatcaggtcacgactgtgaaggtcccaatgatgaagcgcctgggtatgttcaacattcagcattgcaagaaattgtcgagctgggtgcttctgatgaagtatctgggaaacgctacggctatcttctttctgccagacgaggggaagctgcaacatctcgaaaacgaactgacgcatgacatcatcactaagttcctcgagaacgaagatagaaggagcgcatcgttgcaccttccgaagctctctattactggcacctacgatctgaagtcagtcctgggacaactcgggatcactaaagtgtttagcaatggtgcagatctgtcgggagtgaccgaggaggcccccctcaagctcagcaaagccgtgcataaagcggtgctgactatagacgaaaagggaactgaggctgcaggagccatgtttcttgaagcaattccaatgagcatacccccggaagtcaagtttaacaaaccgtttgtctttctgatgattgagcaaaatactaaatcgccacttttcatgggcaaggtggtgaacccaactcaaaag

SEQ ID NO: 18698 - DNA, 1254 bp, Artificial Sequence
  Description of Artificial Sequence: Synthetic coding sequence
atgccctcctccgtgtcctggggaatcttattactcgcaggtctctgctgtctggtacccgtttcactggcagaggatccccagggagacgcagcacagaagacggatactagccaccatgaccaggaccaccctaccttcaacaagatcactcccaatctcgcggaatttgcattttcactgtatcgccagctggctcaccagtcaaactccaccaatattttcttcagccccgtaagcattgccaccgcttttgccatgttgagtctgggcactaaagcagacactcacgatgagatcctggagggcctaaactttaacctgacagagatccctgaagcacaaattcacgaaggatttcaggagcttctgaggacacttaatcagccagatagtcaactgcaactcactactggtaacggcctctttctgtccgaagggcttaaactcgtggacaaattcttagaagacgtgaagaaactgtaccacagcgaggcctttaccgtcaattttggggacacagaagaagccaagaaacaaatcaatgattacgtggaaaagggcactcaaggcaaaatagtcgacctggtcaaggaacttgacagagatactgtgttcgcgcttgtcaactacatcttctttaagggaaagtgggagaggcctttcgaggttaaggacaccgaagaggaggattttcatgttgatcaggtgacaaccgtaaaagtaccaatgatgaaaaggttgggaatgttcaacattcagcattgtaaaaaactgtccagctgggtcctgctgatgaagtatctgggtaacgcaaccgccatcttcttccttcctgacgaagggaaactccagcaccttgagaatgagcttacacatgacataattaccaaattcctcgagaatgaggaccgtcggagcgcaagtctacacctgcccaagctttctattaccgggacgtatgaccttaagtctgtcctgggccaacttgggattacaaaggtgttctcgaatggggcagacctgtcgggagttaccgaggaagcaccattgaaactgagtaaggctgtacacaaggcagttttgaccatcgacgagaagggtacagaggccgccggggccatgtttctggaggccatccctatgagcattcctccggaagtaaaatttaataagcctttcgtattcctcatgattgagcagaatacaaagtcaccactcttcatggggaaggtcgtcaaccctactcagaaa

SEQ ID NO: 18699 - DNA, 1254 bp, Artificial Sequence
  Description of Artificial Sequence: Synthetic coding sequence
atgcctagcagcgtgagctggggtattcttcttctcgccggcctttgctgtctagtgcccgtgtcactggctgaggaccctcagggtgacgcagcccagaaaactgatacttcgcaccacgaccaagatcaccctacttttaacaagattacccctaatctggcagagttcgccttctccctgtaccggcaattggcccatcagtccaactcaacaaacatcttcttctccccggtgagtatcgcaacagcattcgcaatgctaagcctcgggacaaaggcagatacacacgatgagatccttgaagggctcaatttcaatctgacagagataccggaggcccagatccacgaggggttccaggagctgctgagaacactcaaccagcctgattcgcagctgcaactgacgaccggaaatggccttttcctgtctgagggtttaaagttagtcgacaaattcttggaggacgtcaaaaaactgtaccactccgaggcgtttacagtgaacttcggcgatacagaagaagccaagaagcagatcaatgactacgtggaaaagggcacccagggcaaaattgtggacttggtcaaggagcttgaccgagacactgtgtttgcgctggtgaactacatcttctttaaggggaagtgggagcggcccttcgaagtgaaagacaccgaggaggaggatttccacgtggaccaggtcaccacagtgaaggtgcctatgatgaagcgactggggatgttcaatatccagcactgtaaaaagctgtcctcatgggtcctgctaatgaagtacttaggaaatgccacggcaattttttttctcccagatgagggaaagcttcagcatctggaaaatgagcttacccatgacatcatcaccaaattcttggagaacgaggatcgccggtctgcgtccctgcatcttcccaagttgtccataaccgggacatacgatctcaagagcgtcctggggcagttgggtatcacgaaagttttctcgaacggtgcagacctttccggggtcacggaggaagcccctctgaaactctcaaaggctgtccacaaagcagttttaactatcgatgaaaaggggaccgaggctgccggagcaatgtttctagaagccatacctatgagtatcccacctgaagttaagttcaacaagccattcgtattcctcatgattgagcagaacaccaagtcccccctgtttatgggtaaagttgtcaatccgacccagaag

SEQ ID NO: 18700 - DNA, 1254 bp, Artificial Sequence
  Description of Artificial Sequence: Synthetic coding sequence
atgccctccagcgtgtcctgggggattttgctcctcgcgggcttatgttgccttgtgcccgttagtttagcggaagaccctcagggggatgccgctcagaagacagacacctcccaccacgatcaggaccaccccacttttaataagatcacccccaatctcgcagagtttgctttttccctataccggcagttggcgcaccagtccaacagtaccaacattttcttctcgccggtcagcattgcaactgcctttgccatgctttcactcggcaccaaagccgatacgcacgacgagatccttgagggactcaacttcaacttgaccgagatcccggaggcccagatccatgaggggtttcaggagctcttgcgtacccttaaccagcctgactcccagttacagctcaccaccggcaatggcttgtttctgtccgagggtctgaagctggtcgacaaattcctggaggacgttaagaagctctaccattctgaggctttcaccgtcaactttggcgataccgaggaggctaagaagcaaataaacgactatgtggagaaggggactcaaggcaagatcgtcgatttagtcaaggaactggaccgcgacaccgtcttcgcacttgtcaattatattttcttcaaaggcaagtgggaacgccctttcgaagtcaaggacacggaggaagaggactttcacgtcgatcaggttaccacggttaaagtacccatgatgaagaggctcggcatgttcaacatacagcactgcaagaagcttagttcctgggtcttgttgatgaagtaccttgggaatgctacagccatcttcttcttgccggatgagggcaagctgcagcaccttgaaaatgaactgacccatgatatcattacgaagttcttggagaatgaggatcgtcgctccgcaagcctgcacttgcccaagctctccataactggtacctacgatcttaagtctgttctgggccagctggggattacaaaggtgttctcaaacggtgcggacctctccggcgttacggaggaagcccccctgaagctgtctaaggccgtgcacaaggcggtgcttactatcgatgagaaaggtacggaggcggctggcgcgatgtttctcgaagcaattccgatgagtatcccccctgaggtcaagtttaacaagccctttgtgttcctcatgattgagcagaacactaaatccccgctgttcatgggcaaggttgtcaaccccacccagaaa

SEQ ID NO: 18701 - DNA, 1254 bp, Artificial Sequence
  Description of Artificial Sequence: Synthetic coding sequence
atgccaagttcagtgtcttggggtatcctgctgctggccgggctttgttgtctggtgccagtgtccctggccgaggatcctcagggcgatgcagcgcagaagactgacaccagtcatcacgatcaggaccacccgacattcaataagatcacccccaacctggccgaattcgcattcagtctgtatcgacagttggcccaccagtctaacagcaccaacatcttttttagtcccgtgagtatcgccactgcttttgcgatgttgagcctcgggacaaaggctgacacccacgacgagattttggaaggacttaactttaaccttaccgaaatcccagaagcacagatccatgagggttttcaggaactgctgcggaccctgaaccagccagactctcagttgcagctgacgactggcaatggattgtttctgtccgaggggctcaaactggtggataagtttctcgaagacgttaaaaaattgtaccacagcgaggcatttacagtgaacttcggcgacaccgaagaggccaaaaaacagatcaacgactatgtggaaaagggcacacaaggcaagattgtggatctggttaaggagttggacagggacaccgtatttgccctggtgaactacatcttcttcaaggggaagtgggaacgcccgttcgaggtgaaagacaccgaggaggaagacttccatgtcgaccaggtcaccaccgtcaaggttcccatgatgaaacgcctgggtatgttcaacatccagcactgcaagaaattgagcagctgggtattgctgatgaagtatctgggcaacgccaccgccattttttttcttcctgatgagggaaagttgcaacacctggagaacgaactgacccacgacataatcactaaattcctcgaaaatgaagatagacggtcagcctccttgcatctcccaaaactcagcattacgggcacttacgacttgaagtccgttttgggtcagttgggcatcactaaggttttctcaaacggcgcagacttgtctggcgtgactgaagaggctccactgaagttgtccaaagccgttcacaaggccgttctgaccatcgatgagaagggaacggaggctgccggtgcgatgttcctggaagccattcctatgtccattccccccgaggtgaaattcaacaaaccttttgtttttctgatgatcgaacagaacacaaaatccccactgttcatggggaaagtggttaacccgacccagaag

SEQ ID NO: 18702 - DNA, 1254 bp, Artificial Sequence
  Description of Artificial Sequence: Synthetic coding sequence
atgccctccagtgtgtcttggggtattctgcttcttgccgggctttgctgtctcgtccccgtgagtttggctgaggacccacagggagatgcagcccagaaaacagatacatctcaccatgatcaggaccacccgacatttaataagattacccctaacctggcagaatttgccttttctctgtacagacaactcgcccaccagagcaactctactaacatcttcttttctccagtctcaatagctactgcttttgccatgctctccctggggactaaggctgatacacacgacgaaatcctggagggactgaactttaacctcactgaaattcccgaggctcaaattcacgaaggcttccaggagctcctccggaccttgaaccagccagactcccaactgcagctgaccaccggcaatggactgttcctctctgaaggtctgaagctcgtggacaaattcttggaggatgttaaaaagttgtatcacagtgaagctttcacagtcaactttggtgacactgaggaagccaaaaagcagatcaatgactacgtggaaaaagggacccaggggaagatcgtggacttggtgaaggagcttgacagggataccgtgttcgccctggttaactacattttcttcaaaggaaagtgggaaaggcctttcgaggtcaaagacactgaagaggaagatttccacgtcgaccaggtgaccacagttaaggtccccatgatgaaacggttgggtatgttcaatatccaacattgtaagaaattgagctcatgggttctgctcatgaaatatctgggaaacgctacagcaattttttttctgcccgacgagggaaaactgcagcatctcgaaaatgaattgacccatgatatcataaccaagtttctggagaacgaagacaggcgcagcgcaagtctgcacttgcccaaactctcaattacaggcacttacgaccttaaaagcgtgctgggacagttgggcatcacgaaggtcttttccaatggcgccgacctgagcggtgtgacggaagaagcccctctcaagttgagcaaggctgtccacaaggcagtacttacaatcgacgaaaaaggaaccgaagctgccggcgccatgtttctggaggccatacctatgagtatcccccccgaagtgaagttcaacaagccctttgtcttcttgatgatagagcagaataccaagtctcccctgttcatggggaaggtagtgaaccccacccagaaa

SEQ ID NO: 18703 - DNA, 1254 bp, Artificial Sequence
  Description of Artificial Sequence: Synthetic coding sequence
atgccttcttcagtctcctggggaatcctccttctggcgggactttgctgtttggtgccagtgtcccttgcggaagatcctcagggcgatgcagcacaaaaaacggatacctcccaccatgatcaagatcatcccacttttaacaagattactcccaacttggccgaatttgcgttcagcctgtaccgccagcttgctcatcaatccaactcgactaacattttcttcagccctgtatcgattgctaccgcgtttgcaatgctttcccttggcaccaaggcagatactcacgacgagattctggaaggactgaatttcaaccttactgaaattccagaagcacagatacatgagggatttcaagagctgctgaggaccctgaatcagcctgactcacagctccaacttactactggaaacgggctttttctctcggaaggccttaagctcgtggataagtttctcgaggatgtcaagaaattgtaccatagcgaggcgtttactgtgaattttggcgataccgaggaagcgaagaagcagataaatgactacgtggaaaaagggactcaaggaaagattgtggatcttgtgaaggaacttgacagagatactgtgttcgcacttgtcaactacatctttttcaaggggaagtgggaacgacccttcgaggttaaagataccgaagaggaggacttccatgtggatcaagtgactaccgtgaaggtgcctatgatgaagaggcttggaatgtttaacatccagcattgcaaaaagctgtcgtcatgggtccttctcatgaagtacctgggaaacgcaactgccattttctttcttcctgatgaaggcaaacttcaacatctcgaaaacgaactgacccacgacattatcacgaaattcctggaaaatgaagatcgaagatccgcaagcctccatctgcccaagttgtcgatcaccggaacctacgacctgaagtctgtgctcggccagctggggattaccaaggtcttttctaacggtgcagatctttcgggtgtgaccgaagaagcacctttgaagttgtcgaaggcagtgcataaggcagtcttgactattgatgaaaagggaaccgaagccgcaggtgctatgtttttggaagccattcctatgtcaattccccctgaagtcaagttcaataaaccttttgtgtttctgatgattgaacagaacaccaaatccccacttttcatgggaaaggtggtgaatccaactcagaag

SEQ ID NO: 18704 - DNA, 1254 bp, Artificial Sequence
  Description of Artificial Sequence: Synthetic coding sequence
atgccctcctccgtctcatggggtatcctcctgctggccggactgtgctgccttgtcccagtctcccttgcggaggacccccagggagacgcagcacagaagaccgatactagccatcacgaccaagaccatcccaccttcaacaagatcactcccaaccttgccgagttcgcttttagtctgtaccggcagctcgctcaccaatcaaactctaccaatatctttttctcacctgtgtcgatagctaccgcattcgctatgcttagcctgggaaccaaagccgatactcacgacgaaattctcgaaggcctaaactttaacctgaccgagataccggaagcccagatccatgaaggatttcaggagctgctgaggactttgaatcagcctgacagccagcttcagctgaccactgggaacggtctgttcctgtccgagggcctgaagctggtggataagtttctcgaggacgtgaagaagctgtaccattctgaggcttttacagtgaacttcggcgacacggaagaggccaaaaagcaaatcaacgactacgtggagaagggaacacagggaaagatcgtggacctagtcaaggaactggatagagatactgtgttcgcactcgtgaactacatcttctttaaggggaagtgggagcgcccttttgaggtaaaggacactgaagaggaggatttccacgtggatcaggtgacgacagtgaaggtacccatgatgaagagactgggcatgtttaatatacagcactgcaagaagctgtcctcctgggtgctgcttatgaagtaccttggcaacgctaccgccatcttctttcttcctgatgaggggaagctacagcacctcgagaatgagctgacgcatgacatcatcaccaaattccttgaaaacgaggaccggaggtccgccagtctccatttacctaagctttcgatcaccggaacctatgaccttaagtccgtgcttggccagttgggcataaccaaggtgttctctaacggtgctgacttaagtggggtcacagaagaggcgcctcttaaactcagcaaagcggtgcataaggctgttcttactatcgacgagaagggcacagaagctgcgggggccatgtttctggaagccatccccatgtctattccgcctgaagtgaagtttaataagccattcgtgttccttatgattgagcagaataccaagtctcccttgttcatggggaaagtggtgaaccctactcagaaa

SEQ ID NO: 18705 - DNA, 1254 bp, Artificial Sequence
  Description of Artificial Sequence: Synthetic coding sequence
atgccctccagcgttagttggggcatccttttgctggcgggcctgtgctgtttggtccccgtaagtctcgccgaggatcctcagggagacgcagcgcagaagacagacacttcccaccatgaccaagaccatccaacattcaataagattactccaaacctggcagagtttgcgttctccctgtaccgccaattggcccaccagtccaatagtaccaatatttttttttccccggttagtatcgcaacagcctttgccatgctctcccttggaaccaaggccgacacacacgacgaaatcctcgagggattgaatttcaacctgactgagattcccgaggctcagatccacgagggttttcaggagttgctgcgcacgctgaatcagcctgattcccagctccagttgacaacgggaaatggtctgttcctgtctgagggtttgaaattggttgacaaatttcttgaggacgtgaagaaactgtaccattccgaggctttcacagttaacttcggcgacacagaggaagctaagaagcaaatcaatgactacgtggaaaaaggtactcagggtaagattgtcgacttggtcaaggagcttgaccgcgacacggtttttgctctcgttaattacatcttcttcaagggtaagtgggagagacctttcgaagtaaaggacactgaggaggaggactttcacgtggatcaggtgactactgtcaaggtgcccatgatgaagaggctgggcatgtttaatatccagcactgtaagaagctgagctcttgggtcttgctgatgaagtacctgggcaatgcgaccgctatcttctttctgcccgacgagggcaaattgcagcacctggagaacgaactgacgcatgacataattaccaagtttctggagaacgaagacaggagatccgcatctcttcatctgcccaagctctctatcacgggaacctacgaccttaaatcagtgcttggccaactgggcattaccaaggtatttagcaacggtgcagacttgagcggagtgacagaggaggcacccctcaaattgagcaaggctgtgcacaaagcagtgcttacaattgatgagaagggcaccgaagccgcaggcgccatgttcctggaagctattccaatgtccatcccaccagaggtgaagtttaacaaaccattcgtgttccttatgatagagcagaacacaaagagccctttgttcatgggaaaagtggtgaatccgacacaaaaa

SEQ ID NO: 18706 - DNA, 1254 bp, Artificial Sequence
  Description of Artificial Sequence: Synthetic coding sequence
atgccgtcatccgtgtcctggggaatcctgctcctggcaggactgtgctgcctcgtgcccgtctcgctggcagaggacccccaaggagatgctgcacaaaagactgacacctcgcaccatgaccaagatcacccgacctttaacaaaatcactccaaacctcgccgaattcgcgttctcactctaccggcagctcgcccaccaatcgaattccactaatatcttcttcagcccagtgtcgatcgcgactgctttcgccatgctgtccctcggaactaaggctgatactcacgatgaaatcctggaaggactgaactttaacctcaccgaaatcccggaagctcaaatccatgagggcttccaggaacttctgcgcacgctgaatcagccggactcccagctccaactcaccacgggaaatggactgttcctctcagaagggctgaaacttgtcgataagttcttggaggacgtcaaaaagctgtaccatagcgaagcgttcaccgtcaacttcggagacactgaggaggcgaagaagcaaatcaacgattacgtcgagaagggcacccaaggaaagatcgtggacctcgtcaaagaactcgatcgggatactgtgttcgcgctcgtgaactacattttcttcaagggaaagtgggaaagaccgttcgaggtgaaggacaccgaagaagaggattttcacgtggatcaggtgaccactgtgaaagtgccaatgatgaaacggttgggtatgtttaacatccagcattgtaaaaagctgtcaagctgggtgctcctgatgaagtacctcgggaacgcaactgccatcttcttcctgcctgacgaaggcaaactgcagcacttggagaacgaactgactcacgacatcatcaccaaattcctggaaaatgaggacaggcgctcggcaagcctccatctgccaaaactgagcatcaccggcacttacgacctcaagtcagtgctgggacaactgggtatcaccaaagttttctcgaacggagccgacctgtcaggcgtgactgaggaagccccattgaaactgtccaaggccgtccacaaggcggtcctgaccatcgacgaaaagggaacggaagcggccggagcgatgtttctcgaggctatcccaatgagcatcccgccggaagtgaagtttaacaaaccgttcgtgtttctgatgatcgaacagaacactaaatcgcccctcttcatgggaaaggtggtcaacccaactcagaag

SEQ ID NO: 18707 - DNA, 189 bp, Artificial Sequence
  Description of Artificial Sequence: Synthetic coding sequence
atgccttccagcgtctcttggggaatcctccttttagcaggtttgtgctgtctcgtgcccgtctccctcgcccacggcgagggcacatttacatctgatcttagtaagcagatggaagaggaggccgtgagactcttcatcgaatggttgaagaacgggggaccatcctctggggctcctcctccttca

SEQ ID NO: 18708 - DNA, 189 bp, Artificial Sequence
  Description of Artificial Sequence: Synthetic coding sequence
atgccttcatcggtgtcgtggggcatcttgctgttggcaggactgtgctgtcttgtgcccgtaagtctggctcatggcgagggtactttcacctcggatctctccaagcaaatggaagaagaggcagtcagactgtttattgaatggctcaaaaacggtgggccatcctcaggagcccctcccccgtcg

SEQ ID NO: 18709 - DNA, 189 bp, Artificial Sequence
  Description of Artificial Sequence: Synthetic coding sequence
atgcccagttccgtgtcgtgggggattttgctcctggccgggctgtgttgcctggtgcccgtttcattggcacatggagagggaacctttacatctgacctgtcaaagcagatggaggaagaggccgtacggctcttcatcgagtggctgaagaacggaggacctagctctggggccccccccccatcc

SEQ ID NO: 18710 - DNA, 189 bp, Artificial Sequence
  Description of Artificial Sequence: Synthetic coding sequence
atgccgtcgtcggtatcgtggggtatactattattagcgggtttatgttgtttagtaccggtatcgctagcgcatggtgaaggtacgtttacgtcggatttatcgaaacaaatggaagaagaagcggtacgattatttatagaatggttaaaaaatggtggtccgtcgtcgggtgcgccgccgccgtcg

SEQ ID NO: 18711 - DNA, 189 bp, Artificial Sequence
  Description of Artificial Sequence: Synthetic coding sequence
atgcctagctcggtgagctgggggattctgcttcttgcaggcctgtgttgccttgtgcccgtctcacttgcacatggagaaggtacgttcactagcgatttgagcaagcaaatggaagaagaggccgtccgactctttatcgagtggcttaagaatggcggcccttcctccggggcacccccaccatcc

SEQ ID NO: 18712 - DNA, 189 bp, Artificial Sequence
  Description of Artificial Sequence: Synthetic coding sequence
atgccgagctctgtctcgtgggggatcctcctcctggctggtctctgctgtcttgtgcctgtctccctggcccacggcgaggggactttcacctcagatctatcaaaacaaatggaggaagaggccgtcagactgtttattgagtggcttaagaatggaggcccgagctctggggccccccccccgtcg

SEQ ID NO: 18713 - DNA, 189 bp, Artificial Sequence
  Description of Artificial Sequence: Synthetic coding sequence
atgccatcctccgtgagctggggaatcctgttgctggccggtctttgttgtctggtccctgtctccctggcgcatggagagggcacttttacgtctgatctctcgaagcaaatggaagaagaggcagtgcgcctgttcattgaatggctcaaaaacggtggcccctcaagcggtgctcctccgccttcg

SEQ ID NO: 18714 - DNA, 189 bp, Artificial Sequence
  Description of Artificial Sequence: Synthetic coding sequence
atgccaagttcagtctcctggggtatccttctgctcgcgggcctgtgttgcctggttccggttagcctggctcacggcgaaggcacctttacctccgacctgtcaaagcagatggaagaagaagccgtccgcctgttcattgagtggctgaaaaatggcggacctagttctggagctccacctccttcg

SEQ ID NO: 18715 - DNA, 189 bp, Artificial Sequence
  Description of Artificial Sequence: Synthetic coding sequence
atgccgtcgagcgtttcgtggggaatcctgctgcttgccggactgtgctgcctcgtgccggtgtcactcgctcacggcgaaggtacgttcacctcagatctctccaaacagatggaagaagaggcagtcaggctgtttatcgagtggctgaagaatggggggccgtcatcaggtgcaccacccccatcc

SEQ ID NO: 18716 - DNA, 189 bp, Artificial Sequence
  Description of Artificial Sequence: Synthetic coding sequence
atgccttctagcgttagttggggcattctgttactggctgggctatgttgcctggtgcctgtcagcctcgctcacggcgaggggacattcacatcagacttatctaaacagatggaggaagaggccgttcgtctgtttattgaatggctaaagaacggcggcccttctagcggtgccccaccaccatct

SEQ ID NO: 18717 - DNA, 189 bp, Artificial Sequence
  Description of Artificial Sequence: Synthetic coding sequence
atgccaagttccgtttcctgggggatcctgctgctggccggactgtgttgcctagtgccagtatcactcgcccatggagagggaacctttaccagcgacctgagcaagcagatggaggaggaagcagttaggctgtttattgaatggctgaaaaacggaggtccctctagtggcgccccccccccttcc

SEQ ID NO: 18718 - DNA, 189 bp, Artificial Sequence
  Description of Artificial Sequence: Synthetic coding sequence
atgccatctagcgtaagctgggggattcttttattggctgggctttgttgccttgtgccagtctccctggcccacggggagggaaccttcacttccgatttgtccaaacagatggaggaagaagccgtgagactctttattgagtggctgaagaatggtggtccttcttctggcgctcccccaccgtcc

SEQ ID NO: 18719 - DNA, 189 bp, Artificial Sequence
  Description of Artificial Sequence: Synthetic coding sequence
atgccaagctccgtgtcatggggtattttgctgctggccggactctgctgcctcgttccggtttcgctggcacatggcgaaggcactttcacaagcgaccttagcaaacaaatggaggaggaagcagtccgtctcttcattgagtggcttaaaaatggcgggccctcatctggcgcccctcccccttct

SEQ ID NO: 18720 - DNA, 189 bp, Artificial Sequence
  Description of Artificial Sequence: Synthetic coding sequence
atgcccagctctgtgagctgggggatactgctgcttgcgggactctgttgtctagttccggtctctctggcccacggagaaggaacgtttacatcagatctgtcgaagcagatggaggaggaggctgtccgtctgttcatcgagtggctgaagaatggggggccaagcagtggtgcaccacctccgtct

SEQ ID NO: 18721 - DNA, 189 bp, Artificial Sequence
  Description of Artificial Sequence: Synthetic coding sequence
atgccatcttccgtgtcctgggggattttgctgctggctggtctgtgctgtctcgtccccgtgtcgctggctcacggcgaaggaacctttacgtcggatttgtccaaacagatggaggaggaggccgttagactttttattgagtggctcaagaacggaggcccatcttctggggctccaccgccgagt

SEQ ID NO: 18722 - DNA, 189 bp, Artificial Sequence
  Description of Artificial Sequence: Synthetic coding sequence
atgccgtctagcgtaagctggggcatcctactgctcgccggcctgtgctgccttgtgccagtgtcccttgctcacggagagggcacttttactagtgatctttcgaaacagatggaagaggaggctgtgcgattgtttattgagtggttgaagaacggggggccctctagcggcgccccgcccccttcc

SEQ ID NO: 18723 - DNA, 189 bp, Artificial Sequence
  Description of Artificial Sequence: Synthetic coding sequence
atgccatcgtcggtcagctggggaattctgcttctggcgggtctttgctgtttggtcccagtgtcactggcacatggggaaggaacctttaccagcgatctgtccaagcagatggaggaagaagccgtgagattgtttatcgaatggctcaaaaacggcggtccttcatcaggtgcacctccgccgtcg

SEQ ID NO: 18724 - DNA, 189 bp, Artificial Sequence
  Description of Artificial Sequence: Synthetic coding sequence
atgccctcaagcgtatcctgggggattttactattggctggtctgtgctgtctggtgccggtatctttggcgcatggtgaagggacgtttacgtcagatttgagcaaacagatggaggaggaggcggtccgtttatttattgagtggcttaaaaatggcgggcccagttctggagctcctccaccctca

SEQ ID NO: 18725 - DNA, 189 bp, Artificial Sequence
  Description of Artificial Sequence: Synthetic coding sequence
atgccaagtagtgtctcctggggtattttgctgcttgcagggctatgttgtcttgttcccgtaagtctcgcccatggagaaggcacttttacttcagacctgagtaaacaaatggaagaggaagccgttcgcctgttcatcgaatggctgaagaacgggggcccgtctagcggagcgcccccgcccagc

SEQ ID NO: 18726 - DNA, 189 bp, Artificial Sequence
  Description of Artificial Sequence: Synthetic coding sequence
atgccgtcgagcgtgagctggggtatccttcttttggccggattgtgctgccttgtgccagtgtcgctggcacacggtgagggcacttttacctcagatctttccaagcagatggaagaagaagcggtgcgcctgtttattgaatggctgaagaatggcggtccttcgtccggagcacctcccccttcg

SEQ ID NO: 18727 - DNA, 189 bp, Artificial Sequence
  Description of Artificial Sequence: Synthetic coding sequence
atgccctcgtccgtcagctggggaattcttctgctggcaggcctctgttgtctcgtccctgtgagcctggcccacggcgaaggaacgttcacttccgatctttccaaacaaatggaagaagaagcagtgagactgtttatagagtggcttaagaatggagggcctagtagcggagcaccacctccgtcc

SEQ ID NO: 18728 - DNA, 189 bp, Artificial Sequence
  Description of Artificial Sequence: Synthetic coding sequence
atgccaagcagcgtgtcatggggaatccttctgttggcaggactctgttgtcttgtgcctgtctcgcttgcacacggcgaagggacttttacctctgatctttcgaaacaaatggaggaggaggcggtccgactctttatcgagtggctgaagaatgggggaccatcatccggtgctcctccccctagc

SEQ ID NO: 18729 - DNA, 189 bp, Artificial Sequence
  Description of Artificial Sequence: Synthetic coding sequence
atgccaagcagcgtgtcatggggcatcctcctgctggccggactctgttgtctggtacccgtgagcctcgcacatggcgagggaactttcaccagcgatctgtcaaagcaaatggaagaggaagcagtccgcttgttcatcgagtggctgaagaacggaggaccttcatctggtgccccgccacccagc

SEQ ID NO: 18730 - DNA, 189 bp, Artificial Sequence
  Description of Artificial Sequence: Synthetic coding sequence
atgccatcttcagtatcatggggtattcttcttttagctggtttatgttgtttagtaccagttagtttagcacatggagaaggtacatttacaagtgatttatcaaaacaaatggaagaagaagccgtaagacttttcattgaatggttaaaaaatggaggtcctagttccggagcaccaccacctagt

SEQ ID NO: 18731 - DNA, 189 bp, Artificial Sequence
  Description of Artificial Sequence: Synthetic coding sequence
atgccttcctccgtgtcgtggggtatactccttcttgctgggctgtgctgtttggtgccagtgtcgctggctcatggagagggcacttttaccagcgatctgtcaaagcaaatggaggaagaagcagttagactgttcatcgaatggcttaagaacggtggcccttccagtggtgcccctcccccttcg

SEQ ID NO: 18732 - DNA, 189 bp, Artificial Sequence
  Description of Artificial Sequence: Synthetic coding sequence
atgccatctagtgtgtcttggggaattctattacttgccggactctgttgccttgtcccagtcagcttggctcatggagagggaacctttacatctgatttgtcgaaacagatggaagaagaagcagtaagattatttatagagtggcttaaaaacggaggaccatcgtccggtgccccgcctccgtcc

SEQ ID NO: 18733 - DNA, 189 bp, Artificial Sequence
  Description of Artificial Sequence: Synthetic coding sequence
atgccttcctcggttagctgggggatcctcttgcttgctgggctttgctgcctggtgcccgtcagtttggcgcacggagagggtacctttacatctgatctgagcaagcagatggaagaggaggccgtacggttgttcatcgaatggctaaagaacggagggccatcttccggagccccaccccctagt

SEQ ID NO: 18734 - DNA, 189 bp, Artificial Sequence
  Description of Artificial Sequence: Synthetic coding sequence
atgccatcgagcgtatcttggggtattctgctgctcgccggtttgtgctgcctcgtccctgtgagtctggcccacggagagggtacgttcacttcggacctatcgaagcagatggaggaggaggcggttcgcctcttcatcgagtggcttaagaacggcggcccgtcgtccggagctcccccgccgtcg

SEQ ID NO: 18735 - DNA, 189 bp, Artificial Sequence
  Description of Artificial Sequence: Synthetic coding sequence
atgccctcatccgtgtcgtggggaatacttctcctggcgggcctttgctgtcttgtccctgtgtcgcttgcacatggggaaggaacgtttacttcggacctttccaagcaaatggaagaagaggcagtgagacttttcattgaatggttgaagaacggaggaccatcaagcggggcacctcctcccagc

SEQ ID NO: 18736 - DNA, 189 bp, Artificial Sequence
  Description of Artificial Sequence: Synthetic coding sequence
atgccctcatccgtatcctggggcatcctcctgcttgccgggttgtgctgtctggtgccagtgagcctcgcacacggtgaaggtaccttcacaagtgacctgagtaaacagatggaagaagaggcagttcgactctttatcgaatggcttaagaatggaggcccctccagcggtgctcctcctccctca

SEQ ID NO: 18737 - DNA, 189 bp, Artificial Sequence
  Description of Artificial Sequence: Synthetic coding sequence
atgccctcttccgtctcctggggtatactgctcctggcaggattgtgttgcttggtgcctgtcagcctggcgcacggtgaaggcacttttacttcggatctttccaagcaaatggaagaggaagcagtgagactcttcattgagtggcttaagaacggagggccatcgtcaggggcgcctccacctagc

SEQ ID NO: 18738 - DNA, 189 bp, Artificial Sequence
  Description of Artificial Sequence: Synthetic coding sequence
atgccatcatccgtttcatggggaatacttcttcttgctgggctatgctgtcttgtccccgtgtcactagctcatggagaagggacgttcacatcagatttgtcaaaacaaatggaggaggaagcagtccgacttttcatcgagtggctgaaaaatggggggcctagttctggtgcgcctccaccaagc

SEQ ID NO: 18739 - DNA, 189 bp, Artificial Sequence
  Description of Artificial Sequence: Synthetic coding sequence
atgccatccagcgtgtcctgggggatccttttgctggctggcctgtgttgtctagttcccgttagcctggcccacggcgaaggcacctttacgagcgatctgtccaaacagatggaagaggaggccgtgcgcctgttcatcgaatggctcaagaatggcggaccttcgtccggcgccccaccgccctcc

SEQ ID NO: 18740 - DNA, 189 bp, Artificial Sequence
  Description of Artificial Sequence: Synthetic coding sequence
atgccttcttccgtctcctgggggatcctcctgctcgccgggctctgttgcctggttcccgtctctctcgctcatggagaggggactttcacaagtgatctctcaaaacagatggaagaagaagcagtaagactatttattgaatggctaaaaaacggagggccatcttctggagcacctcctccatcc

SEQ ID NO: 18741 - DNA, 189 bp, Artificial Sequence
  Description of Artificial Sequence: Synthetic coding sequence
atgccgtcaagcgtgtcctgggggatcctgctgctggcgggcctctgttgcctggtgccagtgtcccttgcacacggcgaaggaactttcacctcagacttgtcgaaacagatggaagaggaagctgtccgcctgtttatcgagtggctcaagaacggtggacctagctcgggagccccgccgccctcg

SEQ ID NO: 18742 - DNA, 189 bp, Artificial Sequence
  Description of Artificial Sequence: Synthetic coding sequence
atgccttcaagcgtgtcatgggggatcctcctgctcgccggcttgtgttgtcttgttccagtgtcgctggcgcatggcgaaggaacctttacatctgacttatctaagcagatggaggaggaagccgtccggctgtttatagagtggttgaaaaatgggggcccttcctccggtgcccctccaccaagt

SEQ ID NO: 18743 - DNA, 189 bp, Artificial Sequence
  Description of Artificial Sequence: Synthetic coding sequence
atgccatctagcgtgtcttggggtattctcttgctggcgggcctgtgttgcctcgtgcccgtatctctggcgcacggcgagggaacattcacctccgacttgtccaaacagatggaagaggaggctgtgcggctgttcatcgaatggctgaagaatggcggtcctagcagcggggctccacctcccagt

SEQ ID NO: 18744 - DNA, 189 bp, Artificial Sequence
  Description of Artificial Sequence: Synthetic coding sequence
atgccctccagcgtctcctggggaatcctgttgctcgcagggctgtgctgcctcgtcccggtgtccctggctcacggcgagggaacttttaccagcgatctctccaaacagatggaggaggaagctgtgcggctctttatcgaatggctgaagaatgggggtccttccagtggagctcctccccccagt

SEQ ID NO: 18745 - DNA, 189 bp, Artificial Sequence
  Description of Artificial Sequence: Synthetic coding sequence
atgcccagttccgtgagttggggaatacttctgctcgctgggttgtgctgtctagtgcctgtgtctcttgcccatggggaagggacatttacttccgatctaagtaaacagatggaggaagaggccgtcagactatttattgaatggctgaagaacggagggcccagttccggggcgcctccaccatcc

SEQ ID NO: 18746 - DNA, 189 bp, Artificial Sequence
  Description of Artificial Sequence: Synthetic coding sequence
atgccaagcagcgtatcatggggtattctacttctagccggtctctgctgtctggtcccagtctcacttgcgcacggggaagggacttttacatcagatctgagtaaacaaatggaagaggaagctgttcgactgtttattgagtggctgaagaacggggggccgagtagcggcgcccccccgccctct

SEQ ID NO: 18747 - DNA, 189 bp, Artificial Sequence
  Description of Artificial Sequence: Synthetic coding sequence
atgccatcgtcagtgtcatggggtatcctgttgcttgccggactttgttgccttgtcccggttagcctggcgcatggggaggggacttttacctccgatctgagcaagcaaatggaggaagaagctgtgaggctcttcattgaatggcttaagaacggtggcccgtcgtctggcgcccctccacccagc

SEQ ID NO: 18748 - DNA, 189 bp, Artificial Sequence
  Description of Artificial Sequence: Synthetic coding sequence
atgccttcaagtgtgtcctggggcattcttcttcttgcaggactgtgttgtctcgtcccagtgtccttggctcacggcgaggggaccttcacgtctgacctgtcgaagcagatggaggaggaagccgtgagactgttcattgagtggctgaaaaatggaggtccaagtagcggagctcctccaccgagt

SEQ ID NO: 18749 - DNA, 189 bp, Artificial Sequence
  Description of Artificial Sequence: Synthetic coding sequence
atgccgtcgtccgtgtcatggggaatcctgctcctggcaggcctgtgctgcctggtccctgtctctctggcgcacggagaaggaactttcacctctgacttgtcgaagcagatggaagaagaagccgttagacttttcattgaatggctgaagaacggagggccatcgagcggggcgccgcccccgtcc

SEQ ID NO: 18750 - DNA, 189 bp, Artificial Sequence; identical to SEQ ID NO: 18739
  Description of Artificial Sequence: Synthetic coding sequence

SEQ ID NO: 18751 - DNA, 189 bp, Artificial Sequence
  Description of Artificial Sequence: Synthetic coding sequence
atgccgtcatcggtgtcatgggggatcttgctgttggcagggctttgttgcctcgtgcctgtgtcgcttgcccatggcgaaggaacttttaccagtgatttgtccaagcagatggaggaagaggcagtgcgccttttcattgaatggctgaaaaatgggggacccagctccggtgcgcctcctccttcg

SEQ ID NO: 18752 - DNA, 189 bp, Artificial Sequence
  Description of Artificial Sequence: Synthetic coding sequence
atgccaagctccgtgtcatggggaattctccttctcgccggcctgtgctgcctggtccccgtctccctggcgcacggagaaggaactttcacttctgacctgtcgaaacagatggaggaggaggctgtgcgcctgttcatcgaatggctcaagaatggagggcccagctcgggcgccccaccgccatcg

SEQ ID NO: 18753 - DNA, 189 bp, Artificial Sequence
  Description of Artificial Sequence: Synthetic coding sequence
atgccttcgtctgtctcctggggtatcctcctcttggcggggctgtgctgcctggtgccagtgtcacttgcccacggagagggcaccttcacttccgacctcagcaagcagatggaagaggaggccgtgcgcctgtttatcgaatggttgaaaaacggcggtccgagctcgggggcaccgcctccctcc

SEQ ID NO: 18754 - DNA, 189 bp, Artificial Sequence
  Description of Artificial Sequence: Synthetic coding sequence
atgccgtccagcgtgagttgggggatcttgctcctcgcgggcctgtgctgcctggtccctgtgtcgctggcccacggagaggggaccttcacctccgacttgtcgaagcagatggaggaggaagccgtgagactgtttattgaatggctgaaaaacggtggaccttcatcaggcgcacctcccccatcg

SEQ ID NO: 18755 - DNA, 189 bp, Artificial Sequence
  Description of Artificial Sequence: Synthetic coding sequence
atgccctcttccgtctcgtggggcatcctcctgctggcaggactctgctgccttgtcccggtgagccttgctcacggggagggcactttcacctcggatctttcaaagcagatggaggaagaagcagtgaggctgtttatcgagtggttgaagaacggagggccatcaagcggagccccacccccgagc

SEQ ID NO: 18756 - DNA, 189 bp, Artificial Sequence
  Description of Artificial Sequence: Synthetic coding sequence
atgccatctagtgttagttggggaatccttcttctggccggcctgtgctgccttgtcccggtgagtctggcacatggtgaaggaacctttacttcggacctatccaagcagatggaggaagaagctgtgcgactgtttatagagtggctgaaaaatggcggcccgtcgagtggcgcacctccgccatct

SEQ ID NO: 18757 - DNA, 189 bp, Artificial Sequence
  Description of Artificial Sequence: Synthetic coding sequence
atgcccagcagcgtctcgtggggaatcctgttgctggccggcctgtgttgcctcgtgcctgtgtcccttgcacatggtgagggaacttttaccagcgatcttagtaagcagatggaagaggaagcagtcagacttttcattgaatggctcaaaaacggcggaccatcgtctggggctccgcctccttca

SEQ ID NO: 18758 - DNA, 189 bp, Artificial Sequence
  Description of Artificial Sequence: Synthetic coding sequence
atgccttcctcagtttcttggggcatacttctgctggctggtctgtgctgtctcgtccccgtgtcgcttgctcatggtgagggaacctttaccagcgacctcagcaaacagatggaggaggaagcggtcagactatttattgaatggcttaaaaacggaggacccagctccggtgctccaccccccagc

SEQ ID NO: 18759 - DNA, 189 bp, Artificial Sequence
  Description of Artificial Sequence: Synthetic coding sequence
atgccatcttcggtgtcctggggaattctgttgctggcaggattgtgctgtctggtgccagtctcactggcgcacggggaggggacttttacctcggatctttcgaagcagatggaagaagaggccgtccggctctttatcgaatggctcaagaatggaggaccgtcctcgggagccccacctccttcg

SEQ ID NO: 18760 - DNA, 189 bp, Artificial Sequence
  Description of Artificial Sequence: Synthetic coding sequence
atgccgtctagtgtgagctggggaatactgctgctggctggtctttgctgcctcgtgcccgtgtccttggcccacggggaagggaccttcactagcgacctgtcaaagcaaatggaggaagaggccgtgaggttgtttatagaatggctcaagaacggcggccccagtagcggcgccccacctccaagc

SEQ ID NO: 18761 - DNA, 189 bp, Artificial Sequence
  Description of Artificial Sequence: Synthetic coding sequence
atgcccagctcggtgagttggggtatcttgctgctcgcgggattgtgttgccttgtgcccgtctcactcgcccacggtgaagggactttcacctcggatctgtcaaagcagatggaggaagaggcagtgcggctgttcatcgaatggctgaagaacggaggaccgagtagcggcgcccctcctccgtca

SEQ ID NO: 18762 - DNA, 189 bp, Artificial Sequence
  Description of Artificial Sequence: Synthetic coding sequence
atgcccagtagtgtgtcctggggaatcttgctccttgctggattgtgctgcctggtgcccgtgagcttagctcatggagaaggtaccttcacgagtgatctgagtaagcagatggaagaagaggccgtgcgcttgtttattgagtggctgaagaatggcggcccgtcaagtggggcacccccaccttcc

SEQ ID NO: 18763 - DNA, 189 bp, Artificial Sequence
  Description of Artificial Sequence: Synthetic coding sequence
atgccgtcgtcggtgagctggggcatcctgctcctcgcaggattgtgctgcctcgtgccggtgagcttggcccatggggaaggaacctttacctcggatctctccaagcaaatggaggaagaagccgtgcggctgttcattgaatggctcaagaatggcggaccatcctccggcgccccaccaccgtcc

SEQ ID NO: 18764 - DNA, 189 bp, Artificial Sequence
  Description of Artificial Sequence: Synthetic coding sequence
atgccgtcctcggtgtcgtggggcatccttttgctcgccggactgtgctgtctcgtgccggtgtccctggcccacggagagggaacctttaccagcgacctgtccaaacagatggaagaagaggcagttcgcttgttcatcgagtggctgaaaaatggcgggcccagctcgggagcaccgccaccatca

SEQ ID NO: 18765 - DNA, 189 bp, Artificial Sequence
  Description of Artificial Sequence: Synthetic coding sequence
atgccctcgtctgtttcatgggggatcctcctcctggccggactttgctgtctggtccctgtgtccctggcccacggcgaaggtactttcacgtcggacctcagcaagcagatggaagaagaggcggtgaggctgttcatcgagtggctcaagaacggcggaccgtcatcaggcgcaccgccgccaagc

SEQ ID NO: 18766 - DNA, 189 bp, Artificial Sequence
  Description of Artificial Sequence: Synthetic coding sequence
atgccgtcctccgtgagctggggaatccttcttcttgcaggactgtgctgtctggtccccgtcagccttgcccacggagagggaactttcaccagcgacctgtcaaaacagatggaggaagaagcagtgcgcctcttcatcgaatggctcaagaacggcggcccgtcctcaggcgcccctccgccatcc

SEQ ID NO: 18767 - DNA, 189 bp, Artificial Sequence
  Description of Artificial Sequence: Synthetic coding sequence
atgccgtcaagcgtatcctggggaatccttctgcttgccggactgtgttgcttggtcccggtgtccctcgcgcacggcgaaggaactttcacctcggacctcagcaagcagatggaggaggaagctgtgagactctttatcgaatggctgaaaaacggtggcccctcctcgggtgcaccaccgccaagc

SEQ ID NO: 18768 - DNA, 189 bp, Artificial Sequence
  Description of Artificial Sequence: Synthetic coding sequence
atgccttcttccgtgagctgggggattctgctgcttgccgggttgtgttgtctggtcccagtctccctggcacatggcgaagggacatttacttcagatctcagcaaacagatggaagaagaagctgtgcgcctgtttattgagtggctcaagaatggcggccccagctctggggcacctccaccgtca

SEQ ID NO: 18769 - DNA, 189 bp, Artificial Sequence
  Description of Artificial Sequence: Synthetic coding sequence
atgccatcctcggtgtcatggggcatcctgctgctcgcaggactgtgctgtttggtgcctgtatccctcgcgcacggagaggggactttcacctcggacctgagcaaacagatggaggaagaagccgtccgcctctttatcgaatggcttaagaacggaggtccgagctccggcgcaccccctccgtcc

SEQ ID NO: 18770 - DNA, 189 bp, Artificial Sequence
  Description of Artificial Sequence: Synthetic coding sequence
atgccatccagcgtcagctggggcatcttgttgctcgccggcctttgttgtctagtcccagtctcactagcccacggcgagggcacttttacctctgacctgtctaaacagatggaagaggaagccgtacgcctgttcatcgaatggttaaagaatggcggacccagttcaggtgccccgcctccaagt

SEQ ID NO: 18771 - DNA, 189 bp, Artificial Sequence
  Description of Artificial Sequence: Synthetic coding sequence
atgccatcctccgtgtcatggggtattctgctcttggccggactgtgttgcttggttcctgtgtcccttgcacatggagaaggaaccttcactagcgatctctcgaaacaaatggaggaagaagcagtccgactgtttatcgagtggcttaagaacggtgggccatcgtctggagctccgcccccttca

SEQ ID NO: 18772 - DNA, 189 bp, Artificial Sequence
  Description of Artificial Sequence: Synthetic coding sequence
atgccctcgtcggtgagctggggcatcctgctgcttgcgggtctttgttgtttggtccctgtgtccctggcccacggtgaaggaaccttcaccagtgacctgtcaaagcaaatggaagaggaggcagtccgcctctttattgaatggctgaagaatggtggaccaagcagcggcgcgccacctccttcg

SEQ ID NO: 18773 - DNA, 189 bp, Artificial Sequence
  Description of Artificial Sequence: Synthetic coding sequence
atgccgtccagtgtgagctggggcatattgcttcttgccggtctgtgctgcctcgtacccgtgagtctggcccacggcgagggtacttttactagtgatctgtccaagcagatggaagaagaggccgtgcgtttgtttatcgaatggctgaagaacggcggcccctcctcaggggctcccccccctagt

SEQ ID NO: 18774 - DNA, 189 bp, Artificial Sequence
  Description of Artificial Sequence: Synthetic coding sequence
atgccttcgtccgtgtcgtgggggatcctgctccttgcaggtctttgttgccttgtgcctgtttcacttgcgcacggtgaaggcacttttacctccgacctttcgaagcaaatggaggaggaagcagtgagattgttcatcgaatggctcaaaaacggtgggcccagctcgggagcacctccaccatca

SEQ ID NO: 18775 - DNA, 189 bp, Artificial Sequence
  Description of Artificial Sequence: Synthetic coding sequence
atgccatcctcagtgtcatggggtatcctgttgttggctggactttgttgtctcgtgcccgtgagtctggcccacggcgagggcaccttcaccagtgacctgagtaagcagatggaagaggaagcagttaggctgttcatcgagtggttgaagaacggaggtccatctagtggtgcccctcctccctca

SEQ ID NO: 18776 - DNA, 189 bp, Artificial Sequence
  Description of Artificial Sequence: Synthetic coding sequence
atgccttcaagcgttagctgggggatcttattactggccggcctgtgctgtctggtgcccgtgagtctcgcccacggagagggaacattcactagcgacctcagtaagcagatggaagaggaggcagtgagactctttattgagtggcttaagaatggtggtccttcctccggcgcgcccccaccatca

SEQ ID NO: 18777 - DNA, 189 bp, Artificial Sequence
  Description of Artificial Sequence: Synthetic coding sequence
atgcctagctccgtctcatggggaattctgcttctcgcgggtctttgctgcctggtgcctgtgagcctggcccatggcgaggggactttcacttcggacctctccaagcaaatggaggaagaagccgtgcgcctcttcatcgagtggctgaagaacggtggcccttcgtccggagccccgcctccgtct

SEQ ID NO: 18778 - DNA, 189 bp, Artificial Sequence
  Description of Artificial Sequence: Synthetic coding sequence
atgccgtcctcggtgtcgtggggaatcctgctgctggccggactctgctgcctcgtgccagtgtcattggcacacggggaaggaacctttacctcagatctgtccaagcaaatggaggaagaagctgtccgcctcttcatcgagtggctgaagaatggtggcccatcctctggtgcgccgcccccgtcc

SEQ ID NO: 18779 - DNA, 189 bp, Artificial Sequence
  Description of Artificial Sequence: Synthetic coding sequence
atgccatcttcagtcagctgggggattctcctcctggccggactttgttgccttgtgcctgtgtcccttgcacatggtgaagggacctttacttccgatcttagtaaacaaatggaagaagaggctgtgcggctcttcatcgaatggcttaagaacggaggtcccagcagtggcgcgccgcctccttca

SEQ ID NO: 18780 - DNA, 189 bp, Artificial Sequence
  Description of Artificial Sequence: Synthetic coding sequence
atgcctagctcagtttcatgggggatactgctgctcgccggattgtgctgcctggtcccagtcagtcttgcacacggggaagggacttttacctctgacctttcaaagcaaatggaagaggaagccgtacgactattcatcgagtggttgaaaaatgggggtccctccagcggcgctcctccaccctcc

SEQ ID NO: 18781 - DNA, 189 bp, Artificial Sequence
  Description of Artificial Sequence: Synthetic coding sequence
atgccatcctctgtaagttggggaatcctgctgctggcagggctgtgttgcctggtgccagtctctctcgcgcacggcgagggaactttcacaagtgacctctccaaacagatggaggaggaagccgtgcgtctgttcattgagtggctcaaaaacggaggtccttcctccggtgcccctcctccatcc

SEQ ID NO: 18782 - DNA, 189 bp, Artificial Sequence
  Description of Artificial Sequence: Synthetic coding sequence
atgccatcatccgtgtcatggggaatacttctgttggctggtctgtgctgtctagtccctgtgtcactcgcccatggcgagggcacctttacctctgacctgtcaaaacagatggaagaggaggcagtacgcttgttcattgagtggctgaagaacggtggaccctcaagcggcgcacccccaccatct

SEQ ID NO: 18783 - DNA, 189 bp, Artificial Sequence
  Description of Artificial Sequence: Synthetic coding sequence
atgccatcttcggtgtcgtgggggatactcctcctcgcaggcctctgctgcctagtccctgtgtccctggcccatggtgagggcacattcactagcgatctgagtaagcagatggaagaggaggctgtgcgcctgttcattgagtggctgaagaacggcggtcctagcagcggcgccccgcctccctca

SEQ ID NO: 18784 - DNA, 189 bp, Artificial Sequence
  Description of Artificial Sequence: Synthetic coding sequence
atgccttcttcagtctcttggggaattctcttgttggctggcctgtgctgtctggtacctgtctctttagcccacggggaaggaacttttactagcgatctctccaagcagatggaggaggaggctgtgagactgttcatcgagtggctcaaaaacggtgggccaagcagtggcgccccccctccctct

SEQ ID NO: 18785 - DNA, 189 bp, Artificial Sequence
  Description of Artificial Sequence: Synthetic coding sequence
atgccctcttctgttagctggggaattcttcttctggcaggcctctgttgtctcgttcccgtgtcactggctcatggtgaggggacatttacctcagatctaagcaaacagatggaagaagaggcagtgagactgtttatagaatggctgaaaaacgggggacctagctccggggcccctcccccttct

SEQ ID NO: 18786 - DNA, 189 bp, Artificial Sequence
  Description of Artificial Sequence: Synthetic coding sequence
atgccgagctctgtatcttgggggatattactactggcaggactatgttgcctggttcctgtgtccctcgcccatggtgagggaaccttcactagtgatctgtctaagcaaatggaggaagaggccgtcagattgtttatcgagtggctgaaaaatgggggcccgtcgagcggggcccctcctcccagt

SEQ ID NO: 18787 - DNA, 189 bp, Artificial Sequence
  Description of Artificial Sequence: Synthetic coding sequence
atgccttcgtctgtttcctggggtatattgctgctggctgggctatgctgcttagttcctgtgtcccttgcccacggagaaggaacgtttacatcagacttgtctaaacagatggaggaggaagccgttagactgtttatcgagtggttgaaaaacggcggtccatcatctggggcaccaccccccagc

SEQ ID NO: 18788 - DNA, 189 bp, Artificial Sequence
  Description of Artificial Sequence: Synthetic coding sequence
atgccttccagcgtttcctgggggattctgctgctcgccgggctgtgttgtcttgttcctgtgtccttggctcacggcgaggggaccttcacttctgacctctcgaagcagatggaggaagaggccgtcaggctgttcattgagtggctcaaaaacggtggccccagctcaggggctcctccaccgtct

SEQ ID NO: 18789 - DNA, 189 bp, Artificial Sequence
  Description of Artificial Sequence: Synthetic coding sequence
atgcctagcagcgtgtcctggggaatcttgctactggccggcctgtgttgtctggtccctgtttccctagctcatggggagggcaccttcacctccgacctttctaagcaaatggaggaggaggctgttaggttgtttatcgagtggctaaaaaatgggggcccttcaagtggcgcaccacctccttcc

SEQ ID NO: 18790 - DNA, 189 bp, Artificial Sequence
  Description of Artificial Sequence: Synthetic coding sequence
atgccctccagcgtctcctggggcattctcctcctggctggattgtgctgcctggtcccggtttcacttgcacatggagaaggaaccttcactagcgacctgtcgaagcagatggaggaggaggcagtgagactcttcatcgaatggctgaaaaacggaggtccttcgtcgggagccccaccgccgtcg

SEQ ID NO: 18791 - DNA, 189 bp, Artificial Sequence
  Description of Artificial Sequence: Synthetic coding sequence
atgccatcatcagttagctggggcatcctcctgctggccgggttgtgttgtcttgtgcctgtgtccctcgcgcacggggagggcacatttaccagcgacttaagcaagcaaatggaggaggaggctgtgaggctgtttatcgagtggttgaaaaacggagggccgtcatcaggggcacccccaccctca

SEQ ID NO: 18792 - DNA, 189 bp, Artificial Sequence
  Description of Artificial Sequence: Synthetic coding sequence
atgccatcgtccgtgtcatgggggatcctgctcttggcgggactgtgttgtttggtgccagtcagccttgcacacggagagggcaccttcactagtgatctgtcaaaacaaatggaggaagaggccgtgcggctgtttatcgaatggctcaaaaacggcggaccctcctccggggcacctcctccgagc

SEQ ID NO: 18793 - DNA, 189 bp, Artificial Sequence
  Description of Artificial Sequence: Synthetic coding sequence
atgccctccagtgtgtcatgggggattctgttgctggctgggctttgctgtctggtgcccgtgagcctggcacacggagagggtacctttacgtccgacttgtccaaacagatggaggaggaggcagttagactctttattgagtggttgaagaatggcggcccttccagcggagctcctcccccatcc

SEQ ID NO: 18794 - DNA, 1392 bp, Artificial Sequence
  Description of Artificial Sequence: Synthetic coding sequence
atgtattccaacgtgattggtaccgtcacgtccgggaagaggaaggtgtacctgctgtccctgttgctcatcggcttttgggactgcgttacctgtcacggcagcccagtcgacatttgcacagccaagccgcgcgacatccctatgaaccctatgtgcatctaccggagcccagaaaaaaaagctactgaagacgaggggtctgagcagaagatccccgaagccaccaatcgcagagtctgggaactgagtaaggccaactcccgcttcgccaccacattttaccagcaccttgccgactccaagaatgacaatgacaatatctttctgtctcccctgtcaatttccaccgcgtttgcaatgaccaagctgggcgcctgcaacgataccttgcagcaactcatggaggtttttaagttcgacaccataagcgaaaagacatccgatcagatccacttcttctttgcaaaattgaactgccggctttatcggaaggccaacaagagctccaaattggtctctgctaatagattgttcggggacaaaagcctgacgttcaatgaaacgtatcaggatatctccgagcttgtgtatggcgccaaattgcaaccgcttgatttcaaggaaaacgccgagcaatccagagctgccataaacaagtgggtttccaacaaaacagaagggaggatcactgacgtgattccaagcgaggcaatcaatgagctgaccgtgcttgtgttggttaatacaatctatttcaaaggcctctggaagtcaaaatttagtcccgagaatacccgcaaggagcttttctataaggctgacggtgaaagttgttcagccagtatgatgtatcaggaggggaaatttcggtaccgccgggtggcagaaggaacccaggtccttgagctgccatttaaaggtgacgatatcactatggtgctcatcttgccaaagccagagaagtccctggccaaagttgaaaaggaactgacacccgaggtattgcaggaatggctcgatgaactggaagagatgatgctcgttgtgcacatgccaaggttcagaattgaggacgggttcagccttaaggagcagctgcaggacatgggtcttgtcgacttgtttagtcccgaaaaaagcaaacttccagggattgtggccgaaggtagggatgacctgtacgtgtccgacgcgtttcacaaggcctttttggaggtgaatgaggaaggcagtgaggccgcagcaagcactgctgtggtgattgcaggacgatcactgaacccaaacagagtgacctttaaggctaacaggccctttctcgtgttcatacgagaagtgcccctgaataccattatttttatgggcagagtggccaacccctgcgtgaag

SEQ ID NO: 18795 - DNA, 1392 bp, Artificial Sequence
  Description of Artificial Sequence: Synthetic coding sequence
atgtactcgaacgtgatcggaacggtgacaagcggcaagcgcaaggtgtacttgctgtctctacttctgattggattttgggactgtgtaacgtgtcacgggagtcctgtggatatatgtaccgctaaacctcgcgatatccccatgaatccaatgtgcatctatcgttccccggaaaagaaggcaaccgaggatgaaggatctgagcagaagatcccagaggccactaatagacgagtgtgggaactttctaaggctaattccagattcgcaactacattttatcagcatttggccgatagcaagaacgacaatgataacattttcctgtcccccctttcaatcagtacagcctttgcgatgaccaaactcggtgcatgtaacgacactctgcagcagcttatggaggtgtttaaattcgacacaatatctgaaaaaacctcagatcagatccatttcttttttgctaagcttaattgtcgattataccgtaaagccaataagtcatcaaaactcgtgagcgcaaataggctattcggcgacaagtcattgaccttcaatgagacctaccaggatattagcgaactggtttatggggccaagttgcagccactggatttcaaggaaaacgctgagcagagccgtgccgcaattaacaagtgggtgtcgaataagaccgagggcagaattacagatgttatcccaagtgaagctatcaacgagctgactgtgctcgtgctcgttaataccatctattttaagggtctgtggaagagcaaatttagccctgaaaatacccgcaaagagttgttctacaaggccgacggggagtcttgctctgcatccatgatgtaccaggaggggaaattcaggtacaggagggttgctgaaggcactcaggtcctggagctccctttcaagggagacgatatcaccatggtgctgattctacccaagcctgagaaaagcctcgccaaggtggagaaggagctcactccagaggttctgcaggagtggttagatgaactggaagagatgatgctcgtcgtccatatgcctaggttcaggatcgaagatggttttagcctaaaagagcagttgcaggatatgggactggtcgacctgttcagtccagaaaagagtaaattaccagggatcgtggctgaggggcgtgacgatctgtatgtgagtgacgcctttcacaaggcattcctggaggtgaacgaagaaggctctgaagcagccgccagtactgctgtggtgattgctggacggtctctgaatcctaatcgggttactttcaaggccaacagacctttcctggtgttcatcagggaggtgcccctgaatactatcatctttatggggcgggtcgcaaacccctgcgtcaaa

SEQ ID NO: 18796 - DNA, 1392 bp, Artificial Sequence
  Description of Artificial Sequence: Synthetic coding sequence
atgtactcgaacgttattggtacggtcacatcgggtaaacgtaaagtgtatctcttaagtcttcttttgatcggtttctgggattgtgtgacgtgtcacgggtctcctgttgacatttgcactgcgaaacctcgtgatattccaatgaacccaatgtgtatctatcgaagcccagaaaagaaagctactgaagatgaaggaagtgaacagaaaatcccagaagcaacaaacaggcgtgtttgggagttgagtaaagccaatagtcgatttgcgacaacgttttaccagcaccttgccgattctaagaatgataatgataatatttttctgagtcccttgagcatttcaactgcgttcgctatgacaaagcttggtgcttgtaatgatacacttcaacagctcatggaagtgttcaaattcgatactatttctgaaaaaacaagcgatcaaattcacttttttttcgcgaagcttaattgcagactttacagaaaagcaaacaagtcatcaaaactagtctcggcaaaccggcttttcggagataagagcctgaccttcaacgagacatatcaagatatttctgagctcgtgtatggggccaagttacaacctctcgatttcaaagaaaatgctgagcaatctagagccgcaataaataagtgggttagtaataagacggaaggaagaattactgatgtaattccatcggaggcaatcaatgaactgacggtgctcgtgctggtgaatactatttactttaaaggtttgtggaagagtaaattcagcccggagaacactagaaaggaattgttctataaagctgatggagaatcatgttctgccagtatgatgtatcaggaaggcaagtttaggtatcgacgggtcgcagaaggtacccaagtgttggagctcccgttcaagggtgatgacattacaatggttctgattctcccgaaaccagagaaatctctagcaaaagtggagaaagaactcactccggaagttttgcaggagtggctcgatgagctagaggaaatgatgcttgtggtacacatgccaagatttcgtattgaagatggatttagcttgaaagaacaattacaagacatgggacttgttgacctgttttcaccagaaaagagtaaattaccaggtatagttgcagaaggtcgtgacgatctatacgtctctgatgcctttcacaaagcattcttagaggtgaatgaagaaggatctgaagcggcagcttccacagcggttgttattgccgggagatcgcttaatccaaatcgtgttactttcaaagcaaatagaccatttctagtttttattcgagaagtgccgttaaataccattattttcatgggacgagttgccaatccatgtgtcaag

SEQ ID NO: 18797 - DNA, 1392 bp, Artificial Sequence
  Description of Artificial Sequence: Synthetic coding sequence
atgtactcaaatgtcattgggactgtgacctccgggaagcggaaagtctacctgctgtcgctgctgctcattggattttgggattgcgttacctgtcatgggtccccagtcgatatctgtacggcaaagcctcgggatattccaatgaacccaatgtgtatttaccgtagcccggagaaaaaggcaaccgaagatgaaggatcagaacaaaagattcccgaagcgaccaatcggcgtgtgtgggagctgtccaaggcaaacagcaggttcgcgactaccttttaccaacatttggccgatagcaagaacgataacgacaatatctttctgtcgccgctgtctatttcgactgcatttgcaatgactaagctcggagcatgcaacgatactcttcagcagctgatggaagtgtttaagtttgacaccatctcagaaaagacctccgatcaaattcactttttctttgcaaaactcaactgtcgcctgtaccgcaaggcaaacaaatcgagcaagctcgtctcagcgaatcggctgtttggtgacaagtccctgacttttaacgaaacctaccaagacatttccgagctcgtctacggagctaaacttcagcctctggactttaaggagaacgcagagcagtccagagcagccattaacaaatgggtgtcgaacaagactgaaggaagaattacggatgtgataccttccgaagctattaacgagcttaccgtgctggtcctcgtcaacaccatctacttcaaagggttgtggaaatcaaagttctcccctgaaaacacccgaaaggagcttttctacaaggccgacggggaaagctgctcggcctcgatgatgtaccaggaaggcaagttccgatatagacgcgtcgccgaaggaacccaggtgctggaacttccctttaaaggagatgatattactatggtcctgatactgccaaagcctgagaaaagcctcgcgaaggtagaaaaagaattgacgccagaagtcctgcaagaatggcttgatgagctggaggagatgatgttggttgtccacatgcccagattcagaattgaggatggattttcacttaaggagcaacttcaggatatgggtttggtcgatcttttttcgcccgagaagtcaaagctcccagggattgtcgccgaaggccgggacgatctgtacgtgtccgacgcttttcacaaagcattcctcgaggtcaatgaggaggggtccgaggcagcagcatccaccgcagtggtgatcgcagggagatcactgaaccctaacagggtgacgtttaaagcgaacagacctttcctggtgtttattcgggaagtgcctctgaacacgataatctttatgggacgagtggcaaacccatgtgtgaag

SEQ ID NO: 18798 - DNA, 1392 bp, Artificial Sequence
  Description of Artificial Sequence: Synthetic coding sequence
atgtactcaaacgttatcggaactgtgacctcaggaaagcgtaaggtctacctcctctcgcttcttctgattggattttgggattgtgtgacctgccatgggagcccagtcgatatctgtactgcgaagccccgagatattcctatgaaccctatgtgcatctaccgctccccagaaaagaaggcaactgaggatgaaggatctgaacagaagatacccgaggcaacgaacaggagggtgtgggagctttccaaagcgaactcccggtttgcgaccaccttctaccagcacctggcagactctaagaatgacaacgacaacatctttctgagccctctttccatctcgaccgcctttgctatgaccaagctgggtgcatgcaacgacaccctgcagcagctcatggaagtgttcaagtttgatacgatttcggaaaagacgagcgatcaaattcacttctttttcgcaaagctgaattgtcgactgtataggaaggcgaacaagtcatcgaagctggtcagcgctaaccgcctcttcggcgacaaaagcctgacttttaacgaaacctaccaggatatctccgaactggtgtacggggcgaagttgcaacccctggactttaaagaaaacgccgaacagagccgagcagcaatcaacaaatgggtgagcaacaagaccgaaggaaggatcaccgatgtcattcctagcgaggcaattaacgaacttactgtgctggtccttgtcaacaccatttacttcaagggcctctggaagtccaaattctcgcctgaaaatactaggaaggaacttttctataaagccgacggcgagtcctgttcagcatccatgatgtaccaggagggtaagttccgctaccgtcgggttgcagaaggtacccaggtgcttgaacttcctttcaagggagacgatatcactatggtgcttattctccctaagccggagaagagcctggcaaaggtcgaaaaggaacttactcctgaggttctgcaggaatggcttgatgaacttgaagagatgatgcttgtcgttcacatgcccagatttcggatcgaggacggtttctcgctgaaggaacaactccaggatatgggtcttgtggaccttttctcaccagaaaaatccaaactgccggggatcgtggcagagggacgtgatgacctctacgtctcggatgctttccataaggctttcctggaggtgaacgaggagggaagcgaagccgcagcctccactgccgttgtgatcgcaggtagatcgttgaatcctaaccgagtcacctttaaggcaaatcgccccttccttgtgtttatcagagaagtgccattgaacaccataatctttatgggaagagtcgcgaatccctgtgtgaag

SEQ ID NO: 18799 - DNA, 1392 bp, Artificial Sequence
  Description of Artificial Sequence: Synthetic coding sequence
atgtactcaaacgtgatcgggaccgtgactagcggaaagagaaaggtgtacctcttgtcgctgctgctgattggcttttgggactgcgtcacttgccacgggtcaccagtggacatctgcactgccaagccacgggatattccgatgaaccccatgtgcatctaccgcagcccagaaaagaaggcaactgaagatgaaggcagcgagcagaagatcccagaagctaccaatcggcgggtctgggagctgtcgaaagcgaattccaggttcgcgaccaccttctaccagcatctggccgactcgaagaacgacaatgacaacatctttctgtcccctctgagcatttcgaccgcattcgccatgaccaagctgggggcatgcaacgacactctgcagcagcttatggaagtgttcaagtttgatactatctccgagaaaaccagcgaccaaatccacttcttttttgccaagctgaactgtcgcctgtaccgcaaggctaacaagtcctccaagctggtgtcggccaacagattgttcggcgataagtcccttacttttaacgaaacctaccaggacatctccgaactggtgtatggggccaaactccagccgctggatttcaaggagaatgctgaacaaagccgcgcagccatcaacaagtgggtgtcaaataagaccgaaggtagaatcactgacgtgattccaagcgaggccatcaacgaactgaccgtcctggtgctggtcaacaccatctacttcaagggactttggaaatccaagttctccccggaaaacacgcggaaggagctcttctacaaggcagatggagaatcatgttcggcctcgatgatgtaccaagaaggaaagttccgctaccgcagagtcgccgaaggcacccaggtgctggagttgccgttcaagggagatgacatcactatggtcctcattctgccgaagccggagaagtccctggccaaggtggagaaggagctgaccccagaagtgcttcaggagtggctcgatgaactggaagaaatgatgctggttgtgcacatgcctcgcttccgcatcgaggacggatttagcctcaaggaacagctccaggacatgggactcgtggacctgttttcacccgaaaagtcgaaactgcctggaatcgtggccgaaggccgcgatgacctttacgtttccgacgcattccataaggcattccttgaagttaacgaagagggctccgaagccgcggcctcgaccgccgtcgtcatcgcgggtcggtcgctcaaccctaatcgcgtgaccttcaaggcgaataggccctttctggtgttcatccgggaagtgcctttgaataccatcatctttatgggacgagtcgcgaacccgtgtgttaag

SEQ ID NO: 18800 - DNA, 1392 bp, Artificial Sequence
  Description of Artificial Sequence: Synthetic coding sequence
atgtactctaatgtaataggcactgtcacttccggtaaacggaaggtctatctgctatctctgttgctcatcggcttctgggactgcgtcacctgccacgggtctccagtggacatctgcaccgccaagcctagagatatccctatgaaccccatgtgtatctaccgctctcctgagaagaaagccacagaggacgagggtagcgaacagaaaatccccgaggccaccaacagacgggtatgggagctcagcaaggctaatagtagattcgcaacgacgttttatcagcacctggctgatagcaagaatgacaacgataacattttcctgtcacccctgagtatatcaacggcatttgccatgaccaagttgggcgcatgtaatgacaccttgcagcagttgatggaagtcttcaaattcgatacgatctccgaaaagacatcagaccaaatccacttcttcttcgcgaagttgaactgccgtttgtatcgcaaggccaacaaatcttccaagctcgtgagcgccaatcggctgtttggggacaagtctttaacatttaatgaaacctaccaagacatttctgaacttgtctatggcgcaaaacttcagcccttagatttcaaagagaatgccgagcagtcccgcgctgcaattaataagtgggtcagcaataagaccgaaggccggattaccgacgtgatcccttctgaggccattaatgaactgactgtcttggtgttggtcaacaccatttacttcaagggcttgtggaagtctaagttttcaccagagaacacaaggaaagaattgttttataaagccgacggggagtcttgttctgcaagcatgatgtaccaagagggaaaattccgctatcgtagagtggctgagggaactcaagttctcgagctgccctttaagggggacgacattactatggtgcttatcttgcctaaacctgaaaaatcattggcaaaggtggagaaagagttaaccccggaggttctccaggagtggctggatgaactcgaggagatgatgctcgtagtccatatgccccggtttcgtattgaggatggattttcgctgaaggagcagttgcaagatatgggcctggtggacctgttttctcccgagaagtcaaagcttccgggcattgttgccgaaggccgagacgatctctacgtatcagatgccttccacaaggcattcctggaagtgaacgaggaaggaagcgaggcagcagcctctaccgccgtcgtaatagcagggaggtccctcaatcctaatcgcgtgacattcaaggccaaccgaccgtttcttgtcttcattagagaggttcccctcaacaccataatcttcatgggcagagtagccaatccttgcgtgaag

SEQ ID NO: 18801 - DNA, 1392 bp, Artificial Sequence
  Description of Artificial Sequence: Synthetic coding sequence
atgtactccaacgtgatcggcaccgtcacaagcgggaagcgaaaggtctatctcctgtctctgttactgataggtttttgggactgcgtgacgtgtcacgggtctcctgttgacatttgcacggcaaaaccaagggacatcccaatgaacccaatgtgcatctatagatcccccgaaaagaaggccaccgaggacgaaggctcagaacagaagatccccgaagctaccaaccggagagtgtgggaactgtcaaaagcgaactcccggttcgcgaccactttttatcagcacttggccgatagtaaaaatgacaatgacaatatctttctatcacccctcagcatttcgaccgcattcgccatgactaagctcggggcttgtaacgacaccttacagcagttgatggaagtgtttaaattcgacacgatttcagaaaagactagcgatcaaattcacttttttttcgctaagttgaactgccgactgtatcgcaaggcgaacaagtcctccaaattagtctcagccaacaggctttttggagacaaatctctgacttttaatgagacataccaggacatctcagagctggtctacggagctaagctgcagcccttggattttaaagagaacgctgagcaaagcagggcagcaatcaacaaatgggttagcaacaagactgaaggccgaatcaccgacgttattcctagtgaggcgattaatgaactgaccgttctggttctggtgaatacgatctattttaaaggattgtggaagagcaaattctcacccgaaaataccaggaaagaattgttctacaaagccgacggcgaaagctgtagcgcaagcatgatgtaccaggagggtaagtttcgctatcggagggtggccgagggtacccaggtgctggagcttcctttcaaaggcgacgacattacgatggtccttatcctgcccaagcctgaaaaatctctggccaaggttgaaaaagaacttacaccagaagtactgcaggagtggttggatgagttggaagaaatgatgctagttgtccacatgccccgtttcaggatagaagatgggttcagtctgaaggaacagctacaagacatggggctggtagacctcttttcacccgagaaatccaagctgcccgggatcgtcgccgagggccgagacgacctgtatgtctctgacgcatttcacaaggcctttcttgaagtgaacgaagaagggagcgaggctgccgcctctacagcagtggtgatcgccggcaggtcactcaatcctaacagggttacatttaaggccaatagaccattccttgttttcatccgggaggtgccgcttaataccattatttttatggggagggtggccaacccttgcgttaaa

SEQ ID NO: 18802 - DNA, 1392 bp, Artificial Sequence
  Description of Artificial Sequence: Synthetic coding sequence
atgtattctaatgttatcggcacagttacatccggcaaaaggaaggtgtacctcttgagtctgctgctcattggcttctgggattgcgtgacttgtcacggctcccctgtggacatctgcacggcaaagccccgcgatattccgatgaaccctatgtgtatctacaggagccccgaaaagaaagccacagaagatgagggctctgagcagaaaataccagaagccaccaacaggcgagtgtgggagctgagcaaagcaaatagccggttcgcgacgacattttatcagcacctggccgattctaagaacgacaatgataacatatttttgtctcctctaagcatctccacggcctttgccatgactaaactgggggcctgcaacgacaccctgcagcaacttatggaagtatttaaattcgatacaatttccgaaaagacatccgaccagatccacttcttcttcgccaagctgaactgtagactatacaggaaggccaataaatcctcgaagttggttagcgcgaatcgattgttcggagacaaatctttaactttcaacgaaacttaccaagacatatctgagctggtttacggagccaagctgcagccactggattttaaagagaatgccgagcagagtcgcgctgccataaacaagtgggtgtccaataagactgagggtaggattaccgacgtcatacccagcgaggccatcaatgaactaaccgtgctggtgctcgtgaacactatttatttcaaaggactttggaagagcaaattctcacccgagaatacacgtaaggaactgttctataaagccgacggagaatcgtgtagtgcaagtatgatgtatcaggagggtaaatttaggtataggagggttgcggagggaacacaagttctggaactcccattcaagggagatgacattaccatggtactaatcctacctaagcccgaaaaatcactggccaaagtagagaaggagctgacacctgaggtcctgcaggaatggctcgatgagttggaagaaatgatgctggtcgtccatatgcctagatttaggatcgaggacggcttcagccttaaggaacagctccaggatatgggattggttgatctgttctcccccgagaaatcaaagttgccaggaattgtcgcggagggtcgtgacgacctatatgtgtcagacgctttccataaggcctttctagaagtgaacgaagaaggttcggaggctgctgcctcgaccgcggtagtgatcgcaggacggagcctcaatccaaacagagtgactttcaaagcaaatagacctttccttgtgtttatccgcgaggtccccttaaacacaatcatatttatgggcagagttgctaacccctgtgtcaaa

SEQ ID NO: 18803 - DNA, 1392 bp, Artificial Sequence
  Description of Artificial Sequence: Synthetic coding sequence
atgtattctaatgtgataggcacggtcacaagcggcaaaagaaaggtgtacttgctgtctcttctcctgattggattttgggattgtgtaacttgccacggaagccccgtggatatctgcactgcaaaacccagggacattcctatgaacccaatgtgcatctaccgaagccccgaaaaaaaggcaaccgaagacgaagggtctgagcaaaagattcctgaagcaactaataggagggtgtgggagctgtcgaaagctaatagtaggtttgcaaccaccttttatcagcatctagccgactcaaagaatgacaacgacaacatcttcctgtccccactcagtatatccaccgccttcgccatgaccaaattgggggcttgcaatgatacactacaacagcttatggaggtgttcaagttcgacactatttctgaaaaaacatcagatcagatccatttcttctttgcaaaactgaattgccgcttgtacagaaaggctaacaagtcgtctaaacttgtgagcgcgaaccgactttttggggataaatctcttaccttcaacgaaacatatcaggacatctccgaattggtgtatggggcgaagttgcaacctctggacttcaaggagaacgcagagcagagccgagccgctattaataaatgggtatctaacaagactgagggtcgaatcactgacgtgataccgtccgaggccatcaatgagttgaccgtgcttgtgctggtcaacaccatatacttcaaaggtttatggaagtccaagttctctcccgagaatacgcggaaagaactgttttacaaagcagatggcgaaagttgctctgcctccatgatgtaccaggagggcaaatttaggtataggcgtgtggccgaagggacccaggtcttagaactgccattcaaaggcgatgatataaccatggtgttgatactgcccaagcccgaaaagtccctggcgaaagtggagaaagaactgactcccgaagtactccaggagtggctggacgagcttgaggaaatgatgctggttgtccacatgcccaggttccgaatcgaggacggtttttccttaaaagaacagcttcaggatatggggcttgtggacctgttctccccagaaaaaagcaagctgcccgggatcgttgcggaaggccgagacgacctgtacgtgagcgacgcattccataaggcctttctcgaagtcaacgaagaaggtagcgaagctgcagccagtacagcagtggtgatagccggccgatcactcaatcctaacagagttactttcaaggcaaaccgtccgttcctggttttcatcagagaggtgcctctgaatacaattatcttcatgggacgtgtcgctaacccttgcgtgaag

SEQ ID NO: 18804 - DNA, 1392 bp, Artificial Sequence
  Description of Artificial Sequence: Synthetic coding sequence
atgtatagtaatgttattggtacggtgacaagcggcaaacgaaaagtgtatttgctgtctctgctccttattggattttgggactgcgttacttgtcatggcagccccgtagacatttgtacggctaaaccgagggatatcccgatgaacccgatgtgcatttatagatcccctgagaaaaaagctaccgaagacgagggatctgaacagaaaatcccagaggcgactaatagaagagtgtgggagctgtctaaagcaaattcgaggtttgccacaacattttaccagcatttagccgactcaaaaaatgacaatgataatatttttctttcgccgttatctatctccacggcttttgctatgacaaaattaggggcctgcaatgacactttacagcaactgatggaggtcttcaaatttgatacgatttctgaaaaaacatcagatcaaatccatttctttttcgctaaactgaattgtcgattgtacaggaaagcgaataaatcaagcaaactggtgtctgcgaatagactctttggtgacaagtcattgacttttaatgagacgtatcaagatatttcggaacttgtgtatggagcgaaactccaaccgctggacttcaaagaaaatgcagaacagagcagggcagctatcaataaatgggtctcaaataagactgagggcagaataacagacgtaattccatcagaagcgatcaacgaactgaccgtcctggttcttgttaatacgatttattttaaaggactgtggaagtcgaaattctcaccggagaacactcgaaaggaactgttttataaagcggatggagaaagttgctccgcatctatgatgtaccaggaaggcaagttccgataccgcagagttgcggaagggacacaagttctggagttaccgtttaaaggagatgatattacgatggtcctgatcctccccaaacctgaaaaatcattagcgaaagtggagaaggagctaacaccagaagttcttcaagagtggctggatgagctcgaggaaatgatgctggtcgtacatatgccaagattcagaatcgaagatggcttttctctcaaggagcagcttcaggatatggggttggtagatctgttttcacctgaaaaatctaagctgccgggaatcgttgcggaaggtcgagacgacttatatgtgtccgatgcgtttcacaaagcctttcttgaagtcaacgaagagggcagtgaggctgcggcatcaaccgctgtggtcatcgctgggcgatcattaaaccctaatcgtgtgaccttcaaggcgaaccgtccgttcctggtttttattcgggaagtaccactaaacacaatcatttttatgggtagagtcgctaacccctgtgtgaag

SEQ ID NO: 18805 - DNA, 1392 bp, Artificial Sequence
  Description of Artificial Sequence: Synthetic coding sequence
atgtactccaatgtcattggaacggtgaccagtggaaagaggaaggtgtacctgctctcactccttctgatcggattttgggactgtgtgacttgtcatggcagcccagtggacatttgcaccgccaagccacgggatatcccaatgaaccctatgtgcatctaccggtcgccagaaaagaaggcaacggaagatgagggttcggaacagaagattcctgaggcaactaatcgacgggtctgggagctctcaaaggcaaactccagattcgccactaccttctaccaacacctggcagacagtaagaacgataatgataacatttttctgagccctcttagcatctccactgcatttgctatgaccaagctgggtgcatgcaacgatacgctccagcaacttatggaggtgttcaaatttgataccatttcagaaaagacctccgatcagatacacttctttttcgcaaagctgaactgtaggctttatcgtaaggcaaataagtcgtccaaactggtgtccgcaaatcggctcttcggtgacaagtcgttgacctttaacgaaacctaccaagatatttcggaacttgtgtacggagcgaagctgcaacctctggatttcaaagagaatgctgagcaatccagagcagcaattaacaaatgggtgtcgaataagaccgagggccgcatcacggatgtcattccaagcgaggccatcaatgaactgactgtccttgtgctcgtcaataccatctacttcaagggactttggaagtctaagttttcccctgagaacactcgaaaagagttgttctacaaggcagacggcgaaagctgttccgcctccatgatgtaccaagaggggaaatttcgttaccgtcgggtggctgagggaacccaggtgcttgaactgccctttaagggcgatgacatcaccatggtgttgattctgccaaagccggaaaagtcccttgcgaaggttgaaaaggaacttacgcccgaagtgctgcaggaatggcttgacgaacttgaagagatgatgctggtcgtgcacatgcctagattccgcatcgaggatggattctctctgaaggaacaactccaggacatgggactggtggaccttttttcgcccgagaaaagcaagttgcctggtatcgtcgccgaaggtcgcgacgatctctacgtcagcgatgcgttccacaaagcctttcttgaagtcaacgaagaaggaagcgaagcggccgcatccaccgcagtggtgattgcgggtcgctcccttaaccctaacagagtcaccttcaaggcgaatcgccccttccttgtgttcatccgagaagtgcccctgaataccatcatattcatgggccgcgtcgcaaacccttgcgtgaaa

SEQ ID NO: 18806 - DNA, 1392 bp, Artificial Sequence
  Description of Artificial Sequence: Synthetic coding sequence
atgtattcgaacgtcatcggtacggtcacgtcgggcaaacgtaaggtgtacctgctgtccctcttgctgatcggcttttgggactgtgtcacctgccatggcagtccagtggatatctgcacggcgaagccgcgagatatcccaatgaaccctatgtgtatctatcggagccctgagaagaaggctacggaagatgaaggttctgagcaaaagattccagaagccacgaaccgtcgcgtttgggaactctccaaagccaattccaggtttgccaccaccttctaccaacaccttgcggactcgaagaacgacaacgacaatatcttcctcagccctctgtccatcagcacggctttcgcaatgactaagctgggagcctgcaatgataccttgcaacagctaatggaagtgtttaaatttgacaccattagcgagaagacctcggatcagatccactttttctttgccaagctcaactgccgtctctatcggaaagccaacaagtcgtccaagttggtctcagcgaataggctgttcggtgacaagtctctgaccttcaacgaaacctaccaggacatctcagagctcgtctacggcgcaaagctgcagcctttggacttcaaggagaacgctgagcagtcccgcgccgccatcaataagtgggttagtaacaagaccgagggcaggatcaccgatgttattccatccgaggctatcaacgagttgaccgtcctagtccttgtcaacaccatctactttaagggactctggaaatcgaagttctctccggagaatacgagaaaggagctcttctacaaggccgacggcgagagctgctccgctagcatgatgtatcaagaggggaagttccgatatagacgcgtcgctgagggtacccaagtgctggagcttcctttcaagggggacgacatcaccatggtcctaatcctcccgaaacctgagaagagcctcgccaaggtcgagaaggagctgactcccgaggtcctccaggagtggttggatgaactcgaggaaatgatgttggtcgttcacatgccgcgtttccgcattgaggatggcttcagcctgaaggagcaactgcaagatatgggccttgttgacctgttcagccccgaaaagtccaagctgccaggtatcgtcgctgagggaagggatgacctttacgttagcgacgccttccacaaggcctttctggaggtcaacgaggagggttccgaggccgcagccagcactgcagtcgtcatcgccggccgctctctgaacccgaacagagtcactttcaaggcgaaccgccctttcctggttttcattcgggaagtcccgctcaacaccataatcttcatgggtcgggtggcgaacccatgtgtcaag

SEQ ID NO: 18807 - DNA, 1392 bp, Artificial Sequence
  Description of Artificial Sequence: Synthetic coding sequence
atgtacagcaacgtgatcggcactgtgacttcgggtaagagaaaggtgtacctgctgtctcttttgctgattggcttctgggactgtgtgacctgccatggaagcccagtcgatatatgtacggccaagccacgcgatatcccaatgaaccctatgtgtatctaccgctcgccggaaaagaaggccactgaagatgagggttctgaacaaaagatcccggaggcaactaaccggcgcgtgtgggaactgagcaaggcaaattccagattcgcaaccaccttttaccagcacctcgccgactctaagaacgataacgacaacatctttcttagccctctttcgattagcactgcgtttgcaatgacgaaacttggagcctgtaacgataccctccaacaactcatggaagtgttcaaattcgacacgatttcagaaaaaacctccgatcagatacatttcttttttgcaaagctcaattgcagactttaccggaaggcgaataagtcgtcgaagctggtgtcagctaatcggctgttcggggataagtcactgacgtttaacgagacttaccaagacatctccgagcttgtgtacggggcaaagctccagccactcgatttcaaggaaaacgctgagcagtcccgcgcagcgattaacaagtgggttagcaacaagaccgaaggaaggattaccgacgtgattccctccgaggccattaatgaacttactgtccttgtgcttgtgaatactatctactttaaaggtctttggaaatctaaattctcacctgagaatacccggaaggagctgttctacaaggccgatggagaatcctgtagcgcatcgatgatgtaccaggaaggcaagtttcgatatagacgggtcgcggagggcactcaagtcctcgaactgccgtttaaaggagatgatattaccatggtgctcatcctcccaaaacccgaaaagtcgctggcaaaggtggaaaaggaacttactcctgaagtactgcaagaatggctcgacgagttggaggaaatgatgctcgtggtgcacatgcctcggttcaggatcgaagatgggtttagcttgaaggagcaacttcaggatatgggacttgtggatctgttttcaccggagaaatcgaagctccccggaattgtggcggagggtagagacgacttgtatgtgtcggatgcctttcataaagcatttttggaagtgaacgaagaagggtcggaagccgcagcctccactgcagtcgtgattgccggacggtcacttaaccccaatagggtcacttttaaggcaaataggccctttctggtgttcattagggaggtgccgctgaataccattatctttatgggacgtgtggcgaacccctgcgtgaaa

SEQ ID NO: 18808 - DNA, 1392 bp, Artificial Sequence
  Description of Artificial Sequence: Synthetic coding sequence
atgtactcaaatgtgatcggcactgtcacttcgggcaagcgcaaagtgtacctcctgagcctgttgctgattgggttctgggactgcgtgacctgccacgggagcccagtggatatttgcaccgcgaaacctagagacatcccaatgaacccaatgtgtatctatcgctccccagaaaagaaggcgactgaggacgaaggctcggagcagaaaatcccggaggctaccaatcggcgcgtgtgggaactctccaaggccaattcacgcttcgccactaccttctaccagcacctggcagattccaaaaatgacaatgacaacatctttctgagcccattgagcatctcgaccgctttcgcaatgactaagctcggcgcatgcaacgacaccctccagcagctgatggaggtgttcaagtttgatactattagcgaaaagactagcgatcagatccatttcttcttcgccaaactgaattgccggctctaccgcaaggccaataagtcctcgaagctggtgtcagccaaccggttgttcggagataagagcctcaccttcaacgaaacctaccaggacattagcgaactggtgtacggagccaagctccaacctctggatttcaaggagaacgcggaacaatcccgggcggcaatcaataagtgggtgtccaacaagacggaaggccggatcacggacgtgatcccgagcgaggccattaatgaactcactgtgctggtcctggttaacaccatctacttcaagggactgtggaagtccaaattctcgccggagaataccaggaaagagctcttctacaaggcggatggcgaatcatgctcggcctcgatgatgtaccaggagggaaagttccgctaccgcagagtcgccgaggggacccaagtcctggagctgccctttaagggagacgacatcactatggtcctcatcctgccaaaacctgaaaagagcttggccaaagtggagaaggagctcactcctgaggtgcttcaagaatggctggatgagctggaggaaatgatgctggttgtgcacatgccgcggtttcgcatcgaggacggtttctcattgaaagaacaacttcaggacatgggactggtcgacctgttttcgccggaaaaatcaaaacttccgggaatcgtggcggagggacgcgacgacctgtacgtgtcagatgccttccacaaggccttcctggaagtgaacgaggaaggtagcgaggccgcggcaagcaccgcagtggtgattgcagggcgctccctcaacccaaatagagtgacgttcaaggccaatcgcccatttttggtctttatcagagaggtgccgctgaacacgataatcttcatgggaagagtcgccaatccatgcgtaaag

SEQ ID NO: 18809 - DNA, 1392 bp, Artificial Sequence
  Description of Artificial Sequence: Synthetic coding sequence
atgtactccaacgtgattggaactgtgacttcaggaaaacggaaagtctacctgttgtccctcctgttgatcggattctgggactgcgtgacttgtcacggaagtccagtagacatctgtactgctaagccacgcgacatccccatgaacccaatgtgcatttacaggtcgccagagaagaaggccactgaagatgagggatcagaacaaaagatcccagaagccaccaatcggcgtgtctgggagttgtcgaaggcgaactcacgcttcgccactaccttttaccagcatttggccgattccaagaacgataatgataacatctttctctcaccgctgtctatctcgaccgcctttgcgatgaccaagctcggcgcctgtaatgatacgctgcagcaactcatggaggtgttcaagttcgacacgatctcggagaaaacttcagatcagattcactttttcttcgccaaactcaactgcagactgtacaggaaggcgaataagagctccaagctggtgtcggcaaatcggttgttcggggacaaatcgctgacgtttaacgaaacctaccaggatatctctgaactcgtgtacggcgctaagctgcaacctctggatttcaaagaaaacgccgagcagtcacgcgcggccatcaacaaatgggtgtccaacaagactgaaggacgcatcaccgacgtcattccctccgaagccatcaacgagctgactgttctggtgctggtgaatacgatttacttcaagggactgtggaagtcgaagttttcgccagaaaacacccgcaaagagctgttctacaaagcggacggcgaatcgtgctcggcgagcatgatgtatcaagaagggaagttcagataccggagggtggcagagggtacccaagtcctggaacttccgttcaagggagacgacatcaccatggtgttgatcctccctaagccagaaaagtccctggcaaaggtcgaaaaggaactgaccccggaagtgttgcaggagtggctggatgaactggaggaaatgatgctggtcgtgcatatgccgcggttccggatcgaggacgggttctccctcaaggaacagttgcaggacatgggccttgtggatctgttttcgccggaaaagagcaagttgcctggaatcgtggctgaaggacgggacgacctctacgtctccgacgccttccataaggctttcctggaagtgaacgaggaaggatctgaagcagcagcctcaaccgccgtcgtcatagccggcagatcgctcaacccgaaccgggtgaccttcaaggccaacaggccattccttgtattcatccgggaggtgccgctcaacactatcatctttatgggccgggtcgctaacccgtgcgtgaaa

SEQ ID NO: 18810 - DNA, 1392 bp, Artificial Sequence
  Description of Artificial Sequence: Synthetic coding sequence
atgtacagcaacgtgataggcactgtgacctctggcaaacgtaaggtttacctgctctccctcctccttattggcttctgggactgcgttacatgccacggcagtcctgtggacatctgcacagccaaacctcgtgacatccccatgaatccaatgtgtatctacaggtctccagagaagaaggctaccgaagatgagggatctgaacagaagatcccagaagctacaaacagaagagtgtgggaactcagcaaggctaactctaggttcgctactacattctaccagcacctggccgattctaaaaacgacaacgacaacatcttcctgtcccccttgtccatctcaaccgctttcgccatgactaaactgggtgcttgcaatgacacccttcaacagctgatggaggtttttaagttcgatactatctccgagaagacatccgatcagatccacttcttcttcgccaaattgaactgcaggctctaccgtaaggctaacaagagctcaaagttggtgagcgcaaatagactgttcggagataagtcactgacattcaatgagacctaccaagacatctccgagttggtctacggtgccaagctgcaacccctggattttaaagagaatgctgagcaatccagagccgctatcaataagtgggtgtccaataagaccgagggccgtataaccgacgtcatcccttctgaagccatcaacgagctcacagtgcttgtgctggtaaacacaatctacttcaagggtttgtggaagtctaagtttagcccagaaaacacacgcaaggaactcttctataaggcagacggagagtcttgctcagcttccatgatgtatcaggaaggtaagttccgttacagaagagtggccgagggcacccaagttctggaacttccattcaaaggagacgacatcacaatggtgttgattctccccaagcccgaaaagagcttggcaaaggtagagaaggagcttacaccagaggttctgcaggaatggctggacgagctggaggagatgatgttggtagtccatatgcctcgttttaggatcgaagacggtttctctcttaaggagcagctccaggatatgggattggtggatttgttctctcccgagaagtcaaagctgcccggcattgtggccgagggtcgcgatgacctgtatgtgagcgacgctttccataaggcttttctggaggtgaatgaagagggtagcgaggccgcagcatctacagctgtagtgatcgccggtcgcagcctgaatcctaaccgcgttaccttcaaggctaataggccatttttggtctttattcgcgaagtgcccctgaataccattattttcatgggcagagtggcaaacccttgtgtgaag

SEQ ID NO: 18811 - DNA, 1392 bp, Artificial Sequence
  Description of Artificial Sequence: Synthetic coding sequence
atgtactcaaacgtcatcggaaccgtgactagtggtaagaggaaagtctacctcttgtcattgttgctgatagggttctgggactgtgtcacatgtcacgggtcacctgtggacatatgtaccgcaaagccacgcgatattcccatgaatcctatgtgtatctaccgatccccagagaaaaaggcaacagaagatgaagggagtgaacaaaagatccccgaggccactaacagaagggtgtgggagctcagcaaagctaatagtaggtttgccacaactttctatcagcacctcgctgattccaagaacgacaatgataacatttttcttagcccactcagtattagtacagcttttgctatgactaagttaggagcctgtaatgatacccttcagcaacttatggaggtttttaagttcgatactatatcggaaaagacctccgaccaaatacacttcttctttgcaaaattgaactgccgcctgtacaggaaagctaacaagagttcgaaactcgtgagcgccaaccgactctttggcgataaatccctgacctttaatgagacataccaggacatatccgagctagtgtacggagccaagctgcaacccctcgattttaaggaaaacgccgagcagagtcgggcagcgattaataaatgggtgtctaataagactgaggggcgcatcactgatgtgattccaagtgaggccatcaacgaactgacggtgctggtactcgtcaatacaatttattttaagggcctatggaaatcaaagttcagtccggagaacacacggaaggagcttttctacaaggcagatggcgaatcttgctctgctagtatgatgtaccaggaaggaaagttcagataccggcgagtggcggaaggcacgcaggttcttgaactgcctttcaagggggacgatattaccatggttctcattctgcctaaaccagaaaagtcactcgccaaagtggaaaaagagctcacccctgaagtattgcaggagtggcttgacgaattagaggagatgatgctcgtagttcacatgcctagattccgaatagaggatggcttctccctcaaggagcagttacaggacatggggctggtggacttattttcccccgaaaaatccaagcttcctggcatagtggctgagggccgggatgacctgtacgttagtgacgcgttccataaggcattcctggaagtaaatgaggagggatcagaagcggccgcttccacggccgtggtcatagcaggccgctcgcttaacccaaatcgagtgacatttaaggccaataggccattcttagtgttcattagagaggtgcccttgaacactattatctttatgggcagggtcgcgaatccatgcgtgaag

SEQ ID NO: 18812 - DNA, 1392 bp, Artificial Sequence
  Description of Artificial Sequence: Synthetic coding sequence
atgtactcgaatgtgattggaaccgttacgtctggaaagcggaaggtctaccttttgtcactgcttcttatcggcttttgggactgtgtcacctgtcatggatcccccgtggatatttgcaccgctaagccacgtgacataccaatgaaccctatgtgcatctataggtcccccgaaaagaaggcaaccgaggatgagggtagtgaacaaaagattcctgaagccacgaaccgtcgcgtatgggagctctcgaaggcaaatagcagatttgcaactaccttctaccagcacttggcagatagtaagaatgacaacgataacatttttctgtcacccctctcaatttccaccgcctttgcaatgaccaaacttggcgcgtgtaatgacactctgcagcaactgatggaggttttcaagtttgataccataagcgaaaaaactagcgatcagatccatttcttctttgcaaaactgaactgtcggctctacagaaaagctaataagtcgagcaaacttgtgtccgcgaatcgcctgtttggtgacaagtcactgacgtttaacgaaacttatcaagacatcagcgagctcgtctacggagcaaaactgcaaccacttgacttcaaagagaacgcagaacagtcgcgcgcagcaattaacaagtgggtgagtaacaaaactgaaggtcgcatcactgatgtcattccttcagaagcgattaatgagcttaccgtcctggtgcttgtcaacactatctactttaaaggattgtggaaaagcaagttttcgccagaaaacaccaggaaggaacttttctacaaggccgatggtgaatcatgctcggcatccatgatgtaccaagaggggaagttcagatacagacgagtcgccgaagggacgcaggtgctggaactgcctttcaaaggtgatgatatcaccatggtcctcattcttcctaagccggagaagagtctggccaaggtggagaaggagctgaccccagaagtactgcaggaatggcttgacgagctggaagaaatgatgctcgtggtgcatatgcctcggttccgtattgaagatggattctccctgaaggaacaactgcaagatatgggactcgtggatcttttttccccggaaaagtcaaagctcccagggatcgtggccgagggaagggacgatctttacgtgagcgacgcctttcacaaagcatttcttgaagtgaacgaagaggggtcggaagctgcggcatcgacggcagtggtgattgcgggccggtccctcaatcccaatagggttactttcaaggccaacagacctttccttgtgtttattcgcgaagttccactcaacaccatcatattcatgggcagagtcgcaaacccttgtgtgaag

SEQ ID NO: 18813 - DNA, 1392 bp, Artificial Sequence
  Description of Artificial Sequence: Synthetic coding sequence
atgtactccaacgtcattggtaccgtcacgtccggaaaaagaaaagtttacctgctttcgctcctcttgataggtttttgggattgcgtgacctgtcatggttcacctgtggatatctgcaccgcaaagccaagagatattcctatgaatccaatgtgcatttaccggagccctgagaaaaaagccactgaggatgaaggctccgagcaaaagattcccgaggctaccaacagacgagtgtgggaacttagcaaggcgaactcgcggttcgcaaccaccttttaccaacatctggcggactccaaaaacgacaatgacaacatatttctgagcccccttagcatttccactgcattcgcgatgaccaaactgggcgcctgtaatgacactcttcaacaactgatggaagtgttcaagtttgatactatatcggaaaagacctcagaccagatccatttcttttttgcaaaacttaattgtagactctacagaaaggcaaataagtcctccaagctggtgtccgctaacaggcttttcggcgataagagcttgacctttaacgagacttatcaggatatctcagaattggtctatggagcaaagctccaacctcttgactttaaggaaaacgccgaacaatccagagccgcaatcaataagtgggtcagcaacaagactgaaggaaggatcaccgatgtgattccatcggaggcaatcaacgagctgacggtccttgtgcttgtgaatactatatacttcaaggggttgtggaagagcaagttctcgcctgaaaacacgcgcaaggagttgttttacaaggcggatggcgaatcatgctcagcatcgatgatgtaccaggaagggaagttccgttacaggcgggtcgcagaggggactcaggtccttgaactgccctttaaaggtgacgatataactatggtcctgattcttcccaagccagaaaagtcgcttgcgaaggtggaaaaagaactgaccccagaagtcctgcaagaatggctggacgaattggaagaaatgatgctggtggtccatatgccgagatttagaatcgaagatggctttagcctgaaagaacagctgcaagatatgggtcttgtcgaccttttttcaccagagaaatctaagctgcctggtatcgtagcagagggtcgcgacgacttgtacgtgtcggacgcatttcataaggcgtttcttgaagttaatgaagagggttccgaagcagcagcatcaaccgctgtggtgatcgcaggtcgctcacttaaccctaatcgggtcacttttaaggcaaaccgccctttcctggtgtttattcgggaagtgcccctgaatacgatcatctttatgggaagggttgcaaatccttgcgttaaa

SEQ ID NO: 18814 - DNA, 1392 bp, Artificial Sequence
  Description of Artificial Sequence: Synthetic coding sequence
atgtactccaatgttattggcactgttacttctggaaagaggaaggtttatttgctttctcttctcctcattggattttgggattgcgtgacctgtcacggtagtcctgtagatatctgcacagccaagccgcgtgatattccaatgaacccaatgtgtatatatcgcagccctgagaagaaggccacagaagatgaaggttcagagcaaaagattccagaggcaactaatcgcagggtttgggagctttctaaggcaaattcccgtttcgctactacattttatcagcacctcgctgactcaaagaatgacaacgataacatatttctgagccctttaagtatctctactgcctttgccatgactaagctaggtgcctgcaacgacacgcttcaacagctaatggaggtttttaagttcgatactatttcagagaaaacctcagatcaaattcatttcttctttgcaaagttgaactgcaggctgtacagaaaggcgaacaagagttcaaagctggtttcagctaatcgtctatttggtgataaatctctcactttcaacgaaacgtatcaagatatatccgaattggtttacggagcaaagctgcagcctctggattttaaggaaaatgccgaacagtcaagggccgctataaacaaatgggttagcaacaaaacggaaggtaggataactgacgttatcccttcagaagctataaatgagttgactgttttggtcctggttaacacaatttatttcaaaggtctttggaagtccaagttttctccggagaatactcgtaaggagcttttctataaagccgacggtgagtcctgctcagcttccatgatgtaccaagagggtaagttcagatatcgcagggtcgctgaagggactcaggtgcttgagttaccttttaagggagacgatatcaccatggttctgatcctcccaaagcctgagaaaagccttgctaaagtggaaaaagaactaacccctgaggttcttcaggagtggctcgatgaacttgaagaaatgatgctcgttgtgcatatgcccagattcaggatcgaggatggattctccctgaaggaacaattgcaggatatgggtttggtggacctcttcagtcctgagaaatctaagttgccaggaatagtggccgagggtcgagatgacttgtatgtgagtgatgcctttcacaaagctttcttggaggtgaacgaggagggtagcgaagcagcggccagtacggcagtggtaatcgctggtcgttctctgaatcctaaccgtgttacgttcaaagccaaccgaccgtttttggtttttatcagggaagtacctcttaacactattattttcatgggtagagttgcgaatccttgtgtcaag

SEQ ID NO: 18815 - DNA, 1392 bp, Artificial Sequence
  Description of Artificial Sequence: Synthetic coding sequence
atgtactcaaacgtcatcggtaccgtcacttccggtaaacgaaaggtgtaccttctgtcgcttctgcttatcggtttctgggactgtgtgacctgccatggatccccggtcgatatctgcactgcaaagcctagagacatacccatgaatccaatgtgtatttacagatctcccgaaaagaaagcgaccgaagatgagggaagcgagcagaagattccagaagcaactaatcgcagggtgtgggaactctccaaggcaaactcccggtttgcaaccactttctaccaacatcttgccgactccaaaaacgataacgataacattttcttgtcgcctctcagcatttcaaccgcctttgcaatgaccaaactcggcgcatgcaacgatacgcttcagcagctcatggaggtgtttaagttcgatactattagtgaaaaaaccagcgaccagattcatttcttttttgcaaaactcaattgtcggctctatcggaaggcaaacaagagctcgaagctggtgtctgcaaacagactttttggtgataagtcccttacctttaacgaaacttaccaggatataagcgagctggtgtacggagccaaacttcaaccgctcgacttcaaggaaaatgcagagcagtctagggcggcaatcaacaagtgggtgtcaaacaagaccgagggacgcatcactgatgtgatcccctccgaggctatcaatgaacttactgtgctcgtgctggttaacactatctactttaagggtttgtggaagagtaagttcagcccagaaaatactagaaaggaattgttttacaaggcagacggagaatcatgttcggccagcatgatgtaccaagaagggaagtttcggtacagacgtgtggcggagggcacccaggtccttgaactgccctttaagggagatgacataaccatggtgctgatccttcccaagccagaaaaaagcctggcaaaggtcgagaaggaattgaccccagaagtgctgcaggaatggttggatgaacttgaagaaatgatgctcgtggtgcatatgcctcgctttagaatagaagatggatttagcctgaaggaacaactgcaggacatgggactcgtcgatcttttctcacctgagaaatcgaagctgcccggtattgtagcagaaggacgggatgatctgtatgtctcagatgcatttcataaggcattcctggaagtgaacgaggagggctccgaggctgcagcgtcgaccgcagtggtgatagcaggacgctcacttaatcccaatagagtcactttcaaggcgaatagaccctttctcgtctttattcgcgaggtgccactgaacactatcatctttatggggagggtggccaacccatgtgtcaaa

SEQ ID NO: 18816 - DNA, 1392 bp, Artificial Sequence
  Description of Artificial Sequence: Synthetic coding sequence
atgtatagcaacgtaatcggaaccgtgacttctggaaagagaaaagtctacctgctctccctgctgcttattggtttttgggactgtgtgacgtgccacggttcccccgtagacatatgcacagcaaaaccacgcgatataccgatgaacccaatgtgtatatataggagtcctgagaagaaagctaccgaggacgaaggtagcgagcagaaaatccccgaggcaacgaatcgcagggtgtgggagctctctaaagccaattctaggttcgcaaccactttttatcaacacctggcggattccaaaaatgacaacgacaatatctttctttcccctttgtctatctcaactgcctttgccatgacaaagctcggagcttgtaatgatacgcttcagcaacttatggaggtattcaaatttgatactatctccgagaagactagcgatcagattcacttcttcttcgctaaacttaattgtcgcctctacaggaaggcaaacaagagcagcaaacttgtctctgccaacaggcttttcggcgataagtccctgacttttaatgagacttaccaagacattagtgagcttgtgtacggcgcgaagctccagccactggacttcaaggaaaacgctgagcagtcaagagcggctatcaataaatgggttagtaacaagaccgagggaaggattaccgatgttatcccctccgaagctattaacgagctcaccgtgctggtgctggttaacaccatctattttaagggtctttggaagtcaaagttctctcccgagaatactagaaaggaattgttctacaaagcagacggcgagtcatgtagcgccagtatgatgtaccaagagggaaagttcaggtacaggcgcgtcgccgagggtactcaagtcttggagcttccattcaagggcgacgacatcactatggtactgatcctccccaagcctgagaagtccctggctaaagtcgagaaggagctgacgcccgaggttctccaggagtggcttgatgaattggaggagatgatgctcgtcgtacacatgcccagatttcgcatcgaggatggattctcacttaaggaacagctgcaggacatgggactggtagacttgttcagccccgagaaatcaaagcttcctggaattgttgctgaaggtagggacgatctctacgtttcagacgcttttcacaaggccttcctcgaggtaaacgaggagggatcagaggctgcggcttccacggccgtggtgatcgcgggaagatcccttaaccccaacagggtaacgttcaaagcaaatagacccttccttgtgttcatcagagaggtccccttgaatactatcatattcatgggccgcgtggcaaatccatgcgtaaag

SEQ ID NO: 18817 - DNA, 1392 bp, Artificial Sequence
  Description of Artificial Sequence: Synthetic coding sequence
atgtactcgaatgtgatcggcactgtcaccagcggaaagagaaaagtgtacctgctctcgctgctcttgatcggcttttgggactgtgtgacctgccacggatcgccggtagatatttgcactgcaaagcctagagatatccctatgaatcctatgtgcatctaccgctcacccgaaaagaaggcgaccgaggacgaaggatccgagcaaaagatcccagaggcaaccaacaggcgggtgtgggaactcagcaaggcgaactcgaggtttgcaactactttctaccaacacctggccgattccaagaacgacaacgacaatatcttcctctcgcccctctcaatcagcacggcctttgcaatgaccaagttgggcgcttgcaatgacactctgcagcaactgatggaagtgttcaagttcgacactatctccgagaaaactagcgaccaaattcacttcttctttgccaagttgaactgtaggctgtaccgaaaagcgaataagtcctccaagctggtgtcagccaatagactctttggagataaaagcctgaccttcaacgagacttaccaggacatctcggagctggtgtacggcgctaaactccaaccattggacttcaaagaaaatgccgaacagagcagggcggccattaacaagtgggtgtccaacaagactgagggccgcatcactgatgtgatcccgtcagaggcaatcaatgaactcactgtgttggtcctggttaacaccatctacttcaaaggcttgtggaagtcgaagttctcgccggaaaacactagaaaagagctgttctataaggccgatggagagtcctgcagcgcgtcgatgatgtaccaggaaggaaagttccgctataggagggttgccgaaggaacccaggtcctggaactgccgtttaaaggtgacgatatcaccatggtgctgatccttccaaagccggagaaatccctggccaaggtggaaaaggagctgaccccagaggtcctgcaggaatggcttgatgaactcgaggagatgatgcttgtcgtccatatgccgcgcttccggatcgaggacggcttctccctgaaggagcagctgcaggatatgggcctggtggacctgtttagtccagagaagtcgaagctgccgggcatagtggcggaagggcgggacgatctgtacgtctccgacgcctttcataaggctttcctggaagttaacgaagagggatcggaagccgcggcctcaactgcggtcgtaattgccgggcgctcgctgaacccaaaccgagtgacgttcaaggccaacaggccttttctggtgtttatcagagaggtgcctcttaacactatcatcttcatggggcgcgtcgctaatccgtgcgtcaag

SEQ ID NO: 18818 - DNA, 1392 bp, Artificial Sequence
  Description of Artificial Sequence: Synthetic coding sequence
atgtacagcaacgtaatcggtaccgtgacctcaggaaagcggaaagtgtacctgctgtccctgctcctgatcggattttgggattgcgtcacttgccatggcagcccggtcgatatctgcactgctaaaccgcgggacatcccaatgaacccgatgtgcatctaccgttctccggaaaagaaggcgactgaggacgagggttccgaacaaaagattccagaagccactaacaggagagtgtgggaactctccaaggctaacagcagattcgcaaccaccttctatcaacacctggcagactccaagaacgacaacgataacatcttcctgagccccctgtcgatctcgaccgcctttgcgatgactaagctcggggcatgcaacgacacgctgcaacaactgatggaagtgttcaagtttgacaccatctccgaaaagacgtccgaccaaatccacttcttttttgcgaaactgaactgtcggctctacagaaaggccaacaaatcctccaagttggtcagtgccaatcgcctctttggcgataagtccttgactttcaatgagacgtaccaggacatctcggaactcgtctacggagccaaacttcaaccacttgactttaaggagaacgcagagcagtcccgcgccgccatcaacaaatgggtttcgaacaagactgagggtcgcatcactgacgtgatcccttcggaggcgatcaacgaactgacggtgctggtgctcgtgaacaccatctacttcaagggactctggaaaagcaagttctcgcccgaaaatactcgcaaagagctcttctacaaagcggacggagagtcatgttcggcttcgatgatgtaccaggaaggaaagttcagataccgccgcgtggctgagggtacccaggtgctcgagctccctttcaaaggagatgatatcactatggtgctgatcctgccgaagcctgagaagtccttggccaaagtggaaaaggagttgactccggaggtgctgcaggaatggttggatgaactcgaagaaatgatgctggtggtgcacatgccacggttccggattgaagatggattttccttgaaagagcaacttcaggacatgggactcgtggacctgttttcgccggagaagtctaagctgccgggaatcgtggcggaaggcagagacgatctctacgtgagcgacgcttttcataaggcgttcctggaagtgaacgaagaaggatcggaagccgccgcatcgactgccgtggtcatcgcgggacggtccctcaacccaaatcgcgtgaccttcaaggcaaaccgcccatttctcgtgtttatcagagaagtgccactgaacaccatcatcttcatgggaagggtcgcaaacccgtgcgttaag

SEQ ID NO: 18819 - DNA, 1392 bp, Artificial Sequence
  Description of Artificial Sequence: Synthetic coding sequence
atgtattctaatgtaattggaactgttacatctggaaaacgtaaagtttatttattatctcttttgttaattggattttgggattgtgttacatgtcatggatcaccagttgatatttgtactgctaaaccaagagatattcctatgaaccctatgtgtatatatagatcacctgaaaagaaagcaactgaagatgagggttcagaacaaaaaattccagaagcaactaataggagagtatgggagttatctaaagctaattccagatttgctactacattctatcaacacttagcagattccaaaaatgataacgataatattttcttatcaccactttctatttctactgcatttgcaatgacaaagttaggagcatgtaatgatactcttcaacaacttatggaagtttttaaatttgatacaatttcagaaaaaacaagtgatcaaattcattttttctttgctaaattaaattgtagattatatagaaaagctaataaaagttctaaacttgttagtgcaaatagattatttggtgataaaagtttaacttttaatgagacttatcaagatatttcagaattagtatatggagcaaaacttcaaccacttgattttaaagagaatgctgaacaatcaagagcagcaattaataagtgggtttctaataaaacagaaggaagaattactgatgttataccaagtgaggctattaatgaacttactgttcttgttttagttaatactatttacttcaaaggtttatggaagagtaagtttagcccagaaaatactagaaaagaacttttttataaagcagatggtgaatcttgttccgcatcaatgatgtatcaagaaggaaaatttagatatagaagagtagcagaaggaactcaagtcttggaactaccatttaaaggagatgatattacaatggtattaattttaccaaagccagaaaaatctcttgcaaaagtggaaaaagaattaactccagaagttcttcaagaatggttagatgaattagaagaaatgatgttagtggttcatatgccaagatttagaattgaagatggatttagtttaaaagagcaattacaagacatgggactagttgatttattttcaccagaaaaatcaaaacttccaggaattgttgcagaagggagagatgatttgtatgtatcagatgcattccataaggcatttttagaagttaatgaagagggatctgaggctgcagcatctactgcagtagttatagctggaagatctttaaatcctaatcgagttacatttaaagctaatagaccatttttagtttttattagagaagttccattaaatacaattattttcatgggtagagtagcaaacccatgtgtaaaa

SEQ ID NO: 18820 - DNA, 1392 bp, Artificial Sequence
  Description of Artificial Sequence: Synthetic coding sequence
atgtactccaacgtgatcggaactgtcacttcaggcaagcgcaaggtctacctcttgagcctcctgttgattggtttctgggactgcgtgacctgccacggatcccccgtggacatttgcactgcgaaaccgcgcgatattccaatgaacccaatgtgcatctaccgctccccggaaaagaaagcgaccgaggacgagggctcagaacaaaagatccctgaagctactaacagaagagtctgggaactctcaaaagccaacagccgattcgcgactacgttctaccagcacctcgcagacagcaagaatgacaatgacaacatctttctctcgccgctttcgatttccaccgcctttgccatgaccaaactcggcgcgtgcaacgatactcttcagcaactgatggaggtgttcaagtttgacaccatctcagaaaagactagcgatcagatccacttcttcttcgccaagctgaactgccggctgtaccgcaaagccaacaagtcctcgaagctggtgtcagccaaccgcctgttcggagacaagagcttgacttttaacgaaacctatcaggatatctcagagttggtttatggagccaaactgcagcccctggacttcaaggaaaacgcagaacagtcacgcgcggccatcaataagtgggtcagcaacaagaccgaaggacggatcactgacgtgatcccgtccgaggccatcaatgaactgaccgtgctcgtgctcgtgaatactatctacttcaagggcttgtggaagagcaagttcagcccggagaatacccggaaagaactcttttacaaggctgacggggaatcatgttcagcgtccatgatgtaccaggagggaaagtttagatatagacgggtggcagaagggacgcaagtgttggaactgccattcaagggtgacgacattaccatggtcctcatcctcccaaagccggagaaatcattggccaaggtggagaaggagctcacccctgaagtcctgcaggaatggttggacgaactggaggaaatgatgcttgtggttcatatgccgagattccgcatcgaggatggattctcacttaaagaacagcttcaagacatgggcctggtggacctcttctctccagaaaaatccaaactcccaggcatcgtcgccgaggggcgcgacgatctgtacgtgtcagatgcgttccacaaggcatttctggaagtgaacgaagaaggatccgaagcagcggcctcaaccgctgtggtcattgcaggccggtcactgaaccctaaccgcgttactttcaaggccaatcggcccttcctggtgttcattcgggaagtgccactgaacacgatcatctttatgggaagagtggccaacccgtgcgtcaag

SEQ ID NO: 18821 - DNA, 1392 bp, Artificial Sequence
  Description of Artificial Sequence: Synthetic coding sequence
atgtattcaaacgtgatcggcacagttactagcggtaaacggaaagtttatctgttaagcttgctcctgattggattctgggactgcgtcacatgtcacggaagtcctgtggatatctgtactgccaaaccccgggacattccaatgaatcccatgtgtatctaccgctccccagagaagaaagccacggaagacgagggctctgaacagaaaattccggaagccactaatagacgggtgtgggagctctctaaagccaactcccgctttgccacaaccttttaccaacaccttgctgactctaaaaatgacaatgataacatcttcctgagccctctctcaatttctactgcctttgcaatgacaaaactaggcgcatgcaatgacaccctgcagcagctcatggaagttttcaagttcgatactatatccgaaaaaacgtccgaccagatccatttcttctttgccaaattgaattgtagattgtatcggaaagccaataaatcctccaagctggtctcggctaatcgtctgtttggcgataaatcactgacattcaatgaaacctaccaagacatttccgaactggtctacggggccaagctgcagccactggactttaaggagaatgcggaacaatcccgggccgctatcaacaagtgggtttcaaacaaaacagaaggaagaattaccgatgtgataccctccgaagccattaacgagctgaccgtactcgttctggtgaacacaatttattttaagggtctatggaaatctaagttttccccagagaatacgcggaaagagctgttctacaaggctgacggggagtcctgttcagcctccatgatgtaccaggaagggaagttccgttatcgaagagtcgctgaagggacccaagttctggagttgccatttaagggcgatgatatcacaatggtgctgatactgccaaagccggagaagtctctcgctaaagtcgagaaggagcttacaccggaggtcctacaggagtggttggacgaactcgaagagatgatgctcgtggtacacatgcccagattcagaatcgaagatgggttttctttaaaggagcagcttcaggacatgggcttggtggaccttttttctccggagaaatcaaagctgccagggatcgtcgccgaagggagggatgacctgtacgtcagtgatgccttccacaaagcattcttggaggttaacgaggagggatccgaagcggccgcgtcaacagccgtagtgattgccggaaggtccctaaaccccaatagagtgacatttaaggctaatcgcccatttctggtctttatacgggaagtgcctcttaatactattattttcatgggacgagttgcaaatccttgcgtaaag

SEQ ID NO: 18822 - DNA, 1392 bp, Artificial Sequence
  Description of Artificial Sequence: Synthetic coding sequence
atgtacagcaacgtcatcgggaccgtgacttccgggaaaaggaaggtgtacttattaagccttttgctcatcggtttttgggactgcgtcacctgccacggatccccagtggacatttgcaccgccaagccgcgggatatccctatgaatcccatgtgtatatatcggagtcccgaaaagaaggccacagaggatgaaggttctgaacagaagatcccagaagctacaaatcgcagagtatgggagctatccaaagcaaatagccgctttgcaactaccttctaccaacatctcgccgactccaaaaatgacaacgacaatattttccttagcccgttgtctatcagtactgcgtttgccatgacaaaactgggggcttgcaacgataccctgcaacagctcatggaagtgtttaaattcgatacaatttcagagaaaacctcagaccagatccatttctttttcgccaaacttaattgcaggctttatcgcaaagctaataaaagttcgaagctcgttagcgccaatcggctgttcggggacaaatccttgacgttcaacgagacctatcaggacattagtgagctggtatacggggcaaaactgcaacccctggacttcaaggaaaacgccgaacagtcccgcgcagctatcaacaagtgggtgagtaacaaaacggaggggcgcattaccgacgtgatccccagcgaagccataaatgaactgaccgtgctggtccttgtaaacacaatctacttcaaagggctgtggaagtccaagttttcccctgagaatactcgcaaagaactgttttacaaggctgacggtgagtcatgctctgcatctatgatgtaccaagagggaaagttccgctacaggcgcgtcgccgagggcacccaagtgctggaattgccatttaaaggggatgatattacaatggtgttgattctccccaagcccgaaaagagccttgcaaaggtggagaaagaactgactcccgaagtactccaggagtggctggacgagctcgaagagatgatgttggtagttcatatgcctcggttccgaattgaggacgggtttagccttaaggagcagttgcaggatatgggacttgtggatctgttctcccccgagaagtccaagttacccgggattgttgctgaggggcgggacgacctgtacgttagcgacgcattccataaagctttccttgaggtcaatgaggaaggctcggaggccgctgcatctactgcagtcgttattgccgggcggagcctgaatcccaatagagtgacttttaaggccaatcggccctttctagtgtttatccgagaagtaccactgaataccataattttcatgggacgggtggcgaacccctgtgtaaag

SEQ ID NO: 18823 - DNA, 1392 bp, Artificial Sequence
  Description of Artificial Sequence: Synthetic coding sequence
atgtactcaaatgtgatcggaaccgtgacgtcgggaaagcgcaaagtgtacctgctttcattgctgctcatcggattttgggactgcgtgacctgccacgggtcaccggtcgacatctgcacggctaaaccccgagacatcccaatgaacccgatgtgcatctaccggtcaccagagaagaaagcaacggaagatgaaggcagcgagcagaaaatcccggaagcaactaatcgacgcgtctgggaactgtccaaagccaacagcagattcgcaacgaccttttaccagcacctcgcagactcaaagaatgacaatgataacatcttcctctcgccgttgagcatttccactgcgttcgcaatgaccaagctcggggcgtgtaatgatactctgcagcaactgatggaggtgttcaagtttgacaccatctccgaaaagacctcggaccaaatccactttttctttgctaaactcaactgtagactgtatcgcaaagccaacaagtcgtccaagctggtgtccgcaaatcggctcttcggggacaagtcgctgactttcaatgaaacctaccaagacatctccgaactggtctatggtgccaagctccagccgctggacttcaaagagaacgcggaacagagccgcgcagctataaacaagtgggtgtcgaacaagaccgagggacgcatcaccgacgtgattccttcggaagccatcaacgagctcactgtgctcgtgctcgtcaatactatctactttaagggactttggaagtcgaagttctccccggagaataccaggaaagaactcttttacaaagcagacggcgaatcgtgtagcgcgtccatgatgtaccaggaaggcaagtttaggtaccgcagagtggccgaaggaacccaggtcctggagctccccttcaagggggacgatatcactatggtgctgatacttccgaagccggaaaagagccttgcaaaggtggaaaaggagctgacccccgaagttcttcaggagtggctggatgaactggaagaaatgatgctggtggtccatatgcctcgcttcaggatcgaagatggattctccctgaaggaacagctgcaagatatgggcctggtggacttgttctcacctgagaagtctaaactgcccggaattgtcgccgaagggcgagatgacctgtacgtcagcgatgcgtttcacaaagccttcctggaagtgaacgaagaaggttcggaggccgcggcttctacggctgtggttatcgccggaagatccctgaacccaaatcgtgtgaccttcaaggccaaccgaccattcctggttttcatcagggaggtgcctctgaacactattatctttatggggcgtgtcgcgaatccatgcgtgaag

SEQ ID NO: 18824 - DNA, 1392 bp, Artificial Sequence
  Description of Artificial Sequence: Synthetic coding sequence
atgtactcaaacgtcattggcacagttacctccggtaaacgcaaggtctatctgttgagcctgctgctgattggcttttgggattgcgtgacctgccacggtagcccggtcgatatctgcaccgctaaaccgcgtgacatcccgatgaacccaatgtgtatctacaggagcccggagaagaaggcaactgaggatgagggttctgagcaaaaaatacctgaagcgacgaatcgccgcgtgtgggagctgtccaaggctaacagccgctttgccacgactttttaccagcacctggcggattccaagaacgataatgacaatattttcctgtcccctctgtccatcagtaccgcatttgcgatgacaaagctcggcgcttgtaacgataccctgcagcaactgatggaggtgtttaaattcgataccattagcgaaaaaacctccgaccagatccatttcttttttgctaagctgaactgtcgtttgtacagaaaagccaacaagagctccaagctggtgagcgcgaaccgcctgttcggtgacaagagcctgacctttaatgaaacttaccaggacatctcagaactggtttatggcgcaaagctgcaaccactagatttcaaggagaacgccgagcagtcccgcgcggccataaataaatgggttagcaataagactgaaggacgcatcacggatgtgattccgtctgaggcaataaacgagttgaccgtgctggttctcgtgaatactatctacttcaaaggcctttggaaaagcaaattctctccagaaaacacccgtaaagagctgttctataaagcggatggcgaatcttgcagcgccagcatgatgtaccaggaaggtaaattccggtatagacgcgtggcggagggcacgcaggtgctggagttaccattcaagggcgatgatatcaccatggttctgattctgccgaagccggagaaaagtttagcaaaagtggagaaagaactgaccccagaagtgttacaggaatggttggacgagctggaggagatgatgctggtggtccacatgccccgtttccgtattgaggacggcttcagcctcaaggagcaattgcaagacatgggcctggttgacctgttcagcccggagaaaagcaagctgccaggtatcgtcgcggagggtcgcgacgatctttatgttagcgatgcgtttcacaaggcgttcctggaggtgaacgaggagggtagcgaggcggctgcgtctacggcggtcgtcattgctggtcgctcccttaacccaaaccgtgtcacctttaaagcgaacaggcctttcctggtgttcatccgcgaagtacctctgaatactatcattttcatgggtcgcgttgcaaatccctgtgtcaag

SEQ ID NO: 18825 - DNA, 1392 bp, Artificial Sequence
  Description of Artificial Sequence: Synthetic coding sequence
atgtatagcaatgtgataggaaccgtgaccagcggaaagaggaaagtctacctgctgtcgttgctgctcatcggcttttgggactgcgtcacctgccacgggtccccagtggatatctgtaccgcaaagcctagggatattccgatgaatcctatgtgtatctacagatcccctgagaaaaaagcaaccgaagatgagggtagcgaacaaaagattccggaagctactaacagaagagtgtgggaactgtccaaggctaattcacggtttgccactaccttttatcagcatctggcagattcgaagaatgataatgacaacatctttctgtcgccactctcgatctcaactgccttcgccatgacgaagctgggcgcatgtaatgacaccctgcaacagcttatggaagtgtttaagtttgatactataagcgaaaaaacctcagatcagattcatttcttcttcgcaaaacttaactgcagactctaccgcaaagcaaacaagtcaagcaaacttgtgtccgccaaccgactgtttggagacaagtccctgaccttcaatgaaacgtaccaggatattagtgaacttgtgtatggagcaaagctgcagccacttgatttcaaagagaacgctgaacagtcacgcgcagccatcaataagtgggtgtcgaacaagactgaaggtcgaattaccgacgtcattccctccgaagcgatcaatgagttgaccgtgttggtgttggttaacacgatatacttcaagggcctttggaagtccaagttctcgcccgaaaatactcgaaaggagctcttctacaaggccgatggcgagtcgtgtagcgcgtccatgatgtaccaagagggaaagttcagatacagaagggtcgcagaggggacccaagtgttggaactccctttcaagggcgacgatattacgatggtcctgattcttccaaagcctgaaaagtctctggcgaaagtggagaaagaacttactcctgaagtgcttcaggaatggcttgacgaactcgaggagatgatgctcgtcgtgcatatgccaagatttcggattgaggatggattcagtctgaaagaacaactccaagatatgggattggtagatctgttttcgcccgaaaagtcgaagctgcctggtattgtggctgaaggaagagatgacctgtacgtctctgatgcctttcacaaagcctttcttgaggtgaacgaggaaggctccgaggcagctgcatccactgctgtggtaattgcgggacgcagcctcaacccaaacagagttacctttaaagcgaaccgcccttttctggtctttatccgcgaggtccctcttaatacgatcattttcatgggccgtgtcgccaacccctgcgtgaaa

SEQ ID NO: 18826 - DNA, 1392 bp, Artificial Sequence
  Description of Artificial Sequence: Synthetic coding sequence
atgtatagcaacgtcatcgggaccgtcacaagtggtaagaggaaagtgtatctcctttccttgctgttaatcggattttgggattgcgtcacctgccacggatctcccgtggacatttgcactgccaagccaagagatatcccgatgaaccctatgtgtatttaccggtccccagagaagaaagccacggaagacgagggctccgagcagaaaatcccggaagctaccaaccgtagagtgtgggagctctctaaggcgaattcacggttcgccacaacattttaccagcatctcgcagattctaagaacgacaacgacaatatattcctttcccctctgtcaatcagtacagccttcgctatgacgaagctcggtgcatgtaacgacacgctacagcaattgatggaagtgtttaaatttgacactatctccgaaaaaaccagtgaccagatccactttttttttgcaaaactgaattgcaggctatacaggaaggccaacaagtctagcaagctggtttcggccaacaggctgttcggcgacaagtcattgacatttaatgagacctaccaggatatcagcgaattggtatacggggccaagttgcaaccattggattttaaggaaaatgccgaacagagtcgagctgctattaataaatgggtgtcaaataagactgagggtcgaatcactgacgttatcccaagcgaagccataaatgagctgacagtcctggttctcgtaaataccatctacttcaaaggcctttggaaatctaagtttagcccggagaacactaggaaggagctattctataaagccgatggcgagtcatgcagcgcctcgatgatgtatcaggaaggtaaattcaggtacaggagggtggcagagggcactcaggtactggagcttcccttcaaaggcgacgacatcactatggttctcatactgccaaagcctgagaaatcgctggccaaagtggaaaaggagctgactccagaagtgcttcaggagtggctcgacgaattagaagaaatgatgctggtggttcacatgccgcggttcaggatagaagatggcttctccttaaaagaacaactgcaggacatgggactcgttgacttgttcagccccgagaagtctaaattaccgggcatagtagccgaaggccgggacgacctgtacgttagcgacgccttccataaggcctttctggaggtgaacgaggagggatccgaggctgctgcatccaccgcagtggtcattgcgggaagatccctgaaccctaatcgcgttacgttcaaggcgaatcgcccgttcctggtcttcattcgtgaagtgcccctgaacacaattatctttatgggacgcgtggctaacccatgtgtgaaa

SEQ ID NO: 18827 - DNA, 1392 bp, Artificial Sequence
  Description of Artificial Sequence: Synthetic coding sequence
atgtatagcaacgttatcggcacagtaaccagcgggaaaaggaaagtctatctgttgagcctgctcctaataggattctgggactgcgtaacttgtcatgggtccccagtggatatctgcacagccaaaccccgtgacattcctatgaacccgatgtgtatatatagaagcccagaaaagaaggctaccgaagacgaaggcagtgagcagaagattcccgaggctacaaaccggagagtctgggagctttctaaggccaactctcgattcgccaccacattttatcagcaccttgcggactctaaaaacgataatgacaatatatttctctcacctcttagcatttcgacggccttcgcaatgacgaaattgggagcctgtaacgatacccttcaacagctcatggaggtcttcaagttcgacaccatctctgaaaagacatctgaccagattcacttttttttcgcaaagttgaactgcagattatataggaaagccaacaaatctagtaagttagtctcagcaaataggctctttggggataagtctctgaccttcaatgagacctatcaagacattagcgaactcgtgtacggcgcaaaacttcagcctctggactttaaagagaatgctgagcagagccgggccgcaatcaataaatgggtgtcaaataaaacagagggacgtatcacagacgtgattcccagcgaggccattaacgagctgaccgtgctcgtgctagtgaacacaatctactttaagggcctgtggaagtctaagttctcccccgaaaatactcggaaagagttattctataaggccgatggcgagagctgtagcgctagcatgatgtatcaggaagggaagtttagatatcggcgcgtcgcagaagggacacaggtgctggagctccccttcaagggtgacgatattactatggtcctcatcctaccgaagcctgagaagtctttagccaaggtggagaaagaactgactcctgaagtgctccaagagtggctggacgagcttgaagaaatgatgcttgtggtgcatatgccgcggttcaggatcgaagacgggttctcactgaaagagcagctgcaggacatgggcctggttgacctgttcagtcccgaaaagtctaagctacctggcattgtagccgaaggccgcgacgatctctacgtcagcgatgcctttcataaagcatttctggaagtgaacgaagaaggcagcgaagctgctgcctcaaccgcagtcgtcattgctggccgttctctgaaccccaatagggtaacctttaaagccaatcgacctttcttggttttcattcgcgaagtgcctctcaacacgattattttcatgggccgcgttgcgaacccctgcgtcaaa

SEQ ID NO: 18828 - DNA, 1392 bp, Artificial Sequence
  Description of Artificial Sequence: Synthetic coding sequence
atgtactcaaacgtcatcggcaccgtcacctctggaaagcggaaggtttatctgctgagcctgctcctgattggcttctgggattgcgtcacatgccatggttctcctgtcgatatatgcacggccaaaccacgagatattccgatgaaccccatgtgcatttaccggagccccgagaagaaggcaacggaggacgaggggtcggaacagaaaatccccgaggccaccaatcgaagggtttgggagctcagtaaggccaatagcagatttgccaccactttctaccaacacctggccgactctaagaacgacaatgacaacatctttctgagccctctctctatctcgacagcatttgccatgactaagttaggcgcgtgtaatgataccctgcagcagttgatggaagttttcaaatttgacacaattagtgagaagacctccgaccagatacactttttcttcgccaagttgaattgtcggctgtaccggaaggccaacaagtctagcaagctagtcagtgcaaaccgcctgtttggcgataagtctctaacctttaatgagacataccaggacatcagcgagttagtctacggagctaaactgcaaccgttagatttcaaggagaatgctgaacagtctagggcagctatcaataagtgggtgagtaacaagactgaaggacggatcaccgacgtgatcccctctgaagccataaacgagctgaccgtactcgtactcgttaacacgatctattttaagggcctgtggaaaagcaaattctcccccgaaaataccagaaaggagctgttctacaaagccgatggggaatcctgtagcgcttccatgatgtatcaagaaggcaagttcagatatcgacgcgtggctgagggtacccaggtccttgagctgccgttcaagggcgacgatataacgatggtactgatcttaccaaaacccgagaagagtctggccaaagtggagaaagagctgactcccgaagtcttgcaagagtggctcgacgagctggaggagatgatgcttgtggtgcacatgcctagatttcgcatcgaggatggcttcagcctgaaggagcagctgcaggacatgggtctggtcgatctgttttcccctgaaaaatctaagctgccaggaatcgtggccgagggcagggatgacctatatgtgagtgacgcattccacaaagccttcctggaagtgaacgaggagggatcggaggcggccgcgtctacagcggtagtgatcgctgggaggagccttaaccccaacagagttaccttcaaagccaacaggccatttctggtgtttatccgggaggtaccactgaacacgataatcttcatgggccgtgtggccaacccctgcgtgaag

SEQ ID NO: 18829 - DNA, 1392 bp, Artificial Sequence
  Description of Artificial Sequence: Synthetic coding sequence
atgtattctaatgtgatcgggaccgtgacctcgggaaagcgcaaagtctacctcttgtctttattgctaattggattttgggattgcgtgacttgccacggaagtccggtcgacatttgtaccgccaagccccgtgacatcccaatgaatcccatgtgcatttatagatcacccgaaaaaaaggccactgaggatgaaggcagcgagcagaagattccagaggcgactaaccgcagagtatgggagctgtcaaaagccaattctcgatttgcgacgacattctaccagcatctcgccgactctaagaacgacaacgataacatcttcctctctcctctcagcatttctacggcgttcgccatgacaaaattgggagcctgcaatgacactttgcagcagttgatggaagttttcaaatttgatactattagtgagaaaacatctgatcagatccactttttctttgcaaagctgaactgccggctgtaccggaaggctaacaaaagcagtaagctggtgtccgccaatagacttttcggagacaagagcctcactttcaacgagacctaccaagatatttctgaactggtatacggcgccaaactccaacccctcgatttcaaagagaacgccgagcaaagcagggcagccataaataagtgggtgtccaataaaacagaagggaggattacagatgtcattccgtcagaagctatcaacgaattaaccgtactggttctcgtgaacaccatatattttaagggattgtggaagagtaaattctctccagagaacaccaggaaggagctgttttataaagcggatggggaatcatgttccgcatctatgatgtatcaggaaggcaaattcaggtacaggcgagtcgctgaaggcactcaggtgctagagctgccttttaagggggacgacatcacaatggtcctaattctcccaaagcctgaaaagtccctggcaaaggtggagaaagaacttacgcccgaagtgctgcaggagtggcttgatgagctcgaggaaatgatgctcgttgtacatatgccaagatttagaatcgaagacggcttctctcttaaggagcagctgcaagacatgggcctggtggacctgtttagccctgaaaagtccaagcttccaggaatcgtagcagagggccgggacgatctgtacgtctccgatgcttttcacaaggcctttttggaggtgaatgaggaaggcagcgaagcagccgcgagcaccgcggttgtaatagcaggtcgatctttgaacccaaacagagtgacctttaaagctaaccgcccatttttggtcttcatcagagaggtccccctaaatacaattatttttatgggtagggttgccaacccttgcgtgaag

SEQ ID NO: 18830 - DNA, 1392 bp, Artificial Sequence
  Description of Artificial Sequence: Synthetic coding sequence
atgtatagcaacgttattggaaccgtaaccagcggtaagaggaaggtgtatttgttatccctgttgttaatcggcttctgggactgcgtgacctgccacggtagccctgtagacatttgtacagccaagccccgtgatataccgatgaatcctatgtgtatttaccgcagtcccgagaagaaggccaccgaggatgagggttcggagcagaaaattcctgaggccaccaatcgccgcgtatgggagcttagtaaggctaattcacgattcgccaccaccttttaccagcaccttgccgacagtaagaatgacaatgataacatcttcttgagcccattgagcatctccactgcctttgcaatgacaaagctaggcgcctgtaatgatactttgcagcagctgatggaggtgttcaagttcgataccatttcggagaaaacatcagatcaaatccacttcttctttgctaaactgaattgcagactgtacaggaaggccaacaaatcgagcaagttggtatcagccaaccggttgttcggcgataagagcttgacgttcaacgaaacctaccaagatatatcggagctggtgtatggtgcgaagctccaaccattggactttaaagagaatgcggaacaatcacgtgcggccataaataagtgggtgtccaataaaaccgaaggccgcatcaccgatgtcattccaagcgaggccattaatgaactgaccgtgttggtgctggtgaacaccatttattttaagggcttgtggaagtcgaaattctcccccgagaacacgcgtaaggaacttttctacaaggccgacggtgagagctgctctgcatccatgatgtaccaggagggaaaattccggtaccgccgagtagccgaaggcactcaggttctggaactgcccttcaagggagatgacatcaccatggtactgattctgccaaaaccagaaaaaagcctggccaaggttgagaaggagctcactcctgaggtcctgcaggagtggttggacgagctggaggagatgatgctggttgtccacatgccgcgcttcagaatagaggatggatttagcctaaaagagcagttgcaggacatgggtctagttgacctgttttctccagagaagtccaagcttccaggcattgtggccgaaggacgcgatgacctctatgtgagcgatgcatttcataaggccttcctggaagtgaatgaggagggaagtgaggcagccgcatccactgcggtggtgattgccggcagaagcctgaacccaaaccgtgtaaccttcaaggcaaataggccttttctcgtgttcattcgggaagtcccgcttaacacgattatcttcatgggacgtgtggccaatccatgcgtgaag

SEQ ID NO: 18831 - DNA, 1392 bp, Artificial Sequence
  Description of Artificial Sequence: Synthetic coding sequence
atgtactccaacgttatcggcactgtgacgtccgggaagcggaaagtgtatctcctctccctcctccttatcggcttttgggactgcgttacctgtcacgggtcgccagttgatatctgcacggcgaagccacgcgacatccccatgaaccccatgtgcatataccggtctccggagaagaaggcaaccgaagacgagggttccgagcagaagattcccgaggccacgaatcgcagagtatgggaactgtccaaggctaattcccgctttgctaccaccttttaccagcacttagctgactctaaaaacgacaacgataatattttcctctcccccctttctatctcaaccgcctttgctatgacaaagcttggtgcctgtaacgataccctacagcagctgatggaggtgttcaaattcgatactatatcagagaaaacctcagatcagattcatttttttttcgccaagcttaattgtcgcttgtatcgcaaggccaacaagagcagcaagctcgttagcgcgaatcgcctgtttggagataagagcctgacatttaatgaaacataccaggatatctcagaactggtgtacggcgctaagctccagcccctcgatttcaaggagaacgcagaacaatcgcgagctgccatcaacaagtgggtcagtaacaagacggaggggagaatcactgatgttataccctccgaagctatcaatgaactgacggtacttgtgctagtgaacacaatctattttaaaggtctatggaagtctaaattctcccctgagaatacacggaaagagcttttctataaggcagacggcgaaagttgcagcgcatcgatgatgtatcaggaggggaagtttaggtatcggcgtgtggccgagggtacccaggtgctagagttgccctttaagggagacgacatcactatggtgcttattctgcccaaaccagagaagagcttggcaaaagtcgagaaggaacttactcccgaggtgctacaagagtggctggacgagctcgaggagatgatgctggtggtgcacatgcctagatttcgcatagaggacggcttctcacttaaggaacaactacaggacatggggctggtcgatctgttctcccctgaaaagtccaaacttcctggaatcgtcgctgagggacgagacgatctgtatgtttctgatgccttccacaaagcttttttagaggtgaatgaggagggaagcgaggcagctgcttcaaccgccgtggtgattgcagggaggtccctgaaccctaaccgcgtgactttcaaggctaacagaccctttctcgtttttattagggaagtgcctcttaacaccataattttcatgggcagagtggccaatccctgcgtcaag

SEQ ID NO: 18832 - DNA, 1392 bp, Artificial Sequence
  Description of Artificial Sequence: Synthetic coding sequence
atgtattctaacgtcatcggtaccgtcacaagcggaaagcggaaggtctacttgctgtccctactgctcatcggcttttgggactgcgttacatgtcacggaagccctgtcgacatttgtaccgcaaagccccgggacattcctatgaaccctatgtgtatttaccggtcgcctgaaaaaaaagctactgaggacgaaggcagcgagcagaagatacctgaggccactaaccggagagtgtgggaattgtcaaaggctaacagccggttcgccacaacattttaccaacacttagccgactctaagaatgacaatgacaacatttttctctccccactgtcaatttctaccgccttcgcaatgacgaagctcggcgcttgcaatgatacattgcagcaattgatggaagtcttcaagttcgacacgatcagtgagaaaactagcgaccagatccacttcttttttgcgaaactcaactgccgactgtaccgaaaagcaaataaatcctccaagctcgtgagcgccaacagattgttcggagataagtctctgaccttcaatgaaacctatcaggacatcagcgagctggtctatggagccaaattgcagccgcttgacttcaaggaaaacgccgagcagtctagggctgctattaacaaatgggtcagcaacaaaacagaaggaaggatcaccgacgtgatcccttccgaggccatcaatgagctgacggtgctggtgctggtgaacaccatctattttaagggactgtggaagagcaaattcagtcccgagaacactagaaaagaactgttttacaaagctgatggggagtcttgttcggcctcgatgatgtaccaggagggaaagttccgttatcgacgcgttgccgaagggactcaagttcttgagttaccttttaaaggagacgacatcacgatggttctgattctgccaaagcctgaaaagtcactggctaaggtcgagaaggagctcactcctgaggtgctgcaggagtggctggatgagctggaggagatgatgttagtcgtgcatatgcctagattccgtatcgaagatggtttctcactgaaggagcagttgcaggatatgggccttgtggacctcttctctcctgagaagagcaagcttccaggcattgtggccgaaggtcgggatgatctgtacgtcagtgacgctttccacaaagccttcctggaagtcaacgaggagggatccgaggccgcggctagcaccgctgtcgttatagccgggcgatcgcttaaccccaatagggtaacatttaaggccaaccgcccatttctggttttcatacgagaagtgcctctcaataccattattttcatggggcgggtagcgaacccctgcgtaaaa

SEQ ID NO: 18833 - DNA, 1392 bp, Artificial Sequence
  Description of Artificial Sequence: Synthetic coding sequence
atgtacagtaatgtgataggcactgttaccagcggaaagcggaaggtgtatctcctgtctctcctcctgatcggcttctgggattgtgtcacctgccatggcagtccggttgatatttgtactgccaaaccccgcgatatccctatgaacccaatgtgtatctataggtctccagaaaagaaggccacagaagatgaggggtccgaacagaagattcctgaggccaccaacaggagggtttgggagctgtctaaggccaattctagatttgccaccacgttctaccagcatctcgctgactctaagaacgataatgataatatcttcctgtctcccctgtctatcagcactgcgttcgctatgaccaagctgggggcctgcaatgacacacttcagcaacttatggaggtgttcaaattcgacacgatatccgagaagacaagcgaccagattcacttcttctttgctaagctgaattgccgcctttacaggaaggctaacaagagtagtaagttggtaagcgctaatagactgttcggcgataagtcacttacgtttaatgagacgtatcaagacatttcagagctggtttacggcgctaaattgcaacccctggacttcaaggaaaatgcggaacagtcacgcgcggccattaacaaatgggtcagcaacaaaaccgaagggagaataacggatgttatacccagtgaagccatcaatgaactgacagtgcttgtccttgtgaacaccatttatttcaagggcctttggaaatcaaagtttagcccagaaaatacaagaaaggagctcttctacaaggctgacggcgagagctgctccgcaagcatgatgtaccaggagggcaagttccgctacaggagagtggccgagggcactcaagtgctggagctgccttttaagggggacgacataacaatggtgctgatcctgcctaagccggaaaagtccctggctaaagtagagaaagaacttacacccgaggtcctgcaggaatggctggatgaattggaggaaatgatgcttgttgttcatatgcccagattcagaatcgaggacggatttagcctcaaagagcaactgcaggatatgggcctcgtggatctctttagtcccgagaagagcaaactgccagggattgtggctgaggggagggatgacctctatgtctctgatgcttttcacaaggcattcttggaggtgaacgaggaggggtctgaggcggcagcttcaacagctgtagtgatagccggccggagtctgaaccctaatcgggtgacatttaaggccaatagaccatttctggtgtttatcagggaggtgccccttaacaccatcatcttcatgggtcgggtggccaacccgtgcgtgaag

SEQ ID NO: 18834 - DNA, 1392 bp, Artificial Sequence
  Description of Artificial Sequence: Synthetic coding sequence
atgtactctaacgtaattggaacagtgacctccggtaaacgaaaggtttatttgttgagcctgctgctgataggcttttgggactgtgtgacctgccatggctcacctgtcgatatctgcactgcgaagcctcgcgacatccccatgaaccccatgtgtatttaccgatctcccgagaagaaggctaccgaagatgagggatctgagcagaagatcccagaggccacaaatcgaagagtgtgggaactgtcaaaggccaattcccgcttcgcaaccaccttctatcaacacttagccgattcgaaaaacgataacgataatatattcttatctcccttatccatcagtacagcttttgcaatgactaaactgggtgcctgcaacgatacgttacagcagctgatggaggtatttaagttcgacaccatcagcgaaaaaaccagtgaccagattcacttcttcttcgctaagctgaactgtagattgtatagaaaagccaataaatcttccaaactggtgagcgctaatcgtctgtttggggacaagtcactgaccttcaacgaaacttaccaggatatttcagagttagtgtatggggctaaactccagcctctggactttaaagaaaatgcagagcaaagccgcgcagccattaataagtgggtgtctaacaagacagaagggcggataactgacgtaattccctccgaggccatcaacgagttgacggtcttggtgctggtgaataccatttatttcaaaggactttggaagagcaagttttctcccgagaacacccgcaaagaactattctataaagcagacggcgagtcctgtagcgcttcaatgatgtatcaggaggggaagtttagataccggagggttgccgagggaacccaggttctggaactccccttcaaaggggacgatatcactatggttctaattcttcccaagccagagaagtctttagccaaggtggagaaggagctcacaccggaagtcctgcaggaatggttggatgagctggaggagatgatgctcgtggtccacatgccccgatttcgaatcgaagacgggttctctttgaaggaacagttgcaggacatgggcttggtggatctcttctctcctgaaaagtccaaactgccggggattgtcgcggaagggagggatgatctgtacgtatccgatgcctttcacaaggcctttctggaggtgaatgaggagggtagcgaggccgcagcatctactgctgttgtgatcgccggacggtcgttgaaccctaatcgcgtcacattcaaagctaatcgcccttttttagtgttcatccgagaagtccccttaaacactattatttttatgggtcgagtcgctaatccctgtgtgaag

SEQ ID NO: 18835 - DNA, 1392 bp, Artificial Sequence
  Description of Artificial Sequence: Synthetic coding sequence
atgtacagtaacgtgatcgggacagtcacctctggtaaaagaaaagtctaccttctgtcacttctgcttattggattttgggactgtgtcacctgccatgggagccccgttgacatctgcactgcaaaaccacgggatatcccgatgaaccctatgtgcatataccgaagcccagagaagaaggcaaccgaagacgagggaagcgaacagaaaattcccgaagcaacaaacagacgagtctgggaattgagcaaagccaactctcgcttcgcgactacattctatcaacacctggctgactccaaaaacgataacgataacatctttttgtcccccctcagcattagtactgcctttgctatgaccaaacttggagcttgcaacgacacactgcagcagcttatggaggtcttcaagtttgatactatcagcgaaaagaccagcgatcagatccacttcttttttgctaaattgaattgtagactctatcgcaaggccaacaagtcctccaaattggttagtgcaaacagattgtttggtgataaatctctcacctttaacgagacataccaggacatttccgagctggtctatggcgctaagctgcaacctctcgattttaaggagaacgccgaacaatctcgtgccgctatcaataagtgggtaagcaacaagactgagggcaggataacagacgtgatcccgtcggaggctatcaacgaactcaccgtcctcgtgctggtgaacacaatttatttcaagggcctctggaaatcaaagttcagccccgagaatacgcggaaagagctgttctacaaagctgacggtgaaagttgtagtgcctctatgatgtaccaagagggaaaattccgttaccgcagggtggcggagggaactcaggtgctggagctgccatttaaaggggatgatataaccatggtccttatcttaccaaagccggaaaaaagtcttgccaaggtcgaaaaagagttgactcccgaagtgctacaagagtggctcgatgagctggaggagatgatgcttgtggtgcacatgcctaggttcaggatcgaggacgggttcagccttaaagagcaacttcaggatatgggactggtggacctctttagccccgagaaatctaagctgcctggcatagtagctgaaggtcgtgacgacctttacgtttcagatgcgtttcataaggcctttctggaggtgaatgaagaaggatccgaggctgcagccagcacagcagtcgttatagctggcagaagcctgaaccctaacagggtgacatttaaggccaacaggccctttttggtttttatcagggaagtgccactgaacacaatcatctttatgggcagggtggctaacccatgcgtgaaa

SEQ ID NO: 18836 - DNA, 1392 bp, Artificial Sequence
  Description of Artificial Sequence: Synthetic coding sequence
atgtacagcaatgtgattgggaccgtgacctcgggaaagcggaaagtttatttgctttctttgctcctgattgggttctgggattgcgtgacgtgccatgggagccccgtggatatttgtacggccaaaccacgggacattcctatgaacccaatgtgcatctacagatcaccagagaagaaagctaccgaggacgagggttctgaacagaagattccggaggccaccaataggcgagtttgggaacttagtaaggcgaactcacggttcgctacaaccttttatcagcacctggccgactctaaaaacgacaatgacaacatattcctgagcccactttctatttccacagcctttgcaatgacgaagttgggggcgtgtaatgacaccttgcagcagttgatggaggtttttaaatttgatacaatcagcgagaaaacatctgaccaaattcacttttttttcgcaaagctgaactgcagactgtaccgcaaggctaacaagagctctaaactggtctctgctaaccggttattcggggataagtcgctgacgttcaatgagacctatcaggatatcagcgagttggtctatggagcgaagcttcagccactggactttaaagaaaacgcagaacagtcgcgtgcagccatcaacaagtgggtaagcaataaaaccgagggccggatcaccgatgttatcccgtcagaagccatcaacgaacttacagtactggtgttggtgaacaccatatattttaaaggtctgtggaagtctaaattctcacccgaaaatactcggaaggaattattttacaaagccgacggggagtcctgcagcgcctctatgatgtaccaggaagggaaatttcggtatcggcgggtggctgagggcactcaagtgctcgagctaccattcaagggcgacgacatcacaatggtgttgatcctgcctaaacccgagaaatccctggccaaagtggagaaagagctaacgcccgaagttctgcaagaatggctggacgaactggaggaaatgatgctggtcgtccatatgcctaggtttagaatcgaagatggtttctctctgaaggagcagttgcaagatatggggctcgtcgatcttttctcccccgaaaagtccaagctaccaggcatcgtagcagagggcagagacgacctatatgtgagcgatgctttccacaaggccttccttgaggtaaatgaggagggtagtgaggccgctgcttccaccgctgttgtgattgctggccgtagtctgaatcccaatcgggtgacatttaaagcaaatagaccttttctggtgtttattcgagaggtcccattgaatactatcatctttatgggacgggtagccaacccttgtgtgaaa

SEQ ID NO: 18837 - DNA, 1392 bp, Artificial Sequence
  Description of Artificial Sequence: Synthetic coding sequence
atgtattcaaacgtgattggaactgtaacttctggtaagcgaaaagtctatttgcttagcctgcttttaatcgggttttgggattgtgtcacatgtcacggctccccggtggatatctgcaccgccaagccccgagatatcccaatgaatccgatgtgcatctataggagtcccgagaagaaggctaccgaagacgagggctctgagcagaagatcccagaggctacaaatcgacgggtatgggagctgagcaaggccaattcacgcttcgcaaccaccttctatcagcatctcgccgacagtaagaacgacaacgacaatatcttcctgtcacctctgtccatatctaccgccttcgctatgacgaaactgggtgcatgcaacgataccttacagcagctgatggaggttttcaaatttgacaccatcagcgagaagacgtccgatcagatccattttttttttgctaaactgaactgccgtctctaccggaaagccaacaagtctagtaaactggtttctgctaatcgtctttttggcgataaatcattgacgtttaacgagacctaccaggacatatcagaattggtctacggggctaagttgcagcctctggattttaaggagaacgcagagcagagccgcgccgctataaataagtgggtgagtaacaagacagaaggaaggatcaccgacgttataccatccgaagccataaatgagctgacagtcctcgtgctggtgaatactatctactttaagggtctgtggaaatcgaagttttctcccgagaacacaagaaaagaattattttataaagctgacggcgaatcatgcagcgcatccatgatgtaccaggaagggaagttccgctataggagggtggccgagggcacccaggtcctggaactgccgtttaaaggagatgacataaccatggtgctgatcttaccaaagcccgaaaaaagtcttgccaaggtggaaaaggagctcacgccagaagttctgcaagaatggctggacgaactggaagaaatgatgctggtggtccacatgccccggttccggatagaggatgggttttctctcaaagagcagctacaggacatgggcctcgtggatctgttttccccagaaaagtcgaaattgcccggaattgttgccgagggaagagatgacctatatgtgtctgatgctttccataaagccttcctagaggtcaacgaggaagggtccgaggcagcggcctcgactgcagtggtaattgccggcaggtcgctcaatcctaacagggtaacattcaaggccaatcgtccttttttggtgtttatccgagaagtgcccttaaatacaataattttcatgggccgggtggctaatccctgcgtgaaa

SEQ ID NO: 18838 - DNA, 1392 bp, Artificial Sequence
  Description of Artificial Sequence: Synthetic coding sequence
atgtactccaatgtcatcgggactgtgacctcaggaaagagaaaggtttaccttctgtccctgttgctcatcggattctgggactgcgtgacgtgccacggatctcctgtggacatctgtaccgccaaaccacgggatatccccatgaacccaatgtgcatttatcgctctcctgagaaaaaggcgaccgaggatgagggatcagagcagaaaatcccggaggccaccaaccggagagtatgggaactgtccaaggccaacagcagatttgctacgaccttctatcagcatctggccgactccaagaacgataacgacaatatcttcttgtcgccgctctctatctcgactgcattcgccatgaccaagctgggggcgtgcaacgacactcttcagcagcttatggaagtgttcaagttcgacactatcagcgaaaagacttcggatcagatccatttctttttcgcaaaactgaattgccggctgtacaggaaggctaacaaaagctcgaagctggtgtctgcaaaccgcctctttggagacaagtctctgactttcaacgaaacttaccaggatatttcagagctcgtgtacggagcaaaacttcaaccgctggactttaaagaaaacgctgagcagtcgcgggcggcgatcaacaagtgggtcagcaataagactgaaggacgcattaccgatgtgatcccttcggaggccatcaacgagctgaccgtcctggtgctcgtcaatacgatttacttcaaaggactttggaagtcgaagttcagccctgagaatacccgcaaagaactgttctacaaggctgacggagagagctgcagcgcatccatgatgtaccaagaagggaagtttcgctacagacgagttgctgaagggacccaggtcctggagctcccctttaagggcgacgatatcaccatggtgctgattctcccgaagccggagaaatccctcgccaaagtagagaaagagctcactcctgaggttcttcaggaatggctggacgaactggaggaaatgatgctcgtcgtccatatgccgaggttcagaatcgaagatggctttagcctcaaggagcaactgcaggacatgggcctcgtggacttgttcagccccgaaaagtccaagctgccgggaatcgtggcggagggtcgggacgatctgtacgtctcggacgccttccacaaagcattcctggaagtgaacgaggaaggatcagaagccgccgcgtccaccgccgttgtgatcgccggccggtcacttaatccgaacagagtcactttcaaggcgaatagaccgttcctggtgttcatccgcgaggtgccactcaatactatcatctttatgggacgggtggcgaacccctgcgtgaaa

SEQ ID NO: 18839 - DNA, 1392 bp, Artificial Sequence
  Description of Artificial Sequence: Synthetic coding sequence
atgtatagtaatgtgattgggacggtcacaagcggtaagaggaaagtgtatctgttgtcattgctcttaatcgggttttgggattgtgtcacatgccatgggtcacccgtggatatttgcaccgcaaagcccagggatatccccatgaacccaatgtgcatttataggtcacctgagaaaaaagctactgaggacgaaggaagcgagcagaagatccccgaggccacaaatcgacgggtgtgggaactgtcgaaggctaacagtcgctttgccacaaccttttatcaacatctggccgactcaaagaatgacaatgacaatatcttccttagccccttgagcatcagtaccgccttcgccatgacgaagctcggcgcgtgtaatgacactttgcaacagttgatggaggtgtttaagtttgatacgatctcagagaaaacgagtgaccagattcattttttctttgccaaattaaattgtcgcctctacaggaaagctaacaaatcctcaaaactcgtgagcgccaatagattgtttggtgataagagccttacatttaacgagacctaccaagacatcagtgaactcgtttacggcgccaagttgcagccattggacttcaaggagaacgccgagcagtcacgggccgcaatcaataagtgggtgagtaataaaaccgaagggcgcatcacagatgtaattcctagtgaggcaataaatgaacttaccgttctagtgctcgttaatacgatttactttaagggtctgtggaagtccaagtttagccctgagaatacacggaaggagctattctacaaagcagacggtgaatcctgcagtgcctcgatgatgtatcaggagggaaaattcagatataggagagtggccgagggcacccaggtcctcgaactaccctttaaaggtgatgatattacaatggtgcttatattgcccaaaccagaaaagtcccttgcgaaggtggagaaagagctgactccagaagtccttcaggagtggctcgacgagttagaagaaatgatgttggtggttcacatgccaagattccgcattgaagacgggttctccctgaaggagcaactgcaggatatgggattggtggacttgttctcgcccgaaaagtcaaagctacccgggatcgttgctgaaggccgtgatgatctgtatgttagtgacgccttccacaaggccttccttgaagtaaatgaggaaggctccgaggcagccgcctcaacagcggttgttatagctggacgctcgttgaaccccaaccgcgtaacttttaaagcaaataggccattcctggtctttattagggaagtaccccttaatacgataatattcatgggacgggtggccaatccttgtgtcaaa

SEQ ID NO: 18840 - DNA, 1392 bp, Artificial Sequence; identical to SEQ ID NO: 18795
  Description of Artificial Sequence: Synthetic coding sequence

SEQ ID NO: 18841 - DNA, 1392 bp, Artificial Sequence
  Description of Artificial Sequence: Synthetic coding sequence
atgtactcgaatgtgattggtactgtgacttctggaaaacggaaggtgtatcttttgtcactgttgctcatcgggttttgggattgtgtgacttgccacggctctcctgtcgacatctgtaccgctaagcctagggatattcccatgaatcctatgtgtatttaccgatcacccgaaaagaaggccacggaagatgagggatcagaacagaaaattccagaagcgaccaatagacgcgtttgggaactgtccaaagcaaacagccgattcgccaccactttctaccagcatcttgctgatagcaagaatgacaatgataacatattcctttcacctttgtccatctctaccgcgtttgcgatgaccaaactgggcgcatgcaacgatactcttcaacaactgatggaggtgttcaagtttgataccatttccgaaaaaacgagcgatcagatccatttcttctttgcgaaacttaattgtagactctacagaaaggcaaataagtcctcgaaactggtgtcggcaaaccgcctcttcggagacaagtcgttgaccttcaacgaaacctaccaagacatctcggagcttgtgtacggtgcaaagttgcagccgctggatttcaaggaaaacgcagagcaaagccgagcagcaattaacaaatgggtgtccaataagactgaggggcggattactgatgtcatcccttccgaggcgattaacgagctcactgtgctcgtccttgtgaatactatctactttaagggtctgtggaagtcaaagttttcgcccgaaaacacgagaaaggagttgttttacaaggccgatggagaaagctgctccgcaagcatgatgtaccaagaaggaaagttcagatacaggcgtgtggcagaaggtactcaggtcctggagttgccgtttaagggagacgacatcactatggttctgattctgccaaagccagaaaagtcgctcgcaaaggtggagaaggaactgactcccgaagttctgcaagagtggctggatgaacttgaagagatgatgctggtcgtccatatgcctaggttcagaatagaagatggattttcactcaaggaacagctgcaagatatgggactcgtcgatttgtttagccccgagaaatcaaaattgcctggtatcgtggcagaaggccgggacgacctgtatgtctccgacgcatttcacaaggcatttcttgaagtgaacgaagaagggtcagaagccgccgcctctaccgctgtggtcatagcaggacggtcgcttaatcccaaccgggtcacctttaaggcaaatcgaccattcctggtgtttatacgagaggtgcctctgaataccattatctttatgggtagagtggctaatccatgtgtgaag

SEQ ID NO: 18842 - DNA, 1392 bp, Artificial Sequence
  Description of Artificial Sequence: Synthetic coding sequence
atgtactctaatgtgatcgggactgtcacctccggcaagagaaaggtgtacctgttgtcccttctccttattggattttgggattgtgttacttgccatggatcccccgtggacatctgtactgccaagccacgcgatataccaatgaatcctatgtgtatatacagatcaccagagaaaaaggctaccgaagatgaagggtccgagcagaagataccagaagcgactaaccggcgggtctgggaactgtcaaaggcaaacagccgatttgcgactaccttctaccagcatcttgcagattccaagaatgacaatgacaacatcttcctttcccctctttcaatttcaactgccttcgcaatgaccaagttgggagcgtgtaacgacaccctccagcagttgatggaggtctttaagttcgacaccatatccgagaaaacttcagatcagatccatttcttctttgccaaattgaattgtcgtctctacagaaaagcaaacaaatcgtctaaacttgtctcggcgaataggctgtttggggacaagagccttacgtttaatgagacttaccaagatatctcggaactcgtgtacggagccaaacttcagcccctggacttcaaggaaaacgcagaacagtcgcgcgcagcaattaacaagtgggtgtccaataagaccgaaggcaggatcaccgacgtgattccttcggaggcaattaacgaacttaccgtgctggtgctggtgaatactatttactttaagggactgtggaagtcgaagtttagccccgaaaatactcgcaaagaacttttctacaaggcggacggggagtcctgctctgcctccatgatgtaccaggaaggaaagtttcgttaccgacgggtggcagagggaacccaagtgctggagctgccttttaagggggatgacattactatggtcctgattctgccaaaacctgaaaagtctcttgcaaaagtggaaaaggaattgactcccgaagtgcttcaagaatggctggatgaactggaagaaatgatgcttgtggtgcacatgccgagattcagaattgaagatggtttttcgttgaaggaacaactgcaagatatgggtcttgtggacctgttttcacctgagaagtccaaactcccaggaattgtggccgaaggacgcgacgatctctacgtctcggacgcatttcacaaggcatttttggaagttaacgaagaaggaagcgaagcagcggcaagcaccgcagtggtcatcgcagggagatcgttgaacccgaacagggtcaccttcaaggcaaatcggcccttcctggtgttcatcagagaggtgcctctgaataccatcattttcatgggtcgcgtggccaacccatgtgttaag

SEQ ID NO: 18843 - DNA, 1392 bp, Artificial Sequence
  Description of Artificial Sequence: Synthetic coding sequence
atgtactcgaatgtgatcggtactgttacctcaggaaagagaaaggtgtacctgctgtcacttctgctcatcggcttctgggactgtgtcacgtgccatggatctccagtggacatctgcactgctaagccgcgcgatatcccaatgaacccgatgtgcatctacaggtcgcccgagaagaaggctacggaagatgaaggctcagaacagaaaattccggaggctactaaccgccgggtgtgggagctgtcgaaggcaaattcacggttcgcaactactttttaccaacaccttgccgactccaagaacgacaacgacaacattttcctctcccctctgtccatcagcacggccttcgcaatgactaagttgggagcctgcaacgataccctgcaacagctgatggaagtctttaagttcgacaccatctcggaaaagaccagcgaccagatccatttcttcttcgcgaagttgaattgccggctttaccgcaaggcaaacaaatccagcaagctcgtgtccgcgaacaggttgttcggagataagtccctgactttcaatgaaacctaccaggacattagcgaacttgtctacggtgcaaagctccagccgctcgatttcaaagagaacgcagaacagtcacgggccgcaatcaataagtgggtgtccaacaagaccgagggaagaattactgacgtgatcccgtctgaggccatcaacgagctcacggtcctcgtccttgtcaacactatctatttcaagggcctgtggaaaagcaaattctcgccggaaaacaccagaaaagagctcttctataaggccgacggagagtcttgctcggcgagcatgatgtaccaggagggaaagttcaggtacaggcgcgtggcggagggaacccaggtgctggaattgcccttcaagggagacgatatcaccatggttctcatcctgccgaagcccgaaaagtcgctcgccaaagttgagaaagagctgaccccggaagtgctgcaggaatggctggatgagctggaggagatgatgctggtggtgcacatgccacggttccgcatcgaggacgggttctctctgaaggagcaactccaagatatgggactggtggatctcttcagtccagaaaaatctaagctgccggggattgtcgcagaaggacgcgacgatctgtacgtcagcgacgcttttcataaagcgttcctcgaagtcaatgaagagggatccgaggcggctgccagcaccgccgtggtgattgccggacggtcgctgaatccaaaccgggtgacgttcaaagcgaatcgcccgtttctggtgttcatcagggaggtccctctgaatacgatcatcttcatgggtcgggtcgcgaacccatgtgtgaaa

SEQ ID NO: 18844 - DNA, 1392 bp, Artificial Sequence
  Description of Artificial Sequence: Synthetic coding sequence
atgtactccaacgtgattggaaccgtgaccagcgggaaaagaaaagtctacctccttagtttgcttctcatcggattttgggattgtgtgacttgccatggcagccctgtcgatatttgtactgccaagcccagggatattcccatgaatccaatgtgtatttacagatcgcctgaaaagaaggcgaccgaagatgagggaagcgagcaaaagatcccagaagctaccaaccggagagtttgggaactctcgaaagcaaactcccgctttgcaacgaccttttaccagcatttggcggattccaaaaacgacaacgacaatatcttcctttccccactgtcaatttcaaccgcgttcgcgatgactaaacttggtgcatgcaatgacactcttcaacaattgatggaagtgttcaagtttgacaccatttccgaaaagacctccgaccaaattcacttcttttttgctaagctgaactgtagactctacagaaaagcaaacaagtcatccaaactggtgtccgcaaaccgactcttcggtgacaagagcctgacctttaacgaaacgtaccaagacatctcagagcttgtctacggcgcaaaactgcagcccttggactttaaggaaaacgctgagcaatcgcgtgcagccatcaacaagtgggtgtcgaacaagactgaaggacgcattactgacgtcattccctcggaagcaatcaacgagctgaccgtgctggtgcttgtcaacaccatttactttaaaggactctggaagtcaaagttctcacctgaaaacaccagaaaggaactgttctacaaggcagatggagaaagctgttcggcatccatgatgtaccaggaaggcaagtttcgctaccgcagagtggcagaaggtacccaagtgctggaactgcctttcaagggagatgatattactatggtgctgattcttccaaagcccgagaaatcgcttgcgaaagtcgaaaaggagctgactccagaggtgctgcaagaatggcttgatgaacttgaagaaatgatgctggtagtgcatatgccacggtttcgcatagaggatgggttctcactcaaagaacaactgcaagatatgggcctcgtggatctgttttcgccggagaagtcgaaacttccgggaattgtggccgaaggaagggacgacctttacgttagcgatgcgtttcataaggctttccttgaagtgaacgaggaagggtccgaggcagcagcgtcgaccgcagtcgtgatcgcagggcggagcttgaatccaaaccgggtgaccttcaaagcaaacagaccttttttggtgtttatccgcgaagtgcctctgaacactatcatctttatgggcagagtcgcgaacccatgcgtgaag

SEQ ID NO: 18845 - DNA, 1392 bp, Artificial Sequence
  Description of Artificial Sequence: Synthetic coding sequence
atgtactccaatgttatcggaactgtgacgagcggaaagcggaaagtgtaccttttgtcgctgctgctgatcggtttttgggactgcgttacctgccacggatcgcccgtggacatctgcaccgcgaagccccgcgacatccccatgaacccaatgtgtatctaccggagccccgagaaaaaggccactgaggatgaaggatctgaacagaagattccggaagctactaatagacgggtctgggagctctcgaaggcaaactcaaggttcgctaccactttttaccaacatctggccgattccaagaatgataacgacaacatatttctgtcgcctctgagcatcagcaccgcatttgccatgaccaaacttggagcgtgcaacgacacccttcagcaattgatggaagtgttcaaatttgacactatctcggagaaaacctctgaccaaatccacttctttttcgcaaaactgaactgtcgcctctaccgcaaagcgaacaagagctcgaagctcgtgagcgccaaccgcctgttcggcgataagtccctcaccttcaacgagacttatcaggacatctccgagctcgtctacggcgctaaacttcagccgctggatttcaaggaaaatgccgaacaatcacgcgcggccataaacaagtgggtgtctaacaagaccgagggacggattactgacgtcatccctagcgaagctattaacgagctgactgtgttggtgctggtcaataccatttacttcaagggtctgtggaagtcaaagttttccccggagaataccaggaaagaactcttttacaaggccgatggcgaatcctgctccgcatccatgatgtaccaggaaggcaagttccggtataggagggtcgctgaaggaacgcaggtgctggaactgccgtttaagggcgatgacatcacgatggtgctcatcctgccaaagccagagaaatccctggccaaggtcgagaaggagctgaccccggaagtgctccaagaatggctggacgaattggaagaaatgatgttggtcgtgcatatgccacggttccgcatcgaagatggattctcacttaaggagcagctgcaggacatgggactggtcgatctgttctcaccggagaagtcaaaactgccgggaatcgtggccgagggtagagacgatttgtacgtgtcggacgcattccacaaggccttcctcgaagtgaacgaagagggatcggaggccgccgcgagcactgcggtggtcatcgctgggcgatcgctcaatccgaaccgcgtgaccttcaaggcaaaccggcctttcctggtgttcatccgggaagtgcctctcaatacgatcatattcatgggacgagtggcaaatccctgcgttaag

SEQ ID NO: 18846 - DNA, 1392 bp, Artificial Sequence
  Description of Artificial Sequence: Synthetic coding sequence
atgtattccaacgtcattggaacagtcacgtcaggtaagagaaaggtctacctcctgtctcttctgttgatcggcttctgggactgcgtgacctgccacggttccccagttgacatctgtacagcaaagcctcgcgatatccccatgaatcccatgtgcatatacaggagccccgagaaaaaagccaccgaagatgagggatctgaacagaagattccggaggccactaatcgacgtgtctgggagttgtccaaggctaacagtagatttgctaccaccttttaccagcatttggctgattccaaaaatgataatgataatatcttcttgtcccctctgtccatcagcaccgccttcgcgatgacaaaactgggggcatgtaacgataccctccaacaactgatggaggtcttcaaattcgataccatcagtgagaaaacttccgaccagattcactttttctttgccaagctgaattgccggctctatcgtaaggccaacaagtccagtaagctcgtcagcgctaataggctatttggcgacaagtctctcacattcaatgaaacctatcaggatatttcggagctcgtatatggagccaaactacaacctttagatttcaaggaaaacgccgagcagtctcgagccgcgataaataaatgggtgtccaataagacggagggccgaatcactgatgttataccctccgaggccattaatgaattgacagtcctggtactggtcaatactatctacttcaagggactctggaagtcaaaattttctcccgaaaatacaaggaaagaacttttctataaggcggatggggaaagctgctcggcttctatgatgtaccaggaagggaaattccgttaccgacgtgtggcggagggaacccaagtattggagctccccttcaaaggcgacgatataactatggtgctgattctgccgaagccagaaaaaagtctagcgaaggtggagaaggagctgacacccgaggtgttacaggagtggttggatgagctcgaagagatgatgctggtagtgcacatgccgaggtttcgaatagaagacggctttagcctgaaggaacagcttcaggatatggggttggtcgatctctttagtcctgagaagtcgaagctgccgggcatagtcgccgagggcagagacgacttgtacgtttcggatgctttccataaagccttcctggaagttaacgaagaaggctcagaagctgccgcgtctaccgccgtggtcattgcagggaggagcttgaaccccaaccgagtcacttttaaagctaaccggcccttccttgtttttatcagagaagtgcccctgaacacgataatttttatgggtagggtcgccaatccatgtgtcaaa

SEQ ID NO: 18847 - DNA, 1392 bp, Artificial Sequence
  Description of Artificial Sequence: Synthetic coding sequence
atgtacagcaacgtgatcggcactgtgacgtctgggaaacgcaaagtgtacctcttgtcgctgctgctgattggtttctgggactgcgtgacgtgccatggctcgccggtcgacatctgcactgcaaagccacgagacatcccgatgaacccgatgtgcatttaccgctcacccgagaagaaggctaccgaagatgaaggatcggagcagaaaatccccgaagcgactaatcggcgcgtgtgggagctctcgaaggcgaattcacggttcgcgaccactttctaccagcatcttgccgatagcaaaaatgataacgacaacatctttctctctccgctgtccatctcgaccgcctttgccatgaccaagttgggcgcgtgtaatgacaccctgcagcagcttatggaagtctttaagttcgacactattagcgaaaaaacctctgaccagatccacttcttctttgcgaagttgaactgccgcctgtacaggaaagccaacaagtcctcgaaactcgtgtcagcaaaccggctgttcggagacaaatccttgaccttcaatgagacgtaccaggatatctcggaactggtgtacggagcaaaattgcaaccactggactttaaggagaatgcagaacagtcccgcgcagccatcaataagtgggtgtcgaacaagacggaaggccggataactgatgtgatcccgtcggaagccataaatgagctcaccgtgctggtactggttaatacgatctactttaaggggctctggaagagcaagttcagcccagaaaacactcgcaaagagctgttttacaaggctgatggagaatcctgcagtgccagcatgatgtatcaagaaggaaagttcagatacagacgggtggcggaaggtactcaggtccttgaacttccattcaagggcgatgatatcaccatggtcctgatcctgccgaagcctgagaaatccctggcgaaggtggaaaaagagctgacccctgaggtcctgcaagaatggctggacgaactggaggaaatgatgctcgtggtgcacatgcctcgctttagaattgaggacggattctccctcaaggagcaactccaagatatgggattggtggacttgttctcaccggagaagtccaagctgccgggaatcgtggctgaaggtagagacgacttgtacgtcagcgatgctttccacaaggcattccttgaggtaaacgaggaggggtcagaggctgccgcttcaactgctgtcgtaattgcaggaaggagcctcaacccgaatagggttaccttcaaggccaacaggcctttcctcgtgttcatccgcgaagtccctctgaacactatcatcttcatgggacgtgtcgccaacccttgtgtgaag

SEQ ID NO: 18848 - DNA, 1392 bp, Artificial Sequence
  Description of Artificial Sequence: Synthetic coding sequence
atgtattcgaatgtaataggtacggtaacgtcgggtaaacgaaaagtatatttactatcgctactactaataggtttttgggattgtgttacgtgtcatggttcgccggtagatatatgtacggcgaaaccgcgagatataccgatgaatccgatgtgtatatatcgatcgccggaaaaaaaagcgacggaagatgaaggttcggaacaaaaaataccggaagcgacgaatcgtcgtgtttgggaattatcgaaagcgaattcgcgttttgcgacgacgttttatcaacatctagcggattcgaaaaatgataatgataatatatttctatcgccgctatcgatatcgacggcgtttgcgatgacgaaattaggtgcgtgtaatgatacgttacaacaactaatggaagtttttaaatttgatacgatatcggaaaaaacgtcggatcaaatacattttttttttgcgaaattaaattgtcgactatatcgtaaagcgaataaatcgtcgaaactagtttcggcgaatcgactatttggtgataaatcgttaacgtttaatgaaacgtatcaagatatatcggaattagtatatggtgcgaaattacaaccgttagattttaaagaaaatgcggaacaatcgcgagcggcgataaataaatgggtatcgaataaaacggaaggtcgtataacggatgtaataccgtcggaagcgataaatgaactaacggttttagtactagttaatacgatatattttaaaggtttatggaaatcgaaattttcgccggaaaatacgcgtaaagaattattttataaagcggatggtgaatcgtgttcggcgtcgatgatgtatcaagaaggtaaatttcgttatcgacgagttgcggaaggtacgcaagtattagaattaccgtttaaaggtgatgatataacgatggtattaatattaccgaaaccggaaaaatcgttagcgaaagtagaaaaagaattaacgccggaagtattacaagaatggctagatgaattagaagaaatgatgttagtagtacatatgccgcgatttcgaatagaagatggtttttcgctaaaagaacaactacaagatatgggtttagtagatctattttcgccggaaaaatcgaaactaccgggtatagtagcggaaggtcgtgatgatttatatgtatcggatgcgtttcataaagcgtttctagaagtaaatgaagaaggttcggaagcggcggcgtcgacggcggtagtaatagcgggtcgatcgctaaatccgaatcgagtaacgtttaaagcgaatcgtccgtttttagtttttatacgagaagtaccgctaaatacgataatatttatgggtcgtgtagcgaatccgtgtgttaaa

SEQ ID NO: 18849 - DNA, 1392 bp, Artificial Sequence
  Description of Artificial Sequence: Synthetic coding sequence
atgtactcgaacgtgattggaaccgtgacctctggtaagcgcaaggtctacctcctgtcgctgcttttgatcggattttgggactgcgtgacctgccatggttcccccgtggatatttgtacggcaaagcctcgagatatcccgatgaatcctatgtgcatttacagatcacctgaaaagaaggccactgaagatgagggatcggagcaaaagatcccagaggccactaatcggagagtctgggaactgtcgaaggcgaacagccgctttgccactacgttctaccaacatttggcggactcaaagaatgacaacgataacatttttctctccccgctgtccatttccactgcatttgccatgaccaagctcggcgcttgtaacgatacccttcagcagctgatggaagtgttcaaatttgatacgatctctgagaaaacgtccgatcagattcacttctttttcgcaaagttgaactgccggctgtaccggaaggcaaacaagagctcaaaacttgtctcagcaaatcgactttttggagataagtcgctgacgtttaatgaaacctaccaggatatatcggaactggtgtacggagcaaaattgcaacctctggatttcaaagagaatgcagagcaatccagggctgcaattaacaagtgggtgtcgaacaagactgaaggtcgcatcaccgatgtcatcccatcggaggcgatcaacgagctgaccgtgctggtgcttgttaatactatttactttaaaggcctgtggaaatcgaaattcagcccggagaacactaggaaggaacttttctacaaggcggatggggaaagctgctcggcatccatgatgtatcaggagggcaagtttcgatacaggagagttgccgagggaactcaggtccttgaactgcctttcaagggagacgatattaccatggtgcttatactgccaaagcccgaaaagtcgctggccaaggtcgaaaaagaactgaccccagaagtgctccaagaatggcttgacgaacttgaagaaatgatgcttgtggtgcacatgcctaggttcaggattgaggatggcttttctcttaaagaacagcttcaagatatgggactcgtggacctcttctcacccgagaagtcaaagctgccagggattgtggcggaaggaagagacgatctttacgtctcggatgcatttcataaggcatttctggaggtaaatgaagaaggatcggaggcagccgcgtcaaccgcagtggtgattgcaggcaggagtcttaaccctaatagggtgacctttaaggcaaaccggcctttcctggtgttcattagagaagtccccctcaacaccatcattttcatgggcagggtcgctaacccgtgtgtgaaa

SEQ ID NO: 18850 - DNA, 1392 bp, Artificial Sequence
  Description of Artificial Sequence: Synthetic coding sequence
atgtacagcaacgtgatcggaaccgtcactagcggcaagagaaaggtgtacctgctctcactgctcctcatcggtttctgggattgtgtgacctgccacggaagcccggtcgatatctgcactgctaagccccgcgatatccctatgaaccccatgtgcatctaccggtcaccggaaaagaaagcgaccgaggacgagggctcggagcagaagatccccgaggctactaaccgaagagtgtgggaactctccaaggctaactccaggttcgcgacgaccttctaccagcatctggccgattccaaaaatgacaacgacaacattttcctttccccgttgagcatctctaccgccttcgcaatgacgaagctcggagcctgcaatgacaccctgcaacagctcatggaagtgtttaaatttgacactatttcggaaaaaacctcggaccaaattcacttcttcttcgcaaagctgaattgccggctgtaccgcaaagccaataagtcatcaaagctggtgtccgctaaccggctcttcggagataagagtctgacctttaatgaaacctaccaagacattagcgagctggtgtacggagccaaacttcaaccactcgacttcaaagagaacgcggaacagtcgcgcgcagctatcaataagtgggtgtcgaataagactgaagggcgcatcactgacgtgatcccttccgaggcaatcaacgagctgaccgtgctggttctggtgaatactatctacttcaaaggactgtggaagtccaaattctcaccagagaacactagaaaggaactgttttacaaggccgatggagaatcgtgcagcgcgagcatgatgtaccaggagggtaagttccggtacaggcgcgtggccgaggggacccaagtactggaattgccattcaagggtgacgatatcactatggtccttatcctgccgaagccggagaagtcccttgccaaggtggaaaaagaactgaccccggaggtgctccaggaatggctcgacgaacttgaagagatgatgctggtggtccacatgcctaggtttcgcattgaggacgggtttagcctgaaggagcagttgcaggatatgggactggtcgatctgttctcgccagaaaagtcgaaactcccgggaatcgtcgctgaaggacgggatgacttgtatgtctcggacgcatttcataaggccttcctggaggtcaacgaagaaggctcagaagcggcggcgtcgacggccgtggtgatcgccggccgctccttgaacccgaaccgggttactttcaaggcaaaccgtcctttcctggtgttcatcagagaagtgccgctcaacaccatcatctttatgggccgggtggccaatccatgtgtcaaa

SEQ ID NO: 18851 - DNA, 1392 bp, Artificial Sequence
  Description of Artificial Sequence: Synthetic coding sequence
atgtactccaatgtgatcggcacggtcactagtggaaagagaaaagtgtaccttttgtcactgctcttaattgggttctgggactgtgtgacctgccatggatccccggtggacatttgcaccgcaaagccccgagatataccgatgaaccctatgtgcatttatcgcagtcccgagaagaaggcaactgaggacgaagggtcagaacagaaaattcctgaagccacaaatagacgagtttgggagctgtcaaaggccaactcaaggttcgcaacaacattctaccagcatttggccgattcgaagaacgataatgataatatattcttgtctcccctgagcatttcgacggcttttgcaatgaccaagttaggagcttgcaatgataccttgcagcaactaatggaggttttcaaattcgataccatcagtgagaaaaccagcgatcagattcacttctttttcgcaaagctgaactgtagattataccggaaagcaaacaaatcttccaagttagtgagcgcaaaccgcctgtttggagataagtcactgacatttaacgagacatatcaagacatatctgagcttgtgtacggagctaagttacagcctctcgattttaaggagaatgctgagcagtcccgggcggctatcaacaagtgggtcagcaataaaacagaaggccgtattaccgacgtgatcccctctgaggctataaacgaattgaccgtgctggtgcttgtgaacacaatttatttcaagggactgtggaagagtaagttttcacccgagaacacaaggaaagagctcttttataaggcggatggcgagtcttgttccgcatcaatgatgtaccaggaagggaagtttaggtacagacgggtggccgaaggcactcaggtgctggagcttccttttaaaggtgacgacatcacaatggtgctgattctccctaagccagagaagtcactcgccaaagtggagaaggagcttactcctgaggtgctgcaggagtggttggacgagctggaggagatgatgcttgtggtccacatgccaagatttagaatcgaagacggattttccctgaaggaacagctgcaggacatggggctcgtggatcttttctctcccgagaagtcaaaactccctggcatcgtggctgagggaagggatgacctatatgtgtcagacgcctttcataaggctttcctggaagtgaacgaagaaggtagcgaagcagccgcttctactgccgttgtgattgccggccggtctctaaaccctaatagagtgacatttaaggccaaccggccatttctagtgtttatcagggaggtacccctgaacacaattatctttatgggccgggtggcaaatccctgtgtcaag

SEQ ID NO: 18852 - DNA, 1392 bp, Artificial Sequence
  Description of Artificial Sequence: Synthetic coding sequence
atgtattcaaacgtgataggaactgtcacttccggaaagcgaaaggtctaccttctctcgctgctgctgatcggcttctgggactgtgtgacatgccacggatctccagtagatatttgcactgccaagcctagggatatcccaatgaaccctatgtgtatctacagaagtccagaaaaaaaggctactgaggatgaggggagtgaacagaagataccagaggccactaaccgccgagtgtgggagctgtccaaggccaactcaaggtttgcgaccaccttctaccagcatctagccgattctaagaacgataatgacaatatctttttgagtcccctgtctatcagcaccgcttttgcaatgaccaaactgggcgcctgtaatgacacgctgcaacagcttatggaggtattcaaatttgacaccatctccgagaaaacctctgaccagatacatttcttctttgcaaagcttaattgtcgcttatataggaaggccaataaatcctcgaagttagtgtccgccaacagactgttcggagacaaatccctgaccttcaatgaaacgtaccaggatataagtgaactcgtgtatggcgcaaaattgcagcctctggatttcaaagagaatgcggaacagtctcgtgccgctatcaacaagtgggtgtctaacaaaaccgagggaagaattacagatgttataccgtccgaggcaattaacgagttgactgtgctcgtcctagtcaatactatttattttaaggggctctggaagagcaaattcagccctgagaatacccggaaggagctgttctataaagccgacggcgaatcctgctcagcctctatgatgtatcaggaggggaagttcaggtaccgaagggtggccgaaggaacccaggtcctggaacttccattcaagggagacgatattactatggtactgatcctgcctaagcccgagaaaagcctggcaaaggttgaaaaagaacttaccccggaggtcctccaagagtggctggacgagctggaagaaatgatgctagtggtccatatgccaagattcaggatcgaggatggcttctccctgaaggaacagctgcaggatatgggcctagtggacctgttcagtcctgaaaagtctaagctacctggaatcgtcgcagaaggccgcgatgatctctacgtcagtgatgcctttcacaaggcctttcttgaagtcaatgaggaaggctcagaagcggcggcgagtactgccgtcgtcatcgccggccgcagcctgaacccaaatcgggtgacttttaaggccaatagaccgttcttagtattcataagagaggttcccctgaacactatcatattcatgggcagggtcgccaacccctgcgtaaag

SEQ ID NO: 18853 - DNA, 1392 bp, Artificial Sequence
  Description of Artificial Sequence: Synthetic coding sequence
atgtattccaatgtcattggaacagtgaccagcggtaagcgcaaggtctatctgctgagcctgttattaattggattctgggactgcgttacctgccacggatctcccgtcgacatctgtaccgctaagcccagagatatccctatgaatcccatgtgcatctacaggagcccagagaaaaaggccactgaagatgagggctccgaacaaaagattccagaagccaccaatcggcgagtttgggaactgtctaaggctaacagtcgatttgccaccacgttttaccagcacttggccgactccaaaaatgataatgacaacattttcctgagccccctgagtatttcaacagccttcgccatgaccaagttgggtgcatgcaacgatactctgcagcagctaatggaggtcttcaaatttgacaccatcagtgaaaagaccagcgaccagattcacttcttttttgcaaaactgaactgcagattgtatcgcaaagccaacaaatcttcaaagctggtttcagctaatagattgtttggcgacaaatcactaaccttcaatgagacataccaggatatttctgagctggtgtatggtgccaagctgcagcctctcgattttaaagagaatgccgagcagtctcgagccgcgatcaataagtgggtctctaataagacagagggccgcattacagatgtaattccttccgaagcaataaacgagctgaccgtgcttgtacttgtaaacacgatctactttaaagggctttggaaaagcaagttttcacctgaaaatacgaggaaagaacttttctataaagctgacggggaatcctgctctgcctccatgatgtaccaagagggaaagttcaggtaccgtagggtcgccgagggcacacaggttttagaactgcccttcaaaggcgacgacattaccatggtgctgattttacctaaacctgaaaagtcattagccaaggttgaaaaggagctgaccccagaggtgctgcaggaatggcttgatgaactggaggagatgatgcttgtagtgcatatgcctcgatttcggattgaagacggcttttcactgaaggaacaactgcaagatatgggcctggtagatctcttctcccccgagaagtcaaaactaccagggattgttgcagagggaagggacgatttgtacgtgtctgatgctttccacaaggcttttctagaggtgaacgaggaggggagcgaagcagctgccagcactgctgtggtaatcgccggccggagcttgaaccctaacagggtgacattcaaagccaacaggccttttctcgtgtttatccgagaggtaccgctgaataccataatctttatggggagagtcgcaaacccatgcgttaag

SEQ ID NO: 18854 - DNA, 1392 bp, Artificial Sequence
  Description of Artificial Sequence: Synthetic coding sequence
atgtactcgaatgtgatcggcactgtgaccagtggtaagcggaaggtgtacctcctgagcctgctgctgatcggtttttgggactgcgtcacttgtcacggatcaccagtggacatatgcactgccaagccaagagatattccgatgaatcccatgtgcatctacagatcgcctgaaaagaaagcaaccgaggacgagggaagcgagcaaaagatcccggaggcgaccaacagacgggtgtgggagctctcgaaggcgaactcgcgatttgcgaccactttctatcaacatctggccgacagcaagaacgataacgacaacatattcctgtcgccgttgtcaatctccacggctttcgcgatgaccaaacttggtgcctgcaacgataccctgcagcagctcatggaggtgttcaaattcgacaccatctctgagaaaacttccgaccagatccatttcttctttgcgaaacttaactgccggctgtaccggaaggcgaacaagtcgtcgaagctggtgagcgccaacagactgttcggcgataagtcgctgactttcaatgaaacctatcaggatatctccgaactggtctacggagcaaagctccagcccctggatttcaaggagaatgccgaacaatcccgggcagcaatcaacaaatgggtgtcaaataagaccgaaggccgcattactgatgtaatcccatccgaggccattaacgaactgactgttctggtcctcgtgaatactatttacttcaagggtttgtggaaatcaaagttttccccggagaacaccagaaaagagctgttctacaaggcggacggggaaagctgtagcgcaagcatgatgtatcaagaaggaaagttccggtatcgccgggtggcggagggcacccaggtgctggaactgcctttcaaaggagatgacatcactatggtcctgatcttgccgaagccggaaaagtcgctggcgaaggtcgaaaaagagttgaccccggaagtcctgcaagaatggttggatgaactcgaggaaatgatgctcgtggttcatatgcctcggttccgcatcgaggacggattctccctgaaggaacagctgcaggacatgggcctggtcgacctcttctcgccagaaaagtcgaagttgccgggaatcgtggcagaaggtcgggacgacctctacgtgtcagatgcgtttcataaggctttcctcgaggttaacgaagaaggcagcgaggcagcggcttccactgccgtggtcatcgccggccgctcgctgaaccctaacagggtgaccttcaaagctaaccgcccattcctggtctttatcagggaagtcccactgaacaccatcatcttcatgggaagagtggctaacccttgtgtgaag

SEQ ID NO: 18855 - DNA, 1392 bp, Artificial Sequence
  Description of Artificial Sequence: Synthetic coding sequence
atgtattccaacgtgatcggaactgtgacctcgggtaaaaggaaggtctatctcctcagccttctcctgatcggattctgggactgcgtcacgtgccatggatctcctgtggatatttgcaccgctaagccgcgcgatatccccatgaatccgatgtgtatctaccgatcgccggaaaagaaagccaccgaggacgagggatcggaacagaagatcccagaagccactaaccgtcgggtctgggaactgtcaaaggcgaacagccgattcgccacgactttctaccagcacttggccgattcgaaaaacgataacgacaatatcttcctgtcgccgctctcgatctccaccgcgttcgccatgactaaactgggggcctgcaacgacaccctgcaacagctgatggaggtgttcaagttcgacaccatttctgaaaagacctcagatcaaattcacttctttttcgctaagctcaactgtcgcctttacaggaaagcgaataagtcgtcaaaattggtttcagccaatagattgttcggcgacaaatcccttactttcaacgagacttaccaagacatttctgaactggtgtacggtgcaaagctgcagccgctggactttaaagagaacgcagaacagtctcgcgcggctatcaacaagtgggtgtcaaacaagaccgaggggagaatcaccgacgtgataccatccgaagcaatcaacgagctgaccgtccttgtcctggtgaataccatctactttaagggcttgtggaagtcgaagttcagccctgagaacacccggaaagagctcttctacaaggccgacggagaatcctgctcggcaagtatgatgtaccaggaaggcaagtttcggtaccggagagtcgcggagggcactcaggtgctcgaactccctttcaagggggacgatatcactatggtgctcatcctgcctaaaccggaaaagtcgctggcgaaggtggagaaggaactgaccccagaagtgctccaagaatggttggacgaactcgaagagatgatgctcgtcgtccatatgccgcgctttcgcatagaggatggtttcagtctgaaagaacaactccaggacatgggactggtcgatctcttcagtcccgaaaagtcgaaattgcctggaattgtcgctgaagggagagatgatctgtacgtgtcggacgcctttcacaaggcattcctggaggtaaatgaggagggttcagaggcggccgcatcaaccgccgtagtgatcgcgggacgcagcctgaacccgaatagagtgactttcaaggccaaccgcccgtttctcgtgtttatcagggaagtgccgctgaacactatcatcttcatgggaagggtggccaatccatgcgtgaaa

SEQ ID NO: 18856 - DNA, 1392 bp, Artificial Sequence
  Description of Artificial Sequence: Synthetic coding sequence
atgtactctaatgtcattggcaccgttacatccggaaagagaaaggtatatctcttgtcattgttattaatcggattctgggactgcgtgacttgccatggcagtccagtggatatctgcactgccaaacccagggatatccccatgaaccccatgtgcatataccggagccctgagaaaaaagcgacagaagatgaaggcagcgagcaaaagatccccgaggccaccaataggcgtgtgtgggagttgtcaaaggccaatagccggttcgctacaactttttaccagcatctggctgatagcaagaacgataatgacaacatcttccttagcccactgagcatcagcaccgcatttgctatgactaagctcggagcatgcaatgataccctgcaacagcttatggaggtgttcaaattcgataccatttcagaaaagacttcagaccagatccacttttttttcgccaaattgaattgtaggctctaccgcaaagccaacaagtcaagcaaactggttagtgccaaccgtctgttcggtgacaaaagcttgaccttcaatgagacctaccaggacatcagcgagttagtgtacggcgctaagcttcagccactcgatttcaaggagaacgcggagcagtcgcgcgccgctattaacaagtgggttagtaataaaaccgaaggtcgcatcacagatgtcatcccttccgaggcaatcaacgaactgacagtcctggtactcgtcaacacaatctatttcaagggcctttggaagtcaaagtttagcccagagaatacaagaaaggagctcttttataaagccgacggcgaaagctgctctgcatccatgatgtaccaggaagggaagttccgatatcggagggtggccgagggaacccaggtacttgaactcccgttcaaaggagatgatatcacaatggtgttgattcttcccaagccagagaagtctttagctaaagtggagaaggaactcacaccagaggtgctccaggaatggctggacgagttggaagaaatgatgctcgtagtacacatgccacgcttcaggattgaggatggttttagcttaaaagagcagctgcaagatatgggacttgtcgatctcttcagcccagagaaaagcaagctcccaggcattgtggcagaaggccgcgacgatctctacgtgtcagacgctttccacaaggccttcctggaagtcaatgaggagggaagcgaggcagccgccagtactgccgtggtcatcgccggcaggagcctcaaccctaaccgggtcacattcaaggcaaatcgtcctttcctggtattcatccgggaggtaccgctgaacactatcatttttatgggcagagtggcgaatccatgcgtgaag

SEQ ID NO: 18857 - DNA, 1392 bp, Artificial Sequence
  Description of Artificial Sequence: Synthetic coding sequence
atgtactcgaatgtgatcggaactgtcacttccggtaagcgtaaggtgtatctgctcagtctccttctcattggtttttgggattgtgtgacttgtcatggcagcccagtggatatttgcactgcgaagccgagagacatccctatgaacccaatgtgtatctaccggtcacctgaaaagaaagctaccgaagatgaaggatctgaacaaaagattcctgaagcaacgaaccgacgagtgtgggagctgagcaaggcaaactccagattcgcaaccactttttaccaacatcttgcagactcgaagaatgataacgataacatatttctgtcgcccctttcgatcagcactgctttcgcaatgactaagttgggtgcatgcaatgataccttgcagcaacttatggaagtgtttaagtttgacactatatcggagaaaacttcggaccagattcatttcttctttgcaaaactgaattgcagactgtaccgaaaggcaaataagtcctcgaaactggtttcggcaaacagattgtttggtgataaatccctgacctttaacgaaacctaccaggatatatccgaattggtgtacggagcgaagctgcagcctctggacttcaaagaaaatgcagagcagtcgcgcgcagctattaacaagtgggtgtccaataagaccgaaggacggattaccgatgtgatcccgtctgaggcaatcaacgaactgaccgtccttgttctcgtgaacaccatctactttaagggcctttggaaaagcaagtttagccctgaaaacacgaggaaagagcttttctacaaggccgatggagaatcatgttcagcatcgatgatgtaccaagaaggcaaatttcgatatcgacgagtggctgagggaacgcaagtgcttgaactcccatttaagggagacgatatcaccatggtcctcatcctgcctaaacctgaaaaatcgctcgcaaaggtggaaaaggagcttactccagaagtgcttcaagagtggctggatgagctggaggagatgatgcttgtggtgcacatgccacgatttcgtattgaggacggtttttccctgaaggaacagctccaggatatggggctcgtggatctcttctcacccgaaaagtccaaactgccaggaatcgtcgcagaagggagggatgacctgtacgtttccgatgccttccacaaggcatttcttgaagtgaatgaagagggttcggaagcggcagcaagcacggcagtcgtgatcgcaggacgtagcttgaacccgaacagagtaaccttcaaagcaaaccgcccctttcttgtctttatccgggaagtcccactcaacactatcattttcatgggtcgagtggccaacccctgcgtgaaa

SEQ ID NO: 18858 - DNA, 1392 bp, Artificial Sequence
  Description of Artificial Sequence: Synthetic coding sequence
atgtacagtaatgtgatcggaacagtcacatctgggaagcgaaaggtatacctgttgagcttattattgatcggtttttgggactgcgtcacttgccatgggtctccggtcgatatttgcacagccaagccgagggatatacctatgaacccaatgtgcatttatcgctccccagaaaagaaagccactgaggatgaaggatcagagcagaagatccctgaagccaccaatcgacgggtctgggaactgtctaaagcaaactccagattcgctactactttttaccagcacctcgcggattccaagaacgataacgataatatcttcctctcgccactcagtatcagtacagcctttgccatgacaaagctgggggcctgcaatgacacgttgcagcaactcatggaggtcttcaaattcgatacaatcagcgagaagacctcggatcaaattcacttttttttcgccaagctgaactgcagattgtaccggaaggcgaacaaatcctcgaagcttgttagtgctaatcgactctttggcgataaatcccttacgttcaatgaaacgtaccaggacataagcgagctggtgtacggtgctaagctgcaacctctcgactttaaagagaacgcagagcaatctagagcagccatcaacaagtgggtttcgaacaagacagagggtcgaattacagatgtcattcccagcgaagcaattaatgaactcaccgtgcttgtgttggttaataccatctattttaagggtttatggaaatccaagttcagcccagagaacaccagaaaagaattattctataaagccgatggagagagttgctccgcatctatgatgtaccaagaaggtaagttcagatatcgcagggttgccgaaggcacacaggtccttgagttaccttttaaaggtgatgacatcacgatggttcttatcctcccaaagccggagaagtccctcgcaaaggttgagaaggagctaacgccggaagtgctacaagagtggctagacgagttagaggaaatgatgcttgtggttcatatgcctaggttcaggattgaagacggtttttcgcttaaggagcagctccaggacatgggccttgtggatcttttctctcctgaaaagtcaaaattgccaggtatcgtcgcggaagggcgcgacgacctttacgtctccgatgcattccataaggctttccttgaagtaaatgaggaaggaagtgaggccgctgcttccaccgccgtggttatagccggtcgtagtctgaatcccaaccgagtcacattcaaggcgaatcgacctttcttggtcttcattcgggaagtcccactgaataccattatcttcatgggacgtgtggcaaatccatgtgtgaag

SEQ ID NO: 18859 - DNA, 1392 bp, Artificial Sequence
  Description of Artificial Sequence: Synthetic coding sequence
atgtactccaacgtgatcgggacggtgacctccggaaagcgaaaggtgtacctgttgtcgctgcttctgattggattctgggactgcgtcacctgtcacggaagcccggtggacatctgcactgcaaagccccgcgacataccgatgaatcccatgtgcatctaccgctctccagagaagaaagctaccgaggatgagggatcggaacagaagatcccggaggcgactaaccgacgggtctgggaactttcaaaggcaaactccagatttgccactactttctaccaacatctggcggattcaaagaatgacaacgataacattttcctgagcccgctgagcatctccaccgctttcgctatgaccaagctgggtgcttgcaacgatactctgcaacagttgatggaagtgttcaagtttgataccatctccgaaaagacctcggaccagatccacttcttcttcgccaagctgaactgccgcttgtaccggaaagcaaacaaatcatccaaactcgtgtccgccaatcggctgttcggggataagtctctcacgtttaacgagacttatcaggacatctcggaactcgtgtacggcgccaagttgcagccactggacttcaaggaaaacgcggaacagtcgcgggcggccatcaacaagtgggtttccaacaaaactgagggtcgaatcactgatgtcatcccgtcggaagccattaatgaactgaccgtgctcgtgctggtcaataccatctacttcaagggcctgtggaagagcaaattctcaccagagaatactcgcaaagagctgttctacaaggccgacggagagtcatgctcggcgtcgatgatgtaccaggagggaaagtttcggtatcgccgcgtcgcggagggcactcaggtgctcgaacttcccttcaaaggcgatgacatcactatggtgctcatccttcctaaaccggagaagtctttggcgaaagtcgagaaggaattgacccccgaggtccttcaggaatggctggatgagctcgaagaaatgatgctcgtggtccacatgccacgcttccggattgaggacgggttttccctcaaggaacagctccaagacatgggtcttgtggatctgttttcgccggaaaagagcaagctgccgggaatcgttgcagaaggacgcgacgacctgtacgtgtcggacgcatttcataaggccttcctggaagtcaacgaagaaggcagcgaagcggcggcatcgactgccgtggtcattgcgggacgctcgctgaacccgaatcgcgtgaccttcaaggccaacagaccttttcttgtgttcatccgggaagtgcctctgaacaccatcatctttatggggagagtcgccaacccatgcgtgaag

SEQ ID NO: 18860 - DNA, 1392 bp, Artificial Sequence
  Description of Artificial Sequence: Synthetic coding sequence
atgtactctaatgtaatcggcaccgtgacctccggaaaacgcaaggtttatctgctcagcttactgctgattggtttttgggactgcgttacgtgtcacgggtcccccgtggatatctgcactgcaaagcctcgagacatccccatgaaccccatgtgcatatatcgaagtcctgaaaaaaaggcaaccgaggacgaggggagcgagcaaaagatcccggaggcaacaaaccgtagagtgtgggaactttctaaggcgaatagtcgatttgccacaacattctaccagcacctggctgacagtaagaatgataacgacaacatattcctgtcaccgctcagcatctccacagcatttgccatgacaaagctaggagcttgcaacgataccttgcagcaactaatggaggttttcaagttcgacaccataagtgaaaaaacgtccgatcaaatacactttttctttgccaagctgaattgccggctttacaggaaagctaacaaaagctcaaagctcgtctccgctaaccggttgttcggcgacaagagtttaaccttcaacgagacctaccaggacatttcggaattggtgtacggggccaagttgcaacctctcgatttcaaggagaatgccgaacagagtcgggccgccatcaacaagtgggtatcgaataagacggaaggtcgaatcaccgatgttattccctcagaggccattaacgagctcaccgtgctagtattggtgaacactatctacttcaaaggcctttggaagagcaaattctcaccggaaaacacgagaaaggagctcttctacaaggccgatggagagtcttgctctgcttcgatgatgtatcaggagggcaaattccgctatcgtagggttgccgagggaacccaagtcctggaacttccttttaagggcgacgacatcacgatggtcttaatcctgcctaagcctgaaaagtcactggctaaagtggaaaaggaacttactcctgaggttctccaggagtggctggacgaacttgaagaaatgatgctcgtcgtgcatatgcctagatttcggattgaagacggtttctcactgaaagaacaactgcaggacatggggcttgtggacttgttctcccccgagaagtcgaagctgcccggcatagtcgctgaggggcgcgacgacctctatgtcagtgatgcctttcacaaagcctttctggaagttaacgaggaggggagcgaggccgccgcctcaactgcagtcgtgatcgcaggcaggtccttaaacccaaaccgggttacgtttaaagccaacagaccttttctggtcttcattcgggaggtacccctgaacactataatttttatgggaagggtcgctaacccctgtgtgaaa

SEQ ID NO: 18861 - DNA, 1392 bp, Artificial Sequence
  Description of Artificial Sequence: Synthetic coding sequence
atgtactcgaacgtgataggaaccgtcacgtctggaaagcggaaagtctacctgctgtcactgctgcttatagggttttgggattgtgtcacctgccatggctcacctgtggatatttgtaccgccaagccacgagatattcccatgaatcctatgtgtatctacagatccccggaaaagaaggcaactgaagatgaaggttcggaacagaaaattccagaggcaactaataggagggtctgggagctttccaaagcaaactcgaggtttgcaactaccttctaccaacatcttgcagattcgaaaaacgataatgataacatatttctgtcacctctgtcaatctcgaccgcatttgctatgacgaaacttggtgcctgcaatgacactctgcagcagcttatggaagtctttaagttcgataccatttcggaaaagacctcggatcagattcatttcttttttgcgaagttgaattgcagactttacagaaaggcaaacaagtcctccaaacttgtgtcggcaaacagactgttcggagataagtcattgacctttaacgaaacttaccaggatatttcagaactggtctacggtgcaaaactgcagccacttgactttaaggaaaacgccgagcagtccagagcagcaatcaataagtgggtttctaataagactgaagggcgcattacggacgtgattccgtccgaggctatcaatgagcttaccgtcctggtgctcgtgaataccatctacttcaaggggctctggaagtccaaattctcgcctgaaaacactcgcaaagaactgttttacaaggcagatggtgaaagctgctcagcgtccatgatgtaccaagagggtaagtttcgctacagaagagtggcagagggtacccaagttctggaactgcccttcaagggtgatgatattaccatggtgcttattctgcctaaaccagagaagtcgcttgcaaaggttgaaaaggaacttactccggaagtgctgcaagagtggcttgacgagctcgaagaaatgatgctggtggtgcatatgcctagattcaggatcgaagatggattctcacttaaagagcaactccaggatatgggattggtggatctcttttcccccgaaaagtcaaaactgcccggaatcgtggccgaaggcagagacgatctctacgtctctgatgcatttcataaggcctttctggaggttaacgaagaagggtccgaagcagcggcaagcaccgcggtggtgatagcaggccgctcccttaaccctaacagagtgacttttaaggcaaacagaccatttctcgtgttcattcgtgaagtccccctcaacactatcattttcatgggacgtgtggcaaatccttgtgtgaag

SEQ ID NO: 18862 - DNA, 1392 bp, Artificial Sequence
  Description of Artificial Sequence: Synthetic coding sequence
atgtacagcaatgtgatcggaaccgtgacttccgggaagcggaaggtctacctgctgtccctccttcttatcggtttctgggactgcgtgacttgtcatggctccccggtcgatatctgtaccgccaagccgcgagatatcccaatgaacccgatgtgcatctaccggagcccggaaaagaaggcgaccgaagatgagggctccgaacaaaagatcccagaggctactaatcgcagagtttgggagctcagcaaggctaacagcagatttgccacgaccttctaccagcacctcgccgattccaaaaacgataatgataacatttttctttccccactgtcgatttcgactgccttcgcaatgactaagctgggggcatgcaacgacacgctccagcaactcatggaggtgtttaagttcgacactatttcagaaaaaacttcagaccaaatccactttttctttgcgaaacttaactgcagactgtatcgcaaggccaacaaatcgtccaagctggtgagcgctaatcgcctgttcggagataaatctctgacgttcaatgaaacttaccaggatatctcggagctggtctacggtgcaaaactgcagccgctcgactttaaggaaaatgccgaacaatcgagagcggcgatcaacaaatgggtatcgaataagaccgaggggagaatcactgacgtcatcccaagcgaggcaatcaacgagcttacggttctggtcctcgtcaacaccatttacttcaagggactttggaagtccaagttctccccagagaacactcggaaggagctgttttacaaggccgatggagagagttgctccgcttctatgatgtaccaggagggaaagttccggtaccgccgggtggccgagggaacccaagtgctggaactgccattcaagggagatgacatcaccatggtgttgatcctgccaaagcctgagaagagcctcgccaaagtggagaaggaactgactcccgaagttctgcaagagtggctggatgaattggaggaaatgatgctcgtggtgcacatgccgcggttccgcattgaggacggtttctcattgaaggaacagctccaggacatgggactcgtcgacctcttttcgcctgaaaaatcgaaacttccggggattgtggctgaaggacgcgacgacttgtacgtctcagatgcattccataaggccttcctggaagtgaatgaagaaggcagcgaagctgccgcctcaactgccgtggtgattgctgggcgatcactcaatcccaaccgcgtaaccttcaaggcgaaccgacctttccttgtgttcatcagagaagtgccgctgaacactatcattttcatgggacgcgttgctaacccatgcgtgaaa

SEQ ID NO: 18863 - DNA, 1392 bp, Artificial Sequence
  Description of Artificial Sequence: Synthetic coding sequence
atgtattccaacgtcatcggtaccgtcacaagcggaaagcgaaaagtctatctcctttctctcctgttaatcggattctgggactgtgtgacttgccatggaagtccggttgatatttgcaccgccaagcctagggacatacccatgaatcctatgtgtatttatcggtctccggagaaaaaggctactgaagacgaggggtccgagcagaaaatcccggaggccacaaataggcgggtctgggaactctccaaagccaacagccgattcgctacaaccttttaccaacatctggccgacagcaagaacgataacgacaacatcttcctgagcccattgagcatatccactgccttcgcgatgacaaaactgggggcttgcaacgatactctccagcagctcatggaggtctttaagttcgataccattagtgaaaagacctccgatcagatccactttttttttgctaagctgaattgccgactgtacagaaaagcaaacaagtcatcaaaactcgtctctgctaacagactcttcggcgataaaagcctcacttttaacgagacctatcaggatatttctgagctagtttacggggcgaagttacagcctctggacttcaaggagaacgccgaacagagtagagccgccattaataaatgggtgtcaaataaaacagaaggacggattactgacgtgataccaagcgaagccataaacgagctgaccgttctagtcctggttaacactatctattttaaaggactgtggaagtcaaagttctccccagaaaatacacgaaaagagctcttttacaaagccgatggagaatcctgcagtgcctccatgatgtatcaggagggaaagttcagatatcgcagagtggccgagggaacccaggtacttgaactgcctttcaaaggagacgatattaccatggtgttgatattgccaaagcctgagaaatctctggccaaagtggagaaagagctcacacccgaagtgcttcaagaatggctggatgaattagaagagatgatgctggttgttcacatgcctagattccggatcgaggacggcttctcccttaaagagcagctgcaggatatggggctcgttgatctcttctccccggaaaaaagcaaactgcctggtatagtcgctgagggtcgtgatgacttatatgtgtcggatgccttccacaaggctttcttggaggtgaatgaggagggatccgaagctgccgcctccactgccgtggtaattgccggtaggagcttgaacccaaatagagtgaccttcaaagccaataggccctttctcgtcttcatcagagaggtaccgctgaacactatcatttttatgggaagagtggccaacccatgtgttaaa

SEQ ID NO: 18864 - DNA, 1392 bp, Artificial Sequence
  Description of Artificial Sequence: Synthetic coding sequence
atgtactccaacgtcatcggaaccgttacctccggtaagcgcaaagtgtaccttctgtcgctgctgctgatcgggttctgggactgcgtgacgtgccatggaagcccggtggatatctgtactgcgaagccgcgagacattccgatgaacccgatgtgcatctatcggtcgcctgaaaagaaagctaccgaggacgaggggagcgagcaaaagatcccagaagctactaatagaagggtgtgggagttgagcaaggccaattcaagattcgctactacgttctaccagcacctggccgattcaaagaacgacaatgataacatctttctctctcctttgtcgatctcgactgccttcgcaatgacgaagctcggagcttgcaatgacacccttcagcagctcatggaggtattcaagttcgataccatctcggagaaaacttccgaccagattcacttcttcttcgcgaaactgaattgtagactgtaccgtaaagcgaacaagtcctctaagctcgtgtcagcaaaccgcttgtttggcgacaagtcgctcacctttaacgaaacctaccaggatattagcgaactggtgtacggcgccaaacttcaaccgctcgatttcaaggaaaacgcggagcagtcccgggctgccatcaataagtgggtttctaataagactgagggacggatcactgacgtgatcccgtccgaagccatcaacgaattgactgtcctcgtgctggtgaataccatctatttcaagggcctgtggaaatcgaaattctccccagaaaacactagaaaggagctcttttacaaggctgatggcgaatcatgtagcgcatcgatgatgtaccaagaaggcaagtttcgctaccggagagtggccgaaggaacccaagtccttgagcttccattcaaaggtgacgatattacgatggtgctgatcctcccaaagccggagaagtcgctggccaaggtcgaaaaggaactcactccggaagtgcttcaggaatggctggacgaactcgaggaaatgatgctcgtggtccacatgccgcgcttccggatcgaggacggattttctctcaaagagcaactccaggacatgggattggtcgatctgttcagcccggagaagtcaaagttgccaggaatcgtggccgagggcagagacgacctgtacgtgagcgatgcgttccataaggcgttcctggaagtgaacgaggagggatcggaagctgctgcatcaactgctgtggttatcgccggacgctccctcaatccaaaccgggtcaccttcaaggcaaacagacctttcctcgtgttcatccgcgaagtaccgctcaataccatcatattcatgggacgggttgcaaacccatgcgtcaaa

SEQ ID NO: 18865 - DNA, 1392 bp, Artificial Sequence
  Description of Artificial Sequence: Synthetic coding sequence
atgtatagcaatgtgataggcactgtaacttctggcaagagaaaagtgtacttactatctctgctgcttatcgggttttgggattgtgtcacttgccatggctccccagtggatatatgtacagccaaacctcgcgatatacctatgaacccaatgtgcatttaccgtagccccgagaaaaaggctaccgaggatgaaggatctgaacaaaagatccctgaggccactaaccgacgggtgtgggagctgagcaaggctaattcccgttttgccactaccttctaccagcacttagccgactctaaaaacgataacgacaatatttttctgagtcctctgtccatctctaccgcctttgctatgaccaagctgggagcctgcaatgacactcttcaacaactgatggaggtgtttaagtttgacaccataagcgaaaagacttcagatcagattcatttctttttcgctaagttaaactgcaggttatacagaaaagcaaacaagagcagtaagctcgtatccgccaatcgcctatttggcgacaagtcattaacatttaacgagacataccaagatataagcgagctggtgtacggcgctaaactacagcccttagacttcaaggaaaacgccgagcagtctcgggctgctattaacaaatgggtttcaaacaaaaccgagggcagaataaccgatgtgataccaagcgaagctatcaatgagctgaccgtgctagttctggtgaacacaatttattttaagggactgtggaagtctaaattctcaccagaaaatacaaggaaagagctattttacaaggctgatggcgagagttgctccgcttctatgatgtaccaagaaggcaagttcaggtaccgacgagttgccgaaggcacacaggtgctggagttaccctttaaaggcgatgacatcactatggttctaatattacccaagccagagaaatctctcgctaaagtggaaaaagaattgactccagaggtgctccaggagtggctggacgagttagaagagatgatgctcgtggttcacatgccacgcttcaggatagaggacggattttctctgaaggaacagctgcaggatatgggcctcgttgacctgtttagtcccgagaaatcaaaactgccaggtattgtggctgaaggccgggatgacctctatgtctctgatgccttccataaggctttcctggaggtgaacgaggagggatccgaggctgccgctagtacagccgtggttatagcaggccggagcctgaaccccaatcgtgttacctttaaggccaacagacctttcttggtgttcatacgcgaggtgcctcttaacaccattatctttatgggccgtgtagctaatccctgtgttaag

SEQ ID NO: 18866 - DNA, 1392 bp, Artificial Sequence
  Description of Artificial Sequence: Synthetic coding sequence
atgtatagcaacgtgattggtacagtgacctctgggaagcgcaaagtgtacctgctgtccctgctgctgatcggcttttgggactgcgtgacctgccacggatcacctgtcgacatctgtacagcaaagcccagggacatccctatgaacccgatgtgcatttatcgcagtcccgaaaaaaaggctaccgaagatgaaggcagcgaacaaaagattcccgaggccaccaaccgcagagtgtgggaactctcaaaggccaattccaggttcgcgacaaccttttaccagcatctggctgactccaagaacgacaacgacaacatcttcctctccccattgtctataagtacagcgtttgccatgaccaagctcggggcctgcaatgacactctacagcaactcatggaagtctttaagtttgataccatcagcgagaaaaccagcgaccagatccacttttttttcgcaaaactcaattgtagactttaccgcaaggccaacaaatcaagcaaattagtatcggcaaatcgactgtttggagataagtcgttgacgttcaacgaaacgtaccaggatatttccgaactggtttatggggccaaactgcagccacttgacttcaaggaaaacgccgaacaaagccgagccgctatcaataaatgggtgagtaacaaaaccgagggcagaatcaccgatgtcattccatcagaggctattaatgaactgaccgtgttagtgttggtaaacacgatctactttaagggtttgtggaagtctaagttctcgcctgagaacacacgcaaggagttgttttacaaggctgacggcgaatcctgtagtgcgtctatgatgtaccaggaggggaagtttaggtatagacgggtggccgagggcacgcaggttttggaactccctttcaagggcgacgacatcacaatggtcctcatcttgcccaaacctgaaaagtccctggccaaggtggaaaaagaactcactcccgaggtcctgcaggaatggctggacgaattggaggagatgatgcttgtcgtgcacatgcctcggttcaggatagaggatgggtttagcctgaaagaacagctgcaggacatgggactggtcgacctgttctctcccgagaaatccaaactgccagggattgtggccgaaggacgcgacgacctctacgtctccgatgcctttcataaggccttcctggaggtgaacgaagaaggctcagaagctgccgcatccacagctgtggttatcgccggccgttccctgaatccaaaccgggttaccttcaaagccaaccgcccctttctggtttttattcgggaagttcccctgaacactatcattttcatgggtcgggtggccaatccctgtgttaaa

SEQ ID NO: 18867 - DNA, 1392 bp, Artificial Sequence
  Description of Artificial Sequence: Synthetic coding sequence
atgtatagcaacgtgattggaaccgtaacttctggaaaacggaaggtgtacttgttgtcactcctgctcattggattctgggactgtgtgacttgtcatggcagtccagtggacatctgtactgcgaaacctagggacatccctatgaatcctatgtgcatctatagatctccagagaaaaaggcgacagaggacgagggatccgagcagaaaattcccgaagccactaaccgcagggtgtgggaacttagcaaagctaacagtaggtttgcgactactttttaccagcacctggccgacagtaagaacgataacgacaatatctttctttcccccctttctatatcaaccgcattcgctatgacaaagctgggggcctgtaatgatacgctgcagcagctcatggaggtcttcaaattcgataccatttccgagaaaacctctgatcagattcacttctttttcgccaagttgaactgccggctgtacagaaaagctaacaaatcctccaagctggtctccgcgaaccgccttttcggcgacaaaagtctgacattcaacgaaacctatcaggatatttcagaactggtgtatggggctaagctgcaacctctggactttaaagaaaacgctgaacagtcacgggccgcaatcaacaagtgggtgtccaataaaaccgaagggcgcataaccgacgttatcccaagcgaagcaattaatgagttgaccgttcttgtgctggttaacacaatttacttcaagggattgtggaaatctaaattctccccggaaaacaccagaaaagagttgttctacaaagccgatggggagtcctgttctgcatccatgatgtaccaggaaggtaaatttagatatagaagagtagcggagggcacgcaggtgctcgaactgccattcaagggcgatgacattacaatggtcttgatcctgcctaaacccgagaaaagcctagccaaggtcgagaaagagcttacaccggaggtgctgcaggagtggctcgacgagctagaggaaatgatgctagtcgtgcatatgccacggtttcgaatagaagatggttttagcctgaaggagcaactgcaggatatggggctggtagacctgtttagccccgagaaatcaaaactgcctggaattgtggccgagggccgggacgatctgtacgtctccgatgcttttcacaaggcttttttagaggtaaacgaggaaggcagcgaggccgcagcctcgactgcagttgtcatagctgggcgaagcctcaatcccaatagagtgacattcaaagcgaacagacccttcttggtctttattcgcgaggtgcccctgaatacaatcatattcatgggccgtgtggccaacccctgtgtcaaa

SEQ ID NO: 18868 - DNA, 1392 bp, Artificial Sequence
  Description of Artificial Sequence: Synthetic coding sequence
atgtacagcaatgtcatcggcacggtaacttctggcaagcggaaggtgtacctgctgtcactgttgctgataggattttgggactgtgtcacctgccacggctctccagtggacatatgcaccgccaaaccaagggatatcccgatgaatccaatgtgtatctaccgctcaccggagaaaaaagctacagaggatgagggcagtgagcaaaagatacccgaagcgacaaaccgaagagtgtgggagctgtctaaagctaacagccgattcgcaactactttttatcagcatctggccgatagcaaaaacgataacgacaacatcttcctgagtcctttgtctatctctaccgcctttgccatgacgaagcttggcgcctgcaacgacacactgcagcagcttatggaagtgttcaagtttgatacgattagcgagaagacgtcagaccagatccacttttttttcgccaaactgaattgccgcttgtaccgcaaggccaacaagtcttctaagcttgtgtctgccaacaggctgttcggtgacaagtctctcacatttaacgagacatatcaggatatttcagagctggtgtatggagccaagctccagcctctggacttcaaggagaatgctgagcagtccagggcagccatcaacaagtgggtaagcaacaaaactgagggcagaattacagatgtgataccctccgaggctattaacgaacttacagtcctggttttggtcaacacaatttactttaagggcctgtggaagtctaagttttcccccgaaaacacacgcaaggagttgttctacaaggctgatggggagtcttgttctgccagcatgatgtatcaggagggaaaattcaggtatcgacgcgttgctgaagggacccaggttctcgagctccctttcaaaggggatgatatcaccatggtgttgatcttgcctaagccagaaaaatccctggcgaaagtggaaaaggagctcacgcctgaggtgcttcaggaatggcttgacgagctggaagaaatgatgctggtcgtgcacatgcctaggtttagaatcgaggatggcttctccctcaaggagcagctgcaggacatggggctcgtagacctgttctctcccgaaaagagcaaactccccggcattgtagctgagggacgcgacgacctttatgtgtccgacgctttccacaaagcttttttggaagtcaatgaagaaggatccgaagccgccgccagtactgccgttgtgattgctggccgctccctgaatcccaaccgagtgacatttaaggcgaatcggccatttctggttttcattagggaggtgccattgaacaccatcattttcatgggtcgggtggccaacccatgcgtgaag

SEQ ID NO: 18869 - DNA, 1392 bp, Artificial Sequence
  Description of Artificial Sequence: Synthetic coding sequence
atgtattcaaacgtcatcgggacagtgacaagtggaaaaaggaaagtgtatcttctgtctttgcttctcatcggattctgggattgtgtcacctgccacggttccccagtcgacatctgcaccgcaaaaccgcgcgacatccctatgaacccaatgtgcatctaccgttcccctgagaaaaaggccacagaggatgaggggtcagagcagaagataccagaagccacaaatcgtagagtgtgggagctctcaaaagccaattctaggtttgcgacaacattttatcagcaccttgcagatagcaaaaatgataacgataatatttttctgtcccctttaagcatcagcactgccttcgccatgacgaaactgggtgcctgcaatgacactttgcagcagctgatggaggtatttaaattcgacaccatttctgagaaaactagcgatcagatccactttttcttcgccaagctgaattgtcgtctctaccggaaagctaataagtcctccaagctcgtgtcggccaacaggctctttggtgacaagtccttgacttttaacgagacttatcaggatatatccgagttagtgtacggcgccaaacttcagccactggactttaaggaaaacgcggagcagagtagagcggccataaacaagtgggtgtcaaacaagacggagggcagaatcacagatgtgataccaagtgaggcaataaatgagttaactgtgttggttttagtgaatactatttacttcaaaggcctgtggaagagcaaattctcaccggagaacaccagaaaagagctgttttataaggccgatggtgagagctgcagcgcttcaatgatgtaccaagaaggtaaatttaggtaccgccgcgtggcggaaggaacacaagttctcgagcttcccttcaagggcgatgatatcacaatggtgctcattttgcccaagcctgagaagtcattggctaaggtagaaaaggaactcacccctgaagtgctgcaagagtggctagacgaattagaggagatgatgctggtcgtgcacatgccccgctttaggatcgaggacggcttttctctcaaggaacagctacaggatatgggcctcgtggacctgtttagccccgaaaaatccaagttaccaggcattgtcgccgaggggcgtgatgatctgtacgtgagcgacgcattccataaagccttcctggaagtgaacgaggaagggtcagaggccgccgcctctacggctgtagtcattgctggccggtctctgaacccgaaccgggttaccttcaaagccaatcgtccctttttggtttttatcagagaggtacctctgaacaccattatctttatggggagggtggcaaacccttgtgttaaa

SEQ ID NO: 18870 - DNA, 1392 bp, Artificial Sequence
  Description of Artificial Sequence: Synthetic coding sequence
atgtactcgaacgtcatcggaaccgtgacctcaggaaagagaaaggtatacctgttgtcactcctcctgattggattctgggactgcgtgacctgccatggatcgccggttgacatttgtactgcgaagccgagagacatcccgatgaacccaatgtgcatctaccggtcaccggagaagaaagcaacggaagatgagggatcggagcagaaaatccccgaagccactaatcggagagtgtgggaacttagcaaggctaattcccgcttcgcgactaccttctaccagcacttggcggactcgaagaacgataacgataacatctttctctctccattgtcgatctcaaccgccttcgctatgaccaagctgggagcatgtaacgacactctccaacagcttatggaggtctttaagttcgacaccatctcagaaaagactagcgaccagatccactttttcttcgccaaactgaattgcagactttacagaaaggccaacaagtcgtccaagctggtcagcgcgaacaggctgttcggtgataaatctctgacgtttaatgagacttaccaggacatcagcgaactggtctacggggcaaagctccagcctctcgatttcaaagagaatgcagagcaatcacgggctgccatcaacaaatgggtgtcaaataagaccgaaggtcgcatcactgacgtcatcccgtcagaggccatcaatgagctgaccgtgctggtgctcgttaacactatatactttaaaggactttggaagtctaagttctcgccagaaaacacccggaaggaactgttctataaagcagacggagaatcctgctccgcgtcaatgatgtaccaagaaggcaaattcagatacagaagggttgccgaaggaacccaagtcttggaactgccattcaagggagacgatattactatggtgttgatacttccaaaaccggagaagagcttggccaaggtggagaaagagctcacgcccgaggtcctccaagaatggctcgatgagctggaggagatgatgctggtggtgcatatgcctcgcttcaggattgaggacggcttttccctgaaggaacagcttcaggacatgggattggtggacctgttctcgcccgagaagtcgaagctcccgggcatcgtcgcagaagggagggacgatctctatgtgtcggacgcctttcacaaggcgtttctcgaggtgaacgaagagggatccgaagccgcggcaagtacggctgtcgtgatcgcaggccgctcattgaatccgaatagagtgactttcaaagccaatcggccatttctcgtgttcatcagagaagtgccccttaacaccatcatcttcatgggcagggtcgccaacccctgcgtgaag

SEQ ID NO: 18871 - DNA, 1392 bp, Artificial Sequence
  Description of Artificial Sequence: Synthetic coding sequence
atgtattccaacgtgattggaaccgtgaccagcggtaaacgaaaggtgtatctgctctcacttttgctgattggcttttgggattgtgtgacttgccacgggtcccctgtggatatctgtaccgcaaaaccgcgggacattcctatgaaccctatgtgtatttacagaagccccgaaaagaaagcgaccgaagatgaaggatcagaacagaaaatacccgaagccaccaacagacgtgtctgggaattgtccaaggcaaacagccgatttgcaactaccttctaccaacatcttgctgactcgaagaacgataatgacaacatcttcctttcccccctgtcaatctcaaccgcgttcgcgatgactaagctgggggcatgcaacgacacgcttcaacagctcatggaggtgttcaagttcgacactatctcggaaaagacgagcgaccagatccatttcttttttgctaaacttaactgtagactgtaccggaaagccaacaaaagctccaagttggtgtcggcaaaccggctgttcggcgataagtcgctgacctttaacgagacttaccaggatatttcggaactggtgtacggggccaagctgcaacctcttgatttcaaggaaaatgctgaacaatcccgtgcagccatcaacaagtgggtgagcaacaagactgaaggcagaattaccgacgtcatcccatccgaagctatcaatgagctcaccgtcctggtgctggtgaataccatctactttaagggtctttggaagagcaagtttagcccagaaaataccagaaaggagttgttttacaaggcggatggagaatcgtgttccgcatccatgatgtaccaggagggtaagtttaggtaccgtcgcgtggcagaaggaacccaagtgcttgaactgccgtttaaaggtgacgatattactatggtcttgattcttccaaagcctgaaaaatcactggccaaagtggaaaaggagctcacccccgaagtcctgcaagaatggctggacgagctcgaagaaatgatgttggtggtgcatatgcctaggttccggatcgaggacggattctcactcaaggagcagctgcaggacatgggtctggtcgacttgttttcacctgaaaagtcgaagctgcccggtattgtcgcggaagggagagacgacctgtacgtgtcggatgcatttcataaggcatttctcgaagtcaacgaagaagggtccgaggcagcagcgtccaccgcagtggtcattgcaggtcgttcgcttaaccccaaccgcgtcacgtttaaagcaaaccggcccttcctcgtgtttattcgcgaggtgccgctgaataccataatctttatgggtcgagtggcgaacccttgtgtcaag

SEQ ID NO: 18872 - DNA, 1392 bp, Artificial Sequence
  Description of Artificial Sequence: Synthetic coding sequence
atgtacagcaacgtgattggtaccgtgaccagtggcaagaggaaggtgtatctgctgagccttctcctgattggtttttgggattgtgtgacctgtcacggttcacccgtggatatttgtacggcaaagccacgagacattccaatgaatcccatgtgtatttacagatcgcctgaaaagaaggcaaccgaagatgaaggctccgagcagaaaattccagaagctactaaccgcagagtgtgggagctgtccaaggcaaacagccgatttgccactactttctaccaacatctggcagacagcaagaacgataatgataacatatttctgtcgcccctgtcgatctccactgcattcgcgatgaccaagctgggagcatgtaatgacactcttcaacagcttatggaggttttcaagtttgataccatctctgagaaaacgtcagaccaaattcatttcttctttgcaaaacttaactgtcggctgtaccgtaaggcgaataagtcctctaaactcgtgtcggcaaataggctctttggggacaagtcattgactttcaacgaaacctaccaggacatatcagaacttgtctacggagccaaacttcaaccattggatttcaaggagaacgcagaacagtcccgcgcagcaattaacaaatgggtgtcgaacaaaaccgaaggcagaattactgacgtgattccctcggaggcaattaacgaactgaccgtgcttgtcttggtgaacaccatctactttaaaggtctttggaaatcaaagttttcgcctgaaaacactcgaaaggaacttttctataaggctgacggagaatcctgctctgcaagcatgatgtaccaagaagggaagtttcggtaccggcgagtcgccgaaggtactcaagtcctcgagctgccctttaagggcgatgatattaccatggtgcttatcctgccgaaacctgaaaaaagccttgcaaaagttgagaaggaacttactccagaggttctgcaagaatggcttgacgaattggaggaaatgatgctggtcgttcacatgcctcgttttaggatcgaagatgggttctccctgaaggagcagcttcaagatatgggtctggtggacctcttttcaccagagaagagcaaacttcctggtatcgtggcggagggcagagatgacctgtacgtgagcgatgcgtttcataaggcatttttggaagtgaatgaagaaggtagcgaagcagcggcatccaccgctgttgtgattgcaggacgttctctgaacccaaatcgggtgacgtttaaagcgaacagaccctttcttgtgttcatccgcgaagtgccattgaataccattatcttcatgggcagggtggctaatccctgcgttaag

SEQ ID NO: 18873 - DNA, 1392 bp, Artificial Sequence
  Description of Artificial Sequence: Synthetic coding sequence
atgtacagcaacgtgatcggaaccgtcacctcgggaaagaggaaggtgtacctgctgtcactgttgctcatcggcttctgggactgcgtgacttgtcatggctcgccggtggacatctgtactgcaaagccgcgcgatatcccgatgaaccccatgtgcatctacaggtcaccggaaaagaaagcgaccgaggacgaggggtcagagcaaaagatccctgaggcgaccaatcgccgggtgtgggaactgtctaaggcgaactcccggtttgccaccaccttctatcagcacctggcggactctaagaatgataacgacaatatctttctctcccccctctcgatctccactgccttcgccatgactaaacttggcgcgtgcaacgatactctccagcagctcatggaggtgttcaaatttgacaccatctcggagaagacctccgatcagatccacttcttcttcgcaaaactcaactgtcggctgtacagaaaggcaaacaaaagctctaaactcgtcagcgccaaccgcctgtttggggacaaatcgctgactttcaacgagacttaccaggacatctcagaacttgtgtacggagcgaagttgcaacccttggacttcaaagagaatgcagagcagagccgggcagcgatcaataagtgggtttcgaacaaaaccgagggacggatcaccgacgtgatacccagcgaggcaatcaacgaattgactgtgctggtccttgtcaatacgatctacttcaaagggctgtggaaatctaagtttagcccggaaaatactcgcaaggaactcttctacaaggccgacggtgaatcctgctcggcctcgatgatgtaccaggaaggaaagttcagataccgcagagtggcagaaggcactcaggtgctggaactgccttttaaaggagacgacattacgatggtgctgatcctgccgaaaccggagaagagcttggccaaggtggaaaaggagctcacccccgaagtgctgcaagagtggctcgacgaactggaagaaatgatgctcgtggtccacatgccgcgcttccggatcgaagatggtttctccttgaaggagcagctgcaagacatgggtcttgtggacctgttttccccggaaaaaagcaagctgccaggcattgtcgctgagggcagagacgatctttacgtctcagacgctttccataaggcattcctggaagtgaatgaagaaggcagcgaggctgcggcaagcaccgctgtcgtcatcgcgggacggtcgctcaatccaaaccgcgtgaccttcaaagctaacagaccctttctcgtcttcatccgggaagtccctctgaataccatcatcttcatggggcgggttgccaacccgtgcgtgaag

SEQ ID NO: 18874 - DNA, 1392 bp, Artificial Sequence
  Description of Artificial Sequence: Synthetic coding sequence
atgtactctaacgtgatcggcaccgtgacatctgggaaacgcaaagtctatcttttgtctctgctgctgatcggcttctgggattgcgttacctgtcacggttcccccgtcgatatctgtacagctaagccccgcgatattcccatgaatcccatgtgtatctacaggtcacccgaaaagaaggcaacagaggacgagggatcagaacagaagatccccgaagccacaaatcgccgggtgtgggagctcagcaaggccaactcgcgatttgcgaccacgttttaccagcacctcgcggactccaagaacgacaacgacaacattttcctgtctccgttatccatcagtacggcctttgcaatgacgaaactcggggcgtgcaacgatactttgcagcagctgatggaagtatttaaattcgacacaatttctgagaaaaccagtgatcagatccatttctttttcgcaaagctgaactgtcggctgtaccggaaagcgaataagtcgtctaagcttgtgtcagcaaacaggctgttcggggataaaagcctgacattcaatgaaacataccaggacatcagcgagcttgtgtatggagccaaactgcagccactggacttcaaggagaacgcagagcagagcagggccgcgatcaacaaatgggtgtccaacaaaactgagggacggatcactgatgtaatcccttctgaagcaatcaacgagttgacagttctggtcctcgtcaatacaatctattttaaaggtctttggaagtccaaattctcccctgaaaacacccggaaagagttattctacaaggcagatggtgaaagctgttctgcctctatgatgtaccaggaaggcaagttccggtatagacgggtcgcggagggaacacaggtgttggaacttcctttcaagggtgacgatattaccatggtcctgattttgcccaagccggagaagagtctcgctaaggtggaaaaggagctgaccccggaagttctgcaagagtggctcgacgaactggaggaaatgatgctcgtggttcacatgcctcgattccgtatagaggacggattttcccttaaggagcagttgcaggacatggggttggtggacttattctcccccgagaagtctaagctccctggaatcgtcgcggaggggcgggacgacctgtacgtgtccgacgcctttcacaaagcctttctcgaagttaacgaagagggaagtgaggcagctgcttccacggcagttgtcatcgccggaaggtcactgaatcctaatcgggttacatttaaggctaaccggccgttcttggtctttattcgggaggtaccgctgaacacaattatctttatgggcagggttgcgaatccatgtgtgaag

SEQ ID NO: 18875 - DNA, 1392 bp, Artificial Sequence
  Description of Artificial Sequence: Synthetic coding sequence
atgtactctaatgtgatcggcacggttacctcaggaaagcgaaaagtgtatctactgagcctattgctcataggtttttgggattgtgtgacttgtcacggatctcctgtggatatatgtactgcaaagcccagagacatccctatgaaccctatgtgcatttatcgtagtcctgagaagaaagcaacggaagatgaagggagtgaacagaaaatccccgaagccaccaaccggcgggtttgggaactgtctaaagctaatagtcgttttgcgaccactttttatcaacatctggcagactctaaaaacgataatgataacatcttcttgtcacccttgagcatctcaactgcctttgctatgaccaaactgggcgcatgcaacgataccttgcagcaactgatggaggtgttcaagtttgacactatctcggagaagacatctgatcaaattcacttctttttcgccaaactgaattgcaggctttatagaaaagccaacaaatctagtaagcttgtgtccgcaaaccgcttgttcggggacaagagtctcacatttaatgaaacttaccaagatatttcagagttagtctatggagcaaagctgcagccgttagatttcaaggaaaatgctgagcagagccgggcagcaatcaataagtgggtgtccaataaaaccgaaggacggattaccgacgtgatcccttcagaggccataaacgagctgacggttttggtccttgtcaataccatttacttcaaggggctctggaaaagtaaattctcccctgaaaacaccagaaaagagctattctacaaagccgacggtgaaagttgctcagccagtatgatgtaccaggaaggcaagtttcggtacagaagggtggcagaaggaacacaggttctggaactgcctttcaagggagatgacattacgatggtactgatcctcccgaaaccggaaaaatctttggcaaaggttgaaaaagaattgacgcctgaagtgttacaggaatggcttgatgaacttgaggagatgatgctggtagtacacatgcctcgatttcgcatcgaggacggtttctctctgaaagaacaactgcaggatatggggttggtggaccttttctcgccagagaagagcaaactgcctggtatcgttgcagaaggtagagacgatctgtacgtgagcgacgctttccacaaggctttcctagaagtcaatgaggaggggtcagaggcagcagcatctacagccgtcgtcatcgctggtaggagcctgaatcctaatcgagtcacgttcaaggcaaaccgtccatttctcgtgttcatccgcgaggtccccctgaatacgatcatattcatggggcgcgtagccaacccttgcgtaaag

SEQ ID NO: 18876 - DNA, 1392 bp, Artificial Sequence
  Description of Artificial Sequence: Synthetic coding sequence
atgtatagcaacgtgatcgggacggtgacctcaggaaagcgaaaggtgtacctcctttccctgctactaattggtttttgggactgcgtaacgtgtcacggctcacccgtcgatatctgtaccgctaagccacgcgatattccaatgaaccccatgtgtatctaccggagcccagaaaagaaagctaccgaagatgagggctctgagcagaagatccccgaagcaaccaatagaagggtatgggaactgtccaaggctaatagtcgcttcgccacaaccttttaccagcacttagccgattccaagaacgataatgacaacatcttcctatcacctctgagtatttcaaccgcgtttgcgatgacaaagttgggagcttgtaacgataccttacagcaactgatggaggtgttcaagtttgacacaatttctgagaaaacttcggatcagatccattttttcttcgctaagcttaattgtcgtctgtataggaaagcgaataaaagttcaaaactggtctcagccaatagactgtttggtgacaagtcgctaacattcaacgagacatatcaggatatctccgagcttgtgtacggcgccaagctacagccactcgacttcaaggagaacgcagagcagagtcgggctgccatcaacaagtgggtgtctaataagaccgaggggaggattacagacgtcatacccagtgaggccattaatgagctgactgtgttggttctcgtgaatacgatatacttcaagggactttggaagtccaagttttctcccgaaaatacgcggaaggaactattttacaaggctgacggtgagagctgtagtgcatcgatgatgtaccaggagggtaagtttaggtaccgcagagtggctgaaggcactcaagtgttagagctaccttttaagggagacgacatcaccatggtcttgatactgcccaagccagagaagagcctcgctaaggtggagaaagagctgactcccgaggtgcttcaggagtggcttgatgaattggaagaaatgatgctggtggttcatatgccaagattccgcatcgaagatggcttttccctgaaagaacagctgcaggatatggggctggtggaccttttcagccccgaaaaatccaagcttcccggaattgtcgcagagggccgcgacgacctgtacgtgtctgacgcattccataaggcctttctggaggtgaatgaagaaggctcagaggccgcggcatccacggccgtggtcatcgcggggcgatccctcaacccgaacagggtaaccttcaaggctaaccgaccctttctggtgttcatccgggaagtgcccctcaataccattatttttatgggtagagtggcaaacccatgtgtcaaa

SEQ ID NO: 18877 - DNA, 1392 bp, Artificial Sequence
  Description of Artificial Sequence: Synthetic coding sequence
atgtattctaacgtcattggcaccgtgacctcaggcaagcgcaaagtgtatctgctcagtttactgttaattggattctgggactgcgtaacttgtcatggatcccccgtggacatttgcactgccaagccgagggacattcccatgaacccaatgtgcatatacagatcccccgaaaagaaagcgacagaggatgagggatctgagcagaaaattcccgaagctacaaaccgtcgagtctgggagttgagcaaggctaactctaggttcgctacaacattctatcagcacctggcggattccaaaaacgacaatgataacatatttcttagcccgctcagcatcagcacggctttcgccatgactaagctgggagcctgtaatgatacacttcagcagttgatggaggtctttaagtttgataccatctcagaaaagacatccgatcagatccatttcttttttgccaagctgaattgtaggttatatcggaaagcaaacaagtcgtcaaagctggtgtccgcaaacaggctgttcggtgacaaatcacttactttcaacgagacatatcaggatatctcagagttagtgtatggagctaagctccagccactggactttaaagaaaatgccgagcaaagccgggctgccattaacaaatgggtctctaataagaccgagggcaggatcactgatgtaatcccttccgaggccattaacgagttgaccgtgctggtgttggtcaataccatttatttcaaaggactgtggaagagtaagtttagccccgagaacacccgcaaggaactgttttataaggcagatggtgagagttgctccgcgtccatgatgtatcaggagggcaaatttcggtataggcgcgtcgcggaaggaacccaggtgctggagttgccattcaaaggcgatgacatcacaatggtgctgattctgcctaaacctgagaagtcgctggcgaaagtagagaaggaattgactcctgaggttctgcaggagtggcttgacgagctcgaggaaatgatgctcgtcgtccacatgccacgcttccgcattgaggatggatttagcctgaaagagcagctgcaagacatggggcttgtggaccttttctctcctgaaaaatccaaacttccagggatagtcgcagaagggagggatgatctttatgtgtctgacgcctttcataaagcatttttggaggtgaatgaagagggctctgaggccgccgcctccacggcagtcgtgatagcgggtcgatccctgaatcccaaccgggtgacttttaaggctaaccgtccctttctggtattcattagagaggtgccattgaatacaatcatattcatgggtagagtagccaacccttgtgtcaag

SEQ ID NO: 18878 - DNA, 1392 bp, Artificial Sequence
  Description of Artificial Sequence: Synthetic coding sequence
atgtattcaaacgtcatagggactgttacaagtgggaaacgcaaggtctacctcctgagtttactgctgatcggattttgggattgtgtaacatgtcatggatcacccgtggatatctgcactgctaaaccaagggatatacccatgaacccaatgtgtatttatcggagtcccgaaaaaaaggctacagaagatgagggatcagaacagaaaatacccgaagcaacgaatcggcgcgtgtgggagctttctaaagctaatagtaggttcgctactactttctatcagcacctagccgactctaaaaatgataatgataatatcttcctttcgcccttatccatctctacagcatttgcaatgactaaactcggggcttgcaatgacactcttcagcagctcatggaggtttttaaattcgatacaataagtgagaaaacttctgaccagatacatttctttttcgcgaaattgaattgtcggttatataggaaagctaacaagtcttccaaactagtttccgctaaccgactatttggagacaagtcactcacttttaatgaaacataccaggatatctccgaactagtgtatggggcaaagctacagcccctagatttcaaagaaaatgctgaacagtcccgtgctgctataaacaaatgggtgtcaaataaaactgaagggagaattactgatgttattccttctgaggcaataaacgagctaactgttttagtgctcgtaaatactatctacttcaaagggctctggaaatcaaagttttctcccgaaaatactagaaaggaactattctacaaggcagatggagaatcgtgttccgcttccatgatgtatcaggaaggaaaatttcgatatcggcgcgtagccgagggaacacaggtccttgagctccctttcaagggagatgatatcacaatggtgctcatcctgccaaaacccgagaaaagtctggctaaagtggaaaaagagctaacacctgaagtgctacaagagtggcttgatgaactggaagaaatgatgctggtcgtacacatgccccggttcaggatcgaagacgggttttcactgaaagaacagctccaggacatggggttagttgatctgttctcacctgagaaatctaaactgccaggaatagtggccgagggaagagatgatctctacgtgtctgatgcctttcataaggcttttttggaagtaaacgaagaagggtctgaagccgctgcttccactgcagtggtaatagccgggcggtccctcaacccaaatcgagtaacgtttaaagccaaccgaccctttctggtgtttatcagagaagtaccactaaacacaataatatttatgggaagggtagcaaacccctgtgtaaaa

SEQ ID NO: 18879 - DNA, 1392 bp, Artificial Sequence
  Description of Artificial Sequence: Synthetic coding sequence
atgtactcaaacgtcattggaactgtcacctcgggcaagagaaaagtttacctcctgagcctgctgctgatcggtttttgggactgcgtgacctgtcatggttcgccagtcgatatctgtacggcaaaacctcgagatattcctatgaacccaatgtgcatttaccggtccccagaaaagaaggcaaccgaagatgaaggctcggagcagaagatccctgaagcaactaaccgaagggtgtgggaactttcaaaagcaaattcccgcttcgccaccaccttctaccaacaccttgcggactccaagaatgacaacgacaacatcttcctgtcgcccctgtcgatttcaaccgcttttgccatgaccaagttgggtgcatgtaacgacaccttgcaacagctgatggaagtgtttaagttcgatacgatctccgaaaaaactagcgatcagatacatttcttttttgcaaaattgaattgtaggctttacagaaaggcaaataagtcgtcgaagctggtcagcgccaacagactgtttggagataaatccctgaccttcaacgaaacgtatcaggatatatctgaactcgtgtacggcgctaaactgcaacctctggatttcaaggaaaacgctgaacaaagccgggctgccattaacaagtgggtgagcaataagaccgaggggcgtattaccgacgtgattccctccgaagcgataaatgagctgaccgtcctcgtccttgttaacacgatctactttaaaggcctctggaagagcaaattctcaccggaaaatactagaaaagaattgttttacaaggcagacggagagtcctgtagcgcttccatgatgtatcaagaaggaaagttcaggtaccggcgggtggccgagggaacccaagtcctggagctccctttcaagggagacgatatcactatggtgctgatcctccccaagcccgaaaaatccctcgcaaaagtggagaaggaacttactcccgaagtgctgcaagagtggttggacgaacttgaagagatgatgctggtcgtccatatgcctcgctttagaatcgaggacggattctcgctgaaggagcagctgcaggatatgggattggtggacctttttagcccagagaagtcgaagctgccgggcattgtggcagagggacgggacgatctctacgtgagcgatgcgtttcataaggcgtttctggaggtgaacgaggagggatccgaagcagccgcatcaactgcagtcgtcatcgcaggtcgcagccttaatccaaaccgggtcaccttcaaagcaaaccgcccatttctggtgtttatccgggaagtcccacttaacactatcatctttatggggagagttgcaaacccttgtgtcaag

SEQ ID NO: 18880 - DNA, 1392 bp, Artificial Sequence
  Description of Artificial Sequence: Synthetic coding sequence
atgtatagtaatgtgattgggacagtgacttctgggaaaagaaaagtgtatcttcttagtctgctcctcatagggttctgggactgtgttacatgccatgggtctccagtcgatatctgtacagccaagccaagggatatccctatgaaccccatgtgtatatatcgatctcccgagaagaaagccacagaagatgaaggatctgaacagaaaatccccgaagcaactaacaggcgggtttgggaactgtctaaagctaactcgagatttgctactacattctaccagcatttagcggattctaaaaatgataacgataacatcttcctatctcccctgtctatttcgacagcctttgctatgacaaaattgggggcctgtaacgatacactgcagcagttgatggaagttttcaaatttgatacaatctcagaaaaaacttctgatcagatccactttttcttcgctaaactcaactgccgcctctaccggaaggcaaacaaatcatctaagctggtcagtgcaaatagactcttcggagataaatccctcactttcaacgaaacataccaggatatatcagaactcgtgtacggggcaaaactccagccactagacttcaaagaaaacgctgagcagtcacgcgccgctataaataaatgggtgtctaacaaaacagaagggagaataacagacgttataccctccgaagcgataaatgaacttacagtgctcgtgcttgtcaatacaatttattttaaaggactctggaaatcaaagttttctcccgaaaacacaaggaaagaactgttttataaagccgacggggaatcttgctcggcgtcaatgatgtatcaggagggaaaattccggtaccggagggtcgctgaagggacacaggttctagagctgccattcaaaggggatgatataactatggtcctgattctccccaaaccagaaaaatcattggccaaggtggaaaaagaacttactcccgaggtgctccaggaatggttagatgaactagaagaaatgatgctagtagtccatatgcctcggtttcggatcgaagatggattctcccttaaagaacagcttcaagatatgggactagtggatctattttccccagaaaaatctaagctacctgggatcgtcgccgaggggagagatgacctttacgtgtccgatgcctttcacaaagcattccttgaagtgaacgaggaagggagtgaagcggctgcaagtactgccgttgttatagccggaagatctctgaatcctaatagggtcactttcaaagctaatcgacctttccttgtattcatcagggaagtgcccttaaacactattatcttcatggggagggtagcgaatccctgcgtcaaa

SEQ ID NO: 18881 - DNA, 1392 bp, Artificial Sequence
  Description of Artificial Sequence: Synthetic coding sequence
atgtattctaacgtcattggaactgttacttcaggcaagcgaaaggtatacctcttgtcgcttctgctaattggattttgggactgtgtgacatgtcatggatccccggtcgatatttgcacagcaaagccgcgggatattccaatgaatcctatgtgtatttaccggtcaccggagaagaaggccactgaggacgagggatcggaacaaaaaattccagaggcaacaaatagacgagtatgggagttgtcaaaagcgaattcccgcttcgctactacattttatcaacacctggcagattccaaaaatgacaatgataatatattcttaagtccattgtccatatcaaccgccttcgctatgaccaagttaggagcatgtaatgatactttgcaacagcttatggaagtgtttaagtttgacactatctcagaaaagacttcggatcaaatccattttttctttgctaaactcaattgccgactctaccggaaggctaacaaatcgagtaaacttgtcagcgcaaaccgattgtttggcgacaaatctctcacatttaacgagacttatcaagatatatcagaacttgtctatggagctaaattgcaaccactcgactttaaagaaaacgccgagcaaagtcgggctgctattaataagtgggtttccaataagactgaaggtagaattacagacgtcattcccagcgaagctataaatgaattgactgtactcgtgttggtcaacactatctacttcaagggactgtggaagtcgaagttcagccctgaaaatacccgtaaggaactcttctataaggctgatggggaatcgtgcagtgcatcaatgatgtatcaagaaggaaaattcagatatcgacgggttgctgaagggacccaagtgttagagctaccattcaaaggagacgatatcactatggttcttatcctgccaaaaccggagaaatcactggctaaagtggagaaggaacttaccccagaagttctgcaagaatggttggatgagctagaagaaatgatgcttgtggtccacatgccaagattccgcattgaagatggattttcgcttaaagaacagctacaagatatgggactggtcgatctattctctccagaaaaatccaaacttcctggaatcgttgctgaaggcagagacgacctatatgtttcagacgcttttcacaaagcattcttggaagtgaacgaggaaggatcggaggcggccgctagcactgccgttgtaattgcaggacgttctctgaacccaaatcgagtaacattcaaggcaaatcgcccttttctcgtctttattcgtgaagtcccattgaacacaataatcttcatggggcgagttgcaaatccttgcgttaaa

SEQ ID NO: 18882 - DNA, 1392 bp, Artificial Sequence
  Description of Artificial Sequence: Synthetic coding sequence
atgtattcaaatgttatcggtaccgtgacgagcggcaagcgaaaagtgtacctgctgagtctgctgctcataggcttctgggattgcgttacatgccacggttcacctgtagacatttgtacagcaaagccaagggatattccaatgaatccaatgtgcatttataggagcccggagaaaaaggccacagaagatgaggggtctgagcagaagatacccgaggctactaataggagggtgtgggaactgtcaaaagcaaatagcagattcgccacaacgttctatcagcatctcgcagactctaagaatgacaacgataacattttcctgagcccgctctccattagcactgcgtttgctatgacaaaactgggcgcctgcaatgatactttgcagcagctcatggaggtgttcaagtttgatacaatcagtgagaagaccagtgatcaaatccacttctttttcgctaagctgaactgccgattgtatcgaaaggctaacaagtccagcaagctcgtgtctgcaaaccgcttgttcggggacaagagcctgacattcaatgagacctatcaggacatcagcgaactggtgtacggcgcaaagcttcagcccctggatttcaaggagaacgccgagcagtcacgcgctgctataaacaagtgggtctccaacaaaactgagggaagaattactgacgtgatcccatcagaagccattaatgaactgaccgttctggtgctggtgaatacgatatactttaagggactttggaagagcaagttttcccccgagaacacgcggaaagaactgttttacaaggctgatggggaaagctgtagcgcaagtatgatgtaccaggaaggaaaatttcggtatcggagggtagccgagggtactcaagtcctcgagcttcctttcaaaggagacgacattacaatggtgctgatactccctaagcccgagaaaagtctggccaaagtggaaaaagaactgacccctgaagtgctgcaagagtggctggatgagctcgaggaaatgatgctggtagtgcacatgcctcggttccgaattgaggatggcttcagccttaaggagcagttgcaagacatggggctcgtggacctgttctccccagaaaagtccaagctgcctggtatcgtagcggagggacgcgatgacctctacgtttctgacgcctttcataaagcttttcttgaagtgaacgaggaggggtccgaggccgctgcttctacggccgtggtgatcgcaggtagaagcctgaatccaaatagagtgacattcaaagctaatagacccttcttggtgtttatccgcgaagtacctctgaatacaattatctttatgggacgggtcgctaatccatgtgtgaaa

SEQ ID NO: 18883 - DNA, 1392 bp, Artificial Sequence
  Description of Artificial Sequence: Synthetic coding sequence
atgtacagtaacgtcattggaactgttacaagcggcaagcggaaagtgtacctgctgagtctgctactcattggcttctgggactgcgtcacgtgtcacggttcccccgtggatatatgtacagcaaagccaagagacatccccatgaaccccatgtgtatctacaggtcccccgagaagaaggcaactgaggatgagggcagtgagcagaagatacccgaagccacaaataggcgggtatgggagctttccaaggctaacagtcgcttcgccaccacattttaccagcacttagccgattcgaaaaatgataacgacaacatcttcctgagccctcttagcataagcactgcctttgctatgacgaagctgggtgcttgcaatgacaccctgcagcagctcatggaggtgttcaaatttgacacaatttcagaaaaaacttctgaccagattcacttctttttcgctaaattgaattgtcgattgtatcggaaggctaacaagtcctcaaagttggtgagtgctaacaggctgttcggcgacaaatctctgactttcaacgagacctatcaggacatcagcgaactcgtgtatggagctaaattacagcccctggactttaaagagaatgcggagcagtcacgggccgccattaacaaatgggtctctaataagacagaggggagaattaccgatgtgatcccatccgaggcaatcaacgagttaacagtgctggtcctagttaataccatctactttaaagggctttggaaatccaagtttagtccagagaacactcgcaaagagctgttttataaagccgacggagagagctgcagtgctagcatgatgtaccaggagggaaaatttcgctacaggagagtggctgaaggaacccaggtcctggaactaccatttaaaggagacgatatcactatggttctgatcttgcctaaaccggagaaatcattggctaaggtggagaaagaactgaccccagaggtgttacaagagtggctggatgaactggaagaaatgatgctagtggtgcatatgcctcgttttcgaatagaggacggcttctccttgaaagaacagctgcaggacatgggactagtggacctgtttagtcctgagaaaagtaagttgcctggaatcgtggccgagggtagagatgacctatatgtgtccgacgctttccacaaagccttccttgaagtcaacgaggaaggaagtgaggcagcggccagtactgccgtagtgattgccggccggtcactcaacccaaatagagtgacattcaaagccaatagaccgttcctcgtatttattagggaagtcccactcaatacaattatcttcatggggcgcgtggctaatccctgcgtcaag

SEQ ID NO: 18884 - DNA, 1392 bp, Artificial Sequence
  Description of Artificial Sequence: Synthetic coding sequence
atgtacagcaatgtgatcgggactgtgacgagcgggaagcgcaaggtttaccttttaagtctgctgcttatcggtttttgggattgcgtcacttgccacggttcccccgttgatatttgcacggctaaaccgcgtgacatcccgatgaaccccatgtgcatctaccgctccccagagaagaaggccacagaagatgagggttccgagcagaagatcccggaggcgactaatcggcgtgtctgggagttgtctaaggctaactctagatttgccactactttctaccaacacctcgctgactccaagaatgacaacgataacatcttcctttcccccctgtccatttcaaccgcgttcgccatgaccaaactcggggcttgcaacgatactcttcaacaactgatggaagtgttcaagttcgataccatctccgagaagacctccgatcaaatccacttcttcttcgccaagctgaactgtcgcctttaccgtaaggctaacaaatcgtcgaagctcgtttcagctaacagactgttcggcgacaagtccctcacctttaacgaaacataccaggatatctccgagttggtctacggtgcgaagttgcaacctctcgactttaaggagaatgctgagcagagccgggccgctatcaacaagtgggtctccaacaagaccgagggcaggattacagatgttattccgtcggaggccatcaatgagctcacggtcctcgttctggtcaacacgatttacttcaagggtttgtggaagtctaagttcagccctgagaatactaggaaggagctcttttataaggccgacggagagtcgtgttcagctagcatgatgtatcaagagggtaagttccggtaccgccgtgtcgccgagggtactcaggtactcgaacttccctttaaaggtgacgacattaccatggtcttgattcttcccaagcctgagaagagcctcgccaaggtcgagaaggagttgacccccgaagttctccaggagtggcttgacgagctggaagagatgatgcttgtggtgcacatgccccgtttccgtatcgaagatgggttctccctgaaggagcagcttcaggatatgggtctcgtagacctgtttagcccggagaagtcaaagctccccggtatcgtcgccgaaggtcgcgacgacttgtatgtctctgacgctttccacaaggctttcctggaggttaatgaggaggggtctgaggcagcggcgtccaccgcagtagtcatcgctggacgcagcttgaatcccaacagagttacgttcaaggccaaccgcccttttctcgtctttatccgcgaagtcccgctgaacaccatcatctttatgggccgcgttgctaatccgtgcgtcaag

SEQ ID NO: 18885 - DNA, 1392 bp, Artificial Sequence
  Description of Artificial Sequence: Synthetic coding sequence
atgtactctaacgtcatcggcacagttaccagcggcaagcggaaagtttatctactgtctctcctccttattggattttgggattgtgtgacctgccatggatcacccgttgatatatgtacagccaaaccgagggatattccaatgaatcccatgtgtatatataggagtccagaaaaaaaggccaccgaggacgaaggttctgaacaaaaaatccccgaggcgacaaacagaagagtgtgggaactcagcaaggcgaatagcaggttcgctactaccttttaccagcaccttgctgactctaaaaacgataatgataacatattcctctccccactctctatatctactgccttcgctatgaccaaactgggcgcgtgcaacgacaccttacagcaactgatggaggtatttaagtttgatacgatctccgaaaagacatctgatcagatccactttttttttgctaagctcaactgcaggttgtatcggaaagcaaacaaatccagcaagttggtgtccgccaacagactgttcggagacaagtccctgacctttaatgagacataccaagacatcagcgagctggtatacggagccaagcttcagcccttggacttcaaggagaatgccgaacagtctcgtgccgcaatcaacaagtgggtttccaacaagactgagggccgcataacagatgtcattcccagcgaagctataaacgaactgacagttctcgtactcgtcaacacaatctacttcaagggactgtggaaatcaaaattctccccggaaaacacacgcaaggagcttttctataaggcagatggtgagagctgctccgcgtcgatgatgtaccaggagggcaaattccggtaccggcgggtcgctgaaggcactcaggtcctggaactgccattcaaaggcgacgacatcacaatggttttgatattgccgaagccggagaaatccctcgcgaaggttgagaaagagttgacccctgaagtgctgcaagaatggctggacgagcttgaggagatgatgctggtggtccacatgccccgctttagaatagaggacggcttcagccttaaggagcagctccaagacatgggtttagttgatcttttctcgccggagaagtctaagctgccaggtatagtggcagagggaagggatgatctctatgtgagtgacgcttttcacaaagcgttcctggaggtaaacgaggaagggagtgaggccgcagccagcaccgctgtggtaatcgcgggtcgatctttgaatcccaatcgcgtgacatttaaggccaacagacctttcttggtgttcatcagagaggttccacttaatactatcatctttatggggagggttgccaacccgtgtgtgaaa

SEQ ID NO: 18886 - DNA, 1392 bp, Artificial Sequence
  Description of Artificial Sequence: Synthetic coding sequence
atgtactctaacgtcattggcaccgttactagcgggaagcgcaaggtatacttgttgtccctgctactaattggcttctgggattgtgttacctgtcacggcagcccggtggatatctgtaccgctaagcctagagatatccctatgaaccctatgtgtatttatagatccccggagaagaaggcaaccgaggacgagggttcggagcagaaaatcccagaagctaccaatcgacgggtctgggaactgagcaaagccaatagtaggttcgctaccaccttctatcaacatctggctgactctaaaaacgacaatgataatatctttctcagtcctctgtctattagcaccgcattcgcaatgaccaagctgggagcctgtaacgacacactccagcagctcatggaggtctttaagttcgacaccatctccgaaaagaccagtgatcagatccactttttctttgccaagttgaactgcagattatatagaaaggcaaataagagcagcaagctggtctcggctaacaggctattcggggacaaatcattgacattcaacgaaacctatcaagacattagcgaactcgtatacggcgcaaaactgcagcctcttgattttaaggagaacgccgagcagagtcgggcagctattaataaatgggtgagcaacaagaccgagggccggataactgatgtcatcccttccgaagcaatcaacgaacttaccgtgctagtgcttgttaacaccatttacttcaagggactttggaaatcaaaattttctccggagaatactcgaaaagagctcttctacaaagcagacggtgagagctgtagcgcatctatgatgtaccaagagggaaagtttagataccgccgggtggccgagggcactcaggttttggagctcccttttaagggcgatgatatcactatggtgctgattctcccgaagccagaaaagagtctggctaaagtagagaaagagttgactcccgaggttctccaggaatggttggacgaactggaggaaatgatgttggttgtgcatatgcctaggttccggatcgaggacggattttctcttaaggagcagctccaggatatgggcctggtggacctattctcacccgaaaaaagtaaactcccaggaattgtcgccgaaggaagggacgatctatatgtctcagatgctttccataaagcattccttgaggttaatgaggagggatccgaggcagccgcctctaccgccgtggtgattgcagggagatcccttaaccccaatcgggtgaccttcaaggcaaaccggccattcttagtgtttatcagggaagtgccactaaataccataatcttcatgggaagggtcgccaatccatgtgttaaa

SEQ ID NO: 18887 - DNA, 1392 bp, Artificial Sequence
  Description of Artificial Sequence: Synthetic coding sequence
atgtattcgaacgttatcggaaccgtcacatcgggcaagcggaaggtgtacttgttgtctttgcttcttattggcttttgggactgtgtgacttgtcacggaagccccgtggacatctgcacggcaaagcctagagatatccctatgaaccctatgtgtatctacaggagcccggagaagaaagctacggaggatgaaggatccgagcagaaaatcccagaggctaccaaccggcgagtctgggagctaagtaaagcaaattcgcgcttcgcaaccactttctatcaacacctcgccgatagcaaaaacgacaacgataatatttttttgagcccattgtccataagcaccgcttttgccatgactaaactgggggcttgcaatgacactctgcagcaacttatggaggtgtttaagttcgatacgatctccgaaaaaacgtctgaccaaatccattttttcttcgccaagctcaattgtagactgtaccgtaaggcaaataaatcgtctaaactggtcagcgccaatcggttattcggggataagtctttgacttttaatgaaacctatcaagatatcagtgaactcgtttacggcgctaagctccagcccctcgactttaaggagaatgcagaacagtcccgggctgcgatcaataagtgggtgagtaataaaacagaaggacggataactgacgtgatccccagcgaggctatcaacgagctcacagtcttagttctggttaacactatctacttcaaagggctttggaagagcaagttttcgcctgaaaacaccagaaaagaactcttctataaggcagatggtgagtcctgctcagcttccatgatgtaccaagaggggaaattccgctatagacgggtagccgagggaactcaggtgctcgaattgccatttaaaggagatgatatcactatggtgctgattctgcccaaaccggaaaaatcattggctaaggtcgaaaaggagctcacaccagaggtccttcaagaatggctagacgaactggaggagatgatgctggttgtgcacatgccaaggtttcgtattgaggatggcttcagtcttaaagagcagctccaggacatgggcctggtcgacctcttttcccccgaaaaaagtaagctgcccggcatcgttgccgagggaagagacgacttatacgtatcagacgcattccataaagccttccttgaggtcaacgaggaggggagcgaagccgcagccagcaccgctgtagtgatcgctgggcgcagcctgaacccaaaccgagtaaccttcaaggcgaataggccttttctggtgttcatccgagaggtgcctcttaacacaattatttttatgggaagagtcgctaacccatgcgtgaag

SEQ ID NO: 18888 - DNA, 1392 bp, Artificial Sequence
  Description of Artificial Sequence: Synthetic coding sequence
atgtactccaatgtgattggcacagtgacatctgggaaacggaaggtttatctgctcagccttctgctgatagggttctgggattgcgtcacatgccatggtagccctgtagatatttgtaccgctaagccgagggacatccctatgaacccgatgtgtatttatagatcacccgaaaaaaaggcgacagaggatgaaggcagcgagcagaaaattcctgaagctaccaaccgacgtgtttgggagctgtctaaagctaatagtagattcgccacaaccttttatcaacatttggctgactctaagaacgacaacgacaatatctttttgagcccattgagcatcagcaccgctttcgccatgactaagctgggcgcctgcaatgacacccttcagcagcttatggaagtcttcaaattcgatacaatctctgagaaaacatccgatcaaatacactttttcttcgccaaacttaactgcaggctttacaggaaggctaataaatcgtccaaacttgtgagcgcaaatcggttgtttggagacaaatctctgacctttaacgagacctaccaggatatctccgagctcgtatatggcgccaagttacagcctctcgactttaaggagaatgccgaacaatccagagcggcaattaacaaatgggtttctaacaagacggaagggagaatcactgacgttattccgagtgaagcgattaatgaacttactgtcttagtcctcgtcaatacaatatacttcaaaggcctgtggaaaagcaagttcagccccgagaatacccggaaggagcttttctataaggcagatggcgaaagctgttctgcctccatgatgtatcaggaaggaaaatttcggtaccgacgagtagctgagggaactcaggtcttggagctgcctttcaaaggcgatgacatcaccatggtcctgatcctgccgaaacctgagaagagccttgcaaaggtggagaaagagctaactcccgaagttttacaggagtggttggatgagctggaggagatgatgttggtggttcacatgcccaggtttaggattgaagatggcttttccctgaaggagcagctccaggacatgggactggttgatctgtttagtccagagaagagtaaactccctgggatcgttgccgagggccgtgacgatttgtacgtgtcagacgccttccacaaggctttccttgaggtcaacgaagagggatctgaggcagcggccagtacagcagtcgtaatcgctgggaggtctttgaatcccaatcgcgtgaccttcaaagcaaacaggccctttctggtattcatccgagaagtccctctaaacacaatcatcttcatggggcgggtggcaaatccatgcgtaaaa

SEQ ID NO: 18889 - DNA, 1392 bp, Artificial Sequence
  Description of Artificial Sequence: Synthetic coding sequence
atgtactcaaacgtcatcggcaccgtgaccagcggcaaaagaaaagtttacctgctgagcctccttctgatcggtttctgggactgtgtgacttgtcatggaagcccagtggacatttgtacagccaaaccgagagatatccctatgaaccctatgtgcatctataggagccctgagaaaaaagccactgaagatgaaggctctgagcagaagattcccgaagctactaataggagagtgtgggaactatcaaaggctaattctaggtttgctactaccttctaccaacatctggcagacagcaaaaacgataatgataatatattcctttcacctctttctatctctacagccttcgccatgaccaagcttggagcgtgcaacgacaccctgcaacagctgatggaagtcttcaaatttgacacgatcagtgaaaaaaccagtgatcaaatccattttttttttgcaaagcttaactgcaggttataccgcaaagccaacaagtcatctaagctggtgagtgccaatagactgtttggagataagagtctgactttcaatgagacctaccaggatatctcagagcttgtttacggcgccaagttacagccgttagactttaaagagaacgccgaacaatcgcgtgctgccatcaacaagtgggtgagcaacaaaaccgaaggacgcatcacagacgtgattccctctgaagctataaatgaactcacagttttggttctcgtgaacaccatttactttaaaggtctttggaagagtaaatttagccctgaaaacacccgtaaggaattgttttacaaggcagacggcgagagctgctcggccagtatgatgtaccaagagggcaaattccggtatagacgggtcgcggaaggcacacaagtgctggaactgccttttaaaggagacgacattacaatggtcctgatcttgcctaaacccgagaaaagcctggctaaagtagaaaaggagctgacccctgaggtgctccaagagtggctcgacgagttggaggagatgatgttagttgtccacatgcccagatttcggatcgaggacggtttctcacttaaagagcagcttcaggatatgggcctggttgatcttttttccccagagaagagcaagctgcctggcatcgtcgctgagggacgggacgatctttacgtcagtgatgcttttcacaaagcttttctcgaagttaacgaggagggctccgaggcagcagcctccaccgcagtggtgatcgctggaaggagtctgaacccaaacagagtgacattcaaggcgaatcgccccttccttgtgttcataagagaggtcccactgaataccattatctttatgggaagggttgcaaatccttgtgtgaag

SEQ ID NO: 18890 - DNA, 1392 bp, Artificial Sequence
  Description of Artificial Sequence: Synthetic coding sequence
atgtattctaacgtcatcggaacggttactagtgggaagcgaaaagtctacttgttgtccctcctgcttataggattttgggactgcgtgacatgtcacggatccccagtcgacatatgcaccgccaagccgcgggatattcctatgaatcctatgtgcatttataggtcgccagagaaaaaagcaacagaggatgaggggagcgaacagaagatcccagaagccacaaacagacgcgtgtgggaactgagcaaagctaatagtcggtttgccactactttttatcagcacctggcggattcgaagaatgacaacgataatatctttttgtctcctctgtctattagcactgccttcgcgatgacgaagctgggagcgtgtaacgacacactgcagcagctaatggaggtctttaaatttgataccatctccgagaaaacctccgaccaaattcattttttctttgcaaaactcaactgccggctctacaggaaagccaataaaagctccaaattagtgtccgctaaccgactttttggggataagtcattgacttttaatgaaacctatcaagacatcagtgaactggtatatggggccaagctccagcccttagactttaaggagaacgccgagcagtctagagcagctattaacaagtgggtgtctaacaagactgaaggtaggataacggacgtgattccgtccgaagccatcaatgagctgactgtgctggttctcgtaaatacaatttacttcaaggggctttggaagagtaaattttcaccagaaaacacgaggaaagagctcttctataaggcagacggcgaaagctgctcggctagtatgatgtaccaagaggggaagttccgctatcgcagggtggctgaggggactcaggttttggagctgcctttcaaaggcgacgacatcacaatggtgctcatcctccccaagccggagaagtcactagctaaggtggaaaaggaacttacacctgaggtgctgcaggaatggctggacgaactggaggagatgatgcttgtggtgcacatgcctcgcttcagaatcgaggacggatttagcctgaaggaacagttacaggatatgggactcgttgacctgttcagccccgagaaatcaaaacttccaggaattgtggccgaaggaagagatgacctgtacgtttctgatgcattccacaaggcatttcttgaggtcaacgaagagggttccgaagccgcagccagtacagccgtggttatcgcggggcgttcgttaaatcccaatagggttacatttaaggctaataggcccttcctcgtctttatccgggaagtccctttaaacaccatcatcttcatgggccgcgtcgcaaatccatgtgtgaaa

SEQ ID NO: 18891 - DNA, 1392 bp, Artificial Sequence
  Description of Artificial Sequence: Synthetic coding sequence
atgtactccaacgttatcggaacagttacctctggcaaacgcaaagtgtaccttctgtctttgctgctgatcggattttgggactgcgtcacatgtcacggcagccccgtcgacatctgcacagccaagcctagagatattcccatgaatcctatgtgtatttacaggagccccgagaagaaggcgaccgaggatgaaggttcagagcagaaaattcctgaagctaccaacagaagggtgtgggaactcagtaaagctaactctaggtttgcaaccacattctaccagcatctggcggattctaagaacgataacgataacatcttcctctccccactttctatctcaactgcattcgctatgactaaactcggtgcctgcaatgacaccctgcagcagctgatggaagtgttcaagttcgacacaatcagcgagaagacgagcgaccagatccacttcttttttgccaagcttaactgtaggttgtaccgcaaggctaacaagtcttccaaattggtgagcgctaaccgccttttcggagataagtcactcaccttcaatgagacctaccaggatatatcagaactggtatacggcgccaagctgcagccgctggacttcaaggaaaacgcggaacagtctagggctgctataaacaaatgggtgtcaaacaagactgagggcaggatcacagacgtcatcccttcagaggccatcaatgagctgaccgtgctcgtccttgtgaacaccatttatttcaagggtctgtggaagtcaaagttttccccagaaaacacccgcaaagagctgttttataaagctgacggagagagctgcagcgcctccatgatgtaccaggagggcaagtttagataccgcagggtggctgaaggaacccaggtcctcgaattgccgtttaaaggagatgatatcacaatggttctcatcctcccaaagccagaaaagtcattggcgaaagtggaaaaagagctgaccccggaggttctgcaagaatggctggatgagctggaagaaatgatgcttgttgtgcatatgcccaggttcaggatcgaggacggtttctccttgaaggaacaactccaggacatgggtctggtcgacctctttagccctgagaagtcaaagctcccgggcatcgtggcagagggtagagatgatctgtacgtatccgatgccttccacaaagccttcctcgaggtgaatgaagaaggctccgaggccgcggcttctactgccgtggtcatcgccggcagaagcttgaatccaaaccgcgtgacttttaaagccaataggcctttcctcgtgtttataagggaggtccccctgaacacaattattttcatgggacgcgtcgccaacccatgtgtaaag

SEQ ID NO: 18892 - DNA, 1392 bp, Artificial Sequence
  Description of Artificial Sequence: Synthetic coding sequence
atgtactccaatgtgattggaaccgtgacgtctgggaaacgaaaagtgtacttgcttagccttttgctgatcggtttttgggactgtgtgacctgtcacgggagcccggtcgacatctgtactgctaaacccagggatatcccaatgaatccgatgtgtatctacaggagtccggagaagaaggcaacagaggacgaaggaagtgagcagaaaatcccagaagctacaaatcgaagagtttgggagctttccaaggcaaattcacgattcgctacaacgttttatcaacacctggccgattccaagaatgacaacgacaacattttcctatccccactgtcaatcagcactgctttcgccatgaccaaactgggcgcatgtaacgacacgctgcaacagcttatggaagtctttaaattcgatacaattagcgagaagacttcggaccagatccacttcttctttgctaagctcaactgcaggctttataggaaggcaaataagagctctaagctcgtgtccgccaatagattattcggtgataagtccctgacatttaatgagacctaccaggacattagcgaattagtgtatggcgccaaattacagccactggatttcaaggagaacgctgaacagtccagagcggccataaataaatgggtgtcgaataaaaccgaaggcagaatcacagacgtgatcccatccgaggcgattaatgagctaacagtgctggttttggtgaatacaatctacttcaaggggctgtggaagtctaagttcagtcccgaaaacactcgaaaagaactgttctataaagcggacggggagtcatgttcggcctccatgatgtatcaggaaggaaaattccgttatagacgtgtcgcagagggaacgcaagttctagagctgcccttcaagggtgatgacatcacgatggtgcttatcctgccaaagcccgaaaaaagccttgccaaggtcgagaaagagctgacacctgaagtactgcaagagtggttagatgaattagaggaaatgatgctggtggtacatatgcctaggtttagaattgaagatgggttctcactcaaggaacagctccaggatatgggtctggttgacctcttttccccagaaaagtctaaacttccagggatcgtggcagaaggaagggacgatttgtatgtgagcgacgcctttcacaaggctttcctggaagtgaatgaggagggaagtgaagccgctgcatcgaccgcagtcgtaatcgctggcaggagtctcaatcccaatagagtaacctttaaagctaaccggccatttctcgtttttatacgagaggtccccctgaatacgatcatttttatgggccgggtagctaatccttgtgtgaaa

SEQ ID NO: 18893 - DNA, 1392 bp, Artificial Sequence
  Description of Artificial Sequence: Synthetic coding sequence
atgtattcaaatgtgatcgggactgtgacttccggaaaacggaaagtgtatctgttgagtttactgctcatcgggttttgggattgcgtaacatgtcatggatctcccgtggatatatgtacagccaaacccagggacattcccatgaaccctatgtgtatatatcggtcccctgaaaaaaaagccactgaggacgaaggatccgaacaaaaaattcccgaagccactaaccgcagagtgtgggaactctccaaggccaactcccggtttgctacaacattctatcagcacctggcagattctaagaatgataatgataatatatttttatcccctttgtcaatctctactgcgttcgcgatgacaaaacttggggcttgcaatgatacgttacagcagctgatggaggtgttcaaatttgatacaatttctgaaaaaactagtgatcagatacatttttttttcgccaaactgaattgccgcctatacagaaaagccaataaatcctcaaagctcgtcagtgccaacagactttttggagataaatcattaacattcaacgaaacataccaggatatctcagaactcgtgtatggggccaaactccaacccctcgattttaaagaaaatgcagaacagtcaagagctgccatcaataaatgggtgtcaaataagactgaagggcggatcacagatgttataccttcagaagccataaacgagttaacagtactcgttctggtcaacacaatttattttaaaggactttggaaatccaaatttagtcccgaaaatacacgaaaagagctattctataaagcagatggagaatcctgttctgcctccatgatgtatcaggaaggaaaattcaggtatagacgggtagcagaaggaactcaagttctcgaactacctttcaaaggggatgatatcactatggtgctgatacttcctaaacccgagaaatccctagctaaagtcgagaaggagctaacacctgaggttctgcaggagtggcttgacgaactcgaggaaatgatgctcgtcgtgcatatgcctcgcttcaggatcgaagatggatttagtctaaaagaacagttacaggatatgggacttgtcgatctgttttctcccgaaaaaagtaaactccctgggatagttgctgaagggagggatgatctctatgtttctgatgcctttcacaaagcttttctcgaagtcaatgaagaggggtctgaagctgcagcgtctactgcagtggttatagccgggcggtccctgaaccctaaccgggtcacattcaaagctaatcgaccctttctggtgttcatacgagaagtgccattgaatacaattatatttatgggacgcgttgccaacccctgtgtgaaa

SEQ ID NO: 18894 - DNA, 1392 bp, Artificial Sequence
  Description of Artificial Sequence: Synthetic coding sequence
atgtactcaaatgttattggcactgtgacgtccggcaagagaaaggtctacttgctttccttgctgctcattggattttgggactgcgtcacttgtcatgggagccccgtcgatatctgtacagcgaagccaagagacattcctatgaatcctatgtgcatataccgctcacccgagaagaaggcaactgaagacgaagggtcagagcaaaagattcccgaggccaccaacaggcgcgtttgggaactcagcaaagctaacagcaggtttgccacaacattttaccagcacctcgccgactccaagaatgacaatgacaacatctttctctcaccactttccatttccaccgcattcgcgatgaccaaactgggcgcttgcaacgataccctgcaacaactgatggaggtgttcaaattcgacaccatctccgagaagacctccgaccagattcattttttctttgcaaagctgaattgccgcttgtaccgcaaggccaacaagtctagtaagctggtcagtgctaataggctctttggggataagtctctgacctttaatgaaacttatcaggatatctctgagctggtttatggagccaagctgcagcctcttgattttaaagagaatgccgaacagtctagagctgcaatcaacaagtgggtgtcaaacaagacggaaggtcggataacagatgtaatcccttctgaggcgatcaacgaactcaccgtgctcgttctcgtgaatactatatactttaaggggctgtggaaaagcaagttctccccagagaatacgcggaaagagctcttctacaaagccgatggcgagagttgctcagcctcaatgatgtatcaagaaggaaagtttcggtacagaagagtggcagaagggacacaggtattggagctccccttcaaaggagatgacataaccatggttctgattctccccaaacctgagaaatccttggctaaggtggaaaaagaactgacccccgaagtgctccaggaatggcttgacgaactcgaggagatgatgctggtggtgcacatgccgagattcagaatcgaggatggattttcactgaaggagcaattgcaagatatggggctcgttgacttgtttagcccagaaaagtctaagctgccaggaattgtcgcagaaggtcgggacgatctgtacgttagcgatgctttccacaaagctttcctggaggtgaacgaggaagggtcagaggctgctgcgtctacagcagtagtcatcgctggccggtctcttaacccaaatagggtgacatttaaagccaacaggccctttctggtgtttattagggaggtccctctgaatacaataatcttcatgggccgggtcgccaacccatgcgtgaag

SEQ ID NO: 18895 - DNA, 1392 bp, Artificial Sequence
  Description of Artificial Sequence: Synthetic coding sequence
atgtactctaatgtaatcgggactgttacttccggtaaacgaaaagtttatctcctctctcttctcttgattggattttgggattgcgttacttgccatggttcgcctgtcgatatttgtacagcaaagccgcgtgatatacctatgaatcctatgtgcatctatagatcgcctgaaaagaaagccaccgaagatgagggctctgaacagaagattcctgaagccactaaccgcagggtttgggaactcagcaaggctaactctcgctttgctacgacattttatcagcatcttgctgattcaaaaaatgataacgataacattttcttatcacctctttctataagtacggctttcgccatgacgaagctaggcgcatgtaacgataccttacagcagcttatggaggtgttcaagttcgatacgatctctgaaaagacctcggatcagatacacttcttcttcgccaagctaaactgtagattataccgtaaagccaacaagagctcgaaactcgtgtcagctaacagacttttcggtgacaaatccctgacattcaatgaaacataccaggatatttctgaacttgtgtatggggcgaaattgcagcctttggacttcaaggagaacgccgaacaatcgcgtgcggctatcaataaatgggttagtaataagaccgaaggtaggattaccgatgttattccctctgaggccatcaacgagcttactgttttggtcctggtgaacaccatttatttcaagggactttggaagtccaaattttctcccgagaacacacgaaaggagctcttctataaagctgatggtgagagttgttcagcctcaatgatgtatcaagagggtaagttccgataccgtcgtgttgctgaagggacccaggtccttgagttgcctttcaaaggtgatgatattacaatggttcttatactcccaaagcctgagaagagcttggcgaaagttgaaaaagaactaactccagaggttctccaagaatggctcgacgagcttgaggaaatgatgcttgtagtccatatgcccaggttcaggattgaggatgggtttagtctcaaagaacagcttcaggatatgggactcgttgacctattctctcccgagaagagcaagctcccggggatagttgcagagggtagggatgatttgtatgtgtccgatgcctttcacaaagcctttctcgaggtgaatgaggaaggttccgaggcggcggcctcgacagctgttgttatcgctggtcggtctctcaatccaaacagggttaccttcaaggcaaatcgcccctttcttgtgtttatccgagaggtaccactgaacacgatcattttcatgggaagagtggctaatccttgtgtgaaa

SEQ ID NO: 18896 - DNA, 1392 bp, Artificial Sequence
  Description of Artificial Sequence: Synthetic coding sequence
atgtactcaaacgtaattggaaccgtgacttccggtaagcgaaaggtttacctattgtcacttctgctgatcggattttgggactgcgtaacatgccacggcagccccgtggacatctgcaccgctaagccccgtgacatccctatgaacccaatgtgtatttataggagtccagaaaaaaaagccacggaggatgagggaagcgaacagaaaattcccgaagctacgaaccgtagggtttgggaactgtctaaggccaactcaagattcgccaccactttttaccagcatctcgctgatagcaagaatgataatgacaatatcttcctgagtccgctgagtatttccaccgcattcgcgatgacgaagctgggcgcctgtaacgatacacttcaacagctaatggaggtcttcaagttcgataccattagcgagaaaacttccgatcagattcacttctttttcgccaaactgaattgtaggctgtatagaaaggccaataagtccagtaagctcgtgtctgcaaatagattgtttggcgataagtcccttactttcaatgagacgtaccaggacatctcagaattggtgtatggggctaagttgcagcccctggacttcaaagagaacgcagagcagtctcgggcggccattaacaagtgggtgtccaataagactgaaggccgaatcacagatgtaatcccctccgaggctatcaacgaactgaccgtactggttctcgtcaacactatttacttcaaggggctctggaagtcaaagttctcaccggaaaataccaggaaagagcttttttacaaggccgacggcgagtcctgctccgcatccatgatgtatcaggaggggaaatttagatatcggagggtggctgagggcacacaggtgctggagctgcccttcaaaggcgatgacatcacgatggtactaatcctgcccaagcctgaaaagtcactggccaaagtggagaaagagcttactcctgaggttctgcaggagtggctggacgaattagaggagatgatgctcgtcgtccatatgccacgcttcaggatcgaggatggattcagtttgaaggagcaactgcaggatatgggcctggttgatctattttccccagaaaagtcaaagctgcctgggatcgtcgcagagggccgggatgatctatatgtatccgacgcgttccataaggcattcttggaagtgaatgaggaaggaagcgaagccgctgcatccactgccgtcgtaattgcaggacgctcactgaaccctaatcgtgtcacctttaaggccaaccgcccttttcttgtttttatccgggaggtgccacttaataccataatctttatgggacgagttgccaatccctgcgtgaag

SEQ ID NO: 18897 - DNA, 1392 bp, Artificial Sequence
  Description of Artificial Sequence: Synthetic coding sequence
atgtattcaaacgtgattggaaccgtcacaagcggcaagagaaaggtttacctactgagcctgctcctgattggtttctgggattgtgtcacgtgccatgggtctcccgtggacatctgcaccgccaagccacgggacatcccaatgaatccaatgtgtatctacagatcacccgagaagaaggccacagaggatgaaggttcagagcagaagatccccgaagcaaccaatagacgggtgtgggagctgtcgaaagcgaatagtaggtttgcaacgacattttaccagcacttggccgatagcaaaaacgataacgacaacatctttcttagtcctctgtctatctctaccgcatttgcgatgacaaagctcggtgcgtgcaatgatacactacagcaactcatggaggtgttcaaatttgacacgatctctgagaagacatccgaccaaatccatttcttcttcgcaaagcttaactgtcggctttaccggaaagcaaacaagtccagtaaattggtgagtgcaaacagactttttggcgataagagtctaactttcaatgagacttatcaggacatcagtgagttagtatatggggccaaacttcagccgttggattttaaggaaaatgccgagcaatcacgagctgcgatcaacaagtgggtgagtaacaagaccgaagggagaatcaccgacgtgattccttctgaagctataaacgagctgaccgttctggtccttgtgaatactatttatttcaagggattgtggaaaagtaaattctcccctgaaaacacccggaaggaacttttttataaagctgacggtgagtcctgctctgcttcaatgatgtaccaggaggggaagtttcgctataggcgggttgctgagggaacccaggttttggagctccccttcaagggcgacgatatcaccatggttctgatcctccctaaaccggaaaagtccctggccaaagttgagaaggagctcacaccagaagtgctgcaagagtggcttgatgaattagaggagatgatgcttgtggtccatatgcccagattcaggatagaagacgggtttagtctgaaagagcaactacaggacatgggacttgttgacctgtttagccctgagaaatctaagttgcctggaatcgttgccgagggtagggatgatctctacgtgagcgatgccttccacaaggcatttttggaagtgaatgaagaaggttccgaggccgccgcctcgaccgctgtggtgatagctggtagatctttaaaccccaaccgcgtgacttttaaagctaacaggccattccttgtcttcatacgggaagtcccactgaacacgataatttttatgggaagggtggccaacccctgtgtaaag

SEQ ID NO: 18898 - DNA, 1392 bp, Artificial Sequence
  Description of Artificial Sequence: Synthetic coding sequence
atgtactccaatgtcatcggaacagtgacatcaggcaaaagaaaagtgtacttactgtctctcctactcatcggcttctgggattgcgtcacctgccacggctcccctgtcgacatttgtactgctaagccccgtgacatccccatgaaccccatgtgtatctatagatcccccgagaaaaaagctaccgaagacgaggggagcgaacaaaaaattccagaggccactaatagacgagtttgggagctgtcaaaggctaacagccgcttcgccaccactttctatcaacacctagcggacagcaagaatgataatgataacattttcttgagccctctgagcatcagcaccgcattcgcaatgacaaaactgggcgcctgcaatgacaccctccaacagctcatggaggtctttaagttcgacacgatttccgagaagaccagtgatcaaatccactttttctttgccaagcttaactgtcgcctgtaccgcaaggccaacaagtcaagcaagctagttagcgccaatagactttttggagacaagagtcttacctttaacgaaacctaccaggatataagtgagctcgtgtatggagctaaacttcagcctctggacttcaaggagaatgccgaacagagtagagctgcgatcaacaagtgggtatctaacaagactgaggggagaatcaccgatgtcatcccttcggaggctatcaatgagctgacagtgctggtgctagttaacactatctactttaagggcctttggaagtcaaaattttccccggagaatactcgtaaggagctcttctacaaggccgacggggaatcttgttcagcctccatgatgtatcaagagggaaagttcaggtatcggcgcgtcgccgaaggaacccaggttctggagctccctttcaagggagatgacattacgatggtcctgatcctcccaaaacctgaaaagtcacttgccaaggtcgaaaaagagctgaccccagaggtgttgcaggagtggttggacgagcttgaggagatgatgctggtcgtgcatatgccccgatttcggatcgaagacggcttcagcctcaaggaacagctacaggacatgggcctggttgacctattttcgccagagaaaagcaagttgcccggtatcgtcgctgagggaagggatgatctgtacgtgagcgacgccttccataaagccttccttgaggtcaacgaggaaggctctgaggctgcggcctcaactgctgttgttatcgcagggaggagtctcaaccctaaccgggtcactttcaaggcaaatcggcctttcttggttttcatccgtgaagtgccactcaacacaataattttcatgggcagagtcgccaacccatgtgtgaag

SEQ ID NO: 18899 - DNA, 1392 bp, Artificial Sequence
  Description of Artificial Sequence: Synthetic coding sequence
atgtattcgaatgtaataggtacggtaacgtcgggtaaacgaaaagtatatttattatcgttattactaataggtttttgggattgtgtaacgtgtcatggttcgccggttgatatatgtacggcgaaaccgcgagatataccgatgaatccgatgtgtatatatcgatcgccggaaaaaaaagcgacggaagatgaaggttcggaacaaaaaataccggaagcgacgaatcgacgtgtttgggaactatcgaaagcgaattcgcgttttgcgacgacgttttatcaacatctagcggattcgaaaaatgataatgataatatatttttatcgccgctatcgatatcgacggcgtttgcgatgacgaaactaggtgcgtgtaatgatacgctacaacaattaatggaagtatttaaatttgatacgatatcggaaaaaacgtcggatcaaatacattttttttttgcgaaattaaattgtcgactatatcgtaaagcgaataaatcgtcgaaactagtatcggcgaatcgtttatttggtgataaatcgctaacgtttaatgaaacgtatcaagatatatcggaactagtatatggtgcgaaactacaaccgttagattttaaagaaaatgcggaacaatcgcgagcggcgataaataaatgggtatcgaataaaacggaaggtcgtataacggatgttataccgtcggaagcgataaatgaactaacggttttagttctagtaaatacgatatattttaaaggtctatggaaatcgaaattttcgccggaaaatacgcgaaaagaattattttataaagcggatggtgaatcgtgttcggcgtcgatgatgtatcaagaaggtaaatttcgatatcgtcgagttgcggaaggtacgcaagtattagaattaccgtttaaaggtgatgatataacgatggtactaatactaccgaaaccggaaaaatcgctagcgaaagtagaaaaagaattaacgccggaagtattacaagaatggctagatgaactagaagaaatgatgttagtagtacatatgccgcgttttcgtatagaagatggtttttcgctaaaagaacaactacaagatatgggtttagtagatttattttcgccggaaaaatcgaaactaccgggtatagtagcggaaggtcgtgatgatctatatgtttcggatgcgtttcataaagcgtttttagaagtaaatgaagaaggttcggaagcggcggcgtcgacggcggttgtaatagcgggtcgatcgttaaatccgaatcgtgtaacgtttaaagcgaatcgaccgtttctagtatttatacgtgaagtaccgctaaatacgataatatttatgggtcgtgtagcgaatccgtgtgtaaaa

SEQ ID NO: 18900 - DNA, 1392 bp, Artificial Sequence
  Description of Artificial Sequence: Synthetic coding sequence
atgtactcgaacgtcattggcacagttacctccggcaaacggaaggtttacttgctgtccctgcttctgatagggttttgggattgtgtgacctgccatggatcccccgtagacatttgtaccgctaaacccagggacatccctatgaacccgatgtgcatataccggtcccccgagaaaaaagccaccgaggacgagggcagcgaacaaaagatacccgaggccaccaaccggcgggtgtgggaactgagcaaagcaaacagcaggtttgctaccaccttttaccagcatcttgctgactccaaaaacgacaatgacaacattttcctgtccccactttccatttctaccgcttttgccatgactaagctgggcgcttgcaacgacaccctccagcagctgatggaggtttttaaattcgataccatttccgagaaaacaagcgatcagatacacttcttctttgcaaagctcaattgcagactgtatcggaaggcaaataaatcgtctaagctggtctctgccaacaggcttttcggtgacaagtcactcacgttcaatgagacttaccaggacatatctgaactggtgtacggggctaagctgcagcctttggatttcaaagagaatgctgagcagtctagggcggctataaacaaatgggtctccaacaaaacagagggccgcattaccgacgtaattccttctgaggctatcaatgagctgaccgtgctggttctggtgaacacgatctattttaagggcctgtggaagtctaaattcagtcctgaaaacaccaggaaggagctgttctacaaagccgatggggagtcctgttctgcatctatgatgtaccaggaagggaaattccggtacagacgagtggctgaaggcacccaggtgctggaactgcccttcaagggcgatgacattaccatggtgttaatcctacccaagccggagaaatcgctggcgaaagtggaaaaggagctgactcctgaggtgcttcaggagtggctggatgagctggaggagatgatgttggtcgtacacatgcctagatttcggatagaggacggcttttcccttaaagagcagctccaagatatgggattagtggacctctttagtccagagaaatctaaattgccaggtatagtggcggagggcagagacgacctgtacgtgtccgatgcttttcacaaagcttttctcgaagttaacgaggagggctcggaggcagccgccagcacagccgtggtcatagcggggaggtcactgaacccgaaccgggtgacattcaaggcgaacagaccgttcctcgtcttcatccgcgaagtgcctctgaatacaattatttttatgggtagagtcgccaatccatgtgttaag

SEQ ID NO: 18901 - DNA, 1392 bp, Artificial Sequence
  Description of Artificial Sequence: Synthetic coding sequence
atgtattcaaatgtcataggcaccgttaccagcggaaaaagaaaagtgtatctactgtccctgctgctcattgggttctgggactgcgtgacatgccatggtagccccgttgacatatgtacagcaaaaccccgagatatacctatgaacccaatgtgtatatataggtcccctgagaagaaagctactgaggacgaagggagcgaacagaaaattcccgaggctacaaaccggcgggtgtgggagctatccaaggccaacagccggttcgccactactttttatcagcacctggccgattctaaaaatgacaatgacaatatctttctgagcccactgtcaatctctactgctttcgcaatgactaagttgggtgcctgtaacgataccttacagcaactaatggaagttttcaaatttgacacaatatctgaaaagacatctgaccaaattcatttctttttcgccaaattaaactgtcgtttatataggaaagctaacaagtcttctaaactggtgtccgctaatagactgttcggggacaaaagtcttacctttaatgaaacatatcaggacatttccgaactagtctacggcgctaaattgcagccactggacttcaaagagaatgctgagcagagtcgagccgccatcaataagtgggtgtccaacaagacagaaggtcgcattaccgacgttataccatctgaagcaataaatgagctcaccgttcttgttctggttaacactatatatttcaagggactgtggaagagtaagttttctcccgaaaatactcgcaaggagctgttttacaaagcagatggagagtcatgttctgccagcatgatgtaccaagaagggaagttccgctataggagggtggccgaggggacacaggtgctggagctgccctttaagggggacgacatcaccatggtgctaattctccccaagcccgagaaatccctcgcaaaagtagaaaaggaattaacacctgaagtgctgcaggaatggctcgacgaactagaagagatgatgctcgtggtccatatgcccagatttagaatagaggatggcttctccctgaaagaacagctgcaggacatgggcttggtggacctgttcagtccagagaagagtaaactgcctggcattgttgccgagggtcgcgacgacctgtatgtttccgatgcattccacaaagccttcctggaagtaaatgaagagggcagcgaagcagcagcttcaactgctgttgttattgctggccggtctctgaaccctaatcgcgtgacttttaaagcaaacagacctttcctagtcttcattcgcgaggtgcctctgaacactattattttcatggggagggtcgcaaatccatgcgtgaaa

SEQ ID NO: 18902 - DNA, 1392 bp, Artificial Sequence
  Description of Artificial Sequence: Synthetic coding sequence
atgtacagcaacgtgatcgggaccgtgactagcggaaagagaaaagtgtacctcctgagcctgttgctaatcggtttttgggattgcgtcacgtgccacgggtcgccagtagatatatgcactgccaagccacgagatattcccatgaacccaatgtgcatttacagaagccccgagaagaaagctactgaggacgaggggtctgagcaaaaaatcccagaggccactaatagacgcgtctgggaactctctaaggccaactcccgatttgcaacaaccttttaccaacacctagctgacagtaagaatgacaatgacaacatcttcctgtcccccctcagtatcagtacagcttttgctatgaccaaactcggcgcatgtaatgataccctgcagcaacttatggaagtgtttaagtttgatacaattagcgaaaagaccagcgatcagatccatttcttctttgccaagctaaattgccggctgtatcgtaaggctaacaaaagttcgaaactcgtgagcgccaacagactgttcggagacaaaagtttgaccttcaacgagacataccaagatatatcagagctggtctatggagcgaaactgcagccactcgattttaaagaaaacgccgagcaatctcgagctgcaatcaacaagtgggtgagcaacaagaccgagggccgcatcactgatgtgattccgagcgaagccatcaacgaactgacagtgctggtgttggtgaacacgatctactttaaaggattatggaaaagcaaattctcaccggagaacacaaggaaagagctgttttataaggctgacggcgaaagttgcagtgcatcaatgatgtatcaagaagggaagttcagatatcgtcgagtcgccgaaggtactcaagtcttggagctaccatttaagggggacgatattaccatggtgttgatccttcccaaaccggagaagtccctggccaaagtcgagaaagagctgactcctgaggtcctccaggagtggctcgacgagctcgaggaaatgatgcttgttgttcatatgccacgattccggatcgaagatggcttttccctgaaggagcagctccaggatatgggcttggtggatctctttagccccgaaaagagcaaattaccaggcatcgtggcagagggaagggacgacctgtacgtttctgacgccttccacaaggcttttttggaagtgaatgaggagggcagtgaggctgccgcaagtactgcagtagtgatagccggccgcagtcttaacccaaatcgggtgacctttaaggccaataggccttttctcgtgttcatccgtgaggttcccctgaatacaattatcttcatgggcagggtcgcaaacccttgtgtcaag

SEQ ID NO: 18903 - DNA, 1392 bp, Artificial Sequence
  Description of Artificial Sequence: Synthetic coding sequence
atgtacagcaacgttattggaactgtcacatccggcaaaagaaaggtttatctgctgtccctgcttctgatcggtttctgggattgcgtcacctgccatggttcaccggtagacatctgtaccgccaagccgagagacatcccaatgaacccgatgtgcatttaccggagccccgagaaaaaagctaccgaggacgaagggtcagagcagaagattccagaggcgaccaatcgccgcgtttgggagctgtctaaagcaaacagccgattcgccacgacattttatcagcatctggcagattccaaaaatgataatgacaacatattcctgagccccctgtctatttcaactgcgtttgccatgactaagctcggcgcctgtaatgatacactccagcagcttatggaagtattcaaatttgacacgatctctgaaaagaccagtgatcaaatacattttttctttgctaagctgaactgcagactgtacagaaaagcaaacaaatcttccaagctcgtgtccgccaatcgccttttcggagataaatctctcacgtttaacgagacttatcaggatattagcgagctggtgtacggcgctaaactccagcctctggactttaaagagaatgctgaacagtctagggctgccataaataagtgggtgtccaataaaaccgagggcaggattaccgatgttataccctccgaggctattaacgagctgacggtcctcgtgctggtgaataccatatactttaagggcctttggaagtcaaagttctcccccgaaaacactaggaaggagctcttttataaagctgatggggagagttgctccgcttcaatgatgtatcaggaaggcaaattccgctacaggagggtggcggaagggacgcaggttctggaactgccctttaagggcgacgatatcacgatggtcttgatcctgcctaagccggagaaatccctggctaaagtagagaaggagcttactcctgaggttctccaggagtggcttgatgaactcgaggaaatgatgttggtggtccatatgccgagattccgaatcgaggacgggttcagcctcaaagaacaactccaggacatgggcttggtggaccttttttctcccgaaaaaagcaaactgcctggaatcgtcgctgaggggcgggatgacctgtacgtgagcgacgcctttcacaaagcctttctggaagtcaacgaggaggggtctgaagctgcggcctccacagccgtggtgattgcagggaggtccctgaaccccaacagagttacatttaaggccaacagaccgttcctcgtgtttatacgcgaagtgcccctgaacaccattatatttatggggagagttgctaacccctgcgtgaaa

SEQ ID NO: 18904 - DNA, 1392 bp, Artificial Sequence
  Description of Artificial Sequence: Synthetic coding sequence
atgtatagtaatgttattggtactgtaaccagtggaaaaagaaaagtttacttattgtctttattacttataggtttctgggattgtgttacctgtcacggatcaccagtagatatttgtacagcaaaaccaagagatattccaatgaatccaatgtgtatttatagatcacctgaaaaaaaagctactgaagatgaaggttctgaacaaaagattccagaagctacgaatcgaagagtttgggaattaagtaaagcaaattcaagatttgctacaacattttatcaacatttagctgattcaaaaaatgataatgataatattttcttaagtccacttagtatttctacagcttttgctatgacaaagttaggagcatgtaatgatacattacaacaattaatggaagtatttaaatttgatacaatttcagaaaaaaccagtgatcaaattcatttcttttttgctaaattgaactgtaggctttatagaaaagcaaacaaatcatcaaaattagttagtgcaaacagattatttggagataagtcacttactttcaacgaaacttaccaagatatttcagaattagtttatggagctaaattgcaaccactagatttcaaagaaaatgcagaacaatcaagagcagcaataaataaatgggttagtaataaaactgaaggacgtattactgatgtaattccttctgaagctattaatgaattaacagttttagttttagttaatacaatttattttaagggtctttggaaatctaaattttcaccagaaaatactcgtaaagaattattttataaagcagatggtgaatcttgttcagcttctatgatgtatcaggaaggaaaatttagatatagacgagttgcagaaggaacacaagtgttagaattaccttttaagggagatgatattacaatggtattaatattaccaaagccagaaaaatctttagctaaagtagaaaaagaacttacaccagaagttttgcaagagtggcttgatgaacttgaagaaatgatgttagttgttcatatgccaagatttagaattgaagatggattttcacttaaagaacaattacaagatatgggtttagtagatcttttttcaccagaaaaatcaaaacttccaggaattgttgcagaaggaagagacgatctttacgtgtcagatgctttccataaagcatttttggaagttaatgaagaaggatcagaagcagcagcaagtactgcagttgtaattgcaggaagaagtttaaatccaaatagagtaacatttaaagctaatcgtccatttcttgttttcattagagaagttccattaaatactattatttttatgggacgagttgctaatccttgtgttaaa

SEQ ID NO: 18905 - DNA, 1392 bp, Artificial Sequence; identical to SEQ ID NO: 18890
  Description of Artificial Sequence: Synthetic coding sequence

SEQ ID NO: 18906 - DNA, 1392 bp, Artificial Sequence
  Description of Artificial Sequence: Synthetic coding sequence
atgtatagcaacgtaattggcaccgtgaccagcggcaagagaaaagtatatctgctatcccttctcctcatcgggttctgggactgcgttacgtgccacggcagtcccgtcgacatctgtaccgccaagcctcgggacatccctatgaaccctatgtgtatttatcgctccccggaaaagaaggcaacagaagatgaaggctcagagcaaaagattccagaagccaccaatcgtagggtgtgggaactctcaaaggctaacagcagatttgcgacgacattttaccaacatctagctgattctaaaaacgacaacgacaatatcttcctttcccctctgagtatctccaccgcctttgctatgaccaagctcggcgcgtgtaacgacaccctccaacagcttatggaggtcttcaagtttgacaccatctctgaaaagactagcgatcagattcacttcttcttcgcgaagctgaactgccggctgtacaggaaggcaaacaagagctccaagttggtctccgccaataggttgttcggagataagtctctgaccttcaacgagacctatcaagacatctcagagctggtatacggcgcaaaacttcaaccactggattttaaagagaacgcagagcagtcgagggccgcaattaacaaatgggtcagcaacaaaacagagggtagaataacagacgtgatccctagcgaggccatcaatgagcttacagtcttagtgttggtgaacactatatactttaaaggattgtggaagagcaaattttctcctgagaacactcggaaggaacttttctataaagctgacggggagtcctgctcggcctctatgatgtaccaggaggggaaatttcgataccgtcgggttgcagaaggcacccaagtcttggagctccccttcaaaggagacgacatcacaatggtgctgattcttcctaaacccgagaagagcttggcaaaagtcgagaaggagctcacacccgaagtgctgcaggagtggcttgatgaactggaggagatgatgctagtggtgcacatgccacggtttcggatagaagatggattttctctcaaagagcaactgcaggacatgggcctcgtggacctttttagcccggagaagtccaaactgccaggtatagttgccgaaggcagagatgatctttatgtgagcgatgcatttcataaggccttcttggaagtaaacgaggagggatcagaggcggctgctagtacagctgtggtcatcgcaggcagaagcctcaaccccaaccgggtgaccttcaaagctaacaggccatttttagttttcatccgcgaggtgccactcaataccatcatctttatgggcagggtggctaacccttgcgtgaaa

SEQ ID NO: 18907 - DNA, 1392 bp, Artificial Sequence
  Description of Artificial Sequence: Synthetic coding sequence
atgtacagcaatgttattggaactgttactagcgggaaacgaaaagtttatcttctatcacttcttctgatcggcttctgggattgtgtgacttgccatgggtctccggttgacatctgtaccgctaaacccagagatattcctatgaaccctatgtgtatttaccgttcccccgaaaaaaaagccacagaagatgaaggctctgaacagaagataccagaagcaaccaacaggcgcgtctgggagctgagcaaagcgaactctcgatttgcaaccacattctaccagcatttggcagacagcaagaacgacaacgacaacatatttctatcccccttgtccatctctacagcatttgctatgacgaaactgggggcctgtaatgacactttgcagcagctgatggaggtgtttaagtttgatactatttccgagaaaacctctgaccagatccacttcttcttcgccaagctgaattgtcgcctgtataggaaagctaataaatctagtaaactggtgtcagcaaaccgcctgtttggcgacaaatcactgacattcaacgaaacttaccaggatatatctgagttagtttacggcgctaaactgcaaccactggacttcaaagagaatgcagagcagtctagggccgccattaacaagtgggtgagcaataaaactgaagggcggataactgacgtgatcccatcagaggccataaacgaactgaccgtcctggtgctggtgaataccatctacttcaagggcctctggaagtctaaatttagcccagagaatacgcgcaaggagctgttttacaaggccgatggcgagtcttgctccgcgtctatgatgtatcaagaagggaaattccggtaccggagagttgcagagggtacccaagtgctagagctacccttcaagggggacgacattacaatggtgcttattctgccgaagccagaaaagagccttgcaaaggtagagaaggaactcacgccagaggtcctccaagagtggcttgatgaactggaagaaatgatgctggtggtccacatgccacggtttcgaattgaggatggatttagtttgaaggagcaactacaggatatgggtttggtggacttattctctcccgaaaagagcaagctacccgggatcgtcgctgagggcagggacgatctgtacgtgtctgacgcctttcataaagcttttttggaggtgaacgaagaggggagcgaggccgccgcctcaactgctgtcgtgatcgctgggcgcagcctgaaccccaatagggtgacattcaaagctaatcggccatttctggtgtttatccgtgaggttccactgaatacaatcatattcatgggaagggtggccaacccatgtgtcaaa

SEQ ID NO: 18908 - DNA, 1392 bp, Artificial Sequence
  Description of Artificial Sequence: Synthetic coding sequence
atgtattctaacgtgattggcacggttaccagtggaaagagaaaagtttacttactatctcttctgttaatcggtttttgggattgcgtcacctgtcacggctctcccgtggatatttgtaccgcaaagcctcgagacattcctatgaatcctatgtgtatttaccgctcacctgaaaaaaaggcgactgaagacgagggttccgaacaaaagattcctgaagcgacgaatcgtcgcgtatgggaactgagcaaagctaattctcgttttgcgacgacattttatcagcatttagccgattcaaaaaatgacaacgataacatttttttatcgccgctttccatcagcaccgcgttcgcgatgactaaacttggagcttgtaatgatacacttcagcaattgatggaagtctttaagtttgacacaattagcgaaaaaacttctgatcaaattcatttctttttcgcaaagttaaactgtcgactttatcgtaaagctaacaaatcatcaaaactcgtgtcagctaaccgcctgttcggagataaatctctgacgttcaatgaaacgtaccaagacatttcagaacttgtttatggagccaaactgcagcctttagattttaaagagaacgctgaacaatcacgagctgcgataaataaatgggtttcaaataaaacggaagggagaatcacagacgttatcccctcagaggcgatcaacgagctaacagtcctggtacttgttaacaccatctattttaaaggcttatggaaatcaaaattttccccagaaaacactagaaaagaactgttttataaagcagatggcgagagttgtagcgcatcaatgatgtaccaagaaggaaaatttcgttaccgtcgcgtagcggaaggcactcaggttttggagcttccgtttaaaggtgacgacattacgatggttctaatcttaccgaaaccagagaaatctcttgcaaaagttgaaaaagaactcacaccggaagttcttcaggaatggttggacgagttggaagaaatgatgttagttgtacatatgcctagattccgcatcgaagacggattttcattaaaagaacagcttcaggacatgggattagtggatttgttttctccggaaaaatcaaaactgcccggtatcgtcgcggagggcagagacgatctttatgtcagtgatgcgttccacaaagcgtttctggaagtgaacgaagaaggaagcgaggcggcagcgtcaacagcggtagtcattgcaggcagaagtttaaatccgaatcgtgttacatttaaagcgaaccgcccgtttttagtgtttatccgtgaggtgccactgaatacaattatttttatgggtcgtgtggctaatccgtgtgttaaa

SEQ ID NO: 18909 - DNA, 1392 bp, Artificial Sequence
  Description of Artificial Sequence: Synthetic coding sequence
atgtactctaacgtcatagggaccgtcacctctgggaaaaggaaagtgtatctactgtctctgctgctcatagggttctgggactgtgtgacctgccatggtagccccgtcgacatatgcaccgccaagcccagggacattcctatgaaccctatgtgtatatataggtccccggaaaagaaagctactgaggacgagggcagcgaacaaaagattcctgaagcgaccaataggcgggtatgggagctttcaaaggctaattctaggttcgccacaactttttaccaacatctggctgatagcaaaaacgataacgataacatcttcttgtcacccctcagcataagcaccgcttttgctatgaccaagcttggcgcttgtaatgacacattgcagcagttgatggaagtctttaagtttgacacaattagcgaaaaaacgtcagaccagatacatttcttctttgctaagctgaattgtaggctgtaccgtaaggcaaacaaatcatctaaactcgtgtccgccaaccggctctttggcgataagtcactgacatttaacgaaacttaccaagatatttcagagctcgtatacggcgcaaaactccagcccctcgatttcaaagagaatgctgaacaatctagggcagccattaacaaatgggtttccaataaaacggaggggcgcatcacagacgtgatccccagtgaggccatcaacgaattgaccgttctagtgctggtcaacacaatctacttcaagggcctttggaaatcaaaattctcgcccgaaaacacacgaaaggagttgttttacaaggcggatggcgagtcctgctctgcctcgatgatgtaccaagagggcaaatttaggtaccgtcgggtggctgagggaacccaggtgctggagctccctttcaagggagatgatatcactatggtgttaatcctcccaaaaccagagaagagtctagcgaaggtggagaaagagttgaccccggaagtgttacaggagtggctggatgaactggaagagatgatgctggtagtgcacatgccccgttttcgaatcgaagacggcttttcacttaaagagcagctccaagacatgggactcgtcgaccttttttcccctgagaagtctaaactgcctggtatcgtggctgaggggcgcgacgacctctacgtgagcgatgcttttcataaggcctttctcgaagtaaatgaggaagggagtgaagctgctgcctcaacggcggtagtgatcgcaggtcggtccttaaatccgaaccgggtaacctttaaggcgaaccgaccttttttggtgtttataagggaggtgccactgaacactatcatctttatgggacgagtggccaacccatgcgttaag

SEQ ID NO: 18910 - DNA, 1392 bp, Artificial Sequence
  Description of Artificial Sequence: Synthetic coding sequence
atgtacagcaacgtaatcggaactgtgacctctggcaagcgtaaggtgtacctgctgtcattgttgctgatcggattttgggattgtgtcacctgtcacggcagcccagtcgacatttgcacagctaagccaagggacatcccaatgaatccaatgtgtatctacaggtccccagaaaagaaggccaccgaggatgaaggatctgagcaaaaaatccctgaggctactaaccgtcgtgtgtgggagcttagcaaagctaactctcgcttcgcaactaccttctaccaacacttggccgactctaagaacgataacgataacatcttcctctcccccctgtctattagtaccgctttcgcaatgaccaagcttggagcctgcaacgacaccctgcagcagctgatggaggtattcaagttcgataccatttctgagaaaactagcgaccagatacacttttttttcgccaagctcaactgccgtttgtaccgtaaagccaacaagtcctcaaagctggtgtctgctaacaggttgttcggcgacaagtccctgaccttcaatgaaacatatcaggatatttcagaactggtctatggagctaaactgcaacctctcgattttaaggaaaatgcagaacagagtagagccgctataaataagtgggtttcaaacaagacagagggtagaattacagacgtgataccatccgaggccatcaacgagctgaccgttctggtacttgtgaacaccatctactttaagggcttgtggaagtcaaagttctctcctgagaatacccgcaaggaattgttctacaaggccgatggcgagtcttgctcagcttctatgatgtaccaagagggcaagtttaggtacagaagagtagcagagggaacacaggtgctcgagctgccttttaagggcgacgacatcaccatggtcctcatcttgccaaagcccgaaaaaagcttggctaaggtcgagaaggaactcacaccagaggtcctccaggagtggcttgatgaactggaggaaatgatgctggtggtgcatatgcctaggttcaggatagaggatggcttctccctgaaggagcaactgcaagacatgggactggtcgatctgttctctccagaaaagtccaagctgccaggcatagttgctgaaggcagggatgatctgtatgtttccgatgccttccacaaggcttttcttgaagtgaacgaggagggttccgaggctgccgcttctaccgcagtagtgattgccggacgtagtctcaacccaaacagggtgacattcaaagcaaatcgccctttcctcgtgttcattagggaggtgcccctcaacaccatcatcttcatgggacgtgtggcaaacccttgtgtgaag

SEQ ID NO: 18911 - DNA, 1392 bp, Artificial Sequence
  Description of Artificial Sequence: Synthetic coding sequence
atgtactccaacgttatcggcacagtcaccagcggtaagagaaaagtctatctgctcagcctgctactcatcggtttctgggactgcgtgacctgtcatggcagccctgtagacatctgcaccgccaagccacgggatattccaatgaacccgatgtgcatctaccggagtcccgaaaaaaaggctacagaagatgaggggtctgagcaaaaaatcccggaggcaaccaacaggagggtttgggaactaagcaaggcgaatagccggttcgcgacaaccttctaccaacatttggcagactctaagaatgacaatgacaatatctttctgagtcccctgagtatcagtaccgcgttcgctatgacgaagttgggtgcgtgcaacgatacactacagcagttgatggaggtgtttaaattcgacacaattagtgagaaaacaagtgatcaaatccatttttttttcgccaagcttaactgccggctttaccgcaaagccaacaagtcgtccaagctggtcagcgcgaatcggttgttcggcgacaagagtttaacatttaatgagacctatcaggacatttctgaactagtgtacggagcaaaactgcaacctctagatttcaaggaaaatgctgaacagagccgcgcagccatcaataagtgggtgtcaaacaagaccgagggtagaataaccgatgtcattccaagcgaggcgatcaatgagttaacggtgctggtactggtgaacacaatttacttcaaaggcctgtggaaatctaagttctccccagagaacactaggaaagaattgttctataaggccgatggtgagtcttgctcagcaagtatgatgtaccaggaagggaagttccggtacagacgcgttgccgagggcacccaagtgttggagctgccttttaagggggatgatatcactatggttctgattctgcccaagcccgagaagtctctggccaaagtagaaaaggagcttacccctgaagtgctgcaggagtggctagacgagctggaggagatgatgctcgtggtgcacatgccacgcttcaggatcgaggacggattttccctgaaggagcagctgcaggacatggggctcgttgatctctttagcccagagaagtcgaagttgcctggaattgtggcagaggggcgagacgacctgtacgtaagtgatgccttccacaaagccttcctagaagtgaacgaagaaggatccgaggcagccgcctccacagctgtagtcatcgcaggaaggtccttgaatccaaatcgggtaactttcaaggcaaatcgacctttcctagtgtttatcagggaagtgccactcaatacaataattttcatggggcgggtggcaaatccgtgcgtaaaa

SEQ ID NO: 18912 - DNA, 1392 bp, Artificial Sequence
  Description of Artificial Sequence: Synthetic coding sequence
atgtacagcaatgtcatcggaacagtaacctcgggcaaacgcaaggtttatctcttgagcctactgctaattggcttttgggactgtgtgacgtgtcatggctctcctgtcgacatttgtactgccaagccgcgtgatatccctatgaaccctatgtgcatttatagatccccggagaagaaggccacggaagacgagggcagcgaacaaaaaatccccgaagcgactaatcgacgagtttgggaactatccaaagcaaattcgcgattcgccaccaccttctaccaacacttggctgattcgaaaaacgacaatgataacatatttctctcgccgctctcaatttccacggctttcgccatgactaagctgggcgcgtgtaacgacactctccagcaactcatggaagtcttcaaatttgacacgatttcagaaaaaaccagcgatcagatccatttttttttcgcgaaactgaattgccggctttatagaaaggctaacaaatccagcaagcttgtttcagccaataggctgtttggagacaagtctctgacttttaacgagacttatcaggatatcagtgaactagtgtatggcgctaagctacaacccttggacttcaaggagaatgcggaacagtcccgggcggcaataaacaagtgggtgagtaacaagacagagggccgtatcactgatgtgatcccttccgaagctattaatgagttgaccgttttagtccttgttaacactatctattttaaggggttgtggaaatccaaattcagccctgagaatactcggaaggagctcttttacaaagcggatggcgagagttgcagtgctagcatgatgtaccaagagggaaagtttcggtataggcgcgtcgcagaaggaacgcaagttttggaactgcccttcaaaggagatgatatcactatggttttgatactccctaagccagagaagtctcttgcaaaggtagaaaaggaattgactcccgaggttctccaggagtggcttgacgaactggaagagatgatgttggtcgtccacatgccccgcttccgcatcgaggacgggttttcccttaaggagcagctgcaagatatgggtttggttgatctgttcagccccgagaagagtaaactcccgggcattgtggctgagggccgcgatgacttatacgtctctgacgcctttcataaagcgttcctggaagtcaacgaagagggttctgaggccgcagcatccacggcagttgttattgccggtcgcagccttaacccaaaccgtgtgacgtttaaggcaaatcgtccgttcttggtcttcattagggaggtcccattgaacacgattatttttatgggtagggttgcaaatccctgcgtcaag

SEQ ID NO: 18913 - DNA, 1392 bp, Artificial Sequence
  Description of Artificial Sequence: Synthetic coding sequence
atgtactctaacgtaatcggaacagtgacttcaggaaaacgaaaggtgtatctccttagtttacttctcatcggattctgggattgtgttacatgccatgggtcgcctgtggatatatgtacagccaagcctcgggatatccctatgaatccaatgtgcatctacaggtcgcccgaaaaaaaagccacagaggacgagggatcagagcagaaaatacctgaagccactaaccggcgcgtatgggaactctcaaaagcaaattcccggttcgctacaacattttatcaacatcttgcggattctaaaaatgataatgataatatatttctttcaccactgtcaatatcgacagcttttgccatgacgaaactcggagcatgtaatgatactttacagcagcttatggaagtcttcaaatttgatacaatctctgaaaaaacatcagatcagatccatttctttttcgcaaaactcaattgtagactctatagaaaagcgaacaagtcatcgaaacttgtgtccgccaaccgactcttcggagataaaagtctgactttcaatgagacgtatcaggacatcagtgagcttgtgtatggggcgaaattacagcccctcgattttaaggaaaatgccgagcagtctcgggccgccatcaataaatgggtgtccaacaaaacagaaggaagaattactgatgtgataccatccgaagcaataaacgaattgactgtgctcgtgttagtcaatactatatacttcaaaggattgtggaagtccaaattcagtcctgagaatacaaggaaagaacttttctataaagctgacggggaatcgtgttctgcttctatgatgtatcaggaggggaaatttcggtatcggcgggtcgcagaaggaactcaggtactggaattgcctttcaaaggggacgatatcacaatggtactaatattgccgaaacccgagaagtctctcgctaaagtggaaaaagagctcacacccgaagtgctccaggaatggctggatgaactggaagaaatgatgttagtggtgcacatgccacggttcagaattgaagatgggtttagtttaaaagaacagctacaggatatgggacttgttgatctgttcagtcccgaaaaatccaaactacccgggatagtcgctgaagggcgcgatgatctctacgtctctgatgcatttcataaagcatttcttgaagttaacgaggaaggatctgaggctgcagcttctactgccgtagtaatcgctggaagaagtctcaatcctaatcgcgtgacatttaaagccaatcggcctttcctggtctttatcagggaagtacctctcaacacaataatctttatggggagagtggccaacccctgtgtgaaa

SEQ ID NO: 18914 - DNA, 1392 bp, Artificial Sequence
  Description of Artificial Sequence: Synthetic coding sequence
atgtacagcaatgttattggcacagtcaccagcggaaaacgcaaggtgtatctgctgagcctgcttctcattggtttttgggattgtgtcacctgccacggtagccctgtcgatatctgcacggcaaaacctcgtgacatccctatgaacccgatgtgcatttaccgctcccctgagaagaaagctacagaggacgagggttccgaacagaaaatcccagaggccactaaccgccgagtttgggaactgagcaaagcgaatagccggtttgcgaccacgttctatcagcacctggcggacagcaagaatgacaacgataacatttttctgagcccgctgagtattagcacggccttcgccatgacgaaactgggggcgtgcaacgataccctccaacagctcatggaagtttttaaatttgatacgatcagcgaaaaaaccagcgaccagattcattttttctttgctaaactgaactgccgactgtaccgcaaagcaaataaaagctctaaactggtttctgccaatcggttgtttggtgacaagtccctgacctttaacgagacctatcaggacatttctgagctggtttacggtgccaaacttcaacctttggattttaaggagaacgctgagcaatcacgcgccgcaatcaacaagtgggttagcaacaaaaccgagggtaggattacggacgtcattccgagcgaggcgatcaatgagctgactgtgcttgtcctggtgaacaccatctatttcaagggcctttggaaatcaaaattcagcccggaaaacacgcgcaaagagctgttttacaaagccgatggagagtcctgctccgcgtccatgatgtaccaggaggggaagtttcgctaccggcgcgtcgctgagggtacgcaggtgctggaactgcctttcaagggtgatgatatcaccatggtgctgatcctaccaaaaccagagaagtcactggcgaaggttgaaaaagagctgaccccagaggtgctccaggagtggctggacgagctggaggaaatgatgctggtcgtgcacatgcctcgctttcgcatagaagacggcttttcgctgaaggagcagctgcaggatatgggcctggtggacctgtttagtcctgaaaaatctaagctgccaggcatcgtagctgagggtagagacgacctgtacgtcagcgatgcattccacaaagcgtttctggaggtcaatgaagaaggttctgaggcagccgcaagtaccgcggtggttattgccggccgttcgctgaatcctaaccgtgtcacttttaaagcaaaccgaccttttctggtgtttatacgtgaagtgccactgaatacgatcatcttcatgggtcgcgtggccaacccttgtgtaaag

SEQ ID NO: 18915 - DNA, 1392 bp, Artificial Sequence
  Description of Artificial Sequence: Synthetic coding sequence
atgtacagcaatgttatcggcactgtgaccagcgggaaaagaaaggtgtacctgctaagtctacttctaatcggcttctgggactgtgttacctgtcacggcagcccagtggacatttgcacggctaaaccacgcgatataccgatgaatccaatgtgtatctatagatctcccgaaaagaaagcaactgaggacgaaggctctgagcagaaaatccctgaggcgaccaacaggagagtgtgggaactctctaaggccaacagccggtttgccacaaccttctatcaacacctcgccgattcaaaaaacgacaatgacaatatattcttgtcaccgctaagtattagcaccgcctttgctatgacaaagcttggcgcgtgtaatgacacgttacagcagttaatggaggtgtttaagtttgatacaatcagcgaaaagacctcggatcaaatacactttttctttgccaaattaaactgtcggctgtaccgtaaggctaacaaaagctccaagttggtgtcggcaaacaggctgtttggggataagagcttaacatttaatgaaacctatcaggacatctccgaactggtgtacggcgccaagctacagcctttggatttcaaggaaaacgcggaacagtcacgagcggctatcaacaaatgggtgtctaataagactgagggcagaattacagatgtcatcccctcggaggcgataaacgaactcacggttctggtgctggtgaatacgatctacttcaaggggctttggaagtctaagtttagccctgaaaacactcggaaagaacttttttacaaagccgacggcgaatcatgctcagcaagtatgatgtaccaagagggcaaattccgctaccgccgtgttgctgaaggcacacaggtactagaactcccattcaagggcgacgatatcacaatggtactgatcctcccgaagcctgagaagagtcttgcaaaggtagaaaaagaactgaccccggaagtgttgcaggagtggcttgacgagctggaggagatgatgttggtggtgcacatgccccgttttaggatagaggatggtttttctcttaaggagcagcttcaggacatgggcctagtggatctgttcagcccagagaagtccaagctccctggcatcgtggccgaaggcagggacgatctgtacgtatccgatgcctttcataaggcgtttctggaggtgaacgaagaagggagcgaagctgctgcctccaccgcggttgtaatcgcaggccgttctctaaacccaaatcgcgtgacattcaaagcgaataggccgtttctggtgttcatccgagaggtacctctgaataccataatctttatgggacgcgtggcaaacccctgtgtgaaa

SEQ ID NO: 18916 - DNA, 1392 bp, Artificial Sequence
  Description of Artificial Sequence: Synthetic coding sequence
atgtatagtaacgtcatcgggactgtgacatccggcaaaaggaaggtatatcttctcagcctgctgctgattgggttttgggactgtgtaacctgccacggctcacccgtggatatttgtaccgccaagcctcgggacatccccatgaaccccatgtgtatctaccgatcccctgagaagaaggcaactgaggacgaggggagcgaacagaagatccccgaagcaaccaaccggagagtgtgggagctcagcaaggcaaattccaggtttgccacgaccttctaccagcatctggccgacagcaagaatgataacgataatattttccttagccctctgagcatcagtacagccttcgcgatgacaaagctcggagcgtgcaatgacactttacagcagcttatggaagttttcaaattcgatacaatttctgaaaagacttccgaccagatccatttctttttcgccaaattaaattgtcgcctctacaggaaggcaaataaatccagcaagctggtttccgccaaccgcctgttcggggacaaatccctgacatttaacgaaacttaccaggacatcagcgaactcgtctacggcgcaaaattacagccgttagatttcaaggagaatgcagaacagtctagagcggcaattaataagtgggtgagtaacaagacagaagggcggatcaccgatgtgatcccctctgaagcaatcaatgagctcactgtgctcgtgttggtcaacacaatctatttcaagggactttggaaatccaaattctctcctgagaatactcgtaaggagctcttttataaggccgacggtgagagttgctccgcctctatgatgtaccaagaagggaagttccgctatcggcgtgtggctgaaggtactcaggtgttggagctaccttttaaaggggatgatatcactatggttcttattctgccgaagcccgagaagagtctggccaaagtcgagaaggaactgacccccgaggtcctacaagagtggctggatgaactagaagaaatgatgctagttgtccacatgcctcgtttcaggattgaagacgggttttcccttaaggagcagctgcaagatatgggccttgtggacttgttcagcccagaaaagtccaaactgccaggcattgtagcagaaggaagggatgatctgtacgtgtcagacgcctttcataaagctttcctggaagtaaacgaggaaggctctgaagccgccgcctcgacagcagtggtcattgcgggccggtctttgaaccctaacagagtaaccttcaaagctaaccggccattcctggtgttcatccgcgaagtaccccttaacacgatcattttcatggggcgcgtggcaaacccctgtgtcaaa

SEQ ID NO: 18917 - DNA, 1392 bp, Artificial Sequence
  Description of Artificial Sequence: Synthetic coding sequence
atgtattccaacgttattggtactgtgaccagcggcaagcgcaaggtctacttgctgtcgctactgctgatcggcttttgggactgcgtgacctgccacggatcgcctgttgacatctgcactgcgaagccgagggatatccccatgaatcccatgtgcatctacaggtcccccgagaagaaggcgaccgaggacgagggcagtgaacagaagatccccgaagctacaaatcgccgagtgtgggagctgtccaaagccaatagcagattcgccactaccttctaccagcacttggccgactccaagaatgataacgacaatatctttctcagccccctatctatcagcactgctttcgccatgacaaaactcggtgcttgcaatgacactctccagcaactgatggaggtgttcaagtttgatacaatttctgaaaagactagcgaccagatccacttcttcttcgcaaagctgaattgccgcctgtacagaaaagctaacaagagttccaaacttgtgagcgcgaatcgattgtttggcgacaagagtctcactttcaacgaaacttatcaggacattagcgaactggtgtacggcgcgaagctgcagccactggatttcaaggagaatgctgagcagagtcgggccgccattaacaaatgggtcagcaacaaaacagaagggagaataacagacgtgattcccagcgaggccatcaatgagctgaccgttctggttcttgtcaacacaatctacttcaaaggtctgtggaagtccaaattttcacctgagaacacccggaaggagctgttctacaaggccgatggggaaagctgcagtgctagtatgatgtaccaggaaggcaagttcaggtaccgtcgagtggcagaaggaacccaagtgctggaactcccatttaaaggcgacgacattacaatggttctgattctcccgaaacctgaaaagtctctggccaaagtggaaaaagaactcacccctgaagtgctgcaggagtggctggatgaactggaggaaatgatgctggtcgtgcacatgccccggttccggattgaagatggcttctcccttaaagagcaactgcaagatatggggttggttgatttgtttagcccggaaaaatcaaagcttcctggaattgtagcggagggcagagacgacctgtacgtgagcgacgctttccataaggcttttctagaggttaatgaagagggcagcgaagctgccgcctcaacagccgtggtcattgctggtaggtctctaaatcctaaccgagtgaccttcaaggccaacagaccattcctcgtgttcatccgtgaggttccattgaatacaatcattttcatgggaagagtggccaatccttgtgtaaaa

SEQ ID NO: 18918 - DNA, 1392 bp, Artificial Sequence
  Description of Artificial Sequence: Synthetic coding sequence
atgtactccaacgtgataggtacggtgactagtggcaagaggaaggtgtatctgctgtccctgctactgataggtttctgggattgcgtgacgtgtcatgggagcccggttgatatctgtactgccaaaccccgggatattcctatgaatccaatgtgcatctacagatcgccagaaaaaaaggccacagaggacgaaggctctgagcaaaaaatccctgaagcgacaaacaggagagtttgggagttatctaaagccaacagccgcttcgcaactaccttttaccagcatctggctgattccaagaacgacaatgataatatttttttgtcgcctttgtctatctctaccgccttcgccatgacgaagttgggggcgtgcaatgacaccttgcagcagctgatggaggtgtttaaattcgacaccatctccgagaagacatccgaccagattcacttcttcttcgcgaagctgaattgccggttatacaggaaggccaataagagcagcaagctggtgtcagccaaccggctatttggcgataaaagcctgaccttcaacgagacatatcaggacatttccgaacttgtctacggggcaaaattgcaaccgctcgacttcaaagagaacgcagaacagtctagagccgctataaacaagtgggtgtcaaataaaacagaggggcgcatcaccgacgtgattccaagcgaggccattaatgaacttacggtgcttgttctcgttaataccatatacttcaaaggcctgtggaagagcaaattcagtcccgagaatacgcggaaagaactcttttataaagcagacggcgagtcatgtagcgcctctatgatgtatcaggaagggaaattccggtatagaagggttgccgagggaacacaggtgttggagcttccatttaagggagatgacatcaccatggtcctcattttgcccaagccggagaagtctctggctaaagtcgagaaagaactaacacccgaggtgctgcaggagtggctggacgagctggaggaaatgatgctggttgtccacatgccgaggttcaggatcgaggatggttttagtctgaaggaacaattgcaagacatgggactggttgatctctttagcccagagaagtctaagcttcccggaattgtcgcagagggacgtgatgatctgtacgtatcagatgcctttcataaggcatttctggaagtcaacgaggaagggagtgaggccgcagctagtacggcagtggttattgctggcaggtctttgaatccgaacagggtgaccttcaaagccaataggcctttcctggtgtttattagggaagttcctctcaataccatcattttcatgggccgtgtggctaacccttgcgttaaa

SEQ ID NO: 18919 - DNA, 1392 bp, Artificial Sequence
  Description of Artificial Sequence: Synthetic coding sequence
atgtactccaatgtaatcgggaccgttacaagcggcaaacgaaaagtctacctgctatctcttttactcatcggtttctgggattgtgtgacatgtcacggttcgccagtggatatatgcactgccaaaccacgagacatacctatgaatcctatgtgtatataccggagcccagagaagaaagcaactgaggatgaaggctcagagcagaagattccggaagctacgaatcggcgcgtgtgggagctctcaaaagccaacagcaggtttgccaccacgttttatcaacacctggccgatagcaagaatgacaacgacaacatcttcttatcaccactgtctatctctactgccttcgcaatgactaagctgggggcttgtaacgacacactgcaacagctgatggaggtgttcaagttcgacaccatcagcgaaaagacctccgaccagattcacttcttcttcgctaaattaaactgcaggctctaccgcaaggcgaacaagagtagtaagttggtttctgcaaaccgcctatttggggataagtctctgacattcaatgaaacgtaccaggacattagtgaattggtgtacggagccaagcttcagccactcgatttcaaggaaaacgcggaacaatctagggccgctatcaataagtgggttagcaacaagaccgaaggccgcataacagatgttatcccaagtgaagcaatcaacgaacttacagtgctggtgttagttaatactatctatttcaagggcctgtggaaatcgaaattttctcccgagaacacacggaaagagctgttctataaggctgacggtgaatcgtgctcagctagcatgatgtaccaagagggcaagttccgctatagacgagtcgctgaggggacgcaggtgcttgaactgccattcaagggagacgatatcacaatggtgctgattttacctaaaccggaaaaatccctagcaaaggtcgaaaaggaactcacccctgaggtgctgcaagaatggctcgacgaactggaagagatgatgctggtcgtgcacatgccgcgatttagaatcgaagatggttttagtctgaaggagcagttgcaggacatggggctggtggatttgttttctcccgaaaagtcaaaactccctggaatcgtggccgagggacgggacgacctctatgtgtcagacgcgttccacaaggcattccttgaggtgaatgaggaagggtctgaagcggctgctagcacagctgtggtgatagctggtcgttccttgaacccaaatagggtgaccttcaaggcgaaccgtccctttctcgtatttattcgcgaagttcccctgaatacgatcatcttcatgggacgagtggccaacccttgtgtcaaa

SEQ ID NO: 18920 - DNA, 1392 bp, Artificial Sequence
  Description of Artificial Sequence: Synthetic coding sequence
atgtactccaacgtaataggcacagtgacatccggcaagagaaaggtgtacctgttgtcgttattgctgatcggcttctgggattgtgtgacgtgccacggatcgcccgtcgacatttgcacggctaagccccgcgatattccaatgaatccgatgtgtatctatagatcccctgagaaaaaggctaccgaggacgagggcagtgaacagaagatcccagaagcaacaaatcggcgcgtctgggagttatcaaaggcgaacagccgttttgcgacgaccttctatcagcacctggccgactccaaaaatgataacgataacatattcctctcgccactgagcatttcgacggcctttgccatgactaagctgggcgcctgcaacgataccttgcagcaactgatggaagtgttcaagttcgacactatttcagagaaaacgagcgaccagattcacttttttttcgctaagttgaattgtcggttgtaccgcaaggcgaataagtcctcaaagcttgtgtcggcaaaccgactgttcggcgacaagagcctgacgttcaatgagacgtaccaagatatctccgagctcgtatacggcgccaagctccagccgttggactttaaagagaacgcggagcagagtcgcgctgcaataaataaatgggtctcaaataagaccgagggacgcattacggatgttatacctagtgaggcgatcaacgagttgactgtgctggtgctagtcaataccatctacttcaagggtttatggaagtcgaagttcagccctgagaacacgcggaaggaacttttctacaaggctgatggcgagtcgtgctccgcgtccatgatgtaccaagagggcaagttcagataccgacgcgtggcggagggcacgcaggttctggaactgcctttcaagggagatgacatcaccatggtcctgatcttgcctaaaccagagaagtccttggctaaagtcgagaaggagctgactccggaggtccttcaagagtggcttgacgagctcgaagaaatgatgcttgttgtccatatgccgcgtttccgtattgaagacggttttagtcttaaggagcagttgcaggacatgggtctggtcgacctcttcagccccgaaaagtcgaaactcccaggcatcgtcgccgaaggaagggatgatttgtacgtgagtgacgcatttcataaagcatttctggaagtgaacgaggagggcagtgaagctgctgcctcaaccgccgtcgtcattgccggaaggtcgcttaacccgaatcgtgtaacttttaaagctaatcgcccattcctggtctttatccgagaggtaccgctgaacaccatcatcttcatgggacgtgtggcaaacccgtgcgtaaaa

SEQ ID NO: 18921 - DNA, 1392 bp, Artificial Sequence
  Description of Artificial Sequence: Synthetic coding sequence
atgtattctaacgtcatagggacggtgacaagtggcaagcgaaaagtgtatctgctctctttgctactgataggcttctgggactgcgttacgtgtcacggaagtccagtggatatctgtacagccaaacctcgtgatatccctatgaaccccatgtgtatttatagatctccagagaagaaggccaccgaagatgaagggtccgagcagaagattccagaggcaacaaatcgtagagtttgggagctgtccaaagcgaatagccgcttcgcaacgacgttctaccagcatctcgccgattctaaaaacgataatgacaacattttcctttcgcccctgagcatctccaccgccttcgcaatgacgaagctaggagcatgtaacgatacgctgcagcaactgatggaggtatttaaatttgatactatcagtgaaaaaacatccgatcaaatacacttctttttcgcaaaactgaattgccggttgtacagaaaggcaaacaagagctccaagctcgtgtcagccaatagattgttcggtgataagtctctgacgtttaacgaaacatatcaggacatctctgagttagtgtatggcgcaaagttgcagcccctcgactttaaagagaacgcggagcagtccagagccgcgatcaataagtgggtgagcaacaaaacagagggcaggattaccgatgttattccatcagaagccatcaacgaacttacggtcctcgtgttagtaaacacgatatactttaaggggctctggaaatctaagttctcaccagaaaacactagaaaagagctgttctataaggccgacggtgagtcatgtagtgcaagtatgatgtatcaagaggggaaattcagatacaggcgggtagccgaaggcactcaagtactagagcttcccttcaagggtgacgatataaccatggtgttgattcttccgaagcccgagaagtctttggctaaagtggagaaggaattgacccctgaggttcttcaggaatggttggatgagctagaggagatgatgctagtggtgcacatgccacgcttccggatcgaagacgggttctctctaaaggagcaactccaggacatgggcttagtggacctgttttccccagagaaaagcaagctgccggggatcgtggctgaaggacgcgacgatctctacgtatctgatgcatttcataaggcctttttggaggtgaatgaggagggttcagaagctgccgcgagtaccgccgtcgtgatcgccggcagatcattgaaccctaacagagtgaccttcaaggctaacaggccttttttagttttcattagagaggtgcctttaaatactattatattcatgggcagggtcgccaatccgtgtgtgaag

SEQ ID NO: 18922 - DNA, 1392 bp, Artificial Sequence
  Description of Artificial Sequence: Synthetic coding sequence
atgtacagcaatgtgatcgggactgtgacttcaggcaagcgcaaagtttacctgctgtcactgctcttgatcggattttgggattgtgtgacatgccatggatctccagtcgacatatgcaccgctaagcctcgagatatcccaatgaacccaatgtgtatctataggagccccgagaaaaaggccacagaggatgagggtagcgagcagaagattccagaggccacaaatagacgcgtctgggagctctctaaagctaatagtcgtttcgccactactttctatcagcacctcgccgacagtaagaatgataacgacaatattttcctcagtcctctgtccatatcgacagcctttgctatgacaaagctcggggcatgcaacgacaccctgcagcagctgatggaagtctttaagttcgataccatttccgaaaaaactagtgaccaaatccattttttttttgccaagctgaactgcaggctgtatagaaaggctaataaaagttctaagttggtaagcgcaaaccggctcttcggggacaaaagcctgacattcaatgagacatatcaggacatctccgaactagtctacggggccaaactgcaacccctggactttaaagagaacgccgaacagtcaagagcggcaatcaataaatgggtttctaacaagacagagggaaggatcaccgacgtcataccaagtgaagctattaatgagctgacagtcctagtgttggtaaatactatctacttcaaaggcctgtggaaaagtaaattctctccagagaacacgagaaaagaattgttttacaaggcggacggagagtcctgttcggcatccatgatgtatcaagaaggcaagttccggtatagaagagtggccgaaggaacccaggtgctggaattaccgttcaagggtgatgatataacaatggtcttgatattgcccaagcctgagaaatcgcttgccaaggtggagaaggaactgacaccagaagtgttacaggagtggctcgacgagctggaggaaatgatgctagtggtgcacatgcctcggtttagaattgaggacggttttagtctgaaagagcagctgcaggatatgggcctggtggacctgtttagtcccgagaagtctaagttaccaggtattgtggcagagggccgcgacgacttatatgttagtgatgcattccacaaggcctttcttgaagtcaatgaggaggggtctgaggccgcagcaagtacagcagttgtcattgcagggcggtccctgaaccccaatagagttactttcaaggctaatcgacccttccttgtattcatcagggaagtgcccctaaacaccatcattttcatggggcgggtggcaaatccctgtgtgaag

SEQ ID NO: 18923 - DNA, 1392 bp, Artificial Sequence
  Description of Artificial Sequence: Synthetic coding sequence
atgtatagcaacgttattgggactgtgacgagcgggaagcggaaagtgtatctcctgagcctgctgctcatcgggttttgggattgcgtgacatgtcacggaagcccagtcgacatatgtacagccaaaccccgggatattccaatgaaccccatgtgtatttatagatctcctgagaaaaaggcaaccgaggatgaaggttcagagcagaagattcccgaagctacaaaccgtcgggtttgggaactcagcaaggctaatagccgatttgcaactacattctatcaacatctcgcagacagtaagaatgataatgacaatatattcctctcacctctgagcatttctacggcctttgccatgacaaagctgggggcttgcaatgacacgctgcagcagttgatggaagtgttcaagtttgatacaataagtgagaaaacgtctgaccaaatccacttttttttcgcgaaacttaactgcagactgtacagaaaagccaacaagtcttcaaaactggtgtccgctaataggctgttcggggacaaatcgttgacttttaacgagacatatcaggatattagtgaactggtgtacggggccaaactgcagccgttggatttcaaggagaacgcggaacagtcccgcgctgctatcaataagtgggtctcgaataagactgaagggagaattacggatgtcatcccctcagaagcgataaacgagctgacggtgctcgtacttgtgaatacgatttattttaaaggcctatggaaaagcaagttttcacctgagaacacaaggaaagagcttttctataaagccgacggggagtcctgctccgcatccatgatgtaccaagagggtaaatttagataccggagggtcgctgaagggactcaggtgctggaactgccctttaagggcgacgatataaccatggtgttgattctgccgaaaccagagaaatccctggcaaaagtcgagaaggaactgactccagaagtgcttcaggagtggttagacgagctcgaagaaatgatgttagttgttcacatgccccgattcaggatcgaagatgggtttagtctgaaggagcagctgcaagacatgggactcgtggatctgtttagtcccgaaaagtcgaaactgccgggcattgtcgctgagggacgcgatgacctgtatgtgagcgatgctttccacaaggcatttttggaagtaaatgaggaaggctctgaagccgcagccagcacagccgtggtgatcgccggtcgatctctgaaccccaatagagttacattcaaagccaatcgccctttcttggtgtttataagggaggtgccgctgaacaccatcattttcatgggtcgcgtggccaatccttgtgtgaag

SEQ ID NO: 18924 - DNA, 1392 bp, Artificial Sequence
  Description of Artificial Sequence: Synthetic coding sequence
atgtacagcaacgtcatcgggaccgtaacaagtggtaaacgaaaagtgtaccttctgtccctcctcctcattggcttctgggattgcgtgacttgccacggctctccagtggatatatgtacggccaagcccagggacatccctatgaatccgatgtgcatttacagatctcctgaaaagaaggccaccgaggatgaaggcagcgaacagaagattcctgaagctacaaatagacgcgtttgggaactgagcaaggcgaatagtagattcgcaaccaccttctatcagcatctggccgatagcaaaaacgacaacgataatatcttcctgagcccgctgagcatttcaactgcctttgccatgacaaaactgggggcatgcaatgacactctgcagcaattgatggaggtgtttaagttcgacactatctcagaaaagacgagcgaccagatacacttctttttcgcaaagctgaattgtagactgtacagaaaggcaaacaagagttcaaagcttgtgtccgcgaaccgtctcttcggggacaagagcctgacttttaatgaaacttatcaagacatcagcgaactcgtctacggcgctaaactgcagcctctcgattttaaggaaaacgctgagcagtcccgagctgccatcaacaagtgggttagtaataagaccgagggtcgaatcacggacgtgatcccaagcgaagccatcaacgagctgaccgtgttggtgctcgtcaataccatctacttcaagggtctctggaagtctaaattcagccctgaaaacacaaggaaggagctattctacaaagcagacggcgaaagttgtagcgcaagcatgatgtaccaggagggtaagtttcggtaccgccgtgtggcagaaggtactcaggtcctcgaactgcctttcaaaggcgacgacatcaccatggtgctcatactgccgaaacccgaaaagagtctggccaaagtagaaaaagagctgacccccgaggtcctgcaagaatggctagacgaactcgaagagatgatgctcgtggtccacatgcctcggttccggatcgaggacggatttagtttgaaggagcagctacaggacatgggcctggttgatctgttcagccccgagaagtccaaacttccaggcatcgtggcagaggggagagacgatctgtatgtaagcgacgcattccacaaagccttcctggaggtgaacgaagagggctctgaggcagccgcatccaccgctgtggttattgcgggaagatctcttaaccctaatagagtcaccttcaaggctaacaggcccttcctggtctttattcgagaggtgccgctgaatacaatcatttttatgggccgggttgcaaatccctgtgtgaaa

SEQ ID NO: 18925 - DNA, 1392 bp, Artificial Sequence
  Description of Artificial Sequence: Synthetic coding sequence
atgtactcaaatgtcatagggactgttacatctggcaaacgcaaagtgtacctgttgtcacttctgctgattggattttgggactgcgtaacatgtcatggcagtcccgtcgatatctgtactgctaaacccagagatattccgatgaacccaatgtgcatatacaggtcacctgagaagaaagcgaccgaggacgaaggctctgagcaaaagatccctgaggccacgaataggcgggtatgggaattaagcaaggcgaattccagattcgctactactttctatcaacacctggccgactccaaaaacgataacgataacattttcctctctcccctttccataagcaccgcgttcgctatgacgaagttgggtgcttgtaatgacaccctccagcagctcatggaggtgttcaaattcgacaccataagcgaaaaaaccagtgaccaaatacacttcttctttgctaaactcaattgtcggctgtaccgaaaggctaataagtcgtcaaaattagtgagcgcgaatcggcttttcggcgacaagagcctgacctttaatgagacttaccaggacatttccgaactggtgtatggcgcaaagctccagccattggactttaaggaaaatgctgagcagtcaagggccgccataaacaagtgggtgagcaacaagactgaagggcgcataacagacgtcattccatccgaggccataaatgagcttaccgtcctcgtgttggtgaacaccatttacttcaaggggctgtggaagtctaaattcagccccgagaacaccagaaaggaactgttttataaagcagacggcgaaagttgctccgcctccatgatgtatcaggagggaaagttcaggtaccgtcgagtcgccgagggcacccaggtgttagaactgcctttcaagggcgacgatatcaccatggtgctgattctaccgaaaccggagaagagtctggcaaaagtggagaaggagttaacacctgaggtccttcaggaatggttggatgagctggaggaaatgatgctagttgtgcatatgccaaggttccgaatcgaagacgggttctcactgaaggagcagctccaggacatgggactggtggatctcttcagcccagagaaatcaaagttgcctggtatcgtggccgaaggacgggacgatctgtatgtgagtgacgcctttcataaagcatttttggaggtgaacgaagagggcagtgaagcagccgccagtaccgcagtcgtgatagccggaaggagtctgaaccctaaccgagtaaccttcaaggctaacaggccattcctggtctttattcgcgaagtgccacttaatactatcatttttatgggcagagtagccaacccttgcgtgaag

SEQ ID NO: 18926 - DNA, 1392 bp, Artificial Sequence
  Description of Artificial Sequence: Synthetic coding sequence
atgtactccaatgtaatcgggacagtgacatccgggaaacggaaggtctatttgctctccctgttactcattggattttgggattgcgtgacttgtcacggttctccagtagatatctgtactgccaagcctagagatatacctatgaatcctatgtgtatctaccggtccccagaaaagaaagcaactgaggacgaagggagcgagcaaaagatcccagaagccactaaccgtcgcgtgtgggagctgtcgaaggcaaattctcgatttgcgactaccttctatcaacacctggccgatagcaagaacgacaacgacaatatttttctaagtccgctgtcgatcagtaccgcattcgcaatgacgaaattgggagcatgcaatgacaccctgcagcagctgatggaagtgttcaagttcgacaccattagcgaaaaaacctctgatcagatccactttttctttgctaaactgaattgtcggttgtatcgaaaagcgaacaagtcctctaaattagtctctgccaaccggttgtttggtgacaagtccttaacgttcaatgaaacataccaggacatttctgaactcgtgtacggggccaaactgcagcccctcgattttaaagaaaacgctgaacaaagtcgcgccgcgatcaataaatgggtgtcaaataaaactgagggccgcattaccgacgtaataccgagtgaggccattaacgaattgaccgttcttgtcctagtcaatacaatttactttaaaggcctgtggaagtccaagttctctcctgaaaacacccgtaaggagctgttctacaaggccgatggtgagtcgtgttcagcatccatgatgtaccaagagggaaagtttcgataccgccgtgtagctgaaggtacccaggttcttgagctgccttttaagggagacgatataactatggtactcatcctaccaaagcctgaaaaatccctggcaaaagtcgaaaaggagttgactcccgaggtccttcaggagtggctcgacgaactcgaagagatgatgctcgtcgttcacatgccacggttcaggattgaagacgggttttctcttaaggagcagctgcaggatatgggcctggtggacctgttttccccagagaaaagtaagctgccggggatagtggcagaaggacgagatgatctttatgtcagcgatgctttccataaggcgtttttagaggtcaatgaagaaggcagcgaggcggcagcctccaccgctgtggtcatcgcaggacgttctctgaaccccaatcgagttacctttaaagccaataggccatttcttgtgtttatcagggaggtgcccctgaataccattattttcatggggcgcgtggctaatccctgtgtaaag

SEQ ID NO: 18927 - DNA, 1392 bp, Artificial Sequence
  Description of Artificial Sequence: Synthetic coding sequence
atgtattcaaatgtgatcgggaccgtgacttctgggaaaagaaaagtgtacctcctgtctctcctgctcattgggttctgggattgcgtgacctgccacggtagccccgtagacatctgcacagccaagccgcgcgacatccccatgaatccgatgtgtatttaccggtcccctgaaaagaaggccaccgaggatgaagggtccgagcagaagattcccgaggctacgaacaggagagtgtgggaactgtccaaggcgaatagcaggttcgctacgaccttctaccagcacctcgctgactcaaagaacgataacgacaacatcttcctgtccccgctatccatttctactgcctttgccatgacaaaattaggcgcttgtaacgatacccttcaacagctaatggaggtcttcaagttcgacacgatttccgagaagacctctgaccagatacattttttctttgccaagcttaactgcagactctatcgcaaggcaaataaatcctctaaactggtgtccgccaatcgcctgtttggtgacaagtctctcacattcaacgagacgtaccaggatattagcgagttagtctatggggcaaagctgcaacctcttgatttcaaagaaaatgcagagcagtcacgagcggcaattaataaatgggtgtcaaacaagaccgagggcaggatcacggatgtgattcccagcgaagcgatcaacgagttaacggttctcgtactggtgaacaccatttattttaagggcctgtggaaatctaaatttagccccgagaacacacgaaaagagctgttctacaaggctgacggtgaaagctgttctgcttccatgatgtaccaagagggcaaattccgctatcgaagagtcgctgagggcacccaagtgctggaactgccctttaagggagatgacattacgatggttctgattctgccaaagcctgaaaagtctctcgccaaagtggaaaaggaattgacccccgaggttctgcaagaatggctggacgaactggaagagatgatgctcgttgtgcatatgccaaggtttcggatcgaggatggctttagtttaaaggagcagctccaggacatgggattggtggaccttttcagtccagagaagtcaaagctacctggcatcgtggctgagggtcgcgatgacctatacgtcagtgacgcctttcataaggcgttcttggaagtcaatgaggagggttctgaggcagccgctagcacagctgtggtcattgccggcaggtcattgaaccccaatagagtgacgtttaaggctaatcgccctttcctcgtgttcatccgcgaagtgccgctcaacacgattatcttcatgggacgtgtggcaaacccttgcgtgaaa

SEQ ID NO: 18928 - DNA, 1392 bp, Artificial Sequence
  Description of Artificial Sequence: Synthetic coding sequence
atgtattcaaacgtgatcggtactgtcacgtcgggaaagcgtaaggtgtacctgctgagcctgttgcttatcggattttgggattgcgtgacctgtcatggaagcccggtcgatatctgcactgccaagccaagagacatccctatgaatccgatgtgcatttacaggtcgcccgagaaaaaggcaaccgaggacgaaggcagcgaacagaaaattccagaagccaccaacagacgagtgtgggaactttctaaggccaattcgcggttcgccactaccttctaccagcacctggctgattcaaagaacgataacgacaacattttcctcagccctctgtccatcagcaccgccttcgccatgactaagttgggagcctgcaacgacactcttcaacaactcatggaggtattcaagttcgacactatatctgaaaagacctcggaccagatccatttctttttcgccaaactcaactgccgcctgtaccgcaaagcaaataagtcgtccaagctcgtgtcggccaaccggctgtttggagataaatcactgacgttcaatgaaacctaccaagacatctccgaacttgtctacggagcgaaactccagccgctggatttcaaagaaaatgccgaacaaagccgggctgctatcaacaagtgggtttcaaacaagacggaggggcgcatcaccgatgtcatcccgtccgaggcgatcaatgaactgaccgttctggtgctggtgaacaccatctacttcaagggtttgtggaaaagtaaattctccccagaaaatactcggaaggagctgttctacaaggcagacggcgaatcgtgctcggcgtcgatgatgtaccaggaaggcaagttcagatacagaagagtggcggaagggacccaagtgctggaactcccgtttaagggagacgatatcactatggtgttgatcctgccaaaacctgagaagtccctcgccaaggtggaaaaggagctgacccccgaagtgctccaggaatggctcgacgaactcgaggagatgatgctggtggtgcacatgccgcggttccgcatcgaggacggattttccctcaaggaacagctgcaggatatgggactggtggatctgttctcaccagagaaatccaaattgccgggcattgtcgcagaggggcgcgacgacctctacgtgtcagacgcgtttcacaaggcgtttcttgaagtcaacgaggagggcagcgaggcagccgcgtccaccgctgtggtcattgctggacggagcctgaaccccaatcgcgtgactttcaaggctaacaggccgttcctcgtctttatccgcgaggtgcctctgaacactatcatcttcatgggtagggtcgcaaatccgtgtgtgaag

SEQ ID NO: 18929 - DNA, 1392 bp, Artificial Sequence
  Description of Artificial Sequence: Synthetic coding sequence
atgtattcaaatgtgattgggaccgtcactagcggcaaacgaaaagtctaccttctgagcctcctgctgattggattttgggattgcgtgacatgccacgggtctcccgttgacatttgtacggccaagccaagggacattcccatgaacccaatgtgtatttatcggtctccagaaaagaaggcaacagaggatgagggttccgagcaaaaaattccagaagccaccaatcggcgggtttgggagctatccaaggccaattcccggttcgctacaactttctatcagcacctggctgacagcaaaaatgataacgacaacattttcttatcccccctttcaattagcacggcctttgctatgactaaactgggcgcttgcaatgacaccctgcagcagctgatggaagtgtttaagttcgacacgatcagcgagaagacaagtgatcaaatccacttctttttcgccaaacttaactgtaggctgtataggaaagcgaataagtcatcaaaactcgtgagcgctaacagactctttggcgacaagtcactaaccttcaatgaaacttaccaggatatctccgagctagtgtatggcgcgaaacttcagcctctggactttaaagagaatgctgagcaaagcagggcagcaataaataagtgggtttctaacaagactgaaggaaggataaccgacgtcataccgagtgaggcgatcaatgaactgaccgttctggtgctagttaataccatttatttcaaggggttgtggaaaagtaaattcagcccagagaacactaggaaggagctattttataaagcagatggcgagagctgcagtgcatctatgatgtaccaggaggggaagtttaggtatcgtcgggtcgccgaaggaacccaggtgctggaactcccattcaagggggatgacatcaccatggtactcatccttccaaaacctgaaaaatcgttagccaaggtcgagaaagaactcacaccggaggtgctgcaggaatggctggacgagctggaggagatgatgctcgtggtccatatgccaaggtttcggatcgaggacggcttttcactcaaggaacagctccaagacatgggattggtcgaccttttcagccctgaaaagtctaagctgcccggcattgtcgccgagggccgcgatgatctgtacgtttcagacgccttccataaggccttcctcgaggtgaacgaggaggggtccgaggccgccgcttcaactgccgtcgtcattgccggtaggtcactgaaccctaacagggtgacttttaaggcaaacagaccctttctggtgttcattagagaggttcccctgaacaccattatttttatgggtcgtgtagccaatccgtgtgtaaaa

SEQ ID NO: 18930 - DNA, 1392 bp, Artificial Sequence
  Description of Artificial Sequence: Synthetic coding sequence
atgtacagcaacgtaatcggcacagtgacgagcggtaaaaggaaagtttaccttctgtccctgcttcttataggattttgggactgcgtgacatgtcacggcagcccggtcgacatttgcacagcaaagcccagagacattcccatgaatccaatgtgtatttataggagtccagagaagaaagcaacggaagatgagggctcggagcagaaaataccagaggccactaacaggagggtgtgggagctgtcgaaggcgaactcccgttttgccacaaccttctatcaacacctggctgatagcaaaaatgacaacgataacattttcctgtctccattatcgatcagtacagccttcgctatgactaagttgggagcttgtaatgacaccctgcagcagctgatggaggtatttaagttcgataccatttcagagaagacttcggatcagattcacttcttctttgccaaactgaattgtcggttgtaccggaaggcgaacaaatcttctaagctggtaagcgcgaaccgcctgttcggggataagtccctgactttcaacgagacttaccaagacatcagtgagctggtttacggggcaaaactccagcctctggatttcaaggagaacgcagagcaatccagggctgctatcaacaagtgggtgtctaacaagaccgagggcagaatcaccgacgtcattccatcagaagcgatcaacgagttgacggtgttggttctagtgaataccatctacttcaaaggcctctggaagagcaagttttcccccgagaataccaggaaggaactgttttataaggctgacggggagtcttgctctgccagcatgatgtatcaggaaggcaagtttcggtacagacgagtggcagagggcacccaggtgctagagctcccctttaagggggacgatattactatggtgctgatcctgcccaaaccagaaaagtccctggcgaaggtcgaaaaagagctcacccccgaagtgctacaggaatggctggacgagctcgaagaaatgatgcttgtagtccatatgcccagattccggattgaagacggattctcgctcaaggaacaactgcaggatatggggctagtggatctcttcagcccggaaaaatccaaattgcccgggatcgtggccgaaggacgcgacgacctgtatgtgagcgatgccttccataaggcattccttgaagtgaatgaagaagggagcgaggccgccgcctccacagcggttgtgatcgcaggtaggagtcttaatcctaaccgagttacctttaaggctaatcggccctttctggttttcatcagggaggttccgcttaacacaataatttttatggggagggtggcaaacccctgcgtaaag

SEQ ID NO: 18931 - DNA, 1392 bp, Artificial Sequence
  Description of Artificial Sequence: Synthetic coding sequence
atgtattctaatgtgattggcactgtgacatcaggtaaaaggaaggtctacttgctcagtctcttgctgattggtttttgggattgcgtgacatgccatgggagtccggtggacatctgtactgcaaaaccacgggatatccccatgaacccgatgtgcatataccgatcccccgagaagaaggctaccgaagatgagggttcagaacagaaaattccagaagcaaccaataggagagtctgggaactgagtaaagctaactcacgctttgccaccacgttctaccagcacctcgcagacagcaaaaatgataacgataatatcttcttgtcgcccctgtctatatctactgccttcgccatgactaagctgggagcttgcaacgacacactgcagcagttgatggaagtcttcaagttcgataccatttcagagaaaaccagcgaccaaatccattttttctttgccaagctcaattgcaggctgtaccggaaggcaaacaaatctagcaaacttgtgtctgccaataggctgtttggagacaagtcgctgacgtttaacgagacttaccaggatatctcggagctcgtctatggtgcaaagctgcagcccctggatttcaaggaaaatgctgaacagtctcgcgccgccattaacaaatgggtgagtaataagaccgaaggccggatcacggacgtaatcccgtccgaagcaattaacgagcttaccgtgctggtacttgtgaatacaatctacttcaaaggcctctggaagtcaaagttttcccccgaaaataccagaaaagaactgttctacaaagcggacggcgaaagctgctctgcctccatgatgtaccaggagggtaagtttagatatcgacgggttgcagaaggcacgcaggtccttgaactccccttcaaaggagacgacattactatggtactaattctgccaaaaccagaaaagtccttagcaaaggtggagaaggagctcacaccagaggtccttcaggagtggttggacgagctggaggaaatgatgctcgtggtgcatatgccacggttccggattgaggacggtttttcactcaaagagcagctccaggatatgggtctggtggaccttttttcaccagagaagtcaaaacttcccgggatcgtggccgaggggagggatgacttatatgtgagcgacgcctttcacaaggctttcctggaggtgaatgaagaaggcagcgaagcggccgctagcaccgctgtggtgatcgcgggccgctctctcaatcctaaccgcgttacattcaaggccaacagaccctttctggtgtttattagggaagtccccctgaacacaatcatcttcatggggcgcgttgctaacccgtgtgtgaaa

SEQ ID NO: 18932 - DNA, 1392 bp, Artificial Sequence
  Description of Artificial Sequence: Synthetic coding sequence
atgtactctaatgtgataggcacagtgacttccggcaagcgcaaggtttacctgttgagcttgctgctgattggattctgggattgcgtgacgtgtcatggctcgcctgtggacatctgcaccgctaaaccaagagacattcctatgaatccgatgtgcatatataggagccccgagaaaaaagccacagaagatgaaggttccgaacagaaaattcccgaggccaccaaccgtcgcgtgtgggaactttctaaggcgaacagtagattcgccaccactttttatcagcacctggcagatagcaagaatgacaatgacaacatattcctgagtccactctccatctcgaccgctttcgctatgaccaaacttggcgcttgcaacgacacgctacagcagttgatggaagtgtttaagttcgataccatctcggaaaagacaagcgaccagattcacttcttttttgctaagctgaactgccgactgtacaggaaagcgaacaagagtagcaagctcgtctccgccaaccggctgttcggggacaaatcgcttaccttcaacgagacataccaagacatcagtgaactggtgtatggcgcaaagctgcagcctctggacttcaaggagaatgccgagcaatccagggctgccatcaacaagtgggtgtccaataagactgaggggcgcattacggacgtcattccgtccgaggcaattaacgagcttacagttctggtgttggtaaacaccatctactttaagggcctgtggaagtctaaattctctccagagaacaccagaaaggagctattttacaaagccgatggcgagtcctgttccgcctcgatgatgtaccaagaggggaagtttaggtacagacgcgtcgccgaaggaacacaagtcctggagctgccattcaaaggagacgatatcacaatggtgcttatcctgccaaagcctgaaaagagtctagcgaaggtggagaaggaactaacgccagaggtcctacaggagtggctggatgaactagaggagatgatgctagtcgtacacatgccacgtttcagaatcgaggatgggttcagtctgaaagaacagctgcaagatatggggctcgtcgaccttttcagtcccgagaagtccaagttgcctggcattgtagcggaggggcgagatgatctgtacgtcagtgacgctttccataaggcatttctcgaagtgaacgaagaggggtctgaggctgccgctagtactgctgtggtcatcgcgggccggtccttgaatcctaatagggtgaccttcaaggcaaatcggccgtttttagtttttattagagaggtccctctcaacactatcatatttatggggagggtcgccaacccctgcgtcaag

SEQ ID NO: 18933 - DNA, 1473 bp, Artificial Sequence
  Description of Artificial Sequence: Synthetic coding sequence
atggcactgttgtgggggctcctggtcctgtcgtggtcctgcctccaagggccctgcagcgtcttttcgccagtgtccgccatggaacctctcggtagacagcttacgagcgggcccaaccaggaacaagtttcccctcttacccttttgaagctcggaaaccaggaaccaggaggccagaccgcactgaagtcgccacctggagtgtgctcgcgagatcctacccctgagcagacgcatcgtcttgcaagagcaatgatggcatttactgcagatttgttcagcctggtcgcacagacttcgacttgtcctaaccttattctctcacctctctcagtggcacttgcactgagccaccttgccctgggtgcgcagaaccataccctgcaaagacttcagcaagtcttgcatgctggaagcggaccatgccttcctcatcttctctcccgactgtgtcaagaccttggaccaggagcttttagactggcggcacggatgtacctgcaaaagggttttccaattaaggaggatttccttgagcagagcgaacagctgtttggtgccaagccagtctcgcttactggcaagcaagaagatgaccttgcaaacatcaaccagtgggtgaaggaagcgactgaaggtaagatccaagagttccttagcggactgcccgaggataccgtgctgcttcttctgaatgcaattcacttccaggggttctggcggaacaagtttgatccatcactgactcagagagactcctttcatctggatgagcaatttaccgtccctgtggaaatgatgcaggcaagaacttaccctctgcgctggttcttgctggaacaaccagagatccaggtcgcacattttccgttcaaaaacaacatgtcctttgtcgtccttgtgcccactcactttgaatggaatgtgagccaagtgctggcaaacttgagttgggataccctgcatcctcctctggtgtgggagcggcccaccaaggtcagactgccgaagttgtacctgaagcaccaaatggatctggtggcaactctgtctcagcttggactgcaggaattgtttcaagctccagaccttcgggggatttccgaacagtcactggtcgtgtccggagtgcagcatcaatcaacccttgaactttcggaggtgggcgtcgaagcggcagcagcaacctcaatagctatgtcccgcatgtctctctcgtccttttcggtgaaccgccccttcctgttcttcatctttgaagatactactggcctgcctctctttgtcggttcagtgaggaaccctaatccttcggcaccccgggaacttaaggaacaacaagattctcctggtaataaggatttccttcaatcactcaagggtttccctagaggggataagttgtttgggcctgaccttaagctcgtgccacccatggaagaagattacccacagttcggatcacccaag

SEQ ID NO: 18934 - DNA, 1473 bp, Artificial Sequence
  Description of Artificial Sequence: Synthetic coding sequence
atggcactgctatggggactgctagtcctttcttggagctgtttgcagggcccatgttccgtcttctctcccgtgtcagccatggagcctctgggccggcagctcaccagcggacccaaccaggagcaggtatcacccctgaccctcctgaagcttgggaaccaggagcccggcggccaaacagcgctgaagtcaccccctggggtgtgcagcagagaccccacccccgagcagactcacagattggcaagagctatgatggcattcaccgcagacttgttctccttagtggcccagacatctacctgccccaatctgatcctgtcccctctgtcagtcgcacttgcattgtcgcatctggccctaggcgcacagaatcatacactccagcgcctgcagcaggttctgcacgccggaagcggtccctgtctgcctcatctgctgtccaggctttgtcaagatcttggcccaggggccttcagactggccgctagaatgtacctgcagaaggggttccccatcaaggaagatttcctcgagcagagtgagcagcttttcggcgctaaaccagtgtctctgaccggcaagcaggaagacgacctggctaacatcaaccagtgggtgaaggaagctacagagggtaagatccaagagttcctgagcggccttcccgaagataccgtgctgttgctgctgaatgcaattcactttcaaggcttctggcgaaataaatttgacccatccttgactcagcgggacagtttccacctggacgagcagtttacagtcccagtagagatgatgcaggccagaacataccctttacgttggtttttgttggagcagccagagatacaggtcgcgcatttcccgtttaagaacaatatgagtttcgtcgttctggtgcctacccatttcgagtggaatgtcagccaggtgctggcaaacctgtcttgggataccctccaccccccactcgtctgggagcggcccacaaaggtacggctccccaaactgtaccttaaacaccagatggatctggtggctacactgagccagttaggtctgcaggagttattccaagcccccgatctgcgcggcatctcagaacagtcactggtagtttccggcgtccagcatcaaagtactctggaactttccgaggtcggcgtcgaagccgcagccgccaccagcatagctatgtcaagaatgtcactgagctccttctctgtgaaccggcccttcctgtttttcatcttcgaggacaccacagggttacccctattcgttggctccgttcggaacccaaacccttctgccccacgcgagcttaaggaacaacaggattcgcctggtaataaagattttctgcaatctctcaaaggcttccctcggggggacaagctgttcgggcctgatctgaagctggtgccgccaatggaggaagactatccgcagtttggttcgcctaag

SEQ ID NO: 18935 - DNA, 1473 bp, Artificial Sequence
  Description of Artificial Sequence: Synthetic coding sequence
atggctcttctatgggggctgctcgtattaagctggagctgcctgcagggaccttgctctgtgttctctccagtgtctgctatggagcccttgggaaggcaactgacctcaggtcctaaccaggaacaagtctctcctctaacgctgctgaagctgggtaatcaagaacctggcgggcaaacagctctaaagtccccgccaggcgtgtgtagtagagacccgacacctgaacaaactcaccgactggcacgggctatgatggctttcaccgccgacctattctccctcgttgctcagaccagcacatgccccaatttgattctctcacctctgagtgtggcattagccctgtcgcacttggcacttggagctcagaaccacacacttcaaagattgcagcaggtgctgcacgctgggtctggaccgtgtttgccccatctattaagtagactgtgccaggatttgggccccggcgccttcagactggcagcccgaatgtaccttcagaaaggttttccgatcaaagaagattttctcgaacagtcagagcagctgttcggcgctaaacccgtgagcctgacagggaagcaggaggacgatttagctaacatcaaccagtgggtgaaggaagccacagagggcaaaatacaggaatttttgtccggccttccagaggatactgtcttactgctgcttaacgccattcactttcaaggcttctggcggaacaagttcgatccctcactgacacagcgggatagctttcatctggatgagcagttcaccgttccagtcgagatgatgcaggcgcgcacataccctctgagatggttccttttggaacaacccgaaatccaagtggctcactttcccttcaagaataatatgagcttcgtggtgctcgtgccgacccacttcgaatggaacgtctcccaggtgcttgctaatctgagctgggacactttgcatcctcccctcgtgtgggaacgccccacgaaggttcgtctccctaagctgtatttaaagcaccaaatggaccttgtcgctactctgagccaattgggcctccaagaactgtttcaagccccggacttaagaggcatctcggaacagtccctcgtggtctcgggcgtccagcatcagtccactctggaattgtcagaggttggagtcgaagctgctgccgccacctcaatagcaatgtcgcgcatgtcattaagcagcttctcggtgaacagaccattccttttctttatattcgaagatacaacagggcttcctctgttcgtagggtctgtgcggaatccaaaccctagtgccccccgagagctgaaggagcagcaggactccccgggtaacaaggattttctgcagtccctgaaagggtttccgcgcggggacaaattgttcgggcccgacctgaaattagttccacccatggaggaggactatcctcagttcggcagccccaaa

SEQ ID NO: 18936 - DNA, 1473 bp, Artificial Sequence
  Description of Artificial Sequence: Synthetic coding sequence
atggcactgctgtggggcctgctggtgctgtcatggtcatgtctgcagggaccttgctcagtgttctctccggtgagcgcgatggagccgctgggtcgccaactgactagcggccctaatcaagaacaggtgtcgcccctcaccctgctgaagctcggaaaccaggagccaggcggacaaacggctttgaaatcccctccaggcgtgtgctcgcgcgacccgactccagagcagactcatcggctggccagggcgatgatggcatttacggccgacctgttttcccttgtcgcccagacctcgacctgccctaatctgatcctctccccattgtccgttgctttggcgctctcccatctggctctcggggcgcagaaccataccctccagcgccttcagcaggtgctgcatgcaggatcgggaccgtgtttgccccacttgctgagccggctctgtcaggatctggggccaggagcctttagactggccgcccgcatgtatctgcaaaagggctttcccatcaaggaggatttcttggaacagtcggagcagctgttcggtgccaagccagtaagcctgaccggaaagcaagaggacgacctcgcaaatatcaatcagtgggtgaaagaggccaccgaaggcaaaattcaggagtttctgtccggtttgcctgaagatactgtgctgctgctcctgaatgccatccacttccagggattttggcggaacaaattcgatccttctctgacccagcgcgattcctttcacctggacgaacaattcaccgtgccagtggagatgatgcaggcccggacgtacccactgagatggttcctgctggaacagccggagatccaagtggcacatttcccgttcaaaaacaacatgtcctttgtggtcctcgtgccaactcatttcgagtggaacgtgtcgcaagtgcttgccaacctctcctgggacactctgcaccctccgctggtgtgggaaagaccgaccaaagtgcgccttccaaagctgtacctcaaacaccagatggacctcgtggccacgctgtcccaacttggcctccaggaactgttccaggccccggatttgagaggaatcagcgaacagagcctcgttgtgtcgggagtgcaacatcaatccactctggaactctccgaagtcggggtcgaagccgctgccgccacttcgatcgctatgtccagaatgagcctctcatccttctccgtgaatagacccttcctcttcttcatcttcgaggacactactggtctgcctctcttcgtcggatcggtccgaaacccaaacccgtcagcccctcgcgagctcaaggaacaacaagactcccctggaaataaggatttcctgcagtccttgaaggggttcccaaggggagacaagctgttcggacctgatctcaagctcgtgcccccgatggaggaggactatccgcaattcggatcccctaaa

SEQ ID NO: 18937 - DNA, 1473 bp, Artificial Sequence
  Description of Artificial Sequence: Synthetic coding sequence
atggctttgctgtgggggctccttgtgctctcttggtcatgcttgcaaggaccgtgctccgtgttttccccagtgtcggccatggaaccgctgggtcggcaactgactagcggaccgaaccaggagcaggtgtctcctctgaccctcctcaagctcggaaatcaggagccaggaggccagactgccctgaagtcgcctccgggcgtttgctcaagggatcccactccggaacaaactcacaggctcgcccgggctatgatggcatttactgccgacctcttctcgttggttgcccagacttccacttgcccgaatctgatcctttcaccgctgtcggtggcgctggcgctgtctcatctggccctcggcgcacagaatcacaccctgcagcggcttcagcaggtgctgcatgctggatcaggaccgtgtctgccgcatctcttgtccaggctttgccaggatctggggccaggagcgtttcgcctcgctgcgcggatgtaccttcagaaaggattcccgatcaaggaagatttccttgagcaatccgaacaactcttcggagctaaaccggtcagcctgactggaaagcaggaggacgacctggcgaacatcaaccagtgggtcaaggaagcaaccgaaggaaagatccaagagtttctgagcggactccccgaggacaccgtgctgctgcttcttaacgccatccattttcaaggattctggcgcaacaaattcgatccttcgctgactcagagagactctttccacctggacgaacagtttaccgtgcctgtcgaaatgatgcaagcgcgcacctaccccttgcgctggttcctcctggagcagccggaaatccaggtcgcccacttcccgttcaagaataacatgagcttcgtggtgttggtcccgacccatttcgaatggaacgtgtcacaggtgctcgcaaatctgtcctgggacaccctccacccaccactggtctgggagcgcccgaccaaggtgagactgcctaaactgtacctgaagcatcagatggatctggtcgcaacgctctcgcaacttgggctccaagaattgttccaagccccggaccttagagggatctccgaacagtcgctcgtggtcagcggagtgcagcatcagagcacccttgagctgagtgaagtgggagtcgaggcggcggccgcaaccagcatcgccatgtcaagaatgagtctcagctcattctccgttaacaggccatttctgtttttcatcttcgaggatactactgggctcccactcttcgtcggaagtgtgcgcaatccgaatccgagcgctccgcgcgagctgaaggaacagcaggactcgccaggcaacaaggatttcctgcaatcgctcaagggtttccctcgcggagataagctcttcggaccggacctgaaattggtgccgccaatggaggaagattacccacaatttggcagcccgaag

SEQ ID NO: 18938 - DNA, 1473 bp, Artificial Sequence
  Description of Artificial Sequence: Synthetic coding sequence
atggctttgctttggggcctgttggtgctcagctggtcttgcctgcagggtccttgttccgttttctctccagtaagcgctatggagccgctcggcagacaactgacctcaggacccaatcaggagcaggtatctccactcactctcctgaaattgggtaatcaggaacctggtggccagacagcgctcaagagccctccaggagtgtgctcaagggacccaaccccagagcagacgcaccgcctggcgagggccatgatggcatttacagctgacctgttcagcctcgttgcacaaaccagcacttgccccaatctgatactctcccccctgtccgtggctctggcactgtcacatctggcgctgggtgcgcagaatcatactctgcaaagactccagcaggttctgcacgcgggaagtggaccgtgtctgccacatctgctgagccgcctctgtcaagaccttggaccaggtgcttttagactggccgccagaatgtatctgcagaagggcttccctatcaaagaagacttcctggagcagagtgagcagctgttcggcgccaagcccgtcagcttgaccggaaaacaagaagacgatcttgcgaatataaaccagtgggtaaaggaggcaactgagggtaagatccaagagttcctgtctggactgcctgaggatacagtgctgctcctgttgaacgctattcactttcagggattttggagaaacaagttcgatcccagccttacgcagcgcgactccttccacttggacgaacagttcactgtcccggtggagatgatgcaagctcgcacctaccctctgcgctggttccttctggagcaaccggaaatacaagtggcccacttcccgttcaagaataatatgtccttcgtcgtgctcgtaccaacacacttcgaatggaacgtcagccaggtcctggccaacctctcttgggataccctgcaccctccactggtctgggaacgcccaaccaaggttaggctccccaagctttatttgaagcatcagatggacctcgtcgcgacgctttctcagcttggtctccaggaactgtttcaggcccctgatcttagaggtatctcagagcagtccctggttgtgtcaggcgtgcagcatcagtccaccctcgagctgtctgaggtgggtgtagaagcagctgccgccacctccatagcgatgtcaaggatgtccctctcctctttcagtgtcaacaggccctttctcttctttatattcgaagacacgaccggcctgccgctgttcgtgggcagtgtgaggaacccaaacccttcagcccccagggagctgaaggaacagcaggactctcctggcaacaaggatttcctccagtcactgaagggtttcccgaggggcgacaagcttttcggcccggacttgaagctcgtgccccccatggaagaagactacccacagtttggatcacccaag

SEQ ID NO: 18939 - DNA, 1473 bp, Artificial Sequence
  Description of Artificial Sequence: Synthetic coding sequence
atggccctgctctggggactgctcgtgctctcctggtcatgcctgcaaggaccgtgctcggtcttttcgcccgtgtcggccatggagccactgggtcgacaactcacctcaggaccaaatcaggaacaagtgagcccgctcacgctgctcaaactcggaaatcaggaaccgggtggacaaaccgcgctcaagtcgccaccgggagtgtgtagcagagatccgacccctgaacagactcaccgcctggcgcgggcaatgatggccttcaccgccgacctcttctcccttgtggcccagacttctacctgtcccaacctgattctgagcccgctctccgtcgctcttgcgctttcccacctggctctgggcgcgcagaaccatactctgcaacgactgcagcaggtgctccatgcaggctcgggaccatgcctgccgcaccttctgtcccggctgtgccaagacctgggacccggagcatttcgcttggcggcacgcatgtacctgcaaaaaggcttcccgatcaaggaggattttcttgaacagtccgagcaactcttcggagcaaagccggtgtcgctgaccgggaagcaggaggacgacctggccaatatcaaccagtgggtgaaggaggccaccgaaggaaagatccaagagtttctcagcggcttgcccgaggacactgtgcttctcctgctgaacgctatccacttccagggattctggaggaataagttcgatccatccctcactcagcgggatagcttccaccttgacgagcagttcactgtgcctgtggaaatgatgcaggccagaacgtacccactgcgatggtttctgctcgaacagcccgaaattcaggtggctcatttcccgtttaagaacaacatgagcttcgtggtgcttgtgcctactcatttcgaatggaacgtgtcccaagtcctcgcgaacttgtcgtgggacaccttgcacccgccgctggtgtgggagcggccgactaaggtccggctcccgaagctctaccttaaacatcagatggatcttgtcgccaccctgtcgcaactgggattgcaggaactcttccaagcaccggatctgaggggcatctcagagcaatccctggtggtcagcggggtccaacaccaatccaccctggaactgtccgaagttggagtcgaagccgccgcggcaacttccatcgcaatgagccggatgtccctcagctcattttcggtgaatagacccttccttttcttcatcttcgaggacaccactggactgccgctgtttgtgggatcggtgcgcaacccaaatccatccgcgccacgggagctgaaggaacagcaggactcgccaggaaacaaggacttcctgcaatcacttaagggcttccctcgcggggataaactgtttggcccggatctcaagctggtccctccgatggaagaggattacccacagtttggtagccccaag

SEQ ID NO: 18940 - DNA, 1473 bp, Artificial Sequence
  Description of Artificial Sequence: Synthetic coding sequence
atggcacttctttggggactgctcgtacttagctggtcgtgccttcagggcccgtgtagcgtcttttcgcccgtgtcggcaatggagccacttggtagacagctgaccagcggaccaaaccaggagcaagtgtccccccttaccctccttaaacttggaaaccaagagcctggcgggcagaccgctctcaagtctcctccaggggtgtgttcccgtgaccctacccctgaacagactcatcgcttggcaagggcgatgatggcattcaccgcagacttgttttccctggtcgcacagacgtccacgtgtcccaaccttattctttcgcctctgtcagtggcactggcactgtcgcaccttgccttgggtgcccaaaatcatacccttcagagacttcaacaggtccttcacgcaggctccggtccttgtctgccacaccttctttcacggttgtgccaggatcttggcccaggcgcctttcgcctggccgcacgaatgtacctgcaaaagggattcccaataaaggaagattttctggagcagtcggagcagctttttggagcgaaacctgtgtcattgactggcaaacaagaggatgatctcgccaacatcaaccaatgggtgaaagaggcaactgaaggcaaaatacaagaatttctctctgggcttcctgaggacaccgtgctgctgcttctcaatgcaatacatttccagggattttggcggaataagtttgaccccagcctgacccaacgagatagctttcacctggatgaacagttcaccgtccctgtcgaaatgatgcaagcccgcacctacccacttcggtggtttctcctggaacagccagaaatccaggtcgcacactttcctttcaagaacaatatgtccttcgttgtcctggtgccaacccattttgaatggaacgtctcccaagttctcgcaaacctgtcgtgggacactctgcatccgcctctggtctgggaaaggcctaccaaggtgaggttgcccaaactgtacctgaaacatcaaatggaccttgtggccaccctgtcacaacttggccttcaggagctgtttcaggcaccagatttgagagggatttcggaacaaagccttgtggtgtccggggtgcagcatcagagcaccctggaattgtcagaggtgggcgtcgaagcagcggcagcaactagcattgcaatgtcacgcatgagcctgtcgagcttttcagtcaaccgcccttttctgttctttatctttgaagatactactggactgccgctgttcgtgggatccgtccgtaatccaaacccatctgcaccgagggagctgaaggaacagcaagatagccctgggaataaggattttctgcagtctctcaagggtttcccaagaggagataagctctttgggccagatctgaaactggtgcctcctatggaagaggattaccctcaattcggtagccctaag

SEQ ID NO: 18941 - DNA, 1473 bp, Artificial Sequence
  Description of Artificial Sequence: Synthetic coding sequence
atggcgcttctttggggcttgcttgtgctgagctggagttgcttacaaggtccgtgttcagtattttcgcctgttagcgcaatggaacctctggggcgacaactcacatcaggaccaaatcaggaacaggtttcgccactgacccttctgaagttaggcaaccaagaaccgggagggcagacggctctgaaatctcctccgggcgtgtgcagccgcgaccctacgccggaacagactcacaggttagctagagctatgatggcatttacggccgatctgtttagcttggtagcgcaaaccagcacgtgccctaatcttattctttctccgctatctgttgcactagcactgtcccatcttgcgcttggagctcagaaccatacgctgcaacgtcttcagcaagttttgcatgcaggctctggaccctgcctcccacatttattaagccggctgtgccaagatcttgggcctggagcatttagacttgctgctcgaatgtacctccagaagggctttccaattaaagaagatttcttagagcagagcgaacagttgtttggagcaaaaccggtcagcctgactggtaagcaagaagatgacttggcaaatattaaccaatgggtgaaagaggcgactgaaggcaaaattcaggaattcctgtcaggattacctgaagatacagtactgttgcttctcaacgcaatacactttcaaggcttttggcgtaacaaatttgacccttcactgacacaacgtgatagtttccacttagatgaacagtttaccgttccggttgaaatgatgcaagcgcgtacatatcctttgcgatggtttctgctggaacaacctgaaattcaagttgcacacttcccgttcaaaaacaacatgagtttcgtggttcttgtaccgacacatttcgaatggaatgtttctcaggtcctggcaaacctttcctgggatacgcttcatcctccgttagtttgggaacgtccaacaaaagtgcgcctccctaaattgtatttgaaacatcagatggacctagtggcgacgctcagccaactggggttgcaagagctattccaggccccggacctgcgtgggatttcagagcagtccttagtagtgtcaggagtacaacatcaatctacactggagctgtctgaagtgggcgtggaagcagccgcggccacttcaatagctatgtcgcgaatgtccctttcttctttctcggttaatcgtccatttctgtttttcatttttgaggacaccacaggccttccgctctttgttggctcagtccggaatcctaatccatctgcgccgagagaactgaaagaacaacaggattctcctgggaacaaggattttctgcaatctcttaaaggatttccgagaggcgataagctttttggcccggatctgaaacttgtgcctccaatggaagaagattatcctcagtttggaagtccaaaa

SEQ ID NO: 18942 - DNA, 1473 bp, Artificial Sequence
  Description of Artificial Sequence: Synthetic coding sequence
atggccctgctctggggactcctggtcctgtcatggagctgccttcaggggccatgttccgtctttagcccagtgtccgcaatggaacccctcgggagacagctgaccagcgggcctaaccaggaacaggtgagccctctgactttgttgaaacttggcaaccaagaacccggcggacagaccgcactgaagtccccgccaggggtgtgttcccgcgatcccactcccgaacaaacccaccgtctggcacgtgcaatgatggccttcaccgcggatttgttttcgctggtggcacagacgtcaacctgtcctaatttgatcctctcccccctttccgtcgcccttgcgctcagccacttggcactcggagcacagaaccatactctgcaacggctccagcaggtgctccacgcaggatcgggtccctgtctcccccatctgctttcgcgcctgtgtcaggacctgggaccaggagcattcagacttgcagcaagaatgtaccttcagaaaggctttcctattaaggaagattttctcgaacaatccgaacaactgtttggcgctaagccagtgtcactgactggtaaacaggaggacgatctggcaaacatcaaccaatgggtgaaggaagcgactgaaggaaagatacaggagtttctctcggggcttcctgaggacactgtgcttctgctgctgaatgcaatacattttcagggattctggaggaacaagtttgatccttcgcttacgcaaagagacagctttcatctggatgaacaatttacggtccctgtcgaaatgatgcaagcacggacctatcctctccgctggttcctcctcgaacaacctgaaatccaagtggcacattttccatttaagaacaatatgtccttcgtggtccttgtgccaacccactttgaatggaacgtgagccaagtgctggcgaacctgtcatgggatactctgcatccacctctcgtgtgggaaaggcctactaaggtgcgactgcccaagctgtacctgaagcaccaaatggacctcgtggctaccctctcacagcttggattgcaggagttgtttcaagcacctgatcttcggggaattagcgaacaatcgctggtcgtcagcggagtccaacatcagagcactcttgaactctcggaagtgggcgtcgaggcagctgcagccacctccatcgccatgagcagaatgtcactgtcctcattctccgtgaatcgacctttccttttcttcattttcgaagataccactggactccctctgtttgtgggctcggtgcgaaacccaaacccttcggcacccagagaacttaaggagcagcaagattcccccggaaacaaggacttcctgcagtccctcaagggctttccgcgcggtgataagctgttcggacccgacctgaaactggtgccacctatggaagaggactacccgcaattcggttctcctaag

SEQ ID NO: 18943 - DNA, 1473 bp, Artificial Sequence
  Description of Artificial Sequence: Synthetic coding sequence
atggctctgctgtggggacttctggtcctgagctggagctgcttgcagggaccctgcagtgtgttctcgccggtcagcgctatggagcccttgggacggcaactgacttcagggccaaatcaggaacaagtgtcaccattgaccctgttgaagctgggcaaccaagaacccggcggccaaaccgccctaaagagccccccaggagtttgcagtagagatcctacccccgaacagacccaccgcctggctcgcgccatgatggcttttaccgccgacctgttctctttggtggcccagacgagtacgtgccccaacctcatcctgtccccactgtctgtggcactcgctttatcccatctagccctcggcgcacagaaccacacgctgcagagattgcaacaggtgcttcacgcaggttctgggccgtgcctacctcatctccttagcaggctgtgccaagacttggggcccggagctttccgtctggccgcaaggatgtacctgcagaagggctttccaatcaaggaggattttctggagcaatcagaacaactgtttggcgctaaacctgtgtccctgaccggcaagcaggaagatgatctcgccaacataaaccaatgggtgaaggaagccacagaaggaaagatccaggagttcctatccggactaccagaggataccgtgctactcctcctgaatgcaattcacttccagggcttttggagaaataaatttgatcccagtttgacgcagcgcgatagtttccatctagatgagcagttcacagttcctgttgagatgatgcaggcgcggacttatccattaagatggtttctgctggagcagcctgagatccaggtagcacatttcccatttaaaaataatatgagttttgtggtcctggtgcccactcatttcgaatggaacgttagtcaggtgctggcaaatttgtcctgggatactctacacccacctctagtgtgggaaaggcccaccaaagtgaggctacccaaactctatttgaaacaccagatggatcttgtggccactttaagccagctgggtttgcaggagttgttccaggcccccgatctacggggcatatctgaacaaagtctcgtagtatccggagtgcaacaccagtcaacactggaactaagcgaggttggagtggaagccgctgcagccacgtcaatcgcgatgagccgaatgagcctgtcatcctttagcgtgaatagaccctttctattttttatattcgaggacacaacaggcttgcccttgttcgtgggaagtgtgcgtaatccaaacccgagcgcccctcgcgaacttaaagagcagcaggattctcccggcaataaggattttctgcaaagtctcaaggggtttcccaggggcgataagctgttcggtcctgacctaaaactggtgcctccaatggaagaagactatccgcaattcggctcccccaaa

SEQ ID NO: 18944 - DNA, 1473 bp, Artificial Sequence
  Description of Artificial Sequence: Synthetic coding sequence
atggcacttctgtggggactgcttgtgctcagctggtcctgcctgcaaggtccatgttcggtcttttcaccagtgtcggcaatggaacctcttggacgacaacttactagcggacctaatcaagaacaggtgtcccctcttactcttctgaaacttggaaaccaagagcccggcggacagactgccctgaaaagtcccccaggtgtctgctcgcgcgatcctactccagaacaaactcatcggcttgcccgtgccatgatggcattcactgcagatcttttttcgctggtcgcccaaacttcaacttgtcctaatctcattctgtcgcctctgtccgtggcactggcactgtcccatcttgcattgggagcccagaaccacactcttcagcgcctgcagcaggtgctgcatgcaggatcaggaccttgccttccgcatttgctttccaggctttgtcaggatctgggtcctggtgcctttcgtcttgcagcaaggatgtacctgcagaaggggttcccgattaaagaggactttctcgagcaatccgaacagcttttcggggctaagccagttagcctgacggggaagcaggaggacgatctcgcaaacattaaccagtgggtgaaagaggcaacggaaggcaaaattcaagaattcctgtcgggtctgccagaggacactgtcctgctcctgctcaacgcaattcattttcagggtttttggcggaacaaatttgaccccagccttacccagagggactccttccatcttgatgaacaatttacggtgcccgtggaaatgatgcaagcgcgaacttaccctctgcgatggtttctgctggagcaacccgaaattcaggtggcacactttccgtttaagaacaacatgagctttgtcgtgctggtccccacccatttcgagtggaacgtgtcacaagtgctggctaatctgtcatgggatactttgcacccgccactcgtttgggaacgaccaactaaggtgcggctccctaaactctacctgaagcatcagatggacctggtcgccactttgtcacagcttgggcttcaggagctgtttcaagcaccggacttgcgtggaatatcggaacaatccctggtggtttcgggtgtccaacaccagagcaccctggaactgtcggaagtgggagtggaagcggctgccgccacttccattgcaatgtcccgcatgtctcttagctctttctcggtcaaccgcccgttcctgttcttcatatttgaagatacgaccgggttgcctctgtttgtgggttccgtgagaaatcccaatccctcagcaccaagagaactgaaggaacaacaagattcgcctggcaataaagatttcctccaatccctgaagggttttcccaggggggataaacttttcgggcctgatcttaagctcgtgccaccaatggaagaagattacccacagtttggatcaccaaaa

SEQ ID NO: 18945 - DNA, 1473 bp, Artificial Sequence
  Description of Artificial Sequence: Synthetic coding sequence
atggcgcttctgtggggattgctggtgctgtcctggtcctgtctgcagggcccgtgttccgtgttttcacctgtgtccgcaatggagcctctcggtcggcagctgacttcgggtcccaatcaggaacaggtgtcgccgcttactctgctgaaactgggaaaccaggagcccggaggacagactgctctgaagtccccgccaggcgtttgctcaagagatcctaccccggagcaaacgcatcgcctggcccgcgcgatgatggcgttcaccgccgacctcttcagcctggtcgcacagaccagcacctgcccgaacctgatcctgtcaccgttgagcgtagcactcgcactgagccacttggccctcggagctcaaaaccataccctgcagagattgcagcaggtgcttcatgctggttcgggaccatgcctcccgcacctgctcagccgcctgtgccaggacctcggaccgggggctttcagactggcagctaggatgtacctgcaaaaagggttcccaatcaaggaggacttcttggaacagtcggaacaactgtttggtgccaagcctgtctcccttacgggcaaacaggaagatgacctggcgaacatcaatcaatgggtgaaggaggccactgaaggaaagattcaggagtttctttctggactcccggaggataccgttctcttgctgctcaacgcaatccacttccaaggattctggagaaacaagttcgacccatcactcactcagcgggactcattccacctcgatgaacagttcactgtgccggtcgagatgatgcaggcacggacttaccccttgcggtggttcctccttgaacagcccgaaatccaggttgcgcattttccatttaagaataacatgtcgttcgtggtcctcgtacccacccactttgaatggaatgtgtcccaagtcctggccaacctgtcgtgggacaccctgcacccgccgcttgtttgggaacgccctacgaaggtccggctgcctaaattgtatcttaaacaccagatggatctcgtggccacgcttagtcagctggggctgcaagaactcttccaagcgccggatttgcgtggcatctccgaacaatcattggtcgtgagcggcgtgcaacatcaatcgactctggagctctccgaggtcggggtggaagccgccgcggccacttcgattgccatgagcaggatgagcctgtcctccttctctgtgaatcgaccgtttctcttcttcatattcgaagataccactggactgcctctcttcgtggggtcagtgcggaacccaaacccatctgcacctcgcgaactcaaggaacagcaggactcgcccggaaataaggactttctccagtctctcaagggattccctcgcggcgacaagctcttcggtccagacctgaagctggtgcctcctatggaggaggattaccctcaattcggctctcccaaa

SEQ ID NO: 18946 - DNA, 1473 bp, Artificial Sequence
  Description of Artificial Sequence: Synthetic coding sequence
atggccctgttgtgggggctgctggtcctgagttggtcttgcctgcagggcccgtgttctgtgttttccccggtgagcgccatggagccactgggaaggcagctgacaagcggccccaaccaggagcaggtgtcaccacttaccctgctgaaactgggcaaccaagagcctggaggccagaccgccctcaagagccctcccggtgtgtgtagtcgcgatcccacccccgagcagacacacagattggcaagagctatgatggccttcacggcagacttgtttagcctggtcgcgcagactagcacatgtcctaatctcatcctgagtcctctgagcgtcgcccttgccctgtcacacctggccctgggtgctcagaatcacacacttcagcgcctgcaacaggtcctgcacgctggttctggcccatgcctgccccatttgctgagcagactctgccaagacctcggtcccggggccttcagactcgctgcacgcatgtacctgcaaaaaggatttccgatcaaagaagacttcctcgaacagagtgagcagctgttcggcgctaaacccgtgtccctgacagggaagcaggaggacgaccttgcgaacatcaatcagtgggtcaaggaagctaccgaaggaaagattcaggaatttctgagtggcttgccagaagatactgtcctgctcctgttgaatgccatccacttccagggattctggcggaataaattcgatccgagcctgactcagagagactcttttcaccttgacgagcaattcaccgtccccgtagagatgatgcaagccagaacgtatcccctcagatggttccttctggaacaacccgagatccaggtggctcatttcccttttaaaaacaacatgtcattcgttgtcctggtgcccacccatttcgaatggaatgtctcccaggtgctggccaatttgtcctgggacactctgcacccaccactcgtttgggagcgccctactaaggtgagactgccgaagttgtatcttaagcaccagatggatcttgtcgcgacattgtcacagctgggcctgcaggagctttttcaggctccggacttgagaggcatctctgaacagagcctggtggtgtcaggcgtccagcaccagagcacactcgagctgagcgaggtgggggtcgaagctgccgcagccacatctattgcaatgtctcggatgtccctgagttctttctctgtaaacagaccatttctctttttcatttttgaagatactacgggattgcctctgttcgtgggctctgtccgaaaccctaacccgtctgcccccagggagctcaaggagcagcaagactcaccggggaacaaggacttcctgcagagcctcaagggctttccgcgcggggacaagttgtttggccccgacctgaaactggtgccccccatggaggaggattacccccagtttggctcccccaag

SEQ ID NO: 18947 - DNA, 1473 bp, Artificial Sequence
  Description of Artificial Sequence: Synthetic coding sequence
atggccctgttgtggggtctcctcgtgttaagctggagctgtctccagggcccttgctcggtattttcccccgtttccgcaatggaacctttgggcagacagctcacgtccggtccgaatcaagaacaagtttcccctctgacattgttaaagctcggcaaccaggaaccaggcggccagacggccttgaaatcgccaccaggcgtctgcagccgggacccgactcctgagcagacacaccgtctggcccgggccatgatggcttttacagccgacttgttttctctggtggcccagacctccacttgtcccaacctcattctttcccccctgtccgttgcgcttgcgctatcccatctggcattgggggcgcagaatcacacgctacagaggctccagcaggtgctgcatgcaggctctggcccatgcctgccccacctactcagccgcctgtgccaggatctcggtccgggagcattccggctcgccgctcgaatgtatctccagaagggcttccccataaaagaggactttctggaacagtcggagcagctgtttggggccaaacctgtttcgctcactggcaaacaagaggatgacctggctaacatcaatcaatgggtcaaggaggcaaccgagggcaagatacaggagtttctgtcggggcttcccgaggacacggtgctgttgcttctgaatgcaattcacttccaagggttttggagaaacaagttcgatccttcactgacacaacgagacagctttcacttagatgaacagtttaccgttcccgtggaaatgatgcaggcccgcacttaccccctgcggtggttcctcctggaacagccggaaattcaagttgctcacttcccctttaaaaataacatgtctttcgtcgttctggttcctacccactttgagtggaacgttagccaggttttagccaacctgtcttgggataccctgcaccctcccctcgtgtgggaacgtcctacaaaagtccggttacccaagttatacctgaagcatcagatggaccttgtagctacgctttcgcagttgggccttcaggagctcttccaggctccggatctgaggggcatctccgaacagtccttagtggtcagtggtgtccagcaccagagcaccctggaactgtctgaagttggcgtggaggcggctgcagccacgtctatcgcaatgagcagaatgtccctctcaagttttagcgttaaccgcccctttctgttcttcattttcgaggacacgactggtcttcccctgttcgtgggcagtgtacggaatccgaatcctagtgccccaagagagctgaaggaacagcaagattctccagggaacaaggatttcctgcaaagcctgaaaggattcccaagaggagacaagttatttggccccgatctcaaattggttcctcccatggaggaggactaccctcagtttggctcccccaag

SEQ ID NO: 18948 - DNA, 1473 bp, Artificial Sequence
  Description of Artificial Sequence: Synthetic coding sequence
atggccctgttgtgggggctcctggttctgagctggagttgcctgcaaggcccgtgcagcgtgtttagtcctgtcagcgcaatggaaccgctgggtcgccagctgacgagcggtccgaatcaggagcaagtctcacccctgacgctgctgaaattgggtaaccaggagccagggggtcaaaccgctctgaagtctccacctggggtctgtagtcgcgatccaacacctgagcagactcacaggctggcgcgcgcgatgatggccttcacggcagacctgttctcactggtagctcagacgagcacttgtcctaatctgatcttgagcccactatctgttgctctggccctgagccacctggcactaggcgcacaaaaccacacgctgcagcgactgcagcaggtgttgcatgccggcagcggtccgtgcctaccacacctgttgtcacgcctttgtcaggacctcggtccaggtgctttccgtttggcagcccgaatgtacctccagaaaggctttcctattaaagaggattttctggagcaatccgaacagctgtttggggccaaaccggtgtctctgacggggaaacaggaggacgacctggccaacatcaaccagtgggtgaaggaggcaacggagggtaagattcaggagtttctgtctggccttcctgaggacactgtcctcctgttgttgaatgccatccatttccagggtttttggcgcaataagtttgacccgtccctgactcaacgcgacagcttccatctggacgagcaatttactgtgccagtcgagatgatgcaagcccgcacgtatcctctgcgttggttcttgttggagcaacctgagattcaggtggctcatttcccctttaaaaacaatatgagtttcgttgtgttggtgcctacccactttgagtggaatgtaagccaagttctggctaatctgtcttgggacacactgcatcctccgctcgtttgggagaggccgactaaagttagactgcccaaactatatctgaaacatcaaatggatctggttgctacactgagccagctgggtctgcaggaactgttccaagcgccagacctacgcggcataagcgaacagtctctggtcgtttccggggttcaacaccagtcgacgctggagctgagcgaagtgggagtggaagcagctgccgccaccagcatcgcgatgtctcgcatgtccttgagctcctttagcgttaatcgtccttttctgtttttcattttcgaggacaccacgggtctgccgctgtttgtgggttctgtgcgcaatcctaacccgtcagcccccagagaattaaaggaacagcaagattccccgggaaataaggactttctccagtcattgaaaggctttccacgcggcgacaaactcttcggtcctgatttaaaactggtccctccgatggaggaggactacccgcagtttggttctccgaag

SEQ ID NO: 18949 - DNA, 1473 bp, Artificial Sequence
  Description of Artificial Sequence: Synthetic coding sequence
atggcgctgctgtgggggctcttggtactgtcctggtcttgtctccagggcccctgtagcgttttcagccccgtgtcagctatggagcccctgggccgccagctcacatccgggcctaaccaggaacaggtaagtccgttgacccttctgaaactgggcaaccaggagccaggcggccagactgctttgaaatctccgcctggtgtgtgtagtcgggatcccacgcctgagcagactcacagactcgctagggccatgatggcctttacggccgatctcttctctctcgtggcccagaccagcacatgtcccaacctgattttgtcaccgctttccgtggctctggctctttcccacctggcacttggggcacagaaccataccctccagcgccttcagcaggtattgcacgccgggagcggcccatgcctgccccatctgctgtctaggctctgccaggacctgggacccggggcattccggctcgccgcaaggatgtacctgcagaagggcttccccatcaaagaggactttctggaacaatctgaacagctgtttggcgcgaaaccagttagcctcacaggtaagcaggaggatgatctcgctaacataaaccaatgggttaaggaagccaccgagggaaagatccaagaattcctctccgggctgcctgaggatacagtccttctgttgctgaacgctattcatttccaggggttttggaggaacaagttcgatccctctctgactcagcgggactcctttcatctcgacgaacagtttactgtgcccgtggagatgatgcaggccagaacctaccctttgcggtggtttctcctcgagcagccggaaatccaggtagcgcactttccattcaagaacaacatgtcctttgtggtcctggtacctacccattttgagtggaatgtcagccaggtgcttgctaacctttcttgggataccctccatccaccgctggtgtgggaaaggcccacgaaggtccgcctgcctaaactgtatctgaagcaccaaatggacctggtcgctactctttcccagctgggcctccaggagctttttcaggctcctgacctgcgaggtattagtgagcaaagtctcgtggtgagtggcgtgcagcaccagagtacactggagctgagcgaggtgggtgttgaggcagccgctgcgacatccattgccatgtccaggatgtcccttagcagcttctcagtgaatcggccattcctttttttcatttttgaggatacaacaggactccctttgtttgttgggagtgtccgaaaccccaatccgtccgcacctagggagctcaaagagcagcaggactcccctggaaataaggatttccttcagagcctgaaaggcttccctcgaggagacaagctctttggccccgacttgaagctcgtcccgcctatggaggaagattatcctcagttcggctcacccaaa

SEQ ID NO: 18950 - DNA, 1473 bp, Artificial Sequence
  Description of Artificial Sequence: Synthetic coding sequence
atggcactcttgtggggtctgttggtactgtcatggtcctgcttgcaggggccttgcagtgtgtttagccccgtgtccgcaatggagcctctgggacggcagctaacttccggcccgaaccaagaacaggtctcgcccctgacactgctgaaactgggcaatcaggaacctggcggtcagaccgctttgaagtcgccccctggagtctgttcaagagaccccacccccgagcagacccaccggctggcgagagccatgatggcctttacagctgatctgttttctttggtcgcccaaacaagcacttgccccaacctcattttatccccactaagcgtggcactggctctgtctcatctggctttgggtgcacagaaccacacactgcaacgtctacaacaggtcttgcacgcaggcagcggcccttgcctgcctcacctgctctcaaggctctgccaggatctgggacccggcgcatttagactagctgctcgaatgtatctgcagaagggcttcccgattaaggaagattttctggagcaatcagagcaactttttggcgcaaagccagttagtctgactgggaagcaggaggatgacttggcaaatatcaatcaatgggtcaaagaggccactgaaggcaaaattcaggagttcctcagcgggctgccggaggatactgttttattgctcctcaacgcaatccatttccagggattctggcgtaacaagtttgaccctagccttacccagcgcgattcgtttcacctggacgagcagtttacggtgccggttgaaatgatgcaggccagaacctatcctttgcgatggttcctcctggaacaaccagagatccaggtagcacatttcccatttaagaacaatatgtccttcgtggttctcgtgcccacccacttcgagtggaacgttagccaggtacttgccaacctgtcctgggataccttgcacccacccctcgtctgggaaaggccaactaaggtgcgtctaccgaaactgtatcttaagcatcagatggatctcgtggcgacattgagccagttgggactacaagagctttttcaggccccagatcttcgcggtatttctgagcagtccctcgttgtaagcggggtgcagcaccagtccacgctggaactaagcgaggttggggttgaggccgcagccgctacatcgattgctatgtctagaatgagtctctcaagcttctcagttaacagacctttcctgttttttatcttcgaggacaccactgggctgccactgttcgtgggttcggttcggaaccctaatccctctgcccccagagaactgaaggagcagcaggatagccctggtaacaaagacttcttgcagtcactcaaaggctttcccaggggagacaagctctttggacccgatttgaagctggtcccaccaatggaggaggattacccacagttcggcagcccaaaa

SEQ ID NO: 18951 - DNA, 1473 bp, Artificial Sequence
  Description of Artificial Sequence: Synthetic coding sequence
atggccctcctctggggactgctggtcctttcatggtcgtgtctccagggaccttgctcagtgttctcaccagtttcagctatggagccgctgggcagacagctgacctccggcccaaatcaggagcaggtgtcacctttgacgctgctgaagctggggaaccaggaaccaggaggccaaacggccctcaagagcccgccgggtgtgtgctccagagatccaacgcccgagcagacgcaccggctcgcacgcgccatgatggcctttaccgcggatctgttttcgctggtcgcacagacttccacgtgtccgaacctgatcctgtcgcccctgtccgtggcgctggccctcagccatctggcgctcggcgcccaaaatcacactctccaacggctgcagcaagtgctccatgccggaagcggcccatgcctgccacacctcctctcgcgcttgtgccaagatctgggtccgggtgctttccgcctggcggcgcgcatgtacctgcagaaaggcttcccgattaaggaggatttcctggaacagtccgagcagctgtttggcgccaagcctgtgtccctgactggaaagcaagaagatgaccttgccaacatcaaccagtgggtgaaggaggcaaccgagggtaagatccaagagtttttgtccggcctccccgaggacaccgtgctgctcctgttgaacgctatacacttccaagggttctggcgaaacaagtttgatccgtccctgacccaaagggacagctttcatttggacgaacagttcaccgtccctgtcgagatgatgcaagcccggacctacccgctgcgctggttcctgctggaacagccagagatccaggtggctcatttccccttcaaaaacaacatgtctttcgtggtgctggtccccacgcactttgaatggaatgttagccaagtcctggcgaatctctcctgggacaccctgcacccacccctggtgtgggaacgccctacgaaagtcaggcttccgaagttgtacctgaagcaccagatggatctcgtggcaactctgagccagctcggcctccaggagcttttccaggcacccgatttgcggggcatttcagaacagagcctcgtcgtgagcggagttcaacaccaaagcaccctggaattgagcgaagtgggggtggaggccgctgctgcaacttctatcgcaatgagcagaatgagcctcagctcgttctcagtgaatagaccgtttcttttctttatctttgaggatactaccggactgcccctctttgtcggatccgtgcggaatccaaatccatccgcgccgcgggaactcaaagagcaacaggactcaccaggcaacaaggacttcttgcaatccctcaagggcttcccccggggtgataaacttttcggaccggatcttaaactggtgccgccaatggaagaggactacccgcagttcggatcgcctaaa

SEQ ID NO: 18952 - DNA, 1473 bp, Artificial Sequence
  Description of Artificial Sequence: Synthetic coding sequence
atggcacttttgtgggggctattggtgctctcatggagttgtctccagggaccctgctctgtattcagccctgtctcagccatggagcctctgggtagacagttaacgtccggccctaaccaggagcaggtatccccattaacgctactaaagctggggaatcaagaaccgggaggccaaacagccttgaaatcccccccaggggtgtgttcccgcgaccccacccccgagcaaacccaccgcttagctagagctatgatggccttcaccgcagacctgtttagtctggtggcgcaaacctccacttgtccaaacctcatactgagtcctctgagtgtcgcactggctcttagtcatttggcactgggagcccaaaatcataccttgcagaggttacagcaggtgctgcacgccggatctggaccgtgcctcccccatttgttatcccggttatgccaagacctggggcccggtgccttccgcctggctgcccggatgtaccttcagaagggattcccaattaaggaagacttcctcgagcagtccgagcagttattcggggccaagccagtatccctcaccgggaagcaggaggatgatctcgctaatataaaccagtgggtgaaggaagcaactgagggtaagatccaagagtttttgtctggcctgcccgaggacaccgtcctgctgctgctgaatgcgatccattttcagggcttttggaggaataaattcgatccaagtttaactcagcgtgacagcttccacctagacgagcagttcacagtgccagttgaaatgatgcaggctagaacatatccactccggtggttcctgctagaacagcccgaaattcaggtcgcgcatttcccgtttaagaacaacatgtctttcgtggtattagtccctacccactttgagtggaatgtcagccaggtgctcgcgaacctctcctgggatacgctgcatcctcccctggtctgggaacgacctaccaaggtacgtctgccaaaactgtacttgaagcaccagatggatctggtggcaaccctctctcaactgggactgcaggagctgtttcaggcaccagatcttcgaggaatatccgagcaatctctcgtggtgagtggagtacagcatcagtccacactggagttgtctgaggtgggtgttgaagctgccgccgcaacctccattgctatgagtcgtatgtcactctcgtcctttagcgtcaaccgtccctttctgttcttcattttcgaggacacaaccgggctccccttattcgtgggatccgtgaggaacccaaacccatccgccccccgggaattgaaggagcaacaagattcccccggcaacaaagattttctccagtcgctgaagggcttccctaggggcgataaactgtttggaccagatttgaaactggttccgccaatggaggaggattatccccaattcggatcacccaag

SEQ ID NO: 18953 - DNA, 1473 bp, Artificial Sequence
  Description of Artificial Sequence: Synthetic coding sequence
atggcgcttctatgggggctgttggtcttatcttggtcttgtctgcagggaccatgttctgtcttttcaccggttagcgcaatggagccgcttggccgtcaactgacttccgggcccaatcaggaacaagtgtcccccctcacattgctgaagctgggtaaccaagaaccaggcggtcaaactgcgctgaaaagcccccctggcgtgtgctcaagagacccgacacctgagcaaacccacagactcgcacgtgccatgatggcatttaccgcagatttgttttccctggtcgcgcagactagtacctgccctaatcttatcctgagccccctctcagtggcgctggccttgtcacacctggccttgggcgcacagaaccacacactacaaagactgcagcaggtgctccacgctggaagtggaccttgtcttccccacctcttaagtcggctctgccaggacctgggacccggtgccttccgattggccgccaggatgtatctccagaagggatttcccatcaaggaggatttcctcgagcagtcggagcagttatttggggccaagcctgtttctctcaccggtaaacaggaagacgatctggccaacattaatcagtgggtaaaagaagccaccgagggtaagatccaggagttcttgtccggtctccccgaggatacagtgctcttgcttttgaacgcaatacatttccaggggttttggcggaacaagttcgacccaagtttgacccagcgcgactcgtttcacctcgatgaacagttcacagtgccagttgagatgatgcaggctagaacctacccactgcgatggtttctcctcgagcaacccgagatccaagtggcacactttcccttcaagaacaatatgagctttgtagtcctcgtacctacccacttcgaatggaacgttagccaggtcttggccaacttgtcttgggacaccctgcatccccccctggtctgggagaggcctactaaggttcgtctgcccaagctctacctgaaacaccagatggatctcgtggctacactgagccagctgggtctacaggagctgtttcaggctcctgaccttagaggcatttccgagcagtctctggtggtatctggtgttcaacaccaatctacattggagctatccgaggtgggagtcgaagccgctgctgcaacaagtatagcgatgtcacgcatgtctcttagtagttttagcgtgaaccgcccattcctttttttcattttcgaagataccaccgggttgccactctttgtcgggagtgtgaggaacccaaatcctagcgccccacgcgaacttaaggagcaacaggattcccccggtaacaaggatttcttgcagagtctgaagggattccctaggggtgacaaactgttcggacctgatcttaaactggtgcccccaatggaagaggattatccgcagtttggcagccccaaa

SEQ ID NO: 18954 - DNA, 1473 bp, Artificial Sequence
  Description of Artificial Sequence: Synthetic coding sequence
atggcgctgctgtggggcctgctggttttgagctggagctgcctccagggcccttgcagcgtgttcagccccgtcagcgcaatggaacccttgggtagacagcttacaagtggtcccaaccaggaacaggtatcccctttgacacttctgaagctcgggaaccaggagccaggaggccaaaccgctttgaaatcaccaccaggtgtgtgttctcgggaccccacgcccgaacagacccatcgattggccagagcaatgatggctttcacagcagacctattttccctggtggcccaaaccagtacttgccctaacctgattctgtccccgcttagcgtggccttggcactgtcccatctggcattaggtgcacagaaccacactctccagcgtctacaacaggtgctacatgctggaagcggtccatgtctaccccacctgctctccagactctgtcaggacttgggcccgggcgcttttcgtcttgcagcacggatgtatctgcagaagggttttcctataaaggaggacttccttgaacagtctgagcagctgttcggcgcaaagcctgtgtccctgactgggaagcaggaggacgatctcgccaatattaaccagtgggtgaaggaagcaacagaaggcaagattcaggagtttctgtcgggtttgcccgaggataccgttctgttgctgctaaacgccattcatttccagggattttggcgcaataaattcgacccctcactaactcagagagatagctttcatctggacgagcagttcacggtgcccgttgaaatgatgcaagcccgcacctatcctctgaggtggttcttgctggaacagcctgaaatccaggtcgctcatttcccatttaagaacaatatgtcatttgtagtcctggtgccaacacatttcgagtggaacgtcagccaggtccttgctaatctctcgtgggataccctccaccctcctctggtgtgggaacgaccaacaaaagtcagactacccaagctataccttaagcaccagatggacttggtggccacactgtctcagctcggccttcaggagttgttccaggcccctgacctccgcggtataagcgagcagtccctcgtagtgagtggcgtccagcaccagtcaacactggaactatctgaggtgggtgtggaggctgctgcagctaccagcatagcaatgtccagaatgtctctgagctctttttcggtgaatcgtccctttctcttcttcatttttgaggatacgaccgggttgcctctgttcgtggggtccgtccggaaccctaacccttcggcaccgcgcgagctcaaagagcagcaagattccccaggtaataaggattttttgcagtcactgaagggcttcccaaggggcgacaagttattcggtcccgatctgaagctggtgcctcccatggaggaggattacccgcagttcgggtctccgaag

SEQ ID NO: 18955 - DNA, 1473 bp, Artificial Sequence
  Description of Artificial Sequence: Synthetic coding sequence
atggcgctgctttggggcctgctggtgctcagctggagctgcctgcaaggtccatgtagtgtattttctcccgtgagtgccatggagcctttgggaaggcagttgacatctggccctaatcaggagcaagtgtcccccttgactctgctgaagctgggtaatcaggagcctggggggcaaaccgctcttaaaagcccacctggagtgtgttctagggatccgacccctgagcagacacataggctggcccgggcaatgatggcttttacagctgacctcttcagtttggttgcccaaacttctacctgcccaaatctgattcttagccccctgtcagtcgcacttgctctgtctcatctcgctcttggggctcaaaaccatacgctgcagcgattgcagcaggtgctgcatgcaggctccggcccatgtcttcctcatcttctgagtcggctgtgtcaagatctggggcccggcgcctttaggcttgccgctcggatgtacctccagaagggatttcccatcaaggaggatttcctcgaacagtcagagcagctgtttggcgccaaaccagtgtccctgaccggcaaacaagaagatgatcttgccaacatcaatcagtgggtgaaggaagctaccgagggtaagatccaggaatttctgtccgggttgccagaagacactgtccttttgcttttgaatgcaattcatttccagggattctggcggaataaattcgatccgtctctcactcagcgggattcttttcaccttgacgagcaattcactgtgccagtcgaaatgatgcaggcaaggacatacccactcaggtggttcctgctggagcagccagagatccaggtggcccactttccatttaagaataatatgtcctttgttgtcctggttcccacccatttcgaatggaacgtcagccaggtgttggctaacctgagttgggatacgctccatcccccactcgtctgggaacggcctaccaaagtccggctgcctaaactttatctgaagcatcagatggatctggtggccacgttgtcacagctgggcctgcaggagctgtttcaggcgcccgacttgcgaggcatttcagagcaatctctggttgtgtccggggtgcagcatcagagtactctcgagttgagcgaagtcggagttgaggccgcagcggcaacctctatcgccatgagcagaatgagcctgagctccttctccgtcaaccggccttttctcttttttatctttgaagataccactggacttccactgttcgtgggttctgtgcggaaccctaatccctcagctccaagagagctgaaggagcaacaggatagcccagggaataaggactttctccagagtctgaaggggttccctcgaggggataaactcttcgggcctgatctcaaactggtcccacccatggaggaagactatccgcagttcgggtctcccaag

SEQ ID NO: 18956 - DNA, 1473 bp, Artificial Sequence
  Description of Artificial Sequence: Synthetic coding sequence
atggcacttctctgggggcttctggtattgtcatggtcgtgtttacagggcccctgcagtgtttttagtccagtgtcagctatggagcctttgggcagacagctcacttccggtcccaaccaagagcaagtttcccctcttacactgctcaaattggggaatcaggaacccggtggccagaccgctcttaagtcaccgccaggagtgtgttcccgagatccaactcccgaacagactcacaggctggctcgggccatgatggcctttaccgccgatttattttccctggttgcgcagacctcaacctgtccgaacctaatcctgagccctttatcagtcgcccttgcactctcccacctcgccctaggcgcccagaatcacactctacagaggctgcagcaggtcttgcacgcaggatctggaccttgtctgccccatctgttgagcagactctgtcaagacctggggcctggagccttcaggctagctgcacggatgtacctacagaagggctttccaattaaggaagacttcctggagcagtcggagcagttattcggagctaaaccggtgagtttgactggtaagcaggaagacgatctggccaatataaaccagtgggtaaaggaagccacagaggggaaaatccaggaatttctcagcgggctgcctgaggacacggtcctcctcttgctgaatgccatacattttcaggggttttggcgaaataagtttgatccaagtctcacgcaacgcgattctttccacctagacgaacagttcactgttccggtggagatgatgcaggcgaggacctacccgctgagatggtttctgttggagcaacctgagatccaggtggcacacttcccctttaaaaacaacatgagtttcgtagtgctggttccaacacactttgaatggaatgtctcccaggtgctggcgaacctgtcgtgggacacactgcacccaccactggtctgggagcgtcccactaaagtccgccttcccaagctctatctcaagcatcagatggatttggtagccactctgagtcaactgggtctgcaggagctgtttcaggcacccgatttacggggaattagcgaacaatctttagtcgtatctggtgtgcaacatcagtcaaccctggaattatctgaggtaggcgtggaggcagccgctgctacctctatcgcgatgagcaggatgtcattgtctagttttagcgtaaatcgccccttcctcttttttattttcgaggacactactggccttcctctgtttgtgggttccgtgcgaaatccaaatccctcagccccacgggaattgaaggagcaacaggacagtcctgggaacaaggacttcctccagtccctaaagggatttccccgaggggacaagctgttcggtcccgatctgaagctggtgcctcccatggaggaagactacccccagttcggatctcctaag

SEQ ID NO: 18957 - DNA, 1473 bp, Artificial Sequence
  Description of Artificial Sequence: Synthetic coding sequence
atggctctactgtgggggctgcttgttctttcctggtcttgcctccagggcccatgtagcgtattttctcccgtcagcgctatggagcctctgggaaggcagctaacaagcggtccaaaccaggagcaagtttcccccctgaccctgctgaagctgggaaatcaggaacctggcgggcagacggcactgaaatctcctccaggcgtgtgcagtagagaccccacccccgagcaaacgcataggctcgcgcgagccatgatggcatttactgccgaccttttctctctcgtggcacagactagtacatgtcctaacctgatcttatcaccgctgagcgtagctctggccctatcacacttggcgctgggcgcccagaaccacaccctccaacggctgcagcaggtgctgcacgcaggtagtggaccttgtctgcctcacctcctttcgaggttgtgtcaagacctggggccaggtgcatttaggttagcagctaggatgtatctccaaaagggattccctatcaaagaggacttcctcgagcagtccgagcagcttttcggggctaagccagtatccctgaccggaaagcaggaggatgatctagcgaatattaaccagtgggtcaaggaagccaccgaaggaaagattcaggagttcctttctggtctcccagaggacacagttttactcttgctgaatgccattcatttccagggcttctggcgcaacaaattcgacccaagcctcacccagcgagattccttccacctggacgagcagtttacggtcccagtggaaatgatgcaagcacgaacctatcctctccgatggtttctcctggagcaacctgaaatccaggtggcccacttccccttcaaaaataatatgtctttcgtggttctcgtacccacgcactttgaatggaatgtgtctcaggtgcttgccaatctctcttgggacacactgcaccccccattggtgtgggaacgaccaacaaaggtccgactccctaagctgtatctgaaacaccagatggacctggtggcaacgttaagccagctcggtctccaagagctcttccaggcccctgacctgcggggcatcagcgaacagtccttggtggtctcaggagttcagcaccagtcaacgttggaactcagtgaggttggtgtagaagctgccgcggctacatctatcgctatgtctagaatgagcctgtcttctttttctgtaaaccgccccttcctgttcttcatctttgaagacactactgggttgcccctttttgttggttccgtgaggaatcctaacccatctgcaccccgggaactgaaagaacaacaagactcgcccggcaacaaagactttttacaatccctgaaaggattcccccggggtgataaactgttcgggcctgacctgaagctcgtccctccaatggaagaggattacccacagttcggctccccaaaa

SEQ ID NO: 18958 - DNA, 1473 bp, Artificial Sequence
  Description of Artificial Sequence: Synthetic coding sequence
atggcactcctatggggcctgctcgtcctgtcttggagctgtctgcaggggccctgtagtgtgttcagccctgtgagtgctatggagcccctcggtcgccaactcactagcggcccgaatcaagaacaagtgagccccctcactttgctaaagcttggaaaccaagagccaggcggacagacggcgctgaagagtccacctggggtgtgcagccgcgacccaaccccggagcagactcacagacttgcaagggctatgatggcctttacagctgatcttttttctctcgtggctcagaccagcacgtgccctaatctaatcctgtctcccctttccgtggcacttgctctgagtcatctggcgctgggcgctcagaatcacacacttcagcggttgcagcaggttctgcatgccgggagtggtccgtgtctcccgcatcttctgtcccggctgtgccaggacctgggccctggggcttttaggctcgccgcacggatgtacctacaaaagggttttccaattaaagaggactttctggaacagtccgagcagctatttggagcaaagccggtttccctgaccggcaaacaagaggatgatttggccaatatcaaccagtgggtgaaggaggccaccgaggggaagatccaggagtttctgagcgggcttcccgaggacacagtgctgctgctcctaaatgccattcattttcagggcttttggaggaataagtttgacccctctctgactcagagagattcctttcatctcgatgagcagttcactgttcccgtggagatgatgcaagcccggacctatcccctgcggtggttcttgttagagcagcctgagattcaggtggcacacttcccctttaaaaataacatgtcctttgtggtcctggtgcctacacacttcgagtggaatgtgagccaggtgttagctaacctatcctgggatacattgcaccccccgcttgtatgggaaaggcctaccaaggtcaggctgcccaagctgtacctcaagcatcagatggatctggtggccacactatcccagttgggtctgcaagagctctttcaagcccctgatctaagagggataagcgagcagtcattagttgttagtggcgtccagcatcaaagcactctggaactctccgaggtgggcgttgaggccgctgctgccacctctattgccatgtcacggatgtcgctcagctcgttctcagtaaataggccattcctctttttcatcttcgaggatactaccggactccccctgttcgtaggctctgttagaaatccgaacccgtccgcccctcgcgaactgaaggaacagcaagacagccccgggaacaaggactttctccagtcgctgaaaggctttcctcgtggagacaagctgttcggacccgatctgaaactggttcctccaatggaggaggactatcctcagtttggcagccccaaa

SEQ ID NO: 18959 - DNA, 1473 bp, Artificial Sequence
  Description of Artificial Sequence: Synthetic coding sequence
atggctctcttgtggggcctgctagtcttgagctggtcttgcttgcaggggccctgctcagtattctcaccagtctccgctatggagcctcttggcagacagttgacaagtgggcccaatcaggagcaagttagtccattgaccctattgaaattgggcaaccaggagcctggcggccagacggcactcaagagtccacctggagtttgttcccgtgatccgacaccagaacagactcaccggctcgcccgcgccatgatggccttcaccgctgatcttttttccctcgtagcccaaacaagcacgtgtccgaatctcatattgtctcccttgtccgtggcgctggccctatcgcatttagctttgggcgcgcaaaaccacacgttacagcggctgcagcaagtgctacacgcgggctccgggccgtgtttgcctcacctccttagccgattgtgccaggatcttggacctggcgcattccgacttgccgcccgaatgtatctccagaaaggtttcccgatcaaagaagattttctagagcagagtgagcaattatttggtgccaaacccgtcagtctaacgggcaagcaggaagatgatctcgctaatatcaaccagtgggtaaaggaagcaacagagggcaaaatacaagaattcctctcaggtcttccagaagatactgttcttctactgctgaatgcaattcactttcagggattctggcgaaacaagttcgacccctctctgactcagcgcgacagctttcacctcgacgagcagttcacagtgcctgtggaaatgatgcaagctaggacttaccctctgcggtggttcttgctggaacaaccagagatccaggtagcgcactttccattcaaaaataacatgtccttcgtcgtcctagtcccaacgcacttcgaatggaacgtttctcaagtcttggcgaacctctcgtgggatacccttcacccccctctggtttgggagaggcccaccaaggtgcgccttccgaagctttatctcaagcaccaaatggatctcgtggcgaccctctcgcagctgggcctgcaagagcttttccaggcgccagacctgcgcgggatcagcgagcagagcctagtagtgagtggtgtacagcaccagagcacattggaactttcggaagtaggggtcgaagctgccgcagcgacgtccatcgcgatgtctcggatgagtctatcctccttcagcgtcaaccgaccattcctgttctttatctttgaggacacgaccggtctccctcttttcgttggctctgtcagaaatcctaatccctcggcacctcgcgagcttaaggagcagcaagactctccgggcaacaaagactttcttcagtctctgaaaggttttcccagaggagacaaattgtttgggccagacttaaaactggtgccccctatggaggaagattatccgcaatttgggtctccgaag

SEQ ID NO: 18960 - DNA, 1473 bp, Artificial Sequence
  Description of Artificial Sequence: Synthetic coding sequence
atggcgctgctgtggggcctgttggtgcttagttggtcctgcttacaggggccctgttctgttttttcccccgtaagtgcaatggaaccattaggccggcagttgacaagcgggcccaaccaggagcaggtaagccccttgacactccttaagttggggaaccaggagccaggaggacagactgcccttaaatcacctccaggggtttgcagccgcgatcccaccccggagcagacccataggttggcacgcgcaatgatggccttcacagccgacctgttttccttggtcgctcagacgtccacctgccctaatctcattttatcgcccttaagtgtcgctctcgcactctcccaccttgccctcggtgctcagaaccacactctgcagcgactccagcaggtattgcatgcaggcagcgggccctgcttgccgcatctcctaagtcgtctctgccaagacctcgggcctggcgccttcagactcgccgcaaggatgtacttgcagaaaggatttccaatcaaggaggatttcctcgaacagagcgagcaactgtttggtgccaagcctgtctccctaacaggaaagcaggaggacgacctggccaacataaatcagtgggtcaaggaggccacagaaggaaagatccaagaattcttgtctggcttgccagaagacacggttttgttgctactaaacgcgattcacttccagggcttttggagaaacaaatttgatccttccctgacccagcgggactcattccatctggacgaacaatttaccgttcctgttgagatgatgcaggcccggacttaccctctaagatggttcctgctggagcagcccgagatccaggtcgcacatttcccctttaaaaacaacatgtcgttcgtcgtgctggtgcctactcacttcgagtggaacgtgtcccaagtgctcgccaacctctcgtgggacaccctccacccccccctggtctgggagaggcccaccaaagttcggcttccaaaactgtatctgaagcaccagatggatctagtcgccacgctgtcgcagctgggactccaagaattgttccaggcacccgacttgcgtggcatctcagagcagtctttagtggtcagcggggttcagcatcagagcacgctcgaattgtcggaagtcggcgttgaggccgctgcggctacgtccatcgccatgtcacggatgagcctgtcatctttctctgttaatcgtccctttctttttttcatcttcgaggacaccaccggattgccattgtttgtgggatcagtgcggaaccccaatccgtctgctccccgggagttaaaggagcagcaagacagccctggcaataaggatttccttcagagccttaaggggttcccccgcggtgacaagctttttggccctgatctgaagttggtgccaccaatggaggaagactacccgcagttcggctcccctaaa

SEQ ID NO: 18961 - DNA, 1473 bp, Artificial Sequence
  Description of Artificial Sequence: Synthetic coding sequence
atggccctgctctgggggttattggtattgtcttggtcatgtctgcaggggccctgttctgtcttcagtcctgtctcagcaatggaacccctcgggcgacagctcacttctggacctaatcaggaacaggtcagtcctctcactctgctcaaattagggaaccaggaacctgggggacagactgccctaaaaagtccccccggggtttgcagtcgtgatcctactccagaacagacacaccgactggcaagagcaatgatggcctttactgccgatttattttccctggtcgcccagacaagtacatgccccaacctcatcttgtcccctctttctgtcgcccttgccctgtcccatttggcactcggggcccaaaaccacactctccagcgacttcaacaggttctccacgccgggagtggaccctgcttaccacacctcttatctagattatgccaagatcttgggcccggagcattccggctagccgccagaatgtatttacagaaagggtttcccattaaagaagattttcttgaacagtctgaacaattattcggggccaagcccgtgtctctaactgggaaacaggaagatgatctggcaaatatcaaccagtgggtgaaagaagctacagaagggaaaatacaggaatttcttagtggactacccgaagacactgtccttttactactcaacgctatccattttcaggggttttggaggaataagttcgatccttctttaacacagcgagatagtttccaccttgatgagcagttcactgtgcctgttgaaatgatgcaggctcgaacgtatccacttcgctggttcctattagagcagccagagattcaggtggcgcatttccccttcaaaaacaatatgtctttcgtcgtgttggtccctacacactttgagtggaatgtgtcccaggtacttgcaaacttatcttgggatactctccacccacctcttgtgtgggaacggccaactaaagtgagactgcctaaattgtatcttaaacatcagatggatctggtggccactttgagtcagctggggcttcaggaactctttcaggcccctgacctgcggggaatctcagaacaatcactagtagtaagtggggtacaacatcagtctacgctagagctcagtgaagttggagtcgaagctgcagccgcaacatccatcgcaatgtcccgaatgtctctttccagtttctcggtaaatcgacctttcttatttttcattttcgaggatactactggactcccactgttcgttgggtctgtacgcaaccccaatccttccgccccacgggaattaaaagagcagcaggattctcccgggaataaagattttctccagtcactcaaagggttcccccggggggacaaactcttcggaccagatctcaaattggtgccaccaatggaagaagattatccccagtttggatccccaaaa

SEQ ID NO: 18962 - DNA, 1473 bp, Artificial Sequence
  Description of Artificial Sequence: Synthetic coding sequence
atggcgctattatggggtctactagttctatcgtggtcgtgtttacaaggtccgtgttcggtattttcgccggtatcggcgatggaaccgttaggtcgtcaactaacgtcgggtccgaatcaagaacaagtatcgccgttaacgctattaaaattaggtaatcaagaaccgggtggtcaaacggcgttaaaatcgccgccgggtgtatgttcgcgagatccgacgccggaacaaacgcatcgactagcgcgtgcgatgatggcgtttacggcggatttattttcgttagttgcgcaaacgtcgacgtgtccgaatctaatattatcgccgttatcggtagcgttagcgttatcgcatctagcgctaggtgcgcaaaatcatacgctacaacgactacaacaagttctacatgcgggttcgggtccgtgtctaccgcatctattatcgcgtttatgtcaagatttaggtccgggtgcgtttcgattagcggcgcgaatgtatttacaaaaaggttttccgataaaagaagattttttagaacaatcggaacaactatttggtgcgaaaccggtttcgctaacgggtaaacaagaagatgatctagcgaatataaatcaatgggtaaaagaagcgacggaaggtaaaatacaagaatttttatcgggtctaccggaagatacggtattattactactaaatgcgatacattttcaaggtttttggcgaaataaatttgatccgtcgttaacgcaacgagattcgtttcatctagatgaacaatttacggtaccggttgaaatgatgcaagcgcgtacgtatccgctacgatggtttttactagaacaaccggaaatacaagtagcgcattttccgtttaaaaataatatgtcgtttgtagtattagtaccgacgcattttgaatggaatgtatcgcaagtattagcgaatctatcgtgggatacgctacatccgccgttagtatgggaacgtccgacgaaagttcgtttaccgaaattatatctaaaacatcaaatggatttagtagcgacgttatcgcaactaggtctacaagaactatttcaagcgccggatttacgtggtatatcggaacaatcgttagtagtatcgggtgtacaacatcaatcgacgttagaattatcggaagtaggtgttgaagcggcggcggcgacgtcgatagcgatgtcgcgtatgtcgctatcgtcgttttcggtaaatcgaccgtttttattttttatatttgaagatacgacgggtttaccgctatttgtaggttcggtacgtaatccgaatccgtcggcgccgcgagaattaaaagaacaacaagattcgccgggtaataaagattttttacaatcgctaaaaggttttccgcgaggtgataaattatttggtccggatttaaaactagttccgccgatggaagaagattatccgcaatttggttcgccgaaa

SEQ ID NO: 18963 - DNA, 1473 bp, Artificial Sequence
  Description of Artificial Sequence: Synthetic coding sequence
atggccttgctttggggtttgcttgtcctctcatggagctgccttcagggaccatgttcggtcttttcgcccgtgtcagcaatggaacctctcggtaggcagctgacttcagggcctaaccaagaacaagtgtcgccccttacgctgctcaagctcggcaaccaagagcctggcggtcaaaccgcgcttaaatcgccccccggagtttgttcccgggatcccaccccagagcagactcataggcttgcaagggctatgatggcattcacggccgatctcttctccctggtcgcccaaacctcgacttgcccgaatcttatactcagcccactttcagtggcacttgccctctcacacctggcactgggggcacaaaaccataccctccagagacttcagcaggtgctgcacgcaggatcgggaccatgtctcccacatctcctttcgcggctttgtcaggatctgggcccaggagcattcagactcgcggcaagaatgtacctccaaaaggggttcccaattaaggaggattttctcgaacaaagcgagcaacttttcggtgcaaagcccgtctcactcaccgggaagcaggaagatgacctggcgaatatcaatcaatgggtgaaggaagccactgaagggaagattcaggagtttctctccggcctccccgaggatactgtcctgctgctgctgaacgccatccattttcaaggtttctggagaaacaagtttgacccgtcgctgactcagagggattccttccatttggatgagcagttcactgtgccagttgaaatgatgcaggccaggacctacccactccgatggtttctcctggaacaaccagaaattcaagtggcgcacttccccttcaagaacaatatgagctttgtggtgctggtcccgacccattttgagtggaacgtgtcgcaggtgctggcgaacctctcgtgggacactcttcaccccccacttgtgtgggaacgccctactaaagtgcgtctgcctaaactctacctcaagcatcagatggatcttgtggcaacgctctcgcaactcgggctgcaagaactgttccaagcacccgaccttaggggtatctcagagcagtcgcttgtggtatctggtgtgcagcatcaatccactctcgaactttcggaagtcggtgtggaggctgcagccgccacctctatagcaatgtcacggatgtccctgagctctttctccgtcaaccgcccattccttttcttcattttcgaagataccactggtctgcctctgtttgtgggaagcgtccgcaacccaaatcctagcgcacctcgggaactgaaggagcaacaggactcgcccggaaacaaggactttctgcagagcctcaaaggcttcccacgaggcgataagctgttcggtcctgacctgaaactggtgccaccaatggaagaagattacccacagtttgggagccccaag

SEQ ID NO: 18964 - DNA, 1473 bp, Artificial Sequence
  Description of Artificial Sequence: Synthetic coding sequence
atggcacttctctggggcctccttgtgctttcctggtcatgcctgcagggcccttgctcagtctttagccccgtgtcggcaatggagccactcggtaggcaactgactagcggacccaatcaggagcaagtgtcccccctgaccctccttaagttggggaaccaggaacctgggggtcagaccgcactgaaatctccaccgggagtctgctcccgggatcccaccccagaacagacccatagacttgcacgcgccatgatggcatttaccgcggatctcttttcacttgtggcgcaaacctcaacttgcccaaaccttattctttcgcctctttccgtggcactcgcactgtcccatctcgccctcggggcacagaatcatacgttgcaaagactgcagcaggtgcttcatgcaggatcaggcccatgtctcccacatcttctttcccgactgtgtcaagacctcgggcctggagctttccgccttgcagctcgaatgtaccttcagaaaggttttcccatcaaggaagatttccttgaacaatcggaacagctgtttggagcaaagccagtctcgctcaccggaaagcaagaagatgatcttgctaacataaaccaatgggtgaaggaagcaactgaaggtaagatacaggagttcctttctggtctgcccgaagataccgtgttgcttttgttgaacgcaattcatttccaggggttctggcggaacaagtttgatccatcgctgactcaaagagattcgtttcatctggacgaacagttcactgtgcccgtcgaaatgatgcaggctagaacttacccccttagatggttcctcctggagcagccagaaattcaagtggcacatttcccatttaagaacaacatgtcttttgtggttcttgtgccaactcattttgaatggaatgtgagccaagtcctggcgaatctgtcatgggacactttgcatcctccactggtctgggaacgacccaccaaagtgcgcctgccgaagttgtacctgaagcaccagatggatctggtggctaccctttcgcagctgggactccaagagcttttccaggcccctgatctgcgcggaatttcagagcagagcctggtggtgtccggcgttcagcaccaaagcactttggagctgtcggaagtcggcgtggaggcagcagcagcgaccagcattgcgatgtcacgaatgtccctgtcctcgtttagcgtgaaccggccgtttcttttcttcatatttgaggacaccaccggacttcccctctttgtgggatccgtgcgcaatcctaatccatctgcacctagggagctgaaggagcaacaagattctcccggtaacaaagactttctgcagagcctcaagggttttcctaggggagacaagctctttggtcctgacctgaaactggtgcctccaatggaagaagattacccacagtttggatcacctaag

SEQ ID NO: 18965 - DNA, 1473 bp, Artificial Sequence
  Description of Artificial Sequence: Synthetic coding sequence
atggccctactgtggggcttgctggtcctaagctggtcttgtctgcagggcccttgttcagttttctcacctgtgtccgccatggaacctctaggaagacaactgacaagcggccctaaccaagaacaggtttcccccttaactctgctgaaactggggaaccaagagcctggggggcagaccgccctgaagtcccccccgggggtatgttcgagggatcccacacccgagcagacacatagactcgcccgtgcaatgatggcatttacggctgacctatttagtctcgttgcccagacctccacctgtcccaacctgattctcagccctctgagcgtggcactagcactttctcaccttgctctgggggcccaaaaccataccctccaacgattacagcaagtgctgcacgctggaagcgggccttgcttgccccatctgctgtctaggttgtgtcaggatttaggccccggcgccttccgtttggcagcacggatgtatttacagaaagggtttcctattaaggaggactttctagaacagtccgaacagctattcggtgcaaaacccgtgagcttgactggtaaacaggaagatgacttggcaaacataaaccagtgggtgaaggaggccactgaaggaaaaatccaagagttcctaagcggattgcctgaagacactgtactgctcctgctcaatgctatccatttccagggcttctggagaaataagttcgacccttctctgactcaacgcgactccttccacctagacgagcaattcacggttcccgtggagatgatgcaggcaaggacgtatcccctgagatggtttcttctggaacagccagagattcaggtcgcccacttcccttttaaaaacaatatgtcctttgtcgtattggtgccaacgcatttcgaatggaacgtgagccaggttctggccaacctgtcttgggatacccttcacccacccttggtgtgggaaaggcccactaaagtgaggctccccaagctctaccttaagcaccagatggacctcgtggccaccctctcccagctcggtctacaagagctgttccaggctcccgacctacgtggcattagcgaacagagcctggtggtctccggggtgcaacatcagtctacgctggagctgagcgaagtgggagttgaggcagcagccgccactagtatcgctatgtcacgcatgagtctgtcctcctttagcgtaaatcgaccttttttgtttttcatttttgaggacactaccggacttccacttttcgtgggcagcgttcgtaatccaaacccaagtgccccccgagagctgaaagagcagcaagacagcccgggcaacaaagatttcctgcagtcccttaagggtttcccgaggggcgacaagctattcggacctgatctgaagcttgtcccacccatggaggaagactatcctcaatttggctcccccaaa

SEQ ID NO: 18966 - DNA, 1473 bp, Artificial Sequence
  Description of Artificial Sequence: Synthetic coding sequence
atggcacttctctggggcctgctcgtcctttcctggtcatgcctgcaaggtccctgttcagttttttcgcctgtgtcagcgatggaacctctgggacgccagttgacctctggaccaaaccaagagcaagtgagccctctgactcttcttaagctcggcaaccaagagcctggcggtcaaactgccctcaagtcccctccaggagtctgttcaagggaccctactccagagcagactcaccgcctggcgcgggccatgatggcatttaccgccgatttgttctcactggtggcacaaaccagcacgtgtcccaatcttatcctttcgccactgtcggtcgcactggccctgtcacatctggcgctcggtgcacagaaccacactcttcagcgactgcagcaagtgctgcatgcagggagcggaccctgtctgcctcatcttctttccagactttgtcaagatctgggacctggagcctttagacttgcagcacgcatgtacctgcagaaaggatttcctatcaaggaggattttctcgaacagagcgaacaactctttggggcgaagccagtctctctgaccgggaagcaagaagatgacttggccaacattaatcagtgggtcaaggaagcaactgaaggaaaaatccaggaatttctcagcggacttccggaagataccgtgcttctccttcttaacgctattcatttccaggggttttggcgcaacaagtttgatccgtcgcttactcaacgcgattcgtttcatctggacgaacagtttaccgtccccgtcgaaatgatgcaagcgcggacctacccactgcggtggttccttcttgaacagcctgagattcaagtggcacactttccttttaagaacaacatgtcctttgtcgtgctggtgccaacccatttcgaatggaatgtgtcccaggtgcttgcaaaccttagctgggatactctgcaccctccccttgtctgggaaaggcctaccaaggtgagactcccgaaactttaccttaagcatcagatggatctggtggcaacgctttcgcagcttggtctgcaggaactttttcaagcaccagatctccgcggaattagcgagcaaagtttggtggtcagcggagtgcagcatcaatccactcttgaactgtccgaagtgggtgtggaagcagcagcagcaacctctatagcaatgtcaagaatgtcgctctcatcatttagcgtcaataggccatttctcttctttatctttgaggacactaccggccttcctctttttgtgggctcagtgcgcaacccaaatccatcggcaccacgggaactgaaggaacagcaagactcgccaggaaataaggattttctccaaagcctgaaggggtttcctcgaggagataagctgttcggcccagacctgaagctggtgccacctatggaggaggattatccacagttcgggtcccccaaa

SEQ ID NO: 18967 - DNA, 1473 bp, Artificial Sequence
  Description of Artificial Sequence: Synthetic coding sequence
atggcattgctgtggggactgctcgtcctgtcgtggagctgtttgcaaggcccctgctcggtgttttccccagtctccgcgatggagccgctgggacggcagctgacctcaggaccgaatcaggaacaggtgtccccgctcactctgctcaaacttggcaaccaggagccaggaggccagactgctctgaaaagccccccgggagtgtgctcgagggatccgacccctgagcaaactcacagactcgcgcgcgccatgatggccttcactgcagatctgttcagcctggtggcccagacctcaacctgcccgaaccttatcttgtcaccactgtcggtggctttggcgttgtcccacctggcccttggagcccagaaccatactctgcaaagactgcagcaggtgctccacgctggaagcggaccgtgtctgccccacctcctgtcgcgcctctgtcaggacctgggtcccggagccttccggctggccgcccggatgtacctccaaaagggcttcccaatcaaggaggatttcctggaacaatcagagcagctcttcggagccaagcctgtgtcattgactggcaagcaagaagatgatctggctaatatcaaccagtgggtgaaggaggccaccgaaggaaagattcaggagttcctcagcggactgccggaggacactgtcctgctccttctcaatgccatccatttccaaggtttttggcgcaacaagtttgatccttctctgactcagcgggactcgtttcacctggacgaacagttcactgttccggtcgagatgatgcaggctcgcacgtatccgttgcgctggttcctgttggaacagccggagatccaagtggcccatttcccattcaagaataacatgagcttcgtcgtccttgtccctactcacttcgaatggaacgtctcccaagtgctggcaaacctgagctgggacaccctgcacccgccactggtttgggagaggccgaccaaggtgagactcccgaaactttacttgaagcatcaaatggatctggtggccactctgtcgcagcttgggctgcaggagcttttccaagcaccagacctcagagggatcagcgaacagtccttggtggtgtcaggcgtgcaacatcaaagcaccctcgaactttccgaagtgggagttgaggccgcggctgccacctccatcgcgatgagccggatgtcgctgagctcctttagcgtgaaccgcccgttcctgttcttcatattcgaagataccaccggcctgccgctgtttgtgggatcggtcagaaacccgaatcccagcgcgccgcgggaactgaaggaacagcaagactcgccgggcaacaaggatttccttcagtcactgaagggattcccgaggggggacaaactgttcggacctgacctgaaattggtgccgccgatggaagaagattacccgcagtttggaagcccaaaa

SEQ ID NO: 18968 - DNA, 1473 bp, Artificial Sequence
  Description of Artificial Sequence: Synthetic coding sequence
atggctctgttgtgggggttgctggtgctgtcttggagttgcctccagggtccttgcagcgtgttcagcccggttagcgcgatggaaccacttggtagacagctaacatcggggccaaatcaagagcaagtgagccccctcacactgctgaagctgggcaatcaggaaccgggcgggcaaacagctctcaagtcccctcccggcgtctgctcccgggatcctacccctgagcagactcatcgcctggccagagcaatgatggcgtttactgccgatctgttctcactagtggctcaaacaagtacctgccctaatctgattctgagccctctctccgtggctctcgctctttctcaccttgcactgggcgcgcagaatcataccttacagagactgcagcaggttttgcacgccggatctggtccttgcctgcctcacctcctgagtaggctgtgccaagacctaggacctggtgcctttaggctggccgctaggatgtacctgcagaagggcttcccaattaaagaagacttcctcgaacagagcgagcaattgttcggggctaagccagtgtcactgaccggaaagcaagaggacgacttagctaatatcaaccagtgggtgaaagaagctactgagggcaaaatccaagaattcctgtccggactgcccgaagacaccgttcttctcctgctgaacgcaatccattttcagggattttggcgaaacaaattcgacccctccctaacgcagcgggatagcttccacctggatgaacagttcaccgtgcctgtcgagatgatgcaggccagaacttatcccctcagatggttcctgctcgagcaacccgagattcaggtcgcgcactttccattcaagaacaatatgtccttcgtcgttctcgtgccgactcatttcgagtggaacgtctcccaggtgctagctaatctgagctgggacacacttcatccccccttggtgtgggagaggcccaccaaagttcgcctccctaaactctatttgaaacaccagatggacctcgtcgccactttaagccagctggggctgcaggagctgtttcaggcgcctgaccttcggggtatctccgagcagagtctggtggtaagcggtgtgcaacatcagtcaactcttgaactctccgaagttggagttgaggcagcagcggcgacgagtattgcgatgtctcgaatgagcctgagcagtttttccgtgaatcgcccctttctgttctttatcttcgaagacactaccggtttacctctgtttgtcggcagtgttcgcaaccccaacccctccgcgcctagggaacttaaggaacagcaagactcccccgggaacaaggattttcttcagagcctgaagggcttccccaggggggataaactgtttggccctgacctcaaactggtgcccccaatggaggaggattaccctcagtttggctcccccaaa

SEQ ID NO: 18969 - DNA, 1473 bp, Artificial Sequence
  Description of Artificial Sequence: Synthetic coding sequence
atggcactgctgtggggcttgctcgttttgtcgtggtcgtgcttgcagggaccttgctcggtctttagcccggtgtcggcgatggaaccgctgggccggcaacttacctcaggaccaaatcaagaacaagtgtcccctcttacgcttctgaaacttggaaaccaggaaccgggaggacagaccgccctcaaatcacctccgggagtgtgtagcagagatcctaccccggaacaaacccatcggttggcgcgggccatgatggcattcaccgctgacctgttcagtctggtggcccagacctcgacttgcccgaatctgatcctgtcaccactgtccgttgccctggcgctgtcccacttggccttgggagcgcagaaccatactctccagcgcctgcagcaggtgctccacgctggatctggtccgtgtctcccgcatctgctttcgaggttgtgccaagacctcggaccgggtgccttcagactcgcggctcgcatgtacctgcagaagggatttcccattaaggaggactttctcgaacagtcggagcaactcttcggcgccaaaccggtgtccctgaccggtaaacaggaggacgatctggctaacattaaccaatgggtcaaggaggcaaccgaaggaaaaatccaggagtttctgtccggactcccggaagatactgtgctgctgctcctgaatgcgatacacttccaaggcttctggcggaataagttcgacccttctctgacccagagagacagttttcacctggatgagcagttcactgtcccggttgagatgatgcaggcgagaacctacccgctgcgatggttcctgttggagcagcctgaaatccaggtcgcccatttcccgttcaagaataacatgtcattcgtggtgctggtgcctactcactttgagtggaatgtgtcgcaggtcctcgccaacctctcatgggatactctgcaccctccgctcgtatgggaacgcccgacgaaggtgcgtctgccaaagctctatctgaagcatcaaatggatctggtggcaactttgtcccaactcggactgcaagaactgtttcaagccccggacctgcggggaatctcggagcagtcgctcgtcgtgtccggggtgcaacaccagagcactttggaattgtccgaggtgggtgtggaagcagctgccgcgacttccatcgctatgtcacggatgtcactgagctcctttagcgttaacagaccattcctgtttttcatctttgaggacactactggactgccactcttcgtggggagcgttagaaaccccaacccaagcgcgccgcgcgagcttaaagaacaacaagactcgccagggaataaggacttccttcagagcctcaaggggttcccgcggggtgacaagctctttggacctgacctcaaactcgttccgcctatggaagaggattaccctcagttcgggtcgccgaag

SEQ ID NO: 18970 - DNA, 1473 bp, Artificial Sequence
  Description of Artificial Sequence: Synthetic coding sequence
atggccttactgtggggccttcttgttctctcctggtcatgtttgcagggtccgtgctccgtcttttctcccgtgtcggcaatggaaccactgggcaggcaacttacctcaggccctaatcaagagcaggtatctcccctgacactactgaagttgggaaatcaagaacctgggggacaaacagccttaaagtccccccccggtgtatgctcccgtgaccctaccccagagcaaacacataggttggcaagggcgatgatggctttcactgcagacctcttctcacttgtggcacagacatccacctgtcctaatctgatcctttctccgctgagtgtggcactggctttgtctcatctggccctcggagcccagaaccatactcttcaacgcctgcaacaggtgctgcacgccggctctgggccctgtctgccgcacctcttatcacggttatgccaggacctgggaccaggggccttccgtcttgccgcccgcatgtatctccagaaaggtttccctatcaaggaagacttcctcgagcagagcgagcaactgttcggagcaaaacctgtgagcctgaccggtaaacaggaggatgacctggccaatattaatcaatgggtaaaggaagctacagaaggcaaaatccaggagtttctgtccgggctgccagaggataccgttctgttactgcttaacgccatccacttccagggattttggcgcaacaagttcgatccatcccttacacaacgagactctttccacctggatgagcagttcacagttcctgttgagatgatgcaggcgagaacgtaccctttaaggtggttcttactggagcaacccgaaattcaggtggcacactttccattcaagaacaatatgtctttcgtcgtgctggtcccaacacactttgaatggaacgtgtcccaggttttagcgaatctatcatgggacactcttcatccaccactggtgtgggaaaggccaaccaaggtgcggctgccgaagctttacctgaagcatcagatggatctggtagcgaccttatcccaactaggcctccaagagctgttccaagcacccgatctgcgagggatttcagaacagagcctcgtagtcagcggggtgcaacaccagagcaccttagagctgagtgaagtcggcgtcgaagctgccgcagctacttcaatcgccatgagccggatgtctctgtcaagcttttcagttaaccgcccttttttgttcttcatctttgaagacactaccgggttgccactgtttgtggggtctgtacgcaatcctaacccttcagctccccgggaactaaaggaacagcaagactcccccgggaataaagactttctgcaaagtctgaaggggtttcccagaggggataagctctttgggccagacctgaaactcgtcccacccatggaagaggactatccccaatttgggagccctaaa

SEQ ID NO: 18971 - DNA, 1473 bp, Artificial Sequence
  Description of Artificial Sequence: Synthetic coding sequence
atggctctgctatggggtttgcttgttttaagctggtcttgccttcaggggccctgttcggtgttttcacccgtctcggccatggagcccctcgggcggcagctgacgtccggacctaatcaagaacaggtgagccctcttaccctgttgaagctgggcaatcaagaaccaggcgggcagaccgccctaaaatccccacctggggtctgcagcagggatcctactcctgaacagacacatcgcctggcacgcgcgatgatggcctttacggccgatctcttctcgctggtggcacagacatcaacatgccccaaccttattctatccccgttgtcggttgcattggctctcagtcaccttgccctaggagcccaaaatcataccttacaacgcctccagcaagtgctgcatgccgggtcggggccctgcctcccccatctgctatcgcgtctgtgccaggacctggggcctggtgcattccggctagccgcaaggatgtatctccaaaagggatttcctatcaaggaggactttctggagcaaagtgagcagctgttcggcgctaagccagtctcactgaccgggaaacaggaggacgacctggcaaatatcaaccaatgggtcaaggaagctaccgagggcaagattcaggagttcctgtctggcctgcccgaggacaccgtactcctgctgctgaacgcaattcactttcaagggttttggcggaacaagttcgatccgagtttgacacaaagggacagctttcacctggatgagcaattcacagttccggtagaaatgatgcaggctaggacctatcctctgagatggtttttgctggagcaacctgagatccaggtcgcacactttccatttaagaacaatatgagctttgtagtacttgttcccactcacttcgaatggaatgtgtcacaggtgctggcaaacctctcttgggatactttgcacccccccctcgtctgggaaaggcccaccaaggtgcggctacctaagctgtacctaaagcaccagatggacctcgtcgccaccttaagccaactcggcctacaggagcttttccaggccccagatcttaggggaatttcagaacagagtcttgtggtgagcggcgtgcagcaccaatccactctggaactgtcagaggtaggggttgaagctgccgcagcaactagcatcgcaatgagtcggatgtctctgagcagtttcagcgtgaatcggcccttccttttttttatatttgaggatacaaccggccttcccctatttgtgggctcagtgcgaaaccccaacccctcggctcctagggaactgaaagagcagcaggattcaccaggtaataaggactttctccagagcctgaaggggttcccccgaggggacaaattgttcgggccagatttaaagcttgtgccaccaatggaagaggattaccctcagttcggtagcccaaag

SEQ ID NO: 18972 - DNA, 1473 bp, Artificial Sequence
  Description of Artificial Sequence: Synthetic coding sequence
atggcacttctttggggacttcttgtgctgtcctggtcctgccttcagggaccctgctccgtgttttcaccggtgtcggcaatggaaccactggggagacaactgacttcaggcccaaatcaggagcaggtgtcccctctgactctgctcaagctgggtaaccaggaacctgggggacagactgctctgaagtcccctcctggagtctgtagcagagatccaaccccagaacagactcatcgactggccagagctatgatggcgttcactgcagacttgttcagccttgtggcacaaacttcgacctgcccgaacctcatactgagcccactgagcgtggcactggcacttagtcacttggccctgggtgcccaaaatcatactctgcaacggctccagcaagtgcttcacgcgggatccggaccctgcctgcctcatctgctgtcaaggctgtgtcaagatctgggtccaggcgcatttcgcctggcagcccggatgtacttgcagaaagggtttccgataaaggaagattttctggaacagtccgaacagctttttggcgcaaagccagtgagccttaccggaaagcaagaagatgaccttgcgaacatcaaccagtgggtcaaggaagcgactgaagggaaaattcaagaatttctgagcggacttccagaagataccgttctgctgcttcttaatgcaattcacttccagggtttctggcgcaacaagtttgacccttccctgacgcaaagagattcctttcacctggatgaacagttcacggtgcctgtggaaatgatgcaagcccggacctatcctcttcggtggtttctccttgagcaacctgaaatccaagtcgctcatttcccctttaagaataacatgtcctttgttgtcctggtgcctacgcattttgagtggaatgtctcccaagtgcttgccaacctctcatgggacaccctccacccgcccctggtctgggaaaggcctaccaaggtgcgattgccaaagctgtaccttaagcaccaaatggatctggtggcaaccctgtcccaacttggcctccaggaactgtttcaggcgcccgaccttcgcggaatttcagaacaatcgctggtggtgtcgggggtgcagcaccagagcaccctggaacttagcgaggtcggagtggaagcagcagccgcaacttcgatcgcgatgtcgcggatgagtctctcgtcgttctcggtcaataggcctttcctcttcttcatttttgaggacaccactggcctccctctgttcgtcggaagcgtgcgcaaccccaatccgagcgcccctagagagctgaaagaacagcaggattccccaggaaacaaggattttctccagagcctgaagggtttcccccgaggagataaacttttcggccctgatctcaagctggtgccacctatggaagaggactacccccagtttggctcgccaaag

SEQ ID NO: 18973 - DNA, 1473 bp, Artificial Sequence
  Description of Artificial Sequence: Synthetic coding sequence
atggccctcctttgggggttactcgtgttatcctggtcttgcctacaggggccttgtagtgtgttcagccctgtttccgcaatggaacccctgggcaggcaactcacatctggaccaaaccaggagcaggtcagcccactgaccctgcttaagctgggaaaccaggaaccaggaggtcagacagccttaaagagccctccaggagtgtgcagtagggacccaacacccgagcagacccacaggctggctcgcgctatgatggcctttacggctgacctgtttagcttggtcgcccagacttccacctgcccaaatctaatcttgagcccactctctgtggccctcgccctctcacacctcgctttaggggcacagaaccacaccctgcagaggctgcagcaggttttgcacgctgggtccggtccttgccttccccatctgctgtcacgtctttgccaggacttgggcccgggtgcttttcgcttggctgcccggatgtacttgcagaaggggttccccattaaggaggacttcctggaacagtcagagcagctgttcggcgcaaagcccgtcagtttgactggtaaacaagaagacgacctagcaaacatcaatcagtgggtgaaagaagctactgagggaaagatccaagagttcctttccggcctgccagaagatactgtgcttttactcctaaatgcaatccatttccaggggttttggagaaataaattcgatccgtctctcactcagagggactcctttcacctggacgaacagtttacagtaccagtagaaatgatgcaagctcgtacataccccctgcggtggtttctgcttgaacagccggaaatccaagttgcccattttcccttcaagaacaatatgagctttgtcgtcctggtgccaacccattttgaatggaacgtcagtcaagtccttgctaatctgagttgggacaccctgcatcctccactggtctgggagcggcccaccaaggtccgcctgccaaagttatatttgaaacaccagatggatcttgtggccaccttaagtcagctgggcttgcaggagctgttccaggcccctgatctgcgcggcatcagcgagcagtcgctggttgtgagcggggtgcagcatcagtcgacgctggagctttcggaagtgggagtggaagcagccgctgccacctctatcgccatgtctcgcatgtccctgtcaagtttcagcgttaacaggccctttttattcttcatcttcgaggatactaccggactgcccttatttgtgggatctgtccggaacccaaaccccagtgccccaagggagctaaaagaacagcaggacagccccggcaacaaggactttttacagtccctaaagggattccctcgcggggacaaactgtttgggcctgatctgaaactcgttcctcctatggaggaggactatccacaattcgggtcaccaaag

SEQ ID NO: 18974 - DNA, 1473 bp, Artificial Sequence
  Description of Artificial Sequence: Synthetic coding sequence
atggccctgttatgggggttgctagtgctgtcctggagctgtctacaggggccgtgtagtgtgttttctccagtcagtgctatggaaccgctcggacgccagttgacgtcagggcccaatcaggagcaggtgagccctctgaccctcctgaaacttgggaaccaggagccaggtggtcagacagcgcttaaatctcctcccggggtgtgctctagggatcccactccggaacagacacaccgcttggctagagcgatgatggctttcacagctgatctgttttcattggttgcccagacatctacctgtccaaacctgattctgtcacccctgagtgtggcccttgccctcagccacctggctctgggcgcacagaaccacactctacagcgcttacagcaggttctgcacgcaggctctggcccgtgcttacctcaccttttatcgagactctgccaggacctgggccccggcgcctttcgattggcggccaggatgtatctacagaaaggatttcccattaaagaggacttcttagaacagtccgagcaactgtttggcgcaaaaccagtcagcttgaccggcaagcaagaagatgatctggctaatatcaatcagtgggtgaaagaggctactgaagggaagatccaagagttcctctccggtctgccagaagatacggtgttattgttgctgaacgccattcacttccagggattttggcgtaataagttcgacccaagcctgacccaacgcgattcattccacctggacgaacaattcaccgtgccagtggagatgatgcaggcgagaacctaccctctgcgatggttcttactggagcaacccgagattcaggttgctcacttcccatttaagaataacatgtcctttgttgtgctcgtgcctactcattttgagtggaacgtcagtcaagtcctcgcaaacctttcttgggatacccttcatccacctctggtctgggagagacctaccaaggtgcggctgccaaagctatatctcaaacaccagatggacctggttgccacactgtcccaactcggacttcaggagctgtttcaagctcccgacctcaggggcatatctgagcagtctttggtggtgtctggcgtccagcaccagtccactctcgaactgagcgaggtgggtgtggaagcagctgccgccacgagtatcgcgatgagcagaatgtcactgtcttcgtttagcgtcaacagaccgtttctgttctttatcttcgaggacactaccggattgcctctctttgtcggttcagtacgtaacccgaaccctagcgccccacgagaattgaaagagcaacaggatagcccggggaacaaagatttcctgcagtcactgaaagggtttcctaggggggataaactatttggtccagacctcaaactcgtgcctccgatggaggaagattacccgcagttcgggtcccctaag

SEQ ID NO: 18975 - DNA, 1473 bp, Artificial Sequence
  Description of Artificial Sequence: Synthetic coding sequence
atggccttactctgggggctgctggttctgtcatggtcttgtctgcagggcccgtgtagcgtgttctcacctgtttcagccatggaacctctgggtcgacagctgactagcggaccaaaccaggaacaggtctcccccctgacccttctaaagctcggaaaccaggaaccgggcggacagaccgccctgaaatctccacctggggtgtgtagtcgcgatcctactcccgaacagacccatcggctcgctcgcgccatgatggcctttacagcagacctgttctccctggtggcccagacatccacgtgtcccaatctgatactcagcccgctgagtgtcgccctcgctctgtcacacctggctcttggggcccagaaccataccctgcagcggttgcagcaggtcctgcacgctgggtctggcccttgcctcccccatttgctctctcgtttgtgccaggacctcgggccaggcgccttcaggctggctgcaaggatgtacctgcagaaggggtttcccatcaaggaggactttctggagcagtccgagcaattatttggcgccaagccagtaagcctcaccggaaaacaggaggacgacctggccaatatcaatcaatgggtcaaggaggcgacggagggcaaaatccaagaattcctctctggccttcccgaggatacagtccttctattgctgaacgccatccattttcagggcttttggaggaacaaattcgatcccagcttaacccagcgcgatagttttcatcttgatgaacagttcaccgtgcccgtcgagatgatgcaagctaggacctaccccttgcgctggtttctgctggaacagcctgaaattcaggtggcccattttccttttaagaataacatgagctttgtggtgctggttccaactcatttcgaatggaacgtatctcaggttctggcgaatttgtcctgggataccctacacccaccccttgtatgggaaaggcccactaaagtcaggctgcctaagttatatctcaagcaccagatggatttggtagcaacactgagccagctcggcctccaggaactgttccaggctcccgacctgcgcggcattagtgaacagagtttagtggtttccggcgtacagcatcagtccactctggagttgtccgaggtgggggtggaggcggctgccgctacatccattgccatgtcccggatgtccctgtcttccttctccgtgaataggccatttctgttctttatcttcgaggacaccaccggtctcccgctgtttgtgggaagcgtgagaaacccaaatcccagcgccccccgtgagctcaaagaacagcaggattcgcctggtaataaggatttcctgcaatcgctaaagggattccctcgcggcgacaaacttttcggccccgatctgaagttggtcccgcccatggaggaagattatccccagtttggatctccaaaa

SEQ ID NO: 18976 - DNA, 1473 bp, Artificial Sequence
  Description of Artificial Sequence: Synthetic coding sequence
atggcactcctgtggggtctgttggtgctttcatggagctgtctccagggaccttgttccgtgttttcgcccgtatcggccatggaaccactcggtagacagctgacttcgggacctaaccaagagcaggtgtccccattgaccctgctgaaactgggtaatcaagaacccggtgggcagactgcacttaagtctccaccaggtgtgtgttcccgcgatcctacccccgaacagactcatagactggcacgcgccatgatggcattcacggccgatctgttcagccttgtggcacaaaccagcacctgtccaaacctcattctctcgcctcttagtgtcgccctggcattgtcccatcttgcgcttggtgcacaaaatcacaccctgcaacggctgcagcaagtccttcatgcaggatccggaccttgcctgcctcatcttcttagccgcctctgtcaagatctcgggcctggagcatttaggctcgcagcacgcatgtacctgcaaaagggatttccaataaaggaggacttcctggaacaatccgaacagctgtttggggccaaaccagtctccctgaccggtaagcaggaggacgatcttgcaaacattaaccaatgggtgaaagaagccaccgaaggaaagatccaagaattcctgtccggactccctgaggataccgtgctgcttctcctcaatgcgatacacttccaagggttctggcggaacaagttcgatccatcactcacccagcgcgactcatttcacctcgatgaacagttcaccgtgcccgtggaaatgatgcaagcacgaacctaccccctgcgctggttccttctggaacagccagagatccaagtggcacactttccgtttaagaacaacatgtcattcgtggtcctggtccctactcactttgagtggaatgtgtcacaggtcctggctaacctctcctgggataccctgcacccgccacttgtgtgggagcgcccaacgaaggtgcggctgcctaagctctacctgaaacatcagatggacctggtggcgacgctttcccaactcggtttgcaggaactctttcaggcccctgacctgcgcgggattagcgagcagtcgctggtggtttcgggggtccaacatcaaagcaccctcgagcttagcgaagtgggggtggaggcggctgccgcaacgtcgattgccatgagccgaatgagcttgtccagcttttccgtcaatagaccgtttttgtttttcatctttgaagatactaccggtttgccactttttgtgggatcagtcagaaaccctaatcccagcgcaccgagggaacttaaggagcaacaggactctccgggaaacaaagattttctccagagcctgaagggattcccaagaggtgataagctctttgggccagacctcaagctcgtgcctcctatggaagaagattacccccagtttggatcaccgaaa

SEQ ID NO: 18977 - DNA, 1473 bp, Artificial Sequence
  Description of Artificial Sequence: Synthetic coding sequence
atggcccttctgtggggactgcttgtgctttcctggtcatgtctgcaagggccctgttcagtgttctccccggtgtccgcaatggagccgttggggcgccaactgacctcaggacccaatcaggaacaggtgtcaccacttactcttctcaaactgggaaatcaggaaccgggaggccaaactgcgctgaagtcccctcctggcgtctgtagcagagatccgacgcccgaacaaacccacagactggcacgggcaatgatggcattcaccgcagacctcttttctctcgtggcacagacctcgacttgccccaaccttatcctgtcgcctctgtcggtggctcttgccctgtctcacttggcccttggggcacaaaaccatactctgcaaagactgcaacaagttcttcacgcgggtagcggaccctgtctcccgcatctgctttcacgcctctgccaggatctgggtcctggagcattccgccttgcagcgcgtatgtacttgcaaaagggtttccctattaaggaagattttcttgaacaatctgaacaactcttcggagcaaagccagtctcgctgactggcaaacaagaggacgatctcgccaatatcaaccagtgggtgaaggaagccaccgaaggaaagatacaggagtttctgtcgggcctcccagaagatactgtgttgttgctgcttaacgcaatacatttccaagggttttggaggaacaagtttgacccttccctgacccagcgggactccttccatctggacgagcagtttaccgtcccagttgaaatgatgcaagctaggacgtatcctctgcgttggttccttcttgaacagcctgaaattcaggtggcacattttccatttaagaacaacatgtcatttgtggtgttggtgcctactcattttgagtggaatgtgagccaggtgttggccaacctcagctgggacacgcttcaccctcctctggtgtgggaaagacccaccaaagtgagactgccaaaactctatttgaagcatcaaatggacctcgtggcaaccttgagccagttgggcctccaagagctgttccaggctccggatttgagaggtatttccgagcagtccctggtcgtctctggtgtgcaacaccagtccacccttgaactcagcgaggtcggggtcgaggccgcagcagccacctccattgcgatgtcgaggatgagcctttcatccttcagcgtgaatcggccgttcctgttcttcatctttgaagatactactggactgcctctctttgttgggagcgtgcgaaatccaaacccttcggccccaagagaactcaaggagcaacaagactcgcccggaaacaaggattttctgcaatcccttaaaggatttcctcgcggcgataagttgtttggaccagatctgaaactcgtcccaccaatggaagaagattacccccagtttggatcgcccaag

SEQ ID NO: 18978 - DNA, 1473 bp, Artificial Sequence
  Description of Artificial Sequence: Synthetic coding sequence
atggctctgttgtgggggctgctcgtactgtcctggtcatgtctccagggtccatgctcagtcttctcccctgtatccgcaatggaaccactaggtcgccagctcacgagcgggccaaaccaggagcaagtgtctcccctgactttgctcaagctagggaatcaggagcctggaggacagactgcgctgaaatctccacccggagtgtgcagccgggatcctacacccgagcagacccacagactggcccgcgctatgatggcctttacagcggatttgttctccctagtggcccagacctcaacgtgccctaacctaatcctgtctcccttgtctgtcgcactggccttatctcatcttgccctgggagcccaaaatcacaccctgcagcgcctgcagcaggtgctgcacgcggggtcggggccgtgtctgcctcacctgctctccaggctgtgccaagacctcgggcctggagccttccgtctcgctgcgagaatgtacttacaaaagggctttcccattaaggaggatttcctggagcagtctgaacagctgttcggcgcaaaaccagtcagcttgaccgggaaacaagaggacgacctcgcaaacatcaaccaatgggtaaaagaagcgacagagggcaagatacaggagtttctcagcggactgccggaggacacggttctgctgctactgaacgctatccactttcagggtttttggcgcaataagttcgaccctagcctgacacagcgtgattcatttcacttggatgaacagtttactgtgccggtcgagatgatgcaagccagaacttatccgctaaggtggttccttctggagcagcctgaaatccaggtggcgcactttccattcaagaataatatgtcttttgtggtgctggtgcccacacatttcgaatggaacgtgtcccaagtcctggcgaacctctcttgggacacgcttcacccacctctggtgtgggaacggcccactaaggtccgcctgcctaagttgtacctgaagcaccagatggacctggtggctactctgtcccagcttgggttgcaagagctgttccaggcacccgatcttcggggaatctctgagcagtcgctcgtggtttccggtgtgcagcaccagtctaccttggagctttctgaggtaggcgtggaggctgccgcggcaacatctattgcaatgtcccggatgtctctgtcttctttttcagtgaacagaccctttctatttttcatctttgaagacacaactggacttccactcttcgttggctcagttcggaaccctaacccgagcgcgccacgtgagctgaaagaacagcaagattctccgggaaacaaagattttctgcagagcctgaaagggttcccacggggtgacaagctgtttggccctgatctaaaattggttcccccaatggaagaagactacccgcagttcggtagtcctaag

SEQ ID NO: 18979 - DNA, 1473 bp, Artificial Sequence
  Description of Artificial Sequence: Synthetic coding sequence
atggccctcctctggggtctgctcgtgctgtcgtggagttgccttcagggcccgtgctcggttttctcaccagtgtcggccatggaaccgttgggaaggcagctcaccagcgggcctaaccaggagcaggtgtcccccctcactctgctgaagctgggcaatcaagagcctggagggcagactgcgctcaagagcccacccggagtttgctcacgagatcccacgcccgagcagactcaccggctggcccgcgcaatgatggccttcaccgcagatctcttctcgctggtcgcccagacttctacctgtccaaacctcatcctcagccccctgtcggtcgctctcgccctctcgcatctggccctcggggcccaaaaccacacccttcagaggctgcaacaggtactgcatgccggatctggcccatgtctcccgcatctgctctcccgtttgtgtcaagatctcggcccaggagcgttccggctcgcggctagaatgtaccttcagaaaggatttcctatcaaggaggacttcctggaacaatctgagcagcttttcggagcaaagccggtcagcctgaccggaaagcaggaagatgacctggccaatatcaaccaatgggtgaaagaagctactgaaggtaagattcaggagttcctttccggacttccagaggacaccgtcttgctcctcctgaatgccatacacttccagggcttctggcggaacaagtttgacccgtccctcactcaacgcgacagcttccaccttgacgaacagttcacggtgcctgtggaaatgatgcaggcgcgaacttacccgcttcggtggtttctcctggaacagccagaaatccaagtggcccattttccatttaagaataacatgtctttcgtcgtgctggtcccgacccatttcgagtggaacgtgtcacaggtgctggcaaatctctcctgggatacccttcacccgcctctggtgtgggaacggccgaccaaggtcagactccctaagctgtacctcaaacaccaaatggacctggtcgcaactctgtcccaactcggcctgcaggaactgtttcaggcgccagaccttagaggaatctcagagcaatcactggttgtctcaggagtgcagcaccaatccacgctcgaattgagcgaagtgggagtcgaggcagccgctgccacgtcaatcgcgatgtcccggatgtcactctcgtccttttcagtgaatagaccattcctcttcttcatctttgaggacactaccggcctgcctctgttcgtgggttcggtgcgcaaccctaacccgtccgccccgcgcgaactcaaggagcaacaggactccccgggaaacaaggacttcctccagtctctgaaaggattcccgcggggcgacaaactgttcgggccggatcttaaactggtgcccccgatggaggaggactacccgcaattcggctccccgaag

SEQ ID NO: 18980 - DNA, 1473 bp, Artificial Sequence
  Description of Artificial Sequence: Synthetic coding sequence
atggccctgctctggggtctcctggttctttcatggagctgtctccagggaccttgtagcgtattttctccagtgtccgcaatggagccattgggtcgacagctgactagcggcccgaaccaggaacaggttagccccctgaccctcctgaaactcggcaaccaggagccgggcggtcaaacagcccttaagtcacctccaggcgtgtgttctagagaccctacgcccgaacagacccaccgcctggcaagagcgatgatggcttttacggctgatttgttctctctcgtggcacagacatcaacttgtcctaacctaattctgagccccctaagcgttgctctcgcccttagtcacttagctcttggggcacagaaccacacactccaacggcttcaacaagtgctccacgcaggttcgggtccatgtctgccacatctgctgtctaggctgtgtcaagacctgggaccaggcgccttccgactagcagcccggatgtacttgcagaagggcttcccaatcaaggaggacttcctcgagcaatcggagcagctattcggcgctaaaccagtgtccctcaccggaaagcaggaggacgacctggccaatatcaatcagtgggttaaagaggccactgagggaaagatacaggagttcctgtctggactcccagaggatacagtgctactgctactaaacgcgatccacttccagggcttttggcgtaacaagtttgatccgtcactgacccagcgggacagcttccacctggatgagcagttcaccgttcccgtggaaatgatgcaagcacggacatacccactccgctggtttctcctagagcagccggaaattcaggttgcccatttccccttcaaaaacaatatgtcgttcgttgtcttggtgcccacccattttgagtggaacgtgtcccaagtgctcgcaaacctgtcctgggataccctgcacccccccctggtgtgggaacgacccacgaaagtgagactccctaagctttatctgaagcatcagatggacttagtggccacattatcgcagctgggactccaggaattgttccaggccccagacttgaggggtataagtgagcagtccttggtagtttccggcgtgcagcaccagagcacactggagcttagtgaggttggggtggaggctgctgctgcaacaagcatagctatgtctaggatgagcctcagctcttttagtgtgaataggcccttcctgttcttcatttttgaagacaccacaggtcttcctctttttgtgggaagtgtcaggaaccccaatccatcagcacccagggagctcaaagagcagcaggacagcccggggaataaagatttcctgcagagcctgaagggatttcctcgcggagacaagctgtttggcccagatctcaagctcgtgccacccatggaagaggactaccctcagttcgggtctcctaaa

SEQ ID NO: 18981 - DNA, 1473 bp, Artificial Sequence
  Description of Artificial Sequence: Synthetic coding sequence
atggcgctcctctgggggttgctggtgctatcctggtcgtgcttacagggtccatgctccgtgttcagccccgtcagcgccatggaacctttgggaagacagttgaccagcgggcccaatcaggagcaagtgtcaccactgacgctcctgaaactgggcaatcaggaacccggcgggcagaccgctttaaaatcaccccccggcgtctgttcccgtgaccctacacccgaacagacccatagactcgctcgagcgatgatggcttttacggcagacctgttctctctggtcgctcagacgtcaacttgcccaaacttgattctcagccccctcagcgtggctctggcccttagccatctcgcccttggagctcagaaccataccctgcaaaggctgcagcaggttctgcacgccggatccggcccttgcctccctcacctcttgagcagactgtgccaggacctagggccaggcgcttttaggcttgccgcacgaatgtacctgcagaaggggttccctattaaagaagactttctggaacaatctgaacagctttttggagccaaacctgtgtcattgacaggtaagcaggaggatgacctggccaatatcaaccagtgggtgaaggaggccaccgaggggaagattcaagagttcctaagcgggctgcccgaggataccgttctcctcctgctcaacgcgatccatttccaggggttctggcgaaacaagtttgacccctccttaacccagcgtgactctttccaccttgatgagcagtttacggttccggtcgagatgatgcaggctaggacgtaccccttgcggtggtttctgcttgagcaacctgaaatacaggttgcgcattttcctttcaagaacaacatgagctttgtggtcctggtgcctactcactttgaatggaacgtgtctcaggtccttgctaacctgtcctgggacactttgcacccccccttggtgtgggagagaccgacaaaagtgcgtttgccgaaactgtacctgaagcaccagatggacctggtggcaaccctgagtcagctgggactgcaagagctgttccaggcccccgatctacgaggaattagtgagcaatcactcgtggtcagtggagttcaacatcaaagcaccctggagctgagcgaagtaggcgtcgaggccgcggctgcaacatctatcgccatgtcgagaatgtcactgtcctcattcagcgttaaccgccctttcctatttttcatcttcgaagacacgacaggtcttccgctgtttgttgggagtgtgaggaacccgaacccgagtgccccacgcgaactgaaggagcaacaggatagcccaggcaacaaggatttcctgcaaagtctgaaaggctttccacgtggcgacaagctgttcggccccgacctgaaactggtaccacccatggaggaggactaccctcagtttgggagtcccaag

SEQ ID NO: 18982 - DNA, 1473 bp, Artificial Sequence
  Description of Artificial Sequence: Synthetic coding sequence
atggcattgctgtggggcctgctggtgctgtcctggagttgcctgcaggggccttgctccgtgttcagtcctgtttcagccatggaacccctgggtaggcagctgacttcaggtcccaaccaggaacaggtttctcccctgacactactgaagctgggaaaccaagagccagggggccagaccgcattgaagtctccaccaggggtgtgttcaagagaccccacgccagaacagacacatcgcctggcccgggccatgatggcatttactgcggatctgttctcactggtggcccagacctccacctgtcctaatctcatattgtcaccgctctctgttgctcttgctctgtcacaccttgctttgggcgcacagaaccacaccttgcagcgcttacagcaggttctacacgctggctcaggcccctgtctcccacacctactgagccgattgtgtcaggacctggggccaggcgcgttccgcttggccgcccgtatgtacctgcagaagggcttccctataaaggaagacttcctggaacagtctgagcagctgttcggcgctaagcccgtctccctcactggcaaacaggaggacgatctcgcaaacatcaatcagtgggtcaaggaagcgactgaagggaaaatccaggagtttttaagcggactaccagaagatacagtgctcttacttttgaatgccatccattttcaggggttctggaggaataaatttgatccctccctgactcagagggattcattccaccttgatgagcagtttaccgtcccagttgaaatgatgcaggctaggacctatcctttgagatggttcctgctggaacagcctgagattcaggtagctcactttcccttcaagaataatatgagctttgttgtactggtacccactcatttcgaatggaatgtctctcaggtgttagcgaatctttcctgggatacgttgcatccacccctagtgtgggaaagaccaactaaggtgagactcccaaagctgtacctgaaacaccagatggatctggtagccaccttgtcccagttaggactgcaggaattgtttcaagctcccgacttgcgcggaatctctgagcagtcattagtggtgtccggcgtgcagcaccagagcacactggaattgagtgaagtgggggttgaagccgccgccgcaaccagcatcgcaatgtcaaggatgtccttgtcatccttcagcgtgaacaggccgtttctttttttcatattcgaggacaccacagggctcccattgttcgtgggctcagtgcggaaccctaacccttcagcccctagggagttaaaggagcagcaggacagcccagggaataaggacttccttcagagccttaaaggattccctcgaggcgataagttgtttggaccggatctaaaacttgtgccacctatggaagaagattacccacagtttggaagcccgaag

SEQ ID NO: 18983 - DNA, 1473 bp, Artificial Sequence
  Description of Artificial Sequence: Synthetic coding sequence
atggcacttctgtggggcctgctcgtgctttcctggtcatgcttgcagggtccttgcagcgtctttagccccgtgtccgcaatggaaccacttggtagacagctgacttcgggaccaaaccaagaacaagtttcccctcttactcttctcaagctcggtaaccaggaacctggtggccagaccgccttgaagtcaccacccggggtctgttcgcgcgatcccacccctgagcaaactcatcggcttgcacgcgccatgatggcattcaccgcagatctcttttcccttgtggcccaaacctctacctgtccaaaccttatacttagcccactctccgtggcactggcactttcccacctggcgctcggggcccaaaaccataccctgcaacgccttcaacaagtcctccatgctggttcaggaccttgtttgccacatctgttgtcgagactttgtcaagacctgggcccgggagcctttcgcctcgcggcaaggatgtacctgcaaaaagggttccccataaaggaagatttcttggaacagagcgaacagctgtttggagctaagccggtgtcgctgaccggaaagcaggaggacgatctggcgaacataaatcagtgggtcaaggaggcaacggaaggcaaaattcaagagtttcttagtgggcttcctgaggatacggtgctgctgctcctgaatgcaatccacttccaaggcttttggagaaacaaattcgatccttcccttacccagcgggatagcttccacctggatgaacagtttaccgtgcctgtcgagatgatgcaagcaaggacttacccactccgttggtttctgcttgaacaacctgaaatacaggttgctcatttcccttttaagaacaacatgtcatttgtcgttctcgtcccgactcatttcgagtggaatgtgtcgcaagtgcttgcaaatttgtcctgggacacccttcatcctcccctggtgtgggaaaggcctactaaggtgcgtctgcccaaactttaccttaaacatcaaatggacctggtcgcgacgctttcccagttgggacttcaagagctcttccaagcacctgatctgaggggaatttccgaacaaagcctggtggtcagcggagtgcagcatcaaagcactctcgagcttagcgaagtcggagttgaagctgcagccgccacttcgatcgcaatgtccagaatgagcttgagctccttttctgtgaaccggccttttctgttctttatctttgaggacaccactgggcttccactttttgttggatccgtgaggaacccgaacccctcggcgcccagagaactgaaggagcaacaagactcgccagggaataaagattttcttcaaagccttaaagggttcccgcgcggagacaagctgtttggccccgatctgaagttggtgccgccaatggaagaggattaccctcagtttggctctccaaaa

SEQ ID NO: 18984 - DNA, 1473 bp, Artificial Sequence
  Description of Artificial Sequence: Synthetic coding sequence
atggccctactgtgggggcttttagtgctgtcctggagctgtctgcagggtccatgcagcgtgtttagccctgtgagtgcaatggagcctttgggcagacagttgactagcggcccgaatcaggagcaggtttccccactgaccttgcttaagttggggaatcaggaacctgggggccagaccgcccttaagagcccccccggggtgtgtagcagagatcctacccctgagcagacgcaccgcctggccagggctatgatggccttcaccgcagaccttttttcactggtcgcgcagacctcaacatgcccaaacctgatcctgtcgccgctttctgttgccctcgcccttagtcatctggcactgggcgcgcaaaatcacactcttcaacgactgcagcaagtattgcatgccgggtcaggcccctgtctgcctcacttactttctagattatgtcaggatctggggccgggtgcctttagactcgccgctcgaatgtacctgcaaaaagggttccccatcaaagaagactttctggaacagtccgaacagctatttggcgccaagcccgtgtccttaacaggaaaacaggaggacgatctcgcaaacatcaatcagtgggtgaaggaggcaactgaaggaaaaattcaggaattcctgtccggcctcccagaagatacggtcctcctgctgctgaacgcaatccattttcaggggttctggcggaataagttcgacccttctcttacacagcgagactcgtttcaccttgatgagcagtttaccgtgcccgtcgagatgatgcaggcccgcacctacccattgcggtggtttctattggagcaacctgagattcaagtagcccattttccatttaaaaacaacatgagctttgtggtgcttgtgcccacccacttcgagtggaatgtttcccaggtactggccaatctctcttgggatacattgcatcccccactggtctgggagcggccaacaaaggtgcggttacctaagttgtacctaaaacatcaaatggatctggtggccacgctttcccagctcgggttgcaggagctgttccaggcgccagacttacgcggcatctccgagcagagcctggttgtgtccggggttcaacatcagtccactctggagttgagcgaggtgggggtggaagctgcagccgcgaccagcattgccatgtcccggatgagtttaagcagtttctctgttaacagacctttcctcttctttatcttcgaggatacaaccggtctccctctcttcgtcggcagtgttagaaatcctaatcctagcgcccctagggagttaaaagaacagcaggattctccaggtaataaggactttttgcagtctctgaagggctttccccggggcgacaaactctttggccccgacttaaaattggtaccacccatggaagaagactaccctcaatttgggtcacccaaa

SEQ ID NO: 18985 - DNA, 1473 bp, Artificial Sequence
  Description of Artificial Sequence: Synthetic coding sequence
atggcactgctctgggggctgttggtgctctcttggagctgtcttcagggaccgtgcagtgttttcagcccggtatccgccatggaacctctcggcaggcagttaaccagcggcccgaatcaggaacaggtgagtcctctaacgctgctgaaactcggcaaccaggagccaggcggccagaccgcccttaagtctccccccggagtgtgtagcagggacccaaccccggaacaaactcataggctggcacgcgccatgatggcatttaccgccgacctctttagcctcgtggcacagacaagcacatgtccaaaccttatcctatctcccttatccgttgccctggcccttagccatctggcactgggcgctcaaaatcacactctccagcgtctccaacaagtgctccacgccggttctggcccttgtctacctcacctgctgtctcgcttatgccaggacctgggccctggagcctttcggctggcagcccgtatgtatctacagaaggggtttcccattaaggaggacttcctggagcaatccgagcaattgttcggggcgaagccggtttctttgaccggcaagcaggaggacgatctcgctaacataaaccagtgggtgaaggaggctaccgaaggcaagatccaggagtttctgtccggccttccagaggatacagtacttcttcttctgaacgcgatccacttccagggattttggcgcaacaagtttgacccttccttaacccagcgagacagctttcacctcgatgaacaatttacagtgccagttgaaatgatgcaggcgaggacttaccccctgaggtggttcctcctggagcagccagaaatccaggtggcccattttccgttcaagaacaacatgagctttgtcgtcctggtgccaacgcatttcgagtggaatgtctcacaagtgcttgccaatctctcctgggatactctgcacccacccctggtttgggaacggccgaccaaagtgaggctgcctaaattatatctgaaacaccagatggacctagtggctactctatctcagcttgggcttcaggagctgtttcaagcccctgatctgcgtgggattagcgaacagtcactcgtagtgtctggtgtgcaacatcaatccaccctagagctctccgaagtcggcgtagaggccgcagccgccacatccatagcaatgtcgcggatgtccttatcaagcttctccgtgaatcgtccgttcctgttcttcatcttcgaggacaccacaggcctgccactgtttgtgggaagtgtccgtaacccgaatccctcagccccaagggagctaaaggaacagcaggatagccctgggaacaaggacttcctgcagtctttaaaggggttccctaggggggacaagctattcggacctgacctcaaactggtgcctcctatggaggaagactacccacagttcggttcacccaag

SEQ ID NO: 18986 - DNA, 1473 bp, Artificial Sequence
  Description of Artificial Sequence: Synthetic coding sequence
atggccctgctctggggcctgctggtgctgtcgtggagctgtctccagggcccttgtagtgtgttttcacctgtttccgctatggagcctttgggcagacagctaacctccggtcccaatcaggaacaggtgtcgcctctcaccttgttgaagctggggaaccaggagcctggcgggcagactgcactgaagtcaccccccggtgtgtgttcccgggatccaaccccagaacagacacaccggcttgcgagagcgatgatggcatttacggctgatctgttctctttggtcgctcagacctcaacttgccccaacttaatcctgtccccacttagtgttgctctggctttaagccatctggctctgggagcgcaaaatcacacacttcagcgcttgcagcaagtgctgcatgctggatccgggccatgtttgccgcaccttctttctcgactgtgtcaggacctagggcctggcgcatttcgcttggctgcaaggatgtacctgcagaaagggtttcccatcaaagaagattttctggagcagtccgaacaactgtttggcgctaagcccgtttcactaaccggtaaacaggaagacgacctggctaacatcaatcagtgggtgaaagaggccactgaaggcaaaatccaggagttcctgtctgggctgccagaggatacagtcctgctgctgctgaatgccatacacttccagggattctggaggaacaaatttgacccatccctgacccaaagagacagcttccacttggacgagcagtttacagtgcctgtcgagatgatgcaagcgcgcacttaccccctgagatggtttctcttggaacagcccgaaattcaggtggcccacttccccttcaaaaacaacatgagttttgtagtgctcgtgcccacccattttgagtggaatgtgtctcaggttctcgcaaacctgtcgtgggacactcttcatccccccctcgtgtgggaaagacctactaaagtgaggctgcccaagttgtatctgaagcaccagatggacttagtggccactctgagtcagctgggccttcaggaactgtttcaggcgccagacctgcgcggaatcagcgagcagagtctggtggtgtccggggtccagcaccagagcaccttggagctgtccgaagtgggcgtggaggcggctgcagcaacaagcatcgcgatgagccggatgtctctgagcagttttagcgttaatcgcccatttctatttttcatttttgaggacacaacaggccttccactgtttgtgggtagcgtccgtaaccccaatccatctgccccccgggagctgaaggaacagcaggattctccggggaacaaggacttcctgcagtctctgaagggattccccagaggtgataagctgttcgggcccgatctgaagcttgttcctcctatggaggaggattatccccagtttggaagccctaaa

SEQ ID NO: 18987 - DNA, 1473 bp, Artificial Sequence
  Description of Artificial Sequence: Synthetic coding sequence
atggcactgctttggggcctgctggtcctctcatggtcctgcttgcaaggtccgtgctcggtgttctcgcctgtttccgcgatggaaccattgggacgtcagctgacttcaggcccgaatcaggaacaggtgtccccattgaccctgctgaaactcggaaatcaggaaccaggggggcagaccgctttgaagtcgccgccgggcgtttgcagccgggacccaaccccagaacagacgcatcgcctggccagggccatgatggccttcacggcggacctgtttagcctggtcgcccagaccagcacttgccccaatttgatcctgtcgcctctctccgtggccctggcactctcccacctcgcactcggtgcccaaaatcacacgcttcagcgactccagcaagtgctgcacgcaggatccgggccatgtctgccgcacctgttgtctaggctctgtcaggatctgggacctggggccttcagacttgcggcacgcatgtatctgcagaaaggattcccaatcaaagaggacttccttgagcaatccgagcagctgttcggtgcgaagccggtttcacttactggaaagcaagaagatgatctggcgaacattaaccagtgggtgaaggaagccaccgaaggaaagatccaagagttcctgtcgggactgccagaggacacggtgctgctgcttctcaacgccatccactttcaaggcttctggcggaacaaatttgatccgagcttgacccaacgcgacagcttccacctcgacgaacaattcactgtgccggtcgaaatgatgcaggctaggacctacccgctccggtggttcctgttggagcagccagaaatccaagtcgctcattttccgttcaagaacaacatgagctttgtcgttctggtgcccacccatttcgagtggaatgtgtctcaagtcctggccaatctgtcctgggacactctgcatccaccgctcgtgtgggagaggccaactaaagtgcggctccctaaactctacctcaagcatcaaatggatctggtggccactctgtctcaactgggactccaagagctgttccaggcgccggacttgcggggaatctcggaacagtctttggtcgtgtcaggcgtgcaacaccagtccacccttgaacttagcgaagtgggagtcgaagcagcggcggccacctcaattgcaatgtctcggatgtcgctgtcctcattctcagtcaaccgccctttcctgtttttcatcttcgaggataccacgggactgcccctcttcgtgggcagcgtgcgcaaccctaacccgagcgcaccgcgagagcttaaggagcagcaggactcgccgggaaacaaggacttcctgcagtctttgaagggatttcccagaggcgataagctgttcggacccgatctgaagctggtgccgcctatggaagaggactacccgcagtttggttccccgaag

SEQ ID NO: 18988 - DNA, 1473 bp, Artificial Sequence
  Description of Artificial Sequence: Synthetic coding sequence
atggcactgctgtggggattactcgttctaagttggagctgcctgcagggcccctgtagcgtgttcagccccgtgagcgcaatggaacctctcggcaggcagttgaccagtggacctaatcaagagcaggtatcaccattgactttactgaaactgggcaaccaggagcctggcggccagacagctctgaaaagtcctccaggagtgtgtagccgggatcccacccccgagcagacccacagactggctagagctatgatggcttttacagccgatctgttttccctggtggctcaaaccagcacctgccctaatctcatcttgtctcccttgtcagtagccctggcactgagtcacctggccctgggagcccagaatcacacacttcaaaggctacagcaggtcctacacgccggctccggcccatgcctcccacacctgctatctcgcctgtgtcaggatctgggaccaggggccttcaggcttgcagctcgcatgtacctccagaagggttttcccatcaaagaagatttcctagagcaatctgaacagctgttcggggccaaacctgtgtctctaactgggaagcaagaggacgacctagctaatatcaaccaatgggtgaaagaggctaccgaggggaagatccaggagttcctgtccggcctgcccgaagacaccgtcctgctcctgctgaatgccatacatttccagggtttttggcggaacaagttcgaccccagtctgacccagcgggacagcttccacctggatgagcagttcacagtgccagtagaaatgatgcaggctcggacatatcctctcaggtggtttctactcgagcaaccagaaatccaggtggcacacttccctttcaagaataatatgtcttttgtcgtgctagtgccaacccacttcgaatggaatgtctcccaggtgttagctaacctgtcttgggatacattacaccctcctctggtgtgggaacgcccgactaaggtccggctgcccaagttatatttgaaacatcagatggatctggtggccactctgtcccagctgggccttcaggaactatttcaggccccggacctaaggggaatctccgagcagtctttggttgtaagcggcgttcagcatcagtcaacccttgagctgtctgaggttggggtggaagccgcagctgccacttcaatagccatgtccaggatgagtctctcttcattttctgtgaacagacccttcctgtttttcatttttgaggacaccacagggttacccttgtttgttggttctgtgcggaatccaaaccccagcgccccacgggaactaaaagaacaacaggactctcctggaaataaagacttcttgcaaagtctgaaaggtttcccacgtggagataaactgtttgggccagacttaaaacttgtgccacctatggaagaggactatcctcagttcggatctcccaag

SEQ ID NO: 18989 - DNA, 1473 bp, Artificial Sequence
  Description of Artificial Sequence: Synthetic coding sequence
atggccttattatggggtctgcttgtattatcttggtcctgtctacagggtccctgtagtgttttttccccagtgagcgccatggagcctcttggacggcagctgacttcagggcccaaccaagagcaggtttcaccgctcacattactgaaactgggaaatcaggaaccggggggacagaccgccttgaagtccccacccggcgtgtgcagccgcgaccccactcccgagcagacccaccggcttgctagggccatgatggcattcacggcggacctcttctctctggttgctcagacgtcaacttgcccaaatttgatcttgagcccgctatccgttgccctggctttgagccacttggcactcggggcccagaatcataccctccagagacttcaacaggtgctccatgcaggatccgggccctgtctgcctcatctgctctcaagactatgccaggatctagggcctggggccttcaggctcgcagcacgaatgtacctgcaaaagggtttccccatcaaggaagacttcctcgaacagtccgaacagctcttcggggctaagccggtgagcttgactggtaagcaggaggacgatttagccaatattaatcaatgggtcaaggaggctactgagggtaagattcaggaatttctgagcgggctccctgaggatactgtgctgctgctgctgaacgccatccactttcaaggattttggcgaaacaaattcgacccttcactgactcagcgcgattccttccacttggatgagcagttcacggttcctgtagagatgatgcaagctcgcacttatccactgaggtggtttctgttagagcagcctgagattcaggttgcacactttccattcaaaaataacatgagtttcgtcgtgttggtccctacgcacttcgagtggaatgtatcgcaggtcctggctaacctgtcttgggacactctccacccgcccctagtctgggaaagaccaactaaagtccgcctcccaaaactgtacttgaaacaccagatggacctcgtggcaaccctgtctcaattggggctgcaggaactgttccaggcacccgatcttagagggatttctgagcaatcgttggtcgtgtctggtgtgcaacatcagagtacactggagctgtcggaagtcggggtcgaggccgctgctgctacatctatcgccatgagtcggatgagtctatccagtttcagcgttaacaggccctttcttttcttcatctttgaggatactacgggacttcctctcttcgtgggaagcgtgcgcaatccgaacccgtcagctccgcgcgaactaaaagagcagcaagattctcctggaaataaggacttcttgcagtccttgaaaggcttcccccgaggtgacaagttatttggtccagatttgaagctcgtccccccaatggaagaggactaccctcaatttggttcccctaaa

SEQ ID NO: 18990 - DNA, 1473 bp, Artificial Sequence
  Description of Artificial Sequence: Synthetic coding sequence
atggcgctcctgtggggtctgctggtgctgagctggtcatgccttcagggtccttgttcggttttctccccagtgagtgcaatggaaccgctgggtaggcaactcacttccggacctaaccaggaacaagtgtcgccccttacccttttgaagctcggaaaccaagaaccagggggccaaactgcactcaagtcccctcctggggtgtgctcgcgggatccaaccccagagcagacccacagactcgctagagcgatgatggcgtttacggccgatctctttagccttgtcgcacagacgtcaacctgccccaatctgattctcagcccactttccgtcgcccttgccctgagccatctggcgcttggagcgcaaaatcacactctgcaacggctccagcaggtgctccatgcaggatccggcccttgcctgcctcacttgctgtcgagactgtgtcaggatctcggccctggtgcgtttcgcctggccgcacgcatgtacctccagaaagggttcccgatcaaagaggatttcttggagcaaagcgaacagctgtttggagccaaaccagtgtctcttactggcaagcaagaagatgacctcgcaaacatcaaccaatgggtgaaggaagccaccgaagggaagattcaagaatttctcagcggcttgcctgaggacactgtgttgcttcttcttaacgcaatccattttcagggtttttggaggaacaaattcgacccatccctgacgcagagagattcatttcacttggatgagcaatttaccgtgcctgtggagatgatgcaagcacgaacctacccactgcgatggtttctgcttgaacagccagagattcaggtcgcacattttccgtttaagaacaatatgtcctttgttgtactggtgcctactcatttcgagtggaatgtctctcaagtccttgccaacctttcatgggacacccttcacccccctctcgtgtgggaaagacctactaaggtgcgcctgcctaaattgtacctcaagcatcaaatggatctggtggcgacgctctcgcagcttgggcttcaagaactctttcaagctcctgatctgcggggaatttccgaacaaagcctggtggtgagcggcgtgcagcatcaatcgaccctcgaattgtctgaagtaggggtcgaagcagcggctgcaacttccatagcaatgtcgcgcatgtcgctttcgtccttctccgtcaatagacctttcctgttcttcatctttgaagataccacgggactgcctctgttcgtgggaagcgtgcggaacccgaatcctagcgcccccagagagctcaaagaacaacaggactcgccagggaataaggacttcttgcagtcgcttaaaggttttccgagaggtgataaacttttcggacctgatctgaagttggtccctcctatggaagaggattacccacaatttgggtcaccaaag

SEQ ID NO: 18991 - DNA, 1473 bp, Artificial Sequence
  Description of Artificial Sequence: Synthetic coding sequence
atggctttgctatggggattgttagttctcagctggtcttgtctgcaaggaccatgttcagtgtttagtccagtctcggccatggaaccacttggaagacaattgacgtcgggcccaaatcaagagcaagtttctccactaacattgctgaaactcggaaatcaagaaccgggaggacaaactgctttgaaatctcctcctggagtttgttcccgagatccaacaccggaacaaactcatagactagcacgtgcaatgatggcttttacggcggacctgtttagtttggttgcccagacttcgacatgtcctaatttgatcttatctccgttatctgtagcattagcgttgagtcaccttgctttaggtgcccaaaatcatactctccaacgtttacagcaagtcttacacgccggatcaggaccatgtctgcctcacctcttatcacgtctctgtcaggacttgggcccaggagccttccgattggctgcaaggatgtacctacaaaagggattcccaattaaggaggacttcttggagcaatctgagcagctctttggagcaaagcctgtctcactcacagggaagcaagaggatgatctagcaaatattaatcagtgggtcaaagaagctacagaaggaaaaattcaggagttcctaagtggactcccagaagataccgttcttctcttgttgaatgcaatccatttccaagggttttggagaaataagttcgatccttcacttacccaaagagacagctttcacctagatgaacaattcacagtcccagttgaaatgatgcaagcaaggacatatccgcttcggtggttcctcctagaacagcctgaaattcaagtcgcacattttccatttaagaataatatgtcattcgtcgtccttgtaccgacacatttcgaatggaacgtgtcacaggtgcttgccaatttgagctgggatactctgcacccgcctttggtttgggaaagacctacgaaagtacgcttgcctaaactctatctcaagcaccaaatggacctggtcgcgactttatcccaactcggtttgcaagaactcttccaagccccagatttgagaggtatctcagaacagagtcttgttgtgtctggagttcagcatcaaagcactctagagcttagtgaagtgggtgtggaagccgcagctgcgacgtcaatcgctatgagtcgaatgtccctatcatcattcagtgtgaaccgaccgtttctgttcttcatttttgaagacacgactggcttgccactatttgtcggatctgttcggaatccaaatccgtcagcaccgcgtgagcttaaagagcaacaagatagtcccggaaataaagacttcttgcagtctttaaaaggttttccaaggggagataagctcttcggaccagatctaaagctggttccacctatggaagaagattatccacagtttggtagtcctaaa

SEQ ID NO: 18992 - DNA, 1473 bp, Artificial Sequence
  Description of Artificial Sequence: Synthetic coding sequence
atggccctgctgtgggggctacttgtgctttcctggagttgccttcagggtccatgtagtgttttttctcctgtgtccgccatggaaccgctgggccgacagctgacatctggccccaatcaggagcaggtcagtccgctcaccctgctgaagctgggaaatcaggagcccgggggacaaacagcactaaaatccccgccaggggtatgttccagggacccgactcccgagcagacccatcggctggcacgggccatgatggcctttactgcagacctgttctctctggtcgcccagacctccacttgtcctaacttgattctatcaccactgtccgtggcgttggctctgagccatttggctctaggcgcccagaaccacacactgcagcgactccagcaagtattacacgctggatcgggaccttgtttacctcacctcctctcccggctctgtcaggacctggggccaggagccttcagactggccgctagaatgtacctccagaaggggtttcctatcaaggaagactttttagagcagtccgagcagttgttcggggccaagcccgtgtcgctgacggggaagcaggaggatgacctggccaatattaatcagtgggtgaaggaagcaactgaaggcaaaatccaagagtttctgagcggccttccggaggatactgtgctactcttactcaacgctatacactttcagggattttggcggaacaagtttgacccctcccttacacaacgggacagctttcatctggatgagcagtttaccgtcccagtagagatgatgcaggcaagaacataccctctccggtggtttctgcttgagcaacctgaaatccaagtcgcccattttccattcaaaaacaatatgtcatttgttgtgttagttcccactcacttcgaatggaacgtatcccaggtactggcaaacctctcatgggatacccttcatccacctctagtatgggaaagacccacgaaggttagactgccaaagctctatctgaagcatcagatggacttggttgcaacactgtcccaactcgggttgcaggaattgtttcaggctccagatctgagggggatctcggagcagtccttggtggtatctggagtgcagcatcagagcacgctggagctttctgaagtgggcgtggaagccgcagccgctaccagcatcgctatgtctcggatgtcgttgtcaagtttctcggttaaccgcccctttctcttttttatcttcgaggatacaaccgggctccctctatttgtgggctccgtgcgcaatccaaatccgtcagcccctcgcgagctgaaggagcaacaggacagtcccggaaataaggacttcttgcaatctctcaagggcttcccaaggggtgacaagctattcggtcctgacttgaagctggtgcctcctatggaggaggactacccacaatttggcagtcccaag

SEQ ID NO: 18993 - DNA, 1473 bp, Artificial Sequence
  Description of Artificial Sequence: Synthetic coding sequence
atggctttgctttgggggctcctcgttctttcatggtcttgtctccaagggccttgttctgtgttttccccagtaagtgccatggaaccgttgggccgtcaacttacctctggtcctaaccaagagcaggtcagccctcttacacttcttaaacttggaaatcaggaacctggaggtcaaacagcattgaaatcccctcccggcgtttgtagtcgcgatcctaccccagaacagacccaccgacttgcccgtgctatgatggcattcaccgccgatttgtttagtttggttgctcaaacttccacctgccctaatttgattctctctcccttgtctgtagctcttgcattgagccatcttgcattaggtgctcaaaatcacacactccaaaggttacaacaagttttgcatgctggttctggcccttgtctcccccaccttcttagccgactttgtcaagacttggggcccggagcgttcagattagcagcaaggatgtacttgcagaaaggctttcctattaaggaagattttctggagcagtccgaacaacttttcggcgccaagcctgtgtctctcacaggcaagcaggaagatgatcttgccaatattaatcagtgggtgaaggaagcaacagagggcaagattcaagaattcttgtcgggcttgccagaagacacggttcttctccttctaaacgctatccattttcagggattctggaggaataaattcgatccgtcattgacacagagagattctttccatttagacgaacagtttaccgttcccgttgaaatgatgcaagctaggacctatccattgcgatggttccttttggaacaacctgagattcaggtcgctcatttcccgttcaagaacaatatgagttttgtggttctagttcctacccattttgaatggaacgttagtcaggttttggcgaatctctcttgggacactttacatccaccactggtttgggaacgtccaactaaggttaggctcccaaaattgtatctcaagcatcaaatggatcttgtagctactctttcgcaacttgggctccaagagctctttcaggcacctgatttaagaggaatttccgaacaatcccttgtcgtctccggtgtccagcaccaatccaccctcgaactctctgaagttggagttgaagctgcggctgccacatccatcgctatgtcacggatgagcctgtcatccttctctgttaatcgtcccttcctgttctttatttttgaggacactactggcctgcctctttttgtaggttcagtgcgcaaccccaatcccagcgctccacgtgaattgaaggagcagcaagacagccccggaaacaaggatttcctgcagtctctcaagggattcccaagaggcgataagttgtttggacctgatttgaagttggtacccccaatggaggaggattatccacaatttggttcaccaaag

SEQ ID NO: 18994 - DNA, 1473 bp, Artificial Sequence
  Description of Artificial Sequence: Synthetic coding sequence
atggccctcctctggggcttgctggtcttgtcatggtcctgtctccagggcccatgctcagtcttttccccagtgtcggctatggagccgctgggacggcagctgacctcgggccctaatcaggaacaggtgtcccctctcaccctgctgaaactgggtaaccaagaaccggggggccaaactgccttgaagtcgcctcccggagtctgctcgcgcgatccgactcccgaacagactcataggcttgctcgtgccatgatggctttcactgcagatctgttctccctcgtggcccaaacttcaacctgtccgaacctcattctgtcgccgctgagcgtcgccctggcgctgagccatctcgcgctcggagcccagaaccataccctccagcgcctccaacaggtcctgcacgccggcagcggaccttgccttcctcacctcctgagccggctgtgccaggacctgggcccgggcgcattccgcttggcggccagaatgtacctgcagaagggattcccgatcaaggaggacttcctggaacagtcggagcagttgttcggcgcaaaaccggtgtcgttgactggtaagcaggaagatgacctggctaacatcaaccagtgggtcaaagaggcgactgaaggaaaaatccaggagttcctttcgggcctcccagaggacaccgtgctgctgcttctgaacgcgatccacttccaaggattctggcggaataagttcgacccttccctcacccagcgcgactccttccacctggacgaacagtttaccgtgcccgtggagatgatgcaggctaggacttacccgctccgctggttcctgctggagcaacccgaaatccaggtggcacacttcccttttaagaacaacatgagcttcgtggtgctggtgccaacccatttcgagtggaacgtgagccaagtcctggccaacctcagctgggatactctccatccgcccctcgtgtgggaaaggcctacgaaggtgcgccttccgaagctctacctgaagcaccagatggacctggtcgccactctgagccagctgggactgcaagaactcttccaagccccagacctcaggggcatctcagagcagtccctggtggtgtccggagtccagcatcaaagcaccctggagctgtcggaagtgggcgtggaggcggctgccgctacgagcatcgcgatgtcaagaatgtcgctgtcatcattctcagtgaatcggccttttctgttcttcattttcgaagatactactggactgccgctcttcgtcggcagcgtgcgcaaccccaacccttccgccccgagagaactgaaagagcagcaagactcgccgggcaataaggacttcctgcagtcacttaaaggattcccccgcggagataaactttttggcccagacctgaagctggtgcctccaatggaagaggattacccgcagttcggatcacccaaa

SEQ ID NO: 18995 - DNA, 1473 bp, Artificial Sequence
  Description of Artificial Sequence: Synthetic coding sequence
atggccttactttggggacttttagttttatcatggtcatgtttacaaggaccatgttcagttttctcaccagtttctgctatggaaccacttggtagacaacttacttcaggacctaatcaagaacaagttagtccacttactttattaaaattaggaaatcaagagccaggaggacaaacagctttaaaaagcccaccaggtgtatgttcaagagatccaactcctgaacaaactcataggcttgcaagggcaatgatggcttttactgcagatcttttttctttagtagctcaaactagtacttgtccaaatcttattttatcaccattatcagttgcattggcattatctcatcttgcacttggagcacaaaatcatacgttgcaaagattacaacaagtattacatgctggaagtggaccatgtttaccacatttgctatcaagattatgtcaagatttaggaccaggagcatttcgtttagcagcaagaatgtatctacaaaagggatttccaatcaaagaagattttcttgaacaatctgaacaattatttggtgctaagcctgtaagtttaacaggtaaacaagaagatgatttagcaaatattaatcaatgggtaaaagaagcaacagaaggaaagattcaagaatttcttagcggtttacctgaagatacagttcttttgttattaaatgcaattcattttcaaggattctggcgaaataaattcgatcctagtcttactcaaagagatagttttcatcttgacgaacaatttacagtaccagttgaaatgatgcaagcaagaacttatccattaagatggtttttacttgaacaaccagaaattcaagttgcacatttcccattcaagaataatatgtcatttgttgttttggttccaactcattttgaatggaatgtctcacaagtattagcaaatttatcatgggatactttacatccaccacttgtttgggaaagaccaactaaagttagattaccaaaattatatcttaaacatcaaatggatctcgtagctacattatcacaacttggtcttcaagaactttttcaagcacctgatcttaggggaatttcagaacagtctcttgtcgtatctggagttcaacatcaatcaactcttgaattatcagaagttggagttgaagccgcagccgctactagtatagcaatgtcaagaatgagtttatcttcattttctgttaatagaccatttttattttttattttcgaagacactacaggactaccattgttcgtaggatcagtacgaaatccaaatccaagtgcacctagagagttaaaagaacaacaagattcaccaggaaataaggattttttacaatcattaaaaggattcccaagaggagataagttatttgggccagatctaaaacttgttccacctatggaagaggattatccacaatttggaagtccaaaa

SEQ ID NO: 18996 - DNA, 1473 bp, Artificial Sequence
  Description of Artificial Sequence: Synthetic coding sequence
atggcactcttgtggggactgcttgtcctcagctggtcctgccttcaaggaccctgttctgtgttctcccccgtttccgccatggagccactcggacgccagctgaccagcggtcccaaccaggaacaagtgagcccgctgacccttctgaagctcggaaaccaagaacccggcggacagactgcgcttaagtcgccaccaggagtctgctccagggatccaacccccgaacagactcatagactggcacgtgctatgatggccttcaccgcagatctgttttcgttggtggcccagacctcgacttgtcctaaccttattctttcgcctctttccgtggcactggcactgtctcatcttgctcttggtgcccagaaccataccctgcaacgacttcagcaggtgctgcatgcggggtccggaccatgtctgcctcatttgcttagccgcctgtgccaggatcttggacctggggcattcagactcgcggcgcgaatgtacctgcaaaaggggttccctatcaaagaagattttctcgagcagagcgagcagttgttcggtgcaaagcctgtctcgctgaccggcaagcaagaagatgatctggccaacattaaccagtgggtgaaggaggcaaccgaagggaagattcaggagtttctttcgggactgcctgaagataccgtcctgctgcttctgaatgccattcatttccagggattctggcgtaataagttcgacccgtccctgactcaaagagacagttttcatctcgatgaacagtttaccgtgcctgtggaaatgatgcaggcaagaacttatccactccgatggttcctgcttgaacaacctgaaatccaagtcgcccattttccatttaagaacaatatgtccttcgtggtgctggtgccaacgcatttcgagtggaacgtttcgcaagtgctggcaaacctgtcgtgggatactcttcatcccccactcgtttgggagcgccctactaaagtccggctccctaagctctaccttaagcaccagatggatctggtggccaccctgagccagctgggacttcaggagctgtttcaggcacctgatctgagaggaatctcggaacaatccctggtagtctcaggagtccaacaccagtccaccctggaactctcggaagttggggtggaagcagctgcagcgacctcaatcgctatgtcgaggatgtcactgtcatcgttctcagtcaatcggccctttctctttttcatttttgaagatactactggccttcccctctttgttggctcggtgcgaaaccctaaccctagcgcccccagagagcttaaggaacaacaagactccccaggcaataaagactttctgcagtctctgaaagggtttccccggggagataaactcttcggacctgatcttaaacttgtgccccctatggaagaggactatcctcaattcggatcgccaaag

SEQ ID NO: 18997 - DNA, 1473 bp, Artificial Sequence
  Description of Artificial Sequence: Synthetic coding sequence
atggccctgctctggggcctcctggtccttagctggtcgtgcctgcaggggccatgtagcgtgttcagccctgtctcggcgatggaaccactggggagacagctcaccagcggaccaaaccaggagcaggtgtcgccgctcactctcctgaagctgggaaatcaggaaccgggcggacagaccgcactgaagagcccgccgggcgtctgcagccgcgatccgacccctgaacagactcatcgcctggcccgggcgatgatggcgttcactgcggacctgtttagcctcgtggctcagacctctacctgcccgaacctgatcttgagcccactgtcggtcgcattggcactctcgcatttggctctcggtgcccaaaaccataccctgcagcggctgcaacaggtcctccacgcgggctcagggccctgccttccacacctgctgtcacgcctctgccaagacctcggtccaggcgcctttcggctggccgccagaatgtacctccagaaaggattcccgatcaaggaagattttctggagcaatcggaacagctcttcggcgcaaagcctgtgtccctgaccggcaagcaggaagatgatcttgccaacatcaaccagtgggtcaaggaagcaactgagggtaaaatccaggagttcctttcgggtctgccagaggacaccgtcctcctgcttctgaacgccattcacttccagggcttctggcggaataagttcgaccccagcttgactcaacgggactcgttccacctggacgaacagttcacggtcccggtggaaatgatgcaggctaggacttaccctctgcgctggttcttgctcgaacagcctgaaatccaagtggcccatttccccttcaagaacaatatgtcatttgtcgtcctggtgccgacgcatttcgaatggaacgtcagccaagttcttgccaacctctcatgggacaccttgcacccgccccttgtgtgggaaagaccgactaaggtccgattgccgaaactctaccttaagcaccagatggatctggtcgcaactctctcccagctcggactccaagagctgtttcaagcgcccgacctcaggggtatctccgagcagtccctggtggtgtccggcgtgcagcatcaatcaaccctggaactgtccgaagtcggggtggaggcagcggccgccacttcaatcgccatgagcagaatgtcactctcatcgttcagcgtcaacaggccgttcttgttcttcattttcgaagataccactggactgccgctgtttgtcgggtccgtccggaacccgaacccttcggccccaagagaactgaaggagcagcaggactctccgggtaataaggacttcctgcaatcgctgaaagggttcccgcgcggcgacaagctgtttggaccggacctgaagctcgtgccgccgatggaggaggattacccccaattcgggtcaccaaag

SEQ ID NO: 18998 - DNA, 1473 bp, Artificial Sequence
  Description of Artificial Sequence: Synthetic coding sequence
atggctctactatggggactactcgtcttgtcttggtcttgtctccagggaccttgctcagtcttttccccagtatcagccatggaaccgcttgggcggcagctcacatccgggcccaatcaggagcaggtatctcccttaactctactcaagttagggaaccaagaaccaggaggacaaactgcattaaaatctccccccggggtatgctcgagggatcccacacccgaacagacacatcgcttagcacgggccatgatggcttttacagcagatctgttttctcttgtagcacagacatcaacatgccctaacctaatcctctccccattgtcagtggcgttagctctatctcatctcgccctcggggcccagaatcacacacttcagaggttacagcaggtgttacacgctggatccggaccctgccttccacatctcctctctcgattatgccaggatttgggacccggagcattcaggctcgctgccaggatgtatctgcaaaagggattccccataaaagaagatttcctagaacagtccgaacagttattcggagctaaaccagtaagtctcactggaaaacaggaggatgacctcgctaatattaaccagtgggtcaaggaagccactgaaggaaaaatccaggaatttctctccggactcccagaggatactgtgctcctgctcctgaatgcaatacatttccaggggttttggcgaaacaagtttgaccctagtcttactcagagggatagtttccatctggatgagcagtttactgtgcctgtggaaatgatgcaggccaggacatatcctctccgctggtttctgctcgaacagccagaaatacaggtcgcacactttcctttcaaaaacaacatgtcttttgtggtgcttgtgccaacacattttgagtggaatgtgtctcaggtgttggctaatctctcttgggatacattacacccacccttggtgtgggaaaggcccacaaaagtgcggctcccaaaactctacctcaaacaccagatggatctcgtcgcaacactgtctcagcttgggttacaggaactttttcaggcacctgacttgcgtgggatatccgaacagtcattagtcgtatctggggttcagcatcagtctactcttgagctctcagaggtgggagtagaagccgcagccgccacatccatagcgatgtcccgaatgtcattgtcttcctttagtgtaaataggccctttttatttttcatatttgaggatactacagggctccctctttttgtagggtctgttagaaatcccaatccctcagccccccgagaactgaaagaacagcaggattcccccgggaacaaagattttctccagtctttaaaagggtttccacggggagataaattatttgggcctgatttgaaactggtgcctcctatggaagaagattatcctcagttcggatctccgaaa

SEQ ID NO: 18999 - DNA, 1473 bp, Artificial Sequence
  Description of Artificial Sequence: Synthetic coding sequence
atggccttgctgtgggggctgctggtgctctcgtggtcgtgcctgcagggtccttgttcagtcttctcgcccgtgtcagcaatggaacccttaggccggcaattgacgagcggtccgaatcaggagcaagtgtccccgctgacgcttttgaagctggggaaccaggagcctggtggacagaccgccctgaagtctccccccggcgtgtgctcccgggatcccactcccgaacagacacatcgcctcgctcgcgctatgatggcgttcactgccgacctctttagtctagtagctcaaacttcaacatgcccgaatctgattctaagcccgctgtccgtcgcgctcgcactaagtcacttggccctcggcgcccagaaccatactctgcaacgtctgcagcaggtactgcacgcgggatcggggccgtgtctgccccacctgctgagtcgcctttgccaggatctgggccccggagctttcagactggccgccaggatgtacctacaaaagggcttcccaatcaaggaggacttcctggagcagtcggagcagctttttggcgctaaaccagtctcgctcacgggcaagcaagaagatgatctcgcgaatataaaccagtgggtgaaggaggctaccgagggaaagattcaagagttccttagtggcctgccagaggatacggttttgctcttgcttaacgcgatccatttccagggcttctggcgcaacaagttcgatccctctctcactcaacgtgacagttttcacttagatgagcaatttacagtgcccgtggaaatgatgcaagcccgcacttaccccctccgctggttcctgctggaacagcccgagatccaggtggcgcactttccgttcaaaaacaacatgtcgttcgtcgtgctggtccccactcactttgaatggaacgtgtctcaggtgctagccaatctgtcgtgggatacgttgcacccacccctggtctgggagcgcccaactaaagtgcggctaccgaagctgtatctgaagcaccagatggatctagtggccaccctgtcccagcttggattgcaggagctgttccaggctccagacctcaggggaattagcgagcaatccctcgttgtctctggcgtgcagcatcagtccaccctagaactgtccgaggtaggggtggaagctgcggcagcaacatctattgctatgtcccgcatgtcgctctcgtccttcagcgtcaaccgtccgtttctgtttttcatattcgaggacaccacgggtctacccttattcgtgggttccgtgcgcaaccccaatccctccgcccccagggaattgaaggagcagcaggacagtccaggcaacaaggactttttgcagtcgctgaagggtttcccgcgcggagacaagctgtttggtccagatctgaaactggttccgcccatggaagaggattacccacaattcggaagtcccaag

SEQ ID NO: 19000 - DNA, 1473 bp, Artificial Sequence
  Description of Artificial Sequence: Synthetic coding sequence
atggcgctcctttggggtcttctggtcctctcctggagttgcctgcagggcccatgctccgtcttctctcccgtgagcgccatggagccactgggccgccagttgacttctggtccgaatcaggaacaggtctctccgttaacacttctgaagctcggtaatcaggagccaggtggtcaaaccgccctcaagtcgccacctggcgtttgttcgcgtgatccgacccctgagcagacccatcgtctagcccgcgccatgatggcatttactgctgatctcttctcgcttgtggcgcaaacttctacgtgccctaacttgatcctttccccgttgtctgtcgctcttgccctgtcgcacctggcattgggggctcaaaatcatactttgcagcgtttgcaacaggtgctacatgcgggatccggcccatgcctcccccatctgttgagccgtctgtgtcaagatctcggccctggtgccttccgcctggccgctagaatgtacctgcaaaagggtttccctattaaggaggacttcctagagcagtcagagcaactgtttggggcgaagcccgtgtccctaaccggtaagcaggaagacgacttggcaaacataaatcagtgggtcaaggaagccacggaaggaaagatccaggagttcctaagcggtttgcctgaggacacggttttgctgctgctaaatgcaattcacttccagggcttctggcgcaacaaattcgacccttcccttacacaacgcgactcgtttcatctggacgagcagttcaccgtgcccgttgagatgatgcaggctcgtacctaccctctgagatggtttctgctggagcagcccgaaatccaggtcgcccactttccgttcaagaacaacatgtcattcgtggtgctggttcccactcatttcgagtggaacgtgtcgcaggtgctggcaaatctttcctgggatactttgcacccgccgctggtttgggagcgtcccacgaaggtgcgactgcccaagctctacttgaagcaccaaatggacctggtcgcaaccttgtcccagctcggattgcaggagctgttccaagccccggatttgagaggcatctccgagcagtctctggtcgtgtccggagtccagcaccagtctacactcgagttgtccgaggtcggagtggaggctgcagcggccacaagcatcgccatgtcacgaatgtctctgagctcatttagcgttaacagacccttcttgttcttcatttttgaagataccactggactgcccctgtttgtcggttctgttcgcaacccgaacccgagcgcaccgcgggagttgaaggagcagcaggactcaccgggtaataaagatttcttgcaatccctgaagggattcccgagaggcgacaagctttttggccccgatctgaagctggtaccgcctatggaagaggattacccccagttcggaagtccaaag

SEQ ID NO: 19001 - DNA, 1473 bp, Artificial Sequence
  Description of Artificial Sequence: Synthetic coding sequence
atggccctcctgtggggactgctggtcctctcatggtcctgtctccagggcccgtgctcggttttctcaccggtcagcgccatggagcctttgggtcggcagctgactagtggaccgaatcaggaacaggtgagccctctcactctgctgaagttggggaaccaggagccgggcggacagaccgctctcaaatcaccaccaggagtgtgttccagggacccgaccccagaacagacgcatcggctggcgcgggccatgatggcatttactgccgatctgttcagcctcgtggcccaaacctcgacctgcccgaacctgatcctttcgccattgtccgtggccctggcactctctcacctggcgttgggagcacaaaaccacaccctccagagacttcagcaagtgctgcacgccgggtcaggcccatgcctcccccatctgctgtccagactgtgtcaggacctcggcccgggagcgttccgccttgccgcccgcatgtacctgcaaaaaggattcccaatcaaagaggacttcctggagcaatcagaacagctgtttggcgcaaagcccgtctcactcaccgggaagcaagaggatgacctcgcgaacatcaaccaatgggtgaaggaggcgactgaaggaaaaatccaagaattcctctccgggttgccagaggatactgtgttgctgttgctcaacgccattcacttccagggcttctggcgcaacaagttcgacccaagcctcacccaaagagactccttccacttggatgagcagttcacggtgccagtggaaatgatgcaggcgaggacgtacccactgcgctggttcctgctggaacagccggagatccaagtggctcacttcccgtttaagaataacatgtcgttcgtcgtcttggtccctacgcacttcgagtggaacgtgtcacaggtgctggcaaacctgagctgggacacgctgcatcccccgctggtgtgggagcggccgaccaaggtgcgcctgccaaagctgtacctcaaacatcagatggatctcgtcgctactctgtcacagctcggcctccaggaactgtttcaggcacctgatctgcgcggaatctccgaacagtcgctcgtcgtgagcggcgtgcaacatcaatcgactctggagctctcggaagtgggagttgaagcagctgctgctacttcgatcgctatgtcgcgtatgtcgctgtcatcattctccgtgaaccgcccgttcctgttcttcatcttcgaggacacgaccggcctgccgctgtttgtcggatccgtgagaaacccgaacccgtccgcaccgcgcgaactgaaggaacagcaggattcgccaggcaacaaagacttccttcaaagcctgaaaggcttcccgaggggtgataaactgttcggcccggatctgaaactggtgccgcctatggaggaggactatccccagttcggatccccgaag

SEQ ID NO: 19002 - DNA, 1473 bp, Artificial Sequence
  Description of Artificial Sequence: Synthetic coding sequence
atggcactcctgtggggtttgctcgtgctttcctggtcttgccttcagggaccgtgctcggtgttttcgccagtgtccgcaatggaacctcttggccgccaacttacttccggccctaatcaggaacaagtgtcgcctctgacgcttctgaaactgggcaaccaagagcctggcggccaaaccgcactgaaatccccaccaggagtgtgttcaagagatccaaccccggagcaaactcatagactcgcgagagcaatgatggcatttactgccgacctgttttcgctcgtggcccagaccagcacttgtccaaacctgattctgtcgccactgtcagtggcgttggcgctgtcgcatcttgcacttggagctcagaaccataccctgcagcggctgcaacaagtgcttcatgcgggatcgggaccttgtctccctcaccttctttcgcggctgtgccaggatctcggtcccggtgctttcagattggccgcacgaatgtacctgcaaaagggctttcctatcaaagaggacttcctggaacaatcagagcaacttttcggggcaaagcctgtgtcgcttacgggcaaacaagaagatgacctggcaaacattaaccagtgggtcaaggaagctaccgaaggtaagatccaagaattcctctcgggcctgcctgaggacactgtgctcctccttttgaatgctattcattttcagggtttttggcgcaacaaatttgatccgtcccttactcaacgggacagctttcatcttgatgaacaatttactgttcccgtggagatgatgcaagcacggacttacccactgcggtggtttcttctggagcaacctgagatccaggtggcacattttcctttcaagaacaacatgagcttcgtggtcctggtccctacgcactttgaatggaatgtcagccaggtgcttgcaaacctctcgtgggatactctgcatcctcctcttgtgtgggaacgccccactaaagtgaggcttcccaagctctaccttaagcatcaaatggaccttgtcgcaactctcagccagctcggactgcaggaacttttccaagcccctgaccttcggggtatttccgaacaatctcttgtcgtgtccggtgtccaacaccaaagcacccttgaactcagcgaagtgggagtggaagcagcagcggcaacctcgatagctatgtcaagaatgtcactgtcgtcgtttagcgtcaaccgacctttcctcttcttcatattcgaagatacgaccggcttgccactgtttgtcggaagcgttagaaacccaaacccatctgcacctagggaactcaaggaacagcaagattccccaggaaataaggacttccttcagagcctcaaaggttttcccagaggcgacaaactttttgggcccgatcttaagctcgtgcctcctatggaggaagattaccctcaatttggatcaccaaag

SEQ ID NO: 19003 - DNA, 1473 bp, Artificial Sequence
  Description of Artificial Sequence: Synthetic coding sequence
atggccctcctgtggggcttgctcgttcttagctggagctgcctgcagggaccctgttccgtgtttagtccggtgagcgccatggagcctctgggcagacaactgacgtccggcccaaatcaggagcaagtgtccccgctcaccttgctgaaactcggaaaccaagagccaggaggtcagactgcactgaagtccccgccaggagtctgctcgcgcgatccgacgccggagcagactcaccggctcgcgcgggccatgatggcgttcacggccgaccttttctccctcgtggcgcagacctcgacctgcccaaatctgattctgagccctctttcggtggccctcgcactgagccacctggccctcggtgcccaaaatcatactttgcagcgactgcaacaagtgctgcacgccggttcgggtccatgcctgccgcacctcctgagccgcctttgtcaggatctcggtccgggagccttccgactggccgcacggatgtacctgcagaaaggattcccgatcaaggaggacttcctcgagcagtccgaacagttgttcggcgctaaaccggtgtcactgaccggcaagcaggaagacgatctcgctaatatcaaccagtgggtcaaagaggccaccgaaggaaagatacaagagttcctttccggccttcctgaggacactgtgctgttgctgctgaacgccatccacttccaagggttttggcggaacaagttcgacccttcactgactcagcgcgacagctttcatctggacgaacaattcaccgtcccggtcgagatgatgcaggcccgcacgtaccccctgcggtggttcctgctcgaacagccggagattcaggtcgcccacttcccgttcaagaataacatgtcgttcgtggtgctggtgccgacccatttcgaatggaatgtgtctcaagttctggccaacctctcgtgggacactctccacccgccactcgtgtgggaacgcccgactaaagtgcgcctcccgaagctgtacctgaagcatcagatggaccttgtcgcgactctgtcccaactcggactccaggaactctttcaggcgccggatcttaggggaatctccgagcagagcctcgtcgtctcaggggtgcagcaccagtcgacccttgagctgtctgaggtcggcgtggaggccgcggcggcgacctcaatcgcgatgtcccggatgtcgctgtcgagctttagcgtcaaccggccctttctcttcttcattttcgaagacaccaccggcctgcctttgtttgtgggaagcgtgagaaaccctaatccgtccgcgcccagagaactgaaggaacagcaagactccccaggtaacaaagactttctccagagcctgaagggttttccgagaggagacaagctgttcggtccggatctgaagctggtccctccaatggaggaggattatccgcaattcggctccccgaaa

SEQ ID NO: 19004 - DNA, 1473 bp, Artificial Sequence
  Description of Artificial Sequence: Synthetic coding sequence
atggcactcctctggggcctgctggtactgtcgtggtcttgtctgcaggggccctgctccgttttctcgccagtctccgccatggaacccttgggcagacaactcacctctggaccgaaccaggagcaggtatccccattgaccctactaaaactcgggaaccaggagcccggaggccagactgcacttaagagtccacccggagtttgttcaagggatccaacccccgaacaaacccaccgcctggccagagccatgatggcttttaccgcagacctgttctccctggtagctcaaacctccacctgcccaaatctgatactctcgcccctgtccgtggcactcgctctgtcccacctggcgctgggcgcacagaaccataccctgcagcgactccaacaggtgttacacgctggttccggaccatgcttgccccatctgctgagtcggttgtgccaggatctcgggcctggtgcattccggctggccgcacgaatgtatctacagaagggattcccaatcaaggaggacttcctcgaacagtcagagcaattgttcggagccaagcccgttagtctgacgggaaaacaggaagacgacctggccaatatcaaccagtgggtgaaggaggccaccgagggaaaaatccaagagttcttgagcgggctcccagaggacactgtgttgttgctgcttaacgccatccattttcagggcttttggcgcaacaagttcgacccaagcttaacccagcgggatagtttccacctggacgagcaattcactgtgccagtggaaatgatgcaggccaggacttatcctctgagatggttccttctcgagcagcccgaaatccaagtggctcatttcccattcaaaaacaatatgagcttcgtcgtactcgtacccactcattttgaatggaatgtcagtcaggtgctcgcaaatctgtcttgggatacactgcaccctcctcttgtgtgggaacgccccacaaaggttaggctcccgaagctgtacctgaaacaccagatggatctggttgccacactgagccagctcggacttcaggaattgttccaagctccagacctgaggggcatcagcgagcagagtttggtggtatctggtgttcagcaccaaagtacgcttgaactgtccgaagtaggcgtggaagccgcggcagctacctccattgccatgagtcgcatgtccctgtcctcgttttccgtgaataggccattcctgttttttatatttgaggacacaaccggattgccattgtttgtcgggtctgtacggaatccgaaccctagcgcaccccgcgaactcaaggagcaacaggactcacctggcaataaagattttctccagagcctgaaaggtttccccaggggcgacaaactgttcggccccgacctgaagctcgtgcccccaatggaggaagattatcctcagttcggcagccccaaa

SEQ ID NO: 19005 - DNA, 1473 bp, Artificial Sequence; identical to SEQ ID NO: 18973
  Description of Artificial Sequence: Synthetic coding sequence

SEQ ID NO: 19006 - DNA, 1473 bp, Artificial Sequence
  Description of Artificial Sequence: Synthetic coding sequence
atggcactgctgtggggtctgttggtcctttcatggagttgtctgcaaggcccttgttccgtgttttcgccagtgtccgcaatggaaccgcttgggcgacaactcacttcaggccccaaccaagaacaagtctcacccctcactctcctcaaactcggaaaccaggaacctggtggtcaaactgctctgaaatcgccacccggtgtttgctcacgtgatcctaccccggaacagactcatcggttggcacgagcaatgatggcctttactgcggatctttttagcctggtggcacagacctccacctgtcctaatcttatactgagtccactttcagtggcactggcacttagccatctggcactcggtgcccagaaccatactcttcaaagacttcaacaggtccttcacgcagggtcgggaccttgtctgccgcatttgttgtcgcgcttgtgccaagatctgggacctggtgcgtttcgtttggcggcccgaatgtacctgcagaagggatttcccatcaaagaagattttctggagcagtccgaacaactctttggagcaaaacctgtttcactcaccggtaaacaggaggacgaccttgccaacatcaatcagtgggtgaaggaagcaactgaaggtaagattcaggagtttctgtcggggcttccagaagataccgtgctgctgctgctcaatgcaattcattttcagggattctggagaaacaagtttgatcctagcctcacgcaacgcgactcgtttcaccttgatgaacaattcacggtcccagtggaaatgatgcaagcccggacgtacccactgaggtggttcctcttggagcaacctgaaattcaagtggcccactttccttttaagaacaatatgagcttcgtggtccttgtccctacccactttgagtggaatgtctcacaggtgttggcgaacttgtcgtgggatactttgcatcctccgcttgtgtgggaaagacctaccaaggtacgtttgcccaagctgtacctgaagcatcagatggatcttgtggctaccctgtctcaactgggccttcaagagcttttccaggcaccagacctccggggaatctcagaacagtccttggtggtgtcaggagtgcagcaccaatcgacccttgagctttctgaagttggagttgaagccgccgcagctaccagtattgctatgtcgcggatgtccctgagcagtttttcggtgaacagaccctttttgttcttcattttcgaggacactacgggactgccactttttgtgggcagcgtgagaaaccctaatccttccgccccaagagagctgaaggagcagcaagacagcccaggcaacaaggacttcctccaaagcctcaagggcttcccccggggggacaagctgtttggccctgatttgaaactggtcccaccaatggaggaagattacccccaattcggatcccctaag

SEQ ID NO: 19007 - DNA, 1473 bp, Artificial Sequence
  Description of Artificial Sequence: Synthetic coding sequence
atggcgctcctgtggggacttcttgtcctgagctggtcatgcctgcaaggcccgtgttcggtgttctcccctgtgtccgctatggagccgctggggcgccagctcacgtcggggcctaaccaggagcaagtcagccccctgactctcctgaagctgggaaaccaagaaccggggggccagaccgccctcaagagcccgccgggggtttgctcgcgggacccaacgccagaacagacgcatcgccttgccagagcgatgatggctttcactgccgatcttttctccctggtcgcccagacctccacttgcccgaatctcatcttgtcaccgctttcagtggccctggctctctcccacttggccctgggagcacaaaaccacaccctccaaagactgcagcaggtgcttcatgctggttccggcccgtgtctgccacatctgctctcgaggctgtgccaggatctgggccctggcgccttccggctggccgccaggatgtacctgcaaaaggggttccctatcaaggaggatttcctcgaacagtcggagcagctgttcggcgctaagccagtctcactgactggaaaacaggaggacgatctcgcgaatattaaccaatgggtgaaagaagcgactgaaggaaaaatccaggagtttctcagcggactgcccgaggacaccgtgctgctgttgctgaacgccatccactttcagggattttggagaaataagttcgacccgtccctgactcaacgggactcgtttcacctggacgaacagttcaccgtgccggtggaaatgatgcaggcgcgcacctaccccctccggtggttccttctcgaacaaccggagatccaggtggcccacttcccattcaaaaacaacatgtctttcgtggtcttggtgccgacccatttcgaatggaacgtttcgcaggtgctggcaaatctgtcctgggatactctgcaccctccgctcgtgtgggaaagacccaccaaggtccgtttgcctaagctctacctgaagcatcagatggacctggtcgcgactctctctcagctgggattgcaagaactgttccaggcgccggatttgcggggaatctcagaacaatccctggtggtgtcgggagtgcagcaccaaagcactctcgagctgagcgaggtgggagtcgaagccgcagcagcaacctccatcgcaatgagccgcatgtcgctctcatcgttctcagtgaaccgcccctttctgttctttatttttgaggacaccaccggactcccactcttcgtcggatcggtgcggaacccaaatcccagtgctccacgagaattgaaggaacagcaggacagcccgggcaataaagacttcctgcaaagcctgaagggattcccacgcggtgataagctctttggtccggatcttaaactggtccctccaatggaggaggactaccctcaattcggttccccgaag

SEQ ID NO: 19008 - DNA, 1473 bp, Artificial Sequence
  Description of Artificial Sequence: Synthetic coding sequence
atggcgctactgtgggggcttttagtgctgagctggtcttgtcttcaaggaccctgctcagtgttcagcccagttagcgctatggagccactgggccgccaactgacctctggcccaaaccaagagcaggtttcaccactaaccttacttaaactgggcaaccaagagcctggcgggcaaaccgcattgaaaagtcccccgggcgtctgtagtagggacccaacccccgagcagacacaccgcctcgcaagagcaatgatggcctttactgcagacctgtttagcctggttgcgcagacatccacctgtccaaatcttatcctctctcccttgtctgtggctctggcactgagccacctcgcacttggcgcccagaaccacacactgcaaaggctccagcaggtgctgcacgcagggtccggaccatgcctgccacacctgttgagtaggctttgccaggatcttggtccaggagctttccgcttagcggcaagaatgtaccttcagaaaggctttccgattaaagaggacttcttggagcagtccgagcagttgttcggagcgaagccagtgagcttgacaggaaagcaagaagacgacctggctaacatcaaccaatgggtgaaagaagctactgaaggaaaaatccaggagttcctgtcagggctacctgaggacacggtcctccttcttcttaatgcgatccacttccagggattctggagaaataaattcgacccaagcctgactcagagagacagcttccatctggacgagcagttcaccgttcccgttgagatgatgcaggcacgaacataccccctgcggtggttcctcttggaacaacctgagattcaggtcgcccattttccctttaaaaacaatatgagcttcgttgttctggttccaacacactttgagtggaatgtctcccaagttctagccaacctgagctgggacaccctgcatccaccacttgtctgggagaggcccaccaaagttagacttccaaaattgtacctgaagcatcagatggatctggtggcaaccctgtcccaactgggactccaagagttgtttcaggctcctgatctgaggggtatcagcgagcaaagtttggtggtcagcggcgttcagcatcagtctacactcgagctctctgaggtgggcgtggaagccgctgccgctacaagcattgcaatgtctagaatgtctttgagcagctttagcgtaaatcgaccctttttgtttttcatcttcgaagatactaccggacttccactcttcgtaggatcagttagaaatccaaaccctagtgctccccgcgagttgaaagagcaacaggacagtccaggcaacaaagatttcctccagagcctgaaaggattccctcgcggcgataagctgtttggacccgatcttaaattagtgcctcctatggaggaggattaccctcagttcggaagcccaaag

SEQ ID NO: 19009 - DNA, 1473 bp, Artificial Sequence
  Description of Artificial Sequence: Synthetic coding sequence
atggctctgctttggggcctgctggtgctgtcctggtcatgcttgcagggcccatgcagtgtgttcagccctgtgtcagctatggagcccctgggtcgtcagttgacctctggccctaatcaggaacaggtctctccccttaccctcctgaagttgggtaaccaagaaccaggcggacagactgcccttaaaagccctcctggagtttgttctagagacccaacaccagagcagacacaccgcctggctagggcaatgatggctttcaccgctgacttgttcagtctcgtggcccagacaagcacttgtccaaatctgatactcagcccactgagtgtagctcttgccttgtcacacctcgcactgggagcccagaatcataccctgcagagattgcagcaggtattgcatgccggatccggtccttgcctgccccaccttctgtcacgcctgtgtcaggatcttggtcccggcgcttttagactcgccgcaaggatgtatcttcaaaagggcttccctataaaagaggacttcctggaacagtctgaacagttgttcggagcaaaacctgtctccctcacaggtaaacaggaggatgatctcgccaacatcaatcagtgggtgaaagaagctaccgagggcaaaatacaagaattcttgtccggtctgccagaggataccgttctgctcctgcttaacgcaatccatttccaaggattttggcgtaacaagtttgatcccagtctcacacaacgtgacagcttccaccttgatgaacagttcactgtccctgtcgagatgatgcaggccaggacttaccctctgcgttggttcttgctggaacagcctgagatccaagtcgcccattttccattcaagaataatatgagcttcgtagtgctcgttcccactcatttcgagtggaacgtctcccaagtgctggccaacctgtcatgggataccctccaccctcctctggtgtgggagcgtcccactaaggtccgcctccccaagctttacctgaaacatcagatggacttggttgctaccttgagtcagcttggcctccaggagttgttccaggcccccgacctgaggggaattagtgagcagagcctggtagtctcaggcgtgcagcaccagtccaccctcgagttgtccgaagtgggagttgaggcagccgcagccacctccatcgccatgtcaagaatgagcctgagcagcttctcagtgaacaggcctttcctgttcttcatctttgaagacactaccggtctgccattgttcgtaggaagtgtaaggaaccccaatccaagcgctccccgtgagctgaaggagcaacaagattctccaggtaacaaagatttcttgcagtctctgaagggctttcctcgtggcgacaaactgttcggtcccgaccttaagctggtcccacccatggaggaagattatccacagttcggtagtcccaag

SEQ ID NO: 19010 - DNA, 1473 bp, Artificial Sequence
  Description of Artificial Sequence: Synthetic coding sequence
atggcacttctgtggggactgcttgtgcttagctggtcctgcctgcaaggcccatgtagcgttttcagccctgtgagcgccatggagcctctgggccgacagctgacatctgggcccaaccaggagcaggtttccccactgactttgcttaagctgggcaaccaagagcctggaggacagactgctttaaagtctcctcccggggtgtgttccagagatccaaccccggagcagactcaccgattggctagagctatgatggcatttactgcggacctttttagcttggtggctcaaacctctacttgccccaaccttatcctcagccccctatccgtggctctcgctctgagccacctggctcttggcgcccagaaccacacgctgcagcgactgcaacaggttctgcacgcagggtcaggtccctgtcttccccatctgctgtcaaggttgtgtcaagatcttggccccggagctttccggctggccgcacgaatgtacttacaaaaaggctttccaatcaaggaagattttttggaacagagcgaacaactgtttggagctaaacctgttagcctgaccggtaagcaagaggacgatctcgccaacatcaaccagtgggtgaaggaagcgacagaggggaagatccaagaatttctcagcgggctccctgaggacactgtactccttcttctgaatgcaatccactttcaaggattctggagaaacaaatttgatccaagcctgacccagagagactcttttcacctggatgagcagtttacggttcctgttgagatgatgcaagctagaacctaccccctcagatggtttttgctggaacagccggaaatccaggttgctcactttcccttcaagaacaatatgtccttcgtcgtgcttgtgccaacacatttcgaatggaacgtaagtcaggtcctggcaaacctcagctgggatactctgcatcctcccctcgtctgggagcggcccactaaagtgagattgccaaaactctacctgaaacatcagatggatcttgtagcaacactcagtcaactgggcctccaagagctgttccaggcccctgatcttcgtggaatcagtgaacaatccctggttgtttccggggttcagcaccagagcactctggagctttcagaggtcggagtcgaggctgccgctgcaacatcaatcgctatgagtagaatgtccctctctagcttcagtgtcaacaggccatttctgttttttatctttgaagatactacgggactgccactcttcgtgggatctgttcgcaatcccaacccttcagcacccagagagctgaaagaacagcaggattcccctggcaataaggatttcctgcagagcctgaagggattcccaagaggcgacaaattattcggccctgacctgaaactcgtccctcccatggaagaagactacccacagttcggtagtcctaaa

SEQ ID NO: 19011 - DNA, 1473 bp, Artificial Sequence
  Description of Artificial Sequence: Synthetic coding sequence
atggccctgctctggggtctgctggtcttatcatggtcatgtttacaaggcccttgcagcgtcttcagccctgtttcagctatggaaccacttggtcgccagctgacgagtggtcctaatcaagaacaagttagccctttgactttgttgaagctggggaatcaggagcctggcggccaaactgcactgaagtcacccccgggggtttgttctagggaccccactcctgaacaaactcaccgcctggctcgggcgatgatggccttcacggcggacttgttttctcttgttgcacagacatctacatgcccaaacctaattctgagccccctgtcggtagccctcgctctgtctcacctagcccttggggctcagaaccacacattgcagagactgcaacaggtcctgcacgccggctctgggccttgcctcccgcacctgctttcgcgattatgccaggatctgggcccaggcgcctttagactagccgcccgaatgtacttgcagaaaggatttcctattaaggaagacttcctagaacagtcagagcagttgtttggcgctaagcccgtcagcctcacagggaagcaggaggatgatctggccaacattaaccaatgggtaaaagaggcaaccgaaggaaagatccaggagttcttaagcggcctgccagaggacacagttttattgctgctgaacgctattcacttccagggcttctggagaaacaaatttgatccttctttaactcagcgcgactccttccatctggacgaacagttcaccgtcccagtggaaatgatgcaagcacggacatacccactacggtggttcctgctcgagcaaccggaaatccaggtcgcccacttcccctttaagaataacatgagttttgtggtgctggtgcctacccattttgagtggaacgttagtcaggtcctggccaatctgagctgggatactctacacccccccttggtctgggagcgtcctaccaaggtgcggctaccaaagctttacctgaaacaccagatggatctcgttgctactctttcgcaattggggttgcaggaacttttccaggcccccgatttgcgggggatctccgaacagtcacttgtggtttctggagtgcagcatcagtctaccctggagctttcggaagtcggcgtcgaagccgcggccgctactagcatcgccatgtcacgcatgtctttatcctccttctccgtgaatcgaccttttctattttttatttttgaagatactacaggcctacctctattcgtcggctctgtccgcaaccccaatcctagtgcccctagggaactcaaagagcaacaggatagtcccgggaataaagacttcttgcagtccctaaaaggcttccctagaggagacaaattgttcgggccggacctaaaactggtaccaccaatggaggaggattaccctcaatttggatctcctaag

SEQ ID NO: 19012 - DNA, 1473 bp, Artificial Sequence
  Description of Artificial Sequence: Synthetic coding sequence
atggccttgttgtggggacttctggtgttgagctggagctgcctgcaaggaccctgctccgtgttctcccctgttagcgcaatggagccgcttggacggcagctgacttcgggaccgaaccaagagcaggtgtcgccgctcaccttgctgaagctgggtaaccaagaacctggtggccagactgccctcaagtcaccaccgggtgtctgctcgcgcgacccgaccccggaacagacccacagactggcccgggcgatgatggcttttaccgcggacctcttcagcctcgtggcccaaacttctacttgtccgaacctcatcttgtctcccctgagcgtggctcttgcgctgagccatctggcactgggagcccaaaatcatactcttcagcgcctgcaacaagtccttcacgcaggatcaggaccatgcctgccgcacctgctgagccggctctgtcaggacctgggacctggggccttcaggctcgcagcacggatgtacctccagaaggggttcccgatcaaagaagatttcctggagcagtcggagcagctgttcggagccaagccagtgagcctgaccgggaagcaggaggacgatctggccaatatcaaccaatgggtcaaagaagccactgaggggaagatccaagaattcctgtccggcctcccggaagataccgtgttgctcctgctcaacgcaatccactttcagggtttctggcgcaacaagttcgatccaagcctgacccagcgggactctttccacctcgacgaacaattcacggtgccggttgaaatgatgcaggctcgcacttacccgcttagatggtttctgcttgagcaacccgagattcaagtagcccatttccctttcaagaacaatatgtcgtttgtggtgctggtgccgacccatttcgagtggaatgtgtcgcaggtccttgcgaacctttcctgggatacgctgcacccaccgctcgtgtgggaaaggccaactaaggtacgcctccctaagctgtacctgaagcaccagatggatctggtggctaccctttcccagcttggactgcaggagctctttcaggcgccggacctgcggggcatctccgaacagtcgctggttgtctccggagtgcagcatcaatcaaccctggaactctccgaggtgggagtggaggctgccgcagccacctccattgcgatgtcacgaatgtcattgagctcattctcggtcaaccgtcctttcctcttcttcatcttcgaggacaccactggcctgccactgttcgtcgggagtgtgagaaatccgaatccatcggcgccacgtgaactgaaggaacagcaagattcgcctggcaacaaagactttcttcagtcactcaaaggcttcccgagaggtgacaagctgtttggtcccgacctcaaattggtcccaccgatggaagaagattatcctcagtttgggtcaccaaaa

SEQ ID NO: 19013 - DNA, 1473 bp, Artificial Sequence
  Description of Artificial Sequence: Synthetic coding sequence
atggcgcttttgtgggggttgctcgtgctgtcctggtcgtgcttgcaaggcccgtgctccgtgttctcgccggtttcggccatggaacccctcggccgccagttgaccagcggaccgaatcaggaacaagtcagcccgctgaccctcctgaaactgggaaatcaagaaccaggaggccagaccgcgctgaagagccccccgggcgtctgctcacgcgacccgaccccggaacaaacgcaccgcctcgcccgcgcaatgatggcatttactgcagatctgttctcgcttgtggcccagacttcgacctgtccaaacctgattctctcgccgctcagcgtcgccctcgcgctctcgcacctggcgctgggagcccagaaccacacccttcagcgactccagcaagtgcttcatgccggcagcggaccttgccttcctcatctcttgtcgcgcctctgtcaagacctcggcccgggggcgttccgcctggcagcacggatgtacctccagaagggattcccgatcaaagaggacttcctggagcaatccgaacaactctttggcgctaaacccgtgtccctcactggaaagcaggaggacgacctggccaacatcaatcagtgggtgaaggaggctaccgaaggaaagattcaggaatttctgagcggactgccggaagatactgtgcttctgctcctgaacgcaatccatttccaggggttctggcgtaataagttcgacccgtcactgacccaaagggattcttttcacctggatgaacaatttactgtgccagtggagatgatgcaggcacgcacctacccactgagatggttcctccttgaacagccagagatccaagtggcgcacttcccgttcaaaaacaacatgtcgttcgtggtgctggtgccaactcacttcgaatggaatgtctcccaagtgctggctaacctttcgtgggacacgctgcaccctccactggtctgggaaagacccaccaaggtgcgcctcccaaagctgtacctgaagcatcagatggacctcgtggcgactttgtcgcagctgggactccaagagctgtttcaggcgccggacctgagaggaatctcggagcagtccttggtggtgtctggagtgcagcaccaaagcacgctggagctctcggaagtgggagtggaggctgccgccgccacttcgatcgctatgtcccgcatgtctctctcttcgttcagcgtaaacaggccattcctgttcttcatctttgaggacactaccggcctcccgctcttcgtcggatccgtgcgaaatcctaacccgagcgcgccgcgggagctgaaggagcagcaggactcgccgggaaacaaggacttccttcaatctctcaaaggattcccccggggggataagctgtttgggccggacttgaagctggtgccgccgatggaagaggactacccgcagttcggatcaccgaaa

SEQ ID NO: 19014 - DNA, 1473 bp, Artificial Sequence
  Description of Artificial Sequence: Synthetic coding sequence
atggcccttctttggggactcctcgtcttatcctggtcctgcctgcaagggccgtgtagcgtgtttagccccgtctcagccatggaaccccttggacggcagcttacatccggtcctaatcaggagcaggtgagcccgttaacacttctcaaactcggcaatcaggaacctggaggacagaccgcactcaagtctcctccaggcgtttgtagccgcgatcctactcccgagcagacacaccggctcgcaagagcaatgatggccttcaccgcagacttgttttctctcgtggctcagacctctacctgccctaacctcatcttaagccccctgtccgtagcactggcactaagccatctcgctcttggagcacagaaccacacactgcaacggctgcagcaagtactgcacgctggctccggaccctgcctgccccacttgttgtctagactgtgccaagatctgggtccaggagcctttagactcgctgcccgaatgtatctgcagaagggtttccccatcaaagaggattttctcgagcagtccgagcaattgtttggtgcaaagccggtctcattaactgggaaacaggaagatgacctggccaatattaaccagtgggtgaaagaagccaccgaagggaagattcaggagtttctgtcaggcctccctgaagatactgtgctcttattgctgaatgccatccactttcagggattttggagaaataagttcgacccttcactgacccagagagattcttttcatctggacgagcagttcaccgttcctgttgagatgatgcaggcacgtacatatcctctgcgctggtttcttcttgaacagccggaaatccaggttgcccatttcccattcaaaaataacatgtcgttcgtggttctggtgccgacacatttcgaatggaacgtatcacaagtcttggccaacctgagctgggatacactgcacccccccttggtgtgggaaaggcccaccaaagtaagactaccaaaactgtacctcaaacaccaaatggatttggttgctacactttcccagctgggactgcaggaactgttccaggcacctgatctgcgggggatttctgagcagagccttgtggtgtctggagtgcagcatcagtcaactcttgagctttcagaggtgggggtggaggctgccgctgccacttccatagccatgagtcgtatgtcactctcttcgtttagtgtgaaccgtcccttcttgttttttatctttgaggacaccactggattacctttatttgtgggctcggtcaggaatccaaacccaagcgccccacgtgagctcaaggagcagcaggacagccccgggaataaggactttcttcagtcccttaaaggattcccccggggcgataagctgttcggtccggatctgaagcttgtgccccccatggaggaggattaccctcaattcgggagccctaaa

SEQ ID NO: 19015 - DNA, 1473 bp, Artificial Sequence
  Description of Artificial Sequence: Synthetic coding sequence
atggcgctgctgtggggactcctggtcctgtcgtggtcctgcctccaaggaccatgctccgtgttctcgcccgtttcggccatggaaccgttgggccgccaacttacctcgggaccgaaccaagagcaggtcagcccgctgaccctcctcaagctgggcaaccaagagccgggcgggcagaccgccctgaagtcaccacctggcgtttgctcacgggaccctactcctgagcaaactcaccgcttggctagggctatgatggcattcactgcggatctgttttcgctggtggctcaaacctccacgtgcccaaatctgatcctgtccccgctgtcggtcgccctggccctgtcacacctcgctctcggagcccagaatcataccttgcagagacttcagcaggtgttgcacgctggaagtggcccatgcctgccgcacctcctgtcgaggctctgccaggaccttggcccgggtgctttccgactggccgcacggatgtacctgcagaagggattcccgattaaagaggacttcctcgaacagtcggagcagctgtttggcgccaagccagtgtcgctcactggaaaacaggaagatgatctggctaacattaatcagtgggtgaaagaagccactgaaggtaagatccaagagtttctgtcaggactgccggaagatactgtgctcctgctcttgaacgcaatccacttccagggcttctggcgcaataagtttgacccgtccttgacccagcgcgactccttccacctggatgaacagtttaccgtgccggtggaaatgatgcaagctagaacttacccgctccggtggttcctgctggaacaaccagagatccaggtggcgcactttccctttaagaacaatatgtccttcgtcgtgttggttcccacccatttcgaatggaacgtcagccaggtgctcgcaaacctgtcatgggatactctgcatccgccgctggtgtgggaaagacctacgaaggtcagattgcctaagctgtacctgaaacaccagatggacctggtcgcaacgctgtcacaactgggactgcaagagctgttccaggccccggacttgcgcggcatctcggaacaatcgctcgtggtgtcgggagtccagcaccagtcaactctcgaactctcggaggtcggcgttgaagcagccgctgcaacttcgattgccatgtcccgtatgtcactgtcatccttcagcgtgaatagacctttcctgttcttcatcttcgaggacactaccggactgcctctgttcgtgggctcggtgcgaaatcccaatccgagcgcgccgcgcgaactgaaggagcagcaggatagccccgggaataaggacttcctgcaatctctgaagggcttcccacgcggtgataaactcttcggaccagatttgaaactggtgccgccgatggaagaggactacccgcaatttgggtcgcctaag

SEQ ID NO: 19016 - DNA, 1473 bp, Artificial Sequence
  Description of Artificial Sequence: Synthetic coding sequence
atggccctgctgtggggactgttggtgctgtcctggtcctgtctgcaagggccatgttcggtgttttcgccggtgtcggccatggaaccactcggacggcagctcacttcgggcccaaatcaggagcaggtttctccgctgaccctcctgaagctgggcaaccaagaaccaggtggtcagacggcccttaagtcgccacctggcgtctgcagcagggacccgaccccggagcaaacgcatagactggcaagagccatgatggcttttaccgcagacctgttctcactggtggcccagacttccacctgtccaaaccttatcctctcgccactctccgtggccctggcactttcgcatctcgctctcggcgctcagaaccataccctgcaaagactgcaacaagtgctccacgccggaagcggaccgtgcctgccgcatctgttgtcacgcctgtgccaggacttgggccctggcgcgtttcggctggcggcgaggatgtacctgcagaaagggttcccgattaaggaggatttccttgaacagtcagagcaactgttcggtgccaaaccagtatcgctgaccggaaagcaagaggacgacctggcgaatatcaatcagtgggtgaaagaagccaccgaaggaaagattcaggaatttctctccggcctgccagaggacactgttctgcttctgctgaacgccatccactttcagggattctggcgtaacaagttcgatccatcactcacccaacgggactcattccacctggatgagcagtttaccgtgcctgtcgagatgatgcaggcacgcacttacccgctgagatggtttctgctggagcaaccggaaattcaagtggcccacttcccgttcaagaataacatgtccttcgtcgtgctggtgccgacgcacttcgaatggaacgtgtcccaggtgctggccaacttgtcctgggatacccttcatcctccactggtgtgggaacgcccgactaaggtgcggctgcctaaactttacctgaagcaccagatggacctggtggccactctgtcacagctcggacttcaggaactgttccaagcgccagacctgagaggaatatcagagcagtccctcgtggtgtccggagtgcaacaccagtcaactctcgagctgtccgaagtcggggtggaagccgcggcggcgacttcgattgctatgtccagaatgtcgcttagcagcttctcggtgaatcggccgttcctcttcttcatcttcgaggacactactggactgcctctctttgttggaagcgtccgcaatccaaacccgtcagcgccgagggagctgaaagaacagcaagattcgccaggaaacaaggactttttgcagtctcttaaggggttcccacgaggagataagctgttcgggccagatctgaagctcgtcccgccgatggaagaagattaccctcagttcggatcgcctaag

SEQ ID NO: 19017 - DNA, 1473 bp, Artificial Sequence
  Description of Artificial Sequence: Synthetic coding sequence
atggcccttctgtggggactgcttgtcctttcgtggtcatgccttcagggcccgtgctccgtgttctcccctgtcagcgccatggaaccgcttggccggcagcttactagcggcccgaaccaggagcaggtgtcgcctctgacgctgctcaagttgggtaatcaagagccaggcggacagaccgcccttaagtcgccgcccggggtctgcagccgggatccgacccctgagcaaactcacaggctggctcgggctatgatggcctttactgccgacctgttctctctcgtcgcccaaacttcgacctgtccgaacctcatcctctcaccgctctccgtggcactggccctctcccatctggcgctgggagctcagaaccacacgctgcagaggctgcagcaggtgctgcacgcgggctcaggcccgtgtctgccccatctcctctcgagactgtgtcaagatctcgggccgggcgctttccgcctggcggcccggatgtacttgcaaaagggctttccaatcaaagaggacttccttgagcagtccgaacagctgtttggcgcaaagcctgtgtcgctcactgggaagcaggaagatgatctggcaaacatcaaccagtgggtgaaggaggccaccgaaggtaaaatccaagaatttctgtccggacttcctgaagataccgtgctgctcctgctcaatgccattcatttccagggtttctggcgcaataagttcgacccgtccctgactcaacgggactcctttcacctcgatgaacaattcactgttccagtggagatgatgcaggcaagaacttaccccttgagatggttcctgctggagcagccggagatacaagtggcgcactttccgttcaagaacaacatgtcatttgtggtgctcgtgccgacgcacttcgagtggaacgtctcgcaagtgctggcgaatctctcgtgggacaccctgcatcctccgcttgtgtgggagcgccccacgaaggttagattgcctaaactctacctcaagcatcagatggacctcgtcgcaaccctgtcacagctgggactgcaagagttgttccaggctcctgatctgcggggcatcagcgagcaatccctcgtggtatcgggcgtgcagcatcagtcaaccctggaactctccgaagtgggggtggaggcagctgcggcaactagcatcgcgatgtcgaggatgtcgcttagcagcttttccgtgaaccggccattcctgttcttcatttttgaggacaccactggcctgccgctcttcgtcggaagcgtgagaaaccctaatccgagcgcaccacgcgaactcaaggaacagcaggactcaccaggaaataaggactttctccagtccctcaaaggcttccctcgcggagataagctgttcggccccgacctcaaactggtgcctccgatggaggaggactacccgcagttcggcagcccgaag

SEQ ID NO: 19018 - DNA, 1473 bp, Artificial Sequence
  Description of Artificial Sequence: Synthetic coding sequence
atggccttgctgtggggactcctggtgctctcctggtcgtgtctgcaaggtccatgtagcgtgttttcgcccgtttcggcaatggaacctcttggtaggcaactgacgagcggacccaaccaggagcaagtcagccctttgaccctgcttaagctgggaaatcaagagccaggtggacagacggctctgaagtcgcctcccggtgtgtgctcgagagatccaacccccgaacaaacccaccggttggcccgtgcgatgatggcttttaccgcagatctgtttagccttgtggcgcagacctccacttgtcctaatcttatactctcgcccctgtccgtcgcacttgcactttcacacctggcactgggtgcacagaatcataccctgcaacgacttcagcaagtcctgcatgctggctcaggaccatgcttgccgcatctcctctcgagactctgtcaggacctcggccctggagcatttcgcttggcagcaaggatgtaccttcagaagggattcccaattaaggaagattttctggaacaaagcgaacaactgtttggggctaagcctgtttctctcaccggcaaacaggaagatgatctggcgaacattaatcagtgggtgaaggaggcaacggaaggcaagatccaggagttcttgtcgggacttccggaggatactgtgcttttgctcctcaacgccattcacttccaaggtttttggcggaacaagtttgatccttcactgactcagcgcgatagctttcacctcgacgagcagtttactgtgccggtggagatgatgcaggcccgcacctaccctttgcggtggttcttgttggaacaaccagaaatccaggtggcacactttccgttcaaaaacaacatgtccttcgtcgtgcttgtccccactcactttgaatggaacgtgtcccaggtgctggcaaacctgtcctgggatactctgcatcccccactggtgtgggaaagacctaccaaagtcagacttcctaagctgtacctcaaacatcaaatggatctggtggcaactctgtcccagttgggactgcaggagctgtttcaagctcctgatctgcggggaatctcggagcaaagcctcgttgtgtcgggagtccaacatcaatcgactcttgaactgtcggaggtgggtgtggaagcagcagcggccacctccattgccatgtcccgcatgagcctcagctccttctcggtcaaccgaccatttcttttcttcatatttgaagatactactgggctgccactgtttgtgggatcggtgagaaaccctaatccatccgccccaagagagctcaaggagcaacaagattcgccagggaataaggacttcctccagtcactgaagggcttccctcgaggggataaactctttggcccagatctgaagttggtcccacctatggaagaagattaccctcaatttggatcgccaaaa

SEQ ID NO: 19019 - DNA, 1473 bp, Artificial Sequence
  Description of Artificial Sequence: Synthetic coding sequence
atggcactcttgtgggggctgctcgtgctctcgtggagttgtctccaaggtccgtgttcagtgttttcgccagtcagcgccatggaacctctgggtaggcaattgacctccggcccaaatcaggagcaagtctctcctcttaccctgctgaaactgggtaatcaggagcccggaggtcagactgcacttaagtcgccacccggagtgtgtagcagagatcctacgcctgagcagactcatagacttgcgagagcaatgatggcatttaccgccgatcttttttccctcgtcgcgcagacctccacgtgcccgaacttgattttgtcacccctgagcgtcgcgctggccctttcccatctcgcgcttggtgcccaaaatcacacccttcagcggcttcagcaagtcctccacgcaggttcaggaccgtgcctgccacacttgctcagccgcctgtgccaggaccttggacccggtgccttcagattggcggcccgaatgtaccttcagaagggctttccaattaaggaagatttcctggagcaatcagaacaactttttggcgcaaagccagtgtcactgaccgggaagcaagaagatgacctcgccaacattaaccagtgggtgaaggaagcaacggaaggtaagatccaggaattcttgtccggactgccggaagatacggtgcttcttctgctcaacgcaatccactttcagggcttttggaggaacaagtttgacccatcccttactcaacgtgactccttccatcttgatgaacaatttactgtcccagtggagatgatgcaagcacgcacctacccactgcggtggtttcttcttgaacaacctgaaatacaagtggcacattttccgttcaagaataacatgtccttcgtggtcttggtcccaacccattttgaatggaatgtgagccaggtgttggcaaacctctcgtgggacaccctgcatcctcccctcgtgtgggaacgccctactaaggtcaggctgcctaaactctacctgaaacatcagatggatcttgtcgccactctgtcccaactcggactccaagaacttttccaagcaccggatctcagagggatcagcgagcagtcacttgtggtgagcggagtccagcatcaatcaacgcttgagctgtcagaggtcggggtggaagccgcggcggcaacctcaatcgccatgtccaggatgtcactttcatcattttcagtgaataggccttttctctttttcatatttgaagatactaccgggcttcccctgttcgttgggtccgtgcgcaaccctaacccgagcgcaccaagagagctcaaggaacaacaggattcgccaggaaacaaggacttcctgcaatcgctcaagggcttccccagaggtgacaaactctttggtcctgacttgaaactggtcccacctatggaggaggattaccctcagtttggctcgccgaag

SEQ ID NO: 19020 - DNA, 1473 bp, Artificial Sequence
  Description of Artificial Sequence: Synthetic coding sequence
atggcactgctgtggggacttctcgtgctttcttggagctgtctgcaaggaccatgtagcgtttttagccctgtgtctgccatggagccattggggagacagctcactagtggtcccaatcaagaacaggtgtcacctctcacactgttgaagttgggcaatcaggagcctggcggccaaactgctctgaaatcccctccaggtgtttgctcacgcgacccaacgccggagcaaacccacagactggcacgggctatgatggctttcaccgccgacctgttcagtctggtggctcagacatcaacatgtccaaacctgattctgagccccttgtccgtcgcgctggccttgagccatctcgcccttggggcgcagaaccacaccctgcagagactgcagcaggtgctgcacgcaggttctggtccctgtctcccccatctgctgagtcgcctgtgccaggatctgggtccaggggcgtttaggctcgcggcgcgaatgtatctccagaagggcttccccatcaaggaggattttctggaacagtccgagcagttgttcggcgccaagcccgtgagtctcaccggcaagcaggaagatgaccttgctaatattaaccagtgggtcaaagaagccaccgaggggaagatccaggagtttcttagcgggctgccagaggatactgtgttgctgcttctcaacgccatccactttcaggggttctggcgcaacaaattcgaccctagcctgactcagagggatagcttccatcttgacgaacagttcaccgtaccagtcgagatgatgcaggcaagaacttacccactccggtggtttctgttggaacagccagagattcaagtggcccattttcctttcaagaataatatgtccttcgttgttctggtcccaacccatttcgagtggaatgtgtcccaggtgctggccaacctctcatgggacacgctgcatccacctctcgtgtgggagcggccgaccaaggttcggctcccgaagctttatttgaaacaccagatggatttggtagctacactgtcccaactgggattgcaagagctgttccaggcgcccgaccttcgaggcatttccgaacagagcctggtagttagtggagtgcagcaccagtctacgctcgaactgtcagaagtgggtgtagaggctgccgccgctacttccatagccatgagcagaatgtctctcagcagtttctccgtgaaccgaccctttctgtttttcattttcgaagacaccacagggctccctctgtttgtggggtccgtcaggaatccgaacccctccgctccccgcgaacttaaagagcagcaagacagcccaggcaataaggacttcctgcagtccttgaaaggcttccccagaggagacaagttgtttggaccggatctgaagctggtgcctccaatggaggaagattacccccagtttggtagccctaaa

SEQ ID NO: 19021 - DNA, 1473 bp, Artificial Sequence
  Description of Artificial Sequence: Synthetic coding sequence
atggccctgctgtggggactgcttgttctgagttggagctgtcttcagggaccttgtagtgtcttttcgccagtgtctgcaatggagccactcggccgacagctgactagtggtcccaatcaggagcaggtcagcccattgacactgcttaaattgggcaatcaggagccgggcggccagactgccttgaagtctccccctggagtctgttctcgcgatcccactccagagcagacccatcgtttggctagggccatgatggccttcacagctgatctcttttcattggtcgctcaaacgagcacctgccctaatttgatactttcccctctgtccgttgcgctggctctctcccatttggctctaggagcccagaaccacaccctgcagcgtctccagcaggtattacatgccgggtcgggtccttgtctaccacatcttcttagtagactttgccaggacttggggccgggggcattccgacttgccgccaggatgtatctgcagaagggattccctatcaaagaggattttcttgaacagagcgagcagcttttcggcgccaagcctgtttcgttgactgggaagcaagaagatgatctcgcaaacataaaccagtgggtgaaagaggcaaccgagggaaagattcaggagttcttgagtggtctaccagaggatacggtgctgctgctcttgaatgcgatacacttccagggtttctggcggaataaatttgacccaagtcttacccagagggactctttccacctagatgagcagttcaccgttccagtcgagatgatgcaggcccgaacatacccgcttcggtggttcctgttagagcagcctgagattcaggtggctcacttccctttcaagaacaatatgtcattcgtggttttggtgccaacacacttcgagtggaatgtttcccaagtgctcgccaacctgagctgggatacccttcaccctcccctagtctgggagcgcccgacaaaggtgaggctgccaaagctatacctcaagcaccagatggacctcgtagctacattgtctcaactggggctgcaggagctgttccaggcacccgacctgcgcgggattagcgaacagtcccttgtggtgtctggagtgcagcatcagtccactctggagctctcagaggtcggggtggaagccgctgcagccaccagcatcgccatgagccggatgtcactcagctccttctctgtgaaccgaccattcttgttctttatttttgaggatacaaccggcctgcctctcttcgttggctctgtaagaaacccaaaccccagtgcgccgagggagctaaaggagcagcaggattcccctggtaataaagactttctccagagcctcaagggatttccacgcggggacaaactgttcgggcctgacctgaagctagtcccacctatggaggaggactaccctcagttcggatccccaaaa

SEQ ID NO: 19022 - DNA, 1473 bp, Artificial Sequence
  Description of Artificial Sequence: Synthetic coding sequence
atggccttgctgtggggcctgttggtcctttcttggtcctgcctacaaggaccctgttccgttttctccccggtgtcggccatggagccactgggccgtcagctcacctctggccccaaccaagagcaagtgagcccgctgaccctcctaaaacttggtaaccaggaacctggcggtcaaactgctctgaaatcaccccctggcgtctgttcgcgagatcccaccccagagcaaacacaccgcctcgctcgtgctatgatggctttcactgccgacttgttctcgttagtcgcccagaccagcacctgcccgaacctcatactgtcccctcttagcgttgccttggctctgtcgcacctcgcgctcggcgcgcaaaaccatacccttcagagactacagcaagtgctacacgccggtagcggtccctgcctgccccacctcttgtcccgtttgtgccaggatctgggccccggtgcctttcgcctcgctgcccgtatgtacttgcagaagggatttcctatcaaagaggacttcctggagcagtccgagcaactcttcggcgcgaagcctgtgtccttgaccggtaagcaggaagacgacctcgctaacatcaatcagtgggtcaaggaggccaccgagggcaagattcaggagtttctatcgggtctgccggaggacaccgtcctccttctcctgaatgcgatccacttccagggattctggcggaataagtttgatccgagcctgactcagagagacagcttccatttggacgagcagttcacggtcccagttgagatgatgcaagctaggacgtacccactgcggtggtttctccttgagcaacctgagattcaagttgctcacttcccgttcaagaacaacatgtctttcgttgtcctggtacctacccatttcgagtggaatgtaagccaggtcttggccaacctgtcgtgggacacgctgcacccacctcttgtctgggaaaggccgacaaaagtccgtctgcctaaactttacttgaagcaccagatggatctggttgccaccctatcgcagctgggtttacaggagctctttcaggctcccgatctgaggggtatctcggagcagtcgttggttgtttcaggtgtgcagcaccagtctactctcgagctgtcagaagtgggtgttgaggcagcggccgctacgagcattgccatgagtcgcatgtccctgtcgtccttctcagttaaccgacccttcctattcttcatctttgaggacacaacgggcctgcctctcttcgtgggctccgtccgtaatccgaatccttcagccccgcgtgaactcaaggaacagcaggactcccctgggaacaaagatttcctccaaagtttgaagggctttccccggggagataaactcttcggtcccgatctgaaattggtcccccctatggaggaggactacccccaatttgggtcccctaag

SEQ ID NO: 19023 - DNA, 1473 bp, Artificial Sequence
  Description of Artificial Sequence: Synthetic coding sequence
atggcactgctctggggccttcttgttctgtcctggtcctgcctccagggtccttgctcggtcttctcccccgtaagtgcaatggaaccactcggcaggcaactcacgagcggcccgaatcaagaacaggtatctccactgaccctactcaagctgggtaatcaagagccaggcggacagacagcgttgaagtcccctcccggggtgtgctctcgggatcctacccctgaacagacccatcggctggcgcgcgctatgatggccttcactgctgaccttttttccctggtggcccaaacgtcaacgtgccccaatctcatcctgagtcctctgagtgttgcgctggccctgagccaccttgccctgggagcccagaatcatacgctgcaacgactccagcaagtcctgcacgcggggtctgggccctgcctccctcaccttttgagccgcctatgtcaggatctggggcccggagcttttcgacttgccgcccggatgtacctccagaaaggctttcctatcaaggaggacttcctcgagcaatctgagcagctgtttggggcaaaaccggttagcctgaccggaaaacaagaggatgatcttgcaaacattaaccagtgggtgaaagaggctaccgagggtaagattcaagaattcctatctgggttgccagaggacactgtcctcctgttactcaatgctatacacttccagggcttttggcggaataagttcgatccttccctgacgcaacgcgacagttttcacctcgacgagcaattcaccgttcctgtggagatgatgcaagctaggacctatcccctgaggtggtttttactggaacagccagaaatacaagtggcccacttccctttcaaaaacaatatgtcctttgtagttctcgttccaactcacttcgagtggaacgtttcacaggttctggccaacctgtcatgggacactctccacccacccctggtctgggagcgtccgaccaaagtccggttaccaaagctatacctgaaacatcagatggacctggtggctacccttagccagctgggcttacaagaactgtttcaggcgcctgatcttcggggcatctcagagcagagtctcgttgtcagtggcgtccagcatcagagtaccctagagttgtcagaagttggtgttgaggccgcggccgcaacgtccatagctatgtcccgcatgtctcttagcagcttctcggtcaaccgccccttcctgtttttcatattcgaggacaccaccggcctgccgctgttcgtcggctctgtgagaaacccaaaccccagcgctccacgggagctgaaagaacagcaggattccccgggaaataaagacttccttcagtccctgaagggcttccctcgtggagataaactgttcggacctgacctcaaactggtgccccccatggaagaggattatccacagtttgggtctccgaaa

SEQ ID NO: 19024 - DNA, 1473 bp, Artificial Sequence
  Description of Artificial Sequence: Synthetic coding sequence
atggccctcctgtggggcttgctggtgttgtcatggagctgcttgcagggaccgtgttcagtgttcagcccggtgtcggcgatggaaccactcggtcggcagctgactagcggccctaaccaggagcaagtgtccccgctgacgctgctgaaattgggcaatcaggaaccgggaggacagaccgcgctgaagtctccgccgggagtttgctcacgcgaccccaccccagaacagactcaccgcctggcgcgtgccatgatggcctttaccgccgatctgttctccctggtcgctcaaacttcaacctgccctaacctcatcctcagcccactgagcgtcgccctggcactttcccacctggcgcttggagcacaaaaccatacgctgcagagactgcaacaggtgctccacgctgggtcaggtccgtgtctgcctcacttgctgtcacggctgtgccaagacctgggacccggagccttccggctcgccgcacgcatgtacctgcagaagggatttcctatcaaagaggacttcctcgagcagtccgaacaactgttcggtgccaagccagtgtccctgactgggaaacaggaggatgacctggccaatatcaatcaatgggtgaaggaggccaccgaggggaagatccaagagttcctttcgggcctcccagaggatactgtgctcctccttctcaatgctattcatttccagggattttggcgcaataagttcgatccgtctctcacccaacgggactcgttccatctggacgagcaattcaccgtgccggtggaaatgatgcaagcaaggacctaccctctcagatggttcttgctggaacaaccagaaatccaggtggcgcatttcccgttcaaaaacaacatgtcgttcgtcgtgctggtcccaactcattttgaatggaacgtctcccaagtgctggccaacctgtcctgggacactctccacccgccgttggtgtgggaacgccccacgaaggtgaggcttcctaagctgtacctcaagcaccagatggacctggtcgcaaccctctcgcagcttggactccaggagcttttccaggcgccggacctgcggggcatctcagaacagtcgcttgttgtcagcggagtgcagcaccagtcgaccttggaactgtcggaagtcggcgtcgaggcagcggccgcaactagtatcgctatgtccagaatgagcctgtcgtcgtttagcgtgaaccggccgttcctgttcttcatttttgaggacactaccggcctcccgctcttcgtgggatcggtgcgaaacccaaacccctcagctccccgcgagctgaaagaacaacaggatagcccaggaaataaagacttcctgcagtccctcaaggggtttcctagaggtgataagctgtttggacctgatctgaagctcgttccgccaatggaagaagattacccgcagttcgggtcccccaag

SEQ ID NO: 19025 - DNA, 1473 bp, Artificial Sequence
  Description of Artificial Sequence: Synthetic coding sequence
atggcacttctttggggactgctcgtgcttagctggagctgcctgcagggaccatgttccgtgttctcgcctgtgtcagcaatggaacctctgggcaggcaactcacctcgggcccaaaccaggaacaggtgagtcctctcactctgctgaaacttgggaaccaggagcctggcggacagactgcactgaagtctccccctggcgtgtgcagtcgggatcctactccagaacaaacacatcgccttgcgcgggccatgatggcttttactgcggacctgttttccctggttgcccagacatcaacatgccccaatctgattctcagccccctctccgtggcactggctctgagtcaccttgccctcggagctcaaaatcataccctccagcggctgcaacaggtgctgcacgccgggagcggtccatgtctgcctcaccttctcagtaggttgtgccaagatttgggacctggagcatttcgcctcgccgctagaatgtatttgcagaaaggattcccaatcaaggaggacttcctggaacagagtgaacaactgtttggagcaaagcctgtgagtctgacaggcaagcaggaggacgacttggctaacatcaaccaatgggttaaggaagctacagagggcaaaattcaggaatttctttctggattgccagaagataccgtgctgttgcttctcaatgcaatccatttccagggattttggagaaataaatttgatcccagcttgacacaacgcgatagcttccaccttgacgaacagttcaccgtgcccgttgaaatgatgcaagcccgtacttatcctctccgctggtttctgttggaacagcctgaaatacaggtggcccactttccatttaaaaacaacatgagtttcgtggtgctcgtaccaacacattttgagtggaacgtgagtcaggtactggccaacctttcatgggatactctccaccctcctctcgtttgggaaaggccaactaaggtgaggttgccaaaactgtacctcaaacaccagatggatttagtcgctaccctttcacagctcgggcttcaagaactatttcaggcaccggacttaaggggaattagcgaacagagtctggtagtaagcggtgtccaacaccagtccaccctcgagctctctgaggttggtgttgaagctgctgcggctactagcatcgccatgagccggatgagcctgtcttccttcagtgtcaacagaccatttttgttcttcattttcgaggataccacagggctacctttgtttgtcggatctgttagaaaccccaatccatcagcaccacgggagctgaaggagcagcaggattccccaggcaataaggacttcttgcaaagtctgaagggctttcctcgcggagataaactgtttggtcctgacctgaagctggtgccccctatggaagaggactacccgcagttcggatcccctaag

SEQ ID NO: 19026 - DNA, 1473 bp, Artificial Sequence
  Description of Artificial Sequence: Synthetic coding sequence
atggcactgctctggggcctcttggtccttagttggtcctgtctccagggtccgtgttctgtcttctcacctgtgtctgctatggagcccctcggcaggcagctgacatctggtcctaatcaagaacaagtgagtcccctcaccttgctcaagctcggcaatcaggagccaggtggacagactgcccttaagagcccacctggcgtctgctctagggatccaacgcccgagcagactcatagactggcaagggcaatgatggcgtttactgctgaccttttcagcctggttgctcagacctctacgtgccccaacctcatcctgagccctttgtctgtcgcccttgcactctcccaccttgctctgggtgctcaaaatcatactcttcagcgccttcagcaagtgctgcatgctggctcaggtccctgtctgccccacctgctgtcccgcctgtgtcaggacctgggcccgggagcattcagacttgcagcccgcatgtacctgcaaaagggatttccgatcaaagaagatttccttgagcagtctgaacaactgttcggtgcaaaacccgtgtctctgactggtaagcaagaggacgatctggcaaacatcaaccaatgggtgaaggaagctacggagggtaaaattcaggaattcctttccggactgcctgaagacacggtgttgttgttgcttaatgcgattcatttccaaggattctggagaaacaagtttgaccccagcctcactcaaagggattccttccacctggacgaacagtttacagtgccggtggagatgatgcaggccaggacttatccattgagatggtttttgctcgaacagcctgaaatccaggtggcgcactttccctttaagaacaacatgagcttcgtagtacttgttcccactcattttgaatggaacgtttctcaagtgctggctaacctgagctgggacactttgcatccaccattggtttgggagaggcctacaaaagttcgcttgcccaagctctacctcaaacatcagatggatcttgtggctactctgagccagcttggcctccaggagctgttccaagcccctgacttgcgcggcatctcagaacagtctttggtggtgtcaggcgtgcagcaccagtcaacactcgagctgagtgaggtcggtgtggaggcagctgccgctacttctatcgctatgtctagaatgtctctctcaagtttttcagtcaatcgcccgtttctcttcttcattttcgaagacactacgggacttcccctcttcgtcggttctgtaagaaatcccaacccctcagcacccagggagttgaaggaacagcaggattctccaggaaacaaagacttcctgcagagcctgaaaggctttccgaggggagataagctcttcggtcccgatctgaagcttgtaccgcctatggaagaagattacccacaatttggatctcctaag

SEQ ID NO: 19027 - DNA, 1473 bp, Artificial Sequence
  Description of Artificial Sequence: Synthetic coding sequence
atggccttgctgtggggcttactggttttgtcgtggtcatgcttacagggcccttgttcagttttcagtcccgtcagtgcgatggagcctctgggccgtcagctaacgagtggcccgaatcaggagcaggtgagccccctgaccctgctgaaattgggcaatcaggaaccaggaggacagactgccctgaagtcaccacctggagtctgtagccgggaccctaccccagagcagacccacaggctcgctagagcgatgatggccttcacagccgacctgttttcccttgtggcccagacaagcacctgtccaaacctaatcctgtcccctctctctgtggccctcgcattgtcacatttggcacttggagctcaaaatcataccctgcagagattgcaacaggtgttgcatgctggttcaggcccctgcctcccgcacctgcttagccggctctgtcaggacttgggtcctggtgcattccgcctagcagccagaatgtacctgcagaagggcttccccataaaggaggatttcctggagcagagtgaacagctgtttggcgcaaaaccagtttctttgactggcaagcaggaggatgatctggcgaacattaaccagtgggtcaaagaggcaaccgaaggcaagattcaagagtttctttcgggtttacctgaagacaccgtgctgctattacttaatgctattcattttcagggtttctggagaaataagtttgatcctagtctgacccagcgcgacagttttcacctcgacgagcagtttactgtgccagtggaaatgatgcaggccagaacttatcctctacggtggtttctcctggagcagcccgagattcaagtggcccacttccctttcaaaaacaacatgtcttttgtcgtgctggtgcctacgcactttgagtggaacgtgagccaagtgctcgccaatctgtcctgggacacccttcacccgccactggtctgggaaagacccactaaagtacgcctgcccaagttatacttaaaacatcaaatggaccttgtcgctaccctgtcccaactgggactgcaggaactctttcaggcccccgatctcaggggcatttccgagcagagtctggtggtgtctggggtgcagcaccagtccacactggagctctccgaggtcggggtcgaggctgcagctgcaacttcaatcgcaatgagccgaatgtctctttcctctttctccgtgaatagaccctttctattttttatcttcgaagacacgactggcctgcctctgttcgtcggctctgttcgcaaccctaaccccagcgcgccaagagagttaaaggaacagcaagactcacctgggaacaaagacttccttcaatctctcaagggtttcccaaggggcgataaactcttcggcccggatttgaagctcgtaccgcccatggaggaagattatccccagttcggctcaccaaag

SEQ ID NO: 19028 - DNA, 1473 bp, Artificial Sequence
  Description of Artificial Sequence: Synthetic coding sequence
atggctctcttgtggggcttactggttctttcttggtcctgcttgcaggggccgtgttccgtatttagcccggtaagtgcgatggagccactgggtaggcagcttacctctgggcctaatcaggagcaagtttcccctttaactctgttgaagctcggcaaccaagagcctgggggccagactgctcttaaatcgccgcccggcgtttgttctcgcgatccaactcctgagcagactcatcgactggcaagagccatgatggcttttacagcggatttattttccctcgtcgcgcaaacatcaacctgccctaacctgattctgagcccgcttagtgtcgcgctggctctgtcacatcttgcgctaggtgcacaaaatcatacgcttcaacgtcttcaacaagtacttcatgcaggaagcggaccttgccttccacatcttttgtcacgactctgccaggatcttggtcctggggctttccgacttgccgcgcgaatgtacctccagaaaggatttccgattaaagaagactttctggagcagagcgagcaactcttcggtgcgaaaccggtttcccttacaggaaagcaagaagacgatcttgctaacatcaaccagtgggtcaaggaggctactgaagggaagattcaagagttcttgagcggtctgccggaagatacagtgttattgctgttaaatgcaattcatttccaaggattttggcgcaataaatttgacccttctcttacccaaagagattccttccatttagacgaacagtttaccgtgccagtagaaatgatgcaagcaaggacgtacccgctgcgttggtttttattagagcagccagaaatacaggttgcacattttcctttcaaaaacaatatgagcttcgttgtcctcgttccgactcattttgaatggaatgtctctcaagtgctggccaatcttagctgggatacacttcatccaccgttagtttgggagcgcccaacgaaagtgcgactgccgaaactgtatttaaaacatcaaatggatcttgtcgccacgcttagtcagttgggtctccaggaactttttcaggcgcctgatttacggggcatatctgaacaatctttggtggtttctggagtacaacatcagtccacgttagagctcagcgaagttggagtcgaagctgcagctgcaacgtcaattgcgatgtcacgcatgtctttgtctagtttttctgtgaaccgcccttttcttttttttatttttgaggatacaacaggattgcctctctttgttggatcagtacgcaatccgaacccgtcagcaccgcgggagcttaaggaacagcaagactcgccgggaaataaggattttcttcaatcattgaaagggtttccgcggggcgataaactgtttggcccagatctgaaattagttccaccaatggaggaagattatccacagtttggctcgccgaaa

SEQ ID NO: 19029 - DNA, 1473 bp, Artificial Sequence
  Description of Artificial Sequence: Synthetic coding sequence
atggccctgctgtgggggctcctggtgctgtcttggtcctgcctgcagggaccttgttccgtctttagtcctgtgtcagccatggagccactcggacggcagctgaccagtggtcctaatcaggaacaggtgagtccgctgacccttttgaaactgggcaaccaggagcctggcggtcagacggcgcttaagagccccccaggcgtgtgttctcgagatccaacacccgaacagacacaccgcttggcgcgagcgatgatggcatttacggcagatctgtttagcctggtcgctcagacatcaacctgcccaaacctgatcctgagtccactttccgttgctcttgccttgagtcacctggccctcggagctcaaaatcacacccttcagcgattgcagcaggtcctccatgccggatcagggccctgcctgccacatctgcttagccgcctctgtcaggacctgggtccaggggcttttcgcttggccgctaggatgtatctgcagaagggatttcccattaaggaggacttcctggaacagtccgagcagctgtttggagctaagcccgtgtctctgactggcaagcaggaggacgatcttgccaacatcaaccagtgggtcaaggaggctaccgaaggaaagatccaggagttccttagcggtctccccgaagacacggtactcttgttgctgaatgctatccacttccagggtttctggaggaacaagttcgaccccagcctgacgcagcgggactcttttcacctggatgaacagttcactgtcccggtagagatgatgcaggccagaacatatcccctgagatggttcttgttggaacagcccgaaatacaggtagcacactttccttttaaaaacaacatgagtttcgtggtcctggtgcccacgcattttgagtggaacgtctctcaggtgctcgctaacctgagttgggacacactgcacccgcctctcgtgtgggagagaccgacaaaagtccgactgccaaaactctacctcaagcatcagatggatttggtggcaactctgtcacagttgggactgcaggagctgtttcaggctcctgatctgcgcggaatatccgaacagtccctggtggtgagtggagtgcagcatcagtctaccctggagttgtccgaagtgggagtggaggccgctgcagccacatctatagctatgagtaggatgtccctgtcaagcttctccgttaacagaccatttctgttctttatttttgaggatacaactggactgcctctttttgtgggatctgtaagaaatcccaatccttccgctccaagagagttgaaagaacagcaggactcccctggcaataaggactttctgcagagcttgaagggctttcccagaggggacaagctcttcggtccagacctcaagctcgttcccccaatggaggaggactatccacagtttgggtctccaaag

SEQ ID NO: 19030 - DNA, 1473 bp, Artificial Sequence
  Description of Artificial Sequence: Synthetic coding sequence
atggcactcctgtggggtctgctggtgctcagctggtcctgtctccagggcccctgttccgtattcagcccagttagcgcaatggagccactgggtcggcagctcacctcaggccctaatcaagaacaggtgtctccccttacgctgttgaaacttggcaatcaggagccgggcggtcagaccgcattgaagagccccccgggcgtctgtagcagggacccaacacctgagcagactcaccggctcgccagggccatgatggcctttactgctgatctcttctcactcgtcgctcagacgtccacttgccccaacctgatcctgagccccctttcagtcgcgctggctctgagccatcttgcccttggtgcacagaaccatacacttcagcggctccagcaggtcctccatgctggaagtgggccctgcctgccccatctgcttagcagattgtgccaggatctgggccctggtgcattcaggctcgccgcacgcatgtacctgcagaagggtttccctatcaaggaggatttcttggagcagtcagagcagctcttcggcgcaaagcctgtgagcttgacaggaaagcaggaagatgacctggcgaatatcaaccagtgggtcaaggaagccaccgagggaaagattcaggagtttctctctggattgcccgaagacaccgttctcctcctgcttaacgcaatacatttccaggggttctggcgcaacaagttcgatccttccctcactcaacgcgactctttccatctggacgagcagtttacagtgcctgtggaaatgatgcaggctcgaacataccccctcagatggttcttgcttgaacagcccgaaatccaggtggcccactttccattcaagaacaatatgtcttttgtggtgctggtacctacacacttcgagtggaacgtgtctcaggtgctggcaaatctttcttgggatactttgcacccacccctggtctgggagcgcccaactaaggtgaggcttcccaagctgtacctgaaacaccaaatggacctggttgctaccttgtctcagctggggctgcaggagctctttcaagctccagacctgaggggcatctccgagcagtctctggtcgtaagcggtgtgcagcaccagtcaacactcgagctgtccgaggtcggcgttgaagcagccgccgcaacaagtattgccatgtcccgcatgtctctgtctagcttcagcgtaaaccggccttttctcttctttatttttgaggacactaccggtctgcccctttttgtgggctctgtgagaaacccaaatccctctgcccctcgcgaactgaaagagcaacaggactcccctggcaataaggacttcctgcaaagcctcaagggttttcctagaggcgacaaacttttcggcccagatttgaagcttgtgccgcccatggaggaggattacccgcagttcggcagccctaag

SEQ ID NO: 19031 - DNA, 1473 bp, Artificial Sequence
  Description of Artificial Sequence: Synthetic coding sequence
atggccctgttatggggcctgctggtcttgtcttggtcttgcctgcagggtccgtgctccgttttctcccctgtatctgccatggagccactgggacgccagcttaccagcgggccaaatcaggaacaggtcagccccctgaccctgttgaagctgggcaaccaggaaccgggcggtcagacggccttgaagagtcctccgggggtgtgctctagggatcccaccccagagcaaacccatagactcgcgagagcgatgatggcctttaccgcagatctttttagcttggtcgcccagacgtcaacatgccccaacttaatcctgagtcctttgtccgtcgccctcgccctgtcacatctcgccctgggggcgcaaaaccacacactgcaaaggctgcagcaagtgctgcatgcgggctccggaccttgtctgccccatttgctatcaaggttgtgccaggatctggggccaggcgcttttcggctcgcggcaaggatgtatctgcagaagggctttcctatcaaggaagactttctggagcagagcgagcaactgttcggcgcgaagccagtgagcttaaccggcaagcaggaagatgatctggctaatatcaatcagtgggtgaaggaggctacagaggggaaaatccaggagtttctgtctggcctgcccgaagacacggtgcttcttttactcaatgccatccatttccagggcttttggcgtaataagtttgaccccagcctgacccagcgcgacagttttcacctagatgagcagtttacagtgcccgttgagatgatgcaagcccggacgtatccattgcgctggtttttgctcgagcaaccagagattcaggtcgcacattttccattcaagaacaacatgtcctttgtggtactcgtgcctacccatttcgagtggaatgtgtcccaggtgctcgccaatctgtcctgggacaccctccatccgccgctcgtgtgggagaggcccactaaggtccgccttccaaagttgtacctgaagcaccaaatggacctggtggccacactcagtcagctgggcctgcaggagctatttcaggccccagatctgcgtgggatctctgaacaaagtttggttgtgtctggagtgcagcatcagtcgacccttgagctgtcagaggtgggtgtggaagcggcagcggccaccagcatcgcaatgtcccggatgtctttgtccagcttctcagtgaaccggcccttccttttcttcatctttgaagataccacagggctgcctttatttgtaggcagtgtcaggaatcctaacccctccgctccaagggagctgaaagaacaacaggatagtcccgggaataaagattttttgcaaagcctcaagggcttcccgcggggagacaagctcttcggaccagaccttaaactggtgccacctatggaggaggactacccccaatttggctcaccaaag

SEQ ID NO: 19032 - DNA, 1473 bp, Artificial Sequence
  Description of Artificial Sequence: Synthetic coding sequence
atggcgctcctctggggcctgttggtgctgtcctggtcatgtctccagggcccttgcagcgtcttctcaccagtcagcgctatggagcctctggggagacaattaacctctggacccaaccaggaacaggtaagtcccctcacactgctcaaactcgggaatcaagaaccagggggccagaccgctttaaagtcaccccctggagtttgcagccgagatcccacccccgaacagacccaccgcttagcccgcgcgatgatggcttttactgccgacctatttagcttagtggctcagacgtcaacttgtcccaatctcattctcagtccacttagtgtcgctctagcactatcgcatctcgctctgggagcgcagaaccataccttgcagaggttgcaacaggtattacacgctgggtcagggccctgtctgcctcatttgttgtccaggttgtgccaggatttgggtcccggcgccttcagacttgctgcacgcatgtacttgcaaaaagggttcccaattaaagaggactttcttgagcagagcgagcagctgtttggagcaaagccagtttctctgacagggaagcaggaggacgacctggcaaacataaatcagtgggtcaaagaggccaccgaggggaaaatccaggaatttctatcagggctccctgaagatacagtgctgctgctccttaatgcaattcattttcagggtttctggcggaataagtttgaccccagccttacacaaagggattcctttcatctcgatgagcagttcaccgtcccagtcgagatgatgcaggccaggacctatccccttcgttggttccttctggaacaaccggagatccaagtagcgcactttccgttcaaaaataatatgtcctttgttgttctagtccctacacacttcgagtggaatgtgtcccaagttctagctaacctctcttgggatacacttcatccccctttggtgtgggaacgtcccacaaaggtcaggctccccaagctatatctcaaacatcaaatggacctcgtggccaccctttcgcagttgggacttcaggaattgttccaagcaccagatctccggggcatctccgagcaatccctggtggtctctggagttcagcaccagagtacccttgagcttagtgaggtgggcgtggaagcggcggctgccactagcatcgccatgagtaggatgagcctgagcagtttctcagtgaatcgcccttttctgttcttcatatttgaggatacaacaggccttcccttgtttgtgggctctgtgcgcaatccgaaccctagtgctcctagggagctcaaggagcagcaagactcacctggtaacaaagatttcctgcagtccctcaagggctttcctcgtggcgataagctgttcggccctgatcttaaacttgttcctccaatggaggaggactacccccagtttggctccccaaag

SEQ ID NO: 19033 - DNA, 1473 bp, Artificial Sequence
  Description of Artificial Sequence: Synthetic coding sequence
atggccctgctatgggggctgttagtcctgtcgtggtcttgcctacaggggccttgttcagtatttagccctgtatccgcaatggagcctcttgggaggcagctcacatctggacccaatcaggagcaggtaagccccctcaccctgcttaagctaggcaaccaggagcccggcgggcagaccgcactgaagagtccacccggcgtctgtagccgggaccctacccctgagcaaacacatcggctggctcgggccatgatggcgtttaccgccgacctgtttagccttgtggctcagacctccacttgtccaaacctgattctatccccgttaagcgtggccttggcccttagtcatctggccctcggcgcccagaaccatacactgcagcgcctgcaacaggtactgcatgccggttctgggccctgtcttccgcacctgctttctagactatgccaggacttaggacctggagcttttcgcttggcagccaggatgtatctgcagaaagggttccccataaaagaggactttctggaacagtccgaacaattgtttggagctaaacctgtttctttgacagggaaacaagaggacgatctcgcgaacatcaaccagtgggttaaggaggcaacggagggtaagatccaggagttcctctctgggttgcccgaggacactgtattgctgctgttgaacgcgatccatttccagggtttctggcgcaacaaattcgatccaagccttactcaaagagattctttccatctagatgaacaattcaccgtgcccgtggagatgatgcaggcaaggacttacccccttagatggtttttgctcgagcagcctgaaattcaggttgcccactttccattcaaaaataacatgtcttttgttgttctggtacccacacacttcgagtggaacgtgagccaagtactcgcaaacttgtcttgggataccctgcatcctccattagtgtgggagagacctaccaaggtgagattaccaaaactatacttgaagcaccagatggacctagtggctacgctttcccagctgggcctgcaagagttgttccaggccccggatttgcggggtatttccgaacagtccctggtagtgtcgggcgtacagcatcagagtacattggaattgagcgaagtaggcgtggaagctgctgcagccacaagtatcgccatgtccagaatgagcttgagctccttcagcgttaaccggcccttcctgttcttcatctttgaggatacaaccggactgccactgttcgtcggatcagtgcggaaccctaacccttctgctcctcgggagctgaaggagcagcaggacagccctggaaacaaggactttctacaatcgctgaagggatttcctagaggcgataaactgttcgggcctgatctgaagctcgtaccacctatggaagaagactacccacagtttggaagtccaaaa

SEQ ID NO: 19034 - DNA, 1473 bp, Artificial Sequence
  Description of Artificial Sequence: Synthetic coding sequence
atggcgctcttgtgggggctgcttgtcctgtcttggagctgtttgcaaggtccatgtagcgttttcagccctgtgagcgcaatggagccactgggtcgccaacttacttcgggtccaaaccaagaacaagtttcccctctgactttgttgaaacttggtaaccaggagccaggcggtcaaaccgctctgaaatcgccaccgggagtctgctctcgcgacccaacccctgagcagactcaccgcctggcacgcgccatgatggcatttaccgcagatctgttctcattggtggcgcaaaccagcacctgtcccaacctgatactgagcccccttagtgtggctctggcgctgtcccatctggccctgggtgcccagaaccacactctgcagcgccttcagcaagtcctgcacgcgggtagcggtccttgtttgcctcacttgctgagtcggctatgtcaagatctggggccgggtgcgttccgcctggcggcgcgcatgtacctgcagaaaggctttcccattaaagaagacttcctcgagcagtccgagcaactgtttggggctaagccagtgtccctgaccgggaagcaggaagacgaccttgctaatatcaatcagtgggtgaaggaagcaaccgagggtaagattcaagaattcctgtcgggtctgccggaggacaccgttctgttgttactgaatgcaatccactttcaaggattctggcgcaacaagtttgatcctagtttgactcagcgtgacagcttccatctggacgagcaattcaccgtgccggtggagatgatgcaggctcgtacgtatccactgcggtggtttcttttggagcagcctgaaatccaggtcgcacacttcccgttcaaaaataacatgtcttttgtcgttctggtcccgacacactttgaatggaatgtgtcccaggtcctggcaaatctgtcttgggatacgctgcatccgccgctggtctgggagcgcccaacgaaggtcagattgcctaagctctacttgaagcaccagatggatctagtggcaaccctgtcgcagcttggcttgcaagaattattccaagctccagatttgcgcggtatttctgagcagagcttggttgtgtccggcgttcagcatcagagcaccttggaactgtcagaagtaggcgtcgaagccgcagccgccacttccatcgcaatgagccgcatgtcgctgagcagcttttctgttaataggccctttctgttttttatatttgaggacactaccggtctgccgttgtttgttggaagcgtccgtaaccctaacccctccgcacctcgtgaactaaaggaacagcaggattcccctggaaataaggacttcctccaaagcctgaagggctttccacggggtgataaactatttggtccagatctgaaactggtgccaccaatggaggaagactatcctcaatttggttcgccgaaa

SEQ ID NO: 19035 - DNA, 1473 bp, Artificial Sequence
  Description of Artificial Sequence: Synthetic coding sequence
atggccttgctgtggggcctgttggtcctgtcttggtcctgccttcaaggaccttgttctgttttctcccctgtgtcagcaatggagcctttggggaggcagctcacgtcggggcctaatcaagaacaggtgtcccccttgacactgctgaagctcggtaatcaggagcccggtggacaaacggctttgaagtcaccaccaggagtatgcagccgagatcccaccccggaacagacgcatcgccttgcccgagctatgatggcttttaccgccgatttgttctcccttgttgcacaaacttccacctgtcccaatctgatactatcgcccttgtccgtcgccctggcactctcccatctcgccctcggggcccaaaaccacactctccaacggcttcaacaggtactgcatgctgggtccggcccttgcttgccgcacctgctctcccggctctgtcaggatctcggtcccggcgcgttcagactcgcagcccgaatgtaccttcagaaaggcttcccgatcaaggaggatttccttgagcaaagcgaacaactgtttggcgccaagcctgtttccctcaccggtaagcaggaagatgacttagccaacatcaatcagtgggtcaaagaagcaactgaaggaaagattcaggaattcctctccgggttgcctgaggataccgttcttctgctccttaacgcgatccattttcaaggcttctggcgcaacaaattcgatccgtcactaactcagcgagatagcttccacttagatgagcaattcaccgtgcctgttgaaatgatgcaagctcgcacgtaccccttacgctggtttcttctggagcagcccgagatccaggtcgcccactttcccttcaaaaacaacatgtccttcgtggttttagtcccgacccattttgaatggaacgtatcgcaagtcttggcaaatctaagttgggatacactgcatcccccacttgtctgggaaaggcccacgaaggtccggctgccaaagctctaccttaagcatcagatggacttggtagcaaccttgagccaactgggtctccaagagcttttccaagcgcccgacttgcgcggtatcagcgaacaaagtttggtggttagtggagtccaacaccagtccacccttgagctgagtgaagtgggcgtcgaagcggccgccgcaacatcgattgcaatgagccgcatgtcgctgagcagcttttctgttaatcgcccgtttctattcttcatctttgaggacaccaccggtctaccactctttgttggaagtgtgcgaaatcccaacccttctgcgcctcgcgaacttaaggagcaacaagattccccgggcaacaaggacttcctgcagtccctgaagggcttcccccgtggcgacaagctatttggccccgacctgaaacttgttccacctatggaagaggactatccccaatttggaagtcctaag

SEQ ID NO: 19036 - DNA, 1473 bp, Artificial Sequence
  Description of Artificial Sequence: Synthetic coding sequence
atggccctcctctggggcttacttgtgctctcctggtcatgcctccagggaccttgctccgtgtttagtccggtgagcgctatggagccactcggcagacaacttacttctggccccaatcaggaacaggtgtctcccctgactttactgaagcttgggaaccaagaaccgggcgggcaaacagccctgaagagcccccccggagtgtgttccagagatcctacaccagagcagacgcaccggctagctcgcgccatgatggcatttaccgcagacctctttagtctggtcgcgcaaacatccacatgtcctaatctaatcctgtctcccctttccgtcgcacttgctttaagccacctcgccctgggtgcccagaatcacacactccagcgcctacaacaggtcttacacgccgggtctggaccttgcttaccccatttactgtctaggttatgtcaagatcttggacctggggcctttaggctggcggctaggatgtaccttcagaaaggcttccccattaaggaggactttctggagcagagtgaacaactgtttggcgcaaaacctgtgtccctgaccgggaagcaggaggacgatctggctaacattaaccagtgggtgaaagaggcaacagaaggaaagattcaagagttcctgagcggcttgcccgaggataccgttctgctgcttcttaatgctattcattttcaaggattctggcggaataagttcgacccttcattgacccagcgagatagtttccatttagacgaacagtttactgtcccagtagagatgatgcaggctagaacctacccactgcggtggtttctgctcgagcagccagaaatccaggtagcccacttccccttcaagaacaatatgagtttcgttgtgctggtgccgacacatttcgagtggaacgtgtcccaggtgcttgctaacttgtcctgggacaccctgcatccaccactggtgtgggagaggcctactaaggtccggctacctaaactctatttgaaacaccagatggacctggtggctaccctaagccaactggggctccaggagttgtttcaggcgccagacctaaggggaatatccgagcagagcctagtcgtgagcggggtgcagcaccaatccactttggagctttccgaagtaggagtggaggcagcagccgccacttctattgctatgtctaggatgtctttgtctagtttcagcgtgaatagaccattcctgttttttatattcgaagacacaaccgggttacccctgttcgtaggatcagtgcgcaacccgaatccgagcgcaccaagggaacttaaagagcaacaggacagtccaggtaataaggactttcttcaaagtctgaagggcttccctcgtggcgataaactgttcggcccagacttaaagctggttccacctatggaggaggattatccccagtttggaagtccgaaa

SEQ ID NO: 19037 - DNA, 1473 bp, Artificial Sequence
  Description of Artificial Sequence: Synthetic coding sequence
atggcgctgttgtgggggcttcttgtcctttcttggtcctgtctacaaggaccctgctcagtattcagcccagtgagtgccatggagccccttgggaggcaactgactagtgggcccaaccaagagcaggtgtcccccttaacactcctgaaactaggcaatcaggagcccggcggacagaccgcgctgaaaagcccgccaggcgtgtgctctagggatcccactcccgagcagacgcacagactagctcgcgcaatgatggctttcacggcagacctgttctcactcgttgcacagactagcacttgtccaaacctaatcctgagcccgttgtctgtcgcactagccctctctcatcttgccctgggagcgcaaaaccatacactccaacggttgcaacaggttctgcacgccgggtccgggccatgcctgccacacttgctcagtcgcctgtgccaagacctcgggccgggtgcctttagactggctgcccggatgtacctccaaaagggattccctatcaaagaggactttctggagcagtcagagcagctgtttggtgccaagcccgtgtcattaactggtaaacaggaggacgacctcgccaatatcaatcagtgggtgaaggaggccaccgaaggtaaaatccaggaattcctgtccgggctgccagaagatactgtgctgctactattgaatgccattcatttccagggcttctggaggaataaatttgacccctcactgactcagcgggactcctttcaccttgatgagcagttcactgtcccagttgagatgatgcaggcaagaacatacccgctgaggtggttcctgttggaacagcccgagattcaggtcgctcactttccattcaagaataacatgagctttgttgtcctggtacccacccacttcgagtggaatgtgagccaggtcttagccaacctatcatgggacacactgcaccctcccctggtatgggaacgacctacgaaggtcagactcccaaagctctatctgaagcaccagatggacttggttgctacactgtctcagctcgggctgcaggaactcttccaggctcctgatctgcgtggcatcagtgaacagtctctcgtcgtgtcaggcgttcagcaccaatcaactttagagctatcagaggtgggagtggaggcagccgctgctacctcgatagccatgtcaagaatgtctctgtcctctttttcagtaaaccggcccttcttattctttatcttcgaagacacaaccggactgcccctctttgtgggatctgtgagaaatccaaacccaagcgctccccgagagttgaaggagcagcaggacagccctggcaataaggattttttacaaagcctcaaggggtttcccagaggagacaaacttttcgggcctgacttgaaactggtgcctccgatggaggaagattacccccaattcggaagtcctaaa

SEQ ID NO: 19038 - DNA, 1473 bp, Artificial Sequence
  Description of Artificial Sequence: Synthetic coding sequence
atggcactgctgtgggggctattggtgctttcctggtcgtgtctacagggcccttgttccgtgtttagccccgtgtctgccatggagcctctcggacggcagctcacttccggcccgaatcaggaacaggtgtcaccattgacactgctcaaactaggcaaccaggagcctggcggccagacagctctgaagagtcctccgggcgtgtgctcgagggatcctacacccgagcagactcataggctggcaagggccatgatggccttcacggctgacctattctcccttgtcgcccagacctccacctgccctaacttaattctatcgcccctaagtgtagctctcgctctgtctcacctcgctctgggcgcccagaaccacacccttcaaagactgcagcaagttttgcatgccggttccggcccttgcctcccccatctgttgagtaggctctgccaagacctggggccgggcgctttccggctagctgcgagaatgtatctgcagaaggggttcccgataaaagaagattttctcgagcaatcagagcagctctttggagcaaagcctgtgtcactgacaggcaagcaggaggacgacctcgctaacatcaaccagtgggtcaaggaagccactgaaggcaaaattcaggagttcctaagtggactacccgaagacactgtgcttttacttctgaacgctattcatttccagggcttctggagaaacaaattcgacccttcacttacacagcgcgactcgttccatctcgatgaacagtttacagtccctgtcgaaatgatgcaggcgcggacataccctcttaggtggttcttgctggaacagcctgagatccaggtggcccatttcccatttaaaaataatatgagttttgtcgtcctcgtgcccacacattttgagtggaatgtctcgcaggtgcttgcaaacctgtcttgggatacactccatccgcccctcgtgtgggaaaggcctactaaggtccggttgcccaaactttatctgaagcaccagatggacctcgtagctactctgagccaactggggctgcaagagctgtttcaggccccggacctccgcggaattagcgagcaaagcctggtggtcagcggagttcagcaccaatctacactagagttgtctgaggtcggtgttgaggctgcggcggccacttcgattgcaatgagcagaatgagcttgtctagcttctccgttaatcggccctttctcttcttcatcttcgaggatacaaccggcctacccctcttcgtgggatctgtgcggaaccccaatccctctgccccgcgggaactgaaggagcaacaggattcacccggaaataaggattttttgcagagtctcaaggggtttccacggggcgacaagttgttcgggcctgacctgaaactggttcctcccatggaggaggattacccacagttcggaagcccaaag

SEQ ID NO: 19039 - DNA, 1473 bp, Artificial Sequence
  Description of Artificial Sequence: Synthetic coding sequence
atggcattactctggggcttgcttgtgctatcttggtcatgtttgcaaggaccttgcagtgtattctctcccgtcagtgccatggagcccctcgggaggcaacttacctccggacccaatcaggagcaagtttcacctctcacactcttgaagctcggcaaccaggaacccggaggacaaactgctctcaaaagtccacctggcgtatgctcccgtgatcccaccccagaacaaacacatcgtctggcaagagctatgatggcattcaccgcagaccttttttcactggttgctcaaacttccacatgccccaatttgattttaagtccactgtcagttgccctcgcactaagccacctggctctaggcgctcagaatcacaccctgcagagattgcagcaagtgctgcacgcgggtagcgggccttgtctgccacatttattatccagactgtgtcaggacctggggccgggagcctttaggttggccgcccgaatgtaccttcagaagggatttcctattaaggaggactttctagaacagtccgagcagttgttcggagccaagcccgtctctctgactggtaaacaggaggatgacctagcaaatatcaatcagtgggtcaaagaagctaccgagggaaagatacaggagttcctgagcggacttcccgaagatacagttctgttattgctgaacgcaattcactttcaggggttttggaggaacaaattcgatccctcactgactcagcgggattccttccatctggacgagcagttcactgtgcctgttgaaatgatgcaggctcgcacgtaccctctgcggtggtttcttctggagcaaccggagatccaagttgcccattttccttttaaaaacaacatgtcttttgtggtactcgtgcccacacattttgagtggaacgtttcgcaagttttggctaacctgtcctgggatacgctgcaccctcccctggtgtgggagagacccacaaaagtccggttgccgaaactgtacctgaagcatcaaatggacctagtagcgactctctctcaacttggactacaggagctcttccaggccccagatctgcgggggatatctgaacagtctctagtggtaagtggcgtgcagcatcagtctaccctcgagctctctgaagtcggagtcgaggcagctgctgctacgagtatcgctatgtcgcggatgtctttatcgtcattctcggttaatcggccttttctcttctttattttcgaggataccacaggtttgccccttttcgtgggaagcgttcggaacccaaaccctagtgcccccagagagctgaaggagcagcaagactcacccgggaataaagactttttgcagagtctaaaaggcttccccagaggcgacaagctgttcggccctgatttgaagcttgtgcctccgatggaagaagactacccacagtttggcagccctaaa

SEQ ID NO: 19040 - DNA, 1473 bp, Artificial Sequence
  Description of Artificial Sequence: Synthetic coding sequence
atggccctgctttgggggctccttgtgttgagctggagctgcctgcagggtccttgttccgtgttttcgcctgtcagcgctatggaaccgctgggcagacagttaacatcaggacccaatcaggaacaggtgagccctttgacactccttaaactggggaaccaggagcctggaggtcagaccgcactgaagtcaccgccaggcgtttgctccagagatccaaccccagagcagactcaccgcctggcccgggccatgatggcattcacagcagacctgttctccctggtagcacagacatctacttgtccaaatctaatcctgtcgccactgagcgtcgctttggcactctctcatctcgcccttggagcccagaaccataccctgcagcgcctccagcaggtgctgcacgctggctcgggcccttgccttccccacctgctcagccggctctgtcaagatcttggacccggggccttccgtcttgcggcccggatgtacctgcaaaagggtttccccatcaaagaggattttctggagcagtctgaacagttgttcggggccaaacctgtcagtctgacaggtaaacaggaagatgatctggccaacattaaccagtgggtaaaggaggccacggaagggaagatccaagagtttctgagtggccttcccgaggatacagtactgctgctgctgaatgctatccacttccagggcttctggcgaaacaaatttgatccctcattgacccagagagactctttccatctagatgaacagtttactgttcctgtcgaaatgatgcaggcccggacgtacccattgcggtggttcctgctcgaacagccagagatccaggtggcgcatttcccttttaagaacaatatgagcttcgtagttttggttcccacacactttgagtggaacgtaagtcaggttctggccaatcttagttgggacaccctgcacccacctctggtatgggagaggccaacgaaggtgaggctgcctaaactgtacctgaaacaccagatggacctggtggctaccctgtcccaattaggcctgcaggagttatttcaggctcccgaccttaggggcatctccgagcagtctctagtcgtgagtggggtgcaacaccaaagtactctcgagcttagcgaagtaggcgtggaagctgccgcggccacttctattgcaatgtcgcggatgtctctgtcttcgttctcagtaaaccgccccttcctcttcttcatcttcgaagatacgactggactcccactcttcgtgggcagcgtgcggaatccgaatccatctgctccaagggaactaaaggagcagcaggactccccagggaataaggattttctccagtcactgaaagggttcccccgaggcgacaagctgttcggaccggatcttaagttagtcccccctatggaggaggattacccacagttcggctctccaaag

SEQ ID NO: 19041 - DNA, 1473 bp, Artificial Sequence
  Description of Artificial Sequence: Synthetic coding sequence
atggcactgctttgggggctgcttgtgttatcctggagctgcttgcaggggccatgctccgtgttttcgccagttagcgctatggagccgctgggtaggcaactgactagcggaccaaaccaggagcaagtgtctcctctgacgctgctgaagctgggcaaccaagaacccggcggccagaccgctttaaagagcccgcccggcgtttgctccagagatcctacccccgagcagacccaccgactggcacgggccatgatggcatttacggctgacctgttttccctggtcgcacagacgtcaacatgtccgaatctgatcctcagccctctgtctgtggcactggctttgtcgcacctggccctgggggcacagaaccacaccctccagagacttcagcaggtcttacacgcagggagtggtccgtgcctgccacatttgctctcccggctctgccaggacctgggtcctggcgccttccgtctggcagcacgaatgtatttgcagaaggggtttcctattaaggaagattttctggagcagtcggagcagctgttcggagcaaaacctgtaagccttaccgggaaacaggaggatgacctagctaatattaatcagtgggtcaaggaggccacagaaggcaagattcaagagttcttatccggactccctgaggacactgtcctcctccttttgaacgctatccactttcagggcttctggagaaacaagttcgatccttctctcactcagagagattcctttcacttggatgaacagttcacagttccagtggagatgatgcaggccagaacttatccattgagatggttcctactggaacagccagaaatccaggtggcccacttcccatttaagaataacatgtcctttgttgtcctggtccctacccattttgagtggaatgtcagtcaggtgctagctaacctatcttgggacacccttcaccctccgcttgtttgggagaggccaaccaaggtgaggcttccaaagctgtaccttaaacaccaaatggatttggtggcgactctgagccaacttggcctgcaagaactgtttcaagcaccagatcttcggggcatcagcgaacaaagcctggtggtgagcggcgtccaacaccagtcaacacttgaactctcagaagtgggtgttgaagcagccgctgctacgtcgatcgctatgagccgaatgagtctctcctcattcagcgtcaacaggcccttccttttttttatatttgaagacactactggcctccctctgttcgtgggaagcgtcagaaaccctaatccatccgccccacgagagttaaaggagcagcaggatagcccaggaaataaggattttctgcagtcattaaaaggatttcctaggggggataagctgttcggcccagaccttaagcttgtgccccctatggaagaggattaccctcagttcgggagtcctaaa

SEQ ID NO: 19042 - DNA, 1473 bp, Artificial Sequence
  Description of Artificial Sequence: Synthetic coding sequence
atggcacttctatggggacttctagtcctttcttggtcctgccttcaaggaccatgtagtgttttttctcctgtgtctgcgatggaacctctcggacggcagctcacatccgggccaaaccaggaacaggtcagtccactcactttactcaaactcgggaaccaagaacctgggggacagacagcactcaaaagtcctccaggagtttgttccagagatcccactcccgagcagacacatagactagctcgggccatgatggcctttacagccgatctgttttcgctggtcgctcagactagtacttgtccaaatctgatcctcagtccactttccgtagccctcgctctgtcccatctcgccctgggagcccagaaccacacattgcagcgcctccaacaagtgctccatgctggaagtgggccctgtttgccacatttgctatcacggctctgtcaggatctgggacccggggcgttcaggctggctgctagaatgtacctgcagaaagggttccccatcaaagaagatttcctcgaacaaagtgaacagttattcggagccaaacctgtttctctcacaggaaaacaggaggatgatctcgctaatataaaccagtgggtgaaagaagctactgagggaaaaatccaggaatttctctccggactccctgaagatacagttctccttttgttaaacgccatacattttcagggattttggcggaataaatttgacccttcattgactcagcgcgactccttccatctggacgaacagtttacagtgcctgtcgaaatgatgcaagcccgcacttatccactacggtggttccttctcgaacagcctgagatccaggtggctcattttccctttaaaaataatatgtccttcgtcgttctcgtgcccacacactttgaatggaacgtttcccaggtgttagccaatctcagttgggatactctgcatccccccctcgtgtgggaaagacctactaaggtaaggctcccaaaactgtatcttaaacatcaaatggatctagttgctacactctcacagcttggactccaggaactgttccaggctccagatcttagaggaatttctgaacagtctctcgtggtgagtggagtgcagcaccaatctacactagaactttctgaggtcggggtagaagccgctgcagctacatctattgctatgagtcggatgtctctttctagtttctctgttaatcggccttttctcttctttatctttgaagatactactggactgccactcttcgtggggtcagttcggaaccctaacccatctgcaccaagagaacttaaggagcagcaagattcacccggaaataaggatttcctacaaagtctaaagggattcccccgaggggataaactctttgggcctgatcttaaactcgtgccacccatggaagaagattatcctcagtttgggagtccaaag

SEQ ID NO: 19043 - DNA, 1473 bp, Artificial Sequence
  Description of Artificial Sequence: Synthetic coding sequence
atggccctgctgtgggggctgcttgttctgtcatggtcctgcttgcagggtccgtgtagtgtattctctcccgtatccgcaatggagccacttggccgccagctgacaagcgggccaaatcaggagcaggtctccccacttactctcctgaaactcggcaatcaggagcccggcggtcaaacagccttgaagtctccacccggagtgtgctctcgcgatcccactccagagcagacacatagactggctagagcaatgatggccttcaccgccgatctgttctccctggtggcacaaacctcgacgtgtcctaacctgattttgtctcctctgagcgtggcactggcgctgtcacacctggctctgggagcacaaaaccacactttgcagaggctgcagcaagtgttgcacgctggatccggtccatgtctgccgcatcttctgtccagattatgtcaggacctcggccccggtgccttccgattggccgctagaatgtacctgcaaaagggattccctatcaaggaagattttctggaacaatccgagcagcttttcggtgccaaaccagttagccttacagggaagcaggaggatgaccttgctaatattaaccaatgggtgaaagaggcaaccgagggaaagattcaggaatttttgtccggcctcccagaagacacagttttgttactgctgaacgcaattcactttcaaggtttttggagaaacaaattcgatcccagtttgacccagcgcgatagttttcacctggacgagcagttcacagtgcccgtggaaatgatgcaggcgcgcacttatcccctaagatggtttctgctagaacagccagagattcaggtcgcccattttccctttaagaacaacatgagcttcgtggtgttggtcccaacccacttcgagtggaacgtgagtcaggtgctggcgaatctttcatgggacaccctccaccctcccctcgtctgggaacgacccactaaagttaggctaccaaaactgtatcttaagcatcagatggacctggtcgctaccctcagccaacttgggctgcaggagctgtttcaggcccctgatctaagaggtatctcagagcagtctctcgtggtgagtggagtgcagcaccagtccactctggaattatctgaagtgggagtggaagctgccgccgccacatccatagctatgtctaggatgtctctttcaagcttctccgtgaaccgccccttcctgttctttatttttgaggatactaccggccttcccctgttcgtcggctccgttcgcaatcctaaccccagcgctcctcgggagttgaaggagcagcaggactcacccgggaacaaggactttttgcaatcattaaagggctttccacggggtgacaagctgtttggaccagacctgaaactggtccccccaatggaagaagattacccccagttcggttcgcccaag

SEQ ID NO: 19044 - DNA, 1473 bp, Artificial Sequence
  Description of Artificial Sequence: Synthetic coding sequence
atggccctgctttggggccttctggtcctctcttggtcttgtctccagggcccttgctcagtattcagtccggtttcagcaatggaacccttgggacggcagctaacttcaggtccaaaccaggaacaggtgagcccactgaccttgctcaagcttggcaaccaggaacccggtggacagaccgctctgaaatcacctccaggagtgtgtagcagagacccaacaccagaacagacacaccggctcgctcgcgcaatgatggcctttacagctgacctgttctctcttgtcgcgcagacgtccacttgtcccaatctgattttaagccctctgagcgttgccctcgccctaagccacctggctttgggggcccaaaatcacacgcttcagaggctccagcaggtgttgcacgctggctcaggcccatgtttgccccatctcctgagccgactatgccaggacctaggcccaggggcgttccggctagctgctagaatgtatctgcagaaaggatttcctatcaaggaggacttcctggagcagtccgagcagctgttcggtgcgaagccagtgtcactaaccggcaaacaggaggatgacctcgctaatattaaccaatgggtgaaggaggctacagaaggcaaaatccaggagtttctgagtgggctgcccgaggacaccgtcctgttgttgctaaatgcaatacatttccaggggttttggcggaacaagtttgacccctcattgacgcagcgagattcattccaccttgacgaacagttcactgtgcccgttgagatgatgcaagctaggacttaccccttacgttggttccttctggaacagccagagatacaggtcgcccacttccccttcaagaacaacatgtcctttgtcgttctggtgcccacccatttcgagtggaacgtcagccaagtcctggccaacctctcctgggacaccctgcatcctcccctggtgtgggaaagaccaactaaggttaggctgccaaaactctacctgaagcaccagatggatttggtggcgaccttatctcaattggggctccaggagctcttccaggcgcccgatctacgcgggatcagcgaacagtccttggtggtgagtggcgtccagcaccaatcaacactcgaactttccgaagtgggcgtcgaggcagcagccgccacttcaatcgccatgagtaggatgagtttatcttcattcagtgtgaacaggcccttcctgttcttcattttcgaggatacgactggactgccactgttcgtgggctccgtccgcaatcccaatccttcggctcctagggagcttaaagagcaacaggactctcctggaaataaagactttcttcagagcctgaaggggttcccgagaggtgataagctcttcggtcccgacctgaagctagtgcctcccatggaggaagactatccacaattcggatcaccaaaa

SEQ ID NO: 19045 - DNA, 1473 bp, Artificial Sequence
  Description of Artificial Sequence: Synthetic coding sequence
atggcattactgtggggtttgctcgtattgagctggtcatgcctccagggaccgtgctctgtgttcagcccagtgtccgcaatggagccgctgggccgccagctgacgagcggcccaaaccaggagcaggtctcgccccttaccctcctgaaactgggaaatcaggagcccggcggtcaaactgcactgaagtccccacccggcgtgtgttcccgagaccccaccccggagcagacccacaggttggcccgcgccatgatggcgtttactgcagacctgttttcgcttgtcgcgcaaacttccacctgccccaacctcattttgtcgcccttgtccgtggcactcgccctgtcgcacctggcgctgggtgcgcaaaaccacaccctgcagcgccttcagcaggtgttgcacgccggcagtggcccatgcttgccgcacctactgtcccgattgtgccaggacctgggccccggagcctttcggctggctgccagaatgtatctgcagaagggtttcccgattaaggaggatttcctcgagcagtccgaacaactgttcggtgccaagccggtaagcctgaccggaaaacaggaggatgatttggccaacatcaaccagtgggtgaaagaggccacggagggaaagattcaggaatttcttagcggcctgcccgaagacacagtgttgctgttgctgaacgccatccactttcagggcttctggagaaacaagtttgatccatcgcttacgcaacgggatagctttcacttagacgaacaattcacggtgcctgtcgagatgatgcaggctcgcacttatccgttgcgctggtttctcctggagcagccggagatacaggtcgcccattttccattcaagaataatatgagcttcgtggtcctggtcccgactcacttcgaatggaacgtgtcgcaggtgttggcgaacttgtcgtgggacactttacatcctccgctcgtttgggagagaccgaccaaggtccgcctacccaagttgtacctgaagcatcaaatggacctggttgcgaccttatcccagttgggcctacaggagctgtttcaggctcctgatttaaggggcatttcagagcaatcgctggtggtttctggtgtccaacaccagtccactctcgagctatcagaggtcggggtagaggccgccgccgccacgtctatagctatgagccggatgagtctcagctcctttagcgtgaatcgtccatttctattctttatctttgaggacacaacaggcctcccgctgttcgttggttccgtaaggaacccaaatccatcggcgccacgagagctgaaagagcaacaggatagcccaggtaataaagatttccttcagtcattgaagggcttcccccggggagataagctgtttggaccggacctgaaacttgtgccgccaatggaagaagattacccccagttcggcagcccgaag

SEQ ID NO: 19046 - DNA, 1473 bp, Artificial Sequence
  Description of Artificial Sequence: Synthetic coding sequence
atggcgttgctgtggggattgctggtgctgagctggtcgtgcctgcagggcccttgtagcgtattcagtcccgtctctgctatggagcctctgggcagacaacttacctccggccctaaccaggagcaggtgagccctttgacccttcttaagctgggtaaccaggagccaggcggccaaaccgccctgaagagccccccgggtgtgtgcagtcgggatcccacacctgaacaaacccatcgcctggctcgcgcaatgatggcctttactgcagacctgtttagcctcgtcgcgcagactagcacctgtcccaatctgatcttaagcccattgtcagttgctttagctctgtcccatcttgctctcggcgcccagaaccatacccttcagcggctgcaacaggtactccacgcaggttcaggtccttgtcttcctcatctcctcagcagactttgccaagacctcggtcccggagcttttcgtcttgctgcgaggatgtaccttcagaagggatttcctatcaaagaggatttcttggagcaaagcgaacagctctttggcgctaagccagtgagcctcacggggaaacaagaagacgatctcgctaacatcaatcaatgggtaaaggaagctacagaagggaagatccaggagttcctgagcggattgccggaggacacagtgttgctgcttcttaacgccatccactttcagggattctggcggaacaaatttgacccaagcttgacacagcgggactctttccacttggacgagcaatttaccgtgccagtggaaatgatgcaggcaaggacctatcctctgcgatggttcctcctggaacaaccggagatccaggtggcacacttcccattcaaaaacaatatgtctttcgtcgtgcttgtgccaactcactttgaatggaacgtgtcccaggttctcgccaacttgtcctgggataccttacaccccccactcgtctgggagcgcccgacaaaagtgcggctccctaaactttatctgaaacatcagatggacttggttgcaacattaagtcagctcggtttgcaggagctgttccaagcgcctgacttgagaggaattagcgagcaaagcctcgttgtttcaggtgtccagcaccagagcaccctggagttaagcgaagtgggcgttgaagccgcagcagctacaagcattgcaatgagccgcatgtccttgtcctcattttctgtcaacaggcccttcttgttcttcatttttgaggacacaaccggattgcccttgttcgtcggaagtgtgcgcaacccaaacccgtcagctcctcgcgagctcaaagaacagcaagatagtccgggaaacaaggacttcttacaatctttaaagggatttcccaggggcgataaactgtttggacctgatctcaaactggttcccccgatggaagaggattacccgcagttcggctctccgaag

SEQ ID NO: 19047 - DNA, 1473 bp, Artificial Sequence
  Description of Artificial Sequence: Synthetic coding sequence
atggctctgttatggggactgctggtgctctcgtggagctgcttgcagggaccttgcagcgtgttttctcccgtcagtgcaatggagccactgggccggcaactcacatcgggccctaatcaggaacaggttagcccgctcactttactgaagctcgggaaccaggagcctgggggacagactgcacttaagtctcccccaggggtttgttctcgggaccctactcctgagcagacccaccgtctggcgagggcaatgatggcattcaccgctgacttgttttcattggtcgcccagacatccacttgccctaaccttatcctgtcacccctgagtgtggctctggccctgagccacctggccctgggcgcacagaatcacacgctgcagaggctccaacaggttcttcacgcaggttcagggccttgtctcccccatctgctgagtcggttgtgtcaggacctgggacctggagcgttccgtctagcagctcggatgtatctgcaaaagggctttccgataaaggaagactttctggagcaatctgaacagctctttggtgccaagcccgtgtcattgacaggaaagcaggaggacgacctcgcaaacattaaccagtgggtgaaagaagccaccgaagggaagatccaggaatttctgtcaggactgcccgaggatacagttttgctgctgctcaacgccatacacttccagggattctggcggaataagtttgacccttcactgactcaacgcgactctttccacctggacgagcagtttacagttcccgtagagatgatgcaagccaggacctaccccttgcgctggtttctgttggaacaacctgagatacaggtagctcatttcccctttaaaaataacatgagcttcgtggtgctggttcctacccactttgaatggaacgtttctcaagtcttggcaaatctgtcctgggacacacttcatcctcccctcgtatgggaaaggccaactaaagttcgtcttcctaagctgtacctgaaacaccaaatggatcttgtagcgacactgtcacagcttggcctgcaggagctgtttcaggcacccgacctcaggggcatttccgaacaatcgctggtggtcagcggggtgcagcatcagagcaccctggagctatcagaagtaggcgtggaagcggccgctgccacttccatcgccatgtctagaatgtcactctcatccttcagcgtgaacaggccttttctgtttttcattttcgaggatacaaccggcctgccgctcttcgtgggcagcgtgcggaatcccaatccttcagccccacgggaattgaaggagcagcaggattcacctggcaataaagactttttgcagagtcttaaagggttcccacgcggtgataaactcttcgggccagatttaaaactcgtcccacccatggaggaggactatccccagtttggttctcctaaa

SEQ ID NO: 19048 - DNA, 1473 bp, Artificial Sequence
  Description of Artificial Sequence: Synthetic coding sequence
atggcccttttgtggggtctcctggtattgagctggagttgcctccagggaccctgtagcgtgttttctcccgtctcagcaatggagcccctgggtagacagttgacttccggtcccaaccaggagcaagtatccccgctcactctgttgaagctgggaaatcaggagcctggaggacagacagcgcttaaatcaccacccggcgtgtgctcccgggatcccacacctgagcagacacaccgtctggcgagggcgatgatggcctttaccgcggacctgttttccctagttgcccagacgtccacttgtcctaacctcatacttagtccactgagcgtggcgctggccctatcccacctggcactgggagcgcagaaccatacgttgcagagactgcagcaggtgttgcatgccggctctggcccctgcctgccccatctgctctcccgtttgtgccaagacctgggccctggcgccttcaggctagctgcacgtatgtacctccagaagggttttccaatcaaggaggacttcctggaacagagcgagcagctcttcggggcaaaaccagtatccctgaccggtaagcaagaggatgatctggctaatatcaatcagtgggtgaaggaagcgactgagggaaaaattcaggagtttctgtcaggcctgccagaggatacggttttgctcctgcttaatgctatccactttcagggcttctggcgtaacaaatttgacccttcacttacccaacgggatagcttccacttagatgaacaattcaccgtcccagtggagatgatgcaagcacggacatatcctctaagatggttcctgcttgagcagcccgaaatccaggtagctcacttcccctttaagaataatatgtcttttgtcgtgctagtccccacccactttgagtggaacgtatcacaagttcttgctaatctgtcatgggatactctacacccacccctggtgtgggagcgtcccaccaaggtgcgtctgcctaaactgtatctgaaacaccagatggatttagtcgccacactcagccaactggggttacaggagctgtttcaggcccccgatcttcggggaatcagcgagcagtcattggtcgtcagtggtgtgcagcatcagtcgacactggagcttagcgaagttggtgttgaggccgccgccgccactagcatcgccatgtcccgaatgagtctctcttctttcagcgtcaatagaccttttcttttttttattttcgaggatacgaccggtttgccactatttgtcggctctgtgaggaacccaaatccatctgccccacgggagctgaaggagcagcaagactcacccggcaacaaggatttcctgcagtctctgaaaggattccctagaggcgataagttgtttggacctgatttgaagctggtgccccccatggaggaggactatcctcagtttgggagcccaaag

SEQ ID NO: 19049 - DNA, 1473 bp, Artificial Sequence
  Description of Artificial Sequence: Synthetic coding sequence
atggcattattatgggggctgcttgtgctctcgtggtcatgtttacaggggccctgctctgttttcagtcccgttagtgccatggagccccttgggcggcagctgacatctggacccaaccaggagcaggtcagtccacttacactactgaaactgggaaaccaggaaccagggggacagacagcgttaaagtctccaccaggggtatgttcaagagatcctactcccgaacagacacataggctggcaagagccatgatggcctttactgcagatctgttcagtcttgtggcccagacttccacttgtcctaatctgatcttgagtcctctctcagtggcattggccctcagtcaccttgctcttggagcgcagaaccatacactccagagacttcaacaagtactacacgccgggtctgggccatgcctccctcacttgctgagtaggctgtgccaggatcttggacctggggctttcaggctcgcggctagaatgtatcttcagaaagggtttcccataaaagaagattttcttgaacagtctgaacagctctttggggcaaaaccagtgtcccttacaggaaaacaggaagatgatctagcgaatattaaccagtgggtaaaagaagctacagaagggaaaatccaggaatttctctccgggctccctgaagatactgtactgttgttgctgaacgcaatacatttccaggggttctggagaaacaaattcgatccctctttaacacagcgggactcattccatcttgatgaacagtttactgtgcctgtcgaaatgatgcaggcacgaacttatcctttacgctggttcctgcttgaacagccagaaatccaggtagcgcatttcccatttaagaacaatatgagtttcgttgtgctagttcccacacacttcgaatggaacgtgagtcaagtgttggctaacctgtcttgggatactctgcatccacctctggtctgggaacggcccacaaaagttcgactgcccaaactgtatctcaaacatcaaatggatttggtggctacactgtcccagctggggctccaggaactcttccaggctccagatctgcgaggaatctctgaacagtccctggttgtatccggggtccagcatcagagtactctagagctctcagaggtgggggtcgaagctgccgctgcaacatcgattgctatgagtcgcatgtctctgtcttcgttctctgtgaaccggccatttctcttttttatcttcgaagatacaacaggactaccattgttcgtaggatctgtgcggaaccctaatccctcagcccccagggaactcaaagaacagcaggactcccctgggaacaaagattttcttcagtctcttaaaggatttccacgcggggacaaactctttggaccagatctcaagctagtgcctcctatggaagaagattatcctcaatttgggtcaccaaag

SEQ ID NO: 19050 - DNA, 1473 bp, Artificial Sequence
  Description of Artificial Sequence: Synthetic coding sequence
atggctctgctgtggggcttgttagtgctaagctggtcctgcctgcagggcccgtgctcggtgttcagcccagtgagcgctatggagccactcggacggcaactaactagtggcccgaatcaggaacaagtctctccactcacattattaaaattgggcaaccaagagcctggcgggcagaccgccctgaagagcccccctggcgtttgtagcagggacccaactcctgaacaaacgcaccgtcttgcccgtgccatgatggctttcacagccgaccttttctcactagttgcccagacctcaacttgcccaaatttgattctcagccctctgtctgtggccctagctctgagtcatctggcactgggtgcacagaatcatacactgcagcggctccagcaggtcctacacgcaggaagcggtccctgcctcccccacctgctgagccggttgtgtcaagacttaggacccggagcttttcggctggccgcacgcatgtacctgcagaaggggtttccaatcaaagaagactttttggagcagtcagaacagctttttggggcaaaacccgtcagtcttacaggtaagcaggaagacgacctcgccaacatcaaccagtgggttaaggaagccacagaggggaagatccaggagttcctgtcgggtctaccggaggacacagtgctgctgctcttaaacgcgattcactttcaaggtttctggaggaacaagtttgatccaagcctcacccagagggacagctttcaccttgacgagcagttcacggtacccgtggagatgatgcaggcacgtacctaccctctgcgatggtttcttctagagcagccagagattcaggttgcccactttccatttaagaataacatgtccttcgttgtcctggttcctactcactttgaatggaatgtgtcccaggtcctggccaacctctcttgggatacgcttcacccccctctcgtatgggaacggccaacgaaggtacggctgccgaaactttacttgaagcatcagatggacttggtcgctaccctgagccagcttgggcttcaggaactgtttcaagcaccagatctgagaggcatctccgaacagagcctcgtggtaagcggggtccagcatcagtctaccctcgagttatcagaagtgggggtggaggccgctgcagctaccagtattgctatgtctaggatgagtttatcctccttttccgtgaatagaccgttcttattttttatattcgaagacacgacggggctccctctgttcgtcgggtcagtgcgaaatccgaacccatcagcaccccgggaactgaaagaacagcaggattcccctggaaataaagattttctgcaatccctcaaaggttttccccgaggcgataaactgttcggtccggatctgaagctcgtacctccaatggaagaggattacccccagttcggttcccccaaa

SEQ ID NO: 19051 - DNA, 1473 bp, Artificial Sequence
  Description of Artificial Sequence: Synthetic coding sequence
atggcgctgctatggggtttgctcgtcctgagttggagctgcttgcaaggaccttgttccgtgttcagtccggtatcagccatggagcccctcggccgtcagctgacctccggccctaaccaggagcaggttagtccactcaccctgctcaagctgggcaaccaggagcctggaggacaaaccgctttgaagtcgccacctggcgtgtgtagccgtgaccccactcccgaacaaacccatcgcctggctagagcaatgatggccttcacagcggatctgttctctcttgttgcccaaacttcaacatgcccgaacctcatcctgtccccccttagcgttgccctggcactctcccacctggctcttggggcccagaaccacaccctccagagactgcaacaggtgctgcacgctggcagcgggccatgtctccctcacctgctaagcagactctgccaggatctgggtcctggcgcattccgacttgctgcaagaatgtacttacagaaaggctttcctattaaggaagacttcttggaacagagcgagcaactgtttggcgcaaaacccgtgagcctgacaggcaagcaagaggacgatcttgctaacatcaatcaatgggtcaaagaagcaactgagggcaagatccaagagtttctctcaggcctaccagaggacactgtgctgctgctgttgaatgctattcattttcagggattttggaggaacaaattcgatccttcgttgacccagagagattcgtttcatctagacgaacagtttacagtccctgtcgaaatgatgcaagcgcggacgtatcctttgcggtggtttctgttagagcaaccggagattcaggttgcacatttccctttcaagaataatatgtcttttgtggtgcttgtgcctactcatttcgagtggaacgtgtcacaggtactggcgaacttgtcttgggataccttgcacccacctcttgtctgggagaggcctactaaggtgcggctacctaagctttacctaaagcaccagatggatctggtggccactttgagccaacttggccttcaagagctcttccaagcccccgatctgagggggatctccgagcagagcttggtggtctcgggagtacaacaccagagtaccctggaactcagtgaagtgggggtggaagcagcagccgcaacatcgattgcaatgagtcgaatgtccttgagttcattttcagtgaacaggccatttctgttttttatcttcgaagatactacaggactgccactgttcgtggggagtgtgcggaatcccaatccttctgcaccccgcgagctaaaggaacagcaggactcacccggcaacaaagattttctgcagtctctgaaaggctttccgcgaggcgacaaattatttgggccagatctgaagctcgtgcctcccatggaggaagattacccacagtttggaagcccaaaa

SEQ ID NO: 19052 - DNA, 1473 bp, Artificial Sequence
  Description of Artificial Sequence: Synthetic coding sequence
atggccttgttgtggggcctgctggtactgagctggtcctgcctgcagggcccttgttccgtattctctcccgtgagcgccatggagcctctcggaagacagctcaccagtggtcccaaccaggagcaggtctctccgctgaccttgttaaaactgggcaatcaagaacccggaggacagaccgcattgaagtcaccccctggagtttgctctagggaccccacaccagagcagacccatcgactcgccagagcaatgatggccttcacagccgacctgttctctttagttgcccaaacatccacctgccccaacctgattctgagccccctgtctgtggctcttgcactgtcccacctagccctcggtgcgcagaatcacaccttgcagcgacttcagcaggtgctgcatgctggatccgggccttgtctgccacaccttttgagtaggctctgccaggacctcggccctggcgcgttcaggctcgctgccaggatgtacctgcagaaaggattcccaattaaagaagattttctcgaacagagcgagcagctcttcggcgcaaagcccgtgtcactgaccgggaagcaggaggatgacctggctaacatcaaccagtgggtaaaggaggcgactgagggtaaaattcaggagttccttagcgggctgccagaggatactgttctcctgctcctcaacgccatccacttccaaggcttttggcgcaataaattcgaccccagtctgactcaacgcgattctttccatctggacgaacagtttaccgtacccgtggagatgatgcaggcccggacatatccgctgcgctggtttcttctagaacagcctgaaatccaggtcgcacactttcccttcaagaacaatatgtcgttcgtggtgctggtgcctacacatttcgagtggaatgtgagtcaggtccttgctaatctgtcttgggataccttacaccccccactcgtgtgggaacgtcccacaaaagtccgcctccctaagctgtatcttaaacatcagatggacctggtagccaccttgtcacagcttgggcttcaagaattatttcaggcacctgatctcagggggatctctgaacaatctctggtcgtctcaggagtccaacaccaaagtacactggaactgtccgaagtcggggtcgaggccgcagctgcgacttccatagccatgagcagaatgagcctctccagcttcagtgtaaatagaccttttttgttttttatctttgaagacaccaccggtttgcccctcttcgtgggatccgtgaggaacccaaatcctagtgccccacgcgagctgaaagagcagcaggacagtccagggaacaaagacttcctgcagtcactaaagggattcccaagaggtgataaactattcgggcccgacctgaaactggtccccccgatggaggaggactatccccagtttgggtctcccaag

SEQ ID NO: 19053 - DNA, 1473 bp, Artificial Sequence
  Description of Artificial Sequence: Synthetic coding sequence
atggctctcctctggggcctccttgtcctgtcctggtcttgtctccagggcccttgttctgtcttctcccccgtgtccgccatggagcccctcggcagacagctgaccagcggcccaaatcaggagcaggtcagcccactcaccctgctaaagctgggcaatcaggaaccagggggccagacagcactgaaaagcccacccggtgtgtgttctcgcgaccctactcccgagcagacacacagattggctcgcgctatgatggcttttaccgccgacctgtttagcctggtggctcagactagtacatgcccaaacctaattctaagccccctctctgttgccctggccctgtcccatctggccctaggcgcccagaatcataccctgcaacggctgcagcaagtgctgcacgctgggagtgggccttgtctgccacatctgctaagtcgactctgccaggacctgggacccggcgcctttaggctggcagccagaatgtacctacaaaagggctttcccatcaaggaagacttcctggaacagtctgaacaactgtttggagccaaacccgtgagtctgactgggaagcaagaggacgatctggctaacattaatcagtgggttaaagaggccaccgaggggaagatccaggagttcctttccgggttgcccgaggacactgtgctcttattactaaatgccattcattttcagggcttttggagaaacaagtttgatccttctctgacacagcgagactcttttcaccttgacgagcagtttaccgtgccagtggagatgatgcaggctcgcacctaccctcttcgttggtttttactagagcaaccagaaatccaagttgcccactttcccttcaaaaacaatatgtccttcgtggtgttggtgcccacccacttcgaatggaacgtgagtcaggtcttagcaaatctgtcctgggacactctgcaccccccgctggtgtgggagcgccctaccaaagttcgattgccaaaactgtacctgaagcaccaaatggacctggtcgccactctgtcccaattaggcctccaggagctctttcaggcacccgacctcagggggatctccgagcagtctcttgtagtgtcaggcgtccagcaccagtccaccctggagctgtccgaagttggcgtggaggctgctgctgctacatccattgctatgagccggatgagcctatcctctttttccgttaaccggccatttctgttttttatttttgaggacaccaccggcttacctctcttcgtgggttctgtccgaaacccaaacccatcagctccaagagaactgaaagagcaacaggactctcctggcaataaggatttcctgcagtctctcaaaggtttccctcgtggtgacaaactgttcggcccagaccttaagctagttccccccatggaagaagattatccccaattcggttcccctaag

SEQ ID NO: 19054 - DNA, 1473 bp, Artificial Sequence
  Description of Artificial Sequence: Synthetic coding sequence
atggcgctgctgtgggggttattggttctgtcctggtcttgcttgcagggcccatgtagtgtgttcagccctgtctctgccatggagcccctaggaaggcagctaacttctggacccaatcaggaacaggtgtctccactgaccctgctcaagctcggtaatcaagagcccggtggccaaacggccctaaagagccctcccggagtctgctcgagggatcccacacccgagcagacgcataggcttgccagggcgatgatggccttcacagcggatcttttctctttagtcgcacagactagcacctgccctaacctgattttatcccccttgtctgttgcattagcgttatctcatctcgccttgggagctcagaatcatacactgcagaggctgcagcaggtgctgcacgctgggtctgggccttgtctgccccatttgctgtctcgcctttgccaggacctgggtcccggagcatttcgtctggctgcccgcatgtacctccagaaaggttttcccatcaaagaggactttctggaacagtctgaacaactttttggcgccaagccagtgagtctgaccgggaagcaagaggatgatctggccaacattaatcaatgggtcaaggaagctaccgagggtaagattcaggagttcctcagtggactgcccgaggacaccgtcctgctgctcttaaacgctatccacttccaggggttttggagaaataagtttgatccttcactcacccagagggacagcttccacctggacgagcagtttaccgtgccagtggagatgatgcaggctaggacttatcctttgcgatggttcctcctagagcaaccagaaattcaggtcgcacactttcctttcaaaaacaacatgagttttgtcgttctcgtaccaacccacttcgagtggaatgtgtcgcaggtgctggccaatctgagctgggataccctgcaccctccactcgtctgggagaggcccaccaaagtccgtttgcctaaactgtacctgaagcatcaaatggacctggttgccacgctcagccagctggggctgcaagaactgtttcaggcacccgatctgcggggcattagcgagcaaagtctggtggtttccggtgtgcagcaccagagtaccctggaactgtccgaggtgggcgtcgaggcagcagcagctacaagtatcgctatgagtaggatgtcactcagctcttttagtgtgaaccgtccctttctcttctttattttcgaggacactacaggactacctctgttcgtagggagtgtgcggaacccaaatccatccgcccccagagaattaaaagagcaacaggacagtcctggcaataaagattttctgcagtccttgaaggggtttccacgtggggataagttatttggcccagacctgaaattggtccccccaatggaagaggactacccgcagtttgggagcccgaaa

SEQ ID NO: 19055 - DNA, 1473 bp, Artificial Sequence
  Description of Artificial Sequence: Synthetic coding sequence
atggccttgctgtggggcctcttagttctgtcatggagctgcctgcaggggccgtgcagcgttttctctcccgtctctgccatggaaccactggggagacagctgacctccggccccaatcaggagcaggttagccccctgaccctgctgaaactcggaaaccaggagcctgggggtcagactgcactcaaaagtccccctggcgtatgttcccgtgatcctacgcccgagcaaacccatagactcgctagggcgatgatggcattcacagcagatctcttttccctggtagcccagacgtcaacatgcccaaacctcattctctcgcccctgagtgtggcgttggctctgtcccacctggctctcggcgctcaaaatcatacactgcaacgcctccagcaggtgctgcacgcaggatcaggcccatgtctgccccacctgttatctaggctttgtcaggatctgggaccaggggcattccgtctggcggctcggatgtacctgcaaaagggcttccctattaaggaggattttttagagcagagtgaacagctgttcggcgcgaaacccgtgtccttgaccggcaagcaagaagatgatctagccaatattaatcagtgggtgaaggaggccacagaagggaagatacaggaatttctgtcgggcctcccagaggataccgttcttctactccttaacgccattcacttccagggattttggagaaacaaatttgatcccagcttaactcagcgggactcctttcacttggacgaacaattcacagtaccagtggaaatgatgcaggcgcggacttatcctctgcgctggtttcttttagagcaacccgaaatccaggtggcccacttcccttttaaaaacaatatgtctttcgtagtcttggtccctactcatttcgagtggaatgtctcccaagtgctggctaatctgtcatgggacacactgcaccctccactggtgtgggagaggcccaccaaggtccgccttccaaagttatatctgaagcaccagatggacctcgtggccacattatcacagctggggcttcaggagctcttccaggctcccgacctgcggggaatttccgaacagtctttggttgtatctggggttcaacatcagtcgaccctcgaactgtctgaggtgggcgtcgaggcagcggccgcaacctcaatcgctatgtctcgcatgagccttagtagttttagtgtgaataggcccttcctctttttcatcttcgaagacaccacaggcctgcccctatttgtgggaagcgtgcgcaatcccaatccctccgcaccacgggaattgaaagaacagcaagatagtcccggcaacaaagattttttgcaaagcttgaagggcttccctcgtggcgacaagctttttggacccgacctaaagcttgtgccccccatggaggaagattaccctcaatttggatccccaaag

SEQ ID NO: 19056 - DNA, 1473 bp, Artificial Sequence
  Description of Artificial Sequence: Synthetic coding sequence
atggcgctgctgtggggattgttagtgctgagttggtcctgcctacagggaccttgttcagtttttagcccagtgagtgctatggaacccctgggcagacagctcacatcaggtcccaaccaggagcaggtgtctcctctgaccttgctcaaactcgggaaccaggaaccgggcggccaaaccgctctcaaatcacctccaggcgtttgtagccgtgacccgactccagagcagacacacagactggcccgggcgatgatggcattcactgctgatctgttctccctcgtggctcagaccagcacctgtcccaaccttatccttagccctttgtctgtggcactagccctgtctcatcttgcactgggggcccagaaccatacgctgcagaggctccaacaggttctgcacgctggatctggtccgtgcttgccccacctgctcagtaggctttgtcaggatctgggcccaggggcttttaggctcgcagcccgtatgtatctacagaaggggttccctattaaggaagattttttggagcagagtgaacagctattcggcgccaagcccgtgagcctgacaggtaagcaggaagacgaccttgccaacatcaatcagtgggtcaaggaagccaccgaaggaaagatacaggagttcctgtctggcctccctgaggacacagttcttctgctcctgaatgcaatccacttccagggcttttggcggaataaatttgacccctcactcacgcaaagggattcatttcacctcgacgagcagttcactgtgcctgtggaaatgatgcaggccagaacctatcctctgcgatggtttttgctggaacagcccgagattcaggtggcacacttcccattcaaaaacaacatgtccttcgtggtcttagtcccaacgcacttcgagtggaatgtgagccaggtgctcgctaatttgtcttgggatacgctccatccccccctcgtgtgggaacggccaacaaaggtgcggctcccgaaattgtacctgaagcaccagatggatctcgtcgccacgctgagccaactgggcctacaagaacttttccaggccccggacctcagaggaatcagcgaacagtcactcgtcgtcagcggtgtgcagcaccagtcaaccctggagctaagcgaggtcggtgtggaagcagcagccgctacctcgatcgccatgtcccgcatgtccctgagcagcttctccgttaacaggccctttctcttcttcatttttgaggacaccaccggccttcccctgtttgtcgggtcagtcaggaatccaaatccttccgcgccgcgagagttgaaagaacagcaggatagccctggaaataaggactttttgcagtcactgaagggattcccacgcggggacaaactgtttgggccagacctcaaactggttcctccgatggaagaggactacccgcagtttggtagcccaaag

SEQ ID NO: 19057 - DNA, 1473 bp, Artificial Sequence
  Description of Artificial Sequence: Synthetic coding sequence
atggctctgctatgggggttgctggtgctgagctggtcttgcctgcaaggtccctgctccgtattctcaccagtgagtgccatggaacctttgggtaggcaattgacctctggacccaaccaggagcaggtgagtccgctgacactgctgaaactgggtaaccaggagcccggagggcagactgcccttaagagccccccgggtgtgtgttctcgggacccaacccctgagcagactcacaggttagccagggccatgatggccttcaccgccgatctgttcagtctggttgcccagacaagcacttgcccaaatctgatattgtcaccactcagtgtcgctctcgcgctgagccatctggcgttgggagcgcagaatcacacgcttcagcgcctgcagcaggttctgcacgccgggtctgggccttgcttgccacaccttctttcgagactgtgccaggatctggggcccggggcctttaggctggctgccaggatgtacctccagaagggcttccctatcaaggaagacttcctggagcagagtgaacagctgtttggggccaagcctgtctcccttacagggaagcaggaagacgatttagccaatattaaccagtgggtcaaggaagcgacggaaggcaagatccaagaattcctgtcagggctccctgaggacacggtgctcctgctcctcaacgctattcacttccaaggtttttggaggaacaagtttgacccttccctgacacagagggacagcttccacctggatgaacagttcacggtccccgtcgaaatgatgcaggcccggacctaccctctccgttggtttttactggaacagcctgaaatccaagtggcacactttcctttcaaaaacaatatgagcttcgtagtcctggtgccaacccacttcgagtggaatgtgtcccaggtcctcgcaaacctctcttgggatacactgcacccccccctcgtatgggagaggcctacgaaagtgaggctgcccaaactctatttaaagcaccagatggacttggtagctactctgtctcaactcggcctccaggagctgttccaggccccagacctgagaggcatatcggaacaaagtttggtggtgagcggagtccaacaccagagcactctggaattgtctgaggtgggcgttgaggcagctgcagctacatccatcgccatgtctagaatgtctctgagttccttctctgtcaatagaccttttctgttcttcatcttcgaagacaccactgggttaccccttttcgtgggcagcgttcgcaacccaaacccttctgccccacgagagctcaaggaacagcaggattcaccagggaataaagacttcctacagagtctgaagggatttccacgaggggataagctgtttgggccagacttaaagctggtgcctccaatggaagaggattaccctcaatttggctccccaaaa

SEQ ID NO: 19058 - DNA, 1473 bp, Artificial Sequence
  Description of Artificial Sequence: Synthetic coding sequence
atggctctgttgtgggggctccttgtgctctcttggagctgtctgcagggtccttgttctgtgtttagtcccgtctcagctatggaaccgctgggaaggcaactgacatccggtccaaaccaggagcaggtgagccctttaaccctgctcaaattggggaatcaggaaccaggcggccaaacagcgttaaaatccccgccgggggtctgttcgcgagatcccacccccgagcagactcatagactcgcaagggccatgatggctttcacagccgatctattcagtttggtcgcacagactagtacctgcccgaacctgattctgagccctctgtcagtcgcgctcgccctgagccacttagccctcggagcccagaatcatactctgcagcgtctccagcaggtcctgcatgcggggtcagggccatgtcttccacacctgctttcaagactatgccaggatctgggtcctggggcatttcgtctggccgcgcgcatgtatctccagaagggatttcccataaaggaagattttctcgaacagtctgaacaactgttcggagcaaagccagtgtcactgactggcaagcaggaggacgacctagctaacataaatcagtgggtgaaggaggcaaccgaaggaaaaatccaggagttcctgtccggactaccggaagacaccgttctcctgctgctgaatgcaattcactttcaggggttctggcgcaataagttcgaccctagcctgacacagcgagatagcttccatctcgacgaacagttcacagtaccagtcgaaatgatgcaggccagaacctaccctctgagatggtttctactggagcagccagagatccaggtcgcccattttccctttaaaaacaacatgtctttcgtcgtgctggtacctacccacttcgagtggaacgtgagtcaggtactggccaatctgtcttgggacactctccatcccccgctggtctgggagcggcctacaaaggttcgcctccccaagctctacctgaagcaccagatggatctagtagctactctgtctcagctgggactgcaagaactgttccaggcacccgatttacggggtattagtgaacagtccctcgtagttagtggagtgcagcaccagtcgacgctggagctctccgaggtgggcgtcgaagcagctgcagctacatccatcgcaatgtctagaatgtcgctgtccagcttcagtgtcaacaggccgttcctgttttttatttttgaagatactactggccttcctcttttcgtcgggtccgttaggaaccctaatcctagcgccccacgcgaactaaaagagcagcaggattcccccgggaataaggattttctgcagagtctgaagggcttcccacgaggtgacaaactgttcggaccagacctcaagttggtgcccccaatggaggaggactacccccagttcggctcacccaaa

SEQ ID NO: 19059 - DNA, 1473 bp, Artificial Sequence; identical to SEQ ID NO: 19023
  Description of Artificial Sequence: Synthetic coding sequence

SEQ ID NO: 19060 - DNA, 1473 bp, Artificial Sequence
  Description of Artificial Sequence: Synthetic coding sequence
atggccctcttgtggggcctgctggttttgtcctggtcctgcctccagggcccttgcagcgttttcagccccgtttccgcgatggaacccttaggacggcaattgacatctgggcccaaccaagagcaggtgagtcctttgaccctgttaaagctggggaaccaggagccagggggccaaaccgccttaaagagcccccctggggtgtgtagcagagaccccacgcctgaacagacacaccgattagcgcgggcaatgatggctttcactgctgaccttttctcattggttgcacagacttccacatgccccaatctgatcctttcacccctttccgtagcgctcgctctttcccaccttgctctgggggctcagaatcatacattgcagaggctgcagcaggtgcttcacgcgggcagcggaccctgtttgccccatttgctgagccgactctgccaggatctagggcccggggccttccgtcttgcagcccgtatgtatctgcaaaagggttttcccatcaaagaggatttcttggagcagagtgaacaactcttcggagcaaaacccgttagcttgaccggcaaacaggaggacgatctggcgaatatcaaccagtgggtaaaggaggcaactgaagggaagatccaggagtttttatcagggttgccggaggatactgttctgctacttctgaatgccattcacttccagggtttctggcgtaacaagtttgatccttccctgactcagcgcgactccttccatcttgacgagcagttcacggtgccagtcgagatgatgcaggcccggacttacccactgagatggttcctattggaacagccagaaatacaggtggcccattttccgttcaagaacaatatgtcctttgttgtgctagtacctacgcacttcgaatggaatgtgagccaagttttggccaacctcagttgggatactctgcatcccccgctagtgtgggagcggcccaccaaagtgaggttacccaagctttatttaaagcatcagatggaccttgtggctacactgtcacagcttggcctccaggagctatttcaggctccagacctgagggggatatcagagcagtcccttgttgtgtcaggggtccagcaccaaagcacactagaattatcagaggtcggagtggaggccgctgcagcgacctccattgcaatgtctaggatgtcactctctagctttagcgtgaacagaccgtttttgtttttcatcttcgaagataccaccggcttgcccctgttcgtcggctcagtcagaaacccaaacccctctgccccacgcgaactcaaagagcaacaggactcaccgggcaataaagacttcctgcagtcgctgaaggggtttcccagaggcgacaaattgtttggtcctgatctgaaattggtgccacctatggaggaggattacccgcagtttggttcccctaag

SEQ ID NO: 19061 - DNA, 1473 bp, Artificial Sequence
  Description of Artificial Sequence: Synthetic coding sequence
atggctctgctttggggattgctggtgctgtcttggtcttgtctccagggtccctgttcagtcttcagtccagtctccgccatggaaccactgggacgccagcttacttccggtccaaaccaggagcaagtgtctcctttgactcttttgaaactcggtaaccaggagccaggcggccagaccgctctgaagtctcccccaggcgtttgttctagagatccaactcctgaacaaactcaccgtctcgcaagggcaatgatggcttttactgccgatcttttctccctcgtcgctcaaaccagcacatgccccaacctgatcctctcacccctgtccgtggctctcgcactctctcacctcgccctcggtgcacaaaaccacactctccaaaggctgcagcaggtcctgcatgctggctccggcccttgcttgccccatctgttgagtcgcttgtgccaggatttgggacctggcgccttccgtctcgctgcccgtatgtacttgcagaagggattcccaatcaaggaagacttcctggaacaatcagagcaactgttcggcgctaaacctgtcagcctgaccggcaaacaggaggatgatctcgctaatataaatcagtgggtgaaagaagccaccgaaggaaagattcaggagtttctgagtggtttgcccgaagataccgtacttctgttgctgaatgccattcacttccagggattttggaggaacaaattcgatccttcactcacacaaagagactctttccacctggatgaacaatttaccgtgccagtggagatgatgcaagccaggacttaccccctcaggtggtttctgctggaacagcctgaaatccaggtggcccacttcccattcaagaacaacatgtcattcgttgtgcttgtcccaactcacttcgagtggaatgtgtctcaggtgcttgctaacttgtcatgggacaccctgcaccctcccctggtgtgggagaggccaactaaggttaggctcccaaaactctacttgaaacaccagatggacctggtcgcaacactctcccagttgggattgcaggagctcttccaggcccccgacctgaggggtatttctgaacaaagtttggtcgtttctggtgtgcagcaccagtccaccctggaactttccgaagttggtgtcgaggcagctgccgccacctccatcgccatgtccaggatgagcctgagctctttttcagtgaatcgcccctttcttttctttatcttcgaggatactaccggccttccattgtttgtgggatccgtgagaaatccaaacccttcagctccacgtgaactcaaggagcaacaggattcaccaggaaacaaggattttctgcaaagccttaagggtttccctaggggagacaagttgttcggccctgatttgaaactggttcctccaatggaagaggattaccctcagttcggttcccccaag

SEQ ID NO: 19062 - DNA, 1473 bp, Artificial Sequence
  Description of Artificial Sequence: Synthetic coding sequence
atggcgttattatggggtttactagtattatcgtggtcgtgtctacaaggtccgtgttcggtattttcgccggtttcggcgatggaaccgctaggtcgtcaattaacgtcgggtccgaatcaagaacaagtatcgccgctaacgctactaaaactaggtaatcaagaaccgggtggtcaaacggcgctaaaatcgccgccgggtgtttgttcgcgagatccgacgccggaacaaacgcatcgactagcgcgagcgatgatggcgtttacggcggatttattttcgctagtagcgcaaacgtcgacgtgtccgaatctaatactatcgccgctatcggtagcgttagcgctatcgcatctagcgctaggtgcgcaaaatcatacgttacaacgtctacaacaagttttacatgcgggttcgggtccgtgtttaccgcatttactatcgcgtctatgtcaagatctaggtccgggtgcgtttcgtttagcggcgcgaatgtatctacaaaaaggttttccgataaaagaagattttctagaacaatcggaacaactatttggtgcgaaaccggtttcgctaacgggtaaacaagaagatgatctagcgaatataaatcaatgggtaaaagaagcgacggaaggtaaaatacaagaatttttatcgggtttaccggaagatacggttctactattactaaatgcgatacattttcaaggtttttggcgtaataaatttgatccgtcgctaacgcaacgagattcgtttcatttagatgaacaatttacggtaccggttgaaatgatgcaagcgcgtacgtatccgctacgatggtttttactagaacaaccggaaatacaagttgcgcattttccgtttaaaaataatatgtcgtttgttgttttagttccgacgcattttgaatggaatgtatcgcaagtactagcgaatttatcgtgggatacgttacatccgccgttagtttgggaacgtccgacgaaagttcgactaccgaaactatatttaaaacatcaaatggatttagttgcgacgctatcgcaattaggtctacaagaactatttcaagcgccggatctacgaggtatatcggaacaatcgttagttgtatcgggtgtacaacatcaatcgacgctagaattatcggaagttggtgttgaagcggcggcggcgacgtcgatagcgatgtcgcgaatgtcgctatcgtcgttttcggtaaatcgtccgtttttattttttatatttgaagatacgacgggtttaccgttatttgttggttcggtacgaaatccgaatccgtcggcgccgcgtgaactaaaagaacaacaagattcgccgggtaataaagattttttacaatcgttaaaaggttttccgcgtggtgataaactatttggtccggatctaaaactagttccgccgatggaagaagattatccgcaatttggttcgccgaaa

SEQ ID NO: 19063 - DNA, 1473 bp, Artificial Sequence
  Description of Artificial Sequence: Synthetic coding sequence
atggcgctcctttggggattgttggtgcttagttggtcatgtttgcagggaccttgttccgttttctctcctgtatcagcaatggaaccgctcggacgacaacttacttcaggaccaaaccaagaacaagtgagtcctcttacattgctcaaacttgggaatcaagagccaggaggccaaacagcccttaaatcccctccgggagtgtgctcgcgagatccgactccagaacagactcacagactggcgagagccatgatggcctttactgcagatcttttctcccttgtagcacaaacttctacttgtccgaacttgattctttctccgctctcagtagctctggcactgtcacatctggcattgggagctcaaaatcatactctgcaacgacttcaacaagttctacacgctggatctggaccatgtttgccacatctcctctcacggttgtgtcaagatcttgggccaggagcgttccgtcttgccgctcggatgtatttacagaaaggattcccaattaaagaagatttcttagaacagtcggaacaactgttcggagcaaaaccagtgtcactgacaggaaagcaagaggacgatctcgctaatattaaccagtgggtgaaagaagcaactgaaggtaagatacaagaatttctttctggattgccagaagataccgttttgctcttattgaatgcaatccacttccaaggtttttggagaaacaaattcgacccgtccctcacgcagcgtgatagtttccatttggacgagcaattcactgttcctgtggaaatgatgcaagcacgtacatatccattgcgttggttccttcttgagcaacctgaaattcaagtagcacatttcccgtttaaaaataatatgtctttcgtcgttctcgtcccgactcactttgaatggaatgtttcacaagttcttgccaatttgtcatgggatacccttcacccaccgcttgtatgggagaggccaacgaaggtgagattaccaaaactatacctgaaacaccagatggacctggtggccacattaagtcaactcggactacaagaattgtttcaggcgccagatttgagaggaatttccgaacaaagtctcgttgtgtctggtgtccagcaccaatccacacttgagttgtccgaagtaggagtggaagcagcagcagcgactagtatagctatgtcgcgtatgtctctctcgtcatttagcgtgaataggcctttcttattcttcatcttcgaggataccacgggcttaccattattcgtgggaagtgtgcgcaatccgaatccatcagcacctcgggagcttaaagagcaacaagactctccaggaaacaaggacttcttgcagagtcttaaagggttcccaagaggtgataaactgttcggaccagaccttaagcttgtcccaccaatggaggaagattatccacagttcggctctccaaaa

SEQ ID NO: 19064 - DNA, 1473 bp, Artificial Sequence
  Description of Artificial Sequence: Synthetic coding sequence
atggctttattatggggactacttgtattaagttggtcatgtcttcaaggaccttgttctgttttttcaccagtctcagctatggaacctttagggaggcaattaacatcaggaccaaatcaagaacaagtttctccattaactttattaaagttaggaaaccaagaacctggagggcaaaccgcactcaaatcaccaccaggagtttgttctagggatccaactcctgaacaaactcatagacttgcaagagctatgatggcttttaccgcagatttattttcattagtagctcagacttcaacttgtcctaatcttattttatctcctcttagtgttgcacttgctttatctcatttagctttaggagcacaaaaccatacattgcaaagattacaacaggtattacatgcaggatcaggtccatgtttacctcaccttctttctagattatgtcaagatctaggaccaggagccttcagacttgcagctagaatgtatttacaaaaaggattcccaattaaagaagattttttggaacaatctgaacaactttttggtgcaaagcctgtttctttaacaggaaaacaagaagatgaccttgctaatattaatcaatgggtaaaggaagctactgagggaaaaattcaagaatttcttagtggattaccagaagatacagttttattattattgaatgcaattcattttcaaggattttggcgaaataaatttgatccatcattaactcaaagagattcatttcatttagatgaacaatttacagtaccagtcgaaatgatgcaagctagaacatatccacttagatggtttttgttagaacaaccagaaattcaagtcgctcatttcccttttaaaaataatatgagttttgttgttttagttccaacacattttgaatggaatgttagtcaagttcttgcaaatttaagttgggatactttacatcctccattagtttgggaaagaccaacaaaagttagattacctaaactttatcttaaacaccaaatggatttagttgcaacattatctcaattaggattacaagaactttttcaagcaccagatcttcgtggaatttctgaacaatcacttgttgtatctggagtacaacatcaaagtacacttgaacttagtgaagtaggtgttgaagcagcagctgctacatcaattgctatgtcaagaatgagtttatcatcttttagtgtcaatagaccatttttattttttatttttgaagatactacaggattgccactttttgttggaagtgttagaaatccaaacccatcagctcctagggaacttaaagaacaacaagattctccaggtaataaagactttttacaaagtttaaaaggatttccacgaggtgataaattattcggacctgatttaaaattagtaccacctatggaggaagattatccacaatttggatcacctaaa

SEQ ID NO: 19065 - DNA, 1473 bp, Artificial Sequence
  Description of Artificial Sequence: Synthetic coding sequence
atggctctgttgtgggggctgctggtgttgtcgtggtcttgtctgcagggaccatgcagcgtcttctcgcctgtgtccgccatggagccgcttggacgccagcttacatctggtccaaaccaagagcaggtctcgccattaactctcctaaaattggggaatcaagagccgggtggccagacagccctcaaatcgcctcccggagtgtgctcccgcgatccaacgcctgaacagacccacaggttagcaagagctatgatggccttcactgccgatctcttctcattggtcgcacaaacaagcacgtgccctaatttaatcctgtcccccttatcggtggcattggccctgtcccatctggcgcttggtgcccagaatcacactctgcagcgacttcagcaagtgctccacgcaggaagtggaccctgtcttccacatctactgagtaggctctgtcaagacttgggccccggcgccttccgactggctgccagaatgtacctccagaaagggtttcctatcaaagaggatttccttgaacagagtgagcagttgtttggggccaagcccgtttccctcaccgggaagcaagaggacgacctggctaatataaaccagtgggtgaaggaggctacagagggtaaaattcaggagttcctgtctggcctgccagaagacacggtcctgctactgctgaacgcaatccatttccagggcttctggcgcaataagttcgacccttcactgacacagagagatagttttcaccttgatgaacagttcaccgttcccgtcgagatgatgcaagctcggacctaccctcttcgatggttcctcctggaacagccagaaatccaggttgcacacttcccctttaaaaataacatgagcttcgttgtgctcgtgccgacccactttgagtggaatgtgtctcaggtgctggctaatctgtcatgggataccctgcaccctcccttggtgtgggagcgccccacaaaggtgcggttgcccaaactgtatctgaagcaccagatggacctggtggctacattgtcgcagcttggtctccaggagctatttcaggcccccgatctgcgtggcatttccgagcaatctcttgtggtgagtggtgttcaacaccagtcaaccctggaactttccgaagtgggagtagaagccgccgccgccacctctatcgcgatgtcacggatgagtctgtctagcttcagtgtcaataggccatttctgtttttcattttcgaggacacgacaggactccctctgttcgttggaagcgttaggaacccgaacccctccgcaccgagagaactcaaggagcaacaggattccccagggaataaggatttcctgcagtccctgaaggggtttccacgaggggataagctatttggacccgatctgaaactagtcccgccaatggaagaggactaccctcagtttggctcacctaaa

SEQ ID NO: 19066 - DNA, 1473 bp, Artificial Sequence
  Description of Artificial Sequence: Synthetic coding sequence
atggctctattgtggggcctattagtgctctcctggtcttgcctgcaaggtccatgctctgtctttagccctgttagtgcaatggaaccgttgggacgccagctcacatctggacccaaccaggagcaagtgtcacccctgactctgctgaagctagggaaccaggagcctgggggccagaccgctctgaagagtccccctggcgtttgttcacgcgatccgacgccagagcaaacgcacaggctggctagagcgatgatggcatttacggccgatctgttctctttggtggcccagacatcaacgtgcccaaatctgatcctgtctcctctgtcagtggccttggcactgtctcatttagccctgggtgctcagaaccacaccttgcaacgtctccagcaggtgctccatgctggctccgggccctgtttaccccatcttttatctcgactctgtcaggacctcggcccaggggccttccgccttgccgccagaatgtatctgcagaagggctttccgataaaggaggatttcttagaacagagcgagcaactgttcggggctaaaccagtgtccttaactggcaaacaggaagacgatctcgctaacattaaccagtgggttaaggaggcaactgaaggaaaaatacaagagttcctgagtggactccctgaggataccgttctccttcttcttaacgctatccactttcaaggattttggcgcaacaaatttgaccctagtctgacacagagagattcatttcacctcgacgagcagttcaccgtgcctgtggaaatgatgcaagcaaggacgtatcctttgcgatggttcctattagagcagccagagatccaagtagctcatttccccttcaagaacaatatgtccttcgtggtacttgtgcccacacattttgagtggaacgtctctcaagtgctggccaatctgagttgggatacactgcacccccctctcgtctgggagaggcctacgaaggttcggctgcccaaactatatctcaaacatcaaatggacctagtggccacacttagccagctgggcctgcaggagctgttccaagcacctgacctgcgtgggattagcgaacagtcactggttgtgtccggagtgcagcatcagtccacactggagctttccgaggttggagtagaagcggccgctgcaacttctattgcgatgagcagaatgagtctgtcgtccttcagcgtgaataggccctttttgttttttatcttcgaggataccaccgggctgccactttttgtgggatcagtgaggaatcctaacccttctgccccccgggaactgaaggaacagcaggatagcccaggtaataaagatttcctacaaagccttaaaggatttcccaggggggacaaactgtttggtcccgatctgaagctggttcctccgatggaggaagattacccacagttcgggtcccccaag

SEQ ID NO: 19067 - DNA, 1473 bp, Artificial Sequence
  Description of Artificial Sequence: Synthetic coding sequence
atggctctgttgtggggcctgttggtgctaagttggagctgcctgcaaggaccatgctccgtattctcgcccgtcagcgccatggagcccttggggaggcagttgacgtcagggccaaaccaggagcaggtgtctccactgaccctcctgaagctcggcaatcaggagccaggaggccagaccgcattgaagagtcctccaggtgtatgcagccgggaccccacgcctgaacaaacccatagactggcaagggccatgatggcctttaccgcagatttattctctctcgtggctcaaacttccacctgccccaatctcatcctgagtcccttgtccgtcgccctggctctgtctcatctagcgctgggagcacagaaccacacgctccagcggctccagcaggtgttacacgctgggtctggtccctgtctgccgcaccttttatccagactgtgccaagatctcggacctggtgcctttcgactcgccgcacgcatgtaccttcagaaggggttccccattaaggaagatttccttgagcagagcgaacagctgttcggggcgaagcccgtaagcctcactggcaaacaggaggacgatctcgcgaacatcaatcaatgggtgaaagaggctactgaagggaagatccaggagttcctttctggactccctgaagacacggttctgctgctgctgaatgctatccatttccagggcttttggcgtaataaattcgacccctctttaacacagcgtgacagttttcatctggatgagcaatttactgtgcctgtggaaatgatgcaggctcgtacgtaccccctgagatggtttcttctggagcagcctgagatccaagtagctcattttccattcaaaaataatatgtcattcgtggttctggtgcccactcacttcgaatggaatgtcagccaagtgctcgcaaacctctcttgggataccttacatccaccccttgtgtgggagcggcccaccaaagtgcgcctgccaaagctgtatttgaaacatcagatggatttggtcgctacgttgtctcagctcggactgcaggaactgttccaggcacccgatctcagaggaatctccgagcagtcattagtggtgtctggggtgcaacatcaaagtactctcgaattaagtgaagtaggagtagaggcggcagctgccacatccatcgctatgtccagaatgagcttgagttctttctcggtgaaccgacccttcctgttttttatcttcgaagacactacaggcctcccattgtttgtcggctccgtccgaaatcctaacccatctgcaccgcgggagctcaaggagcagcaggactctccgggtaacaaagatttcttacagtcgcttaaagggtttccaagaggcgacaaattatttggaccagacttgaagttggttccaccaatggaggaagactaccctcaattcggaagtcctaag

SEQ ID NO: 19068 - DNA, 1473 bp, Artificial Sequence
  Description of Artificial Sequence: Synthetic coding sequence
atggccctgctgtggggtcttctcgtgttatcttggtcctgcctccagggtccatgttctgtcttttctcccgtttcagccatggaaccattgggcaggcagttgaccagtggacccaatcaagagcaagtgagcccactgacgctcttaaaattaggaaaccaggagccaggaggtcagactgcgctgaagagcccgccaggcgtctgtagccgagacccaacaccagaacagacccataggcttgcgcgtgcaatgatggcttttaccgccgacctcttttccctggtggctcagaccagcacttgccctaacctgattctgtctccactgtctgtcgcgctcgcactctcccacctggcgctcggcgctcagaaccacaccctgcagcggttgcaacaggtgctccatgctggctccgggccctgtcttccccatttgctgtcgcgattgtgtcaggacctaggcccaggagcgttcagactggccgcaagaatgtacctgcagaagggattccctatcaaagaggatttccttgaacagtctgagcagcttttcggcgcaaaaccagtgtcactgacaggcaaacaggaagatgatctcgctaatataaatcagtgggtgaaagaggctactgaaggaaaaatacaagagttcctaagcgggttgccagaggatacggtgctcctcctgctgaatgcaatccacttccagggcttttggcggaataagttcgatcctagcttgacacagcgtgattcttttcatctcgatgagcagttcacagtacccgttgaaatgatgcaggcccgcacatacccactcaggtggtttcttctggagcagccagaaattcaggtggcccacttccccttcaaaaataacatgtcctttgtcgtgctggtgcccacccactttgaatggaatgttagtcaggttctggccaacctgagctgggacaccctccacccccccctggtttgggagcggcccacaaaggtgagactcccaaagttgtatctgaagcaccagatggatctcgtggccacactgagtcagcttggtttacaggaactattccaggctcccgatctgcggggaatatcagagcagagccttgtggtgtcaggagtacaacaccagagcacactcgagctcagcgaggtgggggtggaggcagcagctgcgacctccattgcgatgtctagaatgtcattgagcagcttctccgtgaacagaccatttctctttttcatctttgaggatacaacagggttgccactgtttgttggctctgttaggaaccccaatccatccgccccccgcgagctgaaggagcagcaggacagccctggcaacaaggactttctacaatctctcaaaggctttcctcggggagataagttgtttgggcctgatctcaagctcgtcccacccatggaagaagattacccccagttcggcagtcctaag

SEQ ID NO: 19069 - DNA, 1473 bp, Artificial Sequence
  Description of Artificial Sequence: Synthetic coding sequence
atggcgctgctgtggggcttactcgtgttatcgtggtcatgtttgcagggaccatgttctgtctttagccccgtgtctgcaatggagccattgggaaggcagttgaccagtggtcctaatcaggagcaagtcagtcccctgacattgctcaagcttggcaatcaagaacccgggggacaaaccgccttgaaatccccgcccggggtgtgctcccgtgaccctacaccggagcagacgcaccggttggcacgggctatgatggcattcaccgctgatttgttctctctggttgcacaaacttctacatgtccaaacctgatcctgagccccctgtccgtcgcattagccctttctcacctggccctcggtgcccagaaccataccctgcagcgattgcagcaggtgctgcacgcaggatcagggccttgcttaccccacctcctgagtcgcctgtgccaggacctggggcccggggcttttcgcctggccgctcggatgtatctgcagaaaggctttcccatcaaggaggactttctggaacagagcgaacaactgtttggagcgaagcctgtgtctctgactgggaaacaagaggatgacctggcaaacattaaccagtgggtcaaggaggcgactgagggtaagatccaggagttcctgagtggcctgccggaggataccgtgcttctgctcttgaacgccattcactttcaggggttttggagaaataagttcgatcccagcctaactcagagggattcatttcaccttgacgagcagtttaccgtgccagttgagatgatgcaggctcgcacttacccattgaggtggttcctcttggaacagcctgagatccaggttgcgcattttccatttaagaacaatatgtcattcgtcgtgctggttccaacccattttgagtggaacgttagccaagtgctggcaaacctcagctgggacacactccatccaccattagtttgggaacgacctaccaaggtacgtctccccaaattgtacctgaagcaccaaatggacttggtagcgactctgtcacagttagggctccaggaattgtttcaggctccagatctgaggggcatctccgagcagtcgctggttgtaagtggggttcaacaccagtcaaccctcgagttgtctgaagttggagtggaagcagccgccgctacaagtattgccatgtcccggatgtccctcagtagtttctccgtgaatcggccatttctgttctttatctttgaggatacgactggtctgcctctcttcgtgggaagtgtaagaaatccaaatccctcagcacccagagagctgaaagagcaacaggacagccccggcaacaaagattttctgcagtctctcaaggggttccctagaggagacaagttatttggcccggacctcaagctagtgcctcctatggaggaggattatccccagttcggttcccccaaa

SEQ ID NO: 19070 - DNA, 1473 bp, Artificial Sequence
  Description of Artificial Sequence: Synthetic coding sequence
atggcacttttgtggggacttttggtgttgagttggtcttgtttacaaggaccttgcagcgtgttttcacccgttagtgcaatggagcctttggggagacaactcacctcaggtccaaatcaggagcaagttagcccattgacgttgcttaagctgggtaatcaagagcctggggggcaaacagcattgaagagcccacctggcgtgtgctctcgcgatccaactccagagcagacgcacaggttagcgagagctatgatggctttcacagctgatttgttctctctggtggctcagacatctacctgcccaaatttgatcttgtctcctttatccgtcgctttggctctgtctcacctcgccttaggggcccaaaatcatacactccagcgtttgcaacaagtcttgcatgccgggagtggaccttgtttgcctcaccttctctctcgattatgccaagatttgggaccgggtgccttcagattggctgcacgaatgtatctgcagaagggcttccctattaaagaagattttcttgaacaatcggagcagctgtttggggccaaacctgtgtctctaacaggaaagcaagaggacgatctagctaacatcaatcagtgggtaaaagaagccacagaaggtaaaatccaggagtttttgtcgggtttgcccgaggatacagttctactactgcttaatgctattcattttcagggtttctggagaaataagtttgatccatctctcacccaacgtgatagttttcatttggatgagcaatttactgttcctgtcgagatgatgcaagctagaacatatccgctacgttggttccttcttgaacaaccagaaatccaggtagctcatttcccatttaaaaataatatgtcatttgttgttttagttcccacccacttcgagtggaatgtgtcacaagtgctcgccaatctctcttgggatactctccatccaccacttgtatgggagaggccaacaaaggttcgattgcctaaactctacctaaaacaccaaatggatctggtcgcaacattgagtcagctaggtcttcaagagctcttccaagcacccgatttgcgtggtatcagcgagcagtcacttgtcgtttcaggcgttcaacaccaatcgacccttgaattatctgaagttggtgttgaggctgcggcggcgacctcgatagcaatgtctcgcatgtccctgtcatctttcagcgtaaatcgtcctttcttgtttttcatctttgaagatacaaccggcttgccattgtttgtcggctctgttagaaatcctaaccctagcgcgccgcgggaactcaaagagcaacaagattctcccggaaacaaggattttcttcagagtctaaagggattcccgaggggcgataagttgttcggcccagacctgaaactcgtgccaccaatggaggaagattaccctcaatttggttcccctaag

SEQ ID NO: 19071 - DNA, 1473 bp, Artificial Sequence
  Description of Artificial Sequence: Synthetic coding sequence
atggctcttctctggggcctattagtgttgtcttggtcgtgcctgcagggaccatgttcggttttttctcctgtctctgcaatggagccactgggacgacaactgactagtgggccaaatcaggaacaagtctccccactcacgctcctaaagctgggtaatcaggagccagggggacaaacggcgctcaagtcaccgccaggcgtgtgtagtcgcgatcctacaccggaacagactcaccgcctggcccgtgccatgatggcattcaccgccgacctcttttcattagtcgcccaaacctcaacgtgccctaatcttatcttatccccactatcagtggcactagcgctctctcatttggccctgggtgctcaaaatcacacgctgcagaggctgcagcaagtgctgcatgctggaagtggtccatgcctgccacatttgttgagcaggctatgccaggatctgggtccaggcgcatttaggcttgccgcacgcatgtatctgcagaaaggtttcccaatcaaggaagatttcctcgagcagagcgagcagctctttggcgctaaaccagtgtctctcaccggaaaacaggaggatgatctggctaatataaaccagtgggtgaaggaggcgactgaaggcaagattcaggaattcctgtccggcttaccagaggatacggtgttgctcctgcttaacgctatccactttcagggcttctggcgaaataagttcgacccttcattaacacaaagagactcctttcacctggatgaacagtttactgttcccgtcgaaatgatgcaagccaggacctatccactccggtggtttctgctggagcagccagagatacaggtggcgcattttccatttaagaacaacatgtcctttgtggtgctggtgccaacacatttcgagtggaatgtgtctcaggtgctggccaacctctcctgggacacgctccacccacccttggtttgggagagacccacaaaggtccgtctgccaaagctttatctgaaacatcagatggacctcgtggcaactcttagccagttggggctacaggagctttttcaggcgcctgacctgagaggaatctcagagcagtctctcgtggtctcaggggttcagcatcagtccaccctcgagctgtccgaggtaggcgtggaagctgcggccgctacttcaatcgctatgagccggatgtccttgtcatccttcagcgtgaaccgaccgttcctattctttattttcgaggatacaacgggcttgccactcttcgtgggcagcgttagaaatcccaatccttccgccccacgcgagttaaaagaacagcaggatagtccgggaaataaggactttctgcagtccttgaaaggtttcccacgcggagacaaactgtttggtcctgatctcaagctggtgcctccaatggaggaggactatccacagttcggcagtccaaag

SEQ ID NO: 19072 - DNA, 1500 bp, Artificial Sequence
  Description of Artificial Sequence: Synthetic coding sequence
atggcttcaaggctcacgttgctgacactgttactacttttactggccggggacagggccagctctaacccaaacgccactagctcttcctcacaagacccagagtctctgcaggaccgcggggagggtaaggttgccaccaccgtaattagcaagatgctgttcgtggaaccaatccttgaggtgtcttcacttccaaccacaaatagcaccacgaattcagccaccaagatcactgcgaacacgaccgacgagcccacgactcagcctaccaccgagcctaccacccagcccaccatccaacctacccagccaacaacccagttaccaactgactctccaactcagcccactactggatccttttgtcctggcccagtcactctgtgcagcgacctggaatcacactcgaccgaagccgtgcttggcgacgctctggtagacttctcgttgaaactttaccatgctttttctgcgatgaagaaagtagagacaaacatggccttcagccccttctccatcgcatccctgcttactcaagtcttgctgggcgccggggaaaataccaagacgaacctagagtccatcctgagctatcccaaagattttacatgtgtgcatcaggcgttgaagggattcaccactaagggcgttacttccgtctcacagatctttcatagccccgatctcgcaatacgcgatacctttgtgaatgcatctcgcactttgtactcttcctctccaagagtgcttagcaacaacagtgacgccaacctggaactgattaacacatgggtagctaagaatactaataacaagatctctagactgctggattctctgccaagcgatacacggctcgtccttctgaacgctatctatctatcagcaaagtggaaaactacctttgatccaaaaaaaacccgcatggaacccttccatttcaagaatagtgtcataaaagtgcccatgatgaatagcaagaaatatcccgtcgcccacttcatcgatcagactcttaaagctaaggtagggcagctccagctgagccacaacctgagcctggtgatcttagtgccccagaaccttaagcatcggctcgaggacatggaacaagccctctctcctagcgtgttcaaagcaatcatggagaaactggaaatgtcaaagttccaacctacactgttaactctgccccggattaaagtaactacttctcaggacatgctgtcaatcatggaaaaactggaattcttcgacttttcctacgatctgaatctatgcggcctcaccgaggacccagacctacaggtttcagcgatgcagcaccaaactgttctcgaactgacagaaaccggtgtggaggcggccgctgcttcagccatcagcgtagccagaactctgctggtgtttgaagtccagcagcctttcttgtttgttttatgggatcagcagcataagtttcctgtgttcatgggccgcgtttacgatcctagagcc

SEQ ID NO: 19073 - DNA, 1500 bp, Artificial Sequence
  Description of Artificial Sequence: Synthetic coding sequence
atggcgagccgactcacattgctcaccttgctgctgctgttattggccggggaccgagccagctctaatccaaatgccacctcttcaagttcccaggatccagagagccttcaggaccgtggcgaggggaaggtcgctacaaccgtcatttcgaaaatgctgtttgttgaacctatccttgaggtcagttcactccctacaacaaactcgaccactaactcagcaaccaagatcaccgcaaacactaccgacgaacccaccacacagccgaccaccgaacccacaactcaacccactatccagcctactcaacctaccacccagctgcccacagattctcctacgcagcccactaccgggagcttctgcccaggacctgttacactttgcagcgatctggagagtcatagtaccgaggccgtgttgggcgacgccctggtagatttcagcctcaagctctaccacgcattcagcgctatgaaaaaagtggagaccaatatggccttcagccctttctcaatcgcctcattgctgactcaggtgctgctcggagcaggggagaacactaaaactaacttagagagcatcctctcttacccgaaggatttcacctgtgtccaccaggcgctgaaaggctttacaactaagggggtaacgagtgttagccagatctttcattcacctgatctggcaatcagagatacatttgtaaacgcatctcgaactctttacagcagcagtcccagggtgttaagcaacaatagcgacgcaaatctggagctgattaatacttgggtggcaaaaaataccaacaataagatcagccgattgctggactcattgcccagcgatactagactggttttactgaacgccatctacctgtcagctaaatggaagactacgttcgacccaaagaagacgcggatggaaccctttcatttcaaaaattctgtgatcaaagtgccaatgatgaactccaagaagtatccagtcgcgcacttcatagaccagaccctcaaggctaaggtgggccagctgcagctctcgcacaatctttcgttggttattcttgtgccacaaaatctgaagcaccgacttgaagacatggagcaagcattgtcaccgtcagtctttaaggctataatggagaagctggagatgtctaagttccaaccaactctgctgactttgcctaggatcaaggtgacaacctctcaggacatgctatccattatggagaagctagagttctttgacttttcgtatgatttgaatctctgtggtctgacagaagacccagacctgcaggtgtcagccatgcaacatcaaactgtcctggaactcaccgaaacaggagtggaggcagcagccgcctccgcaattagcgttgctagaactctgctggtctttgaagttcagcaaccgtttctcttcgttttatgggaccagcagcacaaatttcccgtgtttatgggtagggtttacgatcctcgagcc

SEQ ID NO: 19074 - DNA, 1500 bp, Artificial Sequence
  Description of Artificial Sequence: Synthetic coding sequence
atggcgtcccggcttaccctgttaaccctgctgctgttgctgctggccggcgacagggcatcctccaatcctaatgccacttcttcttctagccaggaccctgagtcgctccaggataggggggagggcaaggtggcgaccactgttatttcgaagatgctttttgtggagcctattcttgaggtctcgtccctgcccactaccaatagcacgacaaactccgccaccaaaattaccgctaacacgactgatgagccaaccactcagcctactactgagcccaccacccaaccaactatccagcccactcagcccacgacacagctgccgacagatagtccgacacagcccacgactggttcgttttgccccgggccagtgacgctatgttctgatctcgagtcacatagcaccgaagcagttctcggcgatgctctggtcgattttagtctcaaactctaccacgcgttctccgccatgaagaaagtcgagaccaatatggcattctcaccgttcagtatcgcttcactgctcacccaggttctgttgggagccggagagaacactaaaaccaacctggaatcaatcctctcctatcccaaggatttcacctgcgtgcaccaggcccttaaaggctttacaaccaagggggttacgtcagtgtcccagatatttcactcccctgatttggcaatcagggacaccttcgtgaacgcaagtagaaccctatatagctctagccctcgggtgcttagtaacaattctgacgcaaatcttgaactcattaacacctgggtcgctaagaataccaataataagataagcaggctcctggattctctcccttcagatactaggttggttctactgaacgccatttacttgtctgccaaatggaaaactacatttgatcccaaaaaaacccggatggaaccttttcactttaagaattccgtaataaaggtccccatgatgaactctaaaaagtatcctgtggcgcacttcatagatcaaaccctgaaagccaaggttgggcagctgcagctgagccacaacttgtctctggtaattttggtgcctcagaacctgaagcacaggctggaagatatggagcaggctctgtctccatccgtgttcaaagcaatcatggaaaagctcgaaatgtcgaaattccagccgaccttgttaactctccctcggatcaaggtcacgacttctcaagacatgcttagcataatggagaaactggaattcttcgacttcagctatgatcttaacttatgcggtttgaccgaagacccagatctgcaggtatccgccatgcaacatcagacggtcttagaactgacggagacaggggttgaggcggccgcggcatccgcaatttccgtggcgcgtactctgctggtctttgaagtgcagcaaccattcttgtttgtgctctgggaccagcagcacaagttccccgttttcatggggagggtttatgaccctcgagcc

SEQ ID NO: 19075 - DNA, 1500 bp, Artificial Sequence
  Description of Artificial Sequence: Synthetic coding sequence
atggcttcgcggctgacgctgctgaccctcctccttcttcttctggcaggagatagagcatcgagcaacccaaatgccacttcaagctcaagccaggatcctgagagccttcaagatcgaggtgagggaaaagtggccaccaccgtcatatccaagatgctcttcgtcgagccaatactcgaagtctcgtcacttcctacgaccaatagcactactaactcggccactaagattactgcgaatacgaccgatgagccaaccacccaaccgactactgaacctaccacccaacctaccatacaacctacccagccaaccacgcagctgccaactgattcgccgacccaacccaccactggctctttctgcccaggacctgtcactctttgttcggaccttgaatcgcactcgactgaagctgtgcttggtgatgcacttgtggatttcagccttaagctgtaccacgctttctctgcaatgaagaaggtggaaacgaacatggcctttagccctttttcaattgcatcgctcctcacccaagtgttgcttggagcaggtgagaacaccaagacgaacctggaatccattcttagctaccctaaagattttacctgtgtgcatcaagcacttaaagggtttaccaccaagggggtcactagcgtctcccagattttccactcccctgatttggcaatcagagatactttcgttaatgcatcaagaactttgtacagcagctcgccgagggtgttgagcaacaactcggatgcaaacctggagctgatcaatacgtgggttgcgaagaatactaacaataagatttcacggctgctcgactcgctgccctcagatactagactggtgctgctgaacgcaatttacctttccgcgaaatggaaaactacctttgatcctaaaaagacccgtatggaaccttttcatttcaaaaactccgtcataaaggtgcccatgatgaactcgaagaaataccctgtggcccatttcattgatcaaactcttaaggccaaagtcggccagcttcagctctcacataatctgtccctggtcattcttgtccctcagaaccttaagcaccgcctggaggatatggagcaggctctgtccccttcggtgtttaaggcaataatggaaaagctcgaaatgtccaagttccagcctacgctgcttacccttccgcgtattaaggtgaccacctctcaagatatgctttcaataatggagaagttggaattctttgacttttcgtacgacctgaatctgtgcggactcactgaagatccagacctccaagtgagcgccatgcaacatcagactgtcttggaattgaccgaaacgggagtggaggccgcagccgcctccgcaatctcagtggcccgcactcttctggtctttgaggtgcaacagccctttctgtttgtgctttgggatcaacagcacaagttcccggtgtttatgggacgggtctatgatccaagagcg

SEQ ID NO: 19076 - DNA, 1500 bp, Artificial Sequence
  Description of Artificial Sequence: Synthetic coding sequence
atggcgtcacggctcaccttgctgacgttgctgctcctgctgctggcaggtgaccgcgcaagctcaaatcctaatgccactagctcctcgagccaagacccggagtcgctccaagataggggcgaaggcaaggtggcgaccaccgtgatcagcaagatgctgttcgtggagcccattctggaagtgtccagcctgccgaccacgaactccaccactaactctgccactaagatcaccgctaacactacggatgaaccaacgacccaaccaacgactgaaccgaccacccagccaacgatccagccaacgcagccgaccacccaactccccacggatagccctacgcagcctactactggatcattctgcccgggaccggtcactctgtgtagcgacctggagtcacattcaaccgaggcggtcttgggtgatgcgctcgtggatttttcccttaagctgtaccacgcgttctccgcaatgaagaaggtcgagactaatatggcatttagcccattctcaatcgcctccctcctcactcaagtcctgctgggagccggcgagaataccaagactaacctggagagcatcctctcgtatccgaaggatttcacttgcgtgcaccaggccctgaaaggattcactactaagggagtcacttcggtgtcccagatctttcactccccggacctggccattcgcgatacttttgtgaacgcctcgcggaccctgtactcatcgagcccgcgtgtgctctcgaacaattcggatgccaatcttgaactcattaacacttgggtggcaaagaatactaacaacaagatttcccgcctgttggactcgttgccatcggacaccagactcgtgttgctgaatgctatctacctgtccgcaaagtggaaaaccaccttcgacccgaagaaaactcgcatggaaccgtttcactttaagaactcggtgattaaggtgccgatgatgaattcgaagaagtatccggtggcccacttcatcgatcagactttgaaggcgaaggtcggacaactgcagctgtcccacaacctgtcattggtgatcttggtgccacagaacttgaagcatagactcgaggacatggaacaggccctcagcccgtcggtgttcaaagcaatcatggaaaagctggagatgagcaaatttcagccgactctgctgactctgcccaggattaaagtgactacctcacaggatatgctgtccattatggagaagttggagttcttcgacttttcatacgacctcaatctctgcggactgaccgaggacccggaccttcaagtctccgcaatgcagcaccaaaccgtgctcgaactgaccgaaaccggtgtggaggctgctgcggcgtccgccatctccgtggcgagaaccctcctcgtgtttgaggttcagcagccattcctgttcgtgttgtgggatcaacaacacaaattcccagtgttcatgggccgcgtgtacgacccgcgggcg

SEQ ID NO: 19077 - DNA, 1500 bp, Artificial Sequence
  Description of Artificial Sequence: Synthetic coding sequence
atggcctcaagattaacactgctgactctattattgctgctgctcgctggcgaccgggcttcatccaatcccaacgctacctctagtagttcacaagaccccgaaagtctgcaggacaggggagagggtaaggtggccaccacggtaatctcaaagatgctgttcgtggaacccattcttgaggttagcagtctccctacaacgaatagcacaactaactccgctacaaaaatcactgctaatacaactgatgaaccgacaacccagccaactactgaacctacaacccagccaactatccagccaacgcaacctaccacccaactcccaacagacagccccacccagcctactacaggcagcttctgccctggtcctgttactctctgttccgatttggagtcccatagcacagaggcggtgcttggggacgcattggtcgactttagccttaagctgtatcatgcattcagtgcaatgaaaaaagtcgaaacaaatatggccttttccccattttccatcgcatcgctgttgacacaggtgctcctcggcgcaggggagaataccaagaccaatctcgagtccatcctcagctatccaaaagacttcacatgcgtacaccaggcccttaaaggcttcacaaccaagggcgtgactagcgtgtcccaaatcttccactcccccgatctcgctattcgagacaccttcgtcaacgcgtccaggactctgtactccagctccccaagagtgctctccaacaattcagacgcaaacctagaactgattaacacatgggtcgccaagaataccaacaataaaatcagcagactactagactctctcccctctgatactagacttgtgttactgaatgctatatacctatccgccaagtggaaaacgactttcgaccctaagaaaactaggatggagccctttcacttcaagaattccgtcatcaaagtgcccatgatgaacagcaagaagtaccccgttgcccacttcatagatcagacactgaaggcaaaggtcggccagctacagctttctcataacctctccctcgtgattcttgtcccccagaatctgaagcaccgcttggaggatatggagcaggccctgagcccgagtgtgtttaaggctataatggagaaactggagatgtctaagttccagccgaccctgctgaccctgccacgcattaaggtcaccaccagccaggacatgctctctattatggaaaaactcgagtttttcgatttcagttacgacctgaacctctgtggactaacagaggacccggaccttcaggtgtctgcaatgcagcatcaaacagtactcgagctgaccgaaaccggcgtggaagcagccgctgcctcggccatttcagttgccaggactctcctagtgttcgaagtgcagcagcccttcttgttcgtgctgtgggatcagcagcacaaatttccagtgttcatgggaagagtgtatgatcctagggcg

SEQ ID NO: 19078 - DNA, 1500 bp, Artificial Sequence
  Description of Artificial Sequence: Synthetic coding sequence
atggcctcaaggttgacactccttactctgctcctcctgctcctggctggagacagggcctcttcaaacccaaacgcgacatcgtctagttcacaggatcctgagagcttgcaggatcgaggtgaaggcaaggtcgccactaccgttatctccaagatgctttttgtcgaaccaatcctagaagtgtcctctttgccaaccacaaacagcacaacaaattcggctaccaagattaccgctaacacgacagacgaaccgacaacccagcctaccactgagcccaccacccagccaacaattcagcctacccagccaacaacgcagctgccaactgacagtcccacacagcccaccacaggcagcttctgccccgggccagtaaccctatgcagcgaccttgagagtcactccactgaagccgtgctcggagatgctctggtagatttctcgctgaagctctatcatgctttttcggccatgaagaaagtagaaacgaatatggccttctcccctttttccattgcctcgcttctgacgcaggtgctgctcggagctggagagaacaccaaaactaatctcgagtctatcttgagttaccccaaggactttacatgtgtccatcaggccctgaagggcttcactacaaaaggagttacctcagtcagccagattttccactccccggacctggcgatcagggacacttttgttaacgctagcaggacgctgtattcaagtagcccccgggtcctgagtaacaacagtgacgccaacctggagctgatcaatacatgggtcgccaagaacactaataacaagatttccaggttactggactctctccccagtgatacgcgtctggtgctactgaacgcaatttacttgagcgcgaagtggaagacaactttcgaccctaagaaaacaagaatggaaccatttcacttcaagaattcggtcattaaagtgccaatgatgaacagcaaaaagtaccccgtggctcacttcatagaccagactttaaaggctaaggtagggcagctgcagctttctcacaatttaagcttagtgatccttgtgccccaaaaccttaagcatagacttgaggatatggaacaggctctctcaccttccgtgttcaaagccataatggagaagctggagatgagtaaatttcagccaactttactcaccctgcccagaattaaggtgaccacgtctcaggacatgttatccattatggaaaagttagaatttttcgatttttcatacgacttgaacctttgtggcctgactgaggatcctgatctgcaggtgtccgctatgcagcatcagaccgtgctcgaacttactgagaccggggttgaggcagcagcagcttctgcaatttccgtcgcccggacactgttagtgtttgaggtgcagcagcctttcctgtttgtgttgtgggatcagcaacacaaattccccgttttcatgggtcgcgtgtacgatccacgtgct

SEQ ID NO: 19079 - DNA, 1500 bp, Artificial Sequence
  Description of Artificial Sequence: Synthetic coding sequence
atggcaagccgtctcaccctccttacgttgctgcttctgctgcttgctggggatcgggcttcctcaaaccctaacgcgacgagctctagcagccaggacccagaatccttgcaagaccgcggagagggaaaagtggccacgactgttatcagcaagatgctcttcgttgaacctatcttggaagtatcgagcctcccaaccaccaacagcaccacgaacagcgctactaaaatcaccgcaaatactactgacgaaccgactacccagccaaccactgagcccactactcaaccaactattcagccgactcaaccaaccacgcagctgccaaccgacagccccacccaacccaccaccggttcgttttgccctggaccggtgactctgtgttctgatctggagtcacattcgactgaagcggtgcttggagatgccctggtggacttctcgctcaaactctaccatgcgttttcggccatgaagaaagtggagacgaatatggcattctccccattctcaatagcctcgctgctgacccaggtcctccttggagcaggcgaaaacaccaagaccaatctcgagtcgatcttgtcgtatccaaaggatttcacgtgcgtgcaccaagctctcaagggtttcactactaagggggtcacttcggtgtcgcaaatctttcattcgccggacctggcgattagagataccttcgtgaatgcctcccgcactctctactcatcctcacctcgagtgctttcaaataactccgatgcgaatctggaactcattaacacctgggtggcgaaaaacactaataacaagatctcccgtctgctggactcgttgccgtcggacactcggttggtcctcctcaacgcaatttacttgtccgctaagtggaaaactaccttcgaccctaagaaaacgcggatggagccgttccacttcaagaacagcgtcatcaaagtccctatgatgaactccaaaaagtacccggtcgctcatttcatcgaccagactctgaaagcgaaagtcgggcaactgcagctgtcacacaatctctccctggtgatcctggtcccgcagaaccttaaacacaggctggaggacatggagcaggccctgagcccgtcggtctttaaggcaataatggagaagctcgaaatgtcgaagttccagccaactctgcttaccttgcctcgcatcaaggtgaccacttcgcaagacatgctctccatcatggaaaagttggagtttttcgacttttcgtacgacctgaacctgtgcggactcaccgaagatcccgatctgcaggtgtcggcgatgcagcaccagaccgtgctcgagctgaccgaaacgggcgtggaggcggccgccgcctcggctatctcagtcgctcgcaccctcctggtttttgaagtgcagcagcctttcctgtttgtcctgtgggaccaacaacacaagttccccgtgttcatggggcgggtgtacgatcctagggcc

SEQ ID NO: 19080 - DNA, 1500 bp, Artificial Sequence
  Description of Artificial Sequence: Synthetic coding sequence
atggcttccaggctgactctgttaaccttgctgttgctgctgctggccggcgaccgcgcctcttccaacccaaacgcaaccagctcttcctcacaagatccagaatccctccaagatcgcggggaaggaaaggtagccaccacggtgatatctaagatgcttttcgttgagcctattctggaggtttcgagtctgcctactactaacagcactacaaacagcgcaacaaaaattaccgcgaatacgacagatgagcctaccacccaaccgaccactgagcctactacacaacctactattcagccaacccagccaaccactcagctgccaacagatagtccgacacagcctacaacaggtagcttctgccccggacccgtaactttatgtagtgatctagagagccattccaccgaggctgtgctgggcgatgccctggtggatttcagtctgaagctgtatcatgccttttcggccatgaagaaggtcgagaccaatatggcgtttagcccgttttcaatcgctagtctgctgactcaagtactgctgggggccggagaaaatacaaagacgaatctcgaatcaattctgtcgtacccaaaggatttcacgtgtgtgcaccaagctttgaagggatttacaacgaagggcgtgacatctgtgagtcagatatttcatagtccagatttggcgatcagagacactttcgtgaatgcttcccggacactctatagttcttcaccacgggttctgtcaaataattcagacgctaatctggagcttataaacacatgggttgccaaaaatactaataacaaaatatctcgcttgctggattcactgccttctgacacccgcttggtgctgctaaatgccatctatctgtccgcaaagtggaagacgactttcgaccctaagaagacccgtatggagccattccacttcaaaaacagtgtcatcaaggttcccatgatgaatagcaagaagtatccagtggcacattttattgatcagactttgaaagctaaggtggggcagttgcagctctcccataatttgtcactggtcatcctggttcctcagaatttgaaacaccggttggaggacatggagcaggccctcagtccatcagtattcaaagccatcatggagaaactcgagatgtcaaagttccagcccacccttttaaccctgccccgcattaaagtgaccaccagccaggacatgctgagcatcatggaaaagctcgaatttttcgacttctcgtacgatcttaatctgtgcgggctgacagaagacccagacctgcaggtaagtgcaatgcagcatcagacagtgctggaactcaccgaaactggtgtggaggccgcagcagcaagcgctatttcagtcgcaaggactctgctcgtcttcgaagtccagcaaccatttcttttcgttctgtgggaccagcagcataagttccccgtattcatgggcagagtctacgatccccgcgcc

SEQ ID NO: 19081 - DNA, 1500 bp, Artificial Sequence
  Description of Artificial Sequence: Synthetic coding sequence
atggcctcaagattgaccttgctgacgctgctgctgcttcttctggccggcgatagagcatcgtcgaacccaaatgcaacctcctcgtcgagccaggaccctgaaagcctgcaagacaggggagaaggtaaggtggcaactactgtgatctccaagatgctgtttgtcgaaccaattctcgaagtgtcgtcgctgcccactactaattccactactaactccgctaccaagatcactgctaacaccactgatgaaccaactacccaaccaaccacggaacccaccactcaaccaaccattcagccaactcagcctactacccagcttcctaccgattcaccgactcagcctaccaccggatccttttgtcccggacctgtgactctctgctccgatcttgagtcgcactctactgaggcagtgcttggcgatgcccttgtggacttctcgctgaaactctaccatgctttttccgcaatgaagaaggtggagactaatatggccttttcaccattttcgatagcatcactgctcacgcaagttctgctgggcgccggagaaaacaccaaaactaaccttgagtctattctttcttaccctaaggatttcacttgtgtgcatcaggcacttaagggttttactactaagggcgtcaccagcgtgtcccagatattccactcccccgaccttgcaattcgtgatactttcgtgaacgcatcgcgaaccctttactcgagcagccctagggtgctttcgaataactcggacgcaaatctggaactgatcaacacgtgggtcgcaaagaatacgaataacaagatcagcaggcttctggatagtctcccttcagatacccggcttgtgctccttaacgcaatttacctttctgccaagtggaaaaccacctttgaccctaagaaaacccggatggaaccatttcactttaagaactctgtgataaaagtgccaatgatgaatagcaagaagtaccctgtggcacactttatcgatcagactcttaaagcaaaagtgggtcagcttcagctgagccataatctttcattggtcattcttgtcccgcaaaatcttaagcatcgacttgaggatatggaacaggctctgtcgccctcggtgttcaaggctattatggaaaagctggagatgtcgaaatttcagccaaccctgctcaccctgccgcggatcaaggtgaccacctcgcaagatatgctctcaattatggagaagctggagtttttcgacttttcctacgatctgaatctgtgtggtctgaccgaagatcctgatcttcaagtctcagcgatgcagcatcaaaccgtgctggaactgaccgaaaccggcgtggaggcggccgctgcttcagcaatttcggtggcaagaaccttgctcgtattcgaggtgcagcagccatttctttttgtgctctgggatcaacaacataagttcccagtctttatggggagagtctacgatcctagagct

SEQ ID NO: 19082 - DNA, 1500 bp, Artificial Sequence
  Description of Artificial Sequence: Synthetic coding sequence
atggcaagccgcctcaccctgctgactctcctgctgctgctgctcgctggagacagagcctcctcaaacccgaatgcaaccagctcgtccagccaagacccggaatcgcttcaagaccggggcgaaggaaaggtggccaccactgtgatctccaaaatgctcttcgtcgaacctatcctcgaggtgtcatcacttcctaccaccaactcaaccaccaactccgcaactaagatcaccgccaatactacggacgaaccgacgacccagccgacgactgaaccaactactcagccgaccatccagccgactcagccgactacccagctccctactgattccccaactcaaccgaccaccgggtccttctgccctggaccggtgaccctgtgtagcgatcttgaatcgcactcgaccgaggccgtcttgggagatgcgctggtcgacttttcccttaaactctaccatgccttctccgctatgaaaaaggtagaaaccaatatggcattctcccccttctcaatcgcgtcactgctgactcaggtgctgctcggagcgggcgaaaatactaagactaacctggagtcgatcctgtcctacccaaaggacttcacgtgcgtccatcaggcactcaaaggatttactactaagggcgtgacttccgtctcgcagatctttcacagcccggatctggcaattcgggacacctttgtgaacgcctcccgtaccctgtacagtagctccccgcgggtgctctccaacaattcggacgccaatctggaactgatcaacacctgggtggcaaagaacaccaacaacaagatttcacgcttgttggactccctgccgtccgatactcgcctggtgctgctgaacgccatctatttgagcgccaagtggaaaaccacgtttgacccaaaaaagacccgtatggaacctttccacttcaagaactcggtcatcaaagtgccgatgatgaactctaagaaataccccgtcgcgcatttcatcgaccaaaccctgaaggccaaggtgggacagctccagctcagccataatctctcactggtgatcctggtgccgcagaacctgaagcatcgcctggaggatatggagcaggccctgtcgccttccgtctttaaggccatcatggaaaagctggaaatgtccaaattccagccaacgctgctgaccctgcctagaatcaaggtcaccacttcccaggacatgctttcgatcatggagaaacttgaattcttcgacttctcgtacgatctgaacttgtgtggactgactgaagatcccgacctccaggtgtcagcaatgcaacaccaaaccgtgctggaactcactgagacgggagtggaagcggctgccgcctccgcgatctcagttgcccgcacccttctcgtgtttgaagtccaacagccgtttctgttcgtgctctgggaccagcaacacaagttccccgtctttatgggccgggtgtacgacccccgcgct

SEQ ID NO: 19083 - DNA, 1500 bp, Artificial Sequence
  Description of Artificial Sequence: Synthetic coding sequence
atggcctcacgcctgactctgttgacccttctcctgctgctgctggccggcgatagggcatcatctaaccctaatgcaactagttcctcaagccaagaccccgagagtctgcaggatagaggcgagggtaaagtcgccacgaccgttatctccaagatgctctttgtggaacccatcctcgaagtatcctcattaccaactacaaattcgactactaactctgccaccaaaattaccgccaatacgacagatgagcccactacccagcctacaactgagccaaccacccagcctaccattcagcctactcagcccactacacagcttcccacggactccccgacgcagcctacgaccgggagcttttgtcccggacctgtgaccctgtgctcagatctggaatcacactccaccgaggcagtactgggagatgcgcttgttgatttttctcttaaactgtaccacgccttctctgctatgaaaaaggtggagactaatatggccttctcgcccttttcaatagcttccttgctgacacaggtcctactgggtgccggcgagaataccaaaacaaatctggagtctatcctttcctatcccaaggacttcacttgcgtgcaccaggcactcaagggcttcacgacaaagggagtcacgagcgtgtctcagatctttcacagtcctgatttagctatccgcgacacctttgtgaacgcatcacggacactttactcctccagccccagagtgctgagcaacaatagtgacgccaatcttgagcttatcaatacctgggtggccaagaacaccaataataaaatcagcagactgctcgactcactgccctcggataccagattggtactccttaatgctatctatttgagcgcaaagtggaagacgacattcgaccccaaaaaaacacggatggagccttttcactttaagaattcagtaattaaagttcctatgatgaatagtaaaaagtatccagttgcgcatttcatcgaccaaacgcttaaggccaaggtgggccaactccaactctcacacaatttaagtctggtgatattggttcctcagaacctgaagcaccgcctggaggatatggagcaggcattatctccgagtgtgttcaaggcgattatggagaagctggaaatgtctaagttccagcccactctactgacccttccccggatcaaggtgacaacaagccaggacatgttgtccataatggaaaagctagagttctttgacttctcatatgatctgaacctgtgcgggcttaccgaggacccggatcttcaggtgtccgccatgcaacatcagacggttttggagttgaccgaaaccggcgtggaggcagccgcagccagcgcaattagtgtggctagaacactcttggtgttcgaggtgcagcaaccttttctgtttgtactgtgggaccagcaacacaaattccctgtcttcatgggtagagtttacgaccccagagcc

SEQ ID NO: 19084 - DNA, 1500 bp, Artificial Sequence
  Description of Artificial Sequence: Synthetic coding sequence
atggcaagtcgactcacattgcttaccctacttctgctgttgttggctggcgacagagccagctcaaatcctaatgccacaagcagctcaagccaggatcccgagtccttgcaggaccgcggggaaggcaaggtggccacgacagtgataagtaagatgctctttgtggaacccatcctcgaagttagtagcttaccaaccactaacagcacaacgaattccgcaacaaagatcaccgccaacacaacagatgagccaacgacacagccgaccacagagcccacaacccagccgacgatccagcccacccagcctaccacccagctgccaaccgattcacccactcagccaactacgggctccttctgtccaggccctgtgacgctctgctctgacttggaatctcacagcacagaggcggtgcttggggatgcactggtggacttttctctgaaattgtatcacgcattcagcgccatgaagaaagtggaaactaatatggcattctctcctttcagtattgcctccctgcttacccaagtgctgctcggcgctggggagaatactaaaactaatctggagagcatcctgtcctatcctaaagacttcacgtgcgtgcaccaggcactcaaggggtttactacaaaaggagtgacttctgtgagccagatcttccacagtcccgacctcgctatccgggatacctttgttaacgccagtcggacgttgtacagcagttcccccagagtgctgtctaacaactctgatgctaacctggaactgatcaacacttgggtggccaagaataccaataacaagatttccaggctgctggactctttgcctagcgacacacgcttagtgctgctgaacgccatatacctgtctgccaaatggaagactacctttgacccaaagaagactcgcatggagccatttcacttcaagaactcagtgattaaggtgcctatgatgaattctaagaagtaccccgtggcacacttcatcgaccagaccttaaaggccaaagtaggccagcttcagctgtcccacaatctgagtttggtcatactggttccacagaatctaaagcaccggctagaggacatggagcaggctctgtctcctagtgtgtttaaggccattatggaaaagctggagatgagcaagtttcagcctaccctcctgacactgccaaggattaaagtcaccacatcacaggatatgctgagtattatggagaaactggagttcttcgatttttcttacgacctgaacctctgtggacttacagaggatcctgatttgcaggtgtccgctatgcagcatcagactgtgctggagttaaccgagactggagttgaggcagcagctgcatccgcgatatcagtggcaaggactttgctcgttttcgaggtacaacagccttttctcttcgtgttgtgggatcagcaacataagttcccagtgttcatgggacgggtctatgacccccgagcg

SEQ ID NO: 19085 - DNA, 1500 bp, Artificial Sequence
  Description of Artificial Sequence: Synthetic coding sequence
atggcatcaagactgactcttcttacccttctgctgctgctgcttgcaggagatcgcgctagttccaatcccaacgccactagctcttcttcgcaggacccggaatcactgcaagatcgaggagagggtaaggtggcgaccaccgtgatatctaagatgttgttcgtagagcctattctggaagtgtcgtcgcttcccacgactaatagcacgaccaattctgccacgaagattacggcaaataccaccgatgaaccaactacccaacctactaccgaacctactactcagcctactatccaaccaactcagcccacgactcaactgccgacggatagtcctactcaaccaacgacgggttcattttgcccagggcccgtgacgctttgttcggatcttgaatcacatagtactgaagccgtcctgggcgatgcacttgtggattttagccttaagttgtaccatgcattttcggctatgaagaaggttgagacgaacatggcgttcagcccttttagcattgcatcactcttgacgcaagtgctcctcggcgcaggggaaaacaccaagactaaccttgaatcgattctgtcgtacccaaaggactttacctgtgtgcatcaggccctgaagggttttacgacgaagggagtcacctcggtgtcccaaatcttccactccccagaccttgcaatccgtgacactttcgtgaatgcatctcggaccttgtatagctcgtcgccacgggtgcttagcaacaacagcgatgcaaaccttgaattgattaacacctgggtcgcaaaaaacaccaacaacaagatctcgagactgctcgactctcttccctccgacactcgcctcgtgctgctcaacgctatttacctgtcagctaagtggaaaactacctttgatccgaaaaagaccaggatggagccattccatttcaaaaactccgtcataaaagtcccaatgatgaattccaaaaagtacccggtggcccatttcatcgaccagactctgaaggcaaaggtggggcaactgcaactgtcacacaaccttagccttgtcatcttggtcccacagaatcttaaacacagattggaggatatggagcaggccttgtccccttcagtgttcaaggccattatggagaagctggaaatgtcgaagtttcaacctaccctgctgaccctgccccggatcaaggttactacttcgcaagatatgcttagcatcatggaaaaacttgagttttttgatttctcatacgacctcaatctgtgtggactgactgaagatcctgatttgcaagtgtcagcaatgcagcatcagaccgtgctggaacttaccgaaaccggcgtcgaggcagccgcagcaagcgcaatttccgtcgctaggacgctcctggtgtttgaggtgcagcagccatttctcttcgtgctgtgggatcaacaacacaaatttccagttttcatgggacgggtgtacgaccctagagca

SEQ ID NO: 19086 - DNA, 1500 bp, Artificial Sequence
  Description of Artificial Sequence: Synthetic coding sequence
atggccagcaggcttacgctcttgaccttgctgttgctactccttgccggagatagggctagctctaaccctaacgcaacctcatcttcaagccaggatcccgagtctttacaggatagaggcgaaggaaaggtcgccacaactgtgatatccaaaatgctctttgtagaacctatactggaagtgtccagcctgccaaccactaactcaactacaaatagtgcaactaagatcacagccaacacgacggatgagcctacgacccagccaaccaccgagcccacaacacagccaacgatccaacccactcagcccaccactcagctgcccacagattctcccactcagcccactaccggctcattctgcccaggccccgtgacactgtgttccgatttagagtctcactcaacggaggctgtgcttggggatgctttggtcgatttttcgcttaaattgtatcacgcatttagcgccatgaaaaaggtggagacaaatatggccttcagtccattttccattgcgtcccttctcacccaggtgttactgggggcaggagagaacacaaaaacaaacctcgagtctatactttcgtatccaaaggactttacgtgtgtacatcaggccttaaaggggtttactaccaaaggcgtgacatctgtttcacagatttttcatagccccgatctcgcaatcagagatacattcgtgaacgccagtagaacactctactcttcttcacctcgggtgctctccaacaacagtgacgccaacttggaactaattaacacctgggtggctaagaacacaaataataagatatccagactcctggacagtctcccatctgataccaggttggtgctgctgaacgcgatctatctatcagccaaatggaagacaacattcgacccaaagaaaacccggatggagccattccactttaagaacagtgtgattaaggtaccaatgatgaatagtaaaaagtacccggttgcccatttcatcgatcaaacactgaaagcaaaagtgggtcagttgcagttgtctcacaatctgagcctggtgatccttgtgccacagaatctcaagcatagactcgaagacatggaacaggccctgtcaccctccgtctttaaagcaattatggagaagctagaaatgtctaagttccagccaactctcttgacactccctcggatcaaagtgaccacttctcaggacatgctcagcattatggaaaagctcgagtttttcgacttttcatatgacctcaacctctgcggattgacggaggacccagacctacaagtctctgccatgcagcaccagaccgtgctggagctgactgagaccggggtcgaagctgctgctgcatcagcgatttcagtcgcccggacccttttagtctttgaggttcagcagccattcctgtttgtgctctgggaccagcagcataaatttccggtgttcatgggacgagtctacgacccaagagca

SEQ ID NO: 19087 - DNA, 1500 bp, Artificial Sequence
  Description of Artificial Sequence: Synthetic coding sequence
atggcctctcgactcaccctgctcactcttctgctgttgctcttggcgggagatagagcgtccagtaaccccaatgccacttcttcctcctctcaggatcccgagtccctccaggaccggggggagggcaaggtggcaacaactgtcatatccaaaatgctcttcgtggaacccatcctcgaagttagctctctccccacaaccaactctactaccaacagtgcaacaaagattacggcgaacactacagatgagccaacaactcagccgactacagaaccaactacccagccaaccattcagcccacacagcctaccactcagctcccaactgactcccccactcagccgacaactggaagcttctgcccaggccctgtaaccctgtgttccgatctggagtcgcattctaccgaggccgtgctaggggacgccctggtggacttttctctgaagttgtatcacgcatttagcgccatgaaaaaggtggaaacaaacatggccttttcccctttctcaattgcatccctattaacgcaagtcctactgggtgccggggaaaacactaagaccaacctggagagcattctgagctatcccaaagacttcacgtgcgttcaccaggctctaaaaggcttcacgactaagggagttacttctgtgagtcaaattttccattccccagaccttgccatccgcgacacattcgtcaatgcaagtcgcactctgtactcctcatcacccagggttctgtccaacaacagcgatgccaatctggagctgattaacacgtgggttgcaaagaacacaaacaacaagatttcacgcctcctagatagccttccgtccgacacacggctagtgctgttaaacgcaatatacctgtccgcaaaatggaaaaccactttcgacccaaaaaagacccgcatggagcctttccacttcaagaacagtgttatcaaagtaccaatgatgaatagcaaaaagtaccctgtggcccactttatagaccagacgcttaaggctaaggtagggcagttacagttaagccacaatttgagcctcgttatcttggtgcctcagaacctgaaacaccggctggaagatatggaacaggccctgagcccctcagtttttaaggcgatcatggagaagctcgagatgagtaagtttcagcctaccctgttgactttgccgaggataaaggtcaccacatctcaggatatgctcagcattatggagaagcttgagttctttgatttttcttacgacctaaatctctgcggccttactgaggacccagatctacaggtcagtgcaatgcagcaccaaacagttttagaactgactgagacaggagtggaggctgcagcagcatctgctatcagtgttgcgcggaccttgctcgttttcgaggtgcagcagcccttcctgtttgtgttgtgggaccaacagcataagtttcccgttttcatgggccgagtctacgatccgcgagca

SEQ ID NO: 19088 - DNA, 1500 bp, Artificial Sequence
  Description of Artificial Sequence: Synthetic coding sequence
atggcctcgcgactgaccttgctgaccctcctcctcctgcttctcgctggagatagagcctcgagcaacccgaatgcgaccagctcttcgtcgcaggacccggaatcgctgcaggatcgtggagaagggaaagtggcaaccaccgtgatatcgaagatgttgtttgtggagccaattctcgaagtgtcgtccctcccaaccactaactcgaccacgaacagcgctacgaaaatcaccgccaatacgaccgacgaaccgaccactcaaccaactactgagccaactacccagccgactatccaaccgacgcagccaacgacccaactccccactgatagcccgacccagcctactaccggatccttctgtccggggccagtgaccctgtgctcagaccttgagtcccattccaccgaagctgttctcggtgacgccctggtggacttctcgctgaagctctaccacgcattttccgcgatgaagaaggtcgaaaccaacatggcattctccccgtttagcatcgcgtccctgcttacccaggtgctgctcggcgcaggagagaacaccaaaaccaacctcgagtcgattctgtcctaccctaaggatttcacttgcgttcaccaagctctgaagggatttacgaccaagggagtgacgagcgtgtctcagattttccattcgccagacctggccattcgcgatacctttgtcaacgcctccaggactctttactcctcctcgccgcgcgtgctgtctaacaatagtgacgctaatctggagctcattaacacctgggtggccaaaaacacgaacaataagatctcacggcttctcgactcactcccgtcagacactaggctggtcctgttgaacgctatctacctgtcggccaagtggaaaactaccttcgacccgaagaaaacccgcatggagccgttccacttcaaaaactccgttatcaaggtcccgatgatgaacagcaagaaatacccggtggcgcacttcatcgaccaaacccttaaggccaaagtgggacaactgcagctcagtcataacctgtccctcgtgatcttggtgccacaaaacctgaaacaccggctggaggatatggaacaggcgctctcgccaagcgtgtttaaggcaatcatggaaaaactggaaatgtcaaaattccagccgactctcctcacgctgccccggatcaaggtcacgactagccaggacatgctgtccattatggagaaactggagttcttcgactttagctacgacctgaacctgtgcggactgaccgaagatccggacctgcaagtctcggcgatgcaacatcagaccgtgttggagctgaccgaaaccggggtggaagcggctgccgcgtcagccatctccgttgctcggaccttgctcgtgtttgaggtgcagcaacctttcctgttcgtcctttgggaccagcagcacaaattcccggtgtttatgggccgggtctacgacccgcgcgcc

SEQ ID NO: 19089 - DNA, 1500 bp, Artificial Sequence
  Description of Artificial Sequence: Synthetic coding sequence
atggccagcaggcttacactcttaacgctcttgcttctcttgctcgctggagatcgcgcttcgagcaaccctaacgcgacgagctcctccagccaggacccggagtccctgcaggatcggggcgaaggtaaggtggccaccaccgttattagtaagatgctgtttgtggagcctatcttggaggtctcctcactccctacgacgaatagtaccaccaactctgctaccaagataaccgcgaacacaaccgatgaacccacgacccagcctaccaccgagcctactactcagcccacaatccagccgacacaacctactactcagcttcccaccgatagtcccactcaacctactactggatctttctgcccggggccggtcaccctgtgctcggatttggagtcccacagcacagaggcggtactgggtgatgcactcgtcgatttcagtctgaagctgtatcatgcattctcggccatgaaaaaggttgagactaacatggctttttcccctttcagcattgccagcctgctgacacaggtacttttgggtgcgggagagaacaccaagactaacctcgagtcgatcctttcctatccgaaggacttcacctgcgtccaccaggcgctgaagggcttcacgacaaagggggtgaccagcgtctctcagatctttcactcgcccgaccttgccatccgggatacgtttgtgaacgcctcccgtacgctgtactccagctctccgcgcgttctgtccaacaactcagatgccaatctggagctcattaatacttgggtcgcaaaaaacaccaacaataaaattagtcgcttgttggatagcctgcccagtgacacccgtctcgtcctgctgaatgctatttacctctctgccaagtggaagaccacgtttgatcccaagaaaactcggatggagcccttccacttcaagaatagcgtgataaaggtacctatgatgaactccaagaagtacccggtggcgcattttatcgaccagacccttaaggccaaggtgggacaactccagctgagccacaacttgtctctggtcattctagtccctcaaaaccttaaacaccgtcttgaggatatggagcaggccctctctccaagtgttttcaaggccattatggaaaagctggaaatgtcgaagttccagccgacgcttctaaccctgccccgtatcaaagtcactacctcacaggacatgctgtccatcatggagaagctggaatttttcgacttttcgtatgatctcaatctctgcgggcttaccgaggaccctgatctgcaggttagcgctatgcaacaccagaccgtgcttgagctgaccgaaacaggcgtcgaagccgcggcggcgtccgccatctccgtcgcccgcactttgctcgttttcgaggtccagcagcccttcctctttgtgctctgggaccaacagcacaagttcccggtcttcatgggcagggtctacgatcctagggcg

SEQ ID NO: 19090 - DNA, 1500 bp, Artificial Sequence
  Description of Artificial Sequence: Synthetic coding sequence
atggctagtcgtctgacccttttgactctcctgctcctgctgttggccggggaccgagcttcgagcaaccctaatgcaacgagctcctctagtcaagaccccgagtccctacaggataggggtgaaggtaaggtggcaactactgtgatctctaagatgctcttcgtggaacccattcttgaggtgtcctccctcccgaccacaaattctactacaaattctgccaccaaaattactgcgaataccactgatgagcctaccactcagcccactacggagcctaccacccagcccacaatacaacccacacaacccacgacccagctacccacagatagcccaacccagcccaccaccggaagtttctgtccagggccggtgactctttgcagcgatctagaatctcactccaccgaagccgttctgggcgacgctcttgtggatttctccctgaaactgtaccacgcctttagcgccatgaagaaggtggagacaaacatggcattctcgcctttctcaatcgcatccctcctgacccaggtgctcctgggtgccggggaaaataccaaaaccaatctggagagtatcctgagctaccctaaagactttacgtgcgtgcaccaggctctaaagggcttcaccactaagggtgtcacaagtgtttcacagatctttcattctccggatctggccattagggatacatttgtcaatgcatctagaacgttgtactcaagtagcccgcgggtgctgtccaataactccgatgccaatctggagcttatcaacacgtgggtagccaaaaacaccaacaataagatctcccggctcctggattcattgccatccgacactcgcctcgtgctgctgaatgctatttacctcagtgctaaatggaagactacatttgacccaaaaaagacacgcatggagccatttcattttaagaacagtgtcataaaggtcccgatgatgaattcaaagaagtaccctgttgcacacttcattgatcagacattgaaagccaaagtcggacagttgcagctttctcacaatctttccttggtgattctggtgccccagaacctgaagcacaggctagaggatatggagcaggctctgtcaccatcagttttcaaggcgatcatggagaagctcgaaatgtctaagttccaaccaacattgcttacactaccaaggattaaggttaccactagccaagatatgctctccataatggagaagcttgagttctttgacttcagttatgatctgaacttgtgtggcttgaccgaagatcccgacttgcaggtatcagcaatgcagcatcaaactgtgctggagttgacggagaccggagtcgaagcagctgccgcctccgccatttccgtggcgcgcacccttctggtattcgaggtacagcagccatttctattcgtgttatgggatcaacagcacaagttccccgtctttatggggcgcgtgtatgaccccagagca

SEQ ID NO: 19091 - DNA, 1500 bp, Artificial Sequence
  Description of Artificial Sequence: Synthetic coding sequence
atggcctcacggctgactttgctgacgctgcttctgctgttgctcgctggagacagggcgagctcaaaccccaatgcaacttcgtccagcagccaggacccagagtcactgcaggaccgcggagaggggaaggtggccaccaccgttatctcaaagatgctgttcgtggagcccattctggaggtgtcatcgcttccgaccaccaactcgactaccaattcggctactaagatcaccgccaacaccactgacgagccgacgactcagccgacgactgaacccaccacccagccgactatccagccgacgcaacccaccactcaactgccaaccgactctccgactcaaccaacgactggatctttttgcccaggaccagtgactttgtgctcggacctggaatcacatagcaccgaggctgtgctcggtgacgccttggttgatttttccctgaagctgtaccatgcattttccgccatgaagaaagtcgagactaacatggcgttctccccgttctctattgcatcactgctgactcaggtcttgctgggcgctggagagaatacgaagactaacctggagtccatcctctcgtaccccaaggacttcacttgtgtgcatcaagccctcaaaggtttcactaccaagggtgtcacctccgtttcacagatttttcactcaccagacctggccatccgggatacgttcgttaatgccagccgcactctgtattcttcgtcccctcgagtcctttccaacaactctgatgcaaatcttgaactcatcaatacctgggtggcgaaaaacacgaacaacaaaatcagccggctccttgactccctcccctcagataccagactcgtgttgctgaacgcgatctacctgagcgctaagtggaaaactaccttcgatcccaagaagaccagaatggaaccatttcatttcaagaattcagtcatcaaggtgccgatgatgaactccaagaagtacccggtggcccacttcatcgaccagaccctgaaagcaaaggtggggcagctgcaactgtcccacaacttgagcctggtgattctggtccctcaaaatctgaagcaccgactcgaagatatggagcaggcactcagcccttcggtgttcaaggccatcatggagaaattggaaatgagtaagttccagccaaccctgctgaccttgccgcgcatcaaagtgaccacttcgcaggacatgctctcgattatggaaaagttggaattcttcgatttttcgtacgatctgaacctgtgtggcctcactgaagacccggaccttcaggtgtcggctatgcaacaccaaaccgtcttggaattgaccgagactggggttgaagcggccgctgcctctgcaattagcgtggcacggactctccttgtgtttgaagtgcagcaaccgttcttgtttgtgctgtgggatcaacagcataagttcccggtgttcatgggacgggtgtacgatcctcgcgcc

SEQ ID NO: 19092 - DNA, 1500 bp, Artificial Sequence
  Description of Artificial Sequence: Synthetic coding sequence
atggctagcaggttgactttgcttaccttgctgctgctcctgttggccggcgatcgcgcatccagcaatccaaacgcaacctcttccagttcgcaggacccagaaagcctgcaggacaggggggaaggcaaagtggctaccacagtgatcagcaaaatgctctttgtggagccaatcctggaagtgagttccctgcccaccactaactccaccactaattccgcgactaagattaccgctaatacaaccgacgaaccaactacccagccaactaccgagcccaccacacagcctacaatccagcctacccagccaactacgcaactccccacagacagccctactcaaccaaccactggaagtttttgcccaggaccagtcacgctgtgctcggatctggagtctcactctacagaggccgtgcttggagatgcacttgtagacttctcactcaaactgtaccacgcgttctcagctatgaaaaaggttgagactaatatggcgttcagcccattcagcatcgctagtctcctgacacaggtcctgctcggggctggcgaaaatacaaagacaaacctggagagtattctcagctaccccaaagattttacttgcgtgcatcaagcattgaaaggattcacaactaagggggtcaccagcgtgtcacagatctttcattcaccggacctggctattcgcgataccttcgttaacgcatcgaggactctttactctagctcacccagggtcctgtctaacaattctgatgccaacctggagcttatcaacacttgggtggccaagaacaccaacaataaaatcagtaggctgctggactcacttcctagtgatacccgccttgttcttctgaacgctatctacctgtcagcgaagtggaaaaccaccttcgatcccaaaaaaacaaggatggaacctttccactttaaaaactccgtgattaaagttcccatgatgaactctaaaaagtacccagtcgctcacttcatcgaccagactttgaaagctaaggtcggacaactccagctcagtcataatctgtccctggtaattctggtgccccagaatctcaagcaccgactggaggatatggagcaggctctgagcccttcggtgttcaaagctatcatggagaagttggaaatgagcaagtttcagcctactcttctgacactccccaggattaaagtgactacaagccaggacatgctgtctatcatggaaaagctggaattttttgacttctcctatgacctcaacctgtgtggtctgactgaggaccccgatctgcaggtcagcgccatgcaacaccagaccgttttagaattgacagagactggggttgaggctgctgccgcctctgcgatttctgttgcacggaccctgttggtgtttgaggtccagcagccctttctgttcgtcctgtgggatcagcaacataaatttcccgttttcatggggagggtctatgaccctagagca

SEQ ID NO: 19093 - DNA, 1500 bp, Artificial Sequence
  Description of Artificial Sequence: Synthetic coding sequence
atggcatcacggctcacgcttctgacactgctgctgctgctgctggccggtgaccgcgcgagctctaacccgaatgccacatccagctcttctcaggaccctgaatccctgcaggaccgaggcgaggggaaagtcgcgacgactgtcataagcaagatgctgttcgtggagcctatcctggaagtgagcagccttcctaccacaaatagcaccacgaacagcgcgacgaagatcacagcaaataccaccgacgaaccaaccacgcagccgactacggagcctactacccaaccaaccatccagccgacacagccaaccacgcagctgccgaccgacagcccgacgcaaccgacgaccgggagcttctgtccgggtcccgtgacgctgtgtagcgatctggaatctcattctaccgaggccgttctgggagatgccctagtggatttctcactcaaactgtaccacgccttctctgccatgaaaaaggtggagaccaacatggctttcagtcctttttccattgcgtctctgctgacgcaagtgttgctgggtgccggcgaaaacacgaagaccaatctggagtcgattctgagctacccgaaagatttcacatgtgtacatcaggcgttgaaaggttttaccaccaagggtgtgacctccgtcagccagatatttcactcccctgatctggcgattcgtgatactttcgtcaacgcgagccgcaccctttacagctccagcccacgtgtcctgtccaacaacagcgatgcgaatttggaactgattaacacttgggtggcaaaaaacacgaataacaaaattagccggctgctggatagcctgccttccgatactcgcctagtcctgcttaacgcaatctacctgagcgctaagtggaagaccaccttcgaccctaagaagacgcggatggaaccgtttcactttaagaactctgtcatcaaagttcctatgatgaacagtaaaaagtatcctgttgctcactttattgaccaaactctgaaggcaaaggtcggacagctgcaactgagccataatctgagcctggtcatattggtcccacaaaacctaaagcaccgtcttgaagacatggagcaggctctgtctccgtccgtctttaaagctattatggagaagttggaaatgtctaaattccaaccaactctgctgaccttacctcggattaaagttactacctcgcaggatatgctgtctatcatggagaagctggagttcttcgacttctcttatgacctgaatctctgcggtctgaccgaggatcccgacctgcaggtcagcgcaatgcagcaccagaccgtcctggaactgactgagactggagttgaagccgccgcagcgagcgctatctctgttgcccgcactctgctcgtgttcgaggtgcaacagcccttcctgtttgttctgtgggaccagcagcacaaattcccggtgttcatgggccgagtttacgacccacgtgca

SEQ ID NO: 19094 - DNA, 1500 bp, Artificial Sequence
  Description of Artificial Sequence: Synthetic coding sequence
atggcttccagactgacactactgaccctcctcttgctgctcttggcgggagatcgagcctcgagtaatcctaacgccaccagcagcagcagccaggatcccgagtcgttgcaggatcgaggcgaaggaaaggttgcaactaccgtcatcagtaagatgctgttcgtggagcctattctggaggtgagcagcctcccaaccacaaactctacaacaaactctgccacaaaaatcaccgccaataccactgatgaacctaccactcaacccactacagagccaaccacgcagcccaccatccaaccaactcaaccaacaacccagctgcccacagatagtcccactcagcccaccactgggtccttctgtccaggcccagttaccctatgttctgacctggagtcacacagcactgaggctgtgctcggagacgccctggtggacttcagcctgaaactctaccatgcattcagcgccatgaaaaaggtcgagacaaacatggccttctcgcccttctccattgcatcgctcctaacccaggtacttctgggcgcaggagagaacacaaaaactaacctggaatcaatactctcttaccctaaagacttcacttgtgtgcaccaagcccttaagggcttcactacaaagggcgtaacaagcgtgtctcaaatcttccatagtcccgatctagcaattcgagatacttttgtgaacgcaagtagaactctttactcatcatcccctcgggtgctatccaacaactccgacgcaaatctcgagctgattaatacctgggtcgccaagaacacaaataataagatctcccgtctgctggatagccttccctccgacacgcgtttagttctgctgaatgccatatatctcagcgcgaaatggaagactactttcgaccctaaaaagactaggatggaaccattccatttcaaaaactccgttatcaaggtgcctatgatgaattctaagaaataccctgtggctcatttcatcgatcagaccctgaaggcgaaagtggggcaattgcagttgtcacacaacctgagcctagttattctggtcccgcagaatcttaagcatcggctggaggatatggagcaggccctctcaccctcagtgttcaaggccataatggagaagcttgagatgtctaaatttcagcccacactgcttactctgccgcgaatcaaagtaactacctcccaggacatgctgtccataatggaaaagctcgaatttttcgactttagttacgacctaaacctgtgcggactgactgaagatccggacctgcaagtctctgcaatgcagcaccagaccgtccttgaactgactgagaccggagtcgaagctgctgctgcaagcgcgatctccgtcgccagaacgctgctggtctttgaggtgcaacagccctttctgttcgtactgtgggaccaacagcacaagttccccgtgttcatgggacgcgtctatgacccccgcgcc

SEQ ID NO: 19095 - DNA, 1500 bp, Artificial Sequence
  Description of Artificial Sequence: Synthetic coding sequence
atggcttcaagacttacccttttgactctacttttgttattgcttgcaggcgatagagctagctcgaatccaaatgctaccagcagtagctcgcaagatccggaatcattacaggatcgtggagaaggaaaagttgcaaccactgtcatcagtaaaatgttatttgtcgagccaattctggaggtgtcaagtcttcctacaaccaattcaactacgaattctgcgaccaagataacggcaaacactacagacgaacccacaactcaaccaacaacagagccgacaacgcaaccgactatccagccaactcagccaacgactcagttgccaacagactcaccgacacaacctacaacaggctcgttctgtccaggaccagtcaccctttgttcagatctcgaatctcatagtacagaagcagtccttggagatgctctcgtggatttctctctcaagctttatcatgcattctcagctatgaaaaaggttgaaacaaacatggctttcagtccattctccattgcttccctgttaacacaagtattattgggagctggagaaaacaccaaaaccaatttagaatcaatattgtcgtatccaaaggacttcacttgcgtccaccaggctcttaaaggatttacaacgaaaggagtgacttcagtgtctcagatctttcattcaccggatctcgccatacgagatacattcgtcaatgcatctcgtactctttactcctcctccccaagagtgttatctaataatagcgatgctaatttggaattgataaacacatgggtggcgaaaaacaccaataataagatatcacggctactagatagcctaccgagcgatactaggctcgtcttgctcaatgcaatatatttgtctgcaaagtggaaaacaacgtttgatccaaagaagactcgaatggagccatttcactttaagaatagtgtgataaaagttccaatgatgaattcgaaaaagtaccctgtggcgcatttcattgaccaaactctcaaggccaaggttggtcagcttcaattgtcacataacttatcgcttgttatccttgttccgcagaatctaaaacatcgacttgaagacatggagcaagctttatcgccaagcgtatttaaggctatcatggaaaaattagaaatgtcaaagtttcagccaactttactaactcttccaagaattaaagttaccacgagtcaggatatgctttcaattatggaaaaacttgaatttttcgacttttcatatgacctgaatctttgcggattgacagaagatcccgatcttcaagtgagcgcgatgcaacatcaaacagttctagagctgacagaaactggcgtggaagccgcagcggcgtctgcaatttctgtagctcgcactttactggttttcgaggtgcaacaaccatttcttttcgtcctttgggatcaacagcataagtttcccgttttcatgggtcgagtatacgacccacgagcg

SEQ ID NO: 19096 - DNA, 1500 bp, Artificial Sequence
  Description of Artificial Sequence: Synthetic coding sequence
atggcctcccgcctcacccttctgacccttctgctcctgctgctggccggggaccgggccagctctaatccaaacgccacctcatcctcctcccaagatccggaatccttgcaggaccgcggcgaaggaaaggtcgccaccacggtcatcagtaagatgctcttcgtcgaacccatcctggaggtttcgtccttgccaacgacgaattcaactaccaattcagcgaccaagatcaccgccaacactactgatgaaccaaccacccaaccaactaccgagcctactacccagccgactatccagccgactcaaccaacgacccagctgccgaccgactcgcctacccagccaaccactggatctttctgtcctggccccgtgactctctgcagcgacctggaaagccactcgactgaagcggtcctgggagatgccctggtggatttctcccttaagttgtaccatgctttctcagctatgaaaaaggtggaaaccaacatggccttctcacctttctcgatcgcatcgctcctgacccaagtgcttctgggagcgggggagaataccaaaacgaacctggagtcgattctctcctacccaaaggacttcacctgtgtccatcaagcgctgaaaggattcaccaccaaaggagtgacttccgtcagccagatcttccactccccagatctcgccattcgcgacacctttgtgaacgcatcgcggactctgtactcatcgagccctagggtcctgtctaacaattcagatgccaaccttgaactcatcaacacgtgggttgccaagaataccaataacaagatctcgcggttgctggattcgctcccaagcgacacccggcttgtgctgcttaacgccatctacctctccgcgaaatggaaaaccacctttgacccaaaaaagacccgaatggaaccgttccatttcaagaattcggtgatcaaggtccctatgatgaattccaagaagtacccggtggcccactttattgatcaaaccctgaaggcaaaggtgggtcagctccaactttcacataacctgagcctggtcatcctggtcccgcagaatttgaagcaccggctggaggacatggagcaggcgctgtcgccttcggtctttaaggcgatcatggaaaagctggaaatgtcgaagttccagcctacgttgcttaccctccctcggatcaaggtgaccacctcacaggacatgctgtccatcatggaaaaactggagtttttcgattttagctacgacctgaatctgtgtggactcactgaggacccggaccttcaggtgtcggccatgcagcaccagactgtgctggagctgactgaaactggtgtggaggcagcggcggcttccgcgatcagcgtggctcgcaccctgttggtctttgaggtgcaacaacccttcctgttcgtactgtgggatcaacaacataagtttccagtctttatggggagagtctacgatcctcgggca

SEQ ID NO: 19097 - DNA, 1500 bp, Artificial Sequence
  Description of Artificial Sequence: Synthetic coding sequence
atggcttctcggctgaccctcctgactttgctcctgctgctgttggccggcgatcgggcatcctcgaaccctaatgccacttcgtcatcgtcccaagatccggaatctctgcaggacaggggtgaaggaaaggtggcgactaccgtaatctcaaagatgctcttcgtggaaccgatcttggaggtgagctcacttcctaccactaactctaccaccaactccgcaactaagatcaccgcgaacactactgacgagcctacgacgcagcccactactgaaccgactacccagccgactatccagccgacccagccgaccacccagctcccgacggattccccaactcaaccaaccaccggatccttttgcccgggaccagtgaccctgtgctccgacctggagagccatagcacggaagcggtgctgggagatgccctcgtcgacttctcactcaagctctaccatgctttctctgccatgaagaaagtggaaactaacatggcattctcgcccttttccatcgcctcgcttctgacccaagtgcttctcggggctggcgagaacaccaagacgaatttggaatccatcctgagctacccaaaagatttcacctgtgtgcaccaggccctgaagggtttcaccaccaagggagttacttctgtgagccagatctttcattcccctgacctggccatcagagacactttcgtcaatgcttcccggacgctgtatagttcatcaccgcgcgtcctgtcgaacaactcggatgcgaacctcgaactcattaacacctgggtggcgaagaatactaacaataagatctcgagactgctggacagccttccgagcgacacccgcctcgtgctcctcaacgccatctacctgagcgccaagtggaaaacgacttttgaccccaaaaagactaggatggaaccatttcacttcaagaattccgtgatcaaggtcccgatgatgaactccaagaaatacccagtcgcccatttcatcgaccagaccctgaaggcgaaggttggccagctgcaactgtcgcacaatctgtctctcgtgattttggtaccccaaaatctgaagcacagacttgaggacatggagcaggcgttgagcccgagcgtgttcaaagctattatggaaaaactggaaatgtcaaagttccagcccacgcttcttaccctgccgcgcattaaggtcaccacttcgcaagatatgctgtcgatcatggagaagctggaattcttcgacttctcctacgatcttaacctgtgcgggctgaccgaggaccctgatttgcaggtgagcgccatgcagcaccaaaccgtactggagctgaccgaaactggagtggaggccgcagcagcaagcgctatctcagtggcgcggaccttgctcgtgttcgaggtgcaacagccatttctgttcgtcctctgggatcaacagcacaaatttcctgtgttcatgggacgagtctacgacccacgcgct

SEQ ID NO: 19098 - DNA, 1500 bp, Artificial Sequence
  Description of Artificial Sequence: Synthetic coding sequence
atggcctcccgcctgactctattgaccctgttgctcttgctgctcgccggcgaccgggcatccagtaaccctaatgccacatcaagcagttcccaggacccagaatcccttcaagatcggggcgagggcaaggtggctaccaccgtgatttcaaagatgctctttgttgagcccatcttggaagtgtccagccttcctaccacaaactctaccacgaactcggcgacaaagattaccgcaaataccaccgacgagcccacaacccagccgacaaccgaacccacgacccagcccaccatccagcctacacagcccaccactcaactgcccaccgatagccctacccaacctacaactgggtcgttctgcccggggccagttactttgtgctctgatctggagtcccactccaccgaggcagtgctgggagatgctcttgtcgatttctcactgaaattgtaccatgccttttccgcaatgaaaaaagtggaaactaacatggcattttcaccgtttagcattgcctcactgctgacccaggtgctgctgggcgccggcgaaaacactaaaacaaacctggaatcaatcttaagttacccaaaagacttcacgtgcgtgcatcaggccctgaagggctttacaacgaagggcgtgaccagcgtgtcgcagattttccacagccccgatctggcgatcagagacacattcgtcaacgcctcccgaacactgtattccagctccccccgcgtgctctccaataactccgacgcgaacctcgaactgatcaacacctgggttgcgaagaacacaaataataagatttcgcgtctcctcgatagtcttcccagtgataccagactagtactgctgaatgcaatctacctgtccgcaaaatggaagaccacattcgacccaaagaaaacacgaatggagccattccactttaagaactctgtgattaaagtgcccatgatgaactctaaaaagtatcccgtggcacattttatagatcagacacttaaagcaaaagtgggtcagttgcagctcagccataatctgtcactggtgattctggtgcctcagaacctgaagcaccgcctggaggacatggagcaagcactgagcccatccgtattcaaggctatcatggagaagctcgaaatgtccaagtttcagcctaccctgctgacactcccccggattaaagttaccacgtctcaagacatgttgagtataatggaaaaacttgagttttttgacttcagttatgatctgaatctgtgtgggcttactgaagaccccgatttacaggtctctgccatgcagcatcaaaccgtgctggagctgactgaaaccggagtggaagctgcggctgcatccgctatcagcgtcgcccgcacactgctggtattcgaagtacagcagccttttctgttcgtgttatgggatcaacagcacaagtttcctgtgttcatgggccgggtgtacgatccacgggct

SEQ ID NO: 19099 - DNA, 1500 bp, Artificial Sequence
  Description of Artificial Sequence: Synthetic coding sequence
atggctagcagactcacgcttcttactctccttctgctccttcttgccggggatcgtgcatcgtcgaacccaaatgcaactagctcctcgtcacaggatcctgaatccctccaagatcgtggagaagggaaggtcgcaaccactgtcattagcaaaatgcttttcgtggagccgattcttgaagtctccagcctgcctaccaccaatagcactaccaactcagcaactaagataaccgccaataccacggacgaaccaaccacccagcccactactgaacccaccacccaacctaccattcaaccaacccaacccaccactcaacttcccaccgatagcccaacccaacctacgaccggatcgttttgtcctggtcctgtgactctgtgcagcgatctggaatcacattcgaccgaggcagtgcttggggacgcacttgtggacttttcgctgaagttgtaccatgcattctcggcaatgaagaaggtcgaaactaacatggcgttcagcccattctcaatcgcatcacttcttacccaggtcctgcttggagcgggagaaaatacgaaaactaatctggaatccatcctgtcctaccctaaggatttcacttgtgtgcatcaagccctgaagggcttcactactaagggcgtcacctcggtgtcccaaatcttccattcccctgaccttgcaattcgtgatacctttgtcaacgcatccagaaccttgtattcttcgtctccgcgggtgctgagcaacaattccgatgcaaacctggaactgattaacacctgggtggcaaaaaacaccaacaacaagataagtagactgctggattctcttccttccgatactaggctcgtgcttttgaatgcaatttacctttcagcaaagtggaaaaccacgtttgacccgaaaaagaccagaatggagccctttcactttaagaactcggtgattaaagtccctatgatgaattccaagaaataccctgtggcacactttatcgatcagaccctgaaagcgaaagtagggcagctgcaactttcgcataacctttcactcgtcattcttgtcccacagaacctgaagcatcggctggaagatatggagcaggcactttcaccttccgtctttaaggcaattatggaaaagctggagatgtccaagttccagcccaccctccttacccttcctcggattaaggtgactactagccaagatatgctttccatcatggagaagctggagttttttgatttttcatacgatctgaacctgtgtggtcttaccgaggacccggaccttcaggtgtcggccatgcaacaccaaaccgtgctcgagctgactgaaactggagtcgaggcagcagctgccagcgcaatttcggtggcacggacccttctggtctttgaggtccagcagccgtttctttttgtgctttgggatcagcaacataagtttccggtgttcatgggtcgagtgtacgatcctcgcgca

SEQ ID NO: 19100 - DNA, 1500 bp, Artificial Sequence
  Description of Artificial Sequence: Synthetic coding sequence
atggcctctagactgacccttctgactctgctactactccttcttgctggcgaccgcgcaagcagcaatccgaacgccacctctagctcatcgcaggatcctgagtccttacaggacagaggtgaagggaaggtggctactacagtcatatccaagatgctgttcgtggagcccattctggaagtttcaagcctgcctacaacaaatagcaccacaaacagcgcaacaaagattacagctaacaccaccgatgagccaacaacacagcctaccacagagcctaccactcaacctactatccagcccacacagcctactacacagctacctacagattcacctacacagcctaccacagggagcttctgtccaggccctgtaaccctgtgctccgatttggaatcacatagcaccgaggctgtgctgggcgacgctctcgtcgacttctcactgaaactgtaccacgctttctcagccatgaagaaggtcgagacaaatatggccttctcccccttcagcattgccagcctgctgacgcaggtgcttttgggggccggcgagaatactaagaccaatctggagagtatcctgtcttatcccaaggactttacgtgcgtgcatcaagcacttaaggggtttacaaccaagggagtcacctccgtctcccagatctttcatagtccagacttggcaattagggatactttcgttaacgcttcaaggacactgtattccagtagtcctcgggtgttaagtaacaattctgacgccaacctggaactgattaatacttgggtggctaaaaatactaataataaaattagccgtctgctggacagcctaccctcggacacaaggttggttcttctgaacgctatttatttgagcgcaaaatggaagacgactttcgacccgaaaaaaacgcgcatggagccctttcatttcaagaattctgtgattaaagtccccatgatgaattctaagaaatatccagtggctcatttcatagaccagacacttaaggcaaaagtaggtcaactccagctttctcacaatttatcactagttatactcgtgccgcaaaaccttaaacatcgactagaagatatggaacaggctctttcccccagcgtgttcaaggccatcatggagaaattagagatgtctaagttccagcccactcttctgaccctgcccaggattaaagtaactacatcccaagacatgctaagcattatggagaagctggaatttttcgacttcagctacgatttgaatttatgcggtcttaccgaggacccagacctgcaggtgtcggcaatgcaacaccaaacagtcctcgagctgactgaaaccggcgttgaagcagcagctgcttctgcaatttccgtggcacgcacgctgctggttttcgaagtccagcagccattcctgtttgtgctgtgggatcagcaacataagtttcctgttttcatgggacgggtgtacgatccccgcgca

SEQ ID NO: 19101 - DNA, 1500 bp, Artificial Sequence
  Description of Artificial Sequence: Synthetic coding sequence
atggcttcacggctgactctgctcactctgctgctgcttctgctcgctggcgatcgcgccagcagcaacccgaatgcgacttcgtcgtcgagccaagatccggagtccttgcaagatcggggggaaggtaaggtcgccaccactgtcattagcaagatgctgtttgtggagccgatcctggaggtgtcctcgctgcctactactaattcgaccacgaattcggcgactaagatcaccgcgaatactaccgacgaacctaccactcaacccactactgaaccaaccactcaaccgaccatccaaccaacccagcctaccacgcagcttccgactgactccccaacccagccgactactggatcgttttgcccgggaccggtcaccctgtgttcagatttggagtcccactccacggaagccgtgctgggagacgcgctggttgacttttcgttgaagttgtaccacgcattctcagctatgaagaaggtggaaactaacatggccttctccccattctccatcgcctcgcttctgacccaagtgctgctgggggctggtgaaaacaccaagaccaacctggagagcatccttagctacccgaaggatttcacctgcgtgcatcaggctctcaaaggcttcaccactaagggagtgacctccgtctcgcagatattccacagcccggacctggccatcagggacacctttgtgaacgcatcacggacgttgtactcctcatcaccacgggtcctgtccaacaacagcgatgctaatctcgagctgatcaatacctgggtggcaaagaatactaacaataagattagcagactgctcgactcattgccgtcggacactcggctggtgctgttgaacgctatctacctctcagccaagtggaaaacgaccttcgaccccaagaaaactcggatggaacccttccactttaagaattcagtgatcaaggtgccgatgatgaactcgaagaagtaccccgtggcccactttatcgaccaaaccctgaaggcaaaggtgggtcagctgcaactcagccataacctctcgctggtgatcctcgtcccacagaacttgaagcatagactggaggatatggaacaggccttgtcgccgagcgtctttaaagcgattatggagaagctcgaaatgtcgaagttccagcctaccctgctgactctgccgcgcatcaaagtgaccacctcgcaggacatgctctcgatcatggagaagttggaattcttcgacttctcatacgacctgaacctgtgcggactgacggaggaccctgacctgcaggtttcggccatgcagcaccagaccgtgctcgaactgaccgaaaccggggtcgaagccgccgcagccagcgccatctccgtggcacgcactctgctcgtgtttgaagtgcaacaaccgttcctgtttgtgttgtgggatcaacaacacaaattcccggtgttcatgggacgcgtgtacgacccgagagcc

SEQ ID NO: 19102 - DNA, 1500 bp, Artificial Sequence
  Description of Artificial Sequence: Synthetic coding sequence
atggctagtcggcttaccctcctgacactgctgctgctgctgctggccggggacagggcctccagcaacccaaacgccacaagttcctcatctcaagatccagaaagtctgcaggaccgcggtgaaggcaaggtggcgactacagtcatttctaagatgctttttgttgagcccattcttgaggtaagcagcctacctactacgaattccaccacaaactccgctaccaaaattactgccaatacaaccgatgagcctacaacccagcccacgacagagcctaccacgcagcctacaatccagcccacccagccaaccactcagttaccgaccgactcacccactcagcctaccactgggtctttttgtccaggtccggtgacgctctgctccgatttggagagccatagcactgaagccgttttgggtgatgcactggtagatttcagcctcaaactgtatcacgccttctccgccatgaaaaaagtggagacgaatatggccttctcacccttctccattgcgtcactactgactcaggtgctgttgggagccggagaaaataccaagacaaacctggagtccatcttgagctatcccaaagattttacgtgtgtccatcaagccttgaaaggatttacaacaaagggcgttacaagcgtgtctcagatttttcatagcccagatctcgccatccgggatacctttgtgaacgcatcaagaactctctactccagctccccacgggtcctttccaacaattccgatgccaacctggagttgattaatacctgggttgcgaaaaatacgaacaataagatctcaaggctgctagacagcctacctagtgatactagactggtgttactcaatgccatatacctgtcagctaagtggaagactacctttgatcctaagaagaccaggatggagccatttcattttaagaatagtgtgatcaaggtcccaatgatgaactccaaaaagtaccctgttgcccacttcattgaccaaaccctaaaggcaaaggtggggcagctacagctgtcccacaatcttagtcttgtcattctggtgccacagaacctgaagcaccggcttgaggacatggaacaggcactgtccccgagcgtgtttaaagccatcatggagaaacttgaaatgtccaaattccagccaacattgctcaccctgccacgtatcaaggtgacaacttctcaggatatgctcagtatcatggaaaagttggaattttttgattttagctacgacctgaacctgtgcggcctgaccgaggatcccgacctgcaggtgagtgccatgcagcatcaaactgtgctcgaactcactgaaactggggtggaagcagccgcggcctccgctattagcgtggctcgcactcttttggtgtttgaggttcagcaaccgtttttattcgtactctgggatcaacagcacaagttccccgtattcatgggccgagtgtacgacccccgggcg

SEQ ID NO: 19103 - DNA, 1500 bp, Artificial Sequence
  Description of Artificial Sequence: Synthetic coding sequence
atggcctcacgcctgactctgctgactttgctcttgctgctcctcgctggtgaccgagcgtccagcaacccgaatgcgacctcgtcgtcgtcccaagatccggagtcactgcaagacagaggagagggcaaagtggccaccacggtgatctcgaaaatgctgttcgtcgaaccgatcctggaagtgtcgagcctgcctactaccaactcgactaccaatagcgccaccaagatcaccgcaaacaccaccgatgaacctactacgcagccaaccacggaaccaaccacccaacccactatccaaccaacccaaccgactacccaattgccgacggactccccgacccagccgaccacgggttcattctgccctgggccggttactctctgttcggacctcgagtcccattccactgaggccgtcctcggcgatgcgctggtggatttttcgcttaagctgtaccacgctttcagcgcgatgaaaaaggtggaaaccaatatggcttttagcccattcagcatcgccagtctgcttacgcaggtgttgctgggcgccggagagaacactaaaactaacctggagtccattctgagctacccgaaggacttcacctgtgtgcaccaagctctgaaaggatttactaccaagggggtgacctcggtgtcacagatttttcatagcccggacctggccatcagggatacgttcgtgaacgcctcccggaccctctactcctcgtcgccgcgagtcctgtcaaacaattcggatgccaacctggaactgattaacacctgggtcgccaagaatacgaacaataagatctcgaggcttctggactcactcccgtctgatactcgcctggtgctgctgaatgcaatctacctgtccgccaagtggaaaaccaccttcgacccgaaaaagacccgcatggaaccgttccacttcaagaattccgtgataaaagtaccaatgatgaacagtaagaagtatcctgtggcccatttcatcgatcagaccctgaaagcaaaggtcggacagctgcagctctcgcacaacctctcgctcgtcattctggttccgcaaaacctcaagcacaggttggaagatatggagcaggcgctgtcccctagcgtctttaaggcgatcatggagaagctcgagatgtctaaattccagccaaccttgttgacgcttccaaggatcaaggtgaccacttcacaggacatgctctccatcatggaaaagctcgagttctttgacttctcgtacgacctgaacctctgtggactcaccgaggatcccgacctccaggtgtcggcaatgcaacaccagactgtcctcgagctcacggagactggagtcgaagccgcggcagcttcggcgatctcggtcgcacggactcttttggtgtttgaagtacagcagccattcctgttcgtgctttgggaccagcagcataagttcccagtgtttatggggcgcgtgtacgacccccgggcg

SEQ ID NO: 19104 - DNA, 1500 bp, Artificial Sequence
  Description of Artificial Sequence: Synthetic coding sequence
atggcatcccgactgactctgttgaccctgctcctgctccttcttgcgggggatcgagcatcgagcaaccctaatgcaacctcctcctcatcacaagaccctgagtcacttcaagatcggggcgaaggtaaagtggcgactactgtgatatcgaagatgctttttgtcgaaccaattcttgaagtgtcctcccttcccactaccaactcaaccactaactccgccaccaagattaccgcgaacaccaccgatgagccaaccacccaaccgaccaccgagcctactacccaacctactattcaaccgactcaaccaaccactcagcttcccaccgatagcccaactcaacccactaccggatccttttgccccggaccggtgactttgtgtagcgacctggagtcacatagcacggaggcagtgcttggtgacgcactcgtggacttttcgttgaagctgtaccatgcctttagcgcgatgaaaaaagtggaaacgaatatggcattttccccttttagcattgcatccctgctgactcaagtcctcctcggagcgggagagaacaccaagaccaacctggaatcgatcctctcgtacccaaaggactttacttgcgttcaccaagctctgaagggattcaccactaagggtgtcacctcagtgagccagatattccatagccctgaccttgctatccgtgatacctttgtgaatgctagtcggactctttatagcagctcgcctagagtcctttcgaacaattcggatgcaaaccttgaactcatcaacacctgggtggcaaaaaacaccaataacaagatctcgcgtctcctggattcactgccgagcgatacccgtctcgtgctgctcaatgcaatctacctgtccgcaaagtggaaaactacttttgatcctaaaaagacccgaatggaaccttttcactttaagaactcggtgatcaaggtccctatgatgaacagcaagaaatacccagtggcccactttattgatcagaccctcaaggcaaaggtcggtcaactgcagctgtcgcacaatctgtccctggtgattctcgttcctcagaacctgaaacatcgtcttgaagatatggaacaagccctgtcgccatccgtgttcaaagccattatggagaaactggagatgtcgaagtttcaacccactcttctgactctgcctcgcatcaaggtgaccacctcgcaggacatgctctcgattatggaaaagctcgagttctttgatttttcttacgatctcaacctttgcggactgacggaggaccctgatcttcaagtatcagcgatgcagcatcaaactgtcctggaactcactgaaactggagttgaagcagccgcagcgtcggcaatcagcgtggcacgcacgctgttggtgttcgaagtccagcaaccgttcctctttgtcctttgggatcagcaacataagtttccggtgtttatgggaagagtctacgaccctcgagcc

SEQ ID NO: 19105 - DNA, 1500 bp, Artificial Sequence
  Description of Artificial Sequence: Synthetic coding sequence
atggcctccagattgaccttactaacactgctgcttttacttttagctggggacagagccagttcaaaccctaacgccacatcctcttccagtcaggatccggagagtcttcaagacagaggtgagggcaaagtagctaccactgttatttctaaaatgctgttcgtcgagcctattcttgaggtgtccagtctgcctactaccaattcaaccaccaatagtgccacgaagatcaccgccaacacaacagatgaacccacaacccagccaacaacagaacctacaacccagcccacaatccaacctacacaaccaacaactcaactgcctacagattcacccactcaacctactaccggcagtttttgccctggtcctgtgactctctgctcagacctcgagagtcactccactgaggccgttctgggggacgccctggtggatttttcactgaagctgtaccacgcattctctgccatgaaaaaagtagagaccaacatggcctttagtcctttttcaatcgcctcactgctgacacaagttctgttaggagccggcgaaaacactaaaacaaacctcgaatcaatacttagctatccgaaggattttacctgcgtgcaccaagccctgaaaggctttaccactaagggagtcacatcagtgtctcagatctttcacagccctgaccttgctatccgcgataccttcgttaacgctagcagaaccctctattctagcagtcccagagtgctttcaaacaattctgacgctaacctggagctcattaacacctgggtagctaagaacaccaataacaagatctcacggctgctggactctctccccagcgacactcggttggtccttttaaacgccatctacctgagcgcgaaatggaagacgacctttgatcccaaaaaaactcgaatggaaccattccacttcaaaaacagcgtgatcaaggtgcccatgatgaatagtaaaaaatacccagtcgcacattttatcgaccaaacactgaaagcaaaggtgggccagcttcagctaagccataacctgagcctggtcatattggtcccgcaaaacttgaagcaccggctcgaagacatggaacaagcattatcccctagtgtgttcaaagcaattatggagaaactggaaatgtcgaagtttcagccaacccttctgacgctgccaaggatcaaggttaccacatctcaagacatgctttccatcatggagaaactggagttcttcgatttcagctacgatctgaatctttgcggacttacagaagacccagatctgcaggtctcagccatgcagcaccagaccgtgctggagctcaccgaaaccggagtagaagccgcagctgcctcagcaatttccgtggccagaacactccttgtgtttgaggttcaacagcctttcctgttcgttttgtgggaccagcagcacaaatttccagtctttatgggcagagtgtacgatccacgggcc

SEQ ID NO: 19106 - DNA, 1500 bp, Artificial Sequence
  Description of Artificial Sequence: Synthetic coding sequence
atggcgagccgtctcactctgctcacattgctgctactcttgctggccggggacagagccagctccaaccccaacgccactagttctagctcacaagaccccgaaagcctccaagatagaggggagggcaaggtggccactaccgtcatcagtaagatgctcttcgttgaaccaattctggaggttagctcgctgcctactacaaactccacaaccaactctgccactaagattacagcgaatacaacggacgagcctaccacacaacccactaccgaaccgacaacacaaccaactatccagcccacacaaccaaccacccagctgccgacagactcacccacacagcccacgacagggagtttctgccctgggccggtaacactgtgttccgatctggagtcccattccaccgaagctgtgctcggcgatgcattggtggacttctcactcaaattataccacgccttttcagctatgaaaaaagtggagaccaacatggccttctcacccttttctattgctagtttgctgacccaggtgttgttgggcgcaggtgagaacaccaaaaccaaccttgagagtatcctctcgtacccaaaagattttacttgcgtccatcaggctctgaaaggtttcacaacgaagggtgttaccagcgtcagtcagatcttccattcccccgatttggcaattcgagatacctttgtgaatgcctcacggacgctgtattcctcttcaccccgcgtgctgtccaataactccgatgccaatctggaactgatcaacacatgggtggccaagaataccaacaataagatctctagactcctcgattcactgccgtctgacacgcgacttgtgttgttgaatgcaatctatctctcagctaagtggaagacaacctttgacccgaagaagaccaggatggaacccttccattttaaaaattcagtgattaaggttcctatgatgaactcaaagaagtatccagtggcccacttcatcgaccagacactcaaggcgaaagtgggccagctacagttgtcccacaacctgtccctggtcatcttggtgccacagaatctgaaacaccgacttgaagatatggagcaggccttgtcccccagcgtgttcaaggccatcatggaaaagctggaaatgagtaagtttcaaccaacattgctgacactgccacgcattaaagtgacaacatctcaggatatgctatcaataatggagaaactggagttttttgactttagttatgatttgaatctctgcggattgaccgaggatccagacttgcaggtgagcgcgatgcaacaccagaccgtactcgagcttacagaaactggagtggaggcggctgccgcgtccgccatttcagtcgctagaacactgttggtgttcgaggtccagcagccattcctgtttgtcctatgggatcagcagcataagtttcccgtcttcatgggcagagtgtatgatcctcgagcc

SEQ ID NO: 19107 - DNA, 1500 bp, Artificial Sequence
  Description of Artificial Sequence: Synthetic coding sequence
atggcctcaaggttgaccctcttgactctgctcctcctactgcttgcaggagaccgcgcttcctctaaccctaatgctacctcatcaagttctcaggatccggagagcctccaagacaggggggagggaaaggtggctacaactgtaatttccaaaatgctgttcgtggaaccaatccttgaggtttcttcgctccccacaaccaacagtacaacaaactccgccaccaagattaccgccaatactactgacgagcctaccacccagcctactaccgaacctacgacgcagcctacaatccagccgacacagcccaccacccaattgcccaccgacagtccgacccagcctacgacagggtctttctgtccggggcccgtgacactctgttccgacctggagagtcatagcacagaagcagtgctcggcgatgcacttgtagactttagcctgaagctctatcatgcctttagcgcgatgaaaaaagtggagaccaacatggcgttttcacccttctcaatcgctagcctgctcacacaggtcctgttaggggcgggagagaacaccaagacaaatctggagtccatactgagctaccctaaggatttcacctgtgtgcaccaagcgcttaaaggattcaccacgaagggggtgactagcgtgagtcagatattccacagtcccgacctagccatacgggacaccttcgttaatgcaagtcggactctatacagcagctcccctagagttcttagcaacaacagtgatgccaaccttgagctcattaacacgtgggtggcgaagaacacgaacaacaaaatctccaggctcctcgacagcctgccctctgatacccgtttggtgcttctgaatgcaatctacttgtccgcaaaatggaaaaccacatttgatcccaaaaaaactaggatggaacctttccatttcaagaattccgtaataaaggtccctatgatgaactccaagaagtatccagtcgcccacttcattgatcagaccctaaaagccaaagttggacaattgcagttatctcacaacctcagtctcgtcatattagtaccacagaatctgaagcaccgcctggaagatatggagcaggcactgagtccatccgttttcaaggctatcatggaaaaactggaaatgtccaaattccaacccacactactgaccctcccccggattaaagtcaccacgtcgcaggacatgctgagtatcatggagaaactggagtttttcgacttcagctacgacctcaacctatgcgggctgacagaggatcctgatctccaggtgtcagccatgcagcatcagaccgtgctggaactcaccgaaaccggggtagaggctgctgccgcttctgctatcagcgtggcccgtacactgttagtcttcgaggttcaacagccatttttgttcgttctgtgggaccagcagcacaagttcccagtgttcatggggagagtgtatgatccaagggcc

SEQ ID NO: 19108 - DNA, 1500 bp, Artificial Sequence
  Description of Artificial Sequence: Synthetic coding sequence
atggcatcacggttgactctcctcacccttctccttttgttgctggcgggggatcgggcctccagcaatcccaatgctacctcctcctccagccaggatccggagtccttgcaggaccggggcgagggtaaggtggcgactactgtcatttctaaaatgctgtttgtggagccgatcctcgaggtctcttctctcccaaccactaactcaaccacaaacagtgccacaaagattaccgccaacacgactgacgagcctaccactcagccaacaaccgagcccaccactcagcctacaatccagcccacgcagccaacgacccaactgccaactgacagccccacacagcccacaactgggtccttctgtcccggcccggttacactgtgcagcgacttggagtcacactccacagaggctgttctgggcgacgctctggtggacttcagcctgaaactgtatcacgctttttccgctatgaagaaggtggagacaaatatggcgtttagtccattctcaatcgcttctctcctgacacaggtgctgctgggcgcgggcgaaaatacgaagacaaatctggaatcaatactttcttaccctaaggactttacgtgcgtgcaccaagccctgaaaggctttaccactaaaggcgtcacctccgtgtctcagatcttccacagtccagacctggcaatcagagacaccttcgtgaatgctagccggaccttgtacagcagttcaccaagagtcctgagtaacaatagtgacgcgaatctggagctgattaatacttgggtggccaagaatactaataacaagatcagccggttgctggactctctgcctagtgacacgcgcctcgtgttgctcaatgccatctacttgagtgccaagtggaaaactaccttcgaccctaagaagaccagaatggagcctttccattttaaaaacagcgttatcaaggttccgatgatgaacagtaagaagtacccagtagcccattttatcgaccagactctgaaagccaaggttgggcagctgcagctgagccacaacctcagcctggtgatcctggttccgcagaatctgaaacataggttggaggacatggagcaagctctgagcccgtctgtctttaaagcgattatggagaagttggagatgtccaagttccaaccaaccctcctgacccttcctcggatcaaggtcaccacaagccaggacatgctgtcaattatggagaaactggaatttttcgatttctcatacgaccttaacttgtgcgggctcacagaagaccccgatttgcaagtttcagccatgcagcaccagaccgtgctcgaattgactgagaccggcgtcgaagccgccgctgcatccgcaatcagcgttgccaggactctgctggtctttgaggttcagcagccatttttgttcgtcctctgggatcagcagcacaagttccccgtgttcatgggcagagtatatgatccccgagct

SEQ ID NO: 19109 - DNA, 1500 bp, Artificial Sequence
  Description of Artificial Sequence: Synthetic coding sequence
atggcttcacggttgaccctccttactcttctgcttctgctgcttgcaggagatagagcatccagcaatcccaacgctacctcatcctcctcgcaagatcctgaatcccttcaggatcgaggtgaaggtaaggtcgccactaccgtgatttctaaaatgctgttcgtggaaccaatactggaagtgtcatcgctgccaaccactaacagcactaccaactccgcgaccaagattactgcaaataccaccgatgaacctactactcagcctaccaccgagccgacgactcaaccaaccattcagcctacgcaacccacgacccaacttccaaccgattccccaacccaacctaccacgggttcattttgccctggcccagtgaccctttgttcagacctcgaatcccactcaacggaagcagtgcttggagatgcgctggtggacttttcgcttaaactttaccatgccttctcggcaatgaaaaaagtggaaaccaacatggccttttcacctttctccattgcgtccctcctgacccaggtgctgctcggtgccggtgaaaatactaagacgaaccttgagtctattctttcgtatccaaaagactttacctgtgtgcaccaggctttgaaaggtttcaccacgaaaggcgtcacttcagtttcgcaaatctttcacagccctgaccttgcgataagagacacctttgtgaatgcaagccggaccctttactcgtcatcaccccgagttctgtcgaacaattcggatgcaaacttggagctgatcaatacttgggtggctaagaatactaacaacaagatctccagactgctcgattctcttccaagcgacactcgactggtgcttttgaatgcaatttacctgagcgcaaagtggaaaaccaccttcgatccgaagaaaactaggatggaacctttccactttaagaattcggtgattaaagtccctatgatgaactcgaagaagtacccggtggcacactttattgatcaaacgctcaaggcgaaggtcggtcaattgcaactttcccataacctttccctggtgattctggtgccgcaaaatcttaagcacaggttggaagatatggaacaagcactttccccttcggtctttaaagctattatggaaaagctggaaatgagcaagtttcagccaactctcttgaccctcccaagaattaaggttacgacttcacaggatatgctgtcgattatggaaaaacttgaattcttcgatttttcatacgacctcaatctctgtggcctgactgaggatcccgatcttcaggtgagcgccatgcaacatcagaccgtgctggaattgactgaaaccggggtggaagccgcagccgcaagcgcaatctccgtggcaagaactcttctcgtctttgaagtgcagcaaccatttctctttgtgctctgggaccaacagcataagtttccggtgtttatggggagggtgtacgatcctcgtgca

SEQ ID NO: 19110 - DNA, 1500 bp, Artificial Sequence
  Description of Artificial Sequence: Synthetic coding sequence
atggcatcccgcttgacgcttttgacgctcctccttctgcttcttgctggtgacagggcatcctccaatcctaacgctacttcgtccagttcgcaggacccggaaagcctgcaagatagaggcgaaggcaaagtggcaactactgtgatctccaaaatgctctttgtggagcctattctcgaagtgagctccctcccaactaccaattcgacgactaactccgccaccaaaatcaccgctaacaccactgacgaaccaacgacccaacccactactgaacccacgactcagcccactattcaaccaacgcaaccgaccacccaacttccgactgattcgcctactcaaccaaccacgggctcattttgccctgggcccgtcaccctttgttccgatctcgaatcgcatagcaccgaggccgtccttggagatgcccttgtcgatttttcgcttaagctctaccacgcattttcagccatgaagaaagtggaaaccaatatggcgttcagtcctttctccatcgcgtcgctgctgactcaggtgctgcttggtgcaggagagaatactaagaccaacctggagtccatcctcagttaccccaaggactttacctgcgtccatcaggcgctcaagggatttaccaccaagggggtgacttcggttagtcagattttccattcacccgatcttgcaataagggataccttcgtgaacgcgtccagaaccctttactcgtcgtcacctcgtgtgcttagcaacaactcagacgccaatcttgaattgattaacacctgggtggccaagaacaccaacaacaagatcagccggctgctggactccctgccttcggacacccggcttgtgctgttgaatgcaatttacctgtcagcaaagtggaaaactacctttgatcctaagaaaaccagaatggaaccttttcactttaagaactccgtaatcaaagtcccgatgatgaattcgaagaagtaccctgtcgcccatttcattgaccagaccttgaaagccaaagtgggacaactgcaactctctcataatctttcacttgtgattctggtgccacagaacctcaagcacagactcgaggatatggaacaggctctttcaccaagcgtattcaaggccatcatggaaaaacttgaaatgagcaagtttcagcctaccctgcttactctgcccagaattaaggtcactacttcacaagatatgctgagtataatggaaaagctcgaattctttgatttttcgtatgatctgaatctgtgtggactgactgaggatcccgatctccaagtgtcagcgatgcagcaccagaccgtgcttgagctgactgaaactggagtggaggcagccgcagcaagcgcgatttccgtcgcaaggacgcttctcgtgttcgaggttcaacaaccattcctttttgtgctgtgggatcagcaacataagtttccagttttcatgggtcgagtttacgacccacgggcg

SEQ ID NO: 19111 - DNA, 1500 bp, Artificial Sequence
  Description of Artificial Sequence: Synthetic coding sequence
atggcatcacggctgactctgctgactctcctgctgctgttgctcgcgggggatcgcgcatcgtctaatcccaacgccacctcatccagctcacaggacccggaaagcctccaggacagaggagagggaaaggtggccaccaccgtcatcagcaagatgctgtttgtcgaaccaatcctggaagtgtcctccctgcctactaccaacagcaccacgaactcagccaccaagatcaccgcaaatacgactgatgagccgaccacccagccgaccactgaaccgaccactcagccgactatccagccgactcagccaactactcagctccctaccgattcaccaacccagcccaccaccggttcgttctgcccgggcccagtgaccctgtgttccgaccttgaatcccactcgaccgaagccgttctgggagacgcattggtggacttctctctgaagctctaccacgcgttttctgctatgaaaaaggtggagacgaacatggcattttccccattctcgatcgcgtccctcctcactcaagtcctgctgggagcgggagaaaacaccaaaacgaacctcgaatctattctgtcatacccgaaggacttcacttgcgtgcaccaagcgttgaagggattcaccaccaagggagtgacttccgtgtcccagatcttccactcaccggacctggccatccgagacaccttcgtcaacgcttcgcgcaccctctactcatccagcccgcgcgtgctctcgaacaactcagacgctaacctggaactgatcaatacttgggttgctaagaatactaacaataagatctcgcggttgctggactcacttccttcggatactcgcctggtgttgttgaacgccatctatctcagcgcgaaatggaaaactaccttcgacccgaaaaagacccgtatggaacctttccactttaagaactccgtcatcaaggtcccgatgatgaacagcaagaaataccctgtggcgcacttcatcgatcagaccctgaaggcaaaggtgggacagctccagctttcccacaacctgtccttggtcatcctggtgcctcaaaatctgaagcaccgcctcgaagatatggagcaggcactgtccccatccgtgttcaaggcgatcatggaaaaactggagatgtccaaattccaaccgaccctcctcaccctgccgcgcattaaggtgaccacttcccaggacatgctctcaatcatggaaaagctggaattcttcgacttcagctacgacctcaacctgtgcggccttaccgaagatccagacctgcaagtgtccgctatgcaacatcaaactgtgcttgagctgactgaaaccggagtggaggctgccgccgcaagcgcgatcagcgtggcccgcactctgctggtgttcgaggtgcagcagccatttctgtttgtgctgtgggaccaacaacataagtttccggttttcatgggccgcgtgtacgacccgcgcgcc

SEQ ID NO: 19112 - DNA, 1500 bp, Artificial Sequence
  Description of Artificial Sequence: Synthetic coding sequence
atggccagtaggttaacactgctcactctcctcctcctgctgctcgctggcgacagggcttctagcaatcccaacgccacaagctcctcatcccaggatcctgaatctttgcaggaccggggggaagggaaagtcgccaccaccgtgatatccaaaatgctatttgttgaacctatcctggaggtcagttctctgcccaccaccaatagcacaaccaattctgccacaaaaatcacagccaacaccacagacgagcctaccacccaacctaccaccgagcctaccactcagcctaccatccagcccacacaacccacgactcagctgcccaccgattctccaactcaacctaccactgggagcttctgccctggaccagtgacgttatgttcggatttggaatctcactccactgaggcggtgctgggggatgcccttgttgacttctccctcaagctgtatcacgcgttttccgccatgaagaaagtagagactaacatggccttttctcccttttctatcgcttccttgctgacacaggtgttactcggagctggggagaatacaaaaactaacttggagtcaatattatcctatccgaaggattttacttgcgttcaccaagcactgaagggattcacaaccaaaggtgtgacttctgtcagccagattttccattcccccgatctggcaatccgcgatacttttgttaacgcctccagaacactgtacagcagctccccaagggtgttatcaaataatagcgacgctaatctagaattgatcaatacctgggtcgctaaaaatactaacaacaagatctctcgcctgctggatagcctaccctccgacaccaggttagtgttgctgaacgccatttatcttagtgcaaaatggaaaactacttttgatcccaaaaaaacgcgtatggaacccttccatttcaagaatagcgtgattaaggttcctatgatgaacagcaagaaatacccagtcgcccacttcattgaccagacactgaaggcgaaggttgggcaacttcaactgtcccataatcttagcctggtgattctagtcccccagaatctgaaacacaggctggaggacatggagcaggccctgtcaccttctgtctttaaggccattatggaaaagctcgagatgtccaagttccagcccaccttgttaaccttgccacgaattaaagtcacgacatcacaagacatgctatctatcatggaaaaactggagttctttgatttcagctatgacctgaacctgtgtggccttaccgaggatccggatctccaggtgagcgcaatgcaacatcaaaccgtcttggagctgactgaaaccggtgtcgaagcagccgccgcaagtgcgatatcggtggccaggaccctacttgtattcgaggtccaacagcccttcctgtttgtcctgtgggaccagcaacacaaattccccgtttttatgggccgtgtctacgacccacgcgcc

SEQ ID NO: 19113 - DNA, 1500 bp, Artificial Sequence
  Description of Artificial Sequence: Synthetic coding sequence
atggcaagccgattgacccttctcactctgttactgctactgctggccggggaccgtgctagcagcaatcctaacgccacgtcctctagttctcaggacccagagtccctgcaggacaggggcgaggggaaggtcgccaccacggtcatcagtaaaatgctgttcgtggagccgattctggaagtgtcttccctcccaaccacaaactcaacgacaaactctgctactaagatcaccgccaatactaccgacgaaccaaccacccaaccaaccaccgagccgacaacccagccaacaatacagcctacccagccaaccactcagttgcccaccgattcacccacccaacctacgaccggatccttttgtccaggccctgtgacgctatgctctgatctggagagtcactctacagaagctgtacttggcgatgcactggtcgatttttccctcaaattatatcacgccttcagcgccatgaaaaaggtagagactaatatggccttctcgccattctctatcgcttctttactgacacaagtgctcctaggtgccggagagaacaccaaaacaaatcttgagagcatcctttcttacccgaaggacttcacctgcgtccatcaagccctgaaaggattcaccactaaaggcgtgacctctgtctctcagattttccattcacccgatctggcaatccgggatacctttgtgaacgcatccaggaccttgtacagttccagcccacgcgtcctgtccaacaattctgacgctaacctggagttaataaacacatgggtggcaaagaacacaaacaataagataagtcggctactggactccttgccttccgacactcggctggtgctcttgaacgccatctacctatccgctaaatggaagacaacgttcgatcctaagaaaacccggatggagccttttcacttcaagaactccgtgatcaaggttcctatgatgaacagcaagaagtatccggtggctcacttcattgaccagacactcaaggcgaaggtggggcaacttcagctttctcataatctgtctctggtcatcctcgtgccacagaacctgaagcatcgactggaagacatggaacaagccctttccccatctgtcttcaaggctataatggaaaaactggagatgtctaagttccagcctaccctactcaccctaccccgaattaaagtgaccacctctcaagacatgttaagtataatggaaaagttagagttcttcgatttctcgtatgacctgaacctgtgtggactcacggaagatcccgaccttcaggtgtctgcaatgcaacaccaaacagttctggaactgactgagacaggcgtagaggcggctgccgcgagtgctattagcgttgcgagaacattgctggttttcgaagtgcagcaaccctttctgttcgtgctctgggatcaacagcacaagttccctgtcttcatggggcgcgtctatgacccacgagct

SEQ ID NO: 19114 - DNA, 1500 bp, Artificial Sequence
  Description of Artificial Sequence: Synthetic coding sequence
atggcttcgcgactgacccttcttactttactacttttgttactggccggcgacagggcctcaagcaacccaaatgcgacctcatcatcttcgcaggaccccgagagcctccaggataggggggagggcaaggtggccactaccgtgattagtaaaatgctgtttgtggaacctatcctcgaggtgtcaagccttcctacaacaaatagcaccaccaactcagccacgaagattaccgccaataccactgacgaacccaccacccagcccacaactgagcctaccacccagcccaccatacagccgacacagccaactacgcagctgccgacagattcaccaactcaacctacaactgggtctttttgccccgggcccgtgactttgtgttccgacctcgaatcccattccacagaggctgtactgggagatgcgcttgtagacttcagcctgaagctataccacgcgttttctgctatgaaaaaagtggagacgaatatggcattttcgcccttttccatcgccagtctcctgacccaggtgttgttaggagctggagagaatacaaaaactaacctcgaatccatcctatcttatccgaaagactttacctgtgtccaccaggcactgaagggctttactactaagggagtgacttcagtgtcgcagatattccatagcccagaccttgcaattcgtgacaccttcgttaacgcgagccgcacactctactcatcttcaccgagagtgctgtctaacaacagcgatgcaaatctggagctcatcaatacgtgggtcgcaaagaataccaacaataagatatctcgcctgttggactctttgccgagtgatacgcgtttggtgctgctaaacgcaatctacctgtccgcgaagtggaagactaccttcgatccaaagaagactcgaatggagccgtttcactttaaaaattccgtgatcaaggtgcccatgatgaacagtaaaaagtaccccgttgctcattttattgaccagaccctgaaggccaaggtgggccaactacagctatctcataacctcagccttgtcatcctcgttccacagaatctcaaacaccgcttggaggacatggagcaggctctgtctccctccgtcttcaaagccatcatggaaaagctggaaatgtcgaagttccagcctacactgctcactctgccacgcataaaggtcacaacctcgcaagacatgttgagcattatggaaaagctggagttcttcgatttttcatatgacttgaacttgtgcggcttaactgaggatccagacctgcaggtgtcagctatgcaacaccagaccgttcttgaactgacagagacaggagtggaggcagctgcggcctccgctatttcggtggcacgcacattgctggtgtttgaggttcagcagccgtttcttttcgtactatgggatcagcagcacaagtttccggtgttcatgggtagggtgtacgacccacgcgcc

SEQ ID NO: 19115 - DNA, 1500 bp, Artificial Sequence
  Description of Artificial Sequence: Synthetic coding sequence
atggcaagtcgattgacattgttaaccttattactgttactgctggccggtgacagagcttcttctaaccccaacgcaaccagctcctccagtcaagatcccgagtctttgcaggatagaggcgaaggcaaggtggcgactaccgtgatcagtaagatgctgtttgtggagccgattctggaggtcagctctctgccgactacaaattctacaacaaattcggcaaccaaaatcacagcaaatactacagacgagcctacaacacagcctactacggagcctacaacgcagcctacgatacaaccaacgcagccaaccacccagttgcccaccgactcaccaactcaaccaactactgggtcattctgccctgggcctgtgaccctctgttccgacctggaatcccactcaactgaagctgtcctcggggacgctctcgtggacttttcactgaaactctaccacgcattcagcgctatgaagaaggtggagacaaatatggcatttagccctttcagtattgcttccctgttgactcaggtcctcttgggggcgggagaaaatactaaaaccaatctggagtccattctgtcatacccaaaagacttcacgtgcgtgcatcaagccctcaaaggatttactaccaagggcgtcacctctgttagccagatcttccacagccccgaccttgcaattcgggatacattcgtgaatgcatcacgcaccctgtactccagtagccccagggtcctctcaaacaacagcgacgccaacctggagctaataaacacctgggtcgccaaaaacaccaacaacaaaatttcacgcttgctagatagcctgcccagtgatacccgccttgtcctgctgaatgccatataccttagcgccaaatggaaaacgacctttgatcccaagaagacaagaatggagccctttcacttcaaaaactcggtgatcaaagtccccatgatgaactccaagaaatatccagtcgcccactttattgaccagacactcaaagcaaaggtggggcaactccagctaagtcataacctaagtctggtgattcttgtgccccagaacctcaaacatcgcctagaagacatggaacaggccttgtccccttcagtgttcaaagctatcatggaaaaactggaaatgagtaaatttcagccgacattgttgacgctacctagaatcaaggtgaccacctcccaggatatgctttctatcatggaaaaactggaattcttcgatttctcctacgatctgaacctgtgtggattgaccgaagacccagacctgcaagtgtctgctatgcaacaccagacggtgttggagttgactgagacgggggttgaagcagctgcggcatccgccatctccgttgcccggacgttactggtttttgaagtgcaacagcctttcctattcgtgctatgggaccaacagcacaagttccctgtcttcatgggccgggtatacgaccctagagca

SEQ ID NO: 19116 - DNA, 1500 bp, Artificial Sequence
  Description of Artificial Sequence: Synthetic coding sequence
atggcctcgcgccttaccttgcttactctgttgctgcttcttctcgccggagacagagcatccagcaatccaaacgcaacctcctcatcatcccaagacccagaaagtctccaagatagaggcgaagggaaggtggccaccaccgttatcagcaagatgctgttcgtcgaacccattcttgaagtgtcctccctcccgaccaccaattccaccaccaactctgcaaccaaaatcactgcaaataccaccgatgaacctactacccagccgactacggaaccaactacccaaccaaccattcagccaactcaacccactacccagcttccaactgatagccctacgcaacctacgactggatccttttgtccaggtcctgtgaccctttgttcagatctcgagagccattccactgaagcagtgctgggagatgcattggtggatttttcactcaagttgtaccatgcattctcagcaatgaaaaaggtggaaaccaacatggcttttagcccattctcgattgcatcgctgctgacccaggtgctccttggtgcaggggaaaataccaaaaccaatcttgaaagcatcctgtcatacccaaaagattttacttgtgtgcatcaagcacttaagggttttacgactaaaggtgtgacgtcggtgtcacagatcttccatagcccagacctcgcgataagggatacttttgtgaacgcaagcagaaccctttactctagctcgccaagagtcctctccaataactccgatgcaaacctggaattgataaacacctgggtcgcgaagaataccaacaacaagatttctaggctgctggacagcctgccttccgatacccggctggtgctgcttaacgcaatttaccttagcgcaaagtggaaaactacctttgatccaaaaaagaccagaatggagccgtttcacttcaagaactccgtgattaaggtccctatgatgaatagcaagaagtaccctgtcgcgcatttcatcgaccaaaccctgaaggcaaaggttggccagctccaactttcccacaacctttccctggtgattctggttccacagaaccttaaacatcggttggaagatatggagcaagcactctccccttcggtctttaaggcaattatggaaaaacttgagatgagcaagtttcagccaaccctgctcacccttccgagaattaaggtgaccacctcccaggatatgctgagcattatggaaaagctggagtttttcgatttttcctacgacctgaatctgtgtggacttactgaggaccccgatctccaggtatccgcaatgcaacatcaaactgtgcttgagctcactgaaaccggagtcgaggctgccgcagcttcggcaatttcggttgccagaactctcctcgttttcgaggtgcaacaacccttcctttttgtcctttgggatcaacaacataagtttcccgtgtttatgggtcgggtctacgatcctagagcc

SEQ ID NO: 19117 - DNA, 1500 bp, Artificial Sequence
  Description of Artificial Sequence: Synthetic coding sequence
atggcgtccaggttgaccctgctcaccctgctgcttctgcttctcgcgggagatagagcgtccagcaatccaaacgcaacctcctcgtcgtcgcaggatcctgaaagcctccaggatcgtggagagggcaaagtcgctactacggtgatctccaagatgctgtttgtagagcccatacttgaagtttcgagcctgcctactactaactcaaccactaactctgcaaccaaaatcaccgccaacactacggatgagccaacgacgcaaccaaccactgaacctaccacgcaaccgacgatacagccaactcagcctactacccagcttcccactgattcccccactcaacctacgaccggatcgttctgtcctggtcccgtcactctgtgcagcgatctggaatcacattcaactgaggcggtcctgggagatgcactggtggacttttcacttaagctctaccacgcatttagcgccatgaagaaggtagaaactaacatggcctttagccctttttccatcgcatcactgttgacccaagtgctccttggtgcgggagagaataccaaaactaacctggaaagcatcctttcataccctaaagactttacttgtgtgcatcaagccctgaagggcttcaccacgaagggggtgacctccgtgtcgcagatttttcacagcccagatctcgctattcgggacacgtttgtgaatgcctcgagaaccttgtacagttcgagcccacgcgtgttgagcaataactccgacgctaaccttgaactcattaacacctgggtggccaagaacaccaacaataagatctcacggctcctcgactccctgccctcggacaccagacttgtgctgctgaatgcaatctacctgtctgccaaatggaaaaccacctttgaccctaagaaaactaggatggagcctttccatttcaaaaactctgtgataaaggtaccgatgatgaacagcaagaagtacccggtcgcacactttattgaccaaacccttaaggctaaggtcggtcaacttcaactcagtcataatctgtctctggtcattctggttcctcaaaacttgaagcaccgactggaggatatggaacaggcactgtccccctcggtctttaaggcaatcatggaaaagctcgaaatgtcgaagtttcaaccaaccctgctgaccttgccacgcattaaagtgaccacctcccaggatatgcttagcattatggaaaagttggaattcttcgatttctcttacgatcttaatctgtgtggcttgactgaagatcctgacctccaggtgagcgcgatgcagcatcaaactgtccttgagctcacggaaactggggttgaggcagcagcagcaagcgccatttccgtggcacgcacgctgcttgtctttgaggtgcagcagccattcctttttgtgctttgggatcaacaacataagttcccagtgtttatgggacgagtgtatgatccacgtgcc

SEQ ID NO: 19118 - DNA, 1500 bp, Artificial Sequence
  Description of Artificial Sequence: Synthetic coding sequence
atggcatcaaggctaacactgctgactcttctcctgctcctgctcgccggcgatcgtgctagctcaaaccctaatgcaacctcaagctcctcgcaagacccagagtctctgcaagatcgcggagaaggtaaagtagcaaccaccgtcatttcgaaaatgctgtttgtggagcctattcttgaggtctccagcttgccgaccaccaacagcaccactaatagtgcaacaaagattaccgcgaatacaactgatgaacccacaactcaaccgaccactgagccaaccacccagcccacgattcaacccacacaaccaacgactcagcttcctacggacagccctactcaacccacgacgggaagtttctgccctggcccggttactctgtgctccgacctggagtcccatagtacggaggcagtgctgggagacgcgcttgttgatttctcattgaagttgtatcacgccttctcggccatgaagaaagttgaaacaaacatggccttttccccgttcagtatcgcctcgttgctcacccaagtgctactgggcgcgggagaaaataccaaaacaaacctagagtcaatcctatcttaccccaaagatttcacatgcgttcaccaggcactcaagggtttcacaaccaaaggcgtaacgtccgtgagccagatcttccattctccggaccttgctatccgagatacattcgtgaacgccagcaggacgctttactcgtcgtccccccgtgttttatcgaataactcggacgcgaatctggaactaatcaatacatgggtggcgaagaacaccaacaataagattagccgtctcctggatagtttgccctcggacacacgcctagtacttctcaatgcaatttacttaagtgctaagtggaagacaacattcgatccgaaaaaaaccaggatggaacccttccatttcaagaactccgtcataaaggtgcccatgatgaactctaaaaagtatccagtggcccatttcatcgaccagactcttaaggccaaggttggccagctgcaactatctcataacttgagcttggtgattctagtgccacagaacctcaaacaccgtcttgaagacatggagcaagcacttagtccctccgtgtttaaggctatcatggaaaagctcgagatgtccaagttccagcccaccttgttgacgttgcctcgtatcaaggttacgacgagccaggacatgctgtctatcatggaaaagctcgagttcttcgatttcagctacgacctcaatctgtgcgggttgactgaagaccctgatcttcaggtttcggccatgcaacatcaaacagttctggagcttaccgaaacaggcgtcgaggctgctgccgcttcggccatatctgtcgcgcgtactttattggtattcgaggtccaacagccattccttttcgtcctgtgggatcaacagcacaagtttccagtattcatgggacgcgtctatgacccccgggcc

SEQ ID NO: 19119 - DNA, 1500 bp, Artificial Sequence
  Description of Artificial Sequence: Synthetic coding sequence
atggcgagtagacttactttgctcacgctccttctcctgctcctcgccggtgaccgggcgtcctccaacccaaacgcaacctcatccagcagccaagatcccgaaagcctgcaggatcgcggtgagggaaaggtcgcaactaccgtgatttccaaaatgctttttgtggagccaatcctggaagttagctcccttcccactactaactccactaccaactccgcaactaagattacggctaacacgactgacgaacctaccactcagcctaccactgaacccaccacgcaacctaccatccaacctacccaacctactacccaactgccaactgattcacccacccagcctaccacgggatccttttgccctggtcctgtcaccctttgttctgatctggaatcccatagcaccgaagcagtgctgggagatgccctggtcgatttttcgctgaagttgtaccatgctttttccgcaatgaagaaagtggaaaccaacatggcattttcaccattctcgatcgcatcacttcttactcaggtgctgctgggagcgggtgaaaataccaaaacgaacttggagtcgattctctcctaccccaaggattttacctgtgtccatcaagcactgaaggggtttactactaaaggagtgacctcagtgtcccagatctttcattcacctgacctggccattagagacacctttgtaaacgcttccaggaccctttactcgagctcgcctagagtgctgtcaaacaattcagatgcgaatctggagcttatcaatacctgggtcgccaaaaacaccaacaacaagataagccgactgttggacagcctgccttcggatacgcgtctggtgctcctgaatgcaatttacctgtcggcgaagtggaaaactaccttcgaccctaaaaagacccggatggagccgtttcactttaagaatagcgtgattaaagtgcctatgatgaactcaaagaagtatcctgtggcccactttatagatcagactcttaaggcgaaggtcggtcagctccagcttagccataatctcagcctggtgattcttgtgcctcagaatctgaagcatcgactggaagatatggagcaggcactgagcccttcagtgttcaaggcaatcatggaaaagttggagatgtcgaagtttcaaccaaccctgctcactcttcctcgcattaaagtcactacttcacaagatatgctttcgataatggaaaaactggagttttttgacttttcatatgatctgaacctgtgcggactcacggaagatcctgatctccaagtttccgccatgcaacatcagacggtcttggagctgacggaaaccggagtggaagcagcagcagctagcgcaatttccgtggcaagaactttgctggtctttgaggtccagcaaccgttcctgttcgttctgtgggaccaacaacataagttcccagtgtttatgggacgggtgtatgatccgagagcg

SEQ ID NO: 19120 - DNA, 1500 bp, Artificial Sequence
  Description of Artificial Sequence: Synthetic coding sequence
atggcctcacggctgactctcctgacgctgctccttctgttgcttgccggtgaccgagcctcgtccaaccctaacgcaactagctccagctcccaagatcccgaaagcctccaagataggggtgaaggcaaggtggcgacgactgtcatttccaagatgctgttcgtggaaccaatcctcgaagtctcgagcctccctaccacgaattccaccaccaatagcgcgactaagatcaccgccaacactaccgacgaacctactactcagccgactaccgagccaaccactcaaccgactattcaaccgactcagccgaccacccaactgcccactgattcaccgacccagccaacgactggtagcttctgccctggaccagtcaccctctgttccgaccttgaatcgcattcgaccgaggctgtgctcggagacgccctcgtggatttctcgttgaaattgtaccacgcattttctgctatgaaaaaagtggaaaccaacatggcattttcgccgttctccattgcgagccttcttacccaggtgctgctgggagcaggcgagaacactaagactaaccttgagtcgatcctcagctatccaaaagactttacttgtgtgcatcaagcactcaagggatttactacgaaaggtgtgacttcggtttctcaaatctttcatagcccagatcttgccattcgcgatacttttgtgaatgcttcgagaaccctgtactcgagcagcccccgggtgctctcgaacaactccgacgcaaaccttgagcttatcaacacctgggtggcaaaaaacacgaataacaagatttcaaggttgctggatagccttccatctgataccagacttgtccttctgaatgccatttacctttctgcaaagtggaaaaccacttttgatcctaagaaaaccagaatggaaccctttcactttaagaattcggtcattaaggtccccatgatgaattcgaaaaagtaccctgtggctcatttcatcgaccaaaccctcaaggcgaaggtggggcaactccaactttcccacaatctcagcttggtcatcctggtgccacaaaatcttaagcatcgcctcgaggacatggagcaagcactttctcctagcgtgttcaaagcgataatggaaaagctcgaaatgtcaaagtttcaacctacccttctgactctcccaagaattaaggtgacgacctcgcaagacatgctgtccattatggagaagctggagttctttgatttctcatacgatctgaacctttgcggtcttaccgaagatcccgatctgcaagtgagcgcaatgcagcaccagaccgtgcttgaactcactgaaacgggcgtggaagcagcagcagcgtcagctatcagcgtcgcccgtactctcctcgtgtttgaagtccagcaacccttcctttttgtgctttgggatcaacagcataagtttcccgttttcatgggacgcgtgtacgaccctagggcc

SEQ ID NO: 19121 - DNA, 1500 bp, Artificial Sequence
  Description of Artificial Sequence: Synthetic coding sequence
atggcgtcacggctgacgctcctcactctgttgctccttctccttgcgggcgatagggccagcagcaatccgaatgctaccagctcgtcctcacaagatccagagtcgctccaagatcggggggaggggaaggtcgctaccacggtcatttcaaagatgctgttcgtcgagcctatcctggaagtgtcatctctgccgaccaccaattcaaccaccaactcagccactaagatcaccgcaaacactactgacgaaccaaccacgcagccaactactgagccaacgactcagccgactatacagcctacccagccaaccactcagctgccgactgactcgcctactcagcccacgacgggatccttctgcccaggtccggtgactctgtgttccgaccttgagagccacagcaccgaggctgtgctgggagatgcgcttgtggacttctcgctgaagctctaccacgccttctccgctatgaaaaaagttgaaactaatatggccttctcccccttctccatcgcatccctcttgacgcaagtgctcttgggagccggagaaaacaccaaaactaaccttgaatccatcctgtcgtaccctaaggacttcacctgcgtgcaccaggcactgaagggttttactactaagggcgtcacttccgtgagccaaatcttccacagcccggatctggcgattagagatactttcgtcaacgcctcgagaactttgtactcgtcgtctccgcgcgtgctgtcaaacaactcggacgccaacctggagctcatcaatacctgggtcgcgaagaataccaacaataaaatctcgaggctgttggactcgctgccgagcgacaccagactggtcctgttgaacgctatttacctgagcgcaaagtggaaaaccacctttgaccccaagaaaactcgaatggaaccgtttcatttcaagaactccgtgatcaaggtgccgatgatgaactccaaaaagtatcctgtggctcacttcatcgaccaaaccctgaaggcgaaggtgggccagctccagttgtcgcacaatctctccctggtgatcctggtaccacagaacctgaagcatcgcctggaagatatggagcaggcgctgtcaccctcagtgtttaaggcaatcatggagaagctggagatgtcgaagttccaaccaaccctgctcacccttccgcgcatcaaggtgaccacttcgcaagatatgctcagcatcatggaaaaactggaattctttgatttctcgtacgacctcaacctctgcggactcaccgaagatcctgacctgcaagtctccgcgatgcagcatcagaccgtgctcgaactcaccgagactggagtggaagcagccgccgccagtgccatcagcgtggcccgcacccttctggtgtttgaagtccagcagccgttcctgttcgtcctgtgggaccagcaacataaattcccggtttttatgggacgggtgtacgacccgcgggcc

SEQ ID NO: 19122 - DNA, 1500 bp, Artificial Sequence
  Description of Artificial Sequence: Synthetic coding sequence
atggcttctcgcctgacactgctcaccctcctgctgcttcttcttgcaggagatcgtgcttctagcaaccccaatgctacctcaagctcctcccaagatcccgagagcctgcaggaccgtggcgagggtaaggtggctacaaccgttatctctaagatgctgtttgttgagcctatactcgaggtttcttcactgccaacaaccaactccactactaattccgctactaagattaccgcaaataccaccgacgagccaaccactcagcctacaactgaaccaaccactcagcctacaatccagcccacccaacctacaacacagctgcctaccgactctccaacacaacctacaaccggtagtttttgccccggtccagttaccttgtgcagtgatcttgagtcccattctaccgaggctgtgctgggtgacgcactcgttgacttcagtttgaaactttaccacgctttttcagctatgaagaaggttgagactaatatggcttttagtccattctcaatcgccagtttgctcacacaagttttgttgggcgctggcgaaaacacaaagacaaatctggaatcaattctctcttaccctaaggactttacctgcgtccaccaggcattgaagggctttactacaaagggcgtaaccagcgtgtcccagattttccattctccagacttggcaatcagggacaccttcgtgaacgcttctaggacactgtactctagctcaccccgtgtattgtcaaataactcagatgccaatctggagctgattaacacctgggtagcaaagaacacaaacaacaagatttccagacttttggatagcctcccatccgacacaagattggtactgttgaacgccatatacctttctgcaaagtggaaaacaactttcgacccaaagaaaacaagaatggagccttttcatttcaaaaactctgttatcaaggtcccaatgatgaacagtaagaagtacccagttgcccacttcatcgatcagacacttaaggccaaggtgggtcaactgcagctgtcacacaacctgtccctggttatcctcgtccctcagaacctgaagcaccgtctcgaggacatggagcaggctctgagcccctcagtgttcaaggccataatggagaagttggaaatgagtaagtttcagccaacactgctgactctccctcgcattaaggttacaacttcccaggacatgctcagcatcatggaaaagctggaattcttcgatttttcctatgacctcaacctctgcggtttgacagaagaccctgacctgcaggtgtccgcaatgcagcatcaaaccgtcctggaacttacagagacaggagtcgaggcagccgctgcttctgcaatttccgtggctaggacactgctggtgtttgaggtgcaacagccctttcttttcgtgttgtgggatcagcagcacaaattcccagtattcatgggaagagtctacgatcctagagct

SEQ ID NO: 19123 - DNA, 1500 bp, Artificial Sequence
  Description of Artificial Sequence: Synthetic coding sequence
atggcctcccgccttaccctgttaaccctcctgctgctcttgttggccggggatagggcttcttcaaacccgaatgctacctcttcctctagccaggatcccgaaagtcttcaagaccgtggtgagggcaaggtcgccacgactgttatctcgaagatgcttttcgtggagcccattctcgaggtcagtagtttgcctacaactaatagcactaccaacagcgctaccaaaatcacagctaacaccacggacgagcccacgacccagcccactacagagccgactacacagccgactatccagcctactcagccaacaacacagctgcctaccgactcaccgacccagccaaccaccggctcattctgtccaggtcccgtcaccctgtgctctgatctggagtctcactcaacagaagccgtgttaggcgacgcattggtcgacttctccctgaagctgtatcatgccttcagcgcgatgaaaaaggtggagacaaacatggccttttcgcccttcagcattgcgtctcttttgacacaagtgctgcttggcgcaggcgagaacaccaagaccaaccttgaaagtattctgagctacccaaaggattttacttgcgtccaccaagctctgaaaggttttacaactaagggggtgacatccgtgagtcaaatttttcacagtccagatctcgctattcgggatactttcgtgaacgcttccagaacactctactccagttcacctcgagtcctttctaacaacagcgacgcgaacctggagctcataaatacatgggtggccaagaatacaaacaacaaaatcagtaggctgctggattccttgccttctgatactaggctcgtgctcctgaacgctatctacctgtcagcaaagtggaaaaccacgttcgatcctaaaaaaacacgcatggaaccatttcactttaaaaatagtgtcatcaaggttcccatgatgaatagtaaaaaatacccagttgcccattttatcgatcagaccctgaaggccaaggtgggacaactgcaactgtcacacaatttatcgctggtcatcctggtcccgcagaatctgaaacaccgcctggaggacatggaacaagccctgtcccctagtgtctttaaggcaattatggaaaagcttgagatgagtaaatttcaaccaacgctgttaaccttacctagaatcaaagtgaccacaagtcaggacatgctaagcattatggagaagctggagtttttcgatttcagctacgatctgaatctctgtggcctgactgaagacccagatctgcaagtgagtgccatgcagcatcagacagtgttagaattaacagagaccggggttgaggccgctgccgcaagcgcgatttccgttgctcgaacgctccttgtgtttgaggtgcagcaacctttcctcttcgtgttatgggatcaacaacacaagtttcccgtcttcatgggcagagtctatgaccctagggcc

SEQ ID NO: 19124 - DNA, 1500 bp, Artificial Sequence
  Description of Artificial Sequence: Synthetic coding sequence
atggccagccggcttaccttgttgactctgcttctgttgctccttgccggagatagagcaagctctaatcccaacgcaacttcttcaagctcacaagatcctgagtccttgcaggatagaggagaaggtaaagtggcaactaccgtgatctcgaagatgctctttgttgagccgatcctcgaggtatcatcactgcctactactaacagcaccactaactcggccaccaagattacggcgaataccactgatgaaccaactacccagccgaccactgagcccactacccaacctaccatccaacctactcagccaactactcaactgccaaccgactcgccgacccaacctactactgggtcgttttgtcctggacctgtgactctttgcagcgaccttgagagccactcaacggaagcagtgctcggcgacgcactggtggattttagccttaaactttaccacgcgttcagcgccatgaagaaggttgaaaccaacatggcatttagccctttttcgattgcttcacttcttacccaggtcctgctgggagcgggcgaaaacaccaagaccaacctggaatcgattctctcttacccaaaagatttcacttgtgtacatcaggctttgaagggattcaccactaagggtgtcacgtccgtgtcgcagatcttccactccccggatcttgcaattcgagatacttttgtgaacgcatcgcggactctgtatagttcgtccccccgtgtgctgtcgaataacagcgacgctaacctggaactcataaacacttgggtggccaagaacaccaataacaaaatcagccggctcttggattccctgccaagtgacacgagacttgtcctgctgaacgcaatttacctctccgcaaaatggaaaacgactttcgacccaaagaaaaccaggatggaacctttccatttcaagaactccgtcataaaggtcccaatgatgaattcaaagaagtaccccgtggcccatttcatcgaccaaactctcaaggcaaaggtgggccaactgcagctgtcacataacctgtcactggtgattctggttcctcaaaatctgaagcatcgcctcgaagatatggagcaggcactttccccatccgtgtttaaggcaatcatggagaaattggagatgagcaaatttcagccaacgcttctcactctgcccaggataaaggtcactacttcgcaagatatgctttccattatggaaaagctggagttttttgatttttcctacgatcttaatctctgcggtcttactgaggaccctgatcttcaagtttcggcgatgcagcatcagaccgtgcttgaactcactgaaacgggtgtagaagcggccgcagcatcggcaatttcggtggccagaacccttttggtctttgaagtccaacaaccgttcctgtttgtcctgtgggaccaacaacacaagtttcctgtgtttatgggacgcgtgtacgatccgagagcc

SEQ ID NO: 19125 - DNA, 1500 bp, Artificial Sequence
  Description of Artificial Sequence: Synthetic coding sequence
atggcttctcggctgactctgctgaccttgctccttctcctcttggcaggagatcgcgcgtcatccaatccaaatgccacttcgtcgtccagccaggacccggaatctctccaagaccgcggcgagggaaaagtggcaactaccgttatcagcaagatgctgttcgttgaaccgattttggaagtcagcagcctgccgactaccaatagcaccactaactccgccaccaaaatcacggcaaacacgactgacgagccaaccactcaaccaactactgaaccaaccacgcaaccaactatccaacccacccagccgacgacccaactgccaactgattccccgacccagccgactactggatcattctgtcctggaccggtgaccctctgttcagacctcgagagccattccaccgaggctgttctcggagacgctctggtcgatttctccctgaagctgtaccacgctttttccgccatgaagaaggtcgaaactaatatggccttttcgcctttcagcatcgcttcgctgctgacccaagtcctgttgggggccggcgagaacaccaagactaacttggaatccatcctgtcgtaccccaaggattttacctgtgtgcaccaggccttgaaggggttcactacgaagggtgtgacctcagtctcacagatcttccacagccccgacctcgcgatccgcgacaccttcgtgaatgcgtcacggaccctgtactcttcctccccgagggtcctgtcaaacaacagcgacgcgaatctggagcttatcaacacgtgggtcgccaagaatactaataacaagatctcaagactgctggattccttgccgtccgacacccggctcgtgcttctgaacgcgatttacctgtccgctaagtggaaaactactttcgatcctaagaaaactcgcatggaaccgttccactttaagaactcagtgatcaaggttccaatgatgaactccaaaaagtacccagtggcccacttcatcgaccaaaccctcaaagccaaagtcggacaactccaactgtcacataacctgtccctggtgatcttggtcccgcagaacctgaagcatcgcctcgaggacatggagcaagccctgtcgccgtccgtgttcaaggccatcatggaaaaacttgaaatgtccaagtttcagccaactttgctgaccctgccacggatcaaagtcacgacttcgcaagatatgctttcaatcatggaaaagctcgaattcttcgacttcagctacgacctgaacctctgcggactgactgaggaccctgacctccaagtctcggcgatgcagcaccagactgtgctggagctgactgaaaccggggtggaggcggccgccgcctcggcaatctcagtcgcccgcaccctgctggtgttcgaagtgcagcagccttttctcttcgtgctgtgggatcagcagcataagttccctgttttcatgggaagagtgtatgatccgcgagcc

SEQ ID NO: 19126 - DNA, 1500 bp, Artificial Sequence
  Description of Artificial Sequence: Synthetic coding sequence
atggcgtcgcgtctaacgctattaacgttattattactactattagcgggtgatcgtgcgtcgtcgaatccgaatgcgacgtcgtcgtcgtcgcaagatccggaatcgctacaagatcgtggtgaaggtaaagtagcgacgacggttatatcgaaaatgctatttgttgaaccgatattagaagtatcgtcgttaccgacgacgaattcgacgacgaattcggcgacgaaaataacggcgaatacgacggatgaaccgacgacgcaaccgacgacggaaccgacgacgcaaccgacgatacaaccgacgcaaccgacgacgcaactaccgacggattcgccgacgcaaccgacgacgggttcgttttgtccgggtccggttacgctatgttcggatttagaatcgcattcgacggaagcggtattaggtgatgcgttagttgatttttcgttaaaactatatcatgcgttttcggcgatgaaaaaagttgaaacgaatatggcgttttcgccgttttcgatagcgtcgctactaacgcaagtattactaggtgcgggtgaaaatacgaaaacgaatttagaatcgatattatcgtatccgaaagattttacgtgtgtacatcaagcgctaaaaggttttacgacgaaaggtgttacgtcggtatcgcaaatatttcattcgccggatctagcgatacgagatacgtttgtaaatgcgtcgcgaacgttatattcgtcgtcgccgcgagttctatcgaataattcggatgcgaatttagaactaataaatacgtgggttgcgaaaaatacgaataataaaatatcgcgtctattagattcgctaccgtcggatacgcgattagttttattaaatgcgatatatctatcggcgaaatggaaaacgacgtttgatccgaaaaaaacgcgaatggaaccgtttcattttaaaaattcggtaataaaagttccgatgatgaattcgaaaaaatatccggttgcgcattttatagatcaaacgctaaaagcgaaagttggtcaactacaactatcgcataatctatcgctagtaatattagttccgcaaaatttaaaacatcgtttagaagatatggaacaagcgttatcgccgtcggtatttaaagcgataatggaaaaattagaaatgtcgaaatttcaaccgacgctattaacgttaccgcgaataaaagtaacgacgtcgcaagatatgctatcgataatggaaaaactagaattttttgatttttcgtatgatttaaatttatgtggtctaacggaagatccggatctacaagtatcggcgatgcaacatcaaacggttctagaattaacggaaacgggtgtagaagcggcggcggcgtcggcgatatcggttgcgcgtacgttattagtttttgaagtacaacaaccgtttctatttgtattatgggatcaacaacataaatttccggtttttatgggtcgtgtatatgatccgcgagcg

SEQ ID NO: 19127 - DNA, 1500 bp, Artificial Sequence
  Description of Artificial Sequence: Synthetic coding sequence
atggcgagtcgcctcactctgctgacgctgctgctgctgttgctcgcgggagatcgtgcgtcgtccaatccgaacgcgactagtagctcaagccaagacccagaatctcttcaagaccggggcgaaggaaaggtggctactactgtgatctccaagatgctcttcgtcgagccgattctggaggtcagcagccttccaaccactaattctaccaccaactccgccactaagatcaccgcaaacactactgacgagccgaccacgcagcctactaccgagcctaccacgcaaccgaccattcaaccaacccagcccacgactcaattgccaacggactctccgacccaaccgacgactgggagcttctgtcccggtccagtcaccctgtgcagcgacctcgaatctcactccaccgaagccgtcttgggtgacgccctggtggacttctcactcaaactgtatcatgcattttccgccatgaagaaagttgagactaatatggccttttccccattttcaatcgcgagcctcctcactcaggtgctgctgggagcaggagaaaacaccaaaactaatttggaatcgattttgtcctaccctaaggatttcacttgcgtgcatcaggccttgaagggcttcaccaccaagggggtcacctctgtcagccagatcttccacagcccagatctggcgatccgcgataccttcgtgaatgcgtcgcggaccctgtactcgtcatccccccgcgtgctctcgaacaactccgatgcaaacctggagcttatcaacacttgggtggccaaaaacaccaacaacaagattagtaggctcctggattcactgccatcagacacgaggctggtcctgctcaacgccatctacctgtccgcaaagtggaaaactacctttgacccgaagaaaactcggatggagccattccatttcaagaattcggtgatcaaagtgcccatgatgaattcaaagaagtaccctgttgctcacttcatcgatcagaccctgaaggcgaaggtaggacagcttcaactgtcgcataacctgtcgctcgtgatccttgtcccgcagaatctgaagcacagactcgaagatatggaacaagcactgtcaccgtcggtgttcaaggcaatcatggaaaagctcgagatgagcaagtttcagccgactctgctcaccctccctcgtatcaaagtgaccacgagccaggatatgctgtcgatcatggaaaaactcgaattcttcgacttctcttacgatttgaacctttgcggcctcaccgaggacccggacctgcaggtgtcagccatgcagcaccagacggtgcttgaactgactgagacgggcgtggaagcagctgccgcctcggctatctcggtcgcacgcacccttctggtatttgaggttcagcaaccattcctcttcgtgctgtgggaccagcagcacaagttcccggtgttcatgggaagagtgtacgaccctcgagct

SEQ ID NO: 19128 - DNA, 1500 bp, Artificial Sequence
  Description of Artificial Sequence: Synthetic coding sequence
atggcatcacgcctgactctgctgaccctcctcctcctgctcctggccggagatcgagcgtcatcgaacccgaacgccactagctcctcgtcccaggacccagaatcgcttcaggatcgcggcgagggcaaggtggccacgaccgtgatttcgaagatgctgttcgtggaacccatcttggaagtgtcctcgttgccgactactaactcaaccacgaacagcgccactaagattactgcgaacactaccgacgaacctaccactcagccaactacggaaccgacgactcaaccgactattcaaccaacccaaccgaccacgcagctcccgactgacagccctacccagccgaccactgggagcttctgtcctggaccggtgactctgtgctcggaccttgagtcccattccactgaggcggtgctcggcgacgctctggtcgatttctcgttgaagctctaccacgcattttcagctatgaagaaggtggaaactaatatggctttctcgccattcagcatcgcgtcgctgctgactcaggtcttgctcggagcgggtgaaaataccaagaccaatcttgagagcatcctgtcttacccaaaagacttcacctgcgtccatcaggcgctgaaaggatttaccaccaagggcgtgacttcagtctcacaaatctttcactctccagacttggcaattagagacaccttcgtgaacgcgtcaaggaccctgtacagctcctccccacgcgtgctgtcgaacaactcggacgccaaccttgagctgatcaacacctgggtcgctaaaaacactaacaacaagatctcgagactgctggactccttgccatcagacaccaggctggtgctcctcaatgccatctacctgtcggcgaagtggaaaacgactttcgatccaaaaaagacccggatggagccgttccatttcaagaatagcgtgattaaagtgccgatgatgaactcgaagaaatacccggtcgcccactttatcgatcagactctgaaggcgaaggttgggcagctgcaactgtcgcataacttgagcctggtgatcctggtgccccaaaacctgaagcaccgcctcgaggacatggagcaagcgctctccccatccgtgtttaaagcgatcatggaaaagctggaaatgagcaagtttcagccaaccctccttaccctgcctagaatcaaagtgaccactagccaggatatgctgtctatcatggagaagttggaattctttgatttctcctacgacctgaacctgtgcggactgactgaggatccggatctgcaagtctccgcgatgcaacatcagaccgtgctggaactgactgaaaccggtgttgaagccgcggctgcctccgccatctccgtggcccgaactctgctcgtgttcgaagtgcagcagccgttcttgttcgtgctgtgggatcagcagcacaaatttccggtgttcatgggtcgcgtctacgatccgcgggcc

SEQ ID NO: 19129 - DNA, 1500 bp, Artificial Sequence
  Description of Artificial Sequence: Synthetic coding sequence
atggcatcgcgcttaacgcttctcaccctgctcctcctactgcttgcgggagatagagcaagttcaaacccaaacgccacgtcctcaagctcacaggacccagaatcgcttcaggatcggggagaaggtaaggtggcaacaaccgttatctctaagatgttgttcgtggaacctattctggaggtgtcttcactgcccaccaccaactcaaccactaacagtgctactaagatcacggcgaacacgaccgacgagcccactactcagccgacgactgagcctaccacccagcctaccatccagccaacccagccaaccacccagcttccaactgacagtcccactcagcctactaccggctctttctgtcccggtcctgtcaccctgtgctccgatctggagtcccactccacagaagcagtcctcggcgacgcactcgtcgatttttctctgaagctctaccatgctttcagtgcaatgaagaaggtggagacaaacatggcattctcacctttctccatcgcctctttgctgacccaggttctgctgggagcaggagagaacactaagactaacctcgaatctatcctttcctatcctaaggacttcacctgcgtccatcaggcgcttaagggattcacaaccaaaggggtgacctctgtgagccagatcttccattcaccggatttggcgattagagacaccttcgtgaatgcatcaagaacactgtattcttccagtccccgagtcctgagcaataatagtgatgcaaacctggaactgattaacacgtgggtggcgaagaataccaacaacaagatcagtaggttactcgactctctaccctctgatactaggttggtactgctcaatgcaatctacctcagtgctaagtggaaaactactttcgaccccaaaaagaccaggatggaaccattccactttaaaaactccgtgataaaggtgccaatgatgaattctaagaagtatccggtcgcacatttcattgatcaaacactcaaggcgaaggtgggtcaactacagctatcacacaatctaagcctggttatcctggtaccgcaaaacctgaaacacagactggaagacatggaacaagctctatcaccctccgtctttaaagccataatggagaaactcgagatgagcaagttccaacctaccctcctgacccttccccggataaaggtaacgactagtcaagatatgctttcaattatggaaaaactggaattctttgacttctcctacgatctgaatttatgtggcctgaccgaagatcctgatcttcaagtctcggcaatgcagcaccagactgtgcttgagctcactgagacaggcgtcgaggccgcagccgcgtccgctatttcagtcgccagaaccctccttgtgtttgaagttcagcagccgtttctctttgttctgtgggatcagcaacacaaattccccgttttcatgggtagggtatacgacccccgggcg

SEQ ID NO: 19130 - DNA, 1500 bp, Artificial Sequence
  Description of Artificial Sequence: Synthetic coding sequence
atggcatccaggctcaccttgctgacactcctgttgctgctgcttgcaggagatcgggcatccagcaacccaaacgcaacgtctagctcttctcaggaccccgagtccctgcaggaccggggcgagggcaaggttgcaactacggttatttccaaaatgctgtttgtcgagcccatactcgaggtcagctctcttcctactaccaatagcacgacaaattctgctactaagattacagcaaataccaccgatgaaccaactacccagcctacaacagagcccactacacagcctacaatccagcccacgcagccaactacacagctgccaaccgattcccccacccaacctaccacgggaagcttctgcccagggccggttacactctgcagcgatctcgagagccatagtaccgaagccgtcctgggggacgccttagtcgatttctcgctgaaattataccacgcattctctgccatgaaaaaagtggaaacaaatatggcctttagtcccttctctattgcgtcactactaacacaggtgctcctgggcgctggggagaacactaaaacaaatctggaatccatcttgtcatatccgaaagacttcacctgcgttcaccaagctcttaagggatttaccactaaaggcgttaccagcgtgagtcagatcttccattctccagacttagccatacgagatacttttgtgaacgctagccggacactgtactcgagctcccctcgcgtgctctccaacaacagtgacgcgaaccttgaactgatcaatacgtgggtggcaaaaaacactaataataaaatatctaggctgctggattccctgcccagcgatacgaggcttgttctcctgaacgcaatctacctgtctgctaaatggaagaccacattcgacccaaagaaaaccagaatggaaccatttcatttcaaaaattcggttataaaagtgccaatgatgaactccaagaaataccctgtcgcccatttcattgaccagaccctgaaggctaaggttgggcagttacagttgagtcacaacctctcgttggtcatactcgtaccgcagaatctgaagcacagacttgaagatatggagcaggctctgtctcctagtgtgttcaaagcaatcatggagaaactggagatgagcaagttccagcccacgctcctgaccttaccgcgaatcaaggtcaccacttcccaggatatgctctctatcatggagaaactggagtttttcgacttttcttatgatcttaacctttgtggactcaccgaggatcccgatcttcaagtatctgccatgcagcaccagactgtgctggaactcacagagaccggcgtggaagcggcagcagcttccgctataagcgtggctcgaacacttctagtttttgaggtccaacaacctttccttttcgtgctgtgggaccagcagcacaaattccccgtattcatgggcagggtttacgacccaagagcc

SEQ ID NO: 19131 - DNA, 1500 bp, Artificial Sequence
  Description of Artificial Sequence: Synthetic coding sequence
atggcgagtaggctcaccctgctcacgctgctgctcctcctgcttgccggggatagagcaagttccaacccaaacgctacttcctcctcatcccaggaccccgaaagtttgcaggaccggggtgagggcaaggtggcaactaccgttatcagtaaaatgttgtttgtggaacccatcctcgaggtgtcctctttgccaacgacaaacagcaccaccaattccgccacaaagattacagctaatacgacggatgagcctaccactcagcctacaaccgagcccacgacccagcctaccatccagccaacgcagcccaccacccagctccctacggactctcctacccagcctaccacagggtccttctgtcccggtcctgtgacactgtgttctgatctggagtctcattccaccgaggccgtgctcggcgacgccctggtggacttcagtcttaaattgtatcatgctttcagcgcaatgaaaaaggtggagactaacatggcctttagtcccttcagtatagccagccttctgactcaggtgttgctgggtgctggcgagaacaccaaaacgaatttggagtctatcttgagctaccccaaagatttcacttgtgtgcaccaagcactcaagggatttaccactaaaggagtcacttccgtgtcccaaatcttccattcccccgatttggcaatccgggacacgttcgtgaatgcctctagaacactgtactcctctagtccccgggtcctgtctaataactctgatgctaatctcgagctgatcaacacctgggtcgctaaaaacacgaacaataagatttcccggttgcttgactcccttccctctgatacgaggctggtgctgttgaatgccatctatctgtctgccaaatggaagacgacctttgacccgaaaaaaacgagaatggagccgttccattttaagaattccgtgattaaggtaccgatgatgaacagtaaaaaataccccgtagcccatttcatcgaccagaccctcaaagccaaagttggacagctgcagctgtcccacaacctgagtctggtgatcctggtgccacagaacctgaaacaccgcctggaagatatggaacaggcactcagcccttctgtgtttaaggctatcatggaaaagctcgaaatgtccaagttccagcccaccctcttgaccctcccacggatcaaggtcactacctctcaagacatgctgtctatcatggagaaattggaattttttgattttagctatgacttgaatctgtgtggtttgactgaggaccctgatctccaggtgagtgctatgcagcatcagacggtcctggaattgaccgagactggcgtcgaggccgccgccgcctccgcaataagcgtagccagaaccctgctggtgtttgaggtacaacagccctttcttttcgtgctgtgggatcagcaacacaaattccctgttttcatggggcgagtgtacgatccgcgcgcc

SEQ ID NO: 19132 - DNA, 1500 bp, Artificial Sequence
  Description of Artificial Sequence: Synthetic coding sequence
atggcttctcggcttacattattgacactactattgctacttctcgcgggggacagagcatcctcgaacccaaacgctacatcaagtagtagtcaggatcccgaatcattacaggataggggagaagggaaggtcgctacaacagttatctctaaaatgctctttgtggagccaatcctggaagtttccagtctccctacaacgaatagtacaactaattccgctacaaagatcacagccaatactactgatgaacccactacacagcctacaactgaacctacaactcaacccacaatccagcctacacagcctactacacagttacctactgactcccccacacagcctacaactggatccttctgccccggaccagttacactctgctctgacctggaaagtcactccacagaagcagtcttaggggatgccctcgtggacttctcgcttaaactataccatgcattctcagccatgaaaaaggtagaaacaaatatggctttcagtccattctcaatcgcttccctgttaacacaggtcctcttaggagccggagaaaacactaagacaaacctcgaatctatcctttcttatcccaaagattttacttgcgtgcaccaggccctcaaaggatttactactaaaggggtcacgtctgtctctcagatttttcattctccagatctcgctattcgggatacattcgttaatgcctcccggacattatattctagttcaccccgcgtgctctcgaacaactcagatgccaatttagaacttataaatacttgggttgcaaaaaacactaataataaaatatcccggctacttgatagtctgccatctgatacaagactggtactcctaaatgccatctatctttccgccaaatggaaaactacttttgatcctaaaaaaactcgaatggaaccttttcacttcaaaaacagtgtcataaaagtgcctatgatgaactctaaaaaataccccgtggcccacttcattgatcagacactcaaagccaaagtcggacagctgcagctctcccacaatctctctctggtgatcctggtaccacagaacttaaaacatagactagaagacatggaacaggccctctcaccaagtgtgttcaaagccatcatggaaaaactcgaaatgtcaaaatttcagcccacattactcactcttccacggatcaaagtcactacttcccaggacatgttaagtataatggagaaacttgagttttttgacttctcatatgatcttaatttatgcgggttaactgaagatcctgacctgcaggtgtcagcgatgcagcatcagactgtgctagaactcactgaaacaggagttgaggccgctgccgcttctgcaatatcagtcgcccggactttattggttttcgaagtccagcagccttttctcttcgtgctctgggatcagcaacataaatttccagtgttcatggggcgcgtgtatgatccaagagct

SEQ ID NO: 19133 - DNA, 1500 bp, Artificial Sequence
  Description of Artificial Sequence: Synthetic coding sequence
atggcatccagactgactttactgacactcctgcttctcctactggccggagatagagcctccagtaatccaaatgcaacttcgtcttcatcacaggatcccgaatcactgcaggatagaggggaaggaaaagtggcaacaactgtgataagtaaaatgctgttcgtggagcccatactcgaagtctcatcattacctacaactaattccacaacaaattctgcaacaaagatcactgccaacacaacagatgagcctacaacacagcctactacagaacctactacacagcccactattcagcctacacagccaactactcagttaccaacagactcgcccacacagcctacaactgggtccttttgccccgggcctgtaactttgtgttctgatctagaaagtcacagtacagaagctgtcctgggagatgcccttgtggacttctctttaaaactgtatcacgcattttcagccatgaaaaaagttgaaactaatatggccttttcgccttttagtatagcttccttactaacacaagtgttgttaggagctggggaaaatactaaaacaaatctggaatccatcctatcttatcccaaagactttacatgcgtccatcaggcactgaaagggttcacaacaaaaggagtgacttctgtgagtcagatatttcatagtcccgatctagccatcagagatacttttgtcaacgcctctaggacattatactcttcatccccgagagtcctgtccaataattctgatgctaacttagaacttatcaacacttgggtcgcaaaaaatacaaataacaaaatatcccggctacttgatagtttgcctagtgatactagactggtgcttctaaatgctatctatctgtccgctaaatggaaaactacatttgatcccaaaaaaacacggatggaacctttccacttcaaaaatagtgtcattaaagttcccatgatgaattccaaaaaataccctgtggctcattttatcgatcagacactgaaagctaaggtggggcagctccagctgtcccataatttatccctcgtgatcctggttccccagaacctcaaacatagacttgaagacatggaacaggcactgagtccatccgtcttcaaagcaataatggaaaaactagaaatgtccaaattccagccaactcttctaactctcccacgcatcaaagttactacatcccaggatatgctgtcaattatggaaaaattagagttctttgatttctcctacgatctgaatctgtgtggactgactgaggatcctgacctacaggtgtccgccatgcagcaccagacggtgttggagctcactgaaacaggagtagaagccgcagcagcctccgcaatctccgttgcacggacactcctagtgtttgaggtgcagcaaccatttctgtttgtattatgggatcagcagcataagttcccagttttcatggggcgggtctatgatcccagggct

SEQ ID NO: 19134 - DNA, 1500 bp, Artificial Sequence
  Description of Artificial Sequence: Synthetic coding sequence
atggcctcccggctgaccttactcacccttttgctgctgctcctggctggggaccgggcttccagcaatcccaatgctacatcatcaagttcccaggacccggaaagcctacaggataggggagaagggaaagtggccacaaccgtgatcagtaaaatgctttttgtggagccgattctcgaggtgtctagcctgcctactacgaacagcaccactaatagtgccacaaagatcaccgcaaataccacggatgaacctactacccagcctaccaccgaacccactacccagccaacaattcaaccaactcagcctacaactcaacttccgaccgacagccctacacaaccaacgacgggttccttctgtcccggcccagtcacactgtgcagtgatttggaatctcattctacagaagctgttctgggggacgcactggtggatttctcccttaagctttaccacgccttctccgctatgaagaaggtagagaccaatatggcgtttagtccatttagtattgcttctctgctgactcaggtgctccttggcgcaggagagaacactaagacgaatctggagtcaatactgtcgtacccaaaagacttcacttgcgtgcaccaggccctgaaagggttcactaccaagggagtgacaagtgtttcacagattttccatagccccgacctagcaatacgcgatacattcgtgaatgctagcaggacgctatattcatcgtccccaagggttttgagtaacaattcagacgctaatctggaactgattaatacgtgggtcgcaaaaaatactaataacaaaatcagcagactgctcgattccttgccttctgacacccgcttggtcctcctgaatgctatatatctgtccgctaagtggaaaacaacattcgaccctaaaaagaccagaatggagccatttcactttaaaaactctgtgataaaggtaccgatgatgaactctaagaaataccctgtggcacacttcattgaccaaaccctgaaagcaaaggtgggacaactgcagctgagtcataaccttagtttggtgatcctggtgccccagaacctgaaacatagactggaggacatggaacaggccttgtcaccctcagtcttcaaagccattatggagaaactcgaaatgtctaaatttcaacccaccttgctcaccctgcctcggatcaaggtgaccactagccaggacatgctttctatcatggagaagctagaattcttcgacttcagctacgatcttaatttgtgtggtctaactgaggaccctgacctgcaggtctccgccatgcagcatcagaccgtacttgaattgaccgagaccggggtggaagcagcggcggctagtgctatctcggtagcccgtacgttgctcgtgttcgaggtgcagcaaccctttttgttcgttctctgggaccagcagcacaaattccccgtgtttatggggcgggtctatgatcccagagcc

SEQ ID NO: 19135 - DNA, 1500 bp, Artificial Sequence
  Description of Artificial Sequence: Synthetic coding sequence
atggcctcccgactcacactcctcactctattgcttctgctgctggctggcgatagggcatcctccaatcctaatgcaacttcaagcagcagtcaggatcctgagagccttcaggacaggggggagggaaaggtggccactactgtgatttccaagatgttatttgtcgagccaatcctggaagtgtcctccctgcctaccactaactccaccactaacagtgccactaaaatcaccgcgaacacgactgatgaacctaccactcagccaacaacggaacccacgacgcagcctaccatccagccaacccaacccacaacacaactgccaacagattcacccacccagccaaccaccggcagtttctgccccggacccgttacactgtgttccgacttggaatctcattcgaccgaggcagtactcggcgacgcactggtggactttagtcttaaactgtaccatgccttctctgccatgaagaaggtggagactaacatggcttttagcccgttcagtatcgcatctttacttacccaggttctgttgggggcaggagaaaatacaaaaactaatcttgagtctatcctgtcatacccaaaagattttacctgcgtgcaccaggcccttaagggattcactaccaaaggcgtgacgtctgttagtcagatattccactcccctgatctcgctatacgagacacgttcgtgaacgcaagccggacactttattcctcaagtccacgagttctgagtaataattctgacgcaaacttagaactgattaacacctgggtggcgaagaacaccaacaacaaaatctcgcgcttgctcgattcactcccatctgacacaagactcgtcttgcttaatgcaatctacctgtcggccaagtggaaaaccacttttgatccaaagaaaaccaggatggagcccttccactttaaaaactcggtaattaaggtaccgatgatgaactccaaaaagtacccagtcgctcatttcattgaccagactttgaaggccaaagtggggcaattgcagctttcccataatctatcattggtcattcttgtgcctcagaacctaaagcacaggctggaagatatggaacaggcattgtcaccctctgtgttcaaggccattatggagaaactggaaatgagcaaatttcaaccaacactgctgacactgccaagaataaaggttacaacttcgcaggacatgttaagcatcatggagaaactggagtttttcgatttttcctacgacctcaatctatgcggcctgaccgaggacccagaccttcaggtatccgccatgcagcaccagactgtgctcgagctgaccgaaacaggggtggaggccgctgcagcatcagccatctccgtcgcacgcacactcctggtatttgaggtgcagcagcctttcctctttgttctttgggaccagcaacataaattcccagtgtttatgggtagggtgtatgatccacgggct

SEQ ID NO: 19136 - DNA, 1500 bp, Artificial Sequence
  Description of Artificial Sequence: Synthetic coding sequence
atggcctcccggctgactctcctcacacttctgctgctgctcctggctggagacagagccagtagtaacccaaatgccacttcatctagcagccaggatcctgagagcctccaggatcggggagaagggaaggtggccacaaccgttatttccaagatgctctttgtagagccgatcctcgaagtgtcctcattgcccaccacaaattcaaccactaatagtgctactaaaattaccgcaaacacaaccgatgagcctacaacacagcccacgactgagcccactacccagcccaccatacagcctacccagccaacaactcagctgcccacagattctcctacacagccaaccacggggtccttttgtcctggaccagtaacactttgttccgatctggagtcccatagtacagaagcggttctgggtgatgctttggtcgacttcagccttaagctttaccatgctttttccgcgatgaaaaaagtagaaaccaatatggcgttctcccctttcagtatcgcctctctcctcacccaggtgctgctgggagccggtgagaacacgaaaacaaacctggagtcaatcctgtcataccctaaggatttcacttgtgtacaccaggcactcaagggttttaccacaaagggagtgacctccgttagtcagatcttccactctcctgatctcgcgatcagggacacttttgtcaatgcctctagaactttgtattcctcttccccccgagttctgtccaataactccgatgctaacttggagctgatcaatacatgggtagccaagaatactaacaacaagatcagcagattgcttgacagcctgccttctgacacccgattggtcttgcttaacgcaatttatctttctgccaagtggaagaccacttttgacccaaagaagactagaatggagccgttccattttaagaattccgtgattaaggtgcccatgatgaatagcaagaaatatccggttgctcactttatcgaccagaccttgaaggcaaaggtgggacagcttcagctctcccataacctgagcctggttatcttggtgccacaaaacctcaaacatagactcgaggacatggagcaagcactttccccatctgtctttaaagctattatggagaagctcgaaatgagtaagtttcagccaaccctgctgacacttccccggatcaaagttactactagccaggacatgctgagcataatggagaaattggagttctttgacttctcctatgacttgaatctgtgtgggctgacagaggaccctgacctgcaggtgagcgccatgcagcatcagaccgtgctggagctgacggagacgggcgtcgaagcggccgccgcgagtgccatctctgtggcaaggacccttctggtctttgaggtgcagcagccctttctttttgtgctctgggatcaacagcataagttccctgtattcatgggacgggtgtacgatccaagagcc

SEQ ID NO: 19137 - DNA, 1500 bp, Artificial Sequence
  Description of Artificial Sequence: Synthetic coding sequence
atggcaagtcgtcttacgctgctgaccctgcttttattgcttctggcaggggatcgcgcatcgtcgaatcccaatgctaccagcagtagctcgcaagatcctgagtcactccaggaccggggcgagggcaaggttgcgaccaccgtgatcagtaagatgctgtttgtcgaaccgatcctggaggtgagttccctgcccacgactaatagtacgaccaacagcgcgactaagattaccgctaacacgacagacgagcccaccactcagccaaccaccgagccaacgacacagcccactatacagccaactcaaccgaccacacagctgccgacggattccccgacccagcccactacgggcagcttttgccctggacccgttactctctgcagcgatttggagtctcactctacagaggcagtgttgggtgatgccctggtggacttcagcctgaagctgtatcacgcattcagcgccatgaagaaggtggagacgaacatggccttcagcccgttcagcattgctagcttgctgacccaggtcctcctgggcgcgggagagaataccaagaccaaccttgagagtatattgtcgtacccgaaggattttacatgcgtgcaccaggctctgaagggcttcactacaaagggagtcaccagcgtttcacagatcttccactcgcccgacctggctatcagggatacctttgtcaatgccagtcggaccctatacagtagctctccaagggtactatcgaataacagtgacgccaacttggagttgatcaatacatgggtcgccaaaaacacaaataataaaatatcgcgacttctcgacagtttgcccagcgacaccagactagtccttctgaatgccatctacttgtccgccaagtggaagaccacattcgatcccaagaagacacgtatggaaccattccactttaagaactccgttattaaggtgccgatgatgaactccaagaagtaccctgtggcccacttcattgatcagactttgaaagccaaggtgggccaattgcaactgagccacaacctcagtctggttattctggtgccccaaaacctgaagcaccgcctggaggacatggagcaagccctgagtccctccgtgtttaaggctatcatggagaagctggagatgagcaaatttcagcccacccttctgacattgccgcggataaaggtgaccacaagccaagatatgctaagcattatggagaagctagaatttttcgatttcagttacgacctgaacctatgtggccttaccgaagatccggatctgcaggtctcggcaatgcagcaccagacagtgctcgagttgacggagaccggagttgaggctgctgccgcatcggctatctccgttgcccgtactctcctggtgttcgaggtgcagcagccgttcctgtttgtgctttgggaccagcagcataaatttccggtgttcatgggacgggtgtacgaccctagagca

SEQ ID NO: 19138 - DNA, 1500 bp, Artificial Sequence
  Description of Artificial Sequence: Synthetic coding sequence
atggcttcgaggctcactttgctcacattacttctgctgctgcttgctggtgatagagcatcttccaaccctaatgcgacctcttcatccagtcaagatcctgagtctttacaagatagaggtgaaggaaaggttgcaactactgtaatcagcaaaatgttgtttgtggaacctatcttggaagtgtcatccttaccaaccactaactctaccacaaattctgctactaaaataactgctaacacaacagacgagccgacaacgcagcctactactgaaccaactactcaaccgaccatacagccaacccagccaactacacagctccccactgattctcctactcaacccactactggtagcttttgccctgggccagtgacattgtgtagcgacttggaatcccattccacagaggcggtgttgggagatgccttggtggatttttcattgaagctttatcatgcattcagtgccatgaaaaaagtcgagactaacatggcatttagcccattttccatcgcttcactgttgacacaagtgttgcttggcgctggagagaatacgaagaccaatcttgagtcaatcttgtcgtatcctaaagattttacttgcgttcatcaggcattgaagggattcactacaaaaggagtcacatctgttagtcagatatttcattcgccagatttagcgatcagagatactttcgtaaacgcgtcacgaaccttatactcatctagcccgagggtattatcaaataatagtgatgcgaatctcgaactcatcaacacctgggttgctaaaaacactaacaacaaaatctccagactcttagattccctaccatccgacactaggttggtgctccttaacgctatttacttgtcagctaaatggaagacaacttttgatccaaaaaagactagaatggaaccattccatttcaagaacagtgttatcaaggtgcccatgatgaactccaagaagtatccagttgcccatttcatcgatcaaactttgaaagcaaaggtcgggcagttacaactgtctcacaatttatcactcgtgatcctggtgccccaaaaccttaaacacagattggaggatatggaacaagccttaagtccttctgtgtttaaagctattatggaaaagcttgagatgtctaagtttcagccaacgcttcttacacttcctcggatcaaggtaacaactagccaagatatgttgtctattatggagaagcttgagttctttgattttagttacgatttgaatctttgcggattgactgaggaccctgatctccaagtttctgcaatgcaacatcagaccgtcctagaattaaccgagactggtgttgaggccgccgcagcttcagccattagtgttgcacgtactttgttggtcttcgaagtgcaacagccttttctgttcgttctttgggatcaacaacacaagtttcccgtttttatgggtagagtgtatgatcctagggct

SEQ ID NO: 19139 - DNA, 1500 bp, Artificial Sequence
  Description of Artificial Sequence: Synthetic coding sequence
atggccagccgcttgaccctcctgacgctgcttctgctcctgctggccggagacagagcatcctcaaaccccaacgcgacttcatcctcctcccaagaccccgagtccctgcaggaccggggggaaggtaaagtggcaactactgttatctcaaagatgctcttcgtggaacctatcctcgaagtgtcatctctgccgactactaacagcaccacgaactccgcaactaaaatcaccgccaacaccaccgacgagcccaccacgcagcccaccaccgaaccaaccacgcaacctactatccaaccaactcagcccactacccagctgcctactgactcccccactcagccaactactggctccttctgccccggtcctgtgaccctgtgctcagacctggaatcccattccacggaggccgtgctgggcgatgccctggtcgactttagcctcaaactctaccacgccttctcagccatgaaaaaagttgaaaccaacatggcgttcagccctttctctatcgcctcgctcctgactcaggtgctgttgggagcaggagagaacaccaagacgaacctcgagtccatcttgtcgtacccgaaggacttcacctgcgtgcaccaagctctcaagggattcaccaccaagggagtgactagcgtgtcgcagattttccactccccggacctcgctattcgcgatactttcgtgaacgcctcgagaaccctgtactcaagctcgccgcgggtcctgtcgaacaactccgatgccaatctggagctgattaacacttgggtggccaagaatacgaacaataagatcagccgcctcctcgatagcctgccttcggacacgaggctcgtgcttctgaacgccatctacctgtccgcgaagtggaaaacgaccttcgacccgaaaaagaccaggatggagccgttccactttaagaactcggtgattaaggtgccgatgatgaatagcaagaaatatcctgtggcacacttcatcgatcagaccctcaaggctaaagtgggacagctccaactctctcacaacctgtcgctggtcatcctggtgccacaaaatctgaagcaccggctcgaggacatggagcaggcgctttcaccgtcagtgttcaaagcaatcatggagaaacttgaaatgtccaaatttcagccgacgctcctgaccctcccgcgcatcaaagtgactacttcgcaagacatgctgtccatcatggaaaagctggagttttttgacttctcgtacgatctgaacctttgcggactcactgaggacccagatctgcaggtgagcgcaatgcagcatcaaactgtcctggaactgactgagactggagtcgaagccgcggccgcctcggcaatcagcgtggccagaactctgctcgtgttcgaagttcaacagccgttcctgttcgtcctgtgggatcagcagcataagttccccgttttcatgggacgggtgtacgatccaagagcg

SEQ ID NO: 19140 - DNA, 1500 bp, Artificial Sequence
  Description of Artificial Sequence: Synthetic coding sequence
atggcatcacgattgaccctgctcaccttgttgctgctgctcctcgcaggtgacagagcctccagcaacccgaatgctacttcctcgtcgtcccaagatccggagtcccttcaggatcggggcgaagggaaggtggctaccacggtcatctccaagatgctcttcgtggagccgatcctcgaggtgtccagccttcccactactaattcaactactaattcggcgaccaagatcaccgccaacactacggatgagcctactactcaaccaactaccgaaccgactactcagccaacgatccagccaacccagccgacgactcagctgccgaccgatagcccaacccaaccgactacgggatctttttgccccggaccagtgactctctgttcagacctcgagtcgcattcgactgaagccgtgctcggggatgctctggtggacttcagccttaagctctaccacgcattttctgcaatgaagaaggtcgaaaccaacatggcattctcgccgttctccatcgctagcttgctgactcaagtgctgctgggcgccggtgaaaacaccaagactaacctggagtcaatcctctcctatcccaaggacttcacctgcgtccaccaagctctgaagggattcactactaagggcgtgacttccgtgtcccagatcttccactcgccggaccttgctattcgcgacaccttcgtgaacgcctccagaacgctgtactcctcaagccctcgtgtgctcagcaataactccgacgccaacctcgagttgattaacacctgggtggccaagaacactaataacaagatcagccggctgctggattcgctgcctagcgacacccggctggtgctcctcaacgcgatctacctttcggccaagtggaaaaccaccttcgatcccaaaaagacgaggatggaaccttttcacttcaagaatagcgtgatcaaagtcccgatgatgaattccaagaaatatccagttgcccacttcatcgaccaaactctgaaagccaaggtgggccaactgcaactgagtcacaatctgtccctcgtgatcctggtgccacaaaacctcaaacatagactggaagatatggaacaagcgctttccccatccgtctttaaggccatcatggaaaagctggagatgagcaagttccagccgaccctgcttaccctgccgagaatcaaggtcactactagccaagacatgctgagcatcatggagaaactcgaattcttcgatttctcgtacgacttgaacctctgcgggctcacggaagatccggacctccaggtcagcgctatgcagcatcagactgtcctggagttgactgaaaccggagtcgaggcagcagccgcatccgcgatcagcgtcgctcggactctcttggttttcgaggtccagcaaccatttctcttcgttttgtgggaccagcaacacaagtttccggtgttcatgggacgggtctacgatccacgcgcc

SEQ ID NO: 19141 - DNA, 1500 bp, Artificial Sequence
  Description of Artificial Sequence: Synthetic coding sequence
atggccagccgcctgaccctgttgaccctgctcctcctgcttctggcgggggatagagcgtcctccaacccgaacgcaacctcgtcgtcctcgcaggatccagaatccctgcaggaccggggagagggtaaagttgcgaccaccgtgatctcgaagatgctgttcgtggaaccgatcctcgaagtctcgtcactcccgactaccaacagcactaccaactcggcgactaagatcaccgctaacactactgacgagcccactacccagccgactactgaaccgaccacccagcccacgatccaaccaacccagccaactactcagctccctactgacagtccgactcagcctaccactgggtcgttctgcccaggacctgtgaccctgtgttcggaccttgaatcacattcaactgaagctgtgctgggagacgcactcgtggacttttccctcaaactgtaccatgccttttcagcaatgaaaaaagtggaaaccaacatggcgttctcacctttttcaattgcgtcgcttcttacccaggtgctcctgggcgccggcgaaaacaccaagactaacctcgaatccatcctctcctaccccaaggacttcacctgtgtgcatcaagctcttaagggatttactaccaagggagtgacctccgtgtcacagattttccacagcccagatctggcaatcagagatactttcgtgaatgcctcaagaactctctactcatcatcgcctcgcgtcttgtcgaacaattccgacgccaatctggaactcatcaacacctgggtggccaagaacaccaataacaagatatcacgcctgctggattccctgccaagcgatacgcggctcgtgctcctgaacgctatctacctgagcgccaagtggaaaacgactttcgaccctaagaaaactcggatggaaccgttccacttcaaaaactctgttatcaaagtcccaatgatgaattcgaaaaagtaccctgtggcccatttcattgaccagactcttaaggccaaagtgggacagctgcaactctcgcacaacctgtccctcgtcattctggtccctcaaaacctgaagcatcggttggaggatatggagcaagcgctgtcgccgtcggtgttcaaggccattatggaaaaactggagatgagcaagttccagcccactttgctgactctcccacgcatcaaggtgactacctcgcaagatatgctcagcattatggagaaattggaattcttcgacttttcatatgatctcaacctgtgcgggctgactgaagatccggacctgcaagtctccgctatgcaacatcagactgtgctggagctcacggaaaccggagtcgaagctgcagccgcatcggcgatctccgtggcgcggactctgcttgtgttcgaggtgcaacaaccgttcctgtttgtgctgtgggaccaacagcacaagttccctgtgttcatgggccgggtgtatgacccgagagca

SEQ ID NO: 19142 - DNA, 1500 bp, Artificial Sequence
  Description of Artificial Sequence: Synthetic coding sequence
atggcttctcggctcaccctcctgacactgctgctgctactgctggcaggcgaccgggcatcctctaatccaaacgcaacaagctccagttcccaggatcctgaatccttgcaagatcgaggggaggggaaagtcgctacaacagttatatccaaaatgctgtttgttgaacccatcttagaagtgtcctctcttcccactaccaacagtaccacaaactccgccacaaaaataaccgcaaatactactgacgaaccaaccacacagcctacaacagaaccaaccacccagccaaccatacaacctactcaaccaaccacccagctgcctaccgactcacctacacagcccacaaccggatctttctgccctggccccgtgacactctgcagcgatctcgaatctcactccaccgaggccgtgctaggcgatgctctggtcgattttagcctgaaactgtaccacgccttttctgccatgaagaaggtggaaaccaatatggcttttagtcccttctccattgcctctctcctgacacaggtcttactcggggccggtgagaatacaaagaccaacctggaaagcatactctcttacccaaaggactttacctgtgtgcaccaggcactgaaaggctttactacaaagggcgttactagtgttagccaaatctttcattctcctgatcttgcaatccgcgataccttcgttaacgccagtaggaccctctatagctcatctccccgtgttttgagcaataatagcgacgctaacttagagctcattaacacttgggtcgccaagaataccaacaacaaaatcagtcgcctgctggacagtctcccttctgacaccaggctggtgctcctcaacgcaatttacctctctgccaagtggaagaccactttcgaccccaagaagactcggatggaacctttccacttcaagaactctgtgattaaagttccaatgatgaatagcaagaaataccctgttgcccacttcattgaccagactctgaaagccaaagtgggccaactccagttatcccataatctcagcctggttatcctggtgccgcagaatctgaaacatcgtttagaagatatggagcaggcccttagtccttctgtcttcaaggccatcatggagaaactggagatgtctaagttccagccgacattgctgaccctgcctcggattaaggtgaccactagccaggacatgttatccatcatggaaaaactcgagttcttcgatttcagctacgacctgaacttatgcgggctgactgaggacccagacctgcaggtctcagcaatgcagcatcagacagtcctggagctgaccgaaaccggcgttgaagccgctgctgcctccgccatctcagttgctagaacactattagtcttcgaggtgcagcagccattcttatttgttctgtgggaccagcaacacaagtttccagtattcatgggcagggtgtatgaccctcgagcc

SEQ ID NO: 19143 - DNA, 1500 bp, Artificial Sequence
  Description of Artificial Sequence: Synthetic coding sequence
atggcatccagacttactctgcttactctccttcttcttctcctggcgggcgaccgggcatcatccaaccctaacgcgaccagctccagctcgcaggaccccgaatctctccaggaccgtggagagggaaaagtggccaccactgtaattagcaaaatgttgttcgtggaaccgatcctggaagtgtcctccctccccactactaattctaccactaatagcgcgaccaagattactgcaaacactaccgatgagcccaccactcaaccaaccaccgaacccactacccagcctaccatacagccaacccagcctactacccaactgcctacggattcaccaacccaacccaccactgggtcgttttgtcctggccctgtgactctgtgctccgatcttgaaagccatagcaccgaagcagtccttggagacgcacttgtggactttagccttaaactgtaccatgcattttcagcaatgaagaaggtcgaaaccaacatggcatttagcccatttagcatcgcaagcctgttgacgcaagtgctcctgggagcaggtgaaaacactaaaaccaacctggagtcaattttgtcctacccaaaagattttacctgcgtccatcaggcgcttaaaggctttactaccaaaggtgttacctcggtgtcccaaatctttcacagcccagacctggccattagggacactttcgtcaatgcatcgagaactctgtactcatcctcgcctagagtgctttcgaacaactcggatgcgaatctggagctcattaacacttgggtggccaagaatactaacaacaaaatctcacgcctgctcgattctctgccctcggacacgagactggtgcttctgaacgctatctacttgtcggctaagtggaaaactaccttcgatcctaaaaagacgcgcatggaaccttttcacttcaaaaactccgtgattaaggtccctatgatgaactccaaaaagtaccctgtggcgcatttcattgatcagacccttaaggcaaaggtgggacaactgcagctttcccataatctctctctggtcattctcgtgcctcaaaaccttaaacacagacttgaagatatggaacaggcgctctccccttcggttttcaaggccattatggaaaagctggagatgtcgaagtttcaacccactcttctgactctccctagaatcaaggtgactacctcccaagacatgctgagcatcatggagaagctggaattctttgatttcagctacgatctcaacctgtgtggacttaccgaggatccagatctgcaggtgtcagccatgcaacatcagaccgttctggaactgaccgaaactggcgtggaagctgctgcagcctccgctatctcagtggcccgtactcttctcgtgttcgaagtgcaacaaccatttcttttcgtcctgtgggaccaacaacataagtttcctgtgtttatgggaagagtctacgacccacgcgca

SEQ ID NO: 19144 - DNA, 1500 bp, Artificial Sequence
  Description of Artificial Sequence: Synthetic coding sequence
atggcatcacgcctcactcttttgacactgctgctgctgcttctggctggcgatagggcctcttccaatccaaacgccaccagcagtagttcacaagatcctgagtcactgcaggacaggggcgagggaaaggtcgcaactacagtaatctccaaaatgctgttcgttgagccgatacttgaggtctcaagtctgccaaccactaattctacaacaaacagcgccactaagatcaccgcgaacacaaccgacgaacctacaacacagcctacaaccgagcctacaacccagccaaccattcaacccacccaacccacgacacagcttccgacggactctccaacccagcctactactggctccttctgcccaggaccagtcactctttgtagcgacctggaatcccacagcaccgaggctgtgttgggcgatgcactcgtggacttctcccttaagttgtatcatgcctttagcgcaatgaaaaaggtcgagactaacatggctttctctccctttagcatcgcatccctgttgacccaggtgctcttgggcgccggtgaaaataccaaaaccaacctggagagtattctcagctatccaaaggacttcacatgcgtgcatcaagccctcaagggtttcacaaccaaaggagtcaccagcgtttcacagatcttccattcccccgaccttgcgatccgcgatacattcgttaatgcttctcgcacactgtactcaagctcaccccgcgtgctttccaataattctgacgctaatctggagctcattaacacctgggtcgcaaagaacaccaataacaagattagcagactgctcgactctctgccttccgacactcgcttggtattgctgaacgctatctacctgagcgctaagtggaagactaccttcgacccaaagaagacccgcatggagccctttcattttaagaattctgtgatcaaggtccccatgatgaattctaagaagtacccagtggcccattttatcgatcagactttgaaagcaaaagtgggacagctccagctcagccacaatctctccctcgtcattttggtcccacaaaatctgaaacatcgcctcgaggatatggagcaggcactctctcctagtgtttttaaggcaattatggaaaaattggaaatgtccaagtttcagccaactctcctgactctgccaagaattaaagtcacaacgtcccaggatatgctgagcatcatggaaaaactggagttttttgatttctcatatgacctgaacctttgtggcctcacggaagacccggaccttcaagtgtccgcaatgcagcaccagacagtgctcgagttgacagaaacgggagtggaggccgctgctgcctcagctatctcagttgccaggactttgctcgtgtttgaggtccagcaacctttcctgttcgtcctgtgggaccaacagcataaattccctgtgttcatgggccgcgtttacgatccacgcgcc

SEQ ID NO: 19145 - DNA, 1500 bp, Artificial Sequence
  Description of Artificial Sequence: Synthetic coding sequence
atggccagcaggcttactctgcttaccctgctgctgcttctgctggccggggaccgggccagctcaaatcccaacgctaccagttcatcaagccaggacccggaatcactgcaagatagaggagaagggaaagtcgccactacagtgatctcaaagatgttatttgttgagcccattctggaagtgagctcgctgcccactacaaactctacaaccaatagtgccactaaaattaccgccaatacgacagacgaaccaacgacccaacctaccacggagcccacgacacagcctacaattcagcccacccaacccaccactcaactgcctacggatagcccaacccaacccacaaccggttctttctgcccaggtcccgttacgctctgctccgacctggagtcacactcaaccgaggcagtgttaggtgatgccctcgttgatttttccctgaagctgtaccacgctttcagcgcgatgaagaaggtcgagactaacatggcgtttagccctttttctatcgccagtttattgactcaggtgcttctgggagcaggcgagaataccaagacaaacctggagagcatcctcagctaccctaaggacttcacttgcgtgcaccaggctctgaaaggcttcacaacaaagggagtgacttctgttagccagatcttccattccccggacttggcaatcagagacacatttgtcaatgcgagccggaccctgtactccagctctcccagagtcctctccaacaactctgatgctaatctggagctgatcaacacctgggtcgcgaagaatactaacaataaaatctcccgattgttggactcattaccatcggacacgcgcctggtcctgttgaatgccatttacctgagcgccaaatggaagacaacttttgatcccaagaaaacccggatggagccgtttcatttcaagaactccgtgataaaggtgcctatgatgaactctaaaaaataccctgtcgctcacttcatcgaccagacactgaaagccaaagtgggtcaattgcaactgagccataacctgtctctagtcatcctggtgcctcaaaacctcaagcacaggttagaagatatggaacaagctctgtcacctagcgttttcaaagctatcatggagaagcttgagatgagtaaattccagccaaccctcctgactttgcctaggatcaaggtaaccacaagtcaagacatgctgtctataatggagaagcttgagtttttcgacttctcttacgacctgaacctctgtgggcttacagaggatcctgacctgcaagttagcgcaatgcagcaccagaccgtgctcgagctgacagagactggcgtggaggcagccgccgcgtctgctatctcagtggccaggacactgctggttttcgaagttcagcagcctttcctgtttgttctgtgggaccagcaacacaagtttccagttttcatggggagagtgtatgatccccgtgcc

SEQ ID NO: 19146 - DNA, 1500 bp, Artificial Sequence
  Description of Artificial Sequence: Synthetic coding sequence
atggccagcaggctgaccctgctgactctgctgctgctccttttggcaggagatagagccagcagcaaccctaacgctaccagctcttccagccaggatccagaatctctgcaagatcggggagagggcaaggtcgcgaccactgtgatatccaagatgctgtttgttgagcctattcttgaagtctcctccctgccaaccaccaacagcaccactaatagcgcaactaagataaccgcaaacactaccgatgaacctacgacccaacctactaccgaaccaaccactcagccaaccattcagccaacccagccgactactcaacttcctactgattcccccactcaacctactactgggtctttttgtccgggtcctgtcaccctgtgttcggacctggagtcgcatagcaccgaagcagtgcttggagacgcactcgtggatttcagccttaagctgtaccatgctttttcggctatgaagaaagtggaaaccaacatggcattctccccattctccatcgcctcgcttcttacgcaggtgctgcttggagccggcgaaaacactaaaaccaacctcgaatccattctgtcatatccgaaggactttacctgcgttcatcaagcactcaagggatttactacgaaaggagtgacctccgtgtcacagattttccattcaccggatttggctattcgtgatactttcgtgaatgcaagccggaccctttactccagctcacccagggtgctgagcaacaattcggatgcaaatctggaactgattaacacctgggtggcaaagaacaccaataacaagatctcgcgccttctggactcccttccttcagacacccggctggtccttcttaacgcaatctacttgtcagctaaatggaaaactacttttgatccaaagaaaactcggatggagccattccactttaagaatagcgtcattaaagtgcccatgatgaactcgaagaaataccctgtcgcacactttatagaccaaactctgaaggccaaggtgggtcagctgcaactcagccacaacctttcgctcgtcatcctggtgccccagaatctcaagcatagactggaggatatggaacaagcactttcgccttcagtgttcaaagcaattatggagaagctcgaaatgagcaagtttcaacctacgttgctgacccttccaaggatcaaggttactacctcgcaagacatgctttcgataatggaaaagctggaattctttgacttttcatatgacttgaatctctgtggcctgacggaagatcctgatctgcaagtctccgcaatgcagcatcagaccgtccttgaactgaccgaaactggagtggaagcggccgcggcgtccgccatttcggtggcccgaactctgcttgtgtttgaagtgcaacaaccgtttctctttgtcctctgggatcaacaacataagtttccggtgttcatgggcagagtctatgatcctagagca

SEQ ID NO: 19147 - DNA, 1500 bp, Artificial Sequence
  Description of Artificial Sequence: Synthetic coding sequence
atggcctctagactaacgttattaacacttttgttgcttctgctggccggggatagggctagttctaaccctaacgccacgtcaagctcctcccaggacccagagagtcttcaggatcgtggtgagggcaaggttgcaactacagttatcagtaaaatgctctttgtagagcccatattagaagtgtcttctctgcctaccaccaactccaccacaaactccgccactaagatcaccgccaatactaccgacgagcctacaacacagccaactacagagccaaccacccagcctacaatccagccgacgcagcccacaactcagttgccaacagattcaccgacacagcctacaacgggtagcttttgcccaggacctgttactctgtgttcagacttggagtctcattctacggaggccgtacttggggatgcattggtggattttagcctcaaactgtaccacgcttttagtgccatgaagaaagtcgaaaccaacatggccttttctccattctctatcgcgtctctgctgacccaagtactgctgggcgcgggagagaataccaagacaaacctggaaagcattctttcctaccctaaagacttcacatgcgttcaccaggcactcaagggttttactacaaagggagtgaccagtgtaagccagatctttcattcgccagacctcgctatcagggataccttcgtgaatgcaagtcgcaccttgtactcatccagccccagagtcctgtctaacaattccgatgcaaatctagagctgatcaacacatgggtcgccaagaacaccaataacaagatcagtagacttttggattccctgccttctgacacccgacttgttctattaaatgcgatatacctgagcgccaagtggaaaacaacctttgaccccaagaagacgcgcatggagccttttcattttaagaattccgtaataaaagtgccaatgatgaactctaagaaatatccagtcgcacattttatcgatcagactctgaaggccaaggtcggccagctgcagctttcacacaatctctccttggttattctcgtaccgcagaatttgaagcatcgcctcgaagatatggaacaggccctgtcaccttccgtgtttaaggctatcatggagaaactggagatgagtaagttccagcctacattgctgacccttcccagaataaaagtgaccacctcccaggatatgctcagcattatggagaagctggagtttttcgacttctcatatgatctgaacttgtgcgggttaacagaggacccagacctccaagtgagcgctatgcaacaccagactgtcctcgagttgaccgagacgggcgtggaggctgccgctgcttcagctatctctgtggcgaggactctcctggtgtttgaagtacagcaaccgtttctcttcgtgctgtgggaccagcagcataaatttccggtatttatggggcgtgtctatgaccccagagca

SEQ ID NO: 19148 - DNA, 1500 bp, Artificial Sequence
  Description of Artificial Sequence: Synthetic coding sequence
atggcaagtcgtttaacgctgctgacgttgttattattgctattagcaggagacagggcatctagcaatcctaacgccacttcgtcctcttcacaggatccggaatctctgcaggatcgcggtgagggaaaggtggcaacaacagttatctcaaagatgctctttgtggagccaatcttggaggtgagctctctgcccacaacaaattcaacaacaaatagcgctaccaagattacagcgaacactacagatgagccaacaacacaaccgacaactgaacctacgacgcagcctacgattcaacctacacagccaaccacacaattaccgaccgactcaccaacacagccgacaaccggaagcttttgtccgggacccgtcacactgtgcagcgatctggaatctcattcaacagaagcggttctgggagacgcactcgttgatttttccctgaaactctatcatgctttttcggctatgaaaaaggttgaaacaaatatggcattttccccattttctatcgcgagcttacttacacaagttcttttgggagctggcgaaaacacaaaaacgaatttagagtcaattcttagctatccgaaggactttacatgcgtacatcaagctttaaaggggttcacaacaaagggggttacatctgttagccaaatttttcatagcccggacttagctataagagataccttcgttaacgcaagccgcacattgtattcttcaagtccgcgtgttctgtctaataacagcgatgcaaatttagagttgataaatacctgggtcgcgaaaaacaccaacaataaaatcagcaggttactggactcgctcccgagcgacacacgactagtattgttgaatgctatttatctgtcggcgaagtggaagaccacgttcgacccgaaaaaaacccgcatggagccttttcattttaaaaactctgtcatcaaagttccgatgatgaacagcaaaaaatatcctgtggctcatttcatcgatcagacgctgaaagctaaagtggggcaactgcagttgagccataatctttctttggtgattctggtgcctcaaaatttaaaacacaggttagaggatatggaacaggctttatcgccatcagttttcaaagcaattatggagaaactggaaatgtccaaattccaacctacattgcttacactgccaaggatcaaggtaacaacaagtcaagatatgttatcaattatggaaaagctagagttttttgatttctcatacgatcttaatctgtgtggattgactgaagatccggatctgcaggttagcgcaatgcagcatcaaaccgtattggaattaacagagacaggagttgaagcagccgctgcctcagctatttctgttgcgcggactcttttggtgtttgaggttcaacagccatttctttttgtgctgtgggaccaacaacataaattcccggtctttatgggtcgggtttacgatcctcgcgcg

SEQ ID NO: 19149 - DNA, 1500 bp, Artificial Sequence
  Description of Artificial Sequence: Synthetic coding sequence
atggcttcccggctcaccctgttgaccctcttgctgctgctgctggccggggacagggcatcgtccaacccaaatgccacctcgagttcgagccaggacccggaatcattgcaggatcggggcgagggcaaggtggcaaccaccgtcatctctaaaatgctgtttgtggagccgattttggaagtctcatcgctcccgactaccaattccactactaactcagcgacgaagattaccgctaataccactgacgagccaaccactcagccgacgactgaacccacgacccaaccgaccatccagccgactcaaccgaccactcaactgccgactgactcaccgacgcaaccaactacggggtcattttgcccaggaccggtcaccctgtgctcggacctcgaatcgcattccaccgaggccgtgctcggagatgcgctggtcgattttagccttaagctgtaccacgccttctcggccatgaaaaaggtcgagactaacatggccttctcacccttctccatcgcttccctgctgacccaggtgctgctcggagcaggcgagaacaccaaaactaacctggagtccatcctgtcatacccgaaggatttcacttgcgtgcaccaggcgctgaagggcttcactaccaagggagtgacctccgtgtctcagatcttccacagcccagatctggcaatccgtgacacttttgttaacgccagcagaacgctgtattccagcagcccacgcgtgttgtccaacaattccgatgccaatctggagctgataaacacctgggtggccaagaacaccaataacaaaatctcaaggctgctcgactccttgccatcagacactagactggtgttgctcaatgccatctacctcagcgcaaagtggaaaaccactttcgacccgaagaaaacgcgcatggaacctttccacttcaaaaacagcgtgatcaaggtgccgatgatgaattcgaagaagtaccctgtcgcccacttcattgaccagaccctgaaagctaaggtcggacaactgcaactgtcccacaatctgtcactcgtgattttggtcccacaaaatctgaagcaccgcctggaggacatggaacaggccctctccccgtcagtgttcaaggctatcatggagaagctggaaatgagcaagttccagcctacgctgctcactctcccgcgcatcaaagtgactacctcacaagacatgctcagcattatggaaaagctggagttctttgacttctcgtatgatttgaacctgtgcgggctgacggaagatcctgatctgcaggtgagcgccatgcagcatcagaccgtgcttgagctgactgaaactggggtggaggctgcagcggcctcggctatctctgtggccaggacgctgctggtgttcgaagtgcagcagccgttcctgttcgtgctctgggatcagcagcacaaatttccggtattcatgggtcgggtctacgatcccagggcc

SEQ ID NO: 19150 - DNA, 1500 bp, Artificial Sequence
  Description of Artificial Sequence: Synthetic coding sequence
atggcatcgcgccttaccctccttacccttcttctgctccttctggcgggtgatagagcatcctcgaacccgaatgcaacctcgtcatcgtcgcaggatccagaatcactgcaggaccgcggagagggaaaggttgccaccactgtcatttccaagatgctctttgtggaaccaatcctggaagtgtcctctctgcctactaccaactcaacgaccaactcagccaccaaaatcactgcgaatactactgatgaaccaaccactcaaccaaccaccgaacctactactcagcccactatacaacccacccagcctacgactcaactcccaaccgactctcctacccagccaaccaccggcagcttttgtcccgggccagtcacgctttgttcggacttggaatcgcattccactgaagcagtgctgggcgatgcactggtcgacttttcgctgaaactttaccatgctttctcggcaatgaaaaaggttgaaaccaacatggcattttctccattttccattgcaagtttgctcacccaagtgctgttgggcgccggtgaaaatacgaaaactaacctggagagcatcctttcgtatcctaaggatttcacctgtgtgcaccaagcgctcaaaggttttaccactaagggtgtaaccagcgtgtcccaaatctttcatagcccagatttggccatacgggatacttttgtgaatgcgagcaggactctttacagctcctccccaagggtgctgagtaataactccgacgccaatctggagttgattaacacttgggtggcgaagaatactaacaataagatctcgaggcttctcgattctctgccctcggacactcgcctggtccttctgaacgcaatttaccttagcgcaaaatggaaaactacctttgatcctaagaaaacccgcatggagccttttcacttcaagaactcggtgatcaaggtgcccatgatgaacagcaagaagtaccctgtggcgcactttattgatcagacccttaaagccaaagtgggacagctgcagttgtcacacaatcttagccttgtgatccttgtgccacagaatctgaaacatcgtctggaggatatggagcaggcgcttagcccttcggtgttcaaggcaattatggaaaaactcgaaatgtccaagttccagccgaccctcctgactctccctcgaattaaggtcaccaccagccaagatatgctgtcaataatggaaaagctggaattctttgatttttcatacgatctgaacctttgtggactcactgaagatccagaccttcaggtgtcagcgatgcaacatcaaacggtgcttgaacttaccgagactggagtggaggcagccgcagcttctgccatctctgtggcacgtacgctgctggtctttgaggtgcagcaaccctttctttttgttctctgggatcaacaacataagttccccgtctttatgggacgtgtctacgaccctagggcg

SEQ ID NO: 19151 - DNA, 1500 bp, Artificial Sequence
  Description of Artificial Sequence: Synthetic coding sequence
atggcctctaggctgacgttgctgaccctgctgcttttactgttagctggcgatcgcgcctccagcaaccctaacgcaacctcaagttctagccaggatcccgagagtctacaggaccgcggtgaaggaaaggtcgcaacaacagttatatctaagatgctgtttgtggagcccatccttgaggtctcaagcctgcctactactaacagcactactaactccgccaccaaaattaccgctaacaccactgacgaaccaacaacgcagcctaccaccgaaccaaccacccagcccacaatacaaccaacgcagcctacaacccagctgcccactgactcacctacacagcccactactggctcattctgcccggggccggttacattgtgctccgacctggagtcacactctaccgaagccgtactaggggatgccttggtcgatttctccctcaagctataccatgcctttagtgctatgaagaaggtggaaaccaacatggcttttagtccgttttcaatcgctagcctactgacccaggtcctcctcggtgcaggcgaaaataccaagactaatctagagtcaattttgtcatacccaaaggattttacttgcgtacaccaggctttgaaaggtttcactactaaaggagtcacttccgttagtcagatcttccattccccagatctagctattcgcgatacctttgtcaatgcctcccggacactctattcatctagcccccgggtgctttcgaataactctgatgcaaatctggagcttattaatacttgggtggctaagaacaccaacaacaaaatcagtaggctgttagattccctccctagcgacacgagactggttcttctcaacgctatctatctgtccgctaagtggaaaaccacctttgatcccaagaagacaaggatggaaccttttcacttcaagaattccgtgataaaggtgcctatgatgaatagtaaaaagtatcccgtcgctcacttcatcgaccaaactcttaaggcgaaagtgggtcagctgcagctgtcccacaatctgtccctggtgatcttagtgccacagaacctgaagcatagattggaggacatggagcaggccctgtccccttctgtgttcaaggctatcatggagaagcttgaaatgtcgaaattccagccgacgctgctgactctgccacgtattaaagtcactacctctcaggatatgctctccatcatggaaaagcttgaattctttgactttagttatgaccttaacctctgtggtctcaccgaggacccagacctgcaggtgtccgcgatgcagcaccagacagtgcttgaactgacagaaacaggggtggaggcagcggcggcctccgccatctccgtggctagaacactgcttgttttcgaggtgcaacagccatttctgtttgtcctgtgggaccagcaacacaagtttccagtctttatgggccgggtgtatgacccacgggct

SEQ ID NO: 19152 - DNA, 1500 bp, Artificial Sequence
  Description of Artificial Sequence: Synthetic coding sequence
atggcttcacgactaacacttttgacattactattacttcttttggcaggagacagagcatcatcaaatccaaatgctacatcttcttcatcacaagatcctgaaagtcttcaagatagaggagaaggtaaggtagcaactactgttatttcaaagatgttatttgttgaaccaattttagaagtttcctctttaccaacaactaatagtactactaattcagctactaagattacggcaaatacaacagatgaaccaacaactcaaccaacaacagaaccaacaacacaaccaactattcaacctactcagccaactacacaattaccaactgatagtccaacacaaccaacaactggttcattctgtcctggaccagtcactttatgttcagatttagaatctcattcaactgaagcagttttaggagacgcacttgttgatttttcacttaaattataccatgcctttagtgcaatgaagaaagttgagacaaatatggctttttcacctttttctattgcatctttgcttactcaagttttattgggtgcaggagaaaatacgaaaactaatcttgaatcaattttatcttacccaaaagattttacttgcgtacatcaagcattaaagggttttactacaaagggagttacatcagtttctcaaatttttcatagtccagatttagctattagagacacatttgttaatgcatctagaactttatattcttcatctccaagagttttatcaaataattcagatgctaatttggaattaattaatacatgggtagctaaaaatacaaataataaaatttcaagacttttagattctttaccaagtgatacccgtttagtcttattaaatgcaatttatttatctgctaaatggaaaactacttttgacccaaaaaaaactcgtatggaaccatttcattttaaaaattcagtaataaaagtcccaatgatgaatagtaaaaaatatccagtagcacattttattgatcaaactttaaaagctaaagtgggtcaacttcaattatctcataatttatcactagttattttagttccacaaaacttaaaacatcgacttgaagatatggaacaagcactttcaccatcagtttttaaagctattatggaaaaacttgagatgagtaaatttcaaccaacacttttaacacttccaagaattaaggttacaacatcacaagatatgttatcaataatggaaaaattagaattttttgatttttcatatgacttaaatctttgtggacttacagaagatccagacttacaagtatccgctatgcaacatcaaaccgttttagaattaactgaaacaggagttgaagctgcagcagcaagtgcaattagtgtagctagaacacttttggtttttgaagtgcaacaaccttttcttttcgttctttgggatcaacaacataaattccctgtctttatgggtagagtttatgatccaagagct

SEQ ID NO: 19153 - DNA, 1500 bp, Artificial Sequence
  Description of Artificial Sequence: Synthetic coding sequence
atggcctccagacttaccctgctcactcttcttctgctgcttctcgccggtgatagagcatcgagcaaccctaatgcgacctccagctcatcacaggacccggaatcgcttcaagacaggggagaaggcaaagtcgcgaccactgtgatttcaaaaatgctttttgtggagccaattctggaggtttcatcgctgccaaccactaacagcactactaatagcgcaactaagattaccgccaataccaccgatgaacctaccactcaacccaccaccgagccaactactcagccgacgatccagcctactcagcctaccacccagctgcctaccgacagcccaacccaaccgaccaccggttcattttgtccaggcccagtgaccctgtgttccgatctggagagccattccaccgaagcagtgctgggggacgcactcgtcgacttcagcctgaagctgtatcatgcattctccgcgatgaagaaggtggagactaacatggcattttcgcccttttccattgcatcactccttacccaagtcctcttgggagccggagagaataccaagactaacttggaatctattctctcgtacccgaaggactttacttgtgtgcaccaagcactgaagggatttaccaccaaaggtgtcacctcggtcagccagatatttcattcgcccgaccttgcaatccgcgatacctttgtgaatgcgtccaggaccctgtactcctcctcgcctagggtgctctcgaataacagcgacgcaaatcttgagcttatcaatacttgggtcgcaaagaacaccaacaacaagataagtagacttcttgattcgctgccctccgacactcgtctggtgctcctgaatgcaatttacctgtcggcaaaatggaaaacgacctttgatccaaagaaaaccaggatggagccatttcacttcaaaaactcggtgataaaggtgcccatgatgaattccaaaaagtacccagtggcgcatttcatcgaccaaactttgaaggcaaaggtcggtcaactccagctgtcccacaatttgtctcttgtgatcctggtgcctcaaaacctgaaacatcggcttgaagatatggaacaagccctctcgccatcggtgtttaaagctattatggagaagctggaaatgtccaagttccaaccgacgcttttgactctgccgagaataaaggtgacgacctcccaagacatgctgtccattatggagaaattggagttcttcgatttcagctacgatctgaatctgtgtggactgactgaggaccctgatctgcaagtatccgccatgcaacaccaaactgtccttgaacttaccgaaaccggagtcgaagctgcagccgcaagcgctatttccgtcgcccgtaccttgcttgtctttgaagtgcagcaaccttttctttttgtgctttgggatcaacaacacaagtttcctgtgtttatgggtagggtgtacgatcctagagca

SEQ ID NO: 19154 - DNA, 1500 bp, Artificial Sequence
  Description of Artificial Sequence: Synthetic coding sequence
atggccagccgcctgactctgctcactctgcttctcctgttgctcgcaggcgaccgcgcctcgtccaatcctaatgccacgtcgtcgtcgagccaagatccggagtccctgcaagatagaggagaggggaaagtggccactaccgtcatttcaaaaatgctgttcgtggagcccatcctggaagtgagctcgctcccaacgaccaactccactactaactcggccaccaagattaccgccaacacgactgacgagcctaccactcagccaaccaccgagccgactacccaaccgaccatccagccaacccaacccactacccagctgccgaccgattccccgacccaaccgactactggctcgttttgccccggccccgtgaccctgtgctccgacctggaatcccattccaccgaagccgtgctcggggatgcacttgtggacttcagcctcaagctgtaccacgcattcagcgccatgaagaaggtggaaactaacatggcattctcaccgttttccatcgcatccttgctgacccaggttctgctgggagccggtgagaataccaaaaccaatttggagtcgatccttagctacccgaaggacttcacttgtgtccaccaggccctcaagggctttactaccaagggcgtcacctcggtgtcacaaatctttcattcaccagacttggccatccgggacaccttcgtgaacgcatctcggaccctgtactcctcatcgccgagagtcctttcaaataactcggacgccaacctggaactgatcaacacttgggtggcaaagaataccaacaacaagatctcacggctgcttgatagcctcccctcagatacgagactggtgctgctcaatgccatctaccttagcgcgaaatggaaaactaccttcgacccaaagaaaacccgcatggaacccttccacttcaagaactccgtgataaaggtgccgatgatgaattcgaagaaataccccgtggctcatttcatcgaccagacccttaaagccaaggtgggacagttgcaactttcccataacctgtcgctggtgatcctggtcccgcagaatctgaagcaccgcctggaggacatggaacaagccctgagccctagcgtgttcaaggcaataatggagaagctcgaaatgtctaagttccagccgacgctgttgactttgccgagaatcaaggtgaccacctcgcaagatatgctgtccatcatggaaaagctcgagttctttgacttctcatacgacctcaatctgtgcggactgaccgaggacccggaccttcaagtctccgcaatgcaacaccaaaccgtgctggaactgactgaaaccggagtcgaagcggcggctgcgtcggcgatctccgtggctagaactctgcttgtgtttgaagtccagcaaccatttctgttcgtgctgtgggaccagcaacacaagttcccggtgttcatgggccgggtctatgacccgagggcc

SEQ ID NO: 19155 - DNA, 1500 bp, Artificial Sequence
  Description of Artificial Sequence: Synthetic coding sequence
atggcatcacgcctaacgcttttgactttgctgctgctgctgctggccggtgatagagccagctctaacccaaacgctaccagttcaagctctcaggaccctgaaagcctccaagacaggggagagggcaaggtagccacgaccgttatcagtaagatgcttttcgtcgagcctattctggaagtgagctccttgccgacgacgaattctactaccaattcggctacaaaaattacagcaaatactaccgacgagcccaccacacagcctactactgagcctaccactcagccaacaatccagcctactcaacctaccactcagctccctactgacagtccgacccagcccacaactggctccttctgtcccggccctgtcacactctgctctgaccttgaatctcactcgaccgaggccgtgttgggtgatgcgctagtggatttttctctgaagctctatcacgcgttttcagccatgaagaaagtggaaaccaacatggctttcagtccattcagtatagcctcgctgctgacccaagtcctgctgggtgctggagaaaataccaaaaccaatttggaatcgattttgagctatcccaaggactttacatgtgttcaccaggcattaaagggatttacaaccaagggtgttacttctgtgtctcagatctttcactctccagatttagcgataagggatacatttgtcaacgctagccgaaccctgtattctagctcgcctagagtgctgtcaaacaattcagacgcaaatctggagctgataaatacctgggtcgccaaaaatactaataataagatctcccgactactggactcgctgcctagtgacacccgcctggtgctgttgaacgctatttacttgagcgcgaagtggaagacgacgttcgacccaaagaagactagaatggagcctttccacttcaaaaattctgtgatcaaagtgccaatgatgaacagtaagaagtatcctgtggcccactttattgatcagacattgaaagccaaagtggggcagctacagctgtcgcataatctctccctggttattctggttcctcagaatttgaagcatagactcgaggacatggagcaggctctaagtcctagcgtgtttaaggcaataatggagaaacttgaaatgtcaaaattccaaccaacgctcctcacactacctcgaatcaaagtgactacctcacaggacatgctgtctatcatggaaaagctcgagtttttcgatttctcatacgatctaaacctgtgcggactgaccgaggacccagatctgcaggtaagtgccatgcagcatcagactgtgctggagctcaccgagactggcgtcgaagcagccgcagcatcagctatctcggtggccagaactcttcttgtgttcgaggtgcagcaacccttcttgtttgtgctgtgggatcagcagcataagtttccggtcttcatggggcgagtatacgacccccgggca

SEQ ID NO: 19156 - DNA, 1500 bp, Artificial Sequence
  Description of Artificial Sequence: Synthetic coding sequence
atggcatcacggctgacgcttttgactcttcttcttctgctgctcgccggcgatagggcaagcagcaacccaaatgcaacctcaagctccagccaggatcccgaatcgcttcaggacagaggagagggtaaagtggcgaccacggtgatatcaaagatgttgtttgtggagccgatcctggaagtgtcgtcgctgcctactaccaattcaaccaccaattccgctactaagatcaccgctaacacgaccgacgaacctaccacccaacccaccaccgaaccaaccactcaacctaccattcagcctacccagccaactacccaacttcctacggatagccctacccaaccaacgacgggatcgttctgtccgggacctgtgacgctttgctccgatctcgaatcccattcaactgaggcagtgttgggcgatgcccttgtggatttctcacttaagctctaccatgcattctccgccatgaagaaggtggaaactaatatggcctttagccccttctcaattgctagcctcctcactcaggtccttctgggggcgggtgagaacactaagaccaatcttgaatcgattctctcatatcctaaggactttacgtgtgtgcatcaggcacttaagggatttacgaccaagggtgtgacgagcgtgtcgcagatttttcactcccccgatctggccattcgcgacacctttgtcaacgcctcgcgtactttgtacagctcaagccctcgcgtgctttcgaacaactcagatgccaacctggaattgatcaatacttgggtcgctaagaacactaacaacaagatctcgcgcctgcttgattcgctgccatccgatacccgtttggtcctgctgaacgcgatttaccttagcgcgaagtggaaaacgactttcgatccaaaaaagaccagaatggaaccgttccatttcaagaactcggtgataaaagtgccaatgatgaactcaaagaaatacccggtggcacactttattgaccaaaccctcaaagccaaggtcgggcagttgcagctctcgcataacctgtcccttgtgatcctggtccctcagaacctgaaacaccgactcgaagatatggagcaagcacttagtccatctgtattcaaggccatcatggaaaaacttgagatgtccaaattccaacccacgttgctgactcttccacgaattaaggtcaccacttcgcaagacatgctttcaataatggagaagctggagttttttgatttttcatacgatctgaatctctgtggactcaccgaagatcccgaccttcaagtgtctgcaatgcagcaccaaactgtcctggaactgaccgagactggtgtggaagcagccgcagcatcagccatttccgttgcacggactctgttggtatttgaagtgcaacaaccgtttctgttcgtcctgtgggaccaacaacataagtttccggtctttatgggaagggtgtacgaccctcgggca

SEQ ID NO: 19157 - DNA, 1500 bp, Artificial Sequence; identical to SEQ ID NO: 19129
  Description of Artificial Sequence: Synthetic coding sequence

SEQ ID NO: 19158 - DNA, 1500 bp, Artificial Sequence
  Description of Artificial Sequence: Synthetic coding sequence
atggcaagccgcctaactcttctgacactcttgcttctgctgctcgcgggggaccgagctagctctaaccctaacgctactagttcttcatcccaggaccccgaatctctacaagacaggggcgaagggaaagtagccacgaccgtgatttccaaaatgctttttgtggaacccattctagaagtctcttccctgcccacgactaattcaaccaccaacagcgcaactaagatcacagcaaacacgaccgatgaacccacaactcaacccactacagaaccaacaacacagcctactatccagcccacacagcccactacccagctgcccaccgatagtccgacacaaccaacaacagggtcattttgtcccggccccgtgaccctgtgttcagaccttgaatcacacagcaccgaagcagttctcggtgacgccctggtggatttctcactgaagctctaccatgcttttagtgcaatgaaaaaagtcgagacaaatatggcttttagcccattcagtattgcatcattgctcactcaggtcctcctgggggccggagagaacacaaagactaacttagaatccatcctctcctatcctaaagactttacctgcgtgcaccaggctctgaaggggtttaccacaaagggagtcacatctgtgtcccaaatcttccactccccggatctagctatcagggatacatttgtgaacgcgtctcggacactctacagctcttctcctagggtgctgtcgaataacagcgatgccaatctggagctcataaacacatgggtggccaaaaacacaaacaacaaaatctctaggctgctggactcactcccaagcgacacaaggctggtgctcttgaatgcaatatatctcagtgccaagtggaaaaccacttttgaccctaaaaagaccagaatggaaccatttcattttaagaactccgtgatcaaggtgcctatgatgaattcaaaaaagtaccctgtggctcactttatagatcagacactgaaggcaaaggttggtcagctccagctctcccataatttgtctttagtgattttagttccacagaatcttaagcaccgtttggaagatatggagcaggccctctcaccatcggtgtttaaagcgatcatggaaaaattggagatgtctaagttccaacctacactgttgacgcttccccgtattaaggtcacgactagtcaggacatgttatccattatggaaaagctggaatttttcgacttttcatacgatctaaatctgtgtggacttacagaggacccagacctccaagttagtgcaatgcaacaccagaccgtcctggagctgacagaaacaggcgtagaggctgctgctgccagcgctatctctgtcgcccggacactactagtcttcgaggttcagcagcctttcctattcgtcctttgggaccagcagcataagttccctgtgttcatggggcgagtttatgacccccgggca

SEQ ID NO: 19159 - DNA, 1500 bp, Artificial Sequence
  Description of Artificial Sequence: Synthetic coding sequence
atggcctcgaggttgacactcttgactcttctgttgctgttgctcgccggagatcgtgcttcgagtaatccaaatgccacaagttctagctcccaggaccccgagagcttacaggatcgcggtgagggaaaggtggccacaactgtaatctccaaaatgttgtttgttgaacccatcctggaggtgtcaagtttacctacgaccaattccaccactaattccgccaccaagattactgctaacactactgatgagccaacaacccaacccactacagaacctacaacccagccaacaatccaacccacccagcccacgacacagctcccaaccgattcgccgacccagccaacaacaggctcattctgccccggccctgttactctgtgctcagacctagagtcccattctaccgaggccgttctgggtgatgcgttagtggatttttccctgaaactctatcatgccttttccgccatgaaaaaagtggaaacaaacatggcatttagccccttcagcattgcttccctgctcacacaggtgctgttgggagccggtgagaacacaaaaacaaacctggagtccattcttagctatcctaaggacttcacctgcgtgcatcaagccctgaaggggtttacaaccaagggcgtgacatcagtaagccagatcttccacagccctgacctcgccataagagatactttcgtaaatgcctctcgcacgctgtactcttcctcccctcgcgtgctttctaacaactccgatgcaaatttggagctcatcaacacctgggtagctaagaataccaacaacaagatttctaggctgctggattccctgcctagcgacaccagactggtgctgctgaacgcgatctaccttagtgcaaagtggaaaactaccttcgatcctaaaaagacgagaatggagccctttcactttaagaattccgttatcaaggttccaatgatgaacagcaagaaatacccggtggcacacttcatcgaccagacactgaaagccaaggtgggccagctgcagctgagtcataacctgtctctggtgatcctcgtgcctcagaatctcaagcaccggttagaagatatggagcaggcgctgtcaccttccgttttcaaggccattatggaaaaactggagatgagtaaattccaacccactctgctcacactgccccgcatcaaggttaccacaagtcaggacatgttatccatcatggagaaactcgagttctttgacttcagttacgacctgaacctgtgcggcctgacagaagatccagatctgcaagtgtcagccatgcagcatcagaccgtgcttgagctcacagaaactggagtagaagcagccgccgcctctgctatttccgtggcacgtactctcttggtttttgaagtgcagcagccttttctgttcgtgctgtgggatcagcagcacaagtttccagtgttcatgggccgtgtgtatgacccccgcgcc

SEQ ID NO: 19160 - DNA, 1500 bp, Artificial Sequence
  Description of Artificial Sequence: Synthetic coding sequence
atggcttccaggctcactctgctgaccctcttgttgctgctgttagctggtgaccgggcctctagcaatcccaacgctacaagctcgtcgtctcaggatcccgagagtctgcaagataggggagagggaaaggtcgccacgactgttatatctaagatgctgttcgtggagccgatactggaagtctctagcctgccaaccacgaatagcactactaatagcgccactaagattaccgccaatacaaccgatgaacccacaacacagccaaccacagagcctacaacccaaccaactattcagccaacacagcccactacccagctgccgacagattcaccgacgcagcctacgactggatcattctgtccagggcctgtaactttgtgctcagatctggagtcccatagtactgaggccgtactgggagatgcactagtggatttcagcctgaagctctatcacgcttttagcgcgatgaaaaaagtagagaccaacatggcattctctcccttttctattgcaagtctcctgactcaggttctgctcggcgcgggggagaacactaagactaatctagagtctatcctctcttaccccaaggactttacttgtgtacaccaggctttaaaaggcttcacgactaagggggtcacctccgtgtcccagatctttcacagccccgacctggccattagagacacgtttgtaaacgcgtccagaactttgtactccagtagcccccgggtccttagcaacaactccgacgctaatctcgagctcattaatacctgggtcgccaagaataccaataacaagatttctaggcttctcgacagcctccccagcgatacaaggctggtgttactcaatgccatctatctgagcgctaagtggaaaacgaccttcgaccccaaaaaaacacgaatggaaccgttccattttaagaactccgtaataaaggtcccaatgatgaacagcaaaaagtatccagtggcccactttattgaccagacactcaaggcaaaagttggacagctgcagctttcacataatctgagcctggtgatcctcgtcccccagaacctcaagcaccggcttgaggacatggaacaggcgctgagtccaagtgtgtttaaggccattatggaaaaactggaaatgagtaaatttcagccgaccctgctgacactgcctaggataaaagttaccacctcacaagacatgctttctataatggaaaagctggagtttttcgactttagttacgacctgaacctttgtggcctgaccgaagatcccgacctgcaggtgtctgccatgcagcatcaaaccgtactggagctgaccgagacaggggtcgaagccgccgcagcaagcgccatcagcgtcgcacgaactctgctcgtgttcgaggtgcagcagcctttcctgttcgtgctatgggaccaacaacataagttccccgtgtttatgggacgggtctacgatcctagggcc

SEQ ID NO: 19161 - DNA, 1500 bp, Artificial Sequence
  Description of Artificial Sequence: Synthetic coding sequence
atggctagtagattgacactgctgacacttctcctgttgctgctagccggtgaccgagcgtctagtaaccctaacgccacgagtagttccagccaggacccagaaagtcttcaagataggggcgaaggaaaagttgcgactacagtgatctcaaagatgctgttcgtggagccaatactggaagttagttctcttcccactaccaactctacaaccaacagcgctaccaagatcacagccaacactacagacgagccaaccacacagcccactacagagccaaccacccagcctacgatccagcctacacagcctacaacacagttgcccactgattccccaactcaacccaccacgggttcgttctgtccgggccccgtcaccttgtgctctgacctggagtctcatagcacagaggccgtgctaggcgatgccttagtagatttctcccttaaactataccatgccttctcagctatgaaaaaggtagaaacaaacatggcctttagtccgtttagtattgccagcctcctgacacaagtgctccttggagccggcgaaaacacaaagactaatctcgaatccattctgtcctacccgaaggatttcacttgcgtacaccaggccctgaagggtttcaccactaagggggtgacgtcggtctctcagatcttccacagccccgatctggcaatccgcgatacatttgtgaatgcctctcgcacactttattcttcctctccccgcgttctgtcaaacaacagcgacgctaatcttgaactgatcaatacttgggtcgctaaaaatactaataataagatctctaggctgttagattccttgccctccgatacacgcctggtgctactgaacgcaatttatctgtccgccaagtggaagactacctttgaccccaaaaaaacgcggatggagccattccattttaagaactccgtgataaaagtgcctatgatgaactcaaagaaataccctgtggcacacttcatcgaccagacactcaaggccaaggtggggcaactgcagctgtcccataacctgtccctggtaatactagttcctcagaatctgaagcaccggttagaggacatggagcaagccctgtcaccttccgtctttaaggctattatggaaaagctcgagatgagtaagtttcagcccacccttctgactctgccacgaattaaggttactacgtctcaagatatgctgtctatcatggaaaagcttgagtttttcgacttcagctatgatttgaatctgtgtgggctcaccgaggaccccgatttgcaggttagcgcaatgcaacaccaaaccgtgctggagctgaccgaaacaggagtggaggccgcggcagctagtgccatctctgtcgctcgcacactgctggtattcgaggtccagcaaccatttctattcgttctgtgggatcagcagcataaattcccggtctttatgggcagagtttatgaccctcgggcc

SEQ ID NO: 19162 - DNA, 1500 bp, Artificial Sequence
  Description of Artificial Sequence: Synthetic coding sequence
atggcctccagacttactttactcactcttctcttgttgctgctggctggggatagggcttcttcgaatccaaacgcgaccagttcttcatcacaggacccggagtccctgcaggaccgaggtgaaggaaaggtggctaccactgtcatctccaaaatgctatttgttgaaccaatcttagaggtctcctccttgccaacgacaaacagcaccaccaatagtgctaccaagattaccgccaatacaacggacgagccgaccacacagcctaccactgaacctactactcagcctaccatccaaccaacacaacccaccacccagctgcccaccgattctcccacacagcctactactggaagcttctgtcctggccccgtgaccctctgtagtgacctcgaatcgcattcaactgaggccgtactgggcgacgcactggtggattttagcctgaaattgtatcacgcttttagcgccatgaagaaggtcgagaccaacatggcattctctcccttctctatcgcatccctgctgacccaggtcctattgggagccggtgaaaacaccaaaaccaatctggagtccatcctgtcctaccccaaggattttacctgcgtacatcaggcacttaaagggttcactacgaaaggggtgacctctgttagtcagatcttccattctcctgaccttgccatccgagacacctttgtgaacgccagccggacactctacagctcctctccacgggtgctgagcaacaattcggatgcgaacctggagttgatcaacacatgggttgccaagaacactaacaacaagatttccagactcttagacagtctgccttccgatacacggttggtcctgctaaacgccatatatctttccgccaagtggaaaacaacctttgatccaaagaaaaccagaatggaaccgttccactttaagaatagcgtcataaaagtccctatgatgaactctaagaaatatcctgtggcccacttcatcgatcaaactctgaaggccaaagtagggcagctgcagctttcgcacaacctcagcctggtgattctggtaccccagaacctgaaacaccgactggaggacatggaacaggctttaagtccctcagtcttcaaagcaatcatggaaaaattggaaatgagtaagttccaacctactttgttgacgctccctaggatcaaggtcaccacaagtcaggatatgctgagcatcatggaaaagcttgagttcttcgacttttcctacgacctgaatctctgcggcttgactgaggacccggacttgcaagtgagcgccatgcaacatcaaactgtgctggaattaacagagacaggagtagaagccgccgctgcatcagccattagcgtcgcccggaccctgctggtgttcgaagtgcaacagccgtttttgttcgtcctgtgggatcagcaacacaagtttcccgtgtttatgggcagagtctatgacccaagagcg

SEQ ID NO: 19163 - DNA, 1500 bp, Artificial Sequence
  Description of Artificial Sequence: Synthetic coding sequence
atggcgtcgcgactaacccttttaacattgctgctgcttctgctggctggagatcgggccagttctaacccaaacgctacctcaagttcttcacaagatcctgaaagcctgcaagaccggggcgagggaaaggttgcgaccactgtgatcagcaagatgttgtttgtggagccaattctggaggtgtccagcctgccaacaacaaattccaccacaaatagtgctacaaagattaccgccaatacaacagatgaaccaacgacacaacctactactgagcctaccacacagccaacaattcaaccgacgcagccaactactcagctaccaactgattcaccaacacagcctacaactgggtccttctgcccgggccccgtaacactctgctcggacctggagtcacattctacggaagcagtcctaggcgacgccctggtcgattttagcctgaaactctatcatgcattttcagctatgaaaaaagtggaaactaacatggccttctccccattctccatagcttctctattgacccaggtactcctgggcgccggtgaaaatacaaaaaccaacttggaatccatcttgtcctaccccaaggacttcacctgcgtgcaccaggcacttaagggcttcacgaccaagggggtgacatctgtgtcccaaatttttcactcaccggatctggcaatccgcgacaccttcgttaacgccagccggactttgtatagctccagccctagggttttgtcaaacaactctgatgccaacctggagcttattaatacatgggtggcaaaaaacacaaataataaaatcagcaggttactggatagccttcctagcgacacacggttagtactgttaaatgccatttatctgtccgctaaatggaagaccacgttcgatcccaagaagacccggatggaaccattccacttcaagaattcagtgattaaggtgcccatgatgaattctaaaaagtatcccgtcgctcacttcatcgatcagacgttaaaggcgaaagtaggccagctgcagctgtcccacaacttatccctcgtcatcctcgtgccgcaaaatcttaaacatcgcctggaagatatggagcaggccctttctccatctgtgtttaaggcaatcatggagaagctagaaatgagtaagttccagcccacccttcttactttaccacgcattaaggtgaccacctcccaggacatgctgtctatcatggagaagcttgagttttttgacttctcctacgatctgaatctttgcggtttgacagaagaccccgacctccaggtgtccgcaatgcagcaccagactgttctggaactgaccgagaccggcgtcgaggcggccgcggccagcgcaatctcggtcgcccggacgttgctggttttcgaagtgcagcagccctttctgtttgtgctatgggatcagcagcacaagttcccggtgtttatggggagggtctacgatccaagagcg

SEQ ID NO: 19164 - DNA, 1500 bp, Artificial Sequence
  Description of Artificial Sequence: Synthetic coding sequence
atggcttctaggttgacgctacttacactgctcctgttgctgctggcaggagaccgggcaagtagcaacccaaatgccactagctctagctcacaggatcctgaatctctccaggataggggcgaaggaaaagtggcaacaaccgtgatctctaaaatgttgttcgtggaaccaatcttggaggtctcgtctctaccaactacaaactccactactaactccgctacgaaaattaccgccaatactaccgatgaacccacgactcaaccgaccaccgagccaacaacccagccaacaatccagcccacccagcccactacacagcttcccaccgatagtcccacgcagccaaccaccggctccttttgcccaggccccgtgaccttgtgcagcgatttagagagtcacagcacagaagccgtgctgggcgacgcccttgtcgacttctcgctgaaactgtatcacgcgttttcggctatgaaaaaggttgagactaatatggcatttagtcccttcagtattgcatcactcctgacccaggtgctgttaggagcaggagagaatacgaagaccaatctggagagcatactgtcgtaccccaaggacttcacctgtgttcatcaggctctgaaagggtttactacgaaaggcgtgacatctgttagtcagatctttcatagcccagacctggccatcagagacacatttgtgaacgccagccggactctctatagtagctcaccccgagtgctgagcaacaacagtgatgcaaacctggaactcattaacacgtgggtcgctaagaacaccaataataagatcagtcgcctgctcgacagcctcccttccgatacaaggcttgtgctgctgaatgcaatctacttgtctgctaagtggaaaacaacttttgatccaaagaagacacgtatggagccatttcactttaaaaactcagtgataaaggttccaatgatgaacagcaaaaagtaccccgtggcccattttattgaccaaacacttaaagctaaagtgggacagctgcaattgagccataacctcagcctggtgattcttgtgccacagaatctgaaacacagactggaagacatggagcaagctttaagtccatctgtgtttaaggccattatggagaaactggaaatgtccaaattccaacctaccctcctgacactgccgagaattaaggtcaccacttcccaggatatgctgtctatcatggagaagttggagtttttcgacttcagctacgatcttaacttgtgcggtctgacggaagacccagacttacaggtgtctgctatgcagcaccaaaccgtgctcgagctgaccgagaccggtgtggaagctgcagctgcttcagcgatttccgtcgcacgtactttgctagtttttgaagttcaacagcctttcctctttgtcctgtgggatcaacagcacaaatttccagtgttcatgggcagggtctatgacccgagggcc

SEQ ID NO: 19165 - DNA, 1500 bp, Artificial Sequence
  Description of Artificial Sequence: Synthetic coding sequence
atggcaagccgacttacgctactgacactgttgctgctactccttgccggggaccgtgcctcctctaatccaaacgccacatcctcatctagtcaggaccctgagtccctgcaggatcgaggagaggggaaggtcgctactactgtgatcagcaagatgctcttcgtggagcctatcctggaggtctcctcccttcccactaccaattccacaaccaatagcgcgactaagattacggccaataccactgacgagccgaccacccagcctacgaccgagccaactacccagcccacaattcagccaactcagccaactacccaactgcccaccgattcccccacgcagcccacaaccggctctttttgtcccgggcctgtgactctgtgttccgatttggagagccactcaaccgaggccgtcctcggcgatgcactggtcgatttctccctgaagttgtaccacgcattttcggctatgaagaaagtggagacaaacatggcctttagcccattcagcatcgcctcactgctgacccaggtcctgctgggcgctggtgagaacacaaagactaatctcgagagtatcctcagctatccaaaggacttcacctgtgtgcaccaggccctcaaaggatttacaaccaagggagtgacatccgtgagccagatctttcactcccctgacctggcaattcgtgatacattcgtaaacgcctcgaggacactctattcctcctctccccgagttctgagcaataactctgatgcgaatctcgagcttataaacacttgggtggccaagaatacaaataacaagatctcccggttgctggactctctgccttctgatacacgcctggtgttgctgaacgcgatctacctatcggctaagtggaaaacaacatttgacccaaagaaaaccaggatggagccgtttcatttcaagaacagtgttatcaaggtcccaatgatgaatagcaagaaatatcccgtggcgcattttatcgatcagaccctgaaggccaaagtcggacagttacaactatcgcataatctcagccttgtgattttagtgccccagaatcttaaacaccgcctggaggacatggagcaagccctgtctcctagcgtatttaaagccatcatggagaagctggagatgagcaaattccagcccactctgctgaccctaccaagaatcaaggtgacgacaagtcaggatatgttgagcatcatggaaaagcttgagttctttgactttagctatgacctgaacctctgtggcttaaccgaggatccagatctccaagtgagcgccatgcagcatcagaccgtcctggaattgaccgaaaccggtgtagaggccgcagctgcatccgccatttcagtggcccggacactcctcgtattcgaagtacagcagccatttttatttgtcctgtgggaccagcagcacaaattcccggtattcatgggccgcgtatacgatccacgggcc

SEQ ID NO: 19166 - DNA, 1500 bp, Artificial Sequence
  Description of Artificial Sequence: Synthetic coding sequence
atggcttcccggctgacattgctgactctgctgctcctgctgctggccggagaccgggcgagttctaacccaaacgccacttcatcctccagccaggatcccgaaagtctgcaggatcggggagagggaaaggtagctaccacagtgattagcaaaatgttgttcgttgagccaatcctggaggtgtcctccctccctaccacaaactctactaccaattccgccacaaagattaccgcaaatacaactgacgagcctactacacagccaaccaccgagcccactacccaacctacaatccagcccacccagccgactacccagctgccaaccgacagccctactcagcccacaacggggagcttttgtccaggtcctgtaacactgtgctctgacctggagagtcacagcacagaagccgtgctgggcgatgccctcgtggacttttccctcaagctgtaccatgccttctctgccatgaaaaaggtcgaaacaaatatggctttttcccccttttccatcgcttcattgttgacacaggtgctcctgggagctggagagaacaccaaaacaaatctggagagtatcctgtcctatccgaaagactttacgtgtgtgcaccaggcactcaaggggttcacaaccaagggagtgactagcgtctcacagatctttcactccccggatctggcgataagggatacttttgtcaatgccagcagaaccctgtactcttcatctcctcgggtgctctccaacaatagcgacgccaatctcgagttgatcaacacctgggttgccaaaaacaccaataataaaatctccagactcctggattctctccctagcgacaccaggttggttctcctcaatgccatctatctgtccgcaaaatggaagacaacctttgaccccaaaaagacgcggatggagccctttcacttcaaaaattctgtaataaaggtgcctatgatgaactcaaagaagtatcctgtggcacactttatagaccagaccctgaaggctaaggtgggtcagctgcagttgagtcacaatctctctctcgtgatacttgtgccacaaaatctgaaacatcgcctggaggacatggagcaggctctctcaccatcagtgttcaaggcaatcatggagaagctggaaatgtcaaaattccagcctacccttctgaccttgccgcggatcaaggtgaccacatcccaggacatgctttctatcatggaaaagcttgaatttttcgatttttcctatgatctgaacctgtgtggactcacggaggacccagatctgcaggtgagcgccatgcagcatcagactgtgctggagctgactgaaacgggggtggaagccgccgctgcgagcgctatatcagtggccaggacacttctcgtgttcgaagttcagcaaccgttcctgttcgtcctgtgggatcagcagcataaattcccagtctttatgggaagggtgtacgaccctcgagct

SEQ ID NO: 19167 - DNA, 1500 bp, Artificial Sequence
  Description of Artificial Sequence: Synthetic coding sequence
atggctagccgtcttacacttctcacacttctgcttcttctacttgcaggcgaccgagcctcatcgaatcctaacgccacatctagctctagccaggatcctgagtctcttcaggatcgaggggaaggaaaggttgctacaaccgtcattagcaagatgttgtttgtggaaccgatattagaggtgagctcacttccaacaacaaattcgacaaccaattccgcaactaaaattacagcaaataccacagatgagcctacgacccagccgacaaccgaacctacaacgcagccaactatccagccaacgcagcccacgacacagcttccaacagatagcccgacacaaccgaccaccggatccttttgtccgggccctgtcacattatgcagcgacctggaatcacactccaccgaggcggttctgggtgacgcattagtcgatttctcattgaaactttaccacgctttttcagcaatgaaaaaagtcgagacgaatatggctttttcccctttctccattgcctctcttctcacgcaggttttacttggcgctggcgagaatacgaagactaacctggaatctatcctttcatatccgaaggacttcacatgtgttcatcaggcattaaagggcttcacgacgaagggagttacttccgtcagtcagatctttcattcacctgatctcgcaatcagagatacatttgtaaatgcttcgcgcactctgtattcttcttctccgcgtgtgttaagtaataattcagatgcaaatctggaacttattaacacttgggttgcgaaaaacactaacaataaaattagtcgactcctagatagccttccgtcagatacaagattggtactgcttaatgctatttatctttcagcgaagtggaagaccacgtttgatcctaaaaaaacccgtatggaaccgtttcattttaagaacagtgtgatcaaggtgccgatgatgaattctaagaaataccctgtggcccattttattgaccaaacactgaaggcaaaagtcggtcagttgcagctctctcataacctttccttggtgattcttgtaccgcaaaatcttaagcatcgattggaagatatggagcaagcattgtctccctctgtatttaaagctataatggaaaaattggagatgtcaaaattccaacctacacttctgacactccctcgcattaaagttacaacatctcaggatatgttaagcatcatggaaaaactggagttcttcgatttttcgtatgacctgaatctttgtggcctcacagaagatccggatctccaagtctccgcaatgcagcaccagacggtcttggagcttacagaaaccggcgtggaagcagccgcagctagcgctattagcgtggctcggacattgctcgtctttgaagtacagcaaccatttcttttcgtcttgtgggatcagcaacacaaatttccggtctttatgggccgagtttatgatcctagagcg

SEQ ID NO: 19168 - DNA, 1500 bp, Artificial Sequence
  Description of Artificial Sequence: Synthetic coding sequence
atggcctcccgactcaccctgctgacgttgctgctcttgctgctggcgggggatcgcgcgagttctaacccaaacgccacctcgtcctcgtcacaggatccggaatctctacaagaccgcggggaaggtaaggtggcgactaccgtgatctcaaagatgttattcgtggaacccattctcgaggtttcctcacttcctacaaccaatagcacaacaaactccgctactaaaataaccgctaataccaccgatgagcccacgactcagcccacgaccgaaccaacaacacagccgactattcagcccacccagcccaccacccaactaccaaccgattcaccaacacagcctacaactggtagtttttgcccaggccccgttaccttgtgttctgatcttgagtcccactccactgaagccgtgttaggagatgccctggtcgatttctctctcaaactgtatcacgcattctccgccatgaaaaaggtggaaaccaacatggcgtttagccccttctcaatcgcgtctctgctcacccaggtgctgctgggcgccggggaaaacaccaaaacgaacttggagtccatcctttcttacccgaaggacttcacgtgtgtacatcaagccctaaaggggtttacgacaaagggggttacaagtgtctcccagatttttcacagtcccgacctggccataagagatactttcgtaaatgcctccaggacactgtatagtagctcacctagagtcctttcaaacaacagcgacgcaaacttggaactcatcaacacctgggtggccaagaacacaaacaacaagatttctcgcttgcttgattcactgccctcggacactagactagtgctcttgaatgcaatctacttatccgccaagtggaagacaacattcgaccctaaaaaaacgagaatggagccattccattttaaaaatagcgtgattaaggtacctatgatgaactctaaaaagtatcccgttgcacatttcatcgaccaaaccctcaaggccaaagtgggccagctccagctttctcacaatctgtcactcgtaatcttggtgccgcagaatctgaagcaccggctggaggacatggaacaggcactgtctccaagcgtgttcaaagccatcatggagaaactcgagatgtccaagttccagccgaccctgctcaccttaccccgcataaaggtcacgaccagtcaggacatgctgtcgattatggagaagttagagttcttcgacttttcttacgacttaaatctctgcgggcttactgaggatcccgacttgcaggtctctgccatgcagcaccagaccgtgctcgagctcactgagacaggtgttgaagcagcagctgccagtgctatctctgttgctcgaaccctcctcgtgttcgaagtgcagcagccgtttctgttcgtcctgtgggatcagcagcataagttcccagtcttcatgggtagggtgtacgacccccgggcg

SEQ ID NO: 19169 - DNA, 1500 bp, Artificial Sequence
  Description of Artificial Sequence: Synthetic coding sequence
atggctagccgtcttactctgcttactctgctgcttttattgctggcgggagatagggcctcatcaaatcccaatgcaacgtcctcttcatcccaggacccagagagtctacaggaccgcggcgagggcaaggttgctactacggtgatctctaagatgctgttcgtggaaccaatcctcgaggtctcgagcttgcccaccactaatagcactacaaattctgccacgaagataactgctaacactacagacgaacctacaacacagccaactactgaaccaactacccagccaactattcagccgactcagccgacgactcagctacccaccgacagcccgactcagcccaccactggaagcttctgtcccggacctgtgacactgtgttccgacttggagagccattcaaccgaagccgtcctgggggatgcgctggtcgatttctctctgaaattgtatcatgcatttagtgctatgaagaaagtcgagaccaatatggcctttagcccgttcagcattgccagtctgttaacccaggtactgctcggggccggtgaaaatactaaaaccaatctggaatcaattctgagctaccccaaggatttcacctgtgttcaccaagccctaaagggatttaccactaaaggagtaacttcagtaagtcagatcttccattctccagatttagccatcagggacacattcgtcaacgcctcgcgtaccctgtatagttcatcgcctagagttctctctaataatagtgatgcaaatttggagctgatcaatacctgggtggcaaagaatacaaataataagatatctagattgcttgattctctcccttctgacacgcggctggttctgcttaatgctatctatctctctgccaagtggaagaccacttttgacccaaaaaagactaggatggaaccatttcacttcaagaactctgtaatcaaagtgcctatgatgaactccaagaaatatcctgtcgctcacttcattgaccaaaccctgaaagccaaggtgggccagctacaattgtcccacaatctgagtctagtaatcctcgtcccacagaatctcaaacatagactggaggacatggaacaggccctgtccccctctgtgttcaaggccatcatggaaaagctggagatgtccaagttccagccaacactcttgactctcccgaggattaaagtgacaacatcgcaggacatgctgtctattatggaaaaacttgaattcttcgacttttcctatgacctcaacctttgcgggctgaccgaagatcctgacctgcaggtgtccgctatgcagcaccagaccgtgttggagctgacagagactggggtcgaggcggcagcagccagtgcaatcagtgttgccaggaccctattggtgtttgaggtccaacaacccttcctttttgtcctgtgggatcagcagcataagtttccagttttcatgggaagggtgtacgatccacgcgcc

SEQ ID NO: 19170 - DNA, 1500 bp, Artificial Sequence
  Description of Artificial Sequence: Synthetic coding sequence
atggcctcaaggctaacactcctcacactgcttctattgctcctagccggggatagggctagttctaatcccaacgctacatcctcttcaagtcaggatcctgagtctttacaggatagaggggaaggaaaagtcgccactactgtgatatccaagatgctctttgtggagcctatcctcgaagtgtcatctctgcccactacaaattcaacaactaactccgcaacaaaaataacagcgaatacaactgatgaacctacaactcagcccacaacagaacctactacacagcctactatccagcccacacagccaactacacagttgcccactgactctcctacacaacccacaacagggtctttttgtcctggacccgtcacactgtgctccgacctggaatcacattctactgaagctgtcctcggagatgcactcgtggacttttcactaaaactgtatcacgcgttttcggccatgaaaaaagtagagacaaatatggctttctcccccttttccatagcctctctcctcacacaggtgctcctaggagcaggggagaatactaaaactaatctagaatctatcttgtcctatcctaaagattttacgtgtgttcaccaggccctgaaagggttcacaactaaaggggtaacatcagtttcccagatctttcattcccctgatcttgccatcagggatactttcgtgaacgcttcaagaactctgtacagttcttctcccagggtgttgtcaaacaactctgatgccaaccttgaattaattaacacatgggtcgccaaaaatacaaacaataaaatatctagactcctagattctttaccatcggatactcgcctagtgctactcaatgccatctatctgtcagccaagtggaaaacaacttttgatcctaaaaagacgcggatggagcccttccacttcaagaactccgtaatcaaagtgcctatgatgaatagtaaaaaatatccagtggcccattttattgatcagacactgaaggccaaagtggggcagcttcagctttctcacaacttatctttagtgatccttgtgccccagaaccttaaacatcggctggaggatatggaacaggctctctcccccagtgtctttaaagctattatggaaaagcttgaaatgtcgaaatttcagcctactctactgacactgcctaggattaaagtcacaacatcacaggatatgctctcaataatggagaaactcgagttttttgatttctcttatgatctcaacctctgtgggttaactgaagatcctgacttacaggttagtgcgatgcagcaccagactgtcctcgaattaactgaaactggggtagaagctgccgcagcttccgccatctccgtggctcggacactgcttgtatttgaagtccagcagccttttctattcgttttatgggatcagcagcataaattccccgtgtttatggggagggtgtacgatccacgggca

SEQ ID NO: 19171 - DNA, 1500 bp, Artificial Sequence
  Description of Artificial Sequence: Synthetic coding sequence
atggcaagcagactgactctcctcacattgttactgttgttgctcgcgggcgatagggcctccagcaaccccaacgcgacaagtagttcctcgcaggacccagagtctcttcaggatagaggcgaaggaaaagtggctaccaccgtgatcagcaaaatgctctttgtagagcctatcctggaggtctcgtctctgcctaccaccaactcgaccacaaattcagccacaaaaatcaccgccaacaccaccgatgaaccaaccacccaacctactacagaaccaaccacacagccaacaatccagcccacacaacctacaactcaactgcctaccgatagcccaacgcaaccgaccacaggcagtttctgtcccggccccgtgaccctgtgcagtgatctggagagccacagtaccgaagctgtcctcggagacgccctcgttgacttttcactgaagctgtaccacgcatttagcgctatgaaaaaagtcgaaacaaatatggccttttctccttttagtattgcatcactgttgactcaggtccttcttggagcaggggaaaacaccaaaacaaacctggagtcaatactcagctacccaaaggattttacctgcgtccaccaagctctcaaagggttcaccacaaagggggtcacttccgtctctcagatcttccactctccagatctggctattcgggatacatttgtgaacgcttcacggactctgtatagcagctcccccagggtcctgagtaacaattccgacgcaaacctggaactgattaatacttgggtggcaaagaacactaacaacaagatctctagacttcttgactctctcccaagcgacacccgtctggtgctgctcaatgccatctatctgagtgctaaatggaaaaccaccttcgatccgaaaaaaacccgtatggagccttttcattttaaaaacagtgtgataaaagtccctatgatgaacagtaaaaagtatccagtggctcatttcatcgaccagaccctcaaagccaaagtggggcagctgcaactgtcccataatctcagcctcgtcatcttggtcccccagaacctcaaacatcgcttggaagatatggaacaagcgcttagcccatctgtatttaaggctatcatggaaaagctcgaaatgagtaagttccaacccacattactcacacttccacgcatcaaagtgaccacatcacaagatatgctgtccatcatggagaaactagagttctttgattttagctatgaccttaatctgtgcggccttacagaggaccccgatctgcaagtgtcggctatgcagcatcagactgtgctggagctgactgagacaggcgtggaagcagctgcagcgtcagctatcagcgtggctcgaacccttctggtgtttgaggttcaacagccttttctgtttgtgctgtgggaccagcaacacaagtttccagtgttcatgggcagggtttatgaccccagggcc

SEQ ID NO: 19172 - DNA, 1500 bp, Artificial Sequence
  Description of Artificial Sequence: Synthetic coding sequence
atggcatcccgactcacactgctgacactgctgctgcttctgctggcaggagatcgggccagctccaaccctaatgcaactagttctagttcacaggatccagagtctctgcaggaccgaggcgagggcaaagtggccacaactgtcatctcaaagatgctgttcgtagagccaatcttggaagtgagctctctgccaacaacaaacagtaccacaaattcagcaactaaaatcacagccaacactacagacgagccaaccacgcagccaaccactgagcctaccacccagcctactatccagcccacacagcctaccacacaactgcccaccgacagtcccacacagccaaccacaggcagcttctgccctggccccgtgacactgtgtagtgacctggagagccattctactgaggctgtcctcggggacgccctcgtcgattttagccttaaactttaccacgccttttccgcaatgaagaaagtggagaccaatatggccttcagccccttctctatcgccagcttgttgactcaggtcctgctgggtgctggtgagaatacaaagactaatctggaatccattttgtcataccctaaagactttacctgcgtccaccaggccctcaaggggttcaccactaaaggcgtgaccagtgtcagccaaatttttcacagcccagacctggctatccgggacacgtttgttaacgcctcacgcaccctttacagttcttctcccagagttctgagtaacaattctgacgcaaatctggagctgattaacacatgggtggcgaagaatacaaacaataagatctctaggttgttggattccctgccaagtgacacgcggctcgtgctgctcaacgccatatatttgagtgcgaagtggaagaccacattcgacccgaagaagacaaggatggagcccttccattttaaaaacagcgttattaaggtgccaatgatgaacagcaaaaagtatccagtggcccatttcatcgatcagaccctgaaggctaaagtgggtcagctccagctcagccataatttgtctcttgtgatcttggtcccacagaacttgaagcaccggctcgaggacatggaacaagctctcagtcctagtgtgttcaaggcaataatggaaaagctggaaatgagtaagttccagccgacactcctgacattgcctcggattaaagtaaccaccagccaggacatgctgtctattatggagaaactggagttcttcgacttttcttacgacctgaacctgtgcggcctgaccgaggaccctgatctgcaggtttccgctatgcaacaccaaaccgtgctcgaactgaccgaaaccggcgtggaggccgcggccgcatctgccatctctgttgccaggacactgctggtgttcgaggttcagcaacccttcttgtttgtgctttgggatcagcagcacaaatttcccgtgttcatggggcgggtatacgacccaagggct

SEQ ID NO: 19173 - DNA, 1500 bp, Artificial Sequence
  Description of Artificial Sequence: Synthetic coding sequence
atggcttctcgcttaaccctacttacgttgcttctgttgttactagctggagaccgagccagttctaatccgaacgctacctcctcctcctctcaggacccggaatctctgcaggacaggggtgaaggaaaagtggccaccactgtcatatctaaaatgttgttcgtcgagcctattttggaagtctccagccttcccactacgaatagtacaactaactctgcgaccaaaatcacggctaatactactgatgaacccacgacccagcccaccacagagcctactacccagcccacaatccagccaacccaaccaacaacccaacttcctacagacagtccaacccagccaaccacaggctctttttgtccagggcccgtcacactgtgctctgacctcgagagccactccacagaggcggtactcggagacgccttggtcgacttctccctgaagctgtaccatgccttttcagccatgaagaaggtggaaactaatatggcattcagtcctttctcaattgcatcactgctgacacaggtgctcctcggggccggtgaaaacacaaagaccaatcttgaatcaatcctgtcctatcctaaggactttacttgcgttcaccaggctttgaaaggctttactactaagggcgtgacgtcagtgtcccagatctttcacagcccagatctggctattagggatacttttgtcaacgcatcacggactttatactcttcatctcccagggttttgtcaaataacagtgatgccaatctggagcttatcaacacttgggtggccaaaaacacgaacaataaaatctctagattactcgattcactgccctcggacacaagattagtgttgctgaacgcaatctacctgtccgccaaatggaaaactacattcgatcctaaaaagactcgcatggagccctttcactttaaaaattcagtgataaaagtcccaatgatgaactcaaaaaagtacccagtggcacactttattgaccaaacccttaaagccaaagtcggccagctgcagctatcccataatttgtcactcgtcattttagtgcctcagaatctcaagcatcggcttgaagatatggagcaggcccttagtccctccgtgtttaaagccatcatggaaaagttggaaatgagcaagttccagcccactctcctgactctgccacggatcaaggtgacaaccagtcaggatatgttgagtatcatggaaaaactggagttcttcgacttcagctatgacctcaacctttgtgggcttaccgaggaccctgaccttcaagtgagtgccatgcagcaccagactgtcctcgaactgactgaaacaggtgtcgaagccgcggcagcttctgccatctccgtcgctcgaacacttctggttttcgaggtccagcagccttttctgtttgtgttgtgggatcaacagcacaaattccccgttttcatgggacgtgtatatgaccctagggct

SEQ ID NO: 19174 - DNA, 1500 bp, Artificial Sequence
  Description of Artificial Sequence: Synthetic coding sequence
atggctagtaggctgactcttttgactctgcttcttcttctcttggcaggtgatagggctagttctaatccaaatgctactagctcaagcagccaagatcccgagtcattacaggataggggagagggaaaggttgcaactactgttattagtaagatgctgtttgtggagccaattctggaggtgtcttcgctaccaacaacgaactctacaactaacagtgctactaaaatcaccgcaaatactacggacgagccgactacacaacctactacagagcccacaacccagccaaccatacagccaactcagcctactactcaactgccgacagattctcctactcaacctaccactggctctttctgccctgggccggttactctgtgttccgatctcgagtcgcattcaactgaggctgttcttggggatgccttggtagatttttcacttaaactttatcatgcatttagtgcaatgaaaaaggtggaaactaacatggctttctctcccttctccattgcatcactccttactcaggtgcttcttggcgctggtgaaaacacaaagaccaacttggagtctatcctctcgtaccctaaagattttacatgcgttcatcaagcacttaagggattcacaacaaagggggttacgtccgtttcccaaatatttcactctccagaccttgctataagggacacttttgtcaacgcaagccgaacactatactcttcctcgcctagagtcttgagtaacaacagtgatgctaatttggagttaattaacacttgggtcgcaaagaacacgaataacaaaatttcaaggttactcgactcactcccctctgatacccgtctagttttacttaatgcaatttacctttcggctaaatggaaaaccacctttgatcctaagaagactagaatggaacctttccactttaaaaattcagtcatcaaagtgcctatgatgaactcgaaaaagtaccctgtggcacactttattgatcagacacttaaggccaaggttggccaattacaactcagccacaacttgtcattggttatactcgtgcctcagaatctcaagcacaggcttgaagatatggaacaagcactttcaccttcagtgttcaaggcaataatggagaaattggagatgagtaagttccagcccacattgctaacactaccgcgcattaaggttactacatcgcaagacatgttgagtattatggaaaaattagaattcttcgatttttcatacgatttgaacctttgcggattgactgaagatcctgacctgcaagttagtgccatgcaacatcaaactgtgcttgaattgaccgaaactggtgttgaagcggctgctgcgtctgctataagcgtcgcacgaacacttctagtattcgaagttcaacaaccttttctcttcgttttgtgggatcaacaacataagttccctgtttttatgggaagagtttatgacccccgagcg

SEQ ID NO: 19175 - DNA, 1500 bp, Artificial Sequence
  Description of Artificial Sequence: Synthetic coding sequence
atggcttcccgcctgactctgctgacactactcctattactactggcgggtgacagggcaagctccaatccaaacgccacctctagttctagtcaggaccctgagtcacttcaggatcgaggggagggtaaggtggctaccacagttatctctaaaatgctgtttgtggaacctatactggaggtatcctccctacccactacaaactccactaccaattccgccactaagataactgccaacactaccgacgaaccgacaacacagcctactactgagcccactacccagccaacaattcagcctacacagcctaccactcaactccctacagacagtcccacacaacccacgactgggtcattctgtcccgggccagtcaccctctgttcagatctggagtcacatagtactgaagccgtgctcggggacgccctggtggatttcagcctgaagctctatcacgcattctctgccatgaagaaagttgaaaccaacatggccttctcgccattctccatcgcttcgctgctcactcaggtactgcttggtgctggagagaatactaaaactaatttagaaagtattctgagctatcctaaggacttcacctgtgtgcaccaggccctgaagggattcaccaccaagggggtcaccagcgtgagtcagatatttcacagccccgatttagccatcagagatacattcgttaacgcatctcgtaccctctattctagctctcctcgcgttctgtccaataattccgatgctaatcttgagctgataaacacctgggttgccaagaataccaataataagatctcgaggctcctagactccctgccctcggacacccggctggtccttcttaacgccatttatctctctgcgaaatggaaaacaactttcgaccccaaaaagacacgaatggagccctttcattttaagaattcggtgatcaaagtgccaatgatgaatagcaaaaagtatcccgttgctcacttcatagaccagaccctgaaggcaaaggttggacagctgcaacttagccataatctgagtctggtgatccttgttccccagaatctgaaacaccgcttagaagatatggaacaggctcttagtccatctgtattcaaggcgatcatggaaaaactggagatgtctaaatttcagcccaccttgctgaccttaccgaggatcaaagtgactacttctcaggatatgctgtccataatggaaaagctggagtttttcgacttctcatatgatctgaatttgtgcgggctgacagaagaccctgatctgcaggttagtgctatgcagcatcagaccgtattggagcttaccgaaacaggagtcgaggccgctgccgcgtccgctatttctgttgcaaggacactgttggtctttgaagtccagcagccttttctgtttgtcctctgggaccagcagcacaagtttccagtattcatggggcgcgtgtatgatccccgcgct

SEQ ID NO: 19176 - DNA, 1500 bp, Artificial Sequence
  Description of Artificial Sequence: Synthetic coding sequence
atggctagccgactgaccctcctgaccctgctcctgttgttattagccggagatagagccagttccaatccaaatgctacaagcagttctagtcaagatcctgagtccctccaggatagaggggagggaaaagtcgctaccacagtcatcagcaagatgctgtttgtcgaaccgattctcgaagtgtccagcctgcccactacaaatagcactacgaattccgccactaagatcacagccaatactaccgacgaacctacaacccaaccaacgacggaaccaactacacagcccaccatacagccaactcagcctacaacgcagctgcctactgactcaccaacgcagcccactactggctctttctgcccggggccagtcactctctgtagcgaccttgaaagtcacagcaccgaggctgtgctcggagatgcacttgttgacttctccctgaagttataccatgctttctccgctatgaagaaagtagagactaatatggccttttcgcccttctctatcgcttcactgctgactcaagtgctcttaggggctggtgaaaacaccaagacgaatctggagtctattctctcgtaccctaaggactttacctgtgtgcatcaagctctgaaggggttcactaccaagggagtgaccagtgtgtcccaaatttttcattcgccagacttggctatcagggatacctttgttaatgctagccgcactctatatagtagctctcctagggtgctctctaataactccgacgcgaacctggagttaatcaacacatgggttgctaaaaacactaacaataagatatctagattactcgattctttgccatcagataccaggcttgtgttgctcaacgcgatctatctgagtgctaagtggaagaccacatttgaccctaagaaaaccaggatggaaccttttcatttcaaaaacagcgtgatcaaagtgccaatgatgaactctaagaaatatcccgtagcgcacttcattgatcaaacccttaaagctaaagtggggcagctccagctgtctcacaacctgtcgctagtcatcttggtcccacaaaaccttaagcacagactagaggatatggaacaagccctttctccttcagtgtttaaagcgatcatggaaaaattagaaatgagtaagttccagccaacgttactgacactgccccggattaaagtgacaacatcacaggacatgttgtcaattatggagaagctggagttcttcgatttctcatatgacctcaatctctgcggtctgacagaggaccccgacttacaagtttccgccatgcagcatcagactgtgctggagttgaccgaaactggagtggaggccgcagccgctagtgcgatctcagtcgcaaggacgctgctggttttcgaggtgcaacagcccttcttgtttgttttgtgggaccaacaacacaagttccccgtttttatgggcagagtgtatgatccacgggcc

SEQ ID NO: 19177 - DNA, 1500 bp, Artificial Sequence
  Description of Artificial Sequence: Synthetic coding sequence
atggcctctcggctgacactgctcaccttacttctgttgctgctggcaggggatcgagcctccagcaatcctaacgccaccagttctagctctcaagatcccgaaagcctacaggatagaggcgaagggaaagtagcaacgactgtaatttcaaagatgttgtttgttgaacctatcctggaggtgtcatccctgccgaccaccaacagtactaccaatagcgctaccaagattacggcgaatacaaccgacgagcccactacccaaccaactaccgaaccaaccacacagccaaccatacagcctacacaaccgaccacacagctgcctacagacagccccacccagcctacgactggcagtttttgccctgggcccgtgactctgtgtagcgatctggaatcacattctacagaggcagttttgggcgacgcactggtggacttcagcctgaaattataccacgcattttcagctatgaaaaaggttgagaccaatatggctttttcaccattctccatagcttcactgcttacccaggtgttactgggggcaggcgaaaacaccaagacaaatctggagtctatcttgagctatccaaaagattttacctgtgtgcaccaggcactcaaggggtttactacaaagggcgttactagcgtctcacagattttccactcaccagatcttgccatacgggacaccttcgtgaacgctagccgcaccctttattcctctagtccaagagtgttgtccaacaattcagatgccaacttggaattaataaacacgtgggtagcgaagaacacaaacaacaaaatctcgaggctgctcgattcacttccgtctgacactcgtctcgtgttgcttaacgctatttatttgagcgccaagtggaaaacgacctttgatcccaaaaaaacgcggatggaaccatttcacttcaaaaactccgttataaaggttcccatgatgaactcgaagaagtacccagtggcccatttcatcgatcagaccctcaaagccaaagtgggccagctccagctgagccacaacctcagtctcgtcatcctggtgccccagaaccttaaacacagactcgaggatatggaacaggctttatcaccatccgtcttcaaagccatcatggagaaactggaaatgtcaaaatttcagcccactctcctgacccttcctcgcatcaaggtgacaaccagtcaggacatgcttagcataatggaaaagctggaattttttgactttagttacgatttgaatttgtgcgggctgacagaagaccctgatctacaggtctctgcgatgcagcatcagaccgtcctcgagctgactgagaccggtgtggaagctgctgccgcctccgctatctccgttgcgcgcactctcctcgtgttcgaggtgcagcagcccttcctctttgtcctgtgggaccagcagcacaagttcccagtctttatgggacgcgtgtatgatccccgggct

SEQ ID NO: 19178 - DNA, 1500 bp, Artificial Sequence
  Description of Artificial Sequence: Synthetic coding sequence
atggccagccggcttaccctcctgaccctgctgctcctcctgctggccggtgaccgggccagcagtaaccctaatgccaccagttcgagctcgcaggatccggagtctcttcaagaccgtggagagggaaaagtcgcgaccactgtgatttccaagatgctgttcgtggaacccattctcgaggtttcatccttgcctacaaccaattcaacaaccaatagcgcaaccaagatcactgcaaatactacagacgaaccaacaacacagcccactacagagcctaccacacagcccacaatccagccaacgcagcctaccacacagcttccaaccgactctcccacacaacctacgaccgggagcttttgcccgggacccgtcactctatgcagtgatctggaatcccactcaactgaagccgtacttggagatgcccttgtggatttctcactaaagctctatcacgccttttccgccatgaagaaggtggagacaaatatggctttttcccccttttcaattgcttctctgctcacgcaggtgctcctcggcgccggagagaacactaagaccaatcttgaatctattctttcatatccgaaagacttcacatgcgtccaccaagccttaaaggggtttacaaccaaaggggtgacttcagtgtcacagatttttcacagtccggacctcgcgatcagggacaccttcgtaaatgcgtctcgcaccctgtactcttcatccccaagggtgctgtccaataacagcgacgccaatttagaactaatcaacacttgggtagcgaagaacaccaacaacaagatctcccgtttgctggattccttgcccagcgatacccgactggttctccttaatgctatatacctttccgccaagtggaagacaaccttcgatcccaaaaagacaaggatggaacctttccactttaagaactctgtgatcaaggtaccgatgatgaactctaagaagtatcccgtggcccattttatcgaccagacattgaaggccaaggtcggccagctccaactatcacacaatctctcgctggtgatactcgttccccagaatctgaaacaccgcctggaagatatggagcaggccctgagcccttctgtgttcaaggctattatggagaaactggaaatgagcaaatttcaacccaccttgttgacccttcctcggatcaaggtgactacctctcaggacatgctgtcaattatggagaagctggagttttttgacttctcctatgacctgaacctgtgcggccttaccgaggacccagacctgcaggtgagcgccatgcaacaccagacagttcttgaactgaccgaaactggtgtggaggctgccgccgccagcgcaatttctgtggccaggacactgctggtttttgaggtacagcagccgtttctgttcgttctgtgggaccagcagcataagtttccagtgtttatggggagggtttatgacccccgcgcc

SEQ ID NO: 19179 - DNA, 1500 bp, Artificial Sequence
  Description of Artificial Sequence: Synthetic coding sequence
atggcctcacgcctgactctgttgactctgttgcttctgctgttggccggtgatagagccagttccaaccctaacgcaacctcttcatcttctcaggacccagaatcactccaggatcgcggtgagggtaaagtggctactaccgtcatttctaagatgcttttcgttgagcctattcttgaagtgtcctctctgcctaccactaatagcacaaccaactctgccaccaagattacagccaatactacagacgagcccaccacacagccaactactgaacctaccacccagcctactatccagcctacccaacctactactcagctgcccactgattcccctacacagcctacaaccggatccttttgtcccggtcctgttactctgtgctcagaccttgagtcccacagcaccgaagcagtccttggcgacgctttggtggatttctcacttaagctctatcacgccttctccgccatgaagaaggtcgaaacaaacatggcattttccccattctccatcgccagcctgctgactcaggtgctccttggagcaggagaaaataccaagaccaacctggaatctatactgtcctaccccaaggacttcacctgcgtgcatcaggccctcaagggttttacaaccaaaggcgtcacatccgtgtcacagattttccatagtcccgatctggctattcgcgatactttcgtcaacgctagcagaacactttattcttctagccccagagtgttgagtaacaacagcgatgccaacctggaactcataaacacctgggtggccaagaataccaacaacaagatcagcagactgctggatagtctcccctcagacacaaggctggtactgctgaacgcaatttacttgtccgccaaatggaagactacatttgacccaaagaagacaagaatggaaccattccacttcaagaattccgtcatcaaggtgcccatgatgaacagcaagaagtaccccgtagcacatttcatcgatcaaaccctgaaagctaaggtgggacagctgcagctgtcccacaatctctcattggtgattctggtacctcagaatctgaagcaccgtctggaggatatggaacaagcccttagtccctcagtgttcaaggccatcatggagaagctggagatgtcaaagtttcagcccaccttgctcaccctccccaggatcaaggtcaccacctcacaagacatgctgtccattatggagaagttggagttctttgacttttcctacgatcttaacctgtgtggccttaccgaggaccctgatcttcaggtcagtgccatgcaacaccagaccgtgctggaactgactgagactggcgtcgaggcagctgctgcctctgctatttcagtggctagaacccttcttgtgtttgaggttcagcagcccttcctgttcgttctgtgggaccagcaacataagtttccagttttcatgggtagggtgtatgatccaagggcc

SEQ ID NO: 19180 - DNA, 1500 bp, Artificial Sequence
  Description of Artificial Sequence: Synthetic coding sequence
atggcatcccggctgacgctgctaaccctgctcttattgttgctggccggtgatagggccagctctaaccctaacgcgacctccagcagctcccaggatccggaatcactgcaagatcggggagaaggaaaggtggcaaccactgtgatctctaagatgctatttgtcgaacctatcctggaggtttctagcctcccaactaccaactccaccaccaactccgctacaaagatcactgccaacaccaccgacgaacctaccacacagccaacaacagagccgaccacacagcctaccatccagcctactcagcccactacccagttgcccaccgactcacccactcagccgactactggcagcttctgtccgggccccgtcacgctttgcagtgacctcgagtcacactctaccgaggccgtgcttggtgacgcattggtcgacttctccctgaaactgtaccacgctttctccgctatgaagaaagtggaaactaacatggctttttctcccttctctatcgcttctttgctgacgcaggtgctcctcggcgcgggagaaaatacaaagaccaacctggagtcgattcttagttacccaaaggacttcacctgcgtccaccaggccttgaagggatttaccaccaaaggggtgacttctgttagtcagattttccactctcccgacttggcaataagagacacatttgtaaacgcttcacgcaccctttattcatcatcccctagggtcttgtctaacaattctgacgcaaatttggaattgattaacacctgggtggctaagaataccaataacaagatatctcgcttgctggatagcctaccatccgacacccgtttggtacttttgaatgccatctatctatccgctaaatggaagacaacttttgacccgaaaaaaacccggatggagccctttcacttcaagaattccgttattaaagttcctatgatgaattctaagaagtaccccgtcgctcatttcatcgaccagaccctgaaggctaaggtgggacagttacagctcagtcacaacctcagcctcgtgatcttggttccccagaacctaaagcaccggctcgaggacatggaacaggctctgtccccgagcgttttcaaggctatcatggagaaactcgagatgtccaagtttcagcctactcttctcactttacctcgtatcaaagtaaccacgagccaggatatgctgagcatcatggaaaagttggagttctttgatttcagctacgacttaaatctttgcgggttgactgaagatcctgacctgcaggtgtcggccatgcagcaccagaccgtcttggagcttactgagaccggagtggaagcagctgccgcatcagccatcagtgtggcgaggaccctactggtgttcgaagtgcagcagccgtttctgtttgtactgtgggatcagcaacataaatttccagtgttcatgggcagagtgtatgacccccgggcc

SEQ ID NO: 19181 - DNA, 1500 bp, Artificial Sequence
  Description of Artificial Sequence: Synthetic coding sequence
atggcctctagactgacattgctaaccctgctcctcttactgctggctggagaccgcgccagttccaatccaaacgcaacaagcagttcctcccaggatcccgaatctctgcaagatagaggtgaggggaaggttgccacaactgttatctccaaaatgctgttcgtggaaccaatcctcgaagtgagctctctaccaactacaaacagcaccaccaactctgctaccaaaataactgcaaacacaaccgacgagcctacaacccagcccacaacagaaccaacaacacaacctactatacagccaacccaacctaccacccagcttcccactgattcacccactcaaccaacaactggatccttttgtccaggccctgttaccctttgttccgatctggagtcccactccaccgaagctgtcttgggcgatgccctggtggactttagtctgaaactttaccatgcatttagtgccatgaagaaggtggagacaaatatggctttctccccatttagcatcgcttctttactgacccaagttctcctgggggcaggggaaaataccaagaccaacctagagtctattttgtcttatccgaaggactttacctgtgtacatcaggctctgaaaggctttacaaccaagggcgttacctccgtttcccagatcttccactctcccgacttggctattcgggacacatttgtcaatgcctccagaacactatattcttctagcccccgtgtgctgtccaataacagtgatgcaaacctggaacttattaacacctgggttgccaagaataccaacaataagataagtaggctcctggactcccttccaagcgacacacggctagtcctactgaacgctatttacctgtccgcaaaatggaagaccacatttgatccaaagaagaccaggatggagcctttccattttaaaaactctgtgatcaaggtgcccatgatgaactctaagaagtatcccgtggctcactttattgatcagaccctgaaggctaaagtgggtcagctacagctgtctcataacctgagtctggtcattctagtcccacagaatctaaagcatcggttggaggacatggagcaagctctgtcaccatccgtgttcaaagccattatggaaaaattagagatgtccaagtttcagccaactctgctcactctgcctagaataaaggtcacaacaagccaggacatgctgagcatcatggaaaagctggagttctttgatttctcctatgatctgaacttatgcggtctgaccgaggatccagaccttcaagtttccgccatgcaacaccagacagttctagaactgactgagacaggtgtagaggccgctgcagcctcagccataagcgtggcccgcactctcctagtgtttgaagtgcaacagcctttcctctttgtgctttgggaccaacagcataagtttcccgtgttcatgggcagggtctacgatccaagggct

SEQ ID NO: 19182 - DNA, 1500 bp, Artificial Sequence
  Description of Artificial Sequence: Synthetic coding sequence
atggcatctcgtctgactttgcttacgttgctgctcttacttctcgcaggagatcgtgcttcatcgaatcccaatgcaacgtctagcagctctcaggatccggaaagtctgcaagaccgtggtgagggaaaggttgcaaccactgttatttcgaagatgctgtttgttgaaccaatcttggaagtttcgtccttaccaactacaaactccactactaattcagctaccaaaataactgccaatacaacagacgaaccaacaacgcaacctacgacagaaccgactactcaaccaactattcaaccaacgcaaccaacgactcaattaccaaccgattccccaacgcaacctacaacgggatcattttgtccaggcccagttacgctgtgttccgacttggaatctcattcgacagaggccgttttgggtgatgcattagttgatttctccctaaaactatatcacgccttctcagcgatgaaaaaggttgaaaccaacatggcattcagtcctttctcaatagctagtctgttgactcaggtccttttaggagcaggtgagaacactaaaactaatcttgaatcaatcctgtcatacccaaaggattttacctgcgtgcaccaggcgctgaaaggatttactacaaagggagttacgtcagtctcacaaatttttcatagcccagatcttgccatacgggatacttttgtgaatgcatctcgtaccttgtacagttcttccccaagggttttgagtaataattcagacgctaatcttgaattaattaatacatgggtggctaaaaacacaaacaacaagatctcgcgattgctggactcattgccatccgataccagactggtccttctgaatgcaatatatctctcggcaaagtggaaaactaccttcgatccaaaaaaaacacgaatggaaccattccactttaaaaacagcgtcataaaagttccgatgatgaattcgaagaagtatccagtagcacacttcattgatcaaacactgaaagcaaaagtaggtcaattgcaactcagccataatttgtctctggtgattctggtcccacaaaatctgaaacacagattggaagatatggaacaggccttgtcaccgtccgtattcaaggccatcatggagaagctggaaatgtccaaatttcaaccgactctcctgacattgccacgtataaaggttacgactagccaagatatgctatcgataatggaaaagttagaattctttgattttagttacgatctaaacctgtgcggacttactgaagacccggatctgcaggtgtccgccatgcagcatcaaaccgttttagaattgactgaaacaggggtcgaggccgcagctgcatcagcgatttcagtcgcccgcactctcctagtatttgaggtgcagcagccattcctttttgttctgtgggatcaacagcacaaattcccggtgttcatgggccgtgtgtatgatccacgtgct

SEQ ID NO: 19183 - DNA, 1500 bp, Artificial Sequence
  Description of Artificial Sequence: Synthetic coding sequence
atggcttcaagattaactttattaactcttttattattacttttagcaggtgatagagcatcaagtaatccaaatgcaactagttcatcatcacaagatccagaatctttacaggatcgaggagaaggaaaggttgccacaaccgtaattagtaagatgttatttgtagagccaatcttagaagtatcttcactcccaacaactaattcaacaactaattcagctacaaaaattactgcaaatactacagatgaaccaacaacacaaccaactactgaaccaacaactcaaccaactatacaaccaactcaaccaacaacacaattacctactgatagtccaacacaaccaacgactggttcattttgtccaggtcctgtcactttatgtagtgatttagaatcacattcaacagaggctgttttaggagatgcattagttgatttttcattaaaattatatcacgcattcagtgctatgaagaaagtagaaactaatatggctttctctccattttcaattgcatcattattaactcaagtacttttaggagcaggtgaaaatactaagactaatttagaaagtattctttcatatccaaaggattttacatgtgtacatcaggctttaaaaggtttcacaacaaaaggagtaacatcagtcagtcagatttttcattctcctgatttagctattagagatacatttgttaatgcaagtagaactctttattcttcttcaccaagagttctttcaaataattcagatgctaatttggaattgattaatacttgggttgctaaaaatactaacaataagatttcaagattacttgattcattaccatctgatactcgtcttgtcttgttaaacgctatatatttaagtgcaaaatggaaaactacatttgacccaaaaaaaacaagaatggaaccttttcattttaaaaattcagtaattaaagttcctatgatgaactcaaaaaaatatccagttgcacattttattgaccaaacacttaaggccaaggttggacaattacaattatcacataatttatcacttgttattttagttccacaaaatttaaaacatagacttgaagatatggagcaagctctttcaccttctgtttttaaggctataatggaaaaattggaaatgagtaaattccaaccaacacttttaacattacctaggataaaggtaacaacttcacaagatatgttatcaattatggaaaaacttgaattctttgacttttcatatgatttgaacctttgcggattaactgaggacccagatttacaggtgtctgcaatgcaacaccaaacagttcttgaattaacagaaactggagttgaagcagccgcagcatctgcaatttcagttgcaagaactttacttgtttttgaagtacaacaaccatttttatttgtattatgggaccaacaacataagttcccagtatttatgggtagagtctatgatccaagagct

SEQ ID NO: 19184 - DNA, 1500 bp, Artificial Sequence
  Description of Artificial Sequence: Synthetic coding sequence
atggcgtcccgtctgaccctgctgacccttctcctcctgctgctcgcgggcgaccgtgcttcctctaaccctaacgcgaccagctcctcctctcaggatccagagtccctgcaagaccgcggtgagggaaaggtagcgactacggttatctctaagatgctattcgtggagccgatcctggaggtttcttcgttgcccactaccaactccacgacgaactctgcgacaaaaataacggccaatactacggacgagcccacaacccagcccacaactgagcccaccacgcagcccacaatccagccgacccaacccacaacgcagctccccacggactcccctactcaacccactacaggatccttctgcccgggcccggttaccctctgttccgacttggaatcccactccaccgaggctgtcctcggcgacgccttggtggatttttccctcaagctctatcatgctttcagcgctatgaagaaggtcgaaactaacatggcattctcgccgttctctatcgcgagtctcctgacccaggtcttgctgggtgccggtgagaacactaagaccaacctcgagagcatcctctcttaccccaaggactttacatgtgtccaccaggcactgaaaggcttcactaccaagggtgttacctccgtgtcgcaaattttccactccccggacctcgcaatccgggatacttttgtaaacgccagtcggacgctgtactcctcctccccccgtgtcctcagcaataactctgacgccaatctcgagctcattaacacctgggtcgctaagaacaccaacaataagatttcccgcttgctcgactccctgccctccgatactcgcttggtcctcctgaacgcaatctacctgtccgcgaagtggaagacaaccttcgatcccaaaaaaacccgtatggaaccctttcacttcaagaattccgtaatcaaggtccctatgatgaacagcaagaagtatcccgtagcccactttatcgaccagacgctcaaagcgaaggtgggccagctgcaattgtcgcataacttgtcgctcgtcatcttggtcccccaaaatctcaagcaccgtctcgaagacatggaacaggccctctcccccagtgtgtttaaggcgatcatggagaagctggagatgagcaagtttcagccgacattgcttacccttccacgcattaaggtgacaacttcccaagacatgctgtcaatcatggagaaactcgagttctttgacttcagttacgacttgaatctgtgcggtctgactgaggatcccgacctgcaggtcagtgcaatgcagcaccaaacggttctggaactcaccgagacgggagtggaagccgcagccgcgtccgccatctcagtcgcccgtactctgctcgtcttcgaagttcagcaacctttcctgtttgttctctgggaccaacagcacaagtttccggtcttcatggggcgtgtgtacgatccgcgagcc

SEQ ID NO: 19185 - DNA, 1500 bp, Artificial Sequence
  Description of Artificial Sequence: Synthetic coding sequence
atggctagtcggctgacactattgacccttttactgttgctgttggccggcgacagggcgtctagtaatcctaatgcaaccagttcatcaagccaagaccctgagtccctgcaggacaggggagagggcaaagtggctacgactgtgattagcaagatgctgtttgtggagcccatcctagaagtcagctccctcccgaccaccaattctacaactaactctgctacgaagatcaccgcaaacaccaccgatgaaccaaccacccaaccgacaacagagccaacaacacaaccaacaattcagccaacccagcccacaacacagctccctacagacagccccactcagccaaccaccgggtccttttgcccaggcccagtgacactttgctctgacctggaatctcactcaaccgaggccgtactcggtgatgcacttgtcgacttttctctcaagctgtaccacgctttttcggctatgaagaaagttgaaaccaatatggcatttagccctttcagcatagcttctctgctgacgcaggtactgcttggtgccggagagaatactaaaaccaatctcgaatctatcctctcatatcctaaggactttacctgtgtccatcaagccttgaaaggatttactactaaaggggtgaccagcgtgtctcaaatctttcactccccggacctggccatcagagatacatttgtcaatgcctcccggaccctgtactcatcaagccctcgagtactgagcaataacagcgacgccaacctggagctgataaatacctgggtcgctaagaacaccaataataagatatcccgactgctggactcattgccatccgacaccaggcttgtattgctcaatgccatctatctgtccgccaagtggaaaaccacctttgaccccaagaaaacccgcatggagcccttccacttcaaaaatagtgtaattaaggtgcccatgatgaattctaagaagtatccagtggctcacttcatagatcagactttgaaagccaaagttggtcagttgcagctaagtcacaatctctccctcgttatcctggtgcctcaaaacctgaaacacaggttggaagacatggagcaagcgctgtctccgtctgtgttcaaagccatcatggaaaagctcgaaatgagcaaatttcagccgacccttttgaccctgcccaggattaaggtaaccaccagtcaggatatgctgtctattatggagaaactggagtttttcgatttcagttatgatctgaacctgtgcgggctcacagaggaccccgaccttcaggtgagcgccatgcagcaccagacggtcctcgaactgactgagaccggggtggaagcggccgcggcatcagccatatccgttgctcgaacactcctggtgtttgaagtccaacaaccctttttgttcgtgctatgggatcaacagcacaagttcccagtcttcatgggccgtgtctacgatccccgagct

SEQ ID NO: 19186 - DNA, 1500 bp, Artificial Sequence
  Description of Artificial Sequence: Synthetic coding sequence
atggccagcaggctgactttgctgactctgctgctcctattgcttgccggcgatcgtgcaagttcaaatcccaatgctacctcatcttcctcccaggaccctgagtcgttgcaggacagaggggaaggcaaggtcgccacaaccgttatttcaaagatgctcttcgtggagcccatcttggaagtgtcctcattgccaaccacaaacagtaccaccaattcagctactaagatcactgcaaataccaccgatgagccgacaacacagccaaccaccgaacccaccacacaacctactattcagcctacccaacccaccacgcagctgcccacagatagtccaactcagcctaccactgggtccttctgcccaggccctgtcacactctgctccgatctggaatcccactctaccgaggccgtgctgggagatgctctggttgacttctccttgaagctctatcacgctttttcagccatgaagaaggtggaaaccaacatggctttctctcctttcagcatcgctagtctgctgacacaggtgctattgggagcaggagagaataccaagacaaacctggaaagcatcttgtcttatccaaaagatttcacgtgcgtccatcaggccctgaaaggttttacaactaagggtgtgacatcagtaagccaaatcttccactcccctgatctggccatccgcgataccttcgtcaatgcctcacgcactctatattctagctctccaagggttctgtccaataattctgacgccaacctggagctgattaacacctgggtggccaaaaatactaataataagatctcccgccttctggatagtctgccctcagatacaaggctggtgctccttaacgctatttatctgagcgctaagtggaagacaactttcgaccctaagaagacccggatggagccatttcatttcaagaatagcgtgatcaaggtgcccatgatgaactcaaaaaaatatccagtcgctcacttcatcgatcagacgctgaaggctaaagttggacagctgcagttatctcacaaccttagcttagttatcctggtaccacagaacttgaaacatcgtctcgaagacatggaacaggccctctctccgtccgtgtttaaagccattatggagaaactggagatgtctaagttccaaccaaccctattaaccttgcctcggatcaaggtcacgacctcgcaggacatgctgtcaattatggagaagctggaatttttcgatttttcatatgacctgaacctgtgcggactaacagaggatccggatctgcaagtgagcgccatgcagcaccagactgtattggaactcacagagaccggcgtggaagccgcagctgcatcagcgatcagcgtcgcccgaacgctactcgtgtttgaggtccagcagcccttcctgtttgtcctgtgggaccaacagcataaatttcctgtgttcatgggtcgggtgtatgacccccgcgct

SEQ ID NO: 19187 - DNA, 1500 bp, Artificial Sequence
  Description of Artificial Sequence: Synthetic coding sequence
atggccagccgcctgaccttgctgacattgctcttactcctgctggccggagaccgagcaagctcgaacccaaatgccacttcttcttcctcccaagacccagagagtttacaggatagaggggaaggcaaggttgcaacaacagtgataagtaaaatgctgttcgtagagcctatccttgaagtatcaagcctgcccactacgaattctaccaccaatagtgccaccaagattactgccaacaccaccgatgaacctacaactcaacctaccacggagccaaccacccaacctacaatacagccaacccagcccacgacgcagcttccgacagatagtccaacccagccaaccaccggttccttttgtcccgggcctgtgacattgtgtagcgacctagagagccactctacggaagctgtgctgggagatgccctagtcgatttctccctgaaactgtaccacgcatttagtgccatgaagaaggtagagactaacatggccttttctccatttagtatcgcttccctcttgacgcaagtcctgctcggagccggcgaaaacactaaaacaaacctggaaagcatcttgagttatcccaaggatttcacatgtgtacaccaggcactcaagggcttcactaccaaaggagtgacttccgtgtctcaaattttccattcaccagatctagctatcagggacactttcgtcaatgcctcccgaactctgtactcctctagtcctagggtgctctcaaataactcagatgctaacctcgaacttattaacacttgggtggctaaaaatactaacaataaaatctctcgactgctggattctttgcccagcgacaccaggctagtgctgctgaacgctatctacctgagcgcaaagtggaagactactttcgacccgaagaaaacgaggatggagccattccacttcaagaatagcgtcattaaagtacccatgatgaactctaagaagtaccccgtggcccacttcattgatcagaccttgaaggccaaagtgggtcagctgcagctatctcacaacctctcgctggttatcctagtgccccagaatctcaagcaccgactcgaagacatggaacaagctctgagtccctccgtgtttaaggccatcatggagaagctggagatgagtaagtttcagcccacgctgcttaccctgcctcgcatcaaggtcaccacttctcaggacatgctgtctatcatggaaaagttggaattctttgacttcagctacgatctaaacctctgcggactcacggaagacccagacctccaggtgtcagccatgcagcaccagaccgttctggaactgactgaaactggagtcgaagcggctgccgcctccgccattagcgtagcaagaacactcctggtttttgaagtgcagcaaccctttctgttcgtgctgtgggatcaacaacacaagtttcctgtgtttatgggtagggtgtacgacccaagggcc

SEQ ID NO: 19188 - DNA, 1500 bp, Artificial Sequence
  Description of Artificial Sequence: Synthetic coding sequence
atggcgtcccgtctgactcttctcaccttgcttctgctgctgctggcaggtgaccgggcgagtagcaacccgaacgccacgagtagtagttctcaggatccggaaagcctccaggaccgcggcgagggtaaagtcgccactaccgttatttccaagatgctgtttgtggagccgatcctggaagtgtctagtctcccaactaccaatagcaccacgaacagcgccacgaagatcacggccaataccactgacgaaccgacgacacagcctaccacggaaccgactacccaaccgactatccagcccacgcaacctactactcaactgccgaccgatagccctacgcagcccaccacgggtagcttctgtccagggcctgttactttgtgttccgacctggaaagccacagtacagaagcggtgctaggtgatgcgttagtggattttagcctgaagttgtaccacgcattcagcgccatgaaaaaagtggaaaccaacatggcattctcccctttcagcatagctagcttgctcactcaggtgctgctgggagcgggagaaaacactaagacgaatctggagagcatcttgtcttatcctaaggattttacctgcgtccatcaggccctcaagggttttacaaccaagggtgtcaccagcgttagccagatcttccattccccagatcttgcgattcgcgacacgtttgttaacgcctcacgcactctctattcctcctctcctcgcgtgctgagcaataattctgacgcaaatctggagctgattaatacctgggttgctaagaacaccaacaataagatttctaggctgctggactccttgccgtccgacacgcgcctcgtactgctgaacgcgatctatctgagcgctaagtggaagacaaccttcgacccgaaaaaaacgcgcatggaaccattccacttcaaaaacagcgtgattaaggtgcctatgatgaattccaagaaatacccagtggcgcactttattgaccagactctgaaggcaaaagtgggccaactgcaactctcgcacaatctgagtctggtcatcctggtgccacagaatctgaagcaccgcttggaggatatggagcaggctctgagtccgagcgtattcaaggccatcatggagaagttggaaatgagcaagttccaacctactctgttgaccctgccaagaatcaaagtcacgacttcccaagacatgcttagcatcatggaaaagcttgagttttttgacttcagctacgatctgaacctctgtggtctgacagaggatcccgatcttcaagtttccgccatgcaacatcagacggtcctcgagctcacggagacgggtgttgaggcggcagcggcctcagcgatcagcgtggcacgtactctgctcgtctttgaggtccaacagccatttctgttcgttttgtgggatcagcagcacaagttcccggtttttatgggtcgggtgtacgatcctcgggcg

SEQ ID NO: 19189 - DNA, 1500 bp, Artificial Sequence
  Description of Artificial Sequence: Synthetic coding sequence
atggcatcgcgcctgaccctgctcactctgctccttctgctcctggcaggagacagagcgtcctcgaatccaaacgcgaccagctcttcctcccaagacccggaatcgctgcaagatcgcggagagggaaaggtggctacgactgtgatctccaagatgctgttcgtggagcctatcctggaagtgtcgagcctccctaccactaactcgaccaccaactccgctaccaagattacggccaacaccactgacgagcctacgactcaaccaaccactgaaccaactacccagccgacgatccagcccacccaacccaccacccagctgccgaccgacagcccgactcagccgactactggatccttctgcccgggcccagtgaccctctgctccgatttggaatcacactcaaccgaagccgtattgggcgatgcactcgtggatttttccctgaaactgtaccacgccttcagtgcgatgaagaaagtggagactaacatggctttcagcccattctcgatcgcctccctcctgacccaggtgttgctgggtgctggggagaatactaagactaacctggaaagcatcctctcgtacccgaaggacttcacctgtgtgcaccaggccctgaagggctttactactaaaggagtgacctcagtctcacagatttttcattcacctgacctggccatccgggacacctttgtcaatgcgtcaagaactctgtacagcagctctccgagagtcctctcgaacaactcggacgctaatcttgaactgatcaacacttgggtggcgaagaacaccaataataaaatttcccgactcctggattcactcccgagcgataccaggctcgtgctcctgaacgcaatctatctgtcagcgaagtggaaaactaccttcgacccgaagaaaacgcgcatggagcctttccattttaagaattcggtcatcaaggtgccgatgatgaactcgaagaagtacccggtggcgcattttatcgaccaaacgcttaaggccaaagtgggacaactgcagctttcccacaacttgtcactcgtcatcttggtgccgcagaacctgaagcatcggctcgaagatatggagcaggccctgtctccctcggtgttcaaggcaattatggaaaaacttgagatgtccaaattccaacccacgctccttaccctgccacgcatcaaggtcactacttcccaggatatgctgtccatcatggagaagctggaattcttcgatttctcgtacgacctgaatttgtgcggactgaccgaggacccagacctccaggtgagcgccatgcagcaccagactgttctcgagcttaccgaaaccggtgtcgaagccgccgcagctagcgccatctcggtcgccaggactctgttggtgttcgaagtgcaacaaccgttcctgttcgttctgtgggatcagcagcacaagttcccagtctttatggggcgggtctacgaccctcgggcg

SEQ ID NO: 19190 - DNA, 1500 bp, Artificial Sequence
  Description of Artificial Sequence: Synthetic coding sequence
atggcgtcgcgtttaacgttattaacgttattactattattattagcgggtgatcgtgcgtcgtcgaatccgaatgcgacgtcgtcgtcgtcgcaagatccggaatcgctacaagatcgaggtgaaggtaaagtagcgacgacggtaatatcgaaaatgctatttgttgaaccgatactagaagtttcgtcgctaccgacgacgaattcgacgacgaattcggcgacgaaaataacggcgaatacgacggatgaaccgacgacgcaaccgacgacggaaccgacgacgcaaccgacgatacaaccgacgcaaccgacgacgcaactaccgacggattcgccgacgcaaccgacgacgggttcgttttgtccgggtccggtaacgctatgttcggatttagaatcgcattcgacggaagcggtactaggtgatgcgttagttgatttttcgctaaaactatatcatgcgttttcggcgatgaaaaaagttgaaacgaatatggcgttttcgccgttttcgatagcgtcgctattaacgcaagttctattaggtgcgggtgaaaatacgaaaacgaatttagaatcgatattatcgtatccgaaagattttacgtgtgtacatcaagcgctaaaaggttttacgacgaaaggtgttacgtcggtatcgcaaatatttcattcgccggatctagcgatacgagatacgtttgtaaatgcgtcgcgaacgttatattcgtcgtcgccgcgtgttctatcgaataattcggatgcgaatttagaactaataaatacgtgggttgcgaaaaatacgaataataaaatatcgcgtttattagattcgctaccgtcggatacgcgtctagttctattaaatgcgatatatttatcggcgaaatggaaaacgacgtttgatccgaaaaaaacgcgtatggaaccgtttcattttaaaaattcggtaataaaagttccgatgatgaattcgaaaaaatatccggtagcgcattttatagatcaaacgctaaaagcgaaagtaggtcaattacaattatcgcataatttatcgttagttatactagtaccgcaaaatttaaaacatcgtttagaagatatggaacaagcgttatcgccgtcggtttttaaagcgataatggaaaaattagaaatgtcgaaatttcaaccgacgctactaacgctaccgcgaataaaagtaacgacgtcgcaagatatgttatcgataatggaaaaattagaattttttgatttttcgtatgatttaaatttatgtggtctaacggaagatccggatttacaagtatcggcgatgcaacatcaaacggtattagaattaacggaaacgggtgttgaagcggcggcggcgtcggcgatatcggttgcgcgtacgctattagtttttgaagtacaacaaccgtttttatttgtactatgggatcaacaacataaatttccggtttttatgggtcgagtatatgatccgcgagcg

SEQ ID NO: 19191 - DNA, 1500 bp, Artificial Sequence
  Description of Artificial Sequence: Synthetic coding sequence
atggcttccagattaacactgctcactctgctattgctgctcttggcaggcgatagagccagctccaatccaaatgcaacttcctctagttctcaggacccagagtctcttcaggatcggggggagggcaaagtggctactacagtgataagcaaaatgttgttcgtggagccaatcttggaagtgagttccttgcccactactaatagcacaacaaactctgctacaaagatcaccgcaaacaccactgacgagcctaccacacaacctaccaccgagcctactacacagcctaccatacagcccacccaacccaccacccagctccctacggattcgccaacccagcctaccacaggaagcttttgtcccggccctgtcacactctgttctgacttggagagtcatagtacggaagcagtgcttggcgatgctctcgtagatttttcacttaagctttatcacgccttctccgccatgaagaaagtcgaaaccaatatggctttcagtcccttttccattgcttctctgctgacgcaagttttgctgggggctggagaaaatactaaaactaatctggagagtattctcagctaccccaaagatttcacatgtgttcatcaggccttgaaaggatttaccacaaagggggttacaagtgtcagtcaaatatttcattcccccgacctcgcaataagggacacatttgtcaatgcaagccgcacactgtactcctcatcaccacgtgtgctctctaacaatagcgatgctaacctcgagctgataaatacatgggtggccaaaaatacaaacaacaagatttccaggctcctagattctttgccaagtgacacgcggctggttctcctgaacgccatttacttgagcgcgaaatggaaaacgacattcgatccaaagaagacgcgaatggagccttttcactttaaaaatagcgtgattaaagtgcctatgatgaactctaagaagtacccagtcgctcatttcattgaccaaacccttaaggccaaagttgggcagctgcagcttagccacaacttatccctggtgatcctagtgcctcagaacctgaagcaccggctggaagacatggaacaggccctgtccccttccgtttttaaggcaatcatggaaaaactagagatgagtaagtttcaacccaccctgctaacacttcctcggatcaaagtgactaccagtcaggacatgctgagtatcatggaaaaattagagtttttcgatttctcatacgatctgaatctctgtgggttgaccgaggatccagatctccaggtgtccgccatgcagcaccagactgttctcgagctgaccgaaacgggagtggaggccgcagccgcctctgcgatctccgttgctcgcactctactggttttcgaggtgcagcagcccttcctcttcgtgctctgggaccagcagcacaagtttcctgtgttcatgggccgcgtgtacgaccccagagcc

SEQ ID NO: 19192 - DNA, 1500 bp, Artificial Sequence
  Description of Artificial Sequence: Synthetic coding sequence
atggccagccgattgactcttttgacgttactgctgctgctcttagcaggcgaccgggcgagcagcaatccgaatgccacaagttcatccagccaggatccagaaagcttgcaagacaggggggagggtaaagttgctactacagtgatctctaaaatgctgttcgtagaacccatccttgaggttagttctctgccgaccaccaattccaccacaaatagcgccaccaagataaccgccaatacaacagacgaacctaccacccagcccacaacggagcccaccactcaacctaccattcaacccacccagccaaccacacaactgcccactgactcccccacccagcctaccaccgggagcttttgcccaggccccgtgacactttgttctgatctggaatcccacagtacagaggcggttctgggggacgccctggtcgacttctctctgaaactctaccacgcctttagtgcaatgaaaaaggtagagacgaacatggcattttctccgtttagcatcgctagcttgctgacccaggtgctgctcggagcgggcgagaacacaaagacaaatctcgagagtatcttgtcctatccaaaagactttacatgcgtgcaccaggcactgaagggattcactacaaaaggcgtgacatctgtatctcaaatttttcacagcccagatctggcaatccgggatacatttgtgaatgcttcacggacactatatagtagctctccccgggtgctttccaacaattcagacgctaatcttgagctcatcaatacttgggtggccaaaaacaccaacaacaaaatcagtcgcctcttggacagtctgccatccgatacccggctggtactgctcaatgccatctacctctcagcgaaatggaagacaaccttcgacccgaagaagaccagaatggagcctttccacttcaaaaactctgtgattaaggtccccatgatgaattcaaaaaagtatccagtggcacactttatagaccagacccttaaagccaaggttgggcaactgcagctgtctcataacctctccctggtgattttggtgccgcagaacctgaagcaccggctggaagatatggagcaggctctgtctccttccgtgtttaaagctattatggagaaactggagatgagcaagtttcagcctactctactgacactcccgagaatcaaagtgaccacaagtcaggacatgttgtcaatcatggaaaaactggaattcttcgactttagctatgacctgaacctgtgcggccttaccgaagaccctgaccttcaggttagcgccatgcagcatcaaactgtcctggaactgactgagactggagttgaggcagcagctgcctctgctattagtgtggcaagaacactccttgtgttcgaggtccaacagcctttcctgttcgtgctttgggaccaacagcataagttcccggttttcatgggaagggtgtatgatccacgggcc

SEQ ID NO: 19193 - DNA, 1500 bp, Artificial Sequence
  Description of Artificial Sequence: Synthetic coding sequence
atggcaagtcgcttgacactgttaacactgttgcttctcctactggccggcgaccgcgcctcgtcgaatccaaacgccacgagctcttcttcccaggaccccgagtctctgcaagaccggggagaggggaaggtcgccaccaccgtgatcagcaaaatgctcttcgtggagccaattttggaggtgtccagcctgccgaccaccaactcaactacgaattccgctacgaagatcacagccaacaccaccgacgaacccaccacccagcccacgacagagccgactacccagccaacaatccagcccacacagccgacgactcagttaccgacagattcccccacgcagcctaccaccggcagtttttgcccaggacctgtgacgctgtgctctgacctggaaagccatagcacagaagctgtgctgggagatgccctcgtggatttctctttgaagctgtatcatgccttttccgccatgaaaaaagttgagaccaacatggctttctccccttttagtatcgcgagcctgctgactcaggtgctgctgggagcgggagagaataccaagacaaatctggaatccatcctatcctatccgaaagacttcacatgtgtccatcaagctctgaaaggctttacgactaagggagtcacgtccgtcagtcagatttttcacagccccgacctcgccattcgcgatacctttgtcaacgcttcgcgcacattatactcatccagtccccgggtactgagtaataactctgacgccaatcttgaactcataaatacttgggtggccaagaataccaacaacaaaatcagccgtcttttggactccctgccgtcggatactagactcgtgctcctgaacgccatttacctgagtgctaaatggaagacgacctttgaccccaagaagacacgcatggaaccattccacttcaagaactctgtgataaaggtgcccatgatgaactccaagaagtatccggttgctcactttatcgatcaaaccctgaaggcgaaagtgggacaattgcagctgagtcacaacctgtcgcttgtgattctggtgccccagaatctgaagcatcgcctggaggacatggaacaagccttgtccccctccgtgtttaaggccattatggagaagctggaaatgagtaaatttcagccgactcttcttactttacccaggattaaagtcaccacctcacaggatatgctgtccattatggaaaagctggaattttttgacttcagttacgaccttaacctttgcggcttgaccgaggatccggatctgcaagtaagcgccatgcagcaccaaacggtgctggagctgacggagactggagtggaagcagctgccgccagtgctattagcgttgcgagaacactgctggtgtttgaggtgcagcagccgtttctgttcgtgctgtgggatcagcagcacaagtttcccgtttttatgggacgtgtctatgatccaagggcc

SEQ ID NO: 19194 - DNA, 1500 bp, Artificial Sequence
  Description of Artificial Sequence: Synthetic coding sequence
atggctagccgtctgactctcctcacattactcctattactcctggctggagaccgggcatctagcaaccccaacgctacgagtagctcgtcccaggatccagaatcactacaggaccgaggagagggcaaggtggccactaccgtgattagcaaaatgctcttcgtggagcccatcttggaggtgtcgtccctacctactacaaattcgaccacaaattctgcgactaagatcacggccaataccacggatgagccgacgacacaacccacgactgaacctaccacgcaacctaccattcagcccacacagcccacgacccagcttcctaccgacagccctactcagcccaccactgggtccttctgtccaggtccagtcaccttgtgttccgatctggaaagtcactccacagaggcagtcctgggggatgcactcgtggacttttcactgaaactgtatcacgccttttcagcgatgaagaaagttgaaactaatatggcgttttcacccttttcaatcgcttccctgctcacccaagtgcttttgggcgcgggggaaaacacaaagaccaacctcgaaagcattctgtcttatcccaaggattttacttgtgtccaccaggccttaaagggatttacgactaagggagttacctccgtatcccagatcttccattcaccagacctggcaatccgcgataccttcgtgaacgcgtcccgcacactgtactcatccagcccacgcgtcctgagcaataatagcgatgcgaatctggagctgattaatacctgggtggcaaaaaataccaataacaaaatttccagacttctagattcactgccaagtgatacacgcctggtgcttcttaacgctatttatttaagcgcaaaatggaaaactacatttgacccgaaaaaaactagaatggaacctttccacttcaagaacagcgtgatcaaagtccctatgatgaactccaaaaaataccccgtggcacacttcatagaccagacgctgaaggcgaaggtcgggcaactccaactcagccacaatctctctttagtcatcctcgtgccacagaatctgaagcacagattggaggatatggagcaggcgttgtctccgtctgtgtttaaggcaataatggaaaagctggagatgagtaagtttcagccgacactactaaccctcccgaggatcaaagttacgacaagtcaggatatgctgagcatcatggaaaagctcgaattcttcgatttttcctacgacctaaacttatgcgggttgacggaagatcctgacctacaagtctcagcaatgcagcatcagacggttcttgagctgactgaaactggagtcgaggccgcagccgcatcagcaatctctgtggcgcgcacccttctggtctttgaagtccagcaacctttcttgtttgtgctctgggatcaacaacacaaattcccagtcttcatgggccgggtctacgatccaagagcc

SEQ ID NO: 19195 - DNA, 1500 bp, Artificial Sequence
  Description of Artificial Sequence: Synthetic coding sequence
atggcttccaggctcacattacttaccctcctactcttgctgctagcgggcgaccgagcctcgtccaatcctaatgccacttcttccagcagccaggatcccgaaagcctccaagatcggggggaaggaaaggtggcaaccacagtgattagcaaaatgctttttgtcgagcctattctagaggtgagctccctgcccaccacaaattcgactaccaacagcgctaccaagatcactgccaatactacagatgaacctactacccagccgactactgagcccaccactcagccaaccatccagcctacacaaccgaccacacaactgccgacggattcaccgacacaaccgacaacgggttccttttgccctggccccgtgaccctgtgctctgacctggaaagtcattctacagaagccgtactgggagacgctctggtcgacttctctctgaagctgtatcatgcattctccgccatgaaaaaggtggagactaacatggctttttccccattttccatcgcctctttgctgactcaagtcctgctgggagccggtgagaacacgaaaactaatctggagtctatcctaagctaccccaaagacttcacgtgcgtccatcaggctctgaaaggattcacaacgaagggcgtgacttctgtgtcacagatatttcattctccagacctggcgatccgggatacctttgtaaatgcgtcccgaacactctactcctcgtcaccccgggtgctttctaacaacagcgatgcgaacctagagctgataaatacgtgggtcgctaagaatacaaataataaaatctcccggctgttagattcacttccatccgatacgcgacttgtcctgttgaacgccatctatctttccgcaaagtggaaaacaaccttcgaccccaagaaaacccgcatggaaccatttcatttcaaaaacagtgttatcaaagtgcccatgatgaattctaaaaaatatccggtggctcatttcatcgatcagacactcaaggccaaagttggtcaattacaactgtcacacaacctgagtctggtgattcttgtgccgcagaacctgaaacaccgcctggaagatatggaacaggccctgtcgcctagtgtctttaaagctattatggaaaaactggaaatgtccaaatttcagcctactctcctgacactcccgcgaataaaggtaaccacaagccaggacatgctgagcataatggaaaaactagaattctttgacttctcctatgatctcaacctctgtggcctgacagaagatcctgaccttcaggtttccgccatgcagcaccagacggttctcgagctgacagaaacaggggtcgaagccgccgcagcatctgccatcagcgtggcaagaacgttgctggtttttgaggtgcagcagcctttcctgtttgtactgtgggatcagcagcacaaatttccggtctttatggggcgggtgtatgatccacgcgct

SEQ ID NO: 19196 - DNA, 1500 bp, Artificial Sequence
  Description of Artificial Sequence: Synthetic coding sequence
atggcgtcccggttaaccttgctaactctgctgctgctgcttcttgcaggagatagggccagctctaatccaaatgcgactagctcgtccagccaggacccagaatcgttgcaggaccgaggggaggggaaggtggcaaccaccgtcataagcaagatgctctttgtggaacctattctggaggtatcttcacttcctacaactaacagtactactaactccgcaactaagatcaccgcaaacacaaccgacgaaccgactacccagcccactaccgagcctacgactcagcctacaatccagcccactcagccaaccacccagcttcccaccgactccccaactcaacctacaaccggctctttttgcccgggccctgtgactctgtgttcagatctggagagccactccacagaggctgttctcggtgatgctcttgtggacttcagccttaagctttaccacgcattcagcgccatgaagaaggttgagacaaacatggcctttagtcccttcagcatcgccagcctgttgactcaggttttactgggggccggtgagaatactaagacgaacttagagtccatcctgtcatatccaaaagactttacttgtgtgcaccaggccctgaagggttttactactaaaggggtgacatccgtaagccagatctttcacagccctgacttggccatcagagacacgtttgtgaacgcttcacggaccctgtacagctcaagcccacgtgtgcttagcaacaatagtgatgcaaatctggagctgattaacacctgggtggctaagaacactaacaataaaatctcacgacttctggactccctgcctagcgacaccaggcttgtcctgctgaacgccatctatttatccgcgaaatggaagactacatttgatccaaagaaaacacggatggagcctttccattttaagaattctgtcatcaaggttcctatgatgaactcaaagaagtatccggtcgcgcacttcattgatcagactctgaaggcgaaggtcggccagctgcaattgtcacacaacttatctcttgtgattctcgttccccaaaatcttaagcatagactggaagatatggaacaggccttgtcaccttcagtgttcaaggccatcatggagaagttagaaatgtccaaattccagcctacactcctgaccctcccaagaatcaaagtgacaacatcacaggatatgttatcgattatggagaaactggagtttttcgacttcagttatgatctgaatttgtgcggcctaaccgaggatcccgacttacaggttagtgccatgcaacaccagacagtcctagagctgacggagacaggggtggaggccgccgcggcgtccgccatatcagtcgctcggaccctgctggtgttcgaagtgcagcagcctttcctgtttgtcctgtgggaccagcagcacaagtttcccgttttcatgggacgggtgtacgacccgcgtgcc

SEQ ID NO: 19197 - DNA, 1500 bp, Artificial Sequence
  Description of Artificial Sequence: Synthetic coding sequence
atggcctcgaggctgaccttgttaacactcctgctgcttctattggcaggggatagagcaagttccaaccccaatgccactagttcctcttcgcaggatcccgagtcactgcaggaccgtggagagggcaaagttgcaacaacagtcatctctaagatgttgtttgtggagccaatactggaggtgtcatcgttgcctaccaccaattctaccacaaattccgctactaagatcacagcgaataccaccgacgaacctactacccaacccacaacagagcctacaacccagccgaccatacagccaacacagcccaccactcagctgcccaccgattcgcctactcaaccaactacaggaagtttttgtcccgggccagtaaccctctgttcagatttggagagccactcaaccgaagccgtgctcggcgatgccctggtggacttctcccttaagctctaccatgccttcagcgccatgaagaaggtggagactaatatggcattcagcccgttctccattgcttctctcttgacccaggttctgttgggagccggcgagaatactaagacaaacttggagtctatactatcataccctaaggactttacatgtgtgcatcaggctctgaaagggttcactactaaaggggtaacctctgtgagccagatctttcatagtcctgatttagccatcagggacaccttcgtaaatgcgtcacgcacattgtacagctcctctccgcgcgtgctgagtaataatagtgacgccaacctggagctgattaatacttgggtggccaagaacacaaacaataagatctctcggcttctggattccctgccttccgatacgcggctggttttgctgaatgccatttatctttcagctaagtggaagactactttcgatcccaaaaaaacacgtatggaacccttccattttaagaactctgtaattaaagtgccaatgatgaattcgaagaaatatccagtcgcgcatttcatcgaccagacgctgaaggccaaggtgggacagcttcagctttcacacaacctctcgttggtgatcctggttccacagaaccttaaacataggctggaggacatggaacaggccctgagcccatccgtgtttaaggcgattatggagaagttggaaatgtccaagtttcagcctacgttgctgacacttccacgcattaaggtaaccaccagccaggatatgctgagcattatggaaaagcttgaatttttcgattttagctatgatctgaatctgtgtgggctgacagaagaccctgatttgcaagtttcggcgatgcagcatcagacggtactggagctcacggagactggggtggaagctgctgcagctagtgctatctctgtggcacgtactctcctggtgtttgaagtgcagcaacccttcctgtttgtgctgtgggatcagcagcataaattccctgtgtttatgggccgcgtttatgatccacgcgcc

SEQ ID NO: 19198 - DNA, 1500 bp, Artificial Sequence
  Description of Artificial Sequence: Synthetic coding sequence
atggcaagcagactgactttactaacactgctcctccttttactggcaggagatcgtgcaagttccaaccctaatgcgacatccagctcgtctcaggacccagagtccctccaggacaggggggaaggaaaggttgcgaccacagtgatcagcaagatgcttttcgtcgaaccaatcttggaggtgtcttcacttccgaccactaactctaccactaatagcgctaccaaaattaccgccaacactacggacgaacctacaacacagccaaccacagaacccaccacccagccaacaatccagccaacgcagcccacgactcagctgcccacagacagccccacgcaacccacaaccgggtctttctgcccagggccagtgactttatgcagcgacctcgagtcccattctacggaggctgtgctcggggatgcactagtcgacttcagcctgaagctgtatcatgccttttccgcgatgaaaaaggtggaaacaaacatggccttttcgccgtttagtattgcctcgctattgactcaagtgctcttgggggcgggtgaaaacaccaagaccaatcttgagtccattctgtcgtatccaaaggacttcacctgtgtgcatcaggccttaaaaggttttacgacaaaaggtgtgacgagcgtgagtcagattttccattcgcctgacttggccattagggacacctttgtgaatgcgtcccgcactctgtatagttcctccccccgagtactgtctaataatagtgacgcaaatctggagctcatcaatacatgggtggctaagaacactaataataagataagtcggctgctagattcccttccctccgataccagactcgtgctcctcaatgcaatctacttgagtgctaaatggaaaactacattcgacccaaagaagacacggatggagccatttcacttcaaaaacagcgtgatcaaagttccgatgatgaatagtaagaagtacccagtggcacacttcatcgatcagaccctgaaggcgaaggtcggacaactgcagctttctcacaaccttagcctcgttatcttggtgcctcagaacctcaagcacaggctggaggatatggagcaagccttgagtccgagcgtgtttaaggcgataatggagaaactggagatgtctaagtttcagccaacactgttgaccctgccaagaatcaaagtcaccacttcacaggatatgctgtcgatcatggagaaattagaattttttgacttctcatatgacctgaatctctgtggactcacagaggaccctgacctacaagtgagtgctatgcagcaccagacagtcctcgagcttacagagacgggggttgaggcagcagctgctagcgccatctccgtagcacgtactctcctggtgtttgaggtgcaacaaccattcctgttcgttttgtgggatcagcagcataaattccccgtattcatgggacgtgtgtacgaccctagagcc

SEQ ID NO: 19199 - DNA, 1500 bp, Artificial Sequence
  Description of Artificial Sequence: Synthetic coding sequence
atggcctcccgcctgacgctgttgaccttgctcctactgctacttgccggcgatagagcttcatctaatcccaatgcgacttcatcttcttctcaggaccctgagtctctgcaggacaggggcgagggtaaagtcgctacgacagtaatctccaagatgttgtttgtcgaaccaatcctggaggtgtcatctcttccaacaaccaatagcaccactaatagcgccaccaaaattacagctaacacaactgatgaacctacaacccagccgacgactgaacctacaacgcagcctacaatccagcccacgcagccgacgacccagctaccaacagactccccaacgcagcctacaacaggctccttctgtcctggtcccgtgacgctgtgcagcgacttggagtctcatagcacagaggcagtcctaggggacgcattggtggatttttcattgaagctgtatcacgcattcagcgccatgaagaaagttgagacaaatatggcgttctctcccttcagcattgcatcactgctgacacaggtcctgcttggtgcgggtgaaaatactaagacaaacctggagagcatcctaagctatcccaaagatttcacatgcgtgcaccaggctctgaagggatttacgaccaaaggcgtgacatctgtttcccagatttttcactcacctgacctggccatcagagatacgtttgttaacgcatcacgcacactctactcctctagtccacgggtgctgagcaacaactccgatgccaatctggaacttattaatacctgggtcgcgaagaacactaataacaagatatcacgattgctagattcactacctagtgacacccggctggtgctcttaaatgccatttatctgtcagcaaagtggaagacgacatttgaccccaagaaaacaaggatggagccttttcacttcaaaaattcagtcatcaaggttccaatgatgaactctaaaaaatacccagtcgcccacttcatcgaccagactctcaaagccaaggtggggcaactccaactttcccacaatctatcactggttatcctggtaccacagaatctgaagcaccggctggaggacatggaacaagctctttcacccagtgtgtttaaagctattatggaaaagctggagatgtccaagttccagcctaccctcctgacactcccacgtattaaggtaactacttcccaggatatgctgtccattatggaaaaacttgaatttttcgacttttcatatgatctgaacttatgtgggctaactgaggaccccgacttgcaggtttcagcaatgcagcaccagaccgtgctggaactgacagagaccggcgtcgaagcagccgcggctagcgcgataagcgtggctcgcaccctgttggtatttgaagttcaacagccttttcttttcgtactctgggaccagcagcataaattccctgtgtttatggggagggtttatgaccctagggcg

SEQ ID NO: 19200 - DNA, 1500 bp, Artificial Sequence
  Description of Artificial Sequence: Synthetic coding sequence
atggcctcccggctgacccttctgaccctgctgctgcttctcctcgcgggcgaccgggcctcttccaaccctaacgcgaccagctcctcttcccaagatcccgaaagtttgcaggatcgcggtgaaggcaaggtagccacgactgtgattagcaaaatgctgtttgtcgagcccattctggaggtgtctagcctgccaacgacaaacagtaccaccaattctgctactaagattaccgcaaacaccactgatgaacctacaacgcagcccactacggagcccacgacacagcctaccatccagcccactcaacctaccacccagttgccaaccgactcccctacacagccaacaaccggtagcttttgtccaggcccggtcactctgtgtagtgatctggaaagccactccactgaagctgttcttggtgacgctctggtggatttcagtttgaagctgtatcacgccttcagtgccatgaaaaaagtggagaccaacatggccttctcccctttttccattgcaagcttgctcacccaagtgctgttgggcgccggcgaaaatacaaagactaacctggagagtatcctgagttaccctaaggactttacatgcgtgcatcaggcactgaagggttttacaacgaagggcgtgacctccgtgtcccagatcttccacagccccgatctcgcaatccgcgacacgttcgtgaatgccagccgaaccctgtactccagctccccacgcgtcctgtccaacaactctgacgccaatctggagctcatcaatacgtgggtcgctaagaacaccaataacaagatctcccgcctgctggacagtttgccatccgatacaagactggtgctgctgaacgccatttacctgtctgccaaatggaaaaccaccttcgaccccaagaaaacgcggatggagccattccacttcaagaacagcgttattaaagtcccaatgatgaattccaagaagtatcccgttgcccacttcatcgatcaaaccctgaaggctaaggtcggccagttgcagctgtcccataatctcagcctggtcattctggtgccccagaacctcaagcataggctggaggatatggaacaagctctctccccgtccgttttcaaagctattatggaaaagcttgaaatgagcaaatttcagcctaccctgctgacccttccccgcatcaaggtgaccacaagccaggacatgctcagtattatggagaagctcgagtttttcgacttctcttacgatctgaacctgtgcggcctgaccgaagatcctgatctgcaggtctccgcaatgcagcaccagaccgtgctggagctgactgagactggcgtggaggcagccgccgcaagtgccatatccgtggctagaactcttctggtgttcgaagtgcagcagccgttcttgtttgtgctgtgggatcagcagcacaagttccccgtgttcatggggagggtgtatgatccccgggcc

SEQ ID NO: 19201 - DNA, 1500 bp, Artificial Sequence
  Description of Artificial Sequence: Synthetic coding sequence
atggcctctaggctcaccctccttactttgctgcttctgctgcttgccggggacagagctagtagtaatccgaacgcaacctcgtcctccagccaagacccagaatccctgcaggacaggggcgagggcaaggtagcgacgactgtcatcagcaagatgctgtttgttgagcctatcctcgaggtgtcctctctgccgactactaatagcacaacaaactctgcgacaaagattaccgctaatacaaccgacgaaccaactacccagcctacaaccgaacccaccacacagccaactatccaaccaacccagccgactactcaactgccaacagacagtccaacccagcctaccacgggcagcttctgccccggacctgttacgctgtgttcagacctcgaatcacattccacagaagctgttttgggcgacgcgttggtcgactttagtttaaagttgtaccatgccttttctgcaatgaaaaaagtggagacgaacatggcattttcccctttcagcattgcatcactgctgacacaagtactactgggtgctggggagaacactaaaactaatctggaatcaatcctgtcttatccaaaagatttcacttgtgtgcatcaggccctgaaaggctttacaaccaaaggagtgacgtcagtcagccaaatcttccactcccctgaccttgctatccgcgatacctttgtaaacgcctctcgaaccctttattcatcaagtcctagagttttaagcaataactccgatgctaacttggagctcataaatacatgggttgctaaaaatactaacaacaaaatctcacggctactggatagtcttccatccgacactagattagttctgctcaacgccatttatttgtcggcgaagtggaagacaacgttcgaccctaaaaagacgaggatggagccattccactttaagaattcagtgattaaggtccccatgatgaacagcaagaaatatccagtggctcacttcatagatcagacattgaaagccaaggtgggccaattacagctgtcccacaacctctccctcgtcattctggtgccccagaacctgaaacaccgactagaagatatggagcaagccctgtctccgtccgtgttcaaggcgattatggagaagctcgaaatgtcaaagtttcagccgactttgctaaccctgccccgcatcaaagtgactacttcacaggacatgctgtcgattatggagaaactcgaatttttcgactttagttacgatctgaacctatgtggccttactgaagacccagatttgcaggtgtccgccatgcaacaccagacggtgttggagttgactgagacgggcgtggaggctgcggcagccagcgcaatcagcgtggcccgtacactgctcgtgttcgaggtacagcagccgttcctgtttgtgttgtgggatcagcaacacaaatttccagtctttatgggtagagtttatgaccccagagct

SEQ ID NO: 19202 - DNA, 1500 bp, Artificial Sequence
  Description of Artificial Sequence: Synthetic coding sequence
atggcatcccgactgaccctcctcacactgctactcctgttgcttgcaggcgaccgggcatcctctaatccgaatgccacatccagctccagtcaggatcctgaatctttacaggatcggggagaggggaaggtagcgactacagtgatatccaagatgctcttcgtcgaacccattcttgaggtttcgtcattgcctaccacgaattctaccacgaattcggccacgaaaattaccgctaacacaacggatgagccgaccacccagcctactaccgaacccactacccagcctaccattcagcctacgcagcctactacgcagttacctaccgacagcccaactcaacccacaactggctcattctgtcccggacccgtcacgctgtgctctgatcttgaatcgcactccacggaagcagtcctaggggacgcgcttgtcgatttctccctcaagttgtaccacgcgttctcagcaatgaagaaagtggagaccaacatggcgttttcgccgttttccattgctagcctacttactcaggtcttactcggtgctggggaaaacactaagactaacttagaatccatcctgagctatcccaaagacttcacttgcgtgcatcaggcgctgaagggttttaccactaaaggagtaaccagtgtttctcagatcttccattcgcctgatctagccatacgagatacattcgttaatgcttcacgcacgttgtacagttcttcgccacgcgtcttgtccaacaactccgacgcaaacctggagttaatcaatacttgggttgcgaaaaacacaaataacaaaatatcccgcttactcgattctctgccaagcgacacccgcctagtcctcttgaatgctatttacctgagcgctaaatggaagacaacatttgaccctaagaaaacacgaatggaacctttccacttcaagaactccgtgatcaaagtgcctatgatgaattcaaagaagtatccggttgctcacttcattgatcagactttgaaggctaaggtagggcagttgcagctttcgcataatctctcattggtgatcttggttccccaaaatctgaaacacaggctggaagatatggaacaagcactttctccctctgtgttcaaagcaattatggaaaagctggagatgtcaaagtttcaaccgacattgcttaccctgccacgaataaaagtcacaaccagtcaggatatgctctctatcatggagaagttggaatttttcgatttttcttatgacctcaatctctgcggcctaaccgaagatcctgatctccaagtgagcgccatgcagcatcagaccgtcttggagctcacagaaacaggcgtggaggccgccgccgcctccgctatctcggttgctcgcactctgcttgtattcgaagtacagcagcccttcttatttgtgctctgggaccagcagcataagttcccagttttcatggggcgtgtgtacgatccacgagct

SEQ ID NO: 19203 - DNA, 1500 bp, Artificial Sequence
  Description of Artificial Sequence: Synthetic coding sequence
atggcttcgagattgaccctgttaactctcctgctactactgttagcaggtgatcgtgctagttcaaacccaaatgcaacatcatcaagctcacaggacccagagtcccttcaggataggggtgagggaaaggttgccaccactgttatctccaagatgctgttcgtcgagccgatactggaggtctcctcactgccgacaacaaatagcacaactaattctgccaccaaaatcacggcaaacaccaccgacgagcccacaacacagccaaccaccgaaccaacgacccagccaaccatccagcccactcagcctaccactcagctacccaccgattcccctacccaacccacaacagggtccttctgcccaggaccagtgactctctgcagcgatcttgaatcccactcaacagaggcggtgttgggagacgcattggtggatttcagcctgaaactttatcatgctttctctgccatgaagaaagttgagacgaacatggcgtttagccccttcagcatcgcatctcttcttacacaggttctacttggagcaggcgagaacacaaagacaaacctcgaatccatcctcagctatcccaaggatttcacttgcgtgcatcaagcactgaagggcttcactaccaaaggggttactagcgtcagtcaaatcttccactcaccagacctcgcaatcagagacacatttgtgaatgcttcaagaacactgtactcgtcttctcctcgcgtgctgtccaataattctgacgccaacctagagctgattaatacatgggtggccaagaatacaaataacaagatcagtcgtctgttagacagtttaccctctgatacacgtctggtgctgctgaatgcgatttacctctccgctaagtggaagacaaccttcgacccgaagaagacacgcatggaaccttttcacttcaaaaacagcgtgatcaaagtaccgatgatgaactccaaaaagtatccggtggcacacttcatcgaccagactctcaaggcaaaagtgggacagctacagctttcccacaacctgtctctggttatcctggtccctcaaaacttgaagcaccggctggaagatatggaacaggctctgagcccctccgtctttaaggccatcatggagaaattagagatgtctaagttccagcccaccttactgacactcccccgtatcaaagtgactaccagccaggatatgctatctataatggagaagctggaattctttgacttctcctacgatctgaacctgtgcggattgacagaagatcctgacctgcaggtgtctgctatgcagcaccaaaccgtgctggaactgacagagaccggcgtggaggcggccgcggcatccgcaatatccgtggcccgtacgttactagtgtttgaagtccaacaaccatttctcttcgtgctgtgggatcaacagcacaagtttcccgtgttcatgggcagagtgtatgaccctagggcc

SEQ ID NO: 19204 - DNA, 1500 bp, Artificial Sequence; identical to SEQ ID NO: 19192
  Description of Artificial Sequence: Synthetic coding sequence

SEQ ID NO: 19205 - DNA, 1500 bp, Artificial Sequence
  Description of Artificial Sequence: Synthetic coding sequence
atggcgagtaggctgacgcttctgactttgctcctgctgttgctggctggtgacagggcttccagtaatcccaacgctacgtcgagctccagtcaggaccctgaaagcttacaagatcggggtgaagggaaggttgccaccacagttatcagcaagatgctttttgtcgaacccatcctggaggtaagctccctcccaaccaccaacagcaccaccaactcagctaccaagatcactgccaacacaaccgacgaacccacaactcagccaaccactgaacctacaacacagcctactatccaaccaacccagcctacaacccagctgcccacagacagtccaactcagcctaccaccggatctttttgcccaggccctgtcaccctttgttcggatttggagagccacagcactgaggctgtgctgggcgatgctcttgtggacttctccctgaagttgtatcatgccttttcagcgatgaagaaagtagaaacaaacatggcattttcgcctttcagcatagcctctctgcttacccaggtcctgcttggcgctggagagaatactaagacaaacctggaatctatactctcctacccaaaagacttcacttgtgtgcaccaggcacttaaaggctttaccactaaaggggttaccagcgttagtcaaatctttcacagtcccgacctggccattcgcgatacattcgttaacgcctcccggacactttactccagcagtccgagggtactcagcaacaacagtgatgccaacctggaactgatcaacacttgggtggcaaaaaacaccaacaacaagatttctagactgctggactccctgcctagcgacactcggctcgtcctactcaatgccatctatctttccgctaagtggaagaccacttttgacccgaagaagacccgcatggaaccattccacttcaagaattcagtgatcaaggttcctatgatgaattcaaagaaataccccgtagctcacttcattgatcagactctgaaggctaaggtcggtcaactgcaattgagccacaatctgtctctggtgatacttgttccccagaatctgaaacaccggttggaggatatggaacaagccctctcacccagtgttttcaaggcgattatggaaaaactcgaaatgagcaagtttcaaccaacgctcctcacacttccacgcattaaagttaccactagccaggatatgctgagcatcatggaaaaattggagttttttgacttctcctacgacctcaacttgtgcgggctcacggaggatccagacctccaggttagcgccatgcagcatcaaaccgtcctcgaactcactgagacgggagtagaggctgccgcagcttctgctatttcagttgctaggacactcctagtgttcgaggtgcaacagccattcctgtttgtgctttgggaccagcagcacaaattcccagtgttcatgggacgggtctacgacccaagagcc

SEQ ID NO: 19206 - DNA, 1500 bp, Artificial Sequence
  Description of Artificial Sequence: Synthetic coding sequence
atggcttctcgcctgaccctgctgacattgctgctcctactactcgcgggcgacagagcaagttcaaatccgaacgcgacctcatcttctagtcaagaccctgaatcactacaggatcgcggggaaggaaaggtcgcaacaacagtgatttctaaaatgctgttcgtcgagcccattttggaagtgtcatccctgcccactaccaactccaccaccaactcagctacaaagataaccgctaataccactgacgaacctacaacacaacccactactgagcctactacgcagcctaccatacagcccacgcagccaactactcagctcccgaccgatagccccacacagcctacgactggctccttttgcccgggccccgtgactctgtgttctgacctggaatcccacagcacggaagccgtgctgggcgatgcactcgtcgacttcagccttaagctctaccacgctttcagcgcaatgaaaaaagtggagacaaacatggccttctccccttttagtatcgcaagtttattgacccaggtgcttctgggggccggagagaatacaaaaacaaacctcgagtcgatattgtcctatccaaaggacttcacttgcgtgcatcaggccctgaaaggctttactactaagggtgtgacatcagtgtcccaaatctttcatagccctgatttagcaataagagacaccttcgtgaatgcctcccggacactgtacagctcaagtcctagagtgttgagcaataatagcgatgctaatttggaactgatcaatacctgggtggcaaagaacacaaacaacaaaatcagccgacttctcgactctctgccttccgacacccggttggtccttctgaacgcaatctacctgtctgccaagtggaagacaacattcgaccctaaaaagactcgcatggagcctttccatttcaaaaactccgtcataaaagttcctatgatgaatagtaagaaataccctgtcgcccactttattgatcaaactctgaaggccaaggtcggacaactgcagctatcccacaatctgtctctggttattcttgtgcctcagaatcttaagcatagacttgaggacatggagcaggcactgtccccaagtgtcttcaaagccataatggagaaacttgagatgtcaaaattccagcccacactgctgacacttcccagaatcaaggtgaccacatctcaggatatgctgagcatcatggaaaagctcgagttcttcgacttttcctacgatctcaacctttgcggcttgaccgaggatccagatttgcaggtcagtgccatgcagcatcagaccgttctggagttgacagaaaccggggtggaggcagccgcagcttctgctattagcgtagcccgcactctcctcgtcttcgaggtgcaacagcccttcctgtttgtgctgtgggatcagcaacacaagtttcctgtgttcatgggccgtgtatatgacccgcgtgcc

SEQ ID NO: 19207 - DNA, 1500 bp, Artificial Sequence
  Description of Artificial Sequence: Synthetic coding sequence
atggcctctagacttaccctgctgactctgctcttgctcctcctggctggagatagggcgtccagtaaccccaacgcgacaagttcttctagtcaggacccagagtccctgcaagaccgcggtgaaggaaaggttgccactaccgtcattagcaaaatgctctttgtcgagccaatcctggaggtatcatctcttcctaccactaactctaccacaaattccgccactaagatcaccgccaacaccactgatgaaccaacaacccaacccaccacagagccgactactcaaccaactatccagcctacccagcccactacacagctgcccacagattcaccaactcagccaacaacaggaagcttctgccctggcccagtcaccctttgcagcgacctggagagtcactccaccgaggcggtcctcggagatgcattggttgacttctctttgaagctgtatcatgcattttcagcaatgaagaaagttgaaacgaacatggcctttagtcccttctcaatcgctagcctgctgactcaggtgttgctcggagcaggtgaaaacaccaagaccaacttggaatcaattttgtcttatccaaaggatttcacctgcgtgcaccaggctctcaaaggcttcaccaccaagggagtgactagcgtaagtcagattttccattctccagacctggcaatcagagacacattcgtaaatgcatcccgcacactgtatagttcctctccacgcgttctgagcaacaactctgacgctaaccttgagctgatcaacacatgggtcgccaagaacactaataataagatcagtcgcttgttggattcacttccctccgacacacgcctcgtgttgcttaacgcaatttacctgagtgccaagtggaagaccaccttcgatccgaaaaaaacgcgcatggaacctttccatttcaaaaacagtgttattaaggttcctatgatgaattccaagaagtatccggtggcccacttcatcgaccagacactcaaggctaaggtgggccagctgcagctgagccataacctgtcactcgtgatcctcgtgccacagaacctcaaacataggttggaagatatggagcaggccttgtccccgagcgtttttaaggcgataatggagaagctcgagatgagcaagttccaaccaaccctgctcacccttcctcgcatcaaggtaacgacttcccaggacatgctgtccattatggaaaagcttgagttcttcgatttctcctacgacctgaacctgtgcggtctcaccgaggacccagatctgcaggtaagtgccatgcagcatcagacagttctggagttgacggagacgggcgttgaagctgccgctgctagtgcaatcagtgtcgccaggactctcctggtttttgaagtccaacagccatttttgtttgtgctctgggaccagcaacacaaatttccagttttcatgggacgcgtctacgaccctagggcc

SEQ ID NO: 19208 - DNA, 1500 bp, Artificial Sequence
  Description of Artificial Sequence: Synthetic coding sequence
atggcctcccggctgacactcctcacgcttctgctgctattactggccggagacagggccagttctaacccaaacgccacaagctcaagctcgcaagatcccgagtccctgcaggaccgaggtgaggggaaggtggccaccacagttataagcaagatgctctttgttgagcccatattagaagttagttcactgccaaccactaactctaccaccaactccgcgactaagattacagccaacactactgacgagccaacaacacagccaacgacggaacctaccactcaaccaacaattcagccgacacagccaactacccagctacctacagacagccccactcaaccgactaccggatctttctgccccggacctgtcaccctttgctcagacctggagtctcattctacagaggctgtcctcggagatgccttggtagactttagcctcaagttgtatcacgcctttagtgccatgaagaaagtagagacgaacatggccttcagtcctttctcgatcgctagtctgttaacacaggtactgctcggggcaggagaaaacaccaaaacaaatctagagtcaattctctcatatccaaaggacttcacttgtgtgcaccaggcactgaaggggtttacgaccaaaggggttaccagcgttagccagatattccattcgcccgacctggccatccgggacacgtttgtcaatgcaagtcgtaccttgtactcgtctagtccgcgggtcctttcgaacaattccgacgccaatcttgagctgatcaacacatgggtggcaaagaacacgaacaacaaaatcagcagactgttggactccctcccctcggacacacgtctggtgctgctgaatgccatttacctttcggcaaagtggaagacaacctttgatccaaagaaaacacggatggaaccgtttcatttcaaaaattctgtgattaaagtccccatgatgaacagcaagaagtacccagtggcacatttcattgaccagacactgaaggcaaaggttggacagctgcagctttcgcacaatctctctctcgtcattctagtgcctcagaatctgaaacataggcttgaggacatggaacaagcactgagcccttctgtctttaaagctatcatggagaagttggagatgtccaaatttcagcctaccttactgacgttgccgagaattaaggtgacaacttcacaagacatgctttctatcatggagaaacttgaatttttcgatttttcctatgacctgaacctctgcggtctgaccgaggaccctgatctgcaggtgtctgcaatgcagcaccaaacagtactcgagctgactgagaccggcgtggaagcggccgcggcatccgcgattagcgtggcacgcacgttactcgtgtttgaggtgcagcaaccctttctgtttgtgctctgggatcagcaacataaatttcccgtttttatgggcagagtgtatgatccccgggct

SEQ ID NO: 19209 - DNA, 1500 bp, Artificial Sequence
  Description of Artificial Sequence: Synthetic coding sequence
atggcttctagactaacactgctaacacttctcctcctacttctggctggggatagggcttcttctaacccaaatgccacttcttcttcgtcacaagatcccgaatctcttcaagatagaggagaagggaaggttgctacaacagttatttccaaaatgcttttcgtggagccaattctcgaagtgtcgtctctgcccacaacaaattcaactacaaattcagcaacaaagatcactgccaatactactgatgaaccaactacacagcctacaactgagccaactactcagcccactattcagcctacacagccaactacacagctgcccactgattcacctacacagccaacaacaggatctttctgtcccgggccagtaacactttgcagtgaccttgaatctcactccacagaagcagtgcttggagatgcactcgtcgatttctcactgaagctgtaccatgcattcagtgcaatgaaaaaagttgaaacaaacatggctttttcccccttttcgatcgcctccctactaactcaggtcttacttggggcaggggaaaatacaaaaacaaatttggaatccattctcagttatcctaaagatttcacatgtgtgcaccaggcattgaaaggatttactactaaaggagtcacttctgtctcccagatatttcatagtcctgatttggctatccgcgatacattcgtgaatgcttctcgaacactctattcgtccagtcctcgggtgttaagtaacaatagtgatgcgaaccttgaactgatcaatacttgggtcgctaaaaacactaataacaagatctcccgcctcctcgattctttaccttctgatacacgcttagtgctactgaacgctatatatctctcagcaaaatggaaaacaacttttgatcccaagaaaacaaggatggagcctttccactttaagaattctgtaattaaagtgcctatgatgaactctaagaaatacccggtggcccatttcatagatcagacgctcaaagcaaaagtcgggcagctgcagctctcccacaatctgtctcttgtgatactcgtccctcagaacttaaagcaccgcttagaagatatggaacaggccctgagtccatccgtgtttaaagcaataatggaaaaattagaaatgagtaaattccagcctacactgcttacactaccaaggataaaagtgactacttctcaggatatgctgagtataatggaaaaacttgaattcttcgatttctcctatgatctaaatttatgtggacttacagaagatccagatctccaggtctcagccatgcagcaccaaacggtgctggagcttacagaaacaggggttgaggcagcagccgccagtgcaatctccgtagctcggactctcctggtgtttgaggttcagcagccttttctttttgtactatgggatcagcagcataaattccctgtgttcatgggacgcgtgtatgatcccagggca

SEQ ID NO: 19210 - DNA, 1500 bp, Artificial Sequence
  Description of Artificial Sequence: Synthetic coding sequence
atggccagccggctcacactcctgacactcctgctcctactgctggccggcgaccgggcttcaagtaaccctaatgcaaccagcagtagctctcaggacccagaaagcctgcaggatcggggcgagggaaaggtggcaactaccgtaatctctaaaatgctgtttgtcgaacctattctggaagtgtcatcgctcccaaccacaaacagcactaccaacagcgcaactaagattaccgcaaataccaccgacgagcccaccacacaacccactaccgagcctacaactcagcccaccatccaacccacacaacccaccacacagctccctacagactcaccaacccagcccaccacaggaagtttttgccctgggccagtgaccctctgtagcgacctggagtcacattctacggaagctgttctaggggacgccctggtggatttcagccttaagctgtatcacgcattctctgccatgaaaaaagtagaaaccaacatggctttttcaccgttttccatcgcatccctactcactcaggttctgctgggggcaggcgaaaacacaaagacaaacctggagagcattctgtcctatcctaaagactttacatgtgtgcaccaagccttgaaaggtttcactactaaaggggtcacatcggtctcacaaatattccacagccccgacctggccataagagacacattcgttaacgcctcgcgaaccttgtacagctcctcgccacgggtgctatcaaacaactctgacgctaatttggagctcatcaatacttgggttgctaagaatacaaacaacaaaatcagtcgcctgcttgactcacttccatcggacactaggctggtccttctgaatgcaatctatttgtccgcgaaatggaagaccacctttgacccaaagaaaactagaatggaaccgtttcactttaaaaactctgtaatcaaagttccaatgatgaactccaaaaagtaccccgtggcccacttcattgatcaaacactgaaagccaaggttggccaactgcaactctcccacaacctgagtctcgtgatactggtgccccagaacctgaaacatagacttgaagacatggagcaggccttgtcgcccagtgtgttcaaagccataatggagaaattagagatgtcgaagttccaacctacgctcctcaccctaccgcggattaaggtgaccacatcacaggatatgttatccatcatggagaaattggaattcttcgattttagttacgatctgaacctttgcgggctgacggaggacccagatctgcaagtcagcgccatgcaacatcagacggtgctggagctcaccgagactggcgtggaggcagcagccgcatctgccatttcagtcgctcgcaccctgctggtattcgaggtccagcagcctttcttgtttgtcctttgggatcaacaacacaagtttccagtgtttatgggtagagtttacgacccccgcgca

SEQ ID NO: 19211 - DNA, 1356 bp, Artificial Sequence
  Description of Artificial Sequence: Synthetic coding sequence
atgtttgacatcgaatattttcggaaagatccccggcctttcttcaagttcgccaaagaaatctatccaggacagttccaaccttccctgtgtcacaaattcattgcactgagcgataaggagggcaagctcctgaggaactacactcagaatattgatacactggaacaggtggctggcattcagcggattattcagtgccatgggtcatttgccaccgctagctgcctgatctgtaagtacaaggtcgactgtgaggccgtgagaggagacatatttaaccaggtcgtcccacgatgtccaaggtgtcccgccgacgagccactagccatcatgaagccagaaatcgtgttttttggggaaaatctgcccgagcagttccacagagcaatgaaatatgacaaggatgaggttgatttactgattgtcattggttcttcgttgaaggtgcgacccgtagccctgatcccctcttctatcccgcacgaggtgccccaaatactgattaacagagaacccctcccacacctgcattttgacgtggagctactgggagactgcgatgtcattattaacgagctttgtcatagactgggaggggagtacgctaagttgtgttgcaaccccgtgaagttatcagaaataaccgagaaacctcctcggactcagaaggagcttgcttacctctctgagcttcctccaactccgttgcacgtttccgaggatagcagttcccctgagcggaccagccctcccgacagctcagtgatcgttactcttctcgaccaggctgcaaagtccaacgatgatctggatgtgagtgagtctaaaggctgcatggaagaaaagccacaagaagtgcaaaccagcagaaacgttgagtctatcgcggagcaaatggagaatcctgatttgaagaatgttgggtcttccaccggtgagaagaatgagcgtacttccgtagcaggcacggtaaggaagtgctggcccaaccgcgtcgctaaagagcagatctcgagacgcttggatggaaaccaatacctgtttttgcctcccaacaggtatatttttcatggggctgaagtgtactctgattccgaagatgacgtactgtctagtagtagttgtggttcaaattccgatagcggaacttgtcagagcccaagtctggaggaacctatggaggatgaatccgagatcgaagaattttacaacgggttggaggacgaaccggacgttccggagcgcgccgggggtgccgggttcgggaccgacggcgacgatcaggaggccattaacgaggccatatctgtgaaacaggaagttaccgacatgaactacccttccaataaatcc

SEQ ID NO: 19212 - DNA, 1356 bp, Artificial Sequence
  Description of Artificial Sequence: Synthetic coding sequence
atgtttgacatagaatacttccgtaaggacccgaggccctttttcaaatttgcaaaggagatttaccctggacagttccagccttcactgtgtcacaagtttatcgctctttccgataaagaagggaaacttctgcgcaattacactcagaatattgacaccctggaacaggtggcaggtattcaaagaatcattcaatgccatggttctttcgcgaccgcatcttgtctgatctgcaagtacaaggtggactgcgaggccgtgagaggtgatatctttaaccaggttgtccctagatgtcctagatgccctgcggacgagcctctggcaatcatgaagcccgaaattgtgtttttcggagaaaacctgccagagcagtttcaccgagctatgaaatacgataaagacgaagttgatttgctcattgtcattgggtcgtccctgaaggtccgtccggtggccctcattccctcaagcatcccgcatgaagttccacaaattctgatcaacagggaacctcttccacaccttcactttgatgtggagctgcttggagattgtgacgtcataatcaacgaactgtgtcatcggcttggaggtgagtacgccaagctgtgctgtaacccagtcaagttgtcagaaattactgaaaaacctcctaggactcagaaagaactggcctacctcagtgagcttccccctactccacttcatgtgagtgaagatagctcttcgcccgaaagaacctcccctcccgactcgtcagtcatcgtgaccttgcttgatcaggcggcaaagagcaacgatgacctcgatgtgtcagaatccaagggctgtatggaggaaaagccccaagaggtccaaacctcccgaaacgtcgagtccatagctgagcaaatggaaaaccctgatctgaaaaacgtgggttcatcaacgggagagaagaacgagcgtaccagcgtcgcaggcaccgtgcggaagtgttggccaaacagggtggcaaaggaacagatttcccgacggcttgatggaaatcaatacttgtttttgccgcccaatcggtacatatttcatggtgccgaagtgtattccgattccgaggacgatgtcctttcttcatcgtcttgtgggagcaattccgattcgggaacttgccaatcaccttcccttgaagagcctatggaggatgaatcagagatcgaagagttctacaacgggcttgaagatgaaccagatgtgcctgaacgggcaggtggtgcaggctttggtactgacggcgatgatcaggaagcgatcaatgaagcaatttccgtcaagcaagaggtcacggacatgaactacccgtccaacaaatcc

SEQ ID NO: 19213 - DNA, 1356 bp, Artificial Sequence
  Description of Artificial Sequence: Synthetic coding sequence
atgtttgacatagagtattttcggaaagacccgcgcccattctttaaattcgcaaaagagatttatcctggacagttccagcccagtctgtgccacaagttcattgccctttccgataaagaaggtaagctactgcgcaactacacacagaacatagacaccctggagcaggtggccggcatccagagaattattcagtgtcacggctcttttgcaacagcctcgtgccttatctgcaagtataaggtagattgcgaggccgtaaggggcgatatcttcaaccaggtggtccctcggtgccccaggtgtcccgctgacgagcccctggcaatcatgaagcctgagatagtctttttcggcgagaacttacccgagcaatttcaccgcgcgatgaagtatgacaaggatgaggtcgatctactcatagtaattggctctagccttaaggtgcgccctgtggcgctgatcccaagttctattccccatgaggtgccccaaatccttatcaatagagaaccattaccgcacctccactttgacgtggagctcctgggagactgtgatgttataataaatgagttatgccataggctcgggggtgagtacgctaagctatgctgtaatcccgtgaagctctccgagattactgagaagccccctcggacccagaaggagctcgcgtacctcagcgagcttcccccgacacccctacacgtgagcgaggatagttcctctccagaacggacctctccccctgacagctctgtgattgttacactcttggaccaggccgcgaagagcaacgatgatcttgatgtctccgagtccaaagggtgtatggaggaaaagccacaggaagtgcaaacctcacgcaatgtagaatccatcgcagaacagatggagaatccagacctaaaaaatgttggctcgagtaccggagagaaaaacgagaggacttccgtggctggcactgtcagaaaatgttggccaaatagggttgccaaggagcagatttctcgtcgtctggacgggaaccagtacttgtttctccccccgaatcgttatatattccacggggccgaagtctatagtgacagtgaggatgatgtgctgtcaagcagttcatgcggctctaattccgactccgggacctgccagagtccgtcacttgaggaaccgatggaagacgagtctgaaatcgaggagttctacaatggattggaagacgagccagatgtcccagaacgtgccggcggggctggcttcggcacagacggtgacgatcaggaagcaattaacgaggcaatttcggtgaagcaggaagtaactgacatgaactatccatcgaataagtca

SEQ ID NO: 19214 - DNA, 1356 bp, Artificial Sequence
  Description of Artificial Sequence: Synthetic coding sequence
atgttcgatattgagtacttcagaaaggaccccaggcctttctttaagttcgcgaaggaaatctatccgggacagttccagccgtccctgtgccataagtttattgccttgagcgacaaggaggggaaacttctgaggaattacacccaaaacatcgacactctggaacaggtggcaggaatccaacgcatcatacagtgccacggatcgttcgcgactgcgagctgcttgatctgcaagtacaaagtggactgcgaggctgtcaggggggatatcttcaatcaggtcgtgccacggtgtccccggtgtccggcggacgagcccctcgctatcatgaaaccggagatagtgtttttcggagaaaacctcccagaacaattccacagagcaatgaaatacgataaagacgaagttgacctgctgatcgtgatcgggtcatcattgaaagtccgcccggtcgccttgatcccctcgtcgattcctcatgaagtgcctcaaatccttatcaatcgcgagccgctgccgcacctgcatttcgatgtcgagctgttgggcgattgcgatgtgatcatcaatgagctgtgtcacagactcggtggtgagtacgcaaaattgtgctgcaacccggtgaagctgagcgaaattaccgagaagcctcctcgcacccagaaggaactcgcatacctgagtgaactgccgccaaccccactccacgtgtcggaggattcctcttccccagaaagaacctcacctccagacagctcagtcattgtgaccctgctggaccaggccgccaagtcgaacgacgacctggatgtgtccgaaagtaagggatgtatggaggaaaagccgcaagaggtacagacgtcgagaaatgttgaaagcatcgccgaacaaatggaaaatccggacctgaagaacgttggaagcagcactggggagaaaaacgagcggacctccgtcgccggtactgtccgcaaatgctggcctaaccgcgtggcaaaggagcaaatctcgcggcgtctggacggaaaccagtacctgttcctgcctccgaaccgctacatcttccatggcgctgaggtgtactccgactcagaggacgatgtactgtcctcctcttcgtgcggatccaattcagactcgggaacttgccagagcccgtcgctcgaagaacccatggaggatgaatccgaaatcgaagagttttacaacggactcgaagatgaacctgatgtgccagagcgggccggaggggcgggctttggtaccgatggagatgaccaggaagcgatcaacgaggcgatctcggtcaagcaggaggtgactgacatgaactacccaagcaacaagtcc

SEQ ID NO: 19215 - DNA, 1356 bp, Artificial Sequence
  Description of Artificial Sequence: Synthetic coding sequence
atgttcgacatcgaatacttcaggaaggatccaagaccgtttttcaagttcgccaaggagatctacccaggacaatttcagccgtcattgtgccataagttcatcgccctttccgacaaggagggcaaattgctgcgcaactacacccaaaacatcgataccctggagcaagtcgccgggatccaacgaatcatccaatgccacggatcgtttgctaccgccagctgcctgatttgcaaatacaaagtggattgcgaagccgtgagaggcgacatcttcaaccaggtggtcccacgctgtcctcgctgcccggcggacgagcccctggctatcatgaagccagaaatcgtgttcttcggtgaaaaccttcctgaacagttccatagggcgatgaaatacgacaaggacgaggtcgacctgctcatcgtgattgggtcatcgctcaaagtgcgtccggtcgcactgatcccgtcatcgatcccgcatgaagtgccacagatcctgatcaaccgcgagcctctgccacatctgcattttgatgtggaactgctcggagactgcgatgtgattatcaatgaactttgccataggctgggaggtgagtacgcaaagctctgctgcaaccctgtgaagttgtcggaaattactgaaaagccgccgcgcacccagaaggaactggcgtacctgtcagaattgccgccaacgccgctgcacgtgtcggaagattcctcctccccggaaagaacgtctccgcctgatagctcggtcatcgtgactctccttgatcaggccgcgaagtcgaacgatgatctggatgtgtcggagtcgaagggatgcatggaggaaaagccgcaggaagtgcagaccagccggaatgtggagtcgatcgctgagcagatggagaacccggatctgaagaacgtgggatcctcgaccggggaaaagaatgaaagaacttcggtggcaggcaccgtgcgcaagtgctggccgaatcgcgtcgccaaagaacagatctccagacggctggatggcaaccagtacttgttcctgccgcctaatcgctacatcttccacggtgccgaggtgtactccgactcagaagatgacgtgctgtcctcatcaagctgtggctcgaacagcgattccgggacctgccagtccccatcgctggaggaaccaatggaagatgaaagtgaaatcgaggagttctacaacggcctcgaagatgaaccagacgtgccggagcgggccggaggagctggattcggaaccgacggagacgatcaggaagcgatcaacgaagccataagcgtgaagcaggaagtgactgacatgaactacccgtcgaacaagtcg

SEQ ID NO: 19216 - DNA, 1356 bp, Artificial Sequence
  Description of Artificial Sequence: Synthetic coding sequence
atgtttgacatcgagtattttaggaaagatccgcgcccatttttcaagtttgcgaaagagatttatcccggtcagttccaaccgagtctgtgccacaagtttatagctcttagtgacaaggagggaaaactgttacgcaactatacccagaacattgacacccttgaacaagtagcaggtattcaacggatcatacagtgccatggctctttcgccaccgccagctgcctgatctgcaagtataaagtcgattgtgaggccgtgcgaggcgatatcttcaaccaggttgtgcctcgctgtccccgctgccctgctgatgaaccacttgccatcatgaaaccagaaatcgtttttttcggagaaaacttgcctgaacagttccatcgggcgatgaagtatgacaaggacgaagtggacttattaattgttatcgggtcttccttgaaagtgcggccggtcgctcttattccgagtagtatcccgcacgaggtacctcagatactcataaaccgtgaacccctcccacacttgcattttgacgtagagctactcggagattgtgatgttattattaacgaattgtgccaccggctgggcggagagtacgcaaaattgtgctgtaacccagtgaagctcagtgaaatcactgagaagccacctcgcacgcagaaggaattagcttacttgagtgagctgcccccgacacctctgcatgtgtcggaagactcgtcaagtcccgagcggacgtccccgccggactcgtctgtgatcgtcacacttcttgatcaagccgctaaatcgaacgatgatctagacgtttccgaaagtaagggttgcatggaggaaaagccacaagaggtgcagacatcaaggaacgttgagtcaatagccgaacaaatggaaaacccagacctgaagaacgttggaagctccaccggcgagaaaaacgagagaacgtctgttgcaggcacagttcgaaaatgctggcctaaccgtgttgcaaaggagcagatatcccgccggctagacggaaatcaatacctctttttaccacccaaccgctacatcttccacggcgctgaggtttactccgactcagaagatgatgtcctctcctcatcatcctgcgggtccaactccgatagcggcacttgccaatcaccaagcctggaagagcctatggaagacgagagcgagatagaggaattctataatgggctggaagacgaacctgatgtgcccgaaagggccgggggcgctggctttggcacggatggtgacgatcaagaggcaatcaatgaagcaatcagtgtgaagcaagaggtcacagatatgaactacccctccaataagtcc

SEQ ID NO: 19217 - DNA, 1356 bp, Artificial Sequence
  Description of Artificial Sequence: Synthetic coding sequence
atgtttgacattgaatatttccggaaagatcctcggcctttctttaaattcgccaaggagatttacccaggccagtttcagccctcactttgccacaagtttattgcactgtccgataaggaaggaaaattactgcgcaattatacccagaacatagatacgctggagcaggtggcagggattcagcggattatccagtgtcacggttcctttgctaccgccagttgccttatttgtaaatacaaagtcgattgcgaagctgtgagaggcgacatatttaatcaggtggtcccacgctgcccacgttgccccgccgacgagccactggctatcatgaaaccagaaattgtgtttttcggcgagaacctgcctgaacagtttcaccgggccatgaaatatgataaggatgaggtggatctgctgatcgtcataggatcatccctgaaggtccgaccggttgcgctcattccttcctccatccctcacgaagtgccgcagatacttattaaccgcgaacccttgccccacttgcatttcgatgtcgagttactcggggactgtgatgtgataatcaatgagctgtgtcacagactcggaggagagtatgctaaattatgttgtaatcctgttaaactgagcgagatcactgaaaaacctcctcgaacccagaaggaactggcctatctgagcgagctccctcctacccctctgcacgtgtcagaagactcaagttcacccgagcggactagccccccggactctagcgtaattgtgactctgctcgatcaagctgctaaatccaacgacgacttggacgtgtccgagagcaagggctgcatggaggaaaaaccccaggaagtccagacaagcagaaatgtcgagtcgattgccgagcagatggaaaatccagatctgaagaacgtggggagctctacaggagaaaagaatgaaagaacttctgtggcagggacggtgcggaagtgctggcctaaccgggtggctaaagagcagatctctcggcggttagatggaaatcagtatctcttcctcccccccaataggtacattttccacggggccgaagtctattccgattctgaagacgatgtccttagctcaagctcatgtggctccaactctgactcggggacttgtcaatctccttctctggaggagccgatggaggacgaatcagagattgaggaattctataacgggttagaggacgagccagacgtgcccgaaagggccgggggggctgggttcggaacagacggagatgaccaggaagctattaatgaagctatatctgttaagcaggaagttaccgatatgaattaccctagcaataagagc

SEQ ID NO: 19218 - DNA, 1356 bp, Artificial Sequence
  Description of Artificial Sequence: Synthetic coding sequence
atgttcgatatcgaatatttccgcaaagaccctcgccccttctttaaatttgccaaagaaatctacccagggcagtttcagccttctctctgccacaaatttattgctctcagtgataaggaaggaaaattactgcggaattacactcagaatatagatacacttgagcaggtggctggaatccagaggatcatccagtgccatggatcctttgctacagcctcatgtctgatatgtaaatataaagtggattgtgaagcagttcgtggagatatctttaaccaggtggtgccccgctgccctcggtgcccagctgatgagccactggcaataatgaaacctgaaattgttttttttggagaaaatctccctgagcagtttcatcgggccatgaaatatgataaagatgaagtggatctgctgatagtcatagggagttccctcaaagttaggcctgtggcccttattccgtcttccatccctcacgaggtgccccagattttaatcaatagagagcctcttcctcatcttcacttcgatgtcgaacttttgggagattgcgacgtgatcatcaatgaactgtgtcacagactagggggggagtatgctaaactgtgttgtaaccctgtgaagctatcggaaatcacagaaaaaccaccccgaactcagaaagaacttgcatatctgtccgaactgccccctacgcccctgcatgtgtccgaggattcaagttcgcctgagagaacttccccccctgattcatctgtgatcgtgacacttttagatcaggctgctaagtcgaatgatgatcttgatgtgtctgaatctaaagggtgcatggaggaaaaaccccaagaagtacagacatcccggaatgtggagtccatagcagagcagatggagaatcccgatctgaaaaacgtggggagttcaactggggaaaaaaatgaacgcacttctgttgctggaactgtcaggaaatgttggccaaatcgggttgcaaaagaacagatctctaggcgactcgatggaaatcagtacctcttcctgcctcccaacaggtatatcttccacggagctgaggtctactctgattctgaagatgatgtcctgtcctcctctagttgcggaagtaattctgattccggaacgtgtcagagtcctagtctcgaagaaccaatggaagatgaatccgaaattgaggaattctacaacgggctcgaagatgagcccgatgtgccagaaagagccgggggagccgggtttggaacagatggggacgaccaggaagctatcaatgaagctatatcagtcaagcaggaagttacagatatgaattatccttctaacaaatcc

SEQ ID NO: 19219 - DNA, 1356 bp, Artificial Sequence
  Description of Artificial Sequence: Synthetic coding sequence
atgtttgacattgagtattttaggaaagacccgcgaccgttcttcaaatttgcgaaagaaatttatccgggtcaattccagccgtcactatgccataaatttatagcgctgtcagacaaagagggtaagttattaagaaattatacacaaaatattgatactcttgagcaagttgctggaatccaacgcattattcaatgtcatggtagctttgccacagcttcatgtctgatttgtaagtataaagtggattgcgaagccgtacgcggcgacatttttaatcaagtggttccacgctgccctcgatgtcctgcagatgaacccttagccattatgaagccggaaatagtcttcttcggcgaaaatttaccggagcaatttcatcgcgccatgaaatatgataaggacgaagtggacctgcttatagtcataggatcctctttaaaagtccgcccggtagccttaataccgtcaagcattcctcatgaagtaccccagatcctcataaatcgtgaacctctgccgcaccttcattttgacgtggaattgttaggcgattgtgatgtcatcatcaacgaattgtgtcacagactagggggcgaatatgcaaaactctgctgcaaccctgtcaaactgtccgaaataacggaaaagcctccgcgcacacagaaggaattagcgtatttgagcgaactgccaccaaccccgcttcacgtctctgaagatagctcgtctccagaacggacaagtccgccggacagctctgtgattgtcacgttgttggatcaggcagctaaatccaacgatgatttagacgtcagcgaatctaaaggctgcatggaagagaaaccgcaagaagtgcagacaagtcgaaacgttgagagcattgcagagcaaatggagaatccggaccttaaaaacgtaggatcttctactggcgagaaaaatgagcggacctcagttgcggggacagtgcgcaaatgttggcctaaccgagtggctaaagaacagatttcccgcagattggacggaaatcagtatctctttctgccaccaaataggtatatatttcatggagccgaggtgtactctgattctgaggacgacgtgttatcaagttcttcatgtggatcaaacagtgattcaggtacgtgccaatcaccgtctttggaggagcccatggaagatgagagcgaaatcgaagaattctataatggcttggaagatgaaccagatgtgccggagagagcgggtggcgctggctttggaacagatggagacgaccaagaggcaattaatgaagctatcagcgtgaagcaagaagtcacggacatgaattatccttccaataaatcc

SEQ ID NO: 19220 - DNA, 1356 bp, Artificial Sequence
  Description of Artificial Sequence: Synthetic coding sequence
atgtttgacattgagtacttccggaaggaccccagacctttcttcaagttcgctaaagaaatttaccccgggcaattccagccatcactatgccacaaatttatcgccctttcagacaaagaggggaaactcctgcgaaattatacccagaacatcgacacattggaacaggtcgccggcatccaacgcattatacaatgtcatggcagcttcgctactgcctcttgcctgatctgcaagtataaggtggactgcgaagcagtgcgcggcgacattttcaatcaagtcgttcctcgctgtcccaggtgccccgcagatgaacccctcgccattatgaagcccgaaattgtgttctttggcgagaatctacccgagcagttccatagggcaatgaagtacgataaggatgaggtggatttactgatcgttataggatcatccctgaaggtgagaccggtagcactgattccttcctctatcccgcacgaggtgccccagatcctgataaacagggagccactaccgcacctgcattttgacgtggaattgctgggcgactgtgatgtgataataaacgaactgtgtcaccgcctggggggcgaatacgctaaactgtgctgcaacccagtgaagcttagcgagataactgagaagccacctcggactcagaaggaattggcctatcttagtgagcttcctcccacaccactgcatgtctccgaagatagcagcagccctgaacggacctccccacctgattcaagtgttattgttacactgctggatcaagcagctaaaagcaacgacgatttagacgtatccgagtcaaaaggctgtatggaggaaaagccacaagaagttcaaacatctagaaatgtggagagcatagcagagcagatggaaaatccggatctgaaaaacgtcggcagcagtacaggggaaaaaaatgagagaacatctgttgctggcactgtccggaaatgctggcctaaccgggtagccaaggaacagatcagtaggagactggatggtaaccagtacctgtttctgccaccgaataggtacatcttccatggagcagaggtgtacagcgacagcgaggacgacgtgctctccagctcctcttgtggatctaacagcgatagcgggacatgccagtcaccaagtttggaggaacccatggaggacgagagtgaaattgaggagttctacaatgggctcgaggatgaacccgatgttcctgagagagcaggtggtgcaggatttggcacagacggagatgaccaggaggcaatcaacgaagctataagcgtgaaacaggaggtgaccgacatgaactatccctctaacaaaagc

SEQ ID NO: 19221 - DNA, 1356 bp, Artificial Sequence
  Description of Artificial Sequence: Synthetic coding sequence
atgtttgatatcgagtacttcaggaaggacccacggccattctttaagttcgcaaaggagatttacccaggacaatttcaaccctcgctctgccataagttcatcgctctgtcagacaaagaaggaaaactgttgcgcaactacacccaaaacatcgacaccctggaacaagtggcagggatccagagaatcatccagtgccacgggagcttcgcaactgcatcatgcctcatctgcaagtacaaggtggactgcgaagcagttcgcggagatatcttcaaccaggtggtgcctagatgccctcgctgccctgccgacgagccgctggccatcatgaagccggagatcgtgttcttcggagagaacctcccggaacagttccatcgcgcaatgaaatacgacaaagatgaagtggacctgctgatcgtcatcggatcatcccttaaagtgcggccggtcgcgctgatcccgtcatccatccctcacgaagtgccgcagattctcatcaatcgagaacccctgccgcacctccactttgacgtagagctgctgggcgactgcgacgtcatcatcaacgagttgtgccatcggttgggcggagagtacgccaagctgtgctgtaaccctgtcaagctgtcagagatcaccgaaaagccaccgcggacgcaaaaggagctggcatacctctcggaactgccaccgactcccttgcacgtgagcgaggattcgtcgagcccggagcggacctcccctccggactccagcgtgatcgtcactctgctggaccaggccgccaagtcgaatgatgacctcgacgtgtcggaatcgaaaggttgcatggaggagaagccacaggaggtccagaccagccgcaacgtggaatccattgctgaacagatggaaaatccagacctcaagaacgtaggatcaagcaccggcgaaaagaatgagcggacttccgtggcggggactgtccggaagtgctggccaaacagagtcgcaaaggaacaaatctcccgccggttggacggcaaccaatacctcttcctccctcccaatcggtacatctttcacggcgccgaagtgtatagcgactcagaagatgatgtgctgtcctccagctcatgcggatcgaactccgattcggggacttgccagtcccctagcctggaagagccaatggaggacgaatcagaaatcgaggagttctacaatgggctcgaggatgagcccgatgtcccagaacgcgcgggaggagccggcttcggaaccgacggagacgaccaggaggcgatcaacgaagccatctcagtgaagcaagaggtcacggatatgaattacccatcgaacaagtcg

SEQ ID NO: 19222 - DNA, 1356 bp, Artificial Sequence
  Description of Artificial Sequence: Synthetic coding sequence
atgttcgacattgaatactttagaaaggaccccagaccctttttcaagtttgcaaaagagatttaccctgggcagttccagcctagcctttgtcacaaattcatcgccctttcggataaggaaggaaagctccttcggaactacacccagaacattgataccctggaacaagtggcagggattcagcgtataatccaatgccacggatcctttgcaaccgcgagctgtctcatctgcaagtacaaggtcgattgcgaagcagtgcgaggtgatatcttcaatcaggtggtgccccggtgtcctcggtgtccagcagatgaacctctggcaatcatgaaacctgaaatagtgttctttggtgaaaatctccctgaacaatttcatagggcgatgaagtacgataaggatgaagtggatttgttgatcgtcattggttcgtctctgaaagttcgacctgtggcacttataccaagctctatcccacatgaagtgcctcagatccttatcaacagagaacccctgccccatctgcattttgatgtggaactgttgggcgactgtgacgtgatcatcaacgagctgtgtcaccggctgggaggtgaatacgccaaactttgttgtaatcccgtgaagttgtccgaaattaccgagaaaccccctcggacccagaaggaactcgcatatctctcagagcttccaccaaccccacttcatgtctccgaggattcgtcaagcccagagcgtaccagccctccggactcgtcagtcatcgtgactctccttgatcaagcagcgaagtccaacgatgatctcgacgtgtcggaaagcaagggatgcatggaggagaagcctcaagaagtccaaacctcgagaaatgtggaatcgattgctgaacagatggaaaacccagacctcaagaatgtcgggtcgtcaactggagaaaagaacgaacgcacttcggtcgcagggactgtccggaagtgctggccaaacagggtggcaaaggagcaaatttccagacggctggacggcaaccagtacctgtttctgccgccgaaccgatacatttttcatggagcggaggtttactccgattcggaagatgacgtgctctccagctccagctgtggatctaactcggactcaggcacctgtcaatcaccgtcccttgaggaacctatggaagatgaatccgaaatcgaggaattctataacggtctggaagatgaaccggatgtcccagaaagggcaggcggcgcaggatttgggactgatggtgatgatcaagaagcgatcaacgaagctatttcggtgaaacaggaagtgactgatatgaattacccaagcaataagtcg

SEQ ID NO: 19223 - DNA, 1356 bp, Artificial Sequence
  Description of Artificial Sequence: Synthetic coding sequence
atgttcgacattgagtactttagaaaggacccgcgaccttttttcaagttcgccaaagaaatctacccaggacaatttcaaccgtcgctgtgccataagtttattgctctctccgacaaagaagggaagctcctgagaaactacacgcaaaacattgacaccctggaacaagtcgcaggaatccagaggattatccaatgtcatggctcgttcgcaactgccagctgtctcatctgtaaatacaaggtcgactgtgaggctgtgcggggtgacattttcaaccaagtcgtgccgagatgcccacggtgtcccgcggatgagccacttgcgataatgaagcctgaaatcgtgttttttggggaaaacctgcctgagcaatttcatagggcaatgaaatacgataaggacgaagtggaccttcttattgtcatcggatcgtccctgaaggtccgaccagtcgcacttataccgtcatccatcccccacgaagtgccacaaatcctcattaacagagaacctttgcctcatttgcattttgacgtggagctcctgggggattgtgatgtgatcataaacgaactttgtcatcgcctgggaggagagtacgcgaaactgtgctgcaatcctgtgaaactgtcagagattaccgagaaaccccctaggacccagaaagaattggcatacctgagcgaacttcctccaactcccctccacgtcagcgaagatagctcctccccggaaaggacttccccacctgattccagcgtcattgtgaccctgctcgatcaagcagcaaagtccaacgatgatcttgacgtctccgaatcgaaaggatgcatggaggagaagccacaagaagtgcaaacctcccgtaacgtggaatcaatcgcggagcaaatggaaaacccagatcttaagaatgtgggatccagcactggagaaaagaatgagcgcacgtcggtcgcaggaaccgtgagaaagtgttggcccaaccgggtcgcaaaggaacaaatatcgagacgactggatggtaaccaatacctgttcctcccaccgaaccggtatatctttcacggggcagaagtgtactcagattccgaagatgacgtgttgagcagcagctcctgcggatcgaactcggactccgggacctgccaatcgccatcccttgaagaacctatggaagatgagtcagagattgaagaattctacaatggtctggaagatgaacctgatgtgccggaacgggcaggtggtgctggctttggcactgacggcgatgaccaggaagctatcaacgaggccatatcggtgaagcaagaggtcaccgacatgaattacccaagcaataagtcc

SEQ ID NO: 19224 - DNA, 1356 bp, Artificial Sequence
  Description of Artificial Sequence: Synthetic coding sequence
atgtttgatattgaatactttcgcaaggatccaagaccattctttaagtttgcaaaagagatctacccaggtcagttccagccttcactttgtcataagtttattgcgctgtccgataaagaaggaaagttgctgcgaaattacacccaaaacatagataccctcgaacaggtggctggtatccagcgcataattcaatgtcacggctccttcgcaactgcctcctgtcttatttgcaagtacaaagtggattgtgaggccgtgcgaggcgacatctttaaccaggttgtgccccgctgtcctaggtgccctgcagatgaaccactggccattatgaaacctgaaattgtgttttttggagaaaacctccctgagcaatttcatcgcgccatgaagtatgacaaggacgaagtcgaccttctgatcgtgattggatcctcactgaaggtgcggccagtggcactcatcccctcttcgattccccatgaagtgcctcagatcctcatcaaccgtgaacctctgcctcatcttcactttgacgttgaactgctgggggattgcgatgtgattatcaatgagctctgtcaccgactcggaggcgaatacgcaaagctgtgctgcaatccagtgaagctgtccgagatcactgaaaagccgccccgcactcaaaaggaacttgcgtacctttcggagttgcctcctactccactccatgtgtcggaggattcctcgagccccgaacggacttcaccacccgacagctctgtgatcgttaccctgctggatcaagcagcaaagtcgaacgatgacctcgacgtgtcggaatcaaagggctgtatggaggaaaaacctcaggaagtccagacctcccgaaatgtcgagtccatcgccgaacagatggaaaatcctgaccttaagaatgtgggatcctcgaccggtgagaagaacgagaggacctcggtggcaggaacggttagaaagtgttggccgaaccgggtcgcaaaggagcaaatctcccggaggcttgatggaaaccagtacctgtttcttccaccaaatcgatacattttccacggggcagaagtctactccgatagcgaggatgatgtcctgtcctcgtcatcttgtgggtccaactccgattcgggcacgtgtcagtcgccctccctggaggagcctatggaagatgagagcgagattgaagagttctataatgggctggaagatgagccagatgtgccggaacgggccggtggagcagggtttggaaccgatggagacgatcaggaggcaatcaatgaggcaataagcgtgaaacaagaggtgactgacatgaattacccttccaacaagagc

SEQ ID NO: 19225 - DNA, 1356 bp, Artificial Sequence
  Description of Artificial Sequence: Synthetic coding sequence
atgtttgacatcgagtacttcagaaaggatccaagaccttttttcaagtttgctaaggagatataccctggtcaattccagccttccctgtgtcacaaattcatcgctctgtcagacaaggaaggaaagctgttgcgcaattacacccaaaacattgacactctggaacaggttgcaggtatccaacggataatacaatgccacggttcgttcgcgacggcctcctgcctcatctgcaaatacaaggtggattgcgaagcagtccggggagacatctttaaccaagtggtacctagatgtcctaggtgcccagcagacgaacctcttgcgattatgaaaccagaaatcgtgtttttcggagaaaacctgcctgagcaatttcatagagccatgaagtacgataaggatgaggtcgatctcttgattgtcattgggtcgtccctcaaagtaagacctgtggcacttattccatcatcaattccacatgaggtcccacagattctgatcaaccgtgagcctcttccacatttgcacttcgatgtggaactcctgggagattgtgacgtgattatcaacgaactttgtcataggttgggcggagagtacgccaaactttgttgtaatccggtgaagctctccgagatcacggaaaaaccaccacggacccagaaagagcttgcatatctctctgaactccctccaactccactgcatgtctcggaagattcctcgagtcctgaacgtaccagccctcctgatagctcagtcatagtcactctcctggaccaagccgcgaagtctaatgatgatctcgatgtgtccgagtcgaaagggtgtatggaggaaaagcctcaagaggtgcagacctctcgcaacgtcgaatctatagcagaacaaatggagaacccagaccttaagaacgtgggatcgtcgactggcgaaaagaacgagagaacctcagtcgcaggcactgtccgaaaatgttggcctaatagggtcgcaaaggaacaaattagccggcggcttgatggaaatcagtacctgtttcttccgccgaacaggtacatctttcatggagctgaagtgtacagcgacagcgaagatgacgtgctttcctcatccagctgtggtagcaattccgactcgggaacctgtcagtctccttcccttgaggagcctatggaagatgaaagcgaaattgaggagttttacaacggtctggaggacgaaccggacgtgcccgaacgtgccggcggagcaggtttcggaaccgatggggatgatcaagaggcaattaacgaggccattagtgtgaagcaggaagtgactgatatgaactatccttcaaataagtca

SEQ ID NO: 19226 - DNA, 1356 bp, Artificial Sequence
  Description of Artificial Sequence: Synthetic coding sequence
atgttcgacatagagtactttagaaaggatccgcgccctttctttaagttcgcaaaagagatttacccgggacaatttcagccgagcctctgccacaagttcatcgcgctgtcggacaaggagggaaaactgctcaggaattacacgcagaatattgacaccctggagcaggtggccggcatccagagaatcatccaatgtcatgggtctttcgctactgcgtcctgcctcatttgtaagtacaaggtggattgcgaagccgtcagaggggatatcttcaaccaggtggtgccacgctgtccgcgttgccccgccgacgaaccgcttgccatcatgaaaccggagatcgtgttcttcggggagaacctgcctgaacagtttcatagagcaatgaaatacgataaggacgaagtggacctcctcatcgtgatcggatcatccctgaaggtccgcccagtggcgctgattcccagcagtatccctcatgaagtgcctcagatcctcatcaacagagaaccactcccgcacctccacttcgacgtcgagctgctcggagattgcgatgtcatcattaacgagctgtgccaccggctcggaggagagtacgcgaaactgtgttgcaaccccgtcaaactttccgagatcaccgagaagcctccccgcacccagaaagaactcgcctacctctcagagctgccgccgaccccacttcatgtgtccgaggatagtagctcgccggagagaacttccccaccggacagctccgtcatcgtgaccctgctggatcaggctgcaaaatcgaacgatgaccttgacgtgtcagaatcgaagggatgcatggaagaaaagcctcaggaagtccaaactagccgcaacgtggagagcatcgccgagcagatggaaaacccggacctgaaaaacgtggggagctccactggggaaaagaacgaaaggacctcggtggcgggaactgtccggaagtgttggccaaaccgggtagcgaaggaacaaatctcccgccgccttgacgggaaccaatacctcttcctgccaccgaaccggtacatcttccacggcgccgaggtgtactccgattcagaagatgatgtgctttcctcctcctcgtgcggctctaactcggactcgggtacctgtcagtcaccgtcccttgaagaaccgatggaagatgaatccgaaatcgaggagttttacaatggcctggaggatgaacctgacgtcccggagcgcgcgggaggcgcaggcttcggaactgacggggacgaccaagaggccatcaatgaagccatttcggtcaagcaggaagtgacggatatgaactacccgtcaaacaaaagc

SEQ ID NO: 19227 - DNA, 1356 bp, Artificial Sequence
  Description of Artificial Sequence: Synthetic coding sequence
atgtttgatattgaatactttcggaaggacccccggccttttttcaagttcgccaaagagatctaccctggccaattccaaccatccctctgccataagttcatcgctctcagcgacaaagaggggaaacttctgcgaaattacacccagaatatcgatacgcttgagcaggtggcaggcatccagaggatcattcagtgtcatgggtctttcgcaaccgcaagttgtctgatatgcaaatataaagtcgattgcgaagcagtcagaggagatatcttcaaccaggtagtaccgcggtgcccccgctgcccagccgacgagccactcgcaattatgaaacccgagattgttttctttggcgaaaacctgcccgagcagttccatagggccatgaagtacgataaggacgaggtcgacctgctgattgtgataggatcttccctgaaagtgcggccagttgcactgataccctcatccattcctcatgaggtgccacaaattctcatcaacagggagccattgccacaccttcacttcgatgtcgagcttctgggcgattgcgatgtgattattaatgagctctgtcaccgactggggggggagtatgccaagctttgttgtaaccctgtgaaactctctgaaatcacagaaaagccccctagaacccagaaagaactggcgtacctcagcgagctgcctcctaccccactgcatgtgagtgaggacagtagttctcccgagaggacgagcccaccagactcaagcgtgatcgtgacactgctggaccaggcagccaagagtaatgacgatctggacgtgagtgaatctaaaggctgtatggaggaaaagccgcaagaggtgcagacatcaaggaatgtggagtccattgccgagcaaatggagaacccggacctgaagaatgtcggaagctctacaggcgaaaagaacgaacggactagcgttgctgggacagtacgcaagtgctggcccaatcgcgtggccaaggaacagatcagtcgacgcttggatggaaaccagtacctgttccttcctccaaaccggtatattttccatggggcagaagtatactcagacagcgaggacgacgtcctctcttctagtagctgcgggtcaaatagcgatagcgggacttgtcagtctccttcactggaggaaccaatggaagatgagtccgagatcgaagagttctacaacggattggaagatgagccagatgtgcccgaaagagcaggcggggctggattcgggaccgacggagatgatcaagaagcaattaatgaggcgatcagcgttaaacaagaagtgactgacatgaattatccttcaaacaaatca

SEQ ID NO: 19228 - DNA, 1356 bp, Artificial Sequence
  Description of Artificial Sequence: Synthetic coding sequence
atgtttgatatagaatacttccggaaagatcctcgtccgtttttcaagttcgccaaggaaatctacccaggccagttccaaccctccttgtgtcataagtttatcgcgctctcggataaggagggaaaacttctgcggaactacacccagaatattgataccctggaacaggtggctgggatacagaggataattcagtgccacggttcgtttgcaacggcttcctgtctgatttgcaagtataaagtggattgcgaagcggtgagaggtgacattttcaatcaggttgtgccgcgctgcccacgatgtccagcagacgagcctctcgccatcatgaagcctgagattgtgttttttggagagaatttgccagaacagtttcaccgggcaatgaaatacgataaggatgaggtggatctgctgattgtgatcggctcatcacttaaagtccgtcctgtcgcactcatcccctcatccattccccatgaggtgccccagattcttatcaacagagaacctcttccacaccttcattttgacgtggaactgcttggcgactgcgatgtgattatcaacgaactgtgccatcgtctgggtggagaatacgccaaactttgctgtaacccagtgaaactttcggaaatcactgaaaagcctccgcgtacgcagaaagagttggcctatctttccgagcttcctcccaccccactccacgtctctgaagattcgtcgtcacctgaacgtacttcgccacctgactcatccgtcatagtgaccttgctggatcaggcagctaagtcaaacgatgatctggacgtttccgaatcaaaggggtgtatggaagaaaagccacaggaagttcaaaccagtagaaacgtggaatcgatcgcagaacaaatggaaaatccggatctgaaaaatgtgggatcatccaccggagagaagaatgaaagaacttcggtggcaggcactgtgcgaaagtgttggccaaatagggtggccaaggagcagatctcaagacgactcgatggaaaccaatacctctttcttcctccaaacagatacatctttcatggagcggaagtgtactcggactcagaggatgacgtgctgtcgtcgtcctcctgtggatctaactctgatagcgggacttgtcaatcgccttccctggaagaaccgatggaggatgaatccgaaatcgaggagttttacaacggcctggaagatgagcctgatgtgcctgaacgggcggggggagcgggttttggtacggatggggatgatcaagaggcgattaatgaagcaatctccgtgaagcaagaggtcaccgatatgaactacccttccaataagagc

SEQ ID NO: 19229 - DNA, 1356 bp, Artificial Sequence
  Description of Artificial Sequence: Synthetic coding sequence
atgttcgatattgagtacttcaggaaagatccaaggccattcttcaagtttgccaaagagatctatccaggtcagttccaaccaagtctctgtcacaagtttatcgccctgagtgataaggagggaaagctgctgcgcaattacacgcagaatatcgacactttggagcaggtggcaggaatacaaaggattatccagtgtcatggctcttttgcgacggctagttgtcttatctgcaaatacaaggtggactgcgaggcagtgcgcggcgatatctttaaccaggttgtacctaggtgtccgagatgcccagctgacgaacctttggccattatgaagccggaaattgtatttttcggagagaacctgcccgagcagttccaccgcgcgatgaaatacgacaaggacgaagtcgatttgttgattgtcattggctcctcattgaaggttagaccggtagctcttattcccagcagtatcccccatgaagtacctcagatccttatcaatagagagcctttgcctcatctgcacttcgatgtagagctgctgggcgattgcgacgtgatcatcaacgagctgtgtcaccgcctgggtggtgagtacgctaaactgtgttgcaacccagtaaagctcagcgagattacggagaaacctcctcgcacccagaaggagcttgcctacctttcagaactccctcccacccccctgcacgtgtctgaggactcatctagtccggagcgcacaagcccacctgactcatccgtaatcgttactctgctggatcaggctgctaagtctaatgacgatctcgacgtctccgaaagtaagggctgtatggaggaaaagccccaggaagtgcagacctcaaggaacgtagagagcatcgctgagcagatggaaaaccccgatcttaagaacgtgggttctagcacaggtgaaaaaaacgagcgcacaagcgtggcaggaactgtcagaaaatgctggcccaacagagtggctaaagagcaaatctctaggaggctggatggaaaccaatacctcttcctgccgcctaatcgctatattttccatggtgctgaagtatactcagactctgaggacgacgttctgtcatcatcatcttgcggttccaacagcgatagcggcacttgccaaagtccgtctcttgaagaaccgatggaagacgagtcagagatcgaagagttttacaacggccttgaggacgagcctgatgttccagagcgcgcgggtggagctggatttggcacggacggcgatgaccaggaggccataaacgaagcaatcagcgtcaagcaggaggtcactgacatgaactacccgagcaacaagtct

SEQ ID NO: 19230 - DNA, 1356 bp, Artificial Sequence
  Description of Artificial Sequence: Synthetic coding sequence
atgttcgatattgagtacttccgcaaggacccgcgtcctttctttaagttcgcgaaggagatttacccgggccagtttcaaccatccctctgccataagtttatcgccctgagtgacaaggagggtaagctccttcggaactacacccagaacatcgataccctcgagcaggtcgccggtatacagaggatcatccaatgtcatggctcgttcgctactgcgtcatgccttatctgcaagtacaaggtggattgcgaggcagtgaggggagacatctttaaccaggtggttccgaggtgccccaggtgcccggccgacgagcccctggccataatgaaaccggaaatcgtgttcttcggagagaatttgccagagcagttccatcgtgcaatgaagtatgacaaagatgaggtcgacctgctcatcgtgattggatcctcacttaaggtccgcccggtggccctgatccccagctccatccctcatgaagtgccgcagatcttgatcaatcgggagccactgccacacctgcacttcgacgtggaactcctgggggactgtgatgtgatcatcaacgagttgtgccaccgccttggtggagagtacgccaagttgtgctgtaacccggtcaagttgtcggagattaccgaaaagcccccgcgcacccagaaggaactcgcttacctgtctgaactcccgcctactccactgcacgtgagcgaggactcgtcgtcgccggagagaacttccccgccggactcatcggtgatcgtcactctgttggaccaggccgcaaaatcgaacgacgatctggacgtgtcggaatccaaaggctgcatggaagagaagcctcaagaggttcagaccagcagaaacgtggagagcattgccgaacaaatggaaaacccagacctgaagaacgttggtagctccacgggggagaaaaatgagaggacctcagtcgccggaactgtccggaagtgctggccaaatcgggtggcaaaagaacaaatttcccggcggctggacggaaatcagtacctgttcctgccacctaaccggtacatcttccacggagcagaggtgtactccgattcggaggacgacgtgctgtcatcctccagctgcggatcgaactcggacagcggaacctgccagtcccctagcctggaggaaccaatggaggatgaatcggaaatcgaggagttttacaacgggctggaagatgaaccggacgtcccggagcgggcgggtggagccggcttcgggaccgatggagacgaccaggaggcgattaacgaggcgatctcggtgaaacaggaagtgaccgatatgaactatccgtccaataagagc

SEQ ID NO: 19231 - DNA, 1356 bp, Artificial Sequence
  Description of Artificial Sequence: Synthetic coding sequence
atgtttgatatcgagtactttaggaaagacccccgacctttctttaagtttgctaaggagatttaccctggacagttccagccttcgctttgtcacaagtttatcgcactgtcggacaaagagggtaaacttctgagaaactacactcagaatatagacaccctggaacaagtggcaggaattcaacgaatcattcagtgccacgggtcctttgcaactgcatcgtgtctgatatgtaagtacaaggttgattgcgaggcagttaggggagatatcttcaaccaagttgtgccgagatgtcccaggtgtcctgccgatgaacctcttgcaatcatgaaaccagaaattgttttctttggtgagaacctgcccgaacagttccatagggcaatgaaatatgataaggacgaagtggatctcttgatcgtaattggaagctcgcttaaagtcaggcctgtcgctctgattccctcgtcgattcctcacgaggtcccccaaatcctcatcaatagagagccgcttccccacctgcactttgacgtggaacttctgggggattgcgacgtgatcatcaatgaattgtgtcatcgtctcggaggagagtacgcaaagctgtgttgtaacccagtgaagctcagcgaaatcaccgagaagccgccccgaacccagaaggaactggcatatctctcggaacttccccctaccccattgcacgtgtctgaggactcctcaagccccgagcgcactagcccccctgattcctccgtcattgtgactcttcttgatcaggccgccaaatcaaacgacgacctggacgtgtcagagtccaagggctgtatggaagagaagccccaagaagttcaaaccagcaggaatgtcgagtcgattgcagaacaaatggaaaacccagaccttaagaacgtgggaagcagcaccggcgaaaagaacgagcgtacttcagtggcaggaactgtgcgcaagtgttggccgaaccgtgtggcaaaagaacagatttcgcgcagactggacggtaatcagtacctctttctgccccctaatagatacatttttcatggagcggaggtctacagcgattcggaggacgatgtgctctcgagctcgtcgtgtggcagcaattccgattccggtacttgtcagagcccttcgcttgaagagccaatggaagatgagtccgaaattgaagaattctacaatggcctcgaagatgaaccagatgtgcctgaacgcgccggaggtgcaggttttgggacggatggggatgatcaggaagccataaatgaagcaatatccgtgaagcaggaggtgactgatatgaactacccgtctaacaaatct

SEQ ID NO: 19232 - DNA, 1356 bp, Artificial Sequence
  Description of Artificial Sequence: Synthetic coding sequence
atgtttgacatagagtattttaggaaggacccccggccgttttttaagtttgcaaaggaaatttacccaggccaatttcagccctccctttgccataagttcattgcgctgtccgataaggaagggaaattgctgcgcaattacactcaaaatatcgataccctggagcaggtagcgggcatccagaggatcatacagtgccatggctctttcgccactgcgagttgcctgatttgcaaatataaagttgattgtgaagcagtccggggtgatattttcaatcaggtggtgccccgatgcccccgatgtccagccgacgagccgctcgccatcatgaaaccagagatcgtcttcttcggagaaaatctgccagaacaattccatcgagccatgaagtacgataaagacgaagtggacttgctgatcgtgatcgggtcatccctgaaggtgcgccccgtagctttgattccctccagcatcccccacgaggtcccccagatcctgatcaaccgggagcccctgcctcatctgcattttgacgtggagctgctaggggattgtgacgtgatcattaatgaactctgccacaggcttggcggcgaatatgcgaaactgtgttgcaaccccgtaaaactttctgagataacggagaagccaccgcgtacgcagaaagaacttgcctacctctctgaactgcctcccactcccctgcatgttagtgaagattccagcagtcccgaaaggacaagtcctccggattcatcggtgattgtcactttgttggatcaggcagcaaaaagtaatgatgatcttgatgtttccgaatctaagggctgcatggaggaaaaaccccaggaagtgcaaacaagtcggaatgtggaaagtatagctgagcagatggagaatcctgatctgaagaacgtaggaagttcgactggagaaaaaaacgaaagaacgagtgtggccggaactgtcagaaaatgctggcccaatcgggtcgcaaaggagcagatttctaggcgcctggacgggaatcagtatctgtttctgccaccaaaccggtatatttttcacggagcagaagtgtactctgactccgaagacgacgtgctgagttctagcagttgcgggtctaactcagatagtgggacttgccagagtccctctctggaggagcccatggaagacgaatccgaaatcgaggaattctataatgggctcgaggacgagccggatgtgcccgaacgcgccggaggggccggcttcggaaccgatggggacgaccaagaagctatcaatgaggctatttctgtgaagcaagaagttactgacatgaactatcctagcaacaagagt

SEQ ID NO: 19233 - DNA, 1356 bp, Artificial Sequence
  Description of Artificial Sequence: Synthetic coding sequence
atgttcgatattgaatatttcagaaaagacccaagaccattttttaaattcgctaaagaaatttatcctggacaattccaaccatctttatgtcataaatttatagctttatcagataaagagggtaaacttttaagaaattatactcaaaatattgacactttggagcaagttgctggaatacaaagaataattcaatgtcatggatcattcgctactgcatcatgtttgatatgtaaatataaagtagattgtgaagcagtaagaggagatatttttaatcaagttgttccaagatgtccaagatgtccagcagatgagcctcttgcaattatgaagccagaaattgtattttttggtgaaaatcttccagaacaatttcatagagctatgaaatatgataaagatgaagttgatttacttatagttattggatcaagtcttaaagtaagaccagttgcacttatcccatcttcaattccacatgaagttccacaaatacttataaatagagaaccattaccacatcttcattttgatgttgaattattaggtgattgtgatgttattattaatgaattatgtcatagattaggaggagaatatgctaaactatgttgtaatccagttaaactttccgaaataactgagaagccaccaagaactcaaaaagaacttgcttatctttctgaattgccacctactccattacatgtatcagaagattcttcatctccagaacgtacttcaccaccagatagtagtgtaattgttacattacttgaccaagcagctaagtctaatgatgatttagatgtatcagaatcaaagggatgtatggaggaaaaacctcaagaagttcaaactagtagaaatgttgaatcaattgctgaacaaatggaaaatccagatttaaaaaatgttggatcttccacaggtgaaaaaaatgagaggacatctgttgctggtacagttagaaaatgttggccaaacagagttgctaaggaacaaatttctagacgtcttgatggaaatcaatatttattcttaccacctaacagatatattttccatggagcagaagtttatagtgatagtgaagatgatgttttaagttctagttcatgcgggtcaaactctgatagcgggacttgtcaatctcctagtttagaagaacctatggaagatgaatcagaaattgaagaattctacaatggattagaggatgaaccagatgttcctgaaagagcaggaggtgctggattcggaacagatggagatgatcaagaagcaattaacgaagcaatttcagttaaacaagaagttactgatatgaattatccatctaataaaagt

SEQ ID NO: 19234 - DNA, 1356 bp, Artificial Sequence
  Description of Artificial Sequence: Synthetic coding sequence
atgtttgatatcgagtacttcagaaaggaccctcgtcctttctttaagtttgctaaggagatatatcctgggcagttccagccaagcctatgccacaaatttattgcattgtcagataaggagggcaagctgttaaggaactatactcagaacattgacactcttgaacaggtagctggcattcagaggattattcagtgtcatggttctttcgccactgcgagctgccttatttgcaagtacaaagttgactgtgaagccgtgcgcggtgacattttcaaccaggtagttcccagatgccctcgttgtccagctgacgaacctctggccatcatgaagcctgaaattgtgttcttcggagaaaatctgcctgaacagtttcatagggccatgaaatacgataaagatgaggtcgaccttcttatcgttatcggatcatcacttaaggttagaccggtggccctcattcctagctccatcccccacgaagttcctcagattcttatcaaccgggagccgctaccccatttgcattttgacgttgagctcttaggtgactgtgatgtgatcattaacgagttgtgccataggctcggaggagaatacgcgaagctttgctgcaacccggtgaagttatctgaaatcactgaaaagcctccaaggactcagaaggaacttgcctacttgtctgaactcccacccacacctcttcatgtaagcgaggacagctcttctcccgagagaacgtctcctccagattctagtgttattgtaactctgctcgatcaggctgctaagtcaaatgatgatttggatgtgtcggaaagtaaaggatgcatggaggagaagccacaggaagtgcagacgtctcgaaatgttgaatcaatagctgaacagatggagaatcctgatcttaagaacgttggctccagtacaggtgagaaaaacgagagaacaagcgttgctggtaccgtaaggaagtgttggcctaacagagtcgctaaagagcaaataagcagaagactagacggtaatcagtatctgtttctccctcccaacagatacatttttcacggcgctgaagtgtactcagattccgaagacgatgtgcttagtagtagcagctgcggaagcaatagcgactcgggtacatgtcagtctccctccctggaggaaccgatggaggacgagtctgagatcgaggaattttataatggtctcgaagacgaacctgatgtgcccgaaagggcaggaggtgccggttttggaactgatggagatgaccaagaggcgataaatgaggcgataagcgttaagcaagaagtcaccgacatgaactatccatcaaataagtca

SEQ ID NO: 19235 - DNA, 1356 bp, Artificial Sequence
  Description of Artificial Sequence: Synthetic coding sequence
atgttcgacattgaatacttcaggaaggatccccgaccgttcttcaagttcgccaaagagatttaccccgggcaattccagccttctttatgccacaaatttatcgccctgtcagacaaagaaggcaagctacttagaaattatactcagaacattgacactctggaacaggtggcggggattcaacgaattatacaatgtcatggctcgtttgcgacggcctcctgtcttatctgcaagtacaaagtggactgcgaggccgtgcggggtgacatttttaatcaggttgtgcctagatgtccccggtgccccgcagacgagcctctcgcaataatgaagccagaaatcgtgttctttggcgaaaatcttcctgaacagtttcacagagccatgaagtacgacaaggacgaagtggatctccttatcgtgatcggcagtagcctgaaggttcggccggtggcactgattccaagcagcattccacacgaagtgccccagatcctgataaatcgggagcctctcccgcatctacactttgatgtcgagctgctcggcgactgcgatgtgatcatcaacgagctctgccaccggctggggggggaatatgcgaagctctgttgtaatcccgtcaaactgagcgagataactgagaagcccccccgaacccagaaggaacttgcatatctcagtgagctaccacctacaccgctgcacgtgtcagaggactcctcatcccccgaacgtaccagccctccagatagcagcgtgatcgtaaccctcctggatcaggcggccaagagcaatgacgacttggatgtgtcagagtcgaaagggtgtatggaggagaagccacaggaagtccagacttccagaaacgtcgagtcaatcgctgaacaaatggaaaatcccgatcttaaaaatgtcggcagctctactggcgagaagaatgagagaaccagtgtggccggcaccgtacggaagtgctggccgaacagagtggctaaggaacagattagtcgacgcctcgacggaaaccagtacttgttcctgccgcccaatcggtatatattccatggggctgaggtgtattccgactctgaggacgatgtgctgtcctcgtcatcttgcggctctaactctgactcggggacatgtcaatctccttcactcgaagaacctatggaagacgagtctgagatcgaggagttctataacggactggaggacgaaccggacgtgcccgaaagagctggcggcgccggcttcggcacagacggagacgatcaggaagccatcaatgaagccatcagcgtgaagcaggaggtgaccgacatgaattatccctcaaacaaaagt

SEQ ID NO: 19236 - DNA, 1356 bp, Artificial Sequence
  Description of Artificial Sequence: Synthetic coding sequence
atgttcgacatcgaatacttccgaaaggacccccgtccgttttttaagttcgcgaaggaaatatatcccgggcagttccagccctcgttgtgtcacaagtttatagctctgtccgacaaagaggggaagcttttgcgaaactatactcagaatattgataccctggagcaggtagcaggcatccagcgcattatccaatgccacggctcttttgccaccgccagttgccttatttgcaagtacaaagttgattgtgaggccgtgcggggggacatatttaaccaggtagtcccacggtgtccacggtgccctgccgatgagccccttgcaatcatgaagccagaaatcgtttttttcggcgagaatctgccggaacagttccatcgtgcaatgaagtacgacaaggacgaggtggacctgctgatcgtcattgggtcttcactcaaggtgcggccggtcgccctgatccccagtagtatcccgcacgaggtgccccagatactcatcaatcgggagccactgcctcaccttcatttcgacgtcgagttgttgggagactgcgacgttatcattaacgaactgtgccatcggcttggcggcgagtatgctaagttgtgttgtaaccctgtcaaacttagcgagataaccgagaagccaccccggactcagaaagaactggcctatctctcggagctgccgcccaccccactccatgtgtctgaagatagcagctctccggagcggacctccccacctgattcctctgtgatcgtaactctgctggaccaggctgcgaagtcaaatgatgatcttgacgtgtcggaaagtaaaggatgcatggaagagaaaccgcaggaagtccagacctcacggaacgtcgagtccattgccgaacagatggaaaaccccgatctcaagaatgtggggagctcaacgggagagaagaacgagagaacatccgtcgctggaaccgtgcggaagtgttggcctaatcgggtggccaaggaacagatatctaggaggcttgacggcaaccaatacctgttcctgccacccaatcgatatatcttccacggcgccgaggtgtatagcgatagcgaggacgatgtgctctcttccagctcctgcggcagcaattctgactctggtacatgccagagtccatctctggaggagcccatggaagacgagtcagaaatcgaggagttctacaacggtttggaggacgagcctgatgtgcctgaacgggccggcggcgcagggttcggaaccgacggggatgaccaggaagctatcaacgaggctatttccgtaaaacaagaggtgaccgatatgaactacccctccaacaagtcc

SEQ ID NO: 19237 - DNA, 1356 bp, Artificial Sequence
  Description of Artificial Sequence: Synthetic coding sequence
atgttcgacatcgaatacttcaggaaggatcccagacccttcttcaaatttgcaaaggagatctaccccggacagttccaacctagcctgtgccataagtttatcgcgctgtccgataaggagggcaagctgctccgcaattacactcaaaacattgataccttggagcaagtcgcagggatccagagaatcatccaatgtcatgggtcgttcgctactgcttcatgtctgatctgtaagtataaggtggattgcgaggccgtccggggcgacatcttcaaccaagtggtcccgagatgtccgcggtgtcctgccgacgaaccactcgctatcatgaagccggagatcgtgttctttggcgaaaacttgccggagcagttccaccgcgccatgaagtatgacaaagacgaggtcgatctgctcattgtcatcggatcctcccttaaggtccggccggtggccctgatcccgtcatcgattccacacgaggtgccacaaatcctgatcaatcgggaaccgctcccgcatctccattttgacgtggaactcctgggcgactgtgacgtgatcatcaacgaactttgccatcgcctggggggagagtacgctaagctgtgctgcaacccggtgaaattgagcgaaataactgagaagccaccgagaactcagaaagagctggcgtacctttccgaactcccgccgacccccctgcatgtttcggaagattccagctcccctgagcgcactagcccaccagattcctcagtgatcgttactctgctggatcaggcggcgaagtcaaacgacgacctcgatgtgtcagaatccaaggggtgtatggaggagaagccgcaagaagtccagaccagccggaacgtcgagtctatcgctgagcagatggaaaacccggacctgaaaaacgtgggttcaagcactggagagaaaaacgagcgcacgagcgtggctggcaccgtcagaaagtgctggccaaatcgggtggcgaaagaacagatctccagaaggttggacggaaatcagtatctctttctgccgcctaacagatacatctttcacggtgccgaagtctactcggactctgaagatgacgtgctgtcatcatcatcctgcggttcaaactctgattccgggacttgccagtcaccctccctggaagaacctatggaggacgagtcagaaatcgaagagttctacaatggactcgaggacgagccggacgtgcctgagcgggccggaggagccggatttggcacggatggtgacgatcaggaggcgatcaacgaagcgatctcagtgaagcaagaggtcaccgacatgaattacccatcgaataagtcc

SEQ ID NO: 19238 - DNA, 1356 bp, Artificial Sequence
  Description of Artificial Sequence: Synthetic coding sequence
atgtttgacatcgaatactttcgcaaagaccctaggccctttttcaagtttgccaaggaaatctaccctggacagttccaaccatcgttgtgtcataagttcatcgctctttcagacaaggaagggaaactgcttcggaattacacgcagaacatcgacacgctggagcaggtcgccggaatccagcggattatccaatgccatgggagctttgcaaccgcatcctgtctgatatgtaagtacaaggtggattgtgaagccgtccggggagacattttcaaccaggtcgtgcctcggtgtcctagatgccctgcagacgaacctcttgcaattatgaaaccagagatcgttttctttggagagaacctgcctgaacagttccatcgggcaatgaagtacgataaggacgaggtggatctgctgattgtgatcggctcctcgcttaaggttcgcccagtggccctgatcccctccagcatcccacacgaagtcccccaaattctcattaacagggaaccacttccacatttgcattttgatgtcgagctcctgggagattgtgatgtcattatcaatgaactttgccacagattgggtggggagtacgcaaaactctgctgtaaccctgtgaagctgagcgaaattactgagaagcccccgagaacccagaaggagctcgcctacctttctgagcttccgcccacgcctctgcatgtgagcgaagattcctcctcccctgagcgaacctcacctccggactcatccgtgattgtgactcttcttgatcaggcagcaaagtccaacgatgaccttgatgtctccgagtcaaagggatgtatggaagaaaagcctcaagaagtgcaaacctctcgcaatgtcgaatccattgcagagcaaatggaaaacccggatcttaagaatgtaggaagctcgactggtgagaagaacgaacggacttccgtggcaggaaccgtgagaaagtgttggccgaacagggtggcgaaggagcaaatcagcaggaggctggatggaaaccaatacctgtttctcccgccgaatcgatacatctttcatggcgccgaggtgtattcggacagcgaggatgatgtcctttcctcgtcatcgtgtgggtctaattcggactcgggaacttgtcagtcccctagcctcgaggagcctatggaggatgaatcagaaatcgaagagttttacaacggactggaagatgaaccagatgtgcctgaacgtgctgggggagcaggctttggaaccgacggagacgatcaagaagcgattaacgaggcaatttcggtgaaacaggaagtcaccgatatgaactacccttccaacaaaagc

SEQ ID NO: 19239 - DNA, 1356 bp, Artificial Sequence
  Description of Artificial Sequence: Synthetic coding sequence
atgttcgatattgagtactttcgcaaggacccccggccttttttcaaatttgccaaggagatttaccctggtcagtttcaaccttcgctgtgccacaagtttatcgctttgtcagataaggagggaaagctcctccgtaactatacgcagaatatcgatacgctggaacaggtggccggaatacaaagaatcatccagtgtcacggatcgtttgcaactgcatcctgtttgatttgcaaatacaaggtggactgtgaggcagtccgcggagatatctttaaccaagtggtccctcgctgcccgcgctgcccagcagatgaacctcttgccatcatgaagcctgaaattgtgttttttggagaaaatcttccagagcagttccatcgggccatgaagtacgataaggatgaagtggatctgttgattgtgattggatcctcgttgaaagtcaggcccgtggccctgattccatcgtcgattccacatgaagtccctcaaatactgattaacagagaaccgctgcctcaccttcactttgacgtcgaactgttgggagactgcgatgtgattatcaacgagctctgtcatcggctcggaggagaatacgcaaagttgtgttgtaaccccgtgaaactcagcgagattactgaaaaaccaccaagaacccaaaaggaacttgcatacctgtccgagctgccgcccacccctctccatgtgtcggaagatagctcctccccggaacgaactagcccccctgattccagcgtgatcgtgactcttcttgatcaagctgcaaagtcaaacgacgacctggatgtgagcgaatcaaaaggatgcatggaggaaaagcctcaagaggtgcaaaccagcagaaacgtggagtcgattgcagagcaaatggaaaaccctgatctgaaaaatgtgggttcatcaaccggcgaaaagaacgaacggacttccgtggctggtactgtccgaaagtgttggcctaaccgtgtcgccaaggagcagatttcgcggagactggatggcaaccagtacctgttccttccaccaaaccgctacattttccacggagccgaagtgtactcggattccgaagatgatgtgctgtcgtcctcttcgtgcgggagcaattcggactcggggacttgccagtccccaagcctcgaggaacctatggaggatgaatccgaaatcgaggagttttacaacggtcttgaggatgagcctgatgtgcccgagagagcgggtggtgcgggtttcggaaccgatggcgacgaccaagaagcaattaacgaagcaatatctgtgaaacaagaggtgacggacatgaactacccatccaacaagtca

SEQ ID NO: 19240 - DNA, 1356 bp, Artificial Sequence
  Description of Artificial Sequence: Synthetic coding sequence
atgttcgatatcgagtattttcggaaggatcccaggccattctttaagttcgccaaggaaatctaccctggtcagtttcaaccatcgctgtgccataagtttattgcactgagcgataaggaagggaagttgctgaggaactatacgcagaatattgatactttggagcaggtagccggcatccagcgcataattcagtgccacggctccttcgctaccgcatcttgtctcatatgcaaatataaagtggactgcgaggccgtaaggggcgacatttttaaccaggttgtgccccgatgcccccgatgtccggctgacgagcctctggcaatcatgaagcccgaaatcgtgtttttcggagaaaatttgcctgagcagtttcatcgcgcgatgaagtatgataaagatgaggtcgatcttctgatagtcattgggtcttcccttaaagtacgccctgtggcgctgatcccgtcttcaatcccccacgaagtgccacagatcctgattaatagagagccattgccacatcttcatttcgacgttgagctgctgggggattgcgacgtaatcattaacgagctctgtcaccggttaggaggagaatatgcaaaactctgttgcaatccagttaagctgagcgaaataacagagaaacctccaaggacacagaaggagttagcttatctatctgaactgcccccaaccccgttgcatgtgtctgaagacagctcatctccagaacgtacctcaccgcccgacagctccgtgatcgtcactcttctggatcaagctgccaagtccaacgacgacctggacgtctctgaaagtaagggctgcatggaggagaaaccacaggaggtccagactagccggaatgtcgagtcgattgccgagcaaatggagaatcctgacctgaaaaatgtgggaagcagtacaggggagaaaaacgaaagaacttctgtggctggcacagttcgcaaatgctggcctaatagggtggccaaagaacaaattagtcgaagattggatggtaatcagtacctcttcctgccgcccaaccggtatatcttccatggcgcagaggtgtattcagattcagaggacgatgttctcagctcatctagttgcggctcaaacagtgactccggcacatgtcagtccccctctcttgaagagcctatggaagacgagtctgaaatcgaagagttctacaacgggcttgaagacgaaccagatgtacccgagcgggctgggggcgcaggtttcggtacagacggggatgatcaagaggccattaatgaagccatttccgtcaagcaggaggttacagatatgaattatcctagtaacaagagc

SEQ ID NO: 19241 - DNA, 1356 bp, Artificial Sequence
  Description of Artificial Sequence: Synthetic coding sequence
atgttcgatattgaatacttcagaaaggatccgcgtcccttctttaagttcgcaaaggaaatatacccagggcagttccaacccagcctgtgtcacaaatttatcgcgttgagcgataaggaaggaaagttgctgaggaattacacccagaacatcgatacactagagcaggtcgctgggatccagcggattattcagtgccatggcagcttcgcaactgcgtcttgtctcatctgcaagtacaaagttgactgcgaggccgtccggggggatatttttaaccaggtagttccgcgatgtcccaggtgccctgcagacgagccactggccatcatgaagcctgagatcgtattctttggcgagaatctgcctgagcaatttcatagagctatgaaatatgacaaagacgaagtagacctgctgatcgtgatcgggtcttccctgaaggtgcgcccggtggcattgattcctagctcgatcccccatgaggtgccacagatcctgattaacagggaacctctcccccacttgcattttgatgtagagttgctgggcgattgtgatgtcattattaatgagctctgtcacagactgggcggcgaatatgcgaagctgtgttgcaaccccgttaagctgtccgagataacagagaaaccaccgcgaactcagaaagaattggcctacctgtctgagctgccacccacaccattgcacgtcagcgaggacagcagcagtcccgaacgcacatctcctccagatagttcagttatcgtcacgctgctcgaccaggctgcaaaaagcaacgatgacctcgatgtcagtgaaagcaagggatgtatggaggagaaaccacaggaagtacaaacatcgcgaaatgttgagagcatcgctgaacaaatggagaacccagatctgaaaaacgtgggttcatcaacaggcgaaaaaaatgagagaacttcggtggcgggcacagtgcggaagtgttggcccaatcgcgtggcgaaagaacaaatcagccgccggttggacggaaaccagtacttatttctcccgcccaacaggtatattttccatggggccgaagtctactctgactctgaggatgacgtcttgagttcttcctcctgtggttctaattcggactctgggacatgtcagagcccgtctcttgaagagccaatggaagatgagtctgagatcgaagaattctataatggactggaggatgagccagatgttccagagcgcgctggcggcgcgggattcggcacggacggcgatgatcaggaggcgattaacgaggcaatttctgttaaacaggaggttacagacatgaactacccctctaataagagc

SEQ ID NO: 19242 - DNA, 1356 bp, Artificial Sequence
  Description of Artificial Sequence: Synthetic coding sequence
atgtttgatattgaatacttcaggaaggacccaaggcctttctttaagtttgctaaagaaatctatcctgggcaatttcagccatccctgtgtcataaattcattgcacttagtgataaagaaggcaaactgctcaggaactacacacagaacatcgatacccttgagcaggtggccggtatacaaagaatcattcaatgccatggtagctttgctactgccagttgcctgatctgcaagtataaggtcgattgcgaagctgtgcgtggagacatcttcaaccaggtggttcccaggtgtcctaggtgtcctgctgatgaaccactggccataatgaaaccagaaattgtgttcttcggcgaaaacctgccagagcagtttcaccgagcaatgaagtatgataaggatgaggtggacctgctcattgttatcgggagttcattaaaagtgcgacccgtagcactcatccccagctcgatcccccatgaagtgccccaaatattgattaacagggagcctctcccacacttgcattttgacgttgaattgcttggcgattgcgatgtgataattaacgagttgtgccaccggctggggggcgagtatgccaaactttgctgcaacccagtaaaactcagcgaaatcacagaaaagcctcccaggactcagaaagagctggcttacctgagcgagctcccaccaactccactccacgttagcgaagacagttcaagtcctgaaaggacgagtccccccgattcttctgtgattgttactctgctagatcaggctgccaagagcaatgacgatcttgatgtgtccgagtccaaaggatgtatggaggagaaaccacaagaggtgcagacttctcgcaatgtcgagtctatcgcagagcagatggaaaaccctgatcttaagaatgtcgggtcttccaccggggaaaaaaatgagaggacgagcgttgcgggaaccgtacgcaaatgctggccgaacagagtcgccaaagaacaaatttctaggagactggatggcaaccagtatcttttccttccgcctaacaggtatatcttccacggagcagaggtgtattccgactcggaggacgacgtcctgagctctagctcttgtggaagcaacagcgacagcggaacatgtcaatccccatcccttgaagagcccatggaagatgagagtgagatcgaggagttttataatgggcttgaagatgaaccagatgtacctgagcgcgccggaggggcaggattcggaaccgacggtgacgatcaagaggcaatcaacgaagctattagtgtgaaacaggaagtgaccgatatgaactatccaagtaacaaaagc

SEQ ID NO: 19243 - DNA, 1356 bp, Artificial Sequence
  Description of Artificial Sequence: Synthetic coding sequence
atgttcgacatcgagtactttcgaaaggatcctcgccctttttttaaattcgcaaaagagatttatccaggccagttccagccaagcctgtgccacaaatttattgctctgtccgacaaggagggcaagctgctgcgcaattacacgcagaatattgatacgttggaacaggtggctggtatccaacgcattatacagtgtcacggatcctttgctaccgcgtcctgtttgatctgtaagtacaaggttgattgcgaagccgtccgcggagacatcttcaatcaggtcgttccgcgctgtccacgctgccctgcggatgagccgttagcaatcatgaagccagaaatcgtgttcttcggagaaaatctgccagagcagtttcaccgcgcgatgaagtacgacaaggatgaggtggatttgctgatcgtgattggtagctcattaaaggttcgcccagttgcactgatccctagcagcattcctcacgaagtgccgcaaatcctgataaaccgcgagccgctgccgcatctgcactttgatgttgaacttttgggcgactgcgatgtcattattaacgagctgtgtcatcgtctgggtggagaatacgctaagttatgttgtaatcccgtaaaactgagtgaaatcaccgaaaagcccccgcgcacccagaaggaactggcctacctgagcgagctgccacctacccctctgcacgtgagcgaggattcctcatcaccggagcgcacttcaccgcctgattcttccgtgatcgtcacactgttggatcaggccgccaaatcaaacgacgacctggatgtcagcgaatctaagggttgtatggaggaaaagccacaggaagttcaaacctctcgcaatgtcgagagcattgcggagcagatggagaacccggacctaaagaacgtcgggtctagcaccggtgagaagaacgagcgcacgtccgtcgctggaaccgtgcgcaagtgctggccaaaccgggttgcaaaagagcagatctctcgccgcctcgatgggaatcaatatctcttcctgccgccgaaccgttacatttttcacggtgcggaggtgtacagcgatagcgaggacgacgtgcttagctcttcgagttgtggttccaacagcgactcaggcacgtgtcagagccctagcctggaggagccaatggaggacgagagcgagatcgaggaattctacaacggtttggaggatgagccggacgttccagaacgcgcgggtggtgctggctttggtaccgacggggacgatcaggaggccattaacgaagctatcagcgtaaagcaagaggtgaccgatatgaattacccgagcaataaaagc

SEQ ID NO: 19244 - DNA, 1356 bp, Artificial Sequence
  Description of Artificial Sequence: Synthetic coding sequence
atgtttgatatcgagtactttcgcaaggaccctcgcccgttctttaagttcgcaaaagagatttaccctggccagttccagccctcgctctgtcataagtttatagctctgtcggataaggaagggaagctgctgaggaattacacccagaatatcgatacccttgagcaagtggcgggaatacaacggatcatccagtgccatggcagcttcgcaaccgcatcatgcctgatctgtaagtacaaggtcgattgcgaagcagtcagaggagacatattcaatcaagtggtcccaagatgtccgaggtgcccggcagatgaacccctcgcaattatgaaacctgaaattgtcttttttggagagaatcttccagaacagttccacagggccatgaagtacgataaagatgaggtggatttgctgattgtgattggctcatccctgaaggtcaggccagtcgccctcatcccgtcgtcaattcctcatgaagtgccccagattctgatcaatagagagcctctgcctcatttgcatttcgatgtggaactgctgggagattgtgatgtgattatcaacgaactgtgtcacaggctcggaggtgagtacgcgaagctgtgttgtaaccctgtgaaactttcggagataactgaaaagcctccccgcactcaaaaggaacttgcataccttagcgaactgccaccgactccacttcatgtctcagaggactcatcttcgcctgaaaggacctctcccccagattcctcggtgattgtcactctgcttgaccaggcagctaagtccaacgatgatttggatgtctccgaatccaaggggtgtatggaagagaagccacaagaggtgcaaacctcgcgcaacgtggaaagcattgcagaacaaatggaaaacccggatctcaagaatgtgggaagctcgacgggtgagaagaacgaaagaacctcagtggccggtaccgtgagaaagtgttggccaaacagggtggcaaaagaacaaatttcgcggagacttgatggtaaccaatacctcttcctgcctcctaaccggtacatctttcatggtgccgaagtttattctgattcagaggacgacgtgctgagctcgtcgtcatgtggatccaattcagacagcggaacttgtcaaagcccttccctggaagaacccatggaggacgagagcgaaattgaggagttctacaacgggctcgaagatgaaccagatgtccctgagagagcaggtggagctggattcggtaccgacggggacgaccaggaagcaattaacgaagcaatatccgtgaaacaagaagtgacggacatgaactacccatccaacaagtcg

SEQ ID NO: 19245 - DNA, 1356 bp, Artificial Sequence
  Description of Artificial Sequence: Synthetic coding sequence
atgtttgatatagaatatttccggaaggatccccgtccattctttaaatttgctaaagaaatctaccccggccaatttcagcctagcctttgccacaaattcatagccttgtccgacaaagaaggcaaactgctacgcaactacacccagaatattgacacattggagcaagtcgcaggcatccagcgcatcattcagtgtcacggatctttcgccaccgcgtcctgtctgatctgcaaatataaggtcgactgcgaggcagtccggggggatatattcaatcaggtcgtgcctcgatgcccaaggtgccccgctgacgagcccttggctattatgaagccagaaattgtctttttcggtgaaaatctgccagagcagttccatcgggctatgaaatatgacaaggacgaagttgacctgctgattgtgatcggatcctctctaaaagtccgtcctgtggcgttgataccctcctctattccccacgaggtgccacagatcttaataaatagagagcccttgccacatctccatttcgacgtggaactccttggtgattgtgacgtaattatcaatgaactttgtcaccggctgggtggggagtacgccaaattgtgctgcaatccggtgaaattgtccgagatcactgagaaacctcctagaacacagaaagaactggcgtatttgagcgaactgcctcccaccccgctgcatgtgagtgaggatagctcttcccctgagcgtacctctccccctgactcttctgtgattgtcactctcttggaccaggctgctaagagtaatgacgatctggacgtctcagagtccaaggggtgtatggaggagaagccacaggaagtgcagacttcaaggaatgtggagtctatcgcggagcagatggagaatcctgatttgaagaatgttggcagttccaccggagaaaagaacgagagaactagcgtggcaggtacagtccgtaaatgctggccgaatcgggttgccaaggagcaaataagtcggagactggatggaaatcagtatttgtttctccccccaaacagatatatttttcatggagcggaggtctacagtgattccgaggatgatgtactcagtagttccagctgcggatccaacagtgatagcggcacgtgccaatcccccagtctggaagagcctatggaggatgaatcggagatcgaagaattctacaatggactcgaggacgaacccgatgtgcccgaaagggccggcggagccggtttcggcacagatggggatgaccaggaggctatcaacgaagctatctctgtcaagcaggaggtcactgacatgaactatcctagtaataagagt

SEQ ID NO: 19246 - DNA, 1356 bp, Artificial Sequence
  Description of Artificial Sequence: Synthetic coding sequence
atgtttgatattgaatacttccgaaaagatcccagaccctttttcaaattcgccaaggaaatctatcccgggcagtttcagccaagtctctgtcataaattcattgccctatccgataaagaaggaaagctcctgaggaattacacacagaacatagatactctagaacaggtggcgggaatccagagaatcatccagtgccatggatctttcgccacagcttcttgtctgatttgcaaatataaagttgattgcgaagcagtgaggggggatatttttaatcaggtggtgccaagatgccccaggtgccccgctgacgaacctctggctataatgaaacctgagatcgtcttcttcggggaaaatctcccagaacagttccacagagctatgaagtatgataaagatgaagtagacctcctaatcgttatcgggtccagtctgaaagtacgccccgtggctcttatcccaagttcgatccctcatgaagtacctcagattctcatcaacagggaaccacttccacatctgcatttcgacgtcgaactacttggggattgcgacgtcataattaacgaactgtgccataggcttggaggggaatatgccaaactatgttgtaaccccgtgaaactctcagagatcactgaaaaaccccctagaacacagaaagaactagcttatctgtctgagcttccccccacacccctacacgtgtctgaagactcaagttcccctgaacggacatctccaccagattcctctgtgattgtgactctactagatcaggccgccaagtccaatgatgatctcgatgtgagtgaatccaaaggatgtatggaagaaaaacctcaggaagtgcagacatctcgcaacgtggagagtatagcagaacagatggaaaaccctgatcttaaaaacgtagggtcctccacaggggagaaaaatgaaaggacttccgttgcaggaactgtcaggaaatgctggcccaatcgggtagcaaaagagcagatcagtaggaggctcgatggaaaccaatatctcttcctccctcctaatcggtatatcttccacggagctgaagtctacagtgattcagaagatgacgtgctctcatcttcttcatgcgggagtaacagtgactccgggacatgtcagtccccttctctggaagaacctatggaagatgaatctgaaatagaagaattctataatggactggaagacgagccagatgtccctgaacgcgcagggggagccggattcggaacagatggggatgatcaggaagccataaacgaagcaataagtgtaaaacaggaagtcactgatatgaactatccttcgaataaatca

SEQ ID NO: 19247 - DNA, 1356 bp, Artificial Sequence
  Description of Artificial Sequence: Synthetic coding sequence
atgttcgatatcgagtacttcagaaaggatccaagacccttcttcaagtttgctaaagagatttacccaggccaattccagcctagtctttgccacaaatttatagctttaagcgataaggagggcaagcttttgcggaattacacccagaatattgacacattggagcaggtagccggaatccagcggataatccaatgccatgggtccttcgccacagctagttgtctgatctgtaaatacaaagtggattgcgaagcggtgcggggtgacatctttaatcaggtcgtgcctcgatgtcccaggtgtccggccgacgaacccttggctatcatgaaacccgaaatcgtgttctttggcgagaacttaccagaacagttccacagagccatgaaatatgataaggacgaggtggacctgctgatagtcattggatcttctctaaaggtacgacctgtggctctcattcctagttctatcccccacgaggtgcctcaaattctcataaatagggagcctctgcctcacctgcactttgacgtggagttactaggtgattgtgacgtcatcattaacgaactgtgccataggttgggcggcgagtacgcgaagctgtgctgtaaccccgttaagctgtctgagattacggagaagcctcctagaacgcagaaggagctcgcctacctctctgagctccctcctacacccctacatgtgtctgaggattctagcagccccgagcggacgtctcctcccgattcgtctgtgatcgtaactctgttggaccaggctgctaagtccaatgacgatctggacgtcagcgagtccaagggctgcatggaagagaaaccccaggaggtgcaaacctctagaaacgtggaatcgatcgctgaacagatggaaaatccagatttgaaaaatgtgggcagtagcactggagagaagaacgaaagaacttccgtggccggcacagtacgaaaatgctggccgaatcgcgtcgcaaaagagcagatatctcgccgccttgacggaaaccagtacctcttcctgccaccaaatcggtacatcttccacggcgctgaagtgtactccgattccgaggatgatgttctttcctcatcttcatgcggatcaaactccgattctggtacctgccagagcccgtctctggaggaacctatggaggacgaatccgagatcgaagagttttataacggtcttgaggacgaacctgatgtacctgaacgcgcggggggcgcaggcttcggaaccgacggagatgatcaagaggctattaatgaagccatttcagttaagcaggaggtgaccgatatgaattatcctagtaataaatct

SEQ ID NO: 19248 - DNA, 1356 bp, Artificial Sequence
  Description of Artificial Sequence: Synthetic coding sequence
atgttcgatatagaatactttaggaaagaccccagaccttttttcaaatttgccaaagagatctaccccggacaatttcaaccttccctgtgtcacaaattcattgctctgagcgacaaggaaggaaagctgcttaggaactacacccagaatattgataccctggaacaagtcgcaggaatccagcgaatcatccaatgtcatggatcatttgcaaccgcctcgtgtttgatttgtaaatacaaggtggactgcgaagcagtgcggggtgatatctttaatcaagtggttccgcggtgtcctaggtgccctgccgatgagccactggcgattatgaagccagaaattgtgttttttggcgaaaacctccccgagcagtttcacagggccatgaagtacgataaggatgaagttgatctccttattgtgatcggatcgtcactgaaggtgcgacccgtcgctctgataccttcctccattccacacgaagtgccccagattctcataaacagagaacctctgccacatttgcatttcgacgtggaactgttgggcgattgtgatgtgatcattaacgaactttgtcatcggcttggtggagaatacgccaaattgtgctgcaaccctgtgaagctgtcagaaatcaccgaaaagcctcctagaactcagaaagagctcgcgtacctctcggaacttcctcctactcctcttcatgtctcagaggactcgtcaagcccggaaaggaccagccctcctgattcgtccgtgatcgtgaccctgctggaccaggccgcaaagtccaatgacgatctggacgtgagtgagtccaagggatgcatggaagaaaaaccgcaagaagtgcagacttcgaggaacgtggaatcgattgcagaacaaatggaaaatcctgatctgaaaaatgtcggctcgtctaccggtgagaagaatgaacgcacttccgtggccgggaccgtccgcaagtgttggcctaatagagtggctaaggaacagatttcacgccggcttgatggtaatcagtacttgtttcttcctcctaaccggtacatattccatggagcagaagtgtacagcgatagcgaagatgatgtgctgtcctcaagctcctgtggttcaaattcagattcgggtacctgtcaatccccttcactggaagaaccaatggaagatgagtccgaaatagaggagttttacaacggcctggaggacgaacctgatgtgccagaacgagcaggcggagcaggttttggaactgatggagacgatcaagaagcaattaacgaagcaatcagcgtgaaacaagaggtgactgatatgaattatccttctaacaagtcc

SEQ ID NO: 19249 - DNA, 1356 bp, Artificial Sequence
  Description of Artificial Sequence: Synthetic coding sequence
atgttcgacattgagtacttccggaaagatccaaggccgttcttcaagtttgccaaagaaatctaccccggacagttccaaccgtcgctgtgccacaaattcatcgccctgtcggacaaggaaggcaagctcctgaggaactatactcagaatatcgacaccctcgagcaggtggcaggaatccagcgcattatccaatgccacggaagttttgctactgccagctgcctcatttgcaagtacaaggtggattgcgaagcggtccgcggagatatcttcaatcaagtggtgccgcgctgcccaagatgtccggccgacgaacccctggccatcatgaagccggagattgtgtttttcggggaaaaccttcctgagcaattccatagagccatgaagtacgacaaagacgaggtcgatctcctcatcgtcatcggttcctccctcaaggtgcgccccgtggccctgatccctagcagcatcccacacgaagtcccgcagatcctgatcaatcgggagccactgcctcacctgcacttcgacgtggaacttctcggcgactgcgacgtgataatcaacgagctgtgccaccggttgggaggggaatacgcgaaactttgttgtaacccggtcaaactgtcggaaatcaccgaaaagccgccacgcactcagaaggaattggcctacctcagcgaattgccaccgactcctcttcacgtgtccgaggactcgtcgtcgccggaacgcaccagcccaccagattcatcagtgatcgtgactctgctggaccaggcagccaagtccaatgacgatttggacgtgtcggagagcaaaggttgtatggaggagaagccgcaggaggtgcagacctcccgcaacgtcgagagcatcgcggaacaaatggaaaacccggacttgaagaatgtgggaagctcgactggcgaaaagaatgagcgcacctcggtcgcgggaactgtgcgcaagtgctggccaaaccgcgtggccaaggagcagatctcgaggcgcctggatggcaaccagtacctcttcctgcccccgaaccgctacatcttccatggagcagaagtgtactcagacagcgaggacgatgtgctgtcatcttcatcctgcggttccaattcggacagcggtacctgccagtccccttcgctggaggaacctatggaagatgagtctgagatcgaagagttctacaacgggctggaggacgaaccagatgtgccagagcgggcgggcggcgctggattcggcactgacggcgatgatcaggaggcgatcaatgaggctatctcggtgaaacaagaagtgactgacatgaactacccttcgaacaagagc

SEQ ID NO: 19250 - DNA, 1356 bp, Artificial Sequence
  Description of Artificial Sequence: Synthetic coding sequence
atgttcgacatcgaatactttcgcaaagatccgcggcctttctttaagttcgccaaggaaatctacccaggccaattccagccgagcctgtgccataagttcattgcgctgagtgataaagaaggaaagctgttgaggaattacactcagaacattgacacgctcgagcaggtggcagggatccaaagaatcatccagtgtcatggctcattcgccaccgcgtcatgcctcatctgcaaatacaaagtggactgtgaagccgtccggggagatatcttcaatcaggtggtcccacgctgcccgcggtgcccagcggacgagccactggctatcatgaagccggaaatcgtgttcttcggagagaatctcccagagcagttccacagagccatgaaatacgacaaggatgaggtcgatctgctcattgtcattggatcctccctgaaggtgcgcccggttgcgctcatccccagctcaatcccacacgaggtgccgcagatcctcatcaacagagaaccgttgccacatcttcacttcgatgtcgagctgcttggcgattgtgacgtgatcatcaacgagctgtgccaccggctcggaggagagtacgcaaagctgtgctgtaacccagtgaaactgtcagaaatcaccgagaaaccaccgcgcacccagaaagaactggcgtacctgtctgaactgccgcctactccactccatgtttcggaggactcgtcgagccctgagagaacttcacccccggactcctccgtcatcgtgaccttgctcgatcaagctgccaagtcgaatgacgacctggatgtgagcgagtcgaagggatgcatggaagagaagcctcaggaagtccagacttcgcgcaatgtcgagtcgatcgctgaacaaatggagaacccagatctcaagaacgtggggtccagcactggagaaaagaatgagagaacctcggtggcgggaaccgtgcggaagtgttggccgaatcgggtcgcaaaggaacaaatctcacgtcgcctggatggaaaccaatacctgtttctgccgcctaaccgatacattttccacggagcggaagtgtactcggattccgaggacgatgtgctctcctccagcagctgcggaagcaactccgattcgggaacctgccagtcaccgtccctggaggaaccaatggaagatgaatcggagatcgaagagttttacaatggactggaggatgaaccagatgtcccggagcgagctggaggagctggattcggaactgacggcgacgaccaagaagcaatcaacgaagccatttccgtcaaacaggaagtgaccgacatgaactacccatcaaacaaatcc

SEQ ID NO: 19251 - DNA, 1356 bp, Artificial Sequence
  Description of Artificial Sequence: Synthetic coding sequence
atgtttgacattgaatacttccgtaaggacccccgccctttctttaaatttgccaaagagatataccctgggcaattccaaccatccctctgccataagtttatcgcgctcagcgataaagagggtaagcttctccgaaactacacccagaacatcgacacgcttgagcaggtggccgggattcaacgaattattcagtgccatggttcatttgctacagcctcatgtttaatttgcaagtataaggtcgattgcgaagcagtgcgtggggatatcttcaatcaggtggtaccccgctgcccaagatgtcccgccgacgaaccactcgccatcatgaaacccgaaatcgtgttttttggtgagaacctgcccgaacagttccatcgcgcaatgaagtacgacaaggacgaggtggatctgctgatcgtgattggatcatccctaaaggtgaggccggtagccctcataccatcctctatcccccacgaggtgccgcagattctgataaatcgcgagccgctgccccatctccactttgacgtggaattgttgggagattgtgatgtgattatcaatgagctgtgccacaggctggggggagagtacgctaagctgtgttgcaatcccgtcaaacttagcgagatcacagaaaagcctcctcgtacccagaaagagctggcgtatctcagcgaactgcctcccacacctctgcatgtatctgaggactctagcagtcccgaacgtacctcgcctccagattctagcgttatcgttaccttactcgaccaagccgccaaatccaatgatgatcttgacgtgagcgagtcaaaaggctgcatggaggagaagccacaggaagtgcaaacttcaaggaatgtggagtctatcgctgagcagatggaaaatcccgatctgaaaaacgttggaagtagcacaggagagaaaaatgaacgaactagcgttgccgggacggtgcggaagtgctggcccaatcgggtggcgaaggagcagatctcgcggcggctcgatgggaatcaataccttttcctaccaccaaaccggtacatctttcacggggcggaagtctatagcgattctgaggatgatgtgctgagttcgtcgagttgtgggtcaaattcagactccgggacctgtcagagcccctccttggaagaaccaatggaagacgagtccgaaattgaggagttttataacggcctcgaggatgaacctgacgttcctgagagggcgggtggcgcagggttcggtaccgacggagatgaccaggaggcgattaacgaggcaatcagtgtaaagcaagaggtgactgatatgaactatccttccaacaagagc

SEQ ID NO: 19252 - DNA, 1356 bp, Artificial Sequence
  Description of Artificial Sequence: Synthetic coding sequence
atgtttgacatcgaatactttagaaaggaccctcgcccatttttcaagtttgcaaaagagatctaccccggacagtttcaacccagcctttgccataagtttattgcactgtcggataaggagggcaaactcctccggaattacactcagaacatagacaccctcgaacaagtggccggaatacaaagaattatccaatgccatggttcatttgcaaccgcaagctgcctgatctgtaaatacaaggtggactgtgaagctgtcagaggcgacattttcaatcaggtggtcccgcgctgtcctaggtgccctgccgacgaacctcttgccatcatgaagcccgaaattgttttctttggagagaacctgcctgaacaatttcatagagcaatgaagtacgataaagacgaggtggaccttctgatcgtgattggttcctcattgaaagtccgaccagtggccctgattccttcgtcaattccacatgaggtgccccaaattctcattaacagagagccacttccacatcttcactttgacgtcgagctgttgggagactgcgacgtgattatcaatgagctctgtcacagacttggtggcgagtacgcaaagctgtgttgtaaccccgtgaagctctcggaaatcaccgaaaagccgccacggactcagaaagaacttgcctacctttccgaactcccacctactccccttcatgtgtcagaggattcctcaagccctgagagaacctccccaccagatagctccgtgatagtgactctgctcgatcaggcagcaaagtccaatgatgacctggacgtgagcgaaagcaagggatgcatggaggaaaagcctcaggaagtgcagactagcagaaacgtggaatccattgcagagcagatggaaaatccagatcttaagaacgtgggttcatccactggagaaaagaatgagagaaccagcgtggccggaactgtgcgaaagtgttggcctaatcgcgtggcaaaggaacagatctcgaggagactggatgggaaccaataccttttccttcctcctaaccggtacattttccacggagcagaagtgtactcggattccgaggatgatgtgctgtccagctcttcatgtgggtctaatagcgatagcggtacctgtcaatctccttcgctcgaagagcccatggaagatgaatcggagatcgaagagttctacaacggtctggaggacgaacctgatgtgccagagagagccggaggggcaggatttggcactgatggggatgaccaagaggcgattaatgaagcaattagcgtcaagcaagaggtcaccgatatgaattacccctcgaacaaaagc

SEQ ID NO: 19253 - DNA, 1356 bp, Artificial Sequence
  Description of Artificial Sequence: Synthetic coding sequence
atgttcgatatcgagtactttcgaaaggaccctcgcccctttttcaaattcgcaaaggaaatctacccgggacagtttcagccgagcctctgccacaaattcatcgccctgtccgacaaggagggcaagttgctccgtaactacacccaaaacatcgacacgctggaacaagtcgcgggaattcaacggatcatccagtgccatggctcattcgccacggcctcatgcctcatttgtaagtacaaggtggactgcgaagcagtgaggggcgatatctttaatcaagtagtgcctcgctgcccacgctgtccggctgatgagccgctggccattatgaaaccggaaatcgtgttctttggggaaaacctgccagagcaattccaccgcgcgatgaagtatgacaaggacgaagtcgaccttctgatcgtgatcggcagttcattgaaggtgcgcccagtggcgcttatcccctcatcgatcccgcatgaagtgccacagatccttatcaaccgggagccgctcccccatctccactttgatgtggaactgctcggcgattgcgatgtgatcatcaatgaactctgccaccgcctgggtggtgaatacgcgaagctgtgttgcaacccagtgaagctgtcagagatcactgaaaagccgccacggactcagaaggaactcgcctacctgtcagaactgccgccgacccctttgcatgtgtcggaggattcgtcgagcccagaaagaaccagcccaccggactcaagcgtgattgtgactctgctcgatcaggctgcgaagagcaacgacgacttggacgtgtccgaatcaaaaggatgcatggaggaaaagccgcaggaagttcaaactagccgcaacgtcgaatcgatcgctgaacagatggagaacccagacctcaaaaacgtgggttcgtcgaccggcgagaagaatgaacgcacctcggttgcaggcactgtgcgcaagtgttggccaaaccgggtggcgaaggaacaaatcagccgccggcttgacggtaaccaatacctcttcctgcctcctaaccggtacatcttccacggggccgaagtgtactccgactcagaggatgatgtgctgagctcatcgtcgtgcggctccaacagcgatagcggaacctgtcagtccccctccctggaagagccgatggaggacgagtcagaaatcgaagagttttacaacggtctggaggacgagccggatgtccccgagcgagctggtggagctgggttcggaaccgatggcgacgaccaggaagctatcaatgaggcaatctcagtcaaacaggaggtgaccgacatgaactacccttcgaataagtcc

SEQ ID NO: 19254 - DNA, 1356 bp, Artificial Sequence
  Description of Artificial Sequence: Synthetic coding sequence
atgtttgatatagagtacttcagaaaagatccccggccattctttaagtttgcaaaagagatttatcccggacagtttcagcctagcctctgtcataaattcatcgcattatccgacaaagaagggaaattactgcgtaattacacccagaatattgacacccttgaacaagtggccggtatccaaagaatcatccagtgccatggtagcttcgccactgcaagctgcctgatctgcaagtataaggtggactgcgaggccgtgcggggggatattttcaaccaggtggtccctcggtgcccaagatgtccagctgacgaacccctggcaataatgaaacctgagatcgtgttcttcggagagaatttgcctgagcagttccaccgcgccatgaagtacgacaaggatgaggtggacctgcttattgttattggaagtagtctgaaggtaagacctgttgctctgatcccttcctctattccacacgaagttccacagatcctaataaatcgagaaccacttcctcatctgcacttcgatgtggagttactgggcgactgtgacgtgataattaatgagctgtgtcacagactgggaggagagtatgccaaactgtgttgcaatccagttaagctgtcggagattactgaaaagcctcctcgaacccagaaggagctcgcgtacctctccgagctcccccccactccgctccatgttagcgaggactccagcagcccagagcggacatcaccaccagacagctcggtgatagttacattgttagaccaggcggccaaatctaatgatgatttggatgttagcgagagcaaaggctgcatggaggaaaagccccaggaagtacagactagccgcaatgttgagtctatcgctgaacagatggaaaacccagatctgaagaatgtgggtagtagtaccggagagaagaatgaacgcaccagtgttgccggaactgtccgcaaatgttggcctaatcgcgtggcgaaggagcagattagtcgccggctcgatggcaatcaatatctgttcctacctcccaaccggtatatcttccatggtgccgaagtctatagcgactctgaagacgacgtcctgtcgagtagctcttgcggtagtaatagcgacagcggaacatgtcagtccccctcactggaagaacctatggaggatgagtccgaaattgaagaattctataacgggcttgaggatgaacctgatgttccggagcgggccggtggtgcagggtttggtacagacggagacgaccaggaggcgattaatgaggctatctcagtgaaacaggaggtgactgacatgaattatccttcaaacaaatct

SEQ ID NO: 19255 - DNA, 1356 bp, Artificial Sequence
  Description of Artificial Sequence: Synthetic coding sequence
atgttcgacattgaatactttaggaaggacccgcggcctttcttcaagttcgcgaaagagatttacccgggacagttccaaccatccctctgccacaagttcattgctctctctgataaagagggcaagctgctgaggaattacacccagaatatagatactctcgaacaagtggccggaattcagcgcatcatccaatgccatggatcgtttgcgactgcgtcgtgcctgatctgcaagtacaaggtggattgcgaggcggtcagaggagacatcttcaatcaagtggtgccccgctgcccaaggtgtcccgctgatgaaccactggcaattatgaaaccggaaattgtgttcttcggagagaatcttccagagcagttccatcgcgccatgaagtacgacaaggacgaggtggacctgctgatcgtgatcgggtcgagcctcaaggtgcgccccgtggcccttatcccttcttcaatcccgcacgaagtaccgcaaatcctcatcaatcgggagcctctcccacacctccacttcgacgtggaactcttgggagactgtgatgtgatcatcaacgaactgtgccaccggctcggaggagagtacgcgaagctgtgttgcaacccggtgaaactgtcagaaattaccgaaaaaccgccacgcactcagaaagagcttgcttacttgtcagaactgccgccgaccccgctgcatgtgtccgaggacagttcatcacccgagaggacctcgcctccagactcgtccgtgattgtgactctccttgatcaggccgctaaatcgaatgacgatctcgatgtgtccgaaagcaaggggtgtatggaagaaaagccccaggaagtgcagacttcgcgcaacgtggaatcgatcgcagaacaaatggaaaaccccgacctcaaaaacgtcggttcgagcactggcgagaagaatgagagaaccagtgtcgccggaaccgtgcggaaatgttggccgaacagggtggccaaggaacaaatctcccgcaggttggacggaaaccaatacctgttcctgccgcctaatagatacatcttccatggcgcagaggtgtattccgactcggaagatgatgtcctgtcatcgtcatcctgcggcagcaattcggattcaggaacgtgccagtccccgtccctcgaagagcccatggaggatgagtcagagatcgaagagttctacaacggtttggaggacgaaccagatgttccggagagagcgggaggcgccggattcggaactgacggagatgatcaggaggccatcaacgaggcgatctcagtcaagcaggaggtcaccgacatgaactacccgtcaaataagtcg

SEQ ID NO: 19256 - DNA, 1356 bp, Artificial Sequence
  Description of Artificial Sequence: Synthetic coding sequence
atgtttgacattgaatattttaggaaggatcctcgaccattttttaaattcgcgaaggaaatctacccaggccagttccagccatcgctgtgtcataagttcatcgccctcagcgataaggaaggaaagctgctgcgcaactacacccagaacatagacactcttgaacaggtcgccggcatacaacgtattatccagtgccacggatctttcgccaccgcctcgtgccttatttgcaaatacaaggtggattgtgaggcagtgcggggggatatctttaatcaagtcgttcctaggtgtccacggtgtcccgcagacgagcctctggcgatcatgaagcccgagatcgtttttttcggagagaacctgccggagcagtttcatcgggcaatgaagtatgataaggatgaagtggatctcctcattgttatcggaagctcccttaaggtccgccccgtggcactgatcccctcaagtatcccacatgaggtgccacaaattttgatcaatcgggaacccctgcctcacctgcacttcgacgtcgagctgctcggggattgtgatgtcatcatcaacgaactttgccaccgtctgggaggcgagtacgcgaagctgtgttgtaatccggtcaagctcagcgagataaccgagaaacctccccgtacgcagaaggagctcgcttatctcagtgagttacctcccacacctttacacgtgtcagaggatagctccagtcccgagaggactagtccgccagactctagtgtgatagttactcttctcgaccaggccgctaagagcaacgatgatcttgacgtctctgagagcaaggggtgtatggaggagaaacctcaggaggtgcagactagcagaaacgtcgaaagcattgctgaacagatggagaatcccgatctcaagaatgtcggaagtagtaccggcgagaagaatgaaagaacaagcgttgccgggactgtgcgcaaatgctggccaaaccgggtggccaaggagcagatttctcgccggcttgacggcaaccagtacctttttctgccccccaaccgttacatcttccatggcgccgaggtgtattctgattctgaggacgatgtgttgagctcgagctcctgcgggagcaattctgacagtggtacttgccaatccccttcactggaagaacccatggaggatgaatcagagatagaagagttttacaatggtctcgaagacgagcccgacgtacccgagagggcaggtggggcagggttcgggactgacggtgatgatcaagaggctatcaatgaggccattagtgtgaaacaagaagtaaccgatatgaactatccgtctaacaaaagc

SEQ ID NO: 19257 - DNA, 1356 bp, Artificial Sequence
  Description of Artificial Sequence: Synthetic coding sequence
atgtttgatattgagtactttcgcaaagatccgaggcctttcttcaagttcgccaaagagatttatcctgggcagtttcagccgtcactgtgtcacaagtttatagctctctctgataaggaaggtaaactgctgaggaattatacacagaacatcgacactctggaacaagtggccggtattcagcggattatccagtgccacgggtcttttgccaccgctagctgcctgatttgtaaatacaaggtggattgcgaggccgtcagaggggacatattcaaccaagtggttccccgatgtcccagatgccccgctgacgagccccttgcgatcatgaagcccgaaatcgtgttttttggggagaacctccctgagcagttccatagggccatgaagtacgataaagatgaggtcgacctcttaatcgtcatcggttcttctctcaaggtccggcccgtcgcgttgatcccttcatccattccccacgaagtgccacagattcttattaaccgggaaccactgccccatctccactttgacgtcgagcttcttggagattgtgacgttattataaatgagctgtgtcacagactcggaggtgagtacgccaagctttgttgtaacccggtaaaattgagcgagatcactgagaaacccccacgcacccagaaagaacttgcgtatttgtcagagttgcctccaactccactccacgtgagtgaggactcatcatctccagaaagaacatctcctcctgacagttcagtcattgtcacactgctggatcaggctgccaaaagcaatgacgatctggacgtgagtgagtcgaagggttgtatggaagagaaaccacaagaagtgcagacaagcagaaatgtcgagtccattgccgagcagatggaaaaccctgatctcaagaatgtgggtagctctaccggggaaaaaaacgaacggactagcgttgccggaacagtgcgtaaatgttggcctaatcgggtggccaaggaacagatttctaggcggctggatggcaaccagtacctgtttttacccccaaacaggtatatttttcatggcgccgaggtgtactccgattcggaggatgacgtactaagttccagctcgtgcggcagtaattccgacagtggcacatgccagtcccctagcttggaggagcccatggaggacgagtccgaaatagaggaattttacaatggactcgaggacgagcctgatgttcctgagagggcagggggagcaggcttcggtacagacggcgatgaccaggaggccatcaatgaggcaatcagtgtgaagcaggaagtcacggacatgaactacccgtcaaataaatcc

SEQ ID NO: 19258 - DNA, 1356 bp, Artificial Sequence
  Description of Artificial Sequence: Synthetic coding sequence
atgtttgacatagagtactttcggaaggaccccagacctttctttaaattcgccaaggagatctatcccggccagttccagccatctttatgtcacaaattcatcgctctttcagacaaggaggggaagctgttgcgcaattacactcaaaatatcgataccctggaacaggtggccggcatccagaggatcatccagtgtcatgggtcctttgccaccgcctcttgccttatctgcaaatacaaggtggactgtgaggccgtgagaggggacattttcaaccaagtggttccaaggtgccccaggtgccccgccgatgagcctctggcgatcatgaagcccgaaatcgtttttttcggagagaacttacccgagcagtttcaccgagcgatgaaatatgacaaggatgaggtggacttgctcattgtgatcggatccagcttgaaggtgcggcctgttgccctgattccgagcagcattccccacgaagtcccccagattctgatcaatcgagagcctctgccccacctgcacttcgatgtcgagctgctcggcgactgtgatgtgatcatcaacgaactgtgccaccggttgggcggcgagtacgccaaactctgttgtaaccctgtgaagcttagcgagatcactgaaaaacctccaaggacccaaaaagagctggcctacctgagcgaactgccacctacgcctcttcacgtgtcagaggacagctcaagccctgaaaggacatccccccccgattcttccgtgatagtgacgctgctggaccaagccgctaagagtaatgacgatcttgacgtttctgaatccaaggggtgtatggaagagaaaccccaggaggtacagacaagccgcaacgtggagtccattgccgagcagatggaaaacccagatttgaagaacgtgggaagctccactggggagaaaaacgaacggacaagcgtggcggggaccgtcaggaagtgttggcctaatcgtgttgctaaagagcagatttcaaggagactggatggcaaccaatatttattcctacctccaaaccggtacatttttcacggcgccgaggtctactcagattccgaagatgatgtgctgagctcttcgtcttgtggctctaattctgactcagggacatgtcagagcccatctctggaagagcctatggaggacgaatctgaaatcgaggaattttacaacggtctggaggacgaacctgacgtcccggaaagggcagggggagctgggtttggaaccgacggcgatgatcaggaagccatcaacgaggctattagtgttaagcaggaagtgaccgacatgaattacccctccaacaagtca

SEQ ID NO: 19259 - DNA, 1356 bp, Artificial Sequence
  Description of Artificial Sequence: Synthetic coding sequence
atgttcgacattgaatacttcaggaaggacccgcgcccgtttttcaaattcgcgaaggagatctacccagggcagttccagccgtcgctgtgccacaagttcatcgcactgagcgataaggagggtaagctcttgaggaactacacccaaaatatcgataccttggaacaggtggccgggatccaacgcatcatccagtgtcatggctccttcgctaccgcgtcgtgcctgatctgcaagtacaaggtggattgcgaggctgtacggggagatatttttaatcaagtcgtgcctcggtgccccaggtgccccgcggacgagccgcttgccatcatgaagccggagatcgtctttttcggtgaaaacctccccgaacaatttcaccgcgcaatgaaatatgataaagatgaagtcgatctgctgatcgtgattgggtcctcactgaaggtccggcctgtggccctcataccaagctcgatcccgcacgaagtcccacagatcctgatcaaccgcgaacccctgccgcatctccacttcgacgtggagctgctcggagattgcgacgtgatcatcaacgagctgtgccatagactgggaggagaatacgctaagctctgttgtaacccggtgaagctgtcagaaattaccgagaagcccccacgcactcagaaggagctggcctacctgtccgaacttcctccgaccccgttgcacgtgagcgaggacagctcatccccagaaagaacttcaccgccggattcgagtgtgatcgtgacgctgttggaccaggcagcgaaatccaacgacgacctcgacgtgtcggagtcgaaaggatgcatggaagagaaaccacaggaagtgcagacttcgcggaacgttgagagcatcgctgagcagatggagaacccggacctgaagaacgtgggatcctcgactggtgagaagaacgagcgcacctcggtcgcaggaactgtgcgaaagtgctggcctaatcgggttgccaaagaacagatctcacggagactcgatggaaatcaatacctgttcctccctcctaatcgctacatctttcatggagcagaagtgtactcggacagcgaggacgacgtcctctcctcctccagctgcgggtcaaactccgactctggcacctgtcaatcgccttcccttgaagaaccgatggaggacgagtctgaaattgaagaattctacaacggacttgaggatgaaccagacgtgccagaaagagccggcggcgccggcttcggcactgatggagacgaccaagaagcgatcaatgaagccatcagcgtgaaacaggaagtcacggatatgaattacccgtcaaacaagagc

SEQ ID NO: 19260 - DNA, 1356 bp, Artificial Sequence
  Description of Artificial Sequence: Synthetic coding sequence
atgtttgatattgagtactttagaaaggatcctcggccgtttttcaaatttgctaaagagatctatccagggcaattccaaccgtcgctctgtcataagttcattgcactctcagacaaggaaggtaagctgctgcgcaattacacccagaatattgatactttggaacaggtggcaggaattcagaggattattcaatgtcacggatcgttcgcaaccgcctcgtgcctgatctgtaaatacaaggttgattgtgaagccgtgcggggtgatatctttaaccaagtggtgcctcgctgtccacgctgccctgcagatgaaccccttgctattatgaagccggagatcgtgttcttcggggaaaacctgccagaacaattccatcgcgccatgaagtacgacaaggatgaagttgatctgctcattgtgattggctcaagtcttaaggtgaggcctgtggcacttatcccttcgtcgatcccccacgaggtgcctcagattcttatcaatagagagccccttcctcatctgcattttgatgtggaactgctgggtgactgtgatgtcataatcaacgaactgtgccatcgccttggcggagaatacgccaaactgtgctgcaatccggtgaagctgtctgaaattactgaaaagcctccaagaacccagaaggaacttgcgtacctttccgagcttccccccactcctctgcatgtctcggaggacagctcctcccctgaaaggacctcaccaccagattctagcgtaattgtgacccttctcgatcaggccgcaaagtccaacgacgatctggatgtgtccgaatcgaagggatgtatggaagaaaagcctcaagaagtgcaaacctcgcgtaacgtggaaagcatcgcggaacagatggaaaacccagacctgaaaaacgttggttcctccaccggcgagaagaacgaacggacctcagtcgcgggtactgtgcgtaaatgctggccaaaccgggtggcaaaggaacaaataagccgcaggctcgacggaaaccaatatctgtttctgccgcccaaccggtacatcttccacggtgcagaagtgtactcggattccgaagatgacgtcctgagctcgtccagctgtggatcaaacagtgattcgggaacctgtcagagcccaagcctcgaggagcctatggaggacgagagcgaaattgaagagttttacaatggacttgaggatgagccagatgtccctgaaagagctggaggggccggatttggaacggacggagatgatcaagaggctatcaatgaagcaatttccgtgaaacaggaagtgaccgacatgaattacccaagcaacaaatcc

SEQ ID NO: 19261 - DNA, 1356 bp, Artificial Sequence
  Description of Artificial Sequence: Synthetic coding sequence
atgttcgacattgagtatttccggaaggacccaagaccatttttcaagtttgcaaaagaaatctacccggggcagttccagccgtctctgtgccataagttcatagcactgtccgacaaggagggcaaactgctgagaaattacacccaaaacattgatacgctggaacaggtggcgggcatccagaggatcatccagtgccacggctccttcgcgaccgcatcgtgtcttatttgcaagtacaaggtggactgcgaggctgtgcggggagacatctttaatcaagtggtgccgcggtgcccgcgctgtccggcagacgagccgctggcgatcatgaagcctgagatcgtgttcttcggcgaaaacctcccagagcaattccaccgggccatgaagtacgataaggatgaggtggatctgctgatcgtcatcggatcgtcattgaaggtccgcccagtggcactgatcccatcgtccatcccgcacgaggtgccgcaaatcttgatcaatcgcgaaccactgccgcatctgcatttcgatgttgaactgctgggagattgtgatgtgatcatcaacgagctctgccaccggctcggcggagagtatgccaagctctgctgcaacccggtcaaattgagcgaaatcaccgagaaacccccgcgaacccagaaagaacttgcgtacctctccgaactccctccaaccccgctgcatgtgtcggaagattcatcatcgccagagaggacttcgcctccggactcgtccgttatcgttactctccttgaccaagcggcaaagtcaaacgatgacctggacgtgtcggaaagcaagggatgtatggaagaaaaaccgcaagaggtgcagacttcacggaacgtcgaatcaatcgctgaacaaatggaaaaccctgatctgaaaaatgtgggaagcagcaccggcgagaaaaacgagagaacttccgtggctggtactgtgcggaagtgctggcctaacagggtcgctaaggaacagatctcccgccggctcgacggcaatcagtacctgttcctgccgcctaatagatacatcttccacggagctgaagtgtactcagattccgaggacgacgtcctgagctcgtccagctgtgggtcgaattcggactcgggaacctgccagtccccaagcctcgaagaaccaatggaagatgagtccgaaatcgaagagttctacaacggcttggaagatgaaccggacgtgccggaacgcgcgggcggagcgggattcgggaccgacggagatgatcaagaggccataaatgaggccattagcgtgaagcaggaagtgaccgatatgaattacccttccaacaaatcc

SEQ ID NO: 19262 - DNA, 1356 bp, Artificial Sequence
  Description of Artificial Sequence: Synthetic coding sequence
atgttcgacatcgaatacttccgcaaggatcccaggccctttttcaagtttgctaaggagatctatccaggccagttccagccctctttgtgtcacaagttcatcgctctgtcagataaggaaggtaagcttcttcgtaactatacccaaaacatcgatacccttgagcaagtggccggaattcagaggatcatccagtgtcatggatcctttgccacagcttcatgcctcatttgtaaatataaagtggattgtgaggctgtacgcggagatattttcaaccaggtcgtccctcgttgcccaaggtgtcctgcagatgagcctttggccatcatgaagcctgaaattgttttcttcggtgaaaaccttcccgaacagttccatcgcgcaatgaagtacgataaagatgaggtggacttgctcattgtaattggttcttctcttaaggtgcgtcctgtggctctgatcccttctagtataccacacgaagttccacagatcttgattaatagagaacccctgccccacctgcactttgacgtcgaactgttgggtgactgtgacgtcatcatcaacgagctgtgccacagattgggtggtgaatatgctaagctgtgctgtaatccagtgaagctcagcgagatcactgagaagcctcctaggacacagaaggaacttgcatacctcagcgagctcccaccaacccccctccatgtgtcagaggacagttcttcccctgaaagaacttcaccccccgattcctcagtgatcgtcactctgctggaccaagccgctaagtcaaatgatgacctggatgtatctgagagtaagggatgtatggaggagaagcctcaggaggtacagaccagcaggaacgtggaatctatcgccgagcaaatggagaaccccgacttgaagaacgtgggttcttccacaggcgagaagaatgaaagaacttctgttgccggcaccgtcagaaagtgttggcccaacagggttgccaaggagcagatttccaggcgcctggatggtaaccagtacctgttcttgccacctaacaggtacatttttcacggtgcagaggtctactccgactccgaggacgacgtattgtccagcagtagctgcggcagtaatagcgattctggaacttgccagtccccctccctggaggagcccatggaagacgagagtgaaatcgaggaattttacaacggacttgaagacgaaccagatgtccccgagcgcgctggcggtgctggcttcggcactgacggtgacgatcaggaggcaatcaatgaggcaatcagtgttaaacaggaagtcacagatatgaactatccttccaacaagagt

SEQ ID NO: 19263 - DNA, 1356 bp, Artificial Sequence
  Description of Artificial Sequence: Synthetic coding sequence
atgttcgatatcgagtacttccggaaggaccccagaccgtttttcaaattcgccaaggaaatctacccggggcagttccaacctagcctgtgccacaagttcatcgcactttcggataaggaaggaaaactgttgagaaactacactcagaatattgacacccttgaacaggtcgccgggatccaacggattatccaatgccatgggtcatttgccacggcctcgtgtctcatctgtaagtacaaggtcgactgtgaagccgtccgtggagacattttcaaccaagtggtccccagatgcccacgctgcccggccgacgaaccgctggcgatcatgaaaccagagatcgtgttctttggagagaatctgcccgagcagttccatagggcgatgaagtatgataaggatgaagttgatctgctcatcgtcatcggtagcagcctcaaggtgcggcccgtggccctgatcccgtcctctatcccgcacgaggtaccacaaattcttatcaaccgcgagcccctcccgcacctgcatttcgatgtcgagctgctgggggactgcgatgtgattatcaatgagctgtgccacaggctgggcggtgaatacgcgaagctgtgctgcaatccggttaagttgtcagagatcacggaaaagccgccgcgcacccaaaaagagctggcgtacctctccgaactgccgccgactccccttcacgtgtctgaagattcgtcctccccggagcggacctccccgccggactcgtccgtcattgtcacgctccttgatcaggccgccaaatccaatgacgacttggacgtctcggaaagcaaaggctgtatggaagaaaaaccgcaggaggtgcagacttcccgcaacgtggaatctatcgctgagcagatggaaaacccggacctcaagaatgtcggctcgtcgaccggagagaagaacgaacgcacctccgttgcgggcactgtgaggaagtgctggccaaaccgcgtggccaaggagcagatatcaaggcgcctcgatggaaaccagtacctgttcctgccgcccaatcgctacatttttcatggtgcggaggtgtacagcgattccgaggatgacgtcctctcttcgagctcgtgcggatcaaactcagattccggaacctgtcagtcaccatcactcgaagagccaatggaggatgaatcagaaatcgaagagttctacaacggactcgaagatgaaccggacgtgccagagcgagccggaggggccggctttggcactgacggggacgaccaagaagctatcaacgaggcgatctcagtgaagcaggaggtgacggacatgaactacccatcgaacaagtca

SEQ ID NO: 19264 - DNA, 1356 bp, Artificial Sequence
  Description of Artificial Sequence: Synthetic coding sequence
atgttcgacatagagtacttccgaaaggatccacggcccttttttaagtttgccaaagaaatctaccctgggcagttccaaccctccctttgccataagtttatagccctctcagacaaggaagggaagttgctgcgtaactatacccagaacattgacacgctggaacaggtggccggcatccagagaattatccagtgtcatgggtcattcgcaaccgcatcttgtctgatctgtaaatataaggttgactgcgaagcagttcggggtgacatctttaatcaagtagtccctagatgtccacgttgccccgctgacgaacctctcgcaatcatgaaacccgagatagtgtttttcggggaaaacctgcctgaacagttccatcgggccatgaagtacgataaagacgaagtcgatcttctcattgttatcggatcatcactaaaggtaaggcctgtcgctttgatccccagtagcattcctcacgaggttccacaaatcctgattaaccgtgaacccctcccccatctccattttgacgtcgagctcctgggggactgcgacgtgatcattaacgaactctgccatcgcctggggggggagtatgccaaattatgttgtaaccccgtcaaattgagtgagattaccgagaagccccctcgaacgcagaaggaattggcatacctgtccgagctgccacccacgccacttcatgttagcgaggattcatcttcacccgagcgaactagtccgccggatagtagtgtcatcgtaacgctgttagatcaggccgccaagagcaacgacgatctcgatgtttcagagagcaaaggttgtatggaagagaagccacaagaggtgcaaacgagcaggaatgtggaaagtatcgcagaacaaatggagaacccagacctgaagaatgtcggctcttcaacaggagaaaaaaacgagcgaacctctgttgctggtactgttaggaaatgttggcccaaccgcgtggccaaagagcagatctctcggcggctggacggaaatcagtacctgttcctccctcctaaccgctatatcttccacggggctgaggtatattctgattcagaagatgacgtcctgtcttcttctagctgcggctccaattcagatagcggcacttgtcagagtccttctttggaggaaccaatggaagatgagagtgaaatcgaagagttttataatgggctggaggacgagcctgatgtcccagaacgcgcagggggtgcaggttttggcacggatggggatgaccaggaagccatcaacgaggcaattagtgtaaagcaagaggtgacagacatgaactacccaagcaataaaagc

SEQ ID NO: 19265 - DNA, 1356 bp, Artificial Sequence
  Description of Artificial Sequence: Synthetic coding sequence
atgtttgacatagaatattttagaaaggatcctcgaccattctttaaatttgcaaaagaaatctacccaggtcagtttcagccctcactctgtcacaaattcatcgctctatccgacaaagaaggcaaactgctcagaaactacactcagaacattgacacgctcgaacaggtcgctgggatccaaaggattatacagtgccacgggtcattcgccacagcgtcatgtctgatctgtaaatacaaggtggactgtgaagctgtgagaggtgatatcttcaatcaagtcgtaccccggtgtccgcgctgccccgcagatgagcccttggcaataatgaagcccgagatcgtgttcttcggggaaaatttaccagaacagttccatcgggctatgaagtatgataaagacgaagttgatcttctcatcgtaattgggagttctctcaaggtgcgccccgttgctcttatcccttcttctatccctcacgaagtgccccagatactgataaacagggagccgcttccacatctgcatttcgacgtggaactgttgggcgattgtgacgtgatcataaatgagctttgccaccggcttggcggagagtatgcgaagctctgctgcaatcccgttaagttgtcagagattaccgagaagccgccgcgaacccagaaggagcttgcttatctgtcggagctgcctccaacacctttgcacgtcagtgaggattcctctagccccgaacgaacatcgccaccggattcgagtgtgattgtcactctcctggatcaggcagctaaaagtaatgacgatctcgacgtttcggagtcgaaggggtgcatggaagagaaacctcaggaggtgcagacatctcggaacgtggagtctatcgcagaacaaatggaaaatcctgacttaaaaaatgtaggttcatccaccggggaaaagaacgagcgaacgagtgtcgctgggaccgtgagaaaatgttggcctaacagggtggctaaagagcaaattagccgcaggcttgatgggaaccagtacctgtttctcccaccgaacaggtacatttttcacggcgccgaggtctatagtgatagcgaagacgatgtgttgtcatcgagttcctgtgggtccaatagcgattctggcacatgtcagtctcccagcttggaggaaccaatggaggatgagtcagagattgaggagttctacaatgggttagaggatgaacctgatgtccctgaaagggccggcggtgccggctttggtactgacggtgacgatcaggaggccatcaatgaggctatatcagtgaaacaggaagtgacagacatgaattatccaagcaacaagtct

SEQ ID NO: 19266 - DNA, 1356 bp, Artificial Sequence
  Description of Artificial Sequence: Synthetic coding sequence
atgtttgatattgagtactttaggaaagacccacggcctttctttaagttcgctaaggagatttatcccgggcagttccagccctccctttgccacaagttcatcgcgctctctgacaaggaaggcaagctgctccgcaactatacccagaatattgacactctggagcaggttgctgggatccagcggattatccaatgccatgggtcctttgcaactgcgtcttgcctgatctgtaaatacaaagtagactgcgaggccgtgcggggcgacatctttaatcaggttgtgcctcggtgcccgagatgtcctgccgacgagccgcttgctattatgaaaccggagatcgtgtttttcggcgaaaacctgccagagcagtttcacagggccatgaagtatgacaaggacgaagtggacctcctgattgtcattggatctagcctgaaggtcaggcctgtagccctgattccaagttcaattcctcacgaggtgccccagatcttgatcaatcgagagccccttcctcacctccatttcgacgtcgaacttctgggtgattgcgacgtgatcataaacgagctttgtcatcggctcggaggggagtacgccaagttgtgttgcaatcccgtgaagttgagcgagattacggaaaagcctccgagaacacagaaggaactggcttacctctcagaactgccaccaacccccctccacgtgagcgaggacagttcctcacccgagaggacgagccccccagattcctctgtaatagtgactctgctggatcaggctgctaagagtaacgacgatttggacgtaagcgagtctaaaggctgcatggaagaaaagccacaagaggtgcaaacctctaggaatgtagagtctatcgcagagcagatggaaaatcccgatttgaagaacgtagggtcctccaccggagaaaagaatgagcgaacgtcagtggcgggcactgtccgcaagtgttggcccaacagagtggcaaaagaacagatctctcggagactggacgggaatcagtacctgttcctcccacctaaccgctatatcttccatggcgcagaggtgtactcagattcagaggatgatgtattgagctctagttcctgcgggtctaatagtgatagtggcacctgccagagcccaagtcttgaggagccgatggaggacgaaagcgagatcgaagagttttataatggtttggaggacgagcccgatgtgcctgaaagggcagggggagcggggttcgggaccgatggagatgaccaggaggccatcaacgaagctatatctgtcaaacaggaagtgaccgacatgaactatccttcaaataagagc

SEQ ID NO: 19267 - DNA, 1356 bp, Artificial Sequence
  Description of Artificial Sequence: Synthetic coding sequence
atgttcgacattgaatatttcagaaaagaccccagaccatttttcaaattcgccaaggagatttatccggggcagttccagccttcattatgccacaagtttatcgccctgagcgataaggagggcaaactgttgcggaactacactcagaatattgataccctggagcaagttgccgggatccagcgaattatccagtgtcatggatctttcgccacagcatcctgcctgatatgtaaatacaaagtagattgcgaggcagtccgcggtgacatttttaaccaggtggtgcctcgctgtccacgttgtccagccgatgagcccctcgcgatcatgaaaccagagattgtcttctttggcgaaaacctccctgagcagttccacagagcaatgaaatatgataaggatgaagtggacttgcttattgtgattggtagcagcctcaaggtcagacctgtggccctgattccaagctccattccccacgaggttcctcagattctgattaatcgggagccgctccctcaccttcatttcgatgtggagctcctgggcgactgtgatgtgatcattaatgaactgtgccatagattgggcggggaatacgctaagctgtgctgtaatccggtcaaactgtccgagattaccgagaaacctccccggactcagaaagagttagcctacctgtcagaattgcccccaacccctctacacgtctccgaggacagtagtagccctgagcggacttccccacccgacagctctgtgatcgtgactctcctcgatcaggcggctaagagcaatgatgatctagatgtttccgaatccaagggctgtatggaggagaagccccaggaagtgcagacgtctcggaacgtcgaatcaattgccgagcagatggaaaatccagacttgaaaaatgtgggatcctctaccggcgagaaaaacgagagaactagtgttgcaggcaccgtccggaagtgctggccaaaccgggtggccaaagaacagattagtaggcgattggatgggaatcagtacctttttctgcccccaaataggtacatcttccatggggcagaggtctattctgacagcgaggatgatgtcctaagctcaagcagttgtgggtccaactcggactcagggacatgccaatcaccgtcccttgaggaacccatggaggacgagagcgagattgaagaattctacaatgggctggaggatgagcccgatgttcctgaacgcgccggaggtgccgggttcggaacagacggagatgatcaggaggccatcaacgaggcaatatctgttaagcaggaagtgaccgatatgaattacccctccaacaagtcc

SEQ ID NO: 19268 - DNA, 1356 bp, Artificial Sequence
  Description of Artificial Sequence: Synthetic coding sequence
atgttcgacatcgagtattttaggaaagatccaaggcctttcttcaaattcgctaaggagatataccctggtcaattccaaccatccctgtgtcataagttcattgctttatctgacaaggagggcaagctgctacggaactatacacaaaatattgatacacttgaacaggtggcagggatccaacgaatcatacagtgtcatggatcctttgccactgcctcatgcctgatctgcaaatacaaggtggactgcgaagctgttcggggcgacatcttcaaccaggtagtgcctagatgcccccgctgccctgccgatgaacccttggctattatgaaaccagaaatcgtgttttttggcgagaacctgcccgaacaattccacagagctatgaagtacgataaggacgaggtcgacctgctcattgtcatagggtcaagccttaaggtgcgccctgtggccctcattcccagctctattcctcatgaagtgccacagatcctaatcaacagggaacctcttccacacctccacttcgacgtggagttgctgggggactgcgacgtcattatcaatgagctttgccatcgactgggcggggagtatgcaaaactgtgttgcaacccagtcaagctgtcagaaatcaccgaaaagcccccgagaacacagaaggagctggcctatctgagtgagttgcctcccacacctttgcacgtgagcgaagactcttctagtcccgagcgaacaagtccaccggactccagcgtaatcgtgacattactagaccaagcagctaaaagtaacgatgacttggacgtgtcagaatctaaaggatgcatggaggagaagccacaggaggtgcagacaagcagaaatgtggaaagtatcgcagagcagatggagaaccccgatctgaagaacgtcggctcgtccaccggagagaaaaatgaaaggaccagcgttgctgggacggtccgaaagtgctggccgaaccgcgtggctaaagagcagatctctcggcgccttgacggcaatcagtacctcttcctaccacctaacagatacattttccacggcgctgaagtttattctgatagcgaagatgacgtgttatcttcatcaagctgtggttcaaactctgacagtgggacttgtcaaagccctagcctcgaggagccaatggaggacgaaagcgaaatcgaggaattttacaacggcctggaggacgaacccgatgtgcctgaaagggccgggggtgcaggattcgggacagatggtgatgaccaggaggccatcaacgaggcgatctccgtcaaacaggaggtgacagacatgaactatccaagcaacaaaagt

SEQ ID NO: 19269 - DNA, 1356 bp, Artificial Sequence
  Description of Artificial Sequence: Synthetic coding sequence
atgtttgatattgagtatttcagaaaagaccccaggccattctttaagtttgcaaaggaaatctaccctggacagttccagcccagcctttgccataagttcattgcactgagcgataaggaaggtaagctcctgaggaattacactcagaacattgacactctcgaacaggttgcagggattcaaagaataatccaatgtcacgggtcttttgcgaccgcctcctgccttatttgtaaatacaaagtggattgcgaagcggttcgaggagacattttcaatcaagtggtgccaaggtgtcctagatgccctgctgatgagcccctggcaatcatgaagcctgagatagtcttttttggtgagaacctgcctgagcaatttcatcgggcaatgaaatacgataaggatgaggtcgatctgcttatcgtcattggctccagcctgaaggtgcggcctgtggctcttataccgagctccatcccccatgaagtgcctcagatactcattaaccgagaacctctcccccatcttcattttgatgtggagttgcttggcgattgtgatgtgattatcaacgaactgtgtcaccggctgggtggcgagtacgctaaactttgctgtaatcctgtgaaactttccgagataacggaaaagcccccaaggactcaaaaggagctggcatacctgtcggagctgcctcctacccctctgcacgtgtcagaggactcgtcatcacctgagcgcacttcacctcctgattcgtccgtgatcgtgactctgctcgatcaagcggcaaagtctaacgatgacctggacgtgtcggaaagcaagggctgtatggaagaaaaaccccaagaagtgcaaacctcccgaaatgttgaatccatagcagaacaaatggaaaaccctgaccttaagaacgttggaagcagcaccggagagaagaatgaacggacttccgtggcaggtactgtgagaaaatgttggcccaaccgggtggcaaaggaacaaatctcccgtcgcctggacggaaaccaatacctgttcctcccaccaaacagatacattttccatggtgccgaggtgtatagcgactctgaagatgacgtgctgtcaagcagctcctgcggatccaactcggactcaggaacctgtcaatcgccttcacttgaagaacctatggaagatgaatcagagatcgaggagttttacaacggtttggaagatgaaccagatgtccctgagcgggcaggaggagcaggttttggcaccgatggagatgatcaagaggcaatcaacgaagccatttcagtgaagcaggaagttactgacatgaactatccttcgaacaagtcg

SEQ ID NO: 19270 - DNA, 1356 bp, Artificial Sequence
  Description of Artificial Sequence: Synthetic coding sequence
atgtttgacattgagtacttccggaaggacccaagaccatttttcaaatttgcaaaggaaatttacccgggacagtttcagccaagcctgtgccacaagtttatagcccttagcgacaaagagggcaaacttctgaggaattacactcaaaacatcgacaccctggagcaggtggcaggcatacaacggataatccagtgtcatgggtcatttgctaccgccagttgcctgatctgcaaatataaggtagactgcgaagctgtccgtggtgacattttcaatcaggtggttcctagatgtccgcgctgtccagcagacgaacccctggcaattatgaagcccgaaattgtcttttttggcgagaatctccctgaacagttccaccgtgccatgaagtatgacaaggatgaagtcgatctgctcatcgtcatcggctcttccctgaaggttaggcccgtggcattaattcctagctccatcccacacgaggttcctcaaatcctgatcaaccgcgaaccactgcctcacttgcacttcgatgttgagctgctgggagattgcgatgtcatcattaacgagctgtgtcatcgcctgggtggagagtacgcaaaactctgttgcaatccggtgaagctcagtgagatcacggaaaagcctccgcgaacccagaaggaactggcttacttaagcgagctgccacctacaccgctccacgtgtctgaggattctagttcccccgaacggacttcaccccccgattcttcagtcattgtcacgctgctagatcaggccgctaagtccaacgacgacttagatgtaagcgagtccaagggatgcatggaagaaaagccccaagaggtacagaccagtaggaacgtggagagtattgccgaacagatggaaaatccggatctcaaaaacgttggtagttccactggcgaaaagaacgagcgcaccagtgttgccggtaccgtgaggaaatgctggccaaatcgggtggccaaagaacagatttcacgccgactcgatggaaaccagtatttgtttctgccacctaatcgctacatcttccatggtgccgaagtttacagcgatagcgaagacgacgtcttaagcagctcatcctgcggtagtaattcggattcaggtacatgccagagcccttcattagaagaacctatggaagacgagtctgagatagaggaattctataacggactggaggatgagcctgatgttccagagagggctgggggtgcaggctttgggacggacggggatgatcaagaagcaattaatgaggccatttcggtgaaacaggaagttactgacatgaattacccttccaacaagtca

SEQ ID NO: 19271 - DNA, 1356 bp, Artificial Sequence
  Description of Artificial Sequence: Synthetic coding sequence
atgttcgatatcgagtacttcagaaaggaccctcgccctttctttaagttcgctaaagagatctaccctggtcagtttcagcctagtctctgccataagtttattgctttgagcgataaggaaggaaaattacttcgaaattatacccagaatatagacactctcgagcaggtcgccggcatacagaggataatccagtgccatggatctttcgccacagcaagttgccttatttgtaagtacaaagtggattgcgaggctgtaaggggcgatattttcaaccaagtggtccctcggtgtccgcgctgccctgcagatgaacctctggccattatgaagccagagattgtctttttcggagaaaatttgcccgagcagtttcacagggccatgaagtacgacaaagacgaggtcgacttactgatagtgatcggttcatctttgaaggtaagaccagttgcgctaattccctcttccataccgcacgaagtgccccaaatcctcatcaaccgggaaccgttaccccaccttcattttgatgttgagctgctgggcgattgtgatgttattatcaacgaattgtgccatcgactgggaggggagtatgccaagctctgttgcaatccagtcaaactttccgagataaccgaaaaacctcctagaacacagaaggaactcgcgtacctgtcagagttgcctccaacacctttgcacgtcagcgaggatagctcttctcccgaaaggacctcgcctcccgatagttccgtcattgtgacccttcttgatcaggccgcaaaatcaaacgatgacctcgatgtctctgagtccaaggggtgtatggaggagaagcctcaggaggtgcagaccagcagaaatgtcgaatccattgcggagcagatggagaatccagacttgaagaatgtgggatcctccactggagagaaaaacgagcgaaccagcgtggcgggaaccgtgcgtaagtgttggcctaatcgggtcgccaaggaacagatctcacggcggttggatggtaaccagtacctcttcctccctcccaacaggtatatctttcatggtgccgaggtgtactcggatagcgaagatgatgttcttagctcttcatcttgtggttccaatagcgacagtggcacgtgccagtcacccagcttagaagagccgatggaagacgagtccgagatcgaagagttttataatggactggaggacgaaccagacgtacctgaaagagccggaggtgccgggtttggcacggacggcgacgatcaagaagcaattaacgaagccatctcagtgaaacaggaggtcaccgatatgaattacccatcaaacaagtct

SEQ ID NO: 19272 - DNA, 1356 bp, Artificial Sequence
  Description of Artificial Sequence: Synthetic coding sequence
atgttcgatatcgaatactttagaaaggatcccagacctttttttaagttcgccaaggagatttatccgggacagttccagccatccctgtgccacaagtttatcgcactgtctgacaaggagggcaaactgctccgaaattatacccagaacatcgatactcttgaacaggttgcgggcattcaacgaattattcaatgtcatgggtcattcgcaacagcctcatgtttaatctgcaagtacaaggttgattgtgaagccgtgagaggcgacattttcaatcaggtcgtgcctaggtgtcctaggtgccctgctgacgagcctctagctatcatgaagcccgaaatcgtgttcttcggagaaaatctgcctgaacagtttcaccgagctatgaagtacgataaggatgaagtggatctgctgatcgtcattggatcttcgttgaaagtgagaccggtcgcactcattccctcaagtataccccacgaagttcctcagatcctaatcaacagagaacctctcccccaccttcactttgatgtcgagctgctgggggattgtgacgtgatcattaatgaactctgccatcgactcgggggcgaatatgctaagttgtgttgtaacccagtcaagctaagtgagatcacagagaaaccaccaagaactcaaaaggagctcgcctaccttagcgaactgccacctacacccttgcatgtctcagaagattcctcttcccctgagcgaacttctccaccagactccagtgtgatagtcacattgctggaccaggccgctaagtctaatgatgatctggacgtctctgaatccaaaggttgtatggaagagaaacctcaggaagtgcagacctctcgaaatgtcgaatccatcgcggaacaaatggaaaaccccgacttgaagaacgtcggatcctccactggcgagaaaaatgagaggacaagtgtggcgggtactgtccgaaaatgctggccaaaccgtgtcgctaaggagcaaatctcccgcaggctggatggcaatcagtacttatttcttccgccaaacaggtacatatttcacggggctgaagtctactccgacagcgaggacgacgtgctgagcagctctagttgtggatcaaactcagattctggcacatgccagtcgccatcactcgaggagcctatggaggacgagtccgaaattgaagagttctacaacggtctggaagatgagcctgacgtgccggagcgtgccggcggcgctggattcggcaccgacggggacgatcaggaggctattaatgaagccatttccgtcaagcaggaggtgaccgatatgaactatccttccaataagtct

SEQ ID NO: 19273 - DNA, 1356 bp, Artificial Sequence
  Description of Artificial Sequence: Synthetic coding sequence
atgttcgatatagaatactttcgaaaggaccctcgccccttcttcaaattcgcgaaagagatttacccaggccaatttcaaccttccctctgtcataagtttattgccctgtcggataaagagggtaaattgcttcgcaattacacccagaacatcgacactcttgaacaagttgcaggtattcaacgcatcatacaatgtcatggatcatttgcaaccgcatcctgtctgatctgcaagtacaaggtcgactgtgaagccgtcagaggggatatcttcaaccaagtggtcccacggtgtcctcggtgccctgccgatgagcccctggctataatgaaacctgaaattgtcttttttggcgagaaccttcctgaacagtttcatcgtgcaatgaaatacgacaaggatgaagtggatcttttgatcgtcattggttccagcctgaaggtccgccccgtggcattgatcccctcctcgataccgcatgaggtgccgcagattctcatcaaccgagagccattgcctcacctgcatttcgatgtggaactgctcggcgactgtgatgtgataatcaacgaactttgtcacagactcggcggggaatatgcaaagctgtgctgtaacccagtcaagctcagcgaaattaccgagaaacctcccagaacccagaaggagttggcatacctgtccgaactgcctcccaccccgctgcatgtgagcgaggattcatcttcgcctgaaaggacttccccaccagatagctcagttatcgttactctgctcgatcaagcagctaaaagcaacgacgacctcgacgtgtcggaatccaagggatgcatggaagaaaagccacaagaagtgcaaacctccagaaacgtggaatcgatagcagagcaaatggagaaccctgacctcaagaacgtcggttcctcgaccggagagaagaacgagcgtacttccgtggctggaacggttcgaaagtgctggcctaatagagtcgccaaagaacagatctcccgcagactcgatggcaatcagtacttgtttcttcctcctaatcgttacatttttcacggtgcagaagtttactccgactcagaagatgacgtcctgtccagctcaagctgtggatccaattcagactccggtacttgtcaaagccctagccttgaagaacctatggaggacgagtcagagatcgaagagttctacaatggcctggaagatgaacctgatgttccagagcgagctggaggagcaggttttggaaccgacggggacgaccaggaggcaattaacgaggcaatcagtgtgaagcaggaagtgactgatatgaactatccatcaaataagtcg

SEQ ID NO: 19274 - DNA, 1356 bp, Artificial Sequence
  Description of Artificial Sequence: Synthetic coding sequence
atgttcgatattgagtactttagaaaggatccccgtccattcttcaaattcgcgaaggagatttacccaggacagttccaaccgtcattgtgccataagtttattgcactatcggataaggagggtaaattgctacgtaattatactcaaaacatcgatactctagagcaggtcgccggtatccaaagaataattcagtgtcatggatcttttgcaacagcttcatgcttgatttgtaaatacaaggtggactgtgaagcggtacgtggggacatctttaaccaagtcgtacctaggtgccctcgctgtccagcagatgaaccacttgctattatgaagcctgagatcgtcttctttggtgaaaaccttccagaacaatttcatagagccatgaagtatgataaagacgaagtggatttgctaattgtcatcggttcctcgctaaaggtccgtccagtagctctcattccgtcctctattcctcatgaggtaccacagatcctaatcaacagagagccactgccacatcttcattttgatgtggagttgttaggagattgcgacgtcattattaatgagttgtgtcaccgacttgggggtgagtatgccaagctctgttgcaatccggttaagttgagtgagatcactgaaaagccacccagaactcaaaaggaactcgcatatctctccgaactcccaccaaccccactacacgtttctgaagattcttcaagtcccgagcgaacttcgccacctgatagttctgtaattgttactctacttgatcaagcagcaaagtcgaatgatgatctcgatgtctcggaatctaagggttgtatggaagaaaagccacaggaagttcaaacaagcagaaatgtagaatctattgccgaacaaatggaaaacccggacctcaaaaatgttggatctagtactggtgaaaagaacgaacgtacatcagtggcaggaactgttcgaaagtgttggccaaaccgcgttgctaaggaacaaatctcacgacggttagatggaaatcaataccttttcttgccaccaaacagatatattttccacggagccgaagtttattcagactcagaagacgatgttctatcgagttcttcttgtggttctaattcggactctggtacgtgccaatctccgtctttggaggaaccaatggaagatgaatcagagattgaagagttttacaatggacttgaggacgaaccggatgtgccagagcgtgctgggggagcaggattcggaactgatggtgatgatcaagaggccattaatgaggcgattagtgtgaaacaagaggtgactgatatgaattacccatccaacaagtct

SEQ ID NO: 19275 - DNA, 1356 bp, Artificial Sequence
  Description of Artificial Sequence: Synthetic coding sequence
atgttcgacatcgaatacttcaggaaggaccctagaccatttttcaaatttgcgaaggaaatctaccccggacagttccagccgtccctgtgccataagtttatcgcgctgtccgacaaggagggcaagctgcttcgcaactacactcaaaacatagataccctggaacaggttgctggtatacagaggattattcagtgccacggttcgtttgcaaccgcctcttgtcttatatgcaagtataaggtggattgtgaggcagttcggggtgacattttcaatcaggtggtgccaagatgtcctcgctgtccagcggatgagccacttgcaatcatgaaacctgaaattgtgttctttggggaaaatcttccagagcaattccatcgggcgatgaagtacgataaagatgaagtcgatcttctgatcgtcattggatcctccctgaaggtccggcctgtggccctcatcccctcctcgattcctcacgaagtgccacagatactgattaacagggaacctctcccgcacctccactttgatgtggagcttcttggtgattgcgatgtgattatcaacgaactttgtcataggttggggggcgaatacgccaagttgtgttgcaaccctgtcaagctgtcagagattaccgagaagcctccacgtactcagaaagaactggcatacctttcagaactccctccaacgccactgcatgtgagcgaagattcgtcctcgcccgagcggactagcccccctgacagcagcgtcatcgtgactctgcttgaccaggcagccaagagcaacgatgatctggatgtgtccgagtccaagggatgcatggaggaaaaaccacaggaagtgcagactagtcgcaatgtggaaagcattgcggagcaaatggaaaatcctgatctgaagaacgtcgggagctccactggcgagaagaatgaacgtacctccgtggccggtactgtgcggaagtgttggccaaatagggtggccaaagaacagataagccggcgattggatggaaatcaatacctctttctcccgcctaaccgttacatttttcacggcgctgaggtgtacagcgacagcgaagatgatgtgctttcgtcaagcagctgtggttcgaattccgatagcggaacctgtcagtcgccgtccctggaagagccaatggaagatgaatcggaaattgaagagttctataacggacttgaggatgagcctgacgttccagaacgtgccggaggcgcaggatttggtactgacggtgatgatcaagaagcaattaacgaagcaattagcgtcaaacaagaagtgaccgatatgaattacccatccaacaagagc

SEQ ID NO: 19276 - DNA, 1356 bp, Artificial Sequence
  Description of Artificial Sequence: Synthetic coding sequence
atgtttgacattgagtacttccggaaagacccgcgtcctttcttcaaatttgccaaagagatctacccagggcaatttcaaccgtcgctctgtcacaagttcatcgccttgtcggacaaagaaggaaaacttctccggaattacacgcagaacatcgacactcttgaacaggtcgcgggaattcagcggattatccaatgccatggttccttcgccaccgcctcgtgcctcatctgtaagtacaaagtcgactgcgaggccgtgcggggagacatcttcaatcaggtcgtgccgcgctgcccccgttgtcccgcagacgaaccactggctatcatgaaaccagagattgtgttctttggcgaaaatctgcctgaacagtttcaccgggctatgaagtacgataaagatgaggtggacctgctcatcgtgattggctcctcactcaaggtgcgcccggtcgccctgataccgagttccatcccgcatgaggtgccacaaatcctcatcaatcgagaaccactgccgcacctgcatttcgatgtggaactgcttggcgactgcgatgtcatcatcaacgaactctgtcaccgcctcggaggagaatacgcgaaactctgctgcaatcccgtgaagttgtcagagatcactgagaagccaccgcggactcaaaaggaactcgcctacctgtccgaactgccgccgactccgctgcatgtgtcggaggactcatcaagcccagagcgcacgtcaccacccgattcgtcggtgatcgtgactctgctcgaccaggcggcgaagtccaatgatgatttggacgtatcggagtccaaaggatgcatggaggagaagccgcaggaggtgcaaacgagcagaaacgttgagagcattgcggaacagatggaaaacccagatctcaagaacgtgggaagctccacgggagaaaagaacgaacgcacctcagtggcagggaccgtgagaaagtgctggccaaatcgcgtcgcgaaggagcagatcagccgccggctcgacggaaaccagtacctgtttttgccgccaaatcgctacatatttcacggggcagaagtgtacagcgactcggaggacgatgtgctgtcctccagctcatgcgggtccaactcagattctggtacctgtcagtcgccctcactggaagaaccgatggaggacgaatctgaaattgaggagttctataacggactcgaggacgagcctgacgtccctgagagagcgggaggggccggattcggcacggacggagacgatcaagaggccatcaacgaagccatctcggtgaagcaggaagtcaccgacatgaactatccctcaaacaagagc

SEQ ID NO: 19277 - DNA, 1356 bp, Artificial Sequence
  Description of Artificial Sequence: Synthetic coding sequence
atgtttgacattgaatattttaggaaggatccacgccctttcttcaagttcgcgaaggagatctatccgggtcagttccagcccagtctgtgtcacaaatttatcgcactgagcgataaagagggcaagctactgcgaaattacacgcaaaacatcgacacactggagcaagtcgccggcatccagagaatcatacagtgtcacggatccttcgccaccgcctcctgtctaatttgcaagtataaggtggactgcgaagccgtccgtggcgacatttttaatcaggtagtacccaggtgcccacgatgcccagccgacgaaccattggccattatgaagcctgagatcgttttcttcggtgagaatcttccggagcagtttcatcgagcgatgaagtacgataaggatgaggttgacttgttaattgtgattggctccagcctgaaggtgcggccagttgccttgattccctcgtcaataccccacgaggtgccacagatcttgattaatcgggagcctcttcctcatctgcacttcgatgtcgagctgctcggcgactgcgatgtgataattaacgagctctgccatcgcctgggcggcgagtacgccaagctgtgctgcaatccggtgaagttaagcgaaatcacggagaagccacccagaacgcaaaaggagctggcctacctttcagagttaccccccactccgctgcatgtgagtgaggactcctcctcgcccgagcgaactagcccgccagacagctccgttatcgtgaccttgttggaccaggcagccaaatctaatgatgatctggatgtgagtgaaagcaaggggtgcatggaggagaagccacaggaggtccagacctcgcgtaatgtcgagagcattgcggagcagatggaaaacccggatctcaagaatgtgggctcctccacgggtgagaaaaatgagcgaacctctgtggccggaactgttcgcaagtgctggccaaaccgcgtggcaaaggaacaaatcagtcgaagattggatgggaaccagtatttgttcctcccgcccaatcggtacattttccacggagccgaggtctactcggatagtgaggatgatgtcctgtcctcctctagctgcggcagcaacagcgactcgggaacgtgtcagtcgccgagcctggaagagccgatggaagatgagtcagaaattgaggaattctataatggcctagaggatgagccagacgtgccggagcgcgccggcggcgccggctttgggactgacggggacgatcaggaagccataaatgaggccatatcggtgaaacaggaggtaacggacatgaactatccgtccaacaagagc

SEQ ID NO: 19278 - DNA, 1356 bp, Artificial Sequence
  Description of Artificial Sequence: Synthetic coding sequence
atgtttgacatcgaatactttagaaaagacccaaggccgttttttaagttcgccaaagaaatctacccagggcaattccagccatccctgtgccataagttcattgctctttccgacaaggaaggcaagctgctccgcaactatacgcaaaatattgacacactcgaacaagtcgccggcatacagcgcattattcaatgccacggctcttttgcgaccgcctcctgtctgatttgcaaatataaagttgactgcgaggcagtcagaggggatatattcaaccaggtggtcccgcgatgtccgcgatgcccagctgacgaaccactggctatcatgaagccagaaattgtgttcttcggagagaacttgcccgaacagtttcatagagcaatgaaatatgataaggatgaagtagacctgttaatcgtgataggctcttcacttaaagtgaggccagtggccttgattccaagcagcattcctcacgaagtccctcagattttgattaatagagaacctctgccacacctgcacttcgatgtcgaacttctgggtgactgcgacgtgatcatcaacgaattatgccataggcttggaggcgaatacgccaagctctgctgtaaccctgtcaaactctcagagatcaccgaaaaaccacccaggactcaaaaagagctggcttacctctctgaactcccacctaccccccttcacgtctcagaagactcgtcttctccagagagaacctctccccctgacagcagcgtgatcgtgactctgttggaccaggcagctaagtccaatgacgatctggatgttagcgaatccaaaggctgcatggaggagaagccacaggaagttcaaaccagccgcaacgtagagtccatagcggaacagatggaaaaccctgacctcaaaaacgtgggcagctctaccggtgaaaaaaatgaaaggacatcggtggctggaaccgtgaggaaatgttggccaaatagggttgccaaggagcagataagcagacgactcgatgggaaccaatacttatttctgcctccgaaccgttacatctttcacggcgctgaagtgtactcagactcagaggatgacgtcctgtcgagcagtagctgcggaagtaatagtgacagcgggacctgtcaaagcccaagcctggaggagccaatggaggatgagtctgagattgaagaattctacaacggactggaagacgagccggacgtgcctgaaagggcgggaggagctggattcggcacagacggcgacgatcaagaggccatcaacgaagcgataagcgttaagcaagaggtgaccgatatgaactatccaagcaacaagagc

SEQ ID NO: 19279 - DNA, 1356 bp, Artificial Sequence
  Description of Artificial Sequence: Synthetic coding sequence
atgtttgatatcgaatatttcaggaaagatccaagaccatttttcaagtttgcaaaggagatttatcctgggcagtttcagccatccttgtgccacaagtttatcgccctgtctgataaagaagggaaactgttgcggaattacacgcagaacatagataccttggaacaggtcgctggcatccagcgcatcatccaatgccatggaagctttgcgaccgccagctgcctcatctgcaaatataaggttgactgtgaggcggtccgaggggacatctttaatcaggtagttccgcgctgtccaaggtgtcctgcagacgaacccctggcgatcatgaagccagagatagtgttcttcggtgaaaatctgcccgaacagttccacagggctatgaagtacgacaaggatgaagtggacctgctgatcgtcattgggagctccctgaaagtgcggcctgtagccctgattccatcctccattccccacgaggttcctcagatactcattaaccgcgagccgctcccccatctccacttcgacgtagagctcctgggcgactgtgacgtgatcatcaatgagctgtgccaccggctgggtggcgaatatgcgaagctgtgttgtaatcccgtgaagctgtccgagataaccgagaaaccaccccgaactcagaaagagctggcttacctgagcgagttgcctcccactcccttgcacgttagtgaggattcttcttcccctgaacggacatctcctcctgacagcagcgtcattgtaaccctcctcgaccaggctgccaaaagtaatgacgatcttgacgtgagcgaatcaaagggttgcatggaggagaagccacaggaggtccagacttcccggaacgtagaatctatcgcggaacaaatggagaatcccgacctcaaaaacgtcggaagcagcacaggtgaaaaaaatgaaaggacatccgtggccgggactgttaggaaatgttggcccaatagggtggctaaggaacaaatcagtcgacggctcgacgggaaccaatatctcttcctgcccccaaataggtacatttttcatggagctgaagtctacagtgatagtgaggacgatgtcttgtcctctagttcctgcgggtccaactctgatagtggaacctgtcagagtccaagcctggaagagcccatggaagacgagtcagaaatcgaggagttctataatggactggaggacgagccagatgttccagagagagccggcggggcaggcttcggaaccgacggagatgatcaggaggccattaacgaagcaatatccgtgaaacaagaggttaccgacatgaactatccttccaacaagagc

SEQ ID NO: 19280 - DNA, 1356 bp, Artificial Sequence
  Description of Artificial Sequence: Synthetic coding sequence
atgttcgacatcgaatactttagaaaagatccgcgaccgttcttcaagttcgcaaaagaaatctacccgggtcagtttcaaccttcgctctgccataagttcatcgcactgtcagataaggaaggcaagctcctgcgcaactacacccagaacattgatacgctggaacaggtggcgggcatccagcggatcatccagtgccatggctcgttcgctaccgcgtcatgcttgatctgcaagtacaaagtggattgcgaggccgttcgcggagacatctttaatcaggtcgtgcccagatgtcctaggtgccctgcggacgaaccgctggcaattatgaagcccgagatcgtgttttttggcgagaacctgccggaacagtttcatcgggccatgaaatacgacaaggacgaagtggacctcctgatcgttattgggtcgtcgctgaaggtgcgccctgtcgcgctgatcccaagctcaatcccacacgaggtgccgcagatcctgatcaaccgcgaacctctgccacacctgcacttcgacgtggaattgctcggagactgtgatgtgatcatcaacgaattgtgccatagacttgggggcgagtatgccaaactgtgctgcaacccggtgaagctgtcggagattaccgagaaaccaccgagaacccaaaaagaactggcctacctgtcagagctccccccgacgccgctgcatgtctccgaggactcgagttcgcctgagaggacctccccgccggactcgtccgtgatcgtgaccctgctcgaccaagctgccaagagcaacgacgacctggacgtctcggagtccaagggatgcatggaagagaagccacaggaggttcagacttcgcggaatgtggaatcgatcgcggaacagatggaaaaccccgatctgaaaaatgtgggatcctccactggtgagaaaaacgaacgcactagcgtggcaggaactgtgagaaaatgctggcccaaccgcgtcgcgaaagagcagatctcccgacggttggacgggaaccagtacctgttcctgccgccaaaccggtacatcttccatggcgcagaagtgtactcagattccgaagatgacgtcctgagctcgtcgtcatgtggatccaattctgacagcggaacttgccaatcgccgtctctcgaggagccaatggaagatgaatcggagatcgaggagttttacaacggcttggaggacgaacctgatgtgcctgaacgcgcaggaggcgccggctttggcacggacggcgacgaccaggaagccatcaacgaggcgatctccgtgaagcaagaggtgactgatatgaactatccatcaaataagtcg

SEQ ID NO: 19281 - DNA, 1356 bp, Artificial Sequence
  Description of Artificial Sequence: Synthetic coding sequence
atgtttgacatcgagtacttccgcaaggacccgcggccgttcttcaaattcgcaaaggaaatctaccccggccaattccagcccagcctttgtcataagttcatcgctctgtccgacaaagaaggcaagctcctgcgcaactacactcaaaacatagatactctggagcaggtggccggcattcagagaatcatccagtgccacgggagtttcgctactgcgtcatgcttgatctgcaaatacaaggtcgactgcgaagccgtgcggggagacatcttcaaccaagtggttccacggtgcccgaggtgccctgccgacgaaccgctcgcaattatgaagccggagatcgtcttctttggcgagaacctccctgaacagttccacagagccatgaagtacgataaagacgaagtggacttgctcattgtgatcggatcctctctgaaggtccggccagtggcccttataccgtcctccatcccacatgaggtgccgcagatcctgatcaaccgcgaaccgctgccgcatctgcattttgacgtcgagctgctcggggactgcgacgtcatcatcaacgaactctgccacagacttgggggagagtacgccaagctctgttgtaaccccgtgaaattgagcgagattactgaaaagccaccgcgcactcaaaaggaactcgcttacctgtcggagctcccgcctactccactgcatgtgtctgaagattcgtcctcgccagaacgcacctccccaccagactcaagcgtcatcgttactctgctggatcaggcagcaaagtccaacgacgacctggatgtctccgagtccaagggctgcatggaagagaagcctcaggaagtccagaccagcagaaatgtggagtccatcgctgaacagatggaaaacccggatctgaagaatgtgggctcaagcaccggggaaaagaacgaacgcacttcggtggcgggcaccgttcggaagtgctggcctaaccgggtggcgaaagagcaaatctccagacgcctggacggtaaccagtacctgttcctccccccgaatcgctacatctttcatggggcggaagtctactcggatagtgaagatgacgtgctctcctcgagctcttgcggatcgaactcggatagcggaacttgccaaagcccgagcctcgaagaacccatggaggacgagtccgaaatcgaagaattctataatggactcgaagacgaacctgacgtcccagagagagccggtggagcaggtttcggaaccgacggagacgatcaggaagcaattaacgaagcaatctcagtgaaacaagaggttactgacatgaactacccgtcgaataagtca

SEQ ID NO: 19282 - DNA, 1356 bp, Artificial Sequence
  Description of Artificial Sequence: Synthetic coding sequence
atgtttgatatagaatattttcgtaaagatccgcgaccgttttttaaatttgcgaaagaaatatatccgggtcaatttcaaccgtcgttatgtcataaatttatagcgttatcggataaagaaggtaaattattacgtaattatacgcaaaatatagatacgctagaacaagtagcgggtatacaacgtataatacaatgtcatggttcgtttgcgacggcgtcgtgtctaatatgtaaatataaagtagattgtgaagcggttcgtggtgatatatttaatcaagttgttccgcgttgtccgcgatgtccggcggatgaaccgttagcgataatgaaaccggaaatagtattttttggtgaaaatctaccggaacaatttcatcgagcgatgaaatatgataaagatgaagtagatctattaatagttataggttcgtcgttaaaagttcgtccggttgcgctaataccgtcgtcgataccgcatgaagtaccgcaaatattaataaatcgagaaccgctaccgcatctacattttgatgtagaactattaggtgattgtgatgtaataataaatgaattatgtcatcgactaggtggtgaatatgcgaaactatgttgtaatccggttaaactatcggaaataacggaaaaaccgccgcgtacgcaaaaagaattagcgtatctatcggaactaccgccgacgccgctacatgtatcggaagattcgtcgtcgccggaacgaacgtcgccgccggattcgtcggttatagtaacgttattagatcaagcggcgaaatcgaatgatgatctagatgtttcggaatcgaaaggttgtatggaagaaaaaccgcaagaagttcaaacgtcgcgaaatgtagaatcgatagcggaacaaatggaaaatccggatctaaaaaatgtaggttcgtcgacgggtgaaaaaaatgaacgaacgtcggtagcgggtacggtacgaaaatgttggccgaatcgtgtagcgaaagaacaaatatcgcgtcgactagatggtaatcaatatctatttttaccgccgaatcgttatatatttcatggtgcggaagtttattcggattcggaagatgatgttttatcgtcgtcgtcgtgtggttcgaattcggattcgggtacgtgtcaatcgccgtcgctagaagaaccgatggaagatgaatcggaaatagaagaattttataatggtttagaagatgaaccggatgtaccggaacgtgcgggtggtgcgggttttggtacggatggtgatgatcaagaagcgataaatgaagcgatatcggttaaacaagaagtaacggatatgaattatccgtcgaataaatcg

SEQ ID NO: 19283 - DNA, 1356 bp, Artificial Sequence
  Description of Artificial Sequence: Synthetic coding sequence
atgttcgacatcgagtacttccggaaggacccgcgccccttcttcaaattcgctaaagaaatctacccgggacagttccagccgtcactgtgccacaagttcatcgcactgtccgataaggaaggtaagctgctgcgcaactacactcaaaacatcgatacgttggaacaggtggccggaatccagcggattatccagtgtcatgggagctttgccactgcgagctgcctgatctgtaaatacaaggtcgattgcgaagcggtgcggggcgatatcttcaaccaagtggtgccacggtgcccgaggtgccccgccgacgagcccctcgccatcatgaagccagagatcgtgttcttcggggaaaacctgcctgaacaattccaccgcgccatgaagtacgataaggacgaagtcgacctgctcatcgtgatcggatcgagcttgaaagtccggccagttgcacttatcccgtccagcattccgcacgaagtgcctcagatcctgatcaaccgcgagccattgccacacctgcatttcgatgttgaactgcttggagactgcgacgtcattatcaatgagttgtgccacagactcggaggcgagtacgcaaagctgtgctgtaacccagtcaagctctcggaaatcactgaaaagccaccgcggacccagaaggagctcgcgtacctgtcggaactccctccgactccgctccatgtctccgaggactcgagctcccctgaacgcacttcgccgcctgactcgagcgttatcgtgactcttctggatcaggcggccaagtctaacgacgatctcgatgtgtccgagtcgaagggatgcatggaagagaaaccgcaggaggtccagacctccagaaacgtcgagagcattgccgaacaaatggaaaaccccgatctgaagaatgtcggatcctccactggggaaaagaacgagcggacctcggtggccggcactgtgcgcaaatgttggccgaatcgcgtcgcgaaagaacagatctcaaggcgcctggatggaaatcaatacctgtttctgccgcctaatcgttacatcttccacggcgcagaggtgtactccgattcggaggatgatgtgctctcaagctcttcgtgtggttcgaactcggactcgggtacctgccaaagcccgtctctcgaagagccgatggaggacgagtccgagatcgaggagttttacaacggtctggaagatgaaccagacgtgcccgagcgcgcggggggagcaggattcgggactgacggtgacgaccaggaagcgatcaacgaggcaatctcggtgaagcaggaagtgacggacatgaactacccctcgaataagtcg

SEQ ID NO: 19284 - DNA, 1356 bp, Artificial Sequence
  Description of Artificial Sequence: Synthetic coding sequence
atgttcgacatcgaatatttccggaaggatcctaggccattctttaagtttgccaaagagatctatcctgggcaattccaaccttcactgtgccacaagtttatcgcgctcagcgacaaggaggggaagttactgagaaactacacacagaacatagatacattagagcaagtcgcgggtatacaacggattatccagtgccatgggtcctttgccaccgctagttgcctgatttgcaagtacaaagtggactgtgaagctgtcaggggcgatatttttaaccaggtggtgccccgatgcccaaggtgccccgctgatgagcccctcgcaattatgaaaccagagatcgtgtttttcggagaaaatctgccggaacaattccaccgcgccatgaagtacgataaagacgaggtggatttgctgattgtaatcgggagctccttgaaagtccggcccgtagccctcattccctctagcatacctcatgaagtcccacaaatcctgatcaatcgggagcccttgcctcacctccactttgacgttgagctgctgggggattgtgatgtgatcattaatgaattgtgccaccggctgggtggggagtatgccaaactctgctgtaatccagtgaaattatccgaaataaccgagaagcccccacgaacacaaaaagagctggcctatctgagcgagctcccccctacacctctgcacgtctcagaggactctagttctcctgagcgcacttccccacccgactcatcagtgatagttactctgttagaccaggcagctaaatcaaatgacgatctcgatgtgtcagaatcgaaggggtgtatggaagagaagccacaggaagtacaaacttcccgaaatgtggaaagcattgccgagcaaatggaaaatccagatttgaagaacgtaggctcttccaccggtgagaagaacgagcgcacatctgtcgccggaaccgttagaaagtgttggccgaatcgggtggcgaaggaacaaatatcgcgacgactggacggcaatcagtatcttttcctaccccccaatagatacatctttcatggcgccgaagtgtattcggactctgaggacgatgtattgtcttccagttcatgtggtagcaactcagattccgggacatgtcagtcccccagcctcgaagaacccatggaagacgaaagcgagatcgaggagttctataacggacttgaggacgagccagacgtgccagaaagagctggaggcgccggttttggaaccgacggggatgatcaggaggctataaatgaagcgatcagcgtgaaacaggaagtaacagatatgaattatccctcgaataaatca

SEQ ID NO: 19285 - DNA, 1356 bp, Artificial Sequence
  Description of Artificial Sequence: Synthetic coding sequence
atgttcgacatagaatactttagaaaagaccccaggccctttttcaagtttgccaaggagatctacccaggccagttccagcccagcctgtgccacaaatttattgccctgagtgacaaggaaggaaagctgcttcgtaattatacccaaaacatagatacattagaacaggtagctggcattcagcggattattcagtgtcacggctcgtttgctacagcctcctgcctcatttgtaaatacaaggttgattgcgaggcagtgagaggagacatattcaaccaagtggtgcctagatgtccccgctgccccgccgacgagcctttggccattatgaagcctgaaatcgtcttctttggagaaaacctcccggaacagttccaccgcgccatgaagtatgacaaggatgaagttgaccttctgattgtgatcgggtcatccctaaaagtacgaccagtagcactgattccttcttccatccctcacgaggtgccccagatcctaattaaccgggagccactgccccacctccacttcgatgtggagctccttggggactgtgatgtgataattaatgaactgtgccacaggctggggggggagtatgccaagctgtgctgtaaccccgtgaaattatcagagattaccgagaagccgcctcggacacagaaggaacttgcttatctcagtgagttgccccctacaccgctgcatgtatctgaggatagctcctcccctgaacgaacttcaccccctgattcctccgtgatcgtcactttgctggatcaggccgccaaaagcaatgacgacctcgacgtctcagaaagcaaagggtgcatggaggaaaaaccgcaggaagtacaaacatcccgcaatgtggagtccatagcggagcaaatggaaaacccagaccttaagaacgttgggagcagtaccggggaaaaaaacgaacgcaccagcgtggcgggaaccgtgagaaagtgttggccgaatcgggtggctaaggagcagataagcaggcgattggatgggaatcagtacctgttcctgccacctaataggtacatttttcatggcgccgaagtatatagtgatagcgaagacgatgtgcttagtagcagctcctgtggcagcaattcggactctgggacctgtcagtctccaagcctcgaagagccaatggaggatgagtcagagatagaagaattttataacggcctcgaggacgaaccagacgtacccgagagagctggtggtgccggattcggaacggacggcgatgaccaggaagcaatcaacgaagcaatcagtgtaaagcaggaggttaccgatatgaattatccatctaacaaatct

SEQ ID NO: 19286 - DNA, 1356 bp, Artificial Sequence
  Description of Artificial Sequence: Synthetic coding sequence
atgttcgatatcgagtacttcaggaaagatcccaggccattttttaaatttgcaaaggaaatctaccctgggcagtttcaacctagcctgtgccacaagtttatagcgctgagcgacaaggaaggcaagttgctcaggaattacacacagaacattgacaccctggagcaggtagccggcatccagcgcatcatacaatgccatggcagcttcgccacagctagctgcctcatctgcaagtacaaagtggattgcgaggctgtgcggggggacatctttaatcaggtggtaccgaggtgtcctagatgtccggccgacgagcctttggccatcatgaagcccgaaattgtttttttcggagaaaatctgcccgagcagttccatagggcaatgaaatatgacaaggacgaggtggacctgcttattgtgattggttctagcctcaaagtgagacctgtggcacttatcccatcgtctatcccccatgaagttccacagattctcattaatcgcgagccgttgccccacttgcacttcgacgttgagctcctcggagattgtgatgtgattattaatgaattatgccacagactcggaggggagtatgccaagctttgctgtaatcctgtgaagttgtctgagattactgaaaagcctcctaggacacagaaggagctcgcatatctttccgagctccctcccacaccgctgcacgtcagtgaggattcttccagcccagaacgcactagcccacccgattcctccgtcattgtcaccttgctggatcaggccgcaaaaagtaacgatgatctagatgtgagtgagagcaaagggtgtatggaggaaaagcctcaagaggttcagacctctcgtaatgtggagtccattgcagagcaaatggaaaaccccgatttgaagaatgtaggcagcagtactggagagaagaatgagcggacttcggtggccgggaccgtgcggaaatgctggccaaatcgtgtggcgaaggagcaaatctctcgacgcttagacggaaatcagtacctcttcttgcctcctaatcggtatattttccatggcgctgaggtctatagcgattctgaggacgatgttctttcatccagttcatgtggcagcaactcagacagcggcacgtgtcagtctccatccctcgaagagcctatggaggacgagtcggagattgaggagttctacaatgggctggaggatgagcctgacgtccctgaacgcgctggtggagcggggtttggtactgacggtgatgaccaggaagctattaacgaagccatctcagtaaagcaggaggtcaccgatatgaactaccccagcaacaagagc

SEQ ID NO: 19287 - DNA, 1356 bp, Artificial Sequence
  Description of Artificial Sequence: Synthetic coding sequence
atgttcgatatcgagtatttccggaaagatcccaggccttttttcaaatttgctaaggaaatttacccaggacagttccagccatccctgtgccacaaattcattgccctttctgacaaagaaggtaaacttctgcggaattacacgcagaatatcgatacgctggaacaggtcgctggaatccagcggataattcagtgtcacgggagtttcgcgacggcaagctgtctgatctgcaagtacaaggtggactgtgaggccgtaagaggagatattttcaatcaagttgtaccacgctgcccacgatgccccgcagacgagccgctggccatcatgaaaccggagatcgttttctttggcgagaatcttcctgagcaattccaccgcgccatgaagtatgataaggacgaagtggatctgttgattgtgattggcagctccttgaaggttcgacctgtagcgctgattccttcatcaataccgcacgaggtaccgcagattctaatcaaccgcgagccgctgccacacctccactttgatgtggaacttctgggagattgcgacgtgataattaacgagctttgtcaccgtctcggaggagaatatgccaagctttgctgcaaccctgtcaaattaagcgagatcactgaaaagcctccacggacccagaaagagttagcttacttaagcgagcttccacccaccccccttcatgtgtctgaagattcgtcctcccccgagaggaccagtcccccagactccagcgtcatcgttacactgcttgatcaggcagccaaatccaatgacgacctggatgttagcgaatcaaagggctgtatggaggaaaagccacaggaagttcagaccagccgtaacgtggagtccattgccgaacagatggagaacccagatcttaaaaatgtgggctcttccactggagaaaagaacgagagaacctccgtggctgggaccgtgcggaagtgttggcccaaccgcgttgctaaggagcagattagtagacgcctggacgggaaccagtacctttttctcccacccaacaggtatatctttcacggagctgaagtgtacagcgactcggaagacgacgtgctgtcctcttcaagctgtggcagcaattctgattctgggacatgtcagagcccaagcctggaggagcccatggaggacgagtccgaaattgaagagttctacaacggtttggaggacgagccagacgtccccgagagggctggtggcgcagggtttggtacggacggggacgatcaggaagccatcaatgaagccattagcgttaaacaggaagtgaccgatatgaactacccctctaacaagagt

SEQ ID NO: 19288 - DNA, 1356 bp, Artificial Sequence
  Description of Artificial Sequence: Synthetic coding sequence
atgttcgatatcgagtattttcgcaaggacccccggcctttctttaagttcgccaaagaaatctatccaggccaatttcagccttcgctgtgtcacaagttcattgcgctgtcagataaggagggaaaactcctccgcaattatactcagaatattgacacccttgaacaggttgccggcattcaacgaatcatccagtgtcatgggtcctttgccaccgcttcatgtttgatctgcaagtataaggttgattgtgaagccgttcggggagacattttcaaccaggtcgtacccaggtgtcctaggtgccccgccgacgagccgctggctattatgaagcctgagatagtgttctttggggagaacctgcctgaacagttccaccgggccatgaagtatgacaaagatgaggtggatctattgatcgtcatcggctcttctctcaaggtgaggcctgtcgccctgattccctcaagcatcccccacgaggttccacagattctgataaacagagagcctttacctcacctacatttcgacgtggagctactgggcgactgcgacgtaatcatcaacgaattgtgtcaccgattaggtggagaatatgccaagctgtgctgcaatccagtgaagctgtccgagatcacagaaaagcccccaaggacacagaaggaactggcctatctgtcggaactgccacctacaccattgcacgtgagcgaggatagtagtagtcccgaaagaacctctcccccggacagctcagtcatcgtcacccttctcgaccaggcagctaaatccaatgatgacctggacgtgtccgagtccaaggggtgcatggaggagaagccccaggaggtccaaaccagtagaaatgtcgagtccattgccgaacaaatggagaacccggatctgaaaaatgtggggagtagcacgggtgaaaagaacgaacgaacttcagtggccgggactgtaaggaagtgctggcccaaccgagttgccaaagagcaaatttcccgaagactagatggtaaccagtacttatttctgccaccgaacaggtacattttccatggcgccgaagtttactccgacagcgaagatgacgttctgagctccagttcttgcggctcaaatagtgactctggcacttgtcaaagccctagcctggaagagcctatggaggatgaatccgaaatcgaggagttttacaatggtctggaagatgaacccgatgtgccggaaagagctggaggagccggcttcggaacagacggagatgatcaggaagctataaatgaggcaatatccgtcaagcaagaggtgaccgacatgaactatccatctaacaagagt

SEQ ID NO: 19289 - DNA, 1356 bp, Artificial Sequence
  Description of Artificial Sequence: Synthetic coding sequence
atgtttgatatcgagtacttcaggaaggatccacggccgttcttcaaattcgccaaggagatctatcccggccagtttcagccgagcctgtgtcacaaattcatcgccctctcggacaaggagggcaagctgctgcgcaattacacccagaacatcgacactctggagcaggtggcgggcatccagcgcatcatccaatgtcacggatccttcgcgaccgcctcttgccttatctgcaagtacaaggtggattgcgaagccgtccgtggggatatctttaatcaagtagtgccgcggtgccctcggtgccccgcggatgaaccactggcgattatgaagccagagatcgtgttcttcggcgaaaacctcccggagcagttccacagagcaatgaagtacgataaggacgaggtggacctcctgatcgtgatcggatcctcactgaaagtgcgcccggtggctttgatcccaagctccatcccgcatgaagtgccgcagatcctcatcaaccgcgaacctctgcctcacctgcatttcgacgtggaacttcttggcgactgtgacgtgatcatcaatgagctgtgccaccggcttggaggagaatacgcaaagctgtgctgtaatccagtcaaactgtcggaaatcacggaaaaaccaccgagaacccagaaggagcttgcgtacctgtcagaacttcctccaaccccgctgcacgtgagcgaggactcatccagccctgagcgcacgagcccgccggattcgtcggttatagtcaccctcctggaccaagccgccaagtctaacgatgacctggatgtgagcgaatcaaagggatgcatggaagagaagcctcaggaggtgcagacttcgaggaacgtcgaatcaatcgcagaacaaatggagaacccggatctgaagaacgtgggatcgtccaccggagaaaagaatgagcggacctcggtggccggaactgtgcgcaagtgctggcctaaccgcgtggcaaaagagcaaatctcccgccgcttggacgggaaccagtacctgtttctgccccccaatcggtacattttccatggcgctgaagtctactccgattccgaggacgacgtgctcagttcgtcatcgtgcggctcgaattcggattccggaacctgccagagcccgtcactggaagagccgatggaggacgagtcggagatcgaagaattctataacggactggaggacgagcccgacgtacctgagcgggcgggtggcgctggattcggcaccgatggtgacgatcaagaagccatcaatgaagcgatttcggtgaaacaagaggtgactgacatgaactacccgtctaacaagtct

SEQ ID NO: 19290 - DNA, 1356 bp, Artificial Sequence
  Description of Artificial Sequence: Synthetic coding sequence
atgttcgatattgagtattttagaaaggatcctaggcctttcttcaagttcgccaaggaaatctatccgggacaattccaacctagcctctgccataagttcatcgcattgtctgacaaggagggtaagctgcttcgcaactacacgcagaatattgacaccctggaacaggtggcgggtattcagcggatcattcagtgccacggttctttcgctactgcttcgtgcttgatttgcaagtataaagtcgattgtgaggctgtgcggggggacatttttaaccaggtggtgccgcggtgcccgcggtgccctgctgacgaacctctagctattatgaagccggagatcgtgttctttggagaaaatctccctgagcagttccatagggcaatgaagtacgataaggatgaggtggacctgcttatcgtaatcggaagctccctgaaagtccgccctgtggctctaatacctagcagcattcctcatgaagtcccacaaatcttgatcaaccgggagccgttaccacaccttcacttcgatgttgagcttctaggagattgcgatgtgataatcaacgagctgtgccaccgccttggaggagaatatgccaagttgtgctgtaacccagtgaagttatcagaaattaccgagaaacctccaagaactcagaaggagctagcgtacctgagcgagttgccacccaccccgctgcacgtctcggaagacagctcatctcccgagagaacatcgccgccagattcgtcggtgattgtaacactgctcgaccaggccgccaagagcaatgatgatctggatgtgagcgagagtaagggctgcatggaggagaagccccaagaagtccagacaagtcggaatgtcgagtccatcgctgagcagatggagaatccagatctgaagaatgtgggctcgtccacaggagagaaaaatgaaagaacctccgttgctgggacagtgagaaagtgctggccaaatcgagtagcaaaggagcagatttctagacgtctggacgggaaccagtatctcttcctgccacccaatcgatacatatttcacggtgctgaggtgtattctgacagcgaggatgatgtccttagctctagctcctgcggaagcaactcagactctgggacttgtcagtccccctcactagaagagcccatggaggacgaatcagagatcgaagaattctacaacgggctggaagacgaacccgacgtccctgaacgcgctgggggcgcaggtttcggaacggacggagatgaccaggaagctattaacgaagctatcagcgttaaacaagaggttactgatatgaactacccctcaaataagtcc

SEQ ID NO: 19291 - DNA, 1356 bp, Artificial Sequence
  Description of Artificial Sequence: Synthetic coding sequence
atgttcgatatcgagtactttcgcaaggaccctaggccgttctttaagtttgccaaggaaatctacccaggtcaatttcagccatccttgtgccataagttcatcgccttgagcgataaggagggaaagttgctgagaaactatacacagaatatagatacactggaacaggtagcaggaatccagcggataatccaatgccacggctctttcgcgacggcttcgtgcttgatatgtaagtacaaagttgactgtgaggcagtgaggggcgacatttttaaccaggtggtgccccgatgccccaggtgtcccgcggatgagccacttgcgatcatgaagcctgaaattgtgttcttcggtgaaaatctgcccgaacagttccatagagcaatgaagtacgacaaagatgaggtcgatcttctgatcgttatcgggtcctctctgaaggtgcgcccagtagccctgataccttcgagtattccccacgaggtgccacagattctcattaaccgagagcctcttccgcacctgcattttgacgttgagctgctcggcgactgcgacgtcatcataaatgaactgtgtcataggctcggcggagaatatgccaagctatgctgcaatcccgtcaaactttcagaaatcaccgagaagccacctcgcacccagaaagaattggcttacctttccgagctacctccaacccctctgcatgtaagcgaagactcatcatctcccgagcgaacgagccctcctgactcatcagtgatcgtgacactgcttgatcaggctgctaaaagtaacgacgatttagacgtctctgagtcgaaaggatgtatggaagagaagcctcaagaggtacaaacatcccgcaatgttgagagtattgcagagcaaatggagaatcctgatttgaagaacgtagggtcttctaccggcgagaaaaatgagcgcacatcagtagctgggacagttcggaagtgctggccgaatagggtggccaaggagcagatcagccggaggctggacggcaatcagtacctgttcttgccccctaacagatacatttttcatggagcggaggtgtattcagattccgaagatgacgttctctccagcagcagttgtggcagtaatagcgactccggcacctgccagtcgcccagtctggaggagcccatggaggatgaaagcgaaatagaagagttttataacggtcttgaagatgagcccgatgtcccggagagggccgggggggctggattcggaaccgatggggacgatcaggaggcgattaacgaagccatttcagtaaaacaggaagtgactgacatgaactaccccagcaacaagtct

SEQ ID NO: 19292 - DNA, 1356 bp, Artificial Sequence
  Description of Artificial Sequence: Synthetic coding sequence
atgttcgatatagagtactttcgcaaggatccaaggcctttcttcaaatttgccaaggaaatctaccccggacagttccagccgagtctctgccacaagttcatcgctctgagcgacaaggagggaaagttgctgcgtaactatacccagaacatcgatactctcgagcaggtcgcggggatccagcgcatcattcagtgccatgggtctttcgccaccgctagttgcctgatctgtaagtataaagtggactgcgaagccgtccgtggagacatctttaaccaggtcgtcccccggtgtccccgatgccccgctgatgagcctctcgcgatcatgaagcccgaaatcgtcttcttcggcgagaacttgcccgaacagttccatcgtgcaatgaagtacgacaaggacgaggtcgacttgcttatcgtcattggttcctctctcaaggtacggcccgtggccttgatccctagttcgatcccccatgaggtgccgcaaatactcatcaaccgtgagcctttgccgcatttgcacttcgacgtcgagctgctaggcgactgcgacgtgattattaacgagctctgtcatcgccttggaggtgagtatgctaagctgtgttgtaacccggtgaagctctcggagattacggagaagccccctcgtacccagaaggaactcgcctacctcagcgagctgccacccacaccgctgcacgtcagcgaggactccagctcgcccgagcgaacgtcgcctcctgatagttctgtcatcgttacgctgctcgatcaggccgctaagagtaacgatgaccttgacgtgagtgagtccaagggttgcatggaggagaagccccaggaggtccagaccagccgaaacgttgaatctatcgccgagcagatggagaaccccgatctcaagaacgtcggtagctctaccggcgagaagaatgaacgtactagtgtggcaggcaccgtccgcaagtgctggcccaaccgtgtggcgaaggagcaaatctcgcgacgtctggatggtaatcaatacctcttcctcccgcccaacaggtacatcttccatggtgcggaggtgtacagtgattcggaagacgatgtcttgtctagcagtagttgtggctcgaactccgatagcggcacgtgccaatctccgagtctggaggagcccatggaggatgagtccgagatcgaggaattctacaacggtttggaggatgaacccgacgtaccagaacgcgccggcggcgctggattcgggactgatggtgatgaccaagaggcgatcaacgaagccatctccgtgaagcaagaagtcacagacatgaattatccttctaacaagtcg

SEQ ID NO: 19293 - DNA, 1356 bp, Artificial Sequence
  Description of Artificial Sequence: Synthetic coding sequence
atgttcgatattgaatactttagaaaggatccccgtccgttcttcaaattcgcaaaggaaatctatcccggccaattccaaccgtcgctttgtcacaaattcattgcccttagcgataaggaaggcaaacttctgagaaactacacccaaaacatagataccttggaacaagtcgcaggtattcagaggattattcaatgtcatggttccttcgccacggcatcatgcctgatctgcaaatacaaagtggattgtgaagcggtccgcggcgatatcttcaaccaagtggtcccacggtgtcctaggtgccctgcagatgaaccgctggcaattatgaagcctgaaattgtgttttttggtgaaaaccttccggaacagttccaccgggccatgaaatacgataaagacgaagtcgatctgcttatcgtaatcggtagttcgctgaaagtgaggcctgtggcactcattccatcctcgatcccccatgaggtccctcagattttgataaacagagaacctctgcctcatctgcattttgacgtggaacttctcggagactgtgatgtgatcattaacgagctctgtcacagacttggtggagagtacgccaaactttgttgtaatcctgtgaagctgtcggagatcactgaaaagcccccgcgcactcaaaaagaactcgcgtacctttccgaacttccccctactcctctgcatgtgtctgaagattcctcctcgccagaacggacttccccgccagattcctctgtcattgtcactcttttggatcaagccgcaaagtccaacgacgacctggacgtctcggagtccaaaggttgtatggaggagaaaccacaggaagtgcaaaccagccggaacgtggagtccatcgccgaacagatggagaaccctgatctgaaaaatgtgggttcgtcgacgggtgaaaagaacgagaggacttcagtggcaggcaccgtgcgaaagtgttggcctaatagagtcgctaaggagcagatatccagacgccttgacggaaatcaatacttgttcctgccacctaacagatacatctttcatggcgcagaagtgtactcagatagcgaggatgacgtgttgtcatcaagcagctgcggatcgaactcggatagcggcacttgccagtccccttctcttgaagaacctatggaggacgaatcagaaattgaagagttttacaacggactggaggacgagcccgatgtgccggaacgggccggaggggcaggattcgggactgatggagacgatcaggaagccattaatgaagcaatttcagtcaagcaggaggtgacggatatgaattacccttccaataagagc

SEQ ID NO: 19294 - DNA, 1356 bp, Artificial Sequence
  Description of Artificial Sequence: Synthetic coding sequence
atgttcgacattgaatactttcgcaaggacccacggccttttttcaaatttgccaaggagatttatcctggacaatttcagccatccctgtgtcacaagtttattgccctgtcggataaggagggaaagttgcttaggaactatacacaaaacattgatactctggagcaggtcgcaggcatccagaggattatacaatgtcatggctccttcgctacagcaagttgcctgatttgcaagtataaggtggattgcgaagcggtgcggggagacatattcaaccaggtagtgccccgatgcccgaggtgcccggccgatgaaccgctggcaattatgaagccagaaatcgttttcttcggtgagaacttgcccgagcagtttcaccgagccatgaaatatgacaaagacgaggtggacttgctaatcgtcattggatccagcctgaaagtgcggccagtggcattgatcccatccagcatcccacatgaggtgcctcagattttaatcaatcgggagcccttgcctcacctccacttcgatgttgagcttctaggggactgtgatgtcatcatcaacgagctatgtcatcggctcgggggagagtacgccaagctgtgctgcaaccccgtaaaactgtcggagattactgagaaaccccctcgaacccagaaggaattagcctacctttcagaactgcccccaactccactccacgtctctgaggattccagcagccccgagaggacatccccaccagacagctcagtaattgtgaccctgctcgaccaagctgccaagagcaacgatgacttggatgtaagcgaaagtaaaggctgtatggaggaaaagccccaggaggtccaaacgtcacgaaatgtggaatcaatcgccgaacaaatggagaaccctgatctgaagaatgttggaagtagcaccggcgagaagaacgaacggacttcagtcgcaggaaccgttaggaaatgttggcctaatcgggtggcgaaagagcagatttcacggcgcctggatggaaaccaatatctgttcctgccgccaaacagatacattttccatggagccgaggtgtatagtgacagcgaggacgacgttctcagttccagcagctgcggatctaacagcgactctggcacttgccagtcaccaagcctggaagaacccatggaggacgagtcggaaatcgaggaattctataacgggctggaggacgaaccggatgtcccggaaagagcagggggcgccggctttggtaccgacggcgacgaccaggaagccattaacgaggcgatctccgtgaaacaggaggtcacagacatgaactatcccagcaataaatca

SEQ ID NO: 19295 - DNA, 1356 bp, Artificial Sequence
  Description of Artificial Sequence: Synthetic coding sequence
atgtttgacattgaatactttagaaaagaccccagaccattcttcaagttcgcgaaggagatctatcccggccagtttcagccctccctctgccacaaattcattgctctcagcgacaaggaaggaaagttgctgaggaactatactcagaatatcgacactctggagcaagtggcaggaattcaacgcataattcagtgtcatggctccttcgccactgcgagctgccttatttgtaagtataaggtcgactgcgaggctgttcggggtgacatctttaatcaggtcgtcccacgctgccctagatgtccggcagacgagcctctggctataatgaagcccgagattgtcttcttcggtgagaatttaccggaacaatttcaccgcgccatgaaatatgacaaggatgaggtggacctgctgattgttattgggtcctctctcaaagttcgacctgtggccttgatcccttcaagcattccccatgaagtcccacagattctaattaatagagagcctctcccccatctgcacttcgacgtcgaactgctcggggactgcgacgtgatcattaacgagctgtgccatagattgggtggagagtacgccaagctgtgctgtaatcccgtgaagctgtcagagattactgaaaagccaccaagaacccagaaagagctggcctatctgtccgagttgcctcctactcctctgcacgtctcagaagattcttcatccccagagcgcaccagcccacctgactctagtgtgatcgtaacgttactcgaccaggccgccaaaagtaacgatgatctggacgtgtctgaaagcaagggatgtatggaagaaaaacctcaggaagtgcagacttctagaaacgtggagtctatcgccgaacagatggagaacccggatctgaagaatgtcggtagttccaccggggaaaagaacgagcgcacaagtgtggctggaaccgtcaggaagtgctggccaaatcgagtggcgaaggagcagatttcgcgccgcctggatggaaaccagtatctgtttctcccgcctaatagatacatatttcatggagcggaagtgtattctgattcagaggacgacgtcttgagttcttccagctgcgggagtaattccgacagcgggacctgccaatcaccttccctggaggagcctatggaggatgaatctgaaatcgaggaattttacaacggcctggaggatgaacctgacgttccagagagagccgggggcgctggcttcggaactgacggggacgaccaggaagccattaacgaggccatatccgttaaacaggaggtcaccgacatgaactacccatctaacaaatcc

SEQ ID NO: 19296 - DNA, 1356 bp, Artificial Sequence; identical to SEQ ID NO: 19257
  Description of Artificial Sequence: Synthetic coding sequence

SEQ ID NO: 19297 - DNA, 1356 bp, Artificial Sequence
  Description of Artificial Sequence: Synthetic coding sequence
atgttcgacatcgagtacttcagaaaggacccgcgtccattctttaagttcgcgaaggagatttaccctggccagttccagccttctctctgccataagttcatcgctctgtcagacaaggagggaaagctgctgcggaattacacccaaaacatcgacaccctggaacaagtcgccggaattcaacgcattatccagtgtcatggctcgttcgcaactgcatcttgcctcatctgcaaatacaaggtagattgtgaagcggtgagaggagacatctttaaccaagtggtccctaggtgcccccggtgtcctgcagacgaaccacttgccatcatgaaaccagaaattgtattcttcggagagaatctcccggagcagttccacagagctatgaaatacgataaggatgaagtggacctcctgatcgtgatcggatcctccctgaaggtgcgccccgttgccctgatcccatcatccatcccgcacgaagtgccgcaaatcctcatcaaccgtgagccgcttccacacctgcattttgacgttgaattgctgggagactgcgatgtcattatcaacgaactctgccaccggttggggggagaatacgcgaagctgtgctgcaacccggtcaaactgtccgaaattacggagaagccgccacgcacccagaaggaattggcgtacctgtctgaactcccaccgactccgcttcacgtgtcggaggactcatcgtcccctgagaggactagcccgccggactcctcagtaatcgtgaccttgctggatcaagccgctaagtcgaacgatgacctcgatgtcagtgagtccaagggttgcatggaggaaaagccacaggaggtgcagacctcgcggaacgtggagagcatcgcggagcagatggagaacccagacctgaaaaacgtgggttcctcaactggagagaagaacgaacgcacttcagtggccgggacggtgagaaaatgttggcctaatcgggtggctaaagaacaaatctcgcgacgcttggacggcaaccagtacctcttcctcccgccgaatcgctacatctttcatggcgccgaagtgtactccgattctgaagatgatgtgctgtcgtcatcctcatgcggatcaaacagtgactcaggaacctgccagtcgccctcgctcgaggaacctatggaggacgaaagcgaaatcgaggaattctacaatgggctcgaggatgaaccggatgtcccagaacgggccggcggtgcaggctttggaactgatggggacgaccaggaagccataaatgaggccatctcggtcaagcaggaggtgaccgacatgaattatccctccaacaaatcg

SEQ ID NO: 19298 - DNA, 1065 bp, Artificial Sequence
  Description of Artificial Sequence: Synthetic coding sequence
atgagcgtgaactacgccgccggtctgagcccatatgctgataagggcaagtgcggactgccagagatctttgaccctcccgaagaactggagagaaaggtctgggagttagctagactagtctggcaaagttcctccgtggtctttcacaccggagccggcatctccaccgctagcggtattcccgactttagaggtccccacggggtatggacgatggaagaacgcggcctcgcccccaaattcgatacaactttcgagagcgcccgacccacgcagactcatatggctctggtgcaattggaacgcgtggggctcctcaggttcttggtgtctcagaacgtggatggtctgcacgtcagatccggcttcccccgagacaagctggcagagctccacgggaatatgtttgtcgaggagtgcgcaaagtgtaagacacagtacgtacgagataccgttgtgggtaccatggggctgaaggcaaccggtagactctgtacggtcgccaaagccagaggtttacgggcatgtcgaggcgagttgcgggatacaatccttgactgggaagattctctgcccgatagggatctggccctggcagatgaggcgagtcgaaatgcggatctctctattaccctcggcaccagcctacagatacggcccagcggcaacttacctctggctactaaacgccgtggcggaagattggtgatcgtcaacctgcagccaactaagcacgataggcacgctgaccttagaattcatggatatgttgatgaggttatgacaagactgatgaagcacctaggactcgaaattcccgcctgggatggacctagggtgttggaacgagccttgccaccccttccccgccctccaactcccaagctcgagcctaaggaagagtctcccactaggatcaatggatcaattcctgccggccccaaacaggagccctgtgcccagcataacgggtcggagccggctagcccaaaacgggagagacccactagccccgctccccatagaccacccaagcgggtgaaggcgaaggccgtgccatcg

SEQ ID NO: 19299 - DNA, 1065 bp, Artificial Sequence
  Description of Artificial Sequence: Synthetic coding sequence
atgtcggtaaattatgcggcgggtttatcgccgtatgcggataaaggtaaatgtggtctaccggaaatatttgatccgccggaagaactagaacgtaaagtatgggaattagcgcgtttagtatggcaatcgtcgtcggttgtatttcatacgggtgcgggtatatcgacggcgtcgggtataccggattttcgtggtccgcatggtgtatggacgatggaagaacgaggtttagcgccgaaatttgatacgacgtttgaatcggcgcgtccgacgcaaacgcatatggcgttagtacaattagaacgtgtaggtttattacgttttttagtttcgcaaaatgtagatggtttacatgtacgttcgggttttccgcgtgataaactagcggaattacatggtaatatgtttgttgaagaatgtgcgaaatgtaaaacgcaatatgttcgtgatacggtagtaggtacgatgggtttaaaagcgacgggtcgactatgtacggttgcgaaagcgcgtggtttacgtgcgtgtcgtggtgaactacgagatacgatattagattgggaagattcgttaccggatcgagatctagcgttagcggatgaagcgtcgcgtaatgcggatctatcgataacgttaggtacgtcgttacaaatacgaccgtcgggtaatctaccgctagcgacgaaacgtcgaggtggtcgattagtaatagtaaatttacaaccgacgaaacatgatcgtcatgcggatctacgaatacatggttatgttgatgaagttatgacgcgattaatgaaacatttaggtttagaaataccggcgtgggatggtccgcgagtactagaacgtgcgctaccgccgctaccgcgtccgccgacgccgaaactagaaccgaaagaagaatcgccgacgcgaataaatggttcgataccggcgggtccgaaacaagaaccgtgtgcgcaacataatggttcggaaccggcgtcgccgaaacgtgaacgaccgacgtcgccggcgccgcatcgaccgccgaaacgtgttaaagcgaaagcggtaccgtcg

SEQ ID NO: 19300 - DNA, 1065 bp, Artificial Sequence
  Description of Artificial Sequence: Synthetic coding sequence
atgtccgtcaactacgccgccggactttcaccgtacgcggataagggaaaatgtggcctcccagagatctttgacccaccagaggagctggaacggaaagtgtgggagctcgcgcgccttgtgtggcaatcctcctccgtcgtgtttcatacgggggcaggaatttcaaccgcctccggtatcccggacttccgcggaccgcatggagtctggaccatggaggaaaggggcctggcacccaagttcgacactacttttgaatccgctaggccaacccagactcacatggcgctcgtgcaactcgagcgcgtcggactgctccggttcctggtgtcacaaaatgtggatggactgcatgttcggtcgggattccccagagataagctggccgagcttcatggcaacatgtttgtggaagagtgtgcgaagtgcaagactcagtatgtgagagataccgtggtgggaaccatgggacttaaggcaaccggtaggctgtgcaccgtggccaaggcgcgcggtctgagagcatgtcgcggggagctgcgcgatactatcctcgattgggaggactcgctgccagatcgcgacctggcgcttgccgatgaggcctcgcggaacgctgacctgtccatcacgctgggtacttcactgcagatccggccttccgggaaccttccgctggccactaagcgtcggggaggacgcctggtgatcgtcaacctccagccgaccaagcatgaccgccacgctgacctccggatccacggatatgtcgacgaggtcatgactcggctgatgaagcacctcggactggagatcccagcgtgggacggacctcgcgtgctcgaaagagcgctgccgccattgccgcggcctccaaccccaaaactggaacctaaagaggagtcgccgacgagaatcaatggatcgattccggccggtccgaaacaggaaccgtgcgcacagcacaatggctcagaacctgcatcgccgaagcgcgaaagacccacttcgcccgctccgcaccggccgccgaaacgagtgaaagcgaaggccgtgccttcg

SEQ ID NO: 19301 - DNA, 1065 bp, Artificial Sequence
  Description of Artificial Sequence: Synthetic coding sequence
atgtccgtgaactacgccgcaggactttctccttacgctgacaagggcaaatgcgggctacccgaaatcttcgaccccccagaagagctggaaagaaaggtttgggagctggcccgactcgtttggcagtcctccagcgtcgtgtttcatacaggcgctggaatctctacagcttctggcataccagatttcaggggaccccacggcgtgtggaccatggaagaacggggcctggctccaaaattcgatacaacctttgagagcgccagacccacccaaacccatatggctctggtgcagttagagcgggttggcctccttcgtttcctcgtttcccagaacgtggacgggctccacgtgcggtccggcttcccgagagacaaattggctgagcttcacgggaacatgttcgtggaagaatgtgccaagtgcaagactcagtacgttcgggacactgtggtggggacaatggggctgaaagcaaccgggaggctttgcaccgttgccaaagccaggggcctgagggcctgccgcggggagctgagggacaccattctagattgggaagatagtttacctgatcgcgacctggctcttgcagacgaggcaagcaggaatgccgatctgagcataacactaggcaccagcctgcagatacgcccctctggaaacctgccactagctaccaagcgcaggggcggccgtctggtgatcgttaacctacaacccacaaagcatgacagacacgccgacttgcgaatacacggttatgttgatgaagttatgacaagactcatgaagcatctaggactagaaatccccgcatgggatggacctcgcgtgctggagcgcgccttacctccactgccacgcccaccaactcctaaacttgaaccaaaagaagaaagtccaacaaggataaatggcagtatacctgctggacccaaacaggagccatgcgcccagcataatggctcagaacccgccagtccaaaaagggagcggcctacctctcctgcacctcaccggcccccaaaacgggtgaaagccaaggccgtgccttcc

SEQ ID NO: 19302 - DNA, 1065 bp, Artificial Sequence
  Description of Artificial Sequence: Synthetic coding sequence
atgagcgtgaactatgctgccggcctgagcccctacgcggacaaaggcaaatgcggcctgcctgagatatttgacccgccggaagaactggagaggaaagtgtgggagttggctcgcctggtatggcagagtagcagcgttgtcttccacactggcgctgggattagcaccgcgagtggtattccagactttcgcgggcctcatggcgtatggaccatggaagagcgcggcttggcccccaagttcgataccacttttgagtctgcacggcctacacagacccacatggcgttggtccagctggagagggtgggcctcttacgatttctagtgagccagaatgttgacgggctacatgttcggagtggatttcctcgcgataaactggccgaattacacggtaacatgttcgttgaggagtgtgcaaagtgcaaaacacaatatgttcgggacactgttgtaggcactatgggtctgaaagcgaccggtcgcctctgcactgtggcgaaggctcgcgggctgcgtgcgtgtcgtggtgaactgcgtgataccatccttgactgggaggactccctgccggatcgcgacctggcattggccgacgaggccagccgcaatgcagacctgagcattaccctggggactagcctgcaaatccgaccttccggtaacctcccattggccacaaaacgccgcggcggccgcctggtcatcgtgaacctgcaaccgactaagcatgacagacacgctgacctgcggatacatgggtacgtggatgaggtgatgacgaggctgatgaaacacctgggtctggaaatccccgcgtgggacgggcctcgtgtcctggagcgcgctctgcctccgctcccgcgcccaccgactccaaagctggagccaaaagaggaaagccctacgcgcatcaatggttctatcccggcgggccctaagcaagagccatgcgcacagcacaatggctctgagccagcgagcccgaagagggaacgcccgactagcccggcaccacatcggccacctaaaagggtgaaggcgaaggctgtccctagc

SEQ ID NO: 19303 - DNA, 1065 bp, Artificial Sequence
  Description of Artificial Sequence: Synthetic coding sequence
atgagcgtaaactacgccgccggccttagtccttacgccgacaagggcaaatgcggactacccgagatcttcgatcctccagaagagctggagagaaaagtttgggagctagcaagactggtatggcagagttcctccgtcgtcttccacacaggagccggcatctcaacagccagtggtatacccgacttcaggggcccacatggggtatggactatggaagaaagagggttagctcccaagttcgataccacattcgaaagcgcccgtccaactcagactcatatggccttggtgcagctggagcgagtagggctgctgagatttctggtttcccagaatgtcgatggtctgcacgtgcggtcaggtttccctcgagacaagctcgcagagctccacgggaatatgttcgtggaagaatgtgcgaaatgtaagacccagtacgtgcgggacactgtcgtgggaactatggggctcaaggcaactggccgattgtgcacagtggcaaaagcccgaggactacgggcttgtcgtggagagctcagggatacgatcctggactgggaggactctttgccggatagagacttagcgcttgccgatgaggcctctagaaatgccgacctttcaatcacactgggcacatctctgcagattcggcccagtggtaatctccccctcgccacgaagaggcgcgggggccgcttggtgatcgtcaacttgcagccaactaagcatgataggcacgcagatcttcggattcacggctacgtggacgaagttatgactaggttgatgaaacatctgggcctggaaattcccgcttgggacgggccaagagtgctcgagcgggctctaccacccctgccgaggcctcctacccccaaactcgagcctaaggaggagagccccacccggatcaacggcagcattcctgccggacctaaacaggagccgtgcgcccagcataacggatcggaacccgccagtcctaaaagggaaagacctacaagtcccgccccacacagaccacctaaacgtgtcaaggccaaggccgtgccctcg

SEQ ID NO: 19304 - DNA, 1065 bp, Artificial Sequence
  Description of Artificial Sequence: Synthetic coding sequence
atgtcagtgaactacgctgccgggctgtctccgtacgcagacaaaggaaaatgcggccttccagagatcttcgatccaccggaagagctggaacgtaaggtttgggaactggcaagattggtgtggcaaagctcctccgtggtgttccacactggagcaggtatttccactgcttcgggaattcctgactttcgcgggcctcatggcgtgtggactatggaagagcgcggtttggcacccaagtttgatactacctttgagtcggcaagacctactcaaacccacatggcacttgtgcagttggaaagagtgggactgctgagatttctcgtctcccagaacgtggatggacttcatgtcagatcagggtttccacgggacaaacttgctgaactgcatggcaacatgttcgtcgaggaatgtgcaaagtgtaagacccaatatgtgcgtgatacggtcgtgggaacgatgggtctgaaggcaaccggcagactgtgtaccgtggcaaaggcgaggggactcagagcatgccggggtgaactccgtgataccattctcgattgggaggatagcctgccggaccgcgatctggcgctggcggatgaggcatcacggaacgcagacctgagcattactctcggaacgagcctccagatccgtccgtccggaaatctcccactggctaccaagcggcgtggcggtcgcttggtgatcgtcaaccttcaacccaccaagcatgatcggcatgcagacctgcgcatccacggatatgtggacgaggtcatgaccagacttatgaagcatcttggtcttgaaataccggcatgggacggaccaagagttctggagagggccttgccaccacttcctcggcctccgaccccaaaacttgaaccgaaggaagagtcacccactcggataaacgggagcatcccggcgggacccaaacaagaaccttgtgcacagcacaatggttccgaacctgcctcgcccaaacgagaaagacccacttcaccagcaccccatcgcccccctaaaagagtcaaggccaaggctgtgcctagc

SEQ ID NO: 19305 - DNA, 1065 bp, Artificial Sequence
  Description of Artificial Sequence: Synthetic coding sequence
atgtctgtgaattatgccgccggcctctctccctatgccgacaagggcaagtgtggcttgcctgagatattcgacccacccgaagaactcgagcgcaaggtctgggagctggccagattggtctggcagagcagctctgtggtgttccacacgggggctggaatttccactgcaagcggcatccccgacttccgagggccccacggcgtgtggacaatggaagaaaggggcctcgcccccaaattcgataccaccttcgaatcagcccgacctacgcagacccatatggcgctcgttcaactcgagcgcgtgggcttgttgcggttcctggtgtctcagaacgtagacggcctgcacgtgcggtctggattccctagagataaactcgccgagcttcatgggaacatgttcgtagaggaatgtgccaagtgtaagacccagtacgtcagagacactgttgtgggaaccatgggattgaaggccacaggccgcctgtgcaccgtggctaaggcacgcggtctgagggcgtgcaggggcgagctgcgagacaccatcctcgactgggaggatagcctgccagacagagacctggcgttggcggacgaggctagcaggaacgccgatctctccatcactctcggtacctctctgcaaatcagaccttctggaaacctgcccctggcaaccaaacgacggggcggtcgcctcgtgatagtgaaccttcagcctactaaacatgaccggcacgcagacctcagaattcatggctacgtggacgaagtaatgactcggttgatgaagcacctgggcctggagatcccggcctgggacgggccacgggttctggagcgggccttgccgcctctgcctcggccccctactcctaagctggagcccaaagaagaatccccaaccaggatcaatggctcaattccagccggccccaagcaggagccttgcgcccagcataacgggtcagagccggcaagcccaaagagggagcggcccactagccctgccccacacaggcctccaaagagagttaaggccaaggcagtgcccagc

SEQ ID NO: 19306 - DNA, 1065 bp, Artificial Sequence
  Description of Artificial Sequence: Synthetic coding sequence
atgtcggtcaactatgccgcaggactgtcgccatacgcagacaagggcaagtgtggccttccagagatatttgatccacccgaagagttggagcgtaaagtctgggagttggcacggcttgtgtggcaatcctcatcggtggtatttcacaccggggctggaatttccactgcatcgggtattcccgactttcgggggcctcatggcgtgtggactatggaggaacgcgggttggcacctaagttcgacaccacttttgaatctgcaagaccaactcagactcacatggctctggtgcaacttgaaagagtgggtctgcttcgatttctcgtcagccaaaacgtggatggactgcacgtgaggtcggggttccccagggataagctggcagaactgcatggcaatatgttcgtggaggaatgcgccaagtgtaagacgcaatacgttagggacacggtcgtggggactatgggtctgaaagccactgggcggctttgcaccgtggctaaggcccgaggactccgcgcctgtcggggtgaacttcgtgacactatccttgactgggaagatagccttcctgaccgggatctggcactggcagatgaggcctcgcgaaacgcggatcttagtatcactcttggcacctcattgcagatcaggccctctggaaatcttcctcttgccaccaagaggcgcggagggcgcctcgtgattgtcaaccttcaaccaactaagcatgatagacatgcagacctcagaatccacggatacgtggatgaagttatgacccggcttatgaaacatttgggacttgaaattcctgcatgggatggacccagagtccttgaaagagcactgccaccgctgccccgaccaccaactcctaaacttgaacctaaagaagaatcacctaccagaataaacggttcgattcccgctggacctaagcaggagccttgtgcccagcataacggaagcgagcccgcctcgcccaagagagagcgcccaacctctcctgcacctcacagaccacctaaaagggtcaaggcaaaggccgttccatcc

SEQ ID NO: 19307 - DNA, 1065 bp, Artificial Sequence
  Description of Artificial Sequence: Synthetic coding sequence
atgtcggtgaactacgcggccggcctgtccccctatgcggacaaaggaaaatgcggactgccggagatcttcgatcctccagaggagttggagcgcaaggtgtgggaactcgctcggcttgtgtggcagtctagctccgtggtgttccatactggagccgggatcagcaccgcctccggaatcccggacttccggggcccacatggagtctggaccatggaggagagaggactggcgcctaagtttgacaccaccttcgagtcggcgcggccaacccaaacgcacatggcactggtccaactcgaacgggtgggactgttgcgcttcctcgtgtcacagaacgtggacggcctccacgtccgtagcggttttcctagagataaactcgcggaactgcacggcaatatgtttgtggaagagtgcgcaaagtgcaagactcaatacgtccgggataccgtcgtgggaaccatgggcctgaaggccaccgggcgactttgtactgtcgccaaagcccgtggcctccgcgcgtgtcgtggggagctgcgcgacactatcctggactgggaagatagcctccctgaccgggatctcgctctcgcagacgaagcctcaagaaatgccgatctttccatcacgctcggtacttccctgcagattaggccgagcggcaacctgccgctggcaaccaagcgccggggcggtagactcgtgatcgtcaatctccaacccactaaacacgatcgccacgccgacctgcggatccacgggtacgtagacgaagtgatgacgcgcctcatgaagcatctgggactggaaataccggcttgggacgggcctcgggtgctcgaacgggccctgccaccgcttccgcgtcctccgactccaaaacttgagccgaaggaagagtcgccgaccagaatcaatgggagcatcccggctggtcctaagcaagaaccatgcgcgcagcataacggatctgaaccagcctccccaaagagggaacggcctacctcaccagccccccaccgccctccgaagagggtcaaggccaaggctgtcccctcc

SEQ ID NO: 19308 - DNA, 1065 bp, Artificial Sequence
  Description of Artificial Sequence: Synthetic coding sequence
atgtccgtgaattacgccgccggactttccccttacgctgacaagggtaagtgcggactcccagagatcttcgatcccccagaagagctcgaacgaaaagtgtgggagctcgcccgactcgtgtggcagtctagtagtgtggtcttccatacaggcgcagggatctctacagcttctggcatacccgactttagggggccgcacggagtgtggacaatggaggagcgcggactggcccctaaatttgacaccactttcgaaagcgcccggccaactcagacacacatggcgctggttcagctggaacgggtcggtcttttgagattcctcgtgtctcagaacgtggatggtttgcacgttcgatcagggtttcccagggacaaacttgcagaactgcatgggaatatgttcgtggaggagtgcgcgaaatgcaaaactcagtacgtccgggacacagtggttggtaccatgggtctgaaagctaccggtagactgtgtaccgtggcgaaggcccgcgggctgcgcgcttgtagaggcgagctcagggacactattctggactgggaggactctctgccagatagggacctcgcgctggctgacgaagcttctaggaacgctgatctttccatcacactgggcacaagtctccagatccggccttctggcaacctgccactggcgaccaaacgccgagggggtagattggttatcgtcaaccttcagccaacgaagcacgacaggcacgcagatttgcggatacacggctacgtcgacgaagtgatgactcgactcatgaagcacttgggactggaaatccccgcatgggatgggccacgagtgctggagagagccctgcccccacttcctcggccacctacacctaagctcgagccaaaggaagagtctcccaccaggattaatgggtcaattcccgccggccccaagcaggaaccctgcgcccagcataacggaagcgagcctgcatctccaaaacgcgagcgccctacaagtccagccccccacagaccaccaaagagggtgaaggcgaaagcggttccctct

SEQ ID NO: 19309 - DNA, 1065 bp, Artificial Sequence
  Description of Artificial Sequence: Synthetic coding sequence
atgagcgtcaattacgccgccgggctttcaccttacgcagacaagggtaagtgtggacttcccgagatttttgaccctccagaagagctcgaaagaaaagtctgggaacttgcgagattggtctggcaatcgtcgtccgtggtgtttcataccggagcgggcatatcaacggcaagcggtattccagactttaggggaccacatggtgtctggactatggaagaacgcggcttggcacctaagtttgacaccactttcgagagcgcaagaccgactcagacccatatggcacttgtgcaacttgaaagagtgggtttgctgcgattccttgtctcgcaaaatgtggatggactgcatgtgaggtccggatttcctagggataaacttgcagagctgcatggcaacatgtttgtggaggaatgtgcaaaatgtaagacgcagtacgtgcgagataccgtggtcggaactatgggtcttaaggcgactgggagactttgcactgtcgcaaaggcgagagggctgcgtgcttgtagaggagaactgcgggataccatcctggattgggaggactcactgccggatcgcgatcttgccctcgcagatgaggcgagccgaaacgctgatctgtccattaccctcggaacctccctccagattaggcctagcggaaacctgcctctggcaaccaagcgaagaggcggccgtcttgtgatcgtgaatctccaacccactaaacatgaccgtcacgccgatctgcggattcatggatacgtggatgaagtgatgacccgacttatgaagcatcttggcttggagattccagcatgggatggaccgcgggtgctggaaagagcactcccgcccctgcccagacccccaaccccgaaacttgaacctaaagaagagtctccgacccgcattaatggatcaattccagcaggacccaagcaagaaccttgcgcccagcataacggatcggaaccagcgtcgcccaagagagaaagacctacctctccagctccccaccggccccccaagcgcgtgaaagctaaggcagtgccatcc

SEQ ID NO: 19310 - DNA, 1065 bp, Artificial Sequence
  Description of Artificial Sequence: Synthetic coding sequence
atgagtgtgaactatgccgcggggctctcgccttacgctgataagggaaagtgcggtctgcctgaaatcttcgaccctccagaagaactggaacggaaggtgtgggaactcgccagactcgtctggcaatccagctcggtggtattccacaccggagcgggcatttcgactgcatcgggaattccagattttcggggaccccatggcgtgtggactatggaggaacggggtcttgcgccgaagtttgataccacttttgaatcagcaagaccaactcaaacccatatggcattggtacaactcgaaagagtcggtcttttgagatttcttgtatcacagaacgtggatggacttcatgtgagatccggatttccgagggataaactggctgagcttcacggcaatatgttcgttgaggaatgtgctaaatgtaaaacccagtacgtgagagacaccgtggtgggaactatgggtttgaaggcaactggacgcctgtgcacggtcgccaaggcaaggggactgcgtgcatgtcgtggtgagcttcgagacacgattctcgattgggaagattcccttcctgacagggaccttgcactggcagatgaggcgtcacgcaatgcagatctctcaatcaccctgggtacttccttgcaaattcgtcctagcggaaacctccctctcgcaacgaaaaggagagggggaagattggtgatcgttaacctgcagccaaccaagcatgatcgccatgcggatctccggatccacggctatgtggacgaggtcatgactcgcctgatgaagcatctgggactggagataccggcctgggacggtccgcgtgtccttgagcgagctcttccaccactgccacgacctccaacgcccaagttggagcccaaggaggaatcgccgacccgcattaacggatccataccagcaggtccgaagcaggaaccttgcgcccaacacaatgggagcgaacctgcctcccctaagagagaacggccaactagccctgcacctcatcgaccccctaagagggtgaaagcaaaagcagtcccttcc

SEQ ID NO: 19311 - DNA, 1065 bp, Artificial Sequence
  Description of Artificial Sequence: Synthetic coding sequence
atgagcgtaaactacgcagctgggctgtcaccctacgcggataaagggaagtgtggactcccagaaatcttcgacccccctgaggaactcgagaggaaagtatgggaactcgcgcgcttggtctggcagtcgtcgagcgtcgtgtttcacacaggtgccggtatctccaccgcgagcgggatcccagacttcagaggccctcacggagtgtggaccatggaagaacgggggctcgctccaaagttcgatacaacatttgaaagcgcccgaccaacacagacccatatggcgctggtacagctggagcgtgtgggcctattgagattcctggttagccaaaacgtggatggactgcacgtgcggtccggctttccccgcgataagctggcggagcttcacggtaatatgtttgtcgaagagtgtgcgaagtgcaaaacacagtatgtaagggacactgtggtgggcaccatgggattaaaagctaccggccgcctttgcactgtagccaaagcccgaggccttagggcatgcagaggggaactgagagacaccatactggactgggaggattccctgcccgacagagatctcgctttggcggacgaagccagccggaatgctgacctgagcattacgttaggcacctccctgcagatcagaccttctggtaaccttcccctggccacaaagcgcaggggggggcgcctggttatagtgaatctacagccgactaagcacgacagacacgcagatctgaggatacatggctacgtggacgaagtcatgacaagactgatgaagcacctaggtctcgagattcctgcatgggatggcccaagggtcctggagcgtgctctgcctccccttccgcggccccccacgccaaaactagagccgaaggaagagtctcccactcgtattaatggatcaattcctgccggacccaagcaggagccctgcgctcagcacaatggttcggaacccgccagtcccaaaagggagaggcctactagccccgcaccccatagaccccccaaaagggtgaaagccaaagccgtgccttcc

SEQ ID NO: 19312 - DNA, 1065 bp, Artificial Sequence
  Description of Artificial Sequence: Synthetic coding sequence
atgtcagtcaattacgctgccggactgagcccgtatgctgacaaaggcaagtgtggtctgccagagatttttgaccctccggaggaattagagagaaaggtgtgggaattggctaggcttgtgtggcagagctctagcgttgtcttccataccggagccggcatcagcactgcctctgggatccctgacttcaggggcccacatggcgtgtggaccatggaagagcgtggtctcgctcccaaatttgacactacctttgaatccgccagaccaacgcagacccacatggctttggtacagctcgaacgtgtgggcttgttgaggttcctcgtgagccagaatgtagacggactgcacgtcaggtcgggattccctcgggacaagttggccgaactgcacgggaatatgttcgtggaagagtgtgccaagtgtaaaacccaatatgtacgcgacaccgttgtagggacaatgggcttaaaggccaccgggagactgtgtacagtagctaaggcccgcggcctaagagcatgcaggggggagcttcgcgataccatattagactgggaagactcactcccagatcgggatttggccttggccgacgaggctagtcggaatgcggatttatcaattacactagggacctcattacaaatccgtccatctggcaatctgccactggctactaaacggaggggcggcaggctggtgattgtgaaccttcagccaaccaagcatgatagacacgctgacctgcgcattcacgggtacgttgatgaggtaatgacaagactgatgaaacatctcgggctggaaatcccagcgtgggatgggccccgagtattagagcgcgctctcccacctctaccaaggccacctactcctaagcttgagccaaaagaggaatccccaacaagaataaatggaagtattcccgctggaccaaagcaagagccatgcgcacagcacaacgggtcagagcctgcaagccctaagagggagagacctaccagcccagcaccacaccgaccccctaaacgtgtgaaggctaaggccgtgccgtct

SEQ ID NO: 19313 - DNA, 1065 bp, Artificial Sequence
  Description of Artificial Sequence: Synthetic coding sequence
atgtcagttaattatgctgctggtctttcaccttatgctgataaaggaaaatgtggattgccagaaatttttgatccaccagaagaattagaaagaaaagtatgggaattagctagattagtctggcaatcatcttcagttgttttccatactggagctggaatttctacagcttctggaataccagattttcgtggtccacatggtgtctggactatggaagaaagaggattagctccaaaatttgacacgacatttgaatcagctagacctacacaaactcatatggctttagtacaactagaaagagttggattgttgcgatttttagtttcacaaaacgttgatggacttcatgttaggtctggatttccacgtgataaattagccgaacttcatggaaatatgtttgtagaagaatgtgcaaaatgtaaaacacaatatgtaagagacactgtagttggaacaatgggattaaaagcaactggtagattatgtacagttgctaaagcaagaggattaagggcttgtagaggagagcttagagatacgattttagactgggaagattctttaccagatcgagatcttgcacttgcagatgaagctagtagaaatgctgatttgtctataacattaggaacctcacttcaaattagaccatcagggaatctacctttagcaactaaaagaagaggaggtcgtttggttattgttaatttacaaccaacgaaacacgacagacatgcagatttaagaattcatggatatgttgatgaagttatgactagattaatgaaacatcttggtttagaaatcccagcatgggatggtccaagagtattagaaagagctttaccacctttaccaagaccaccaactcctaaacttgaaccaaaagaagaatctcctacacgaattaatggatcaattcctgcaggaccaaaacaagaaccatgtgcacaacataacggttcagaaccagcttctcctaagagagaaagaccaactagtcctgcacctcatcgtcctcctaagagagtgaaagctaaggctgttccaagt

SEQ ID NO: 19314 - DNA, 1065 bp, Artificial Sequence
  Description of Artificial Sequence: Synthetic coding sequence
atgtcagtgaactacgctgctggcctttctccatatgcagacaaaggcaagtgcggactacccgaaatattcgacccacctgaggaactggaacgtaaagtgtgggagctggcgcgcctcgtctggcaaagcagttctgtggtgtttcataccggcgccggcataagtacagccagcggcatacctgatttcagaggcccccacggagtttggactatggaagaacgaggcctagcaccgaagtttgacacaacattcgaatcagctcgcccgacacagacacacatggcactggtgcagctggagagagtcgggctgctgaggtttttggtgagccagaatgtggacggccttcatgtaagatccgggtttcctagggacaagcttgccgagctgcacggcaatatgttcgtcgaggagtgcgctaagtgtaagacccagtacgttagggacacggtcgttggaaccatgggactgaaggccaccggacgcctttgcacagtggcaaaagccagaggtcttcgagcgtgtagaggagaacttcgagacactatactcgactgggaagatagccttcctgacagagacctggccctcgctgacgaggcatcccgcaacgccgatctcagtatcaccttaggtacatcgctccagatcaggcctagcggcaacctgccactcgcaacaaagaggcgcggtggtcgactcgtgattgtaaacttgcagccaaccaagcatgaccggcatgcagaccttcgcattcacggatatgtggacgaggtaatgactcgccttatgaagcacctggggttagaaatccctgcctgggatggccctagagtgttggagagagctttgccacctctcccacgtccaccgacgccaaagctggaaccgaaggaagaatcgcctacaagaattaacggcagcatccctgctgggcctaagcaggagccgtgcgctcagcacaatggcagcgagcctgcttcgcccaaaagggagaggccaactagcccagcgcctcatagacctcccaaaagagtgaaggccaaggccgtgccctct

SEQ ID NO: 19315 - DNA, 1065 bp, Artificial Sequence
  Description of Artificial Sequence: Synthetic coding sequence
atgagtgtgaattacgcagccgggctttccccttacgcagacaaggggaagtgcggcttgcccgagatcttcgacccacctgaagagcttgaaagaaaggtttgggaactggcacgtcttgtgtggcagagctcgtccgtcgtctttcacaccggagccggtatttcgacggcctcgggtattccggattttagaggcccacatggagtgtggactatggaagagagaggtctggcccctaagtttgacacgactttcgagtctgctagaccgactcagacccatatggctctcgtgcaacttgagcgagtaggacttcttagattcctggtgtcgcaaaacgttgatggactgcacgtgaggtccggctttcctcgcgacaaacttgccgaactccatggtaacatgtttgtggaagaatgtgcgaagtgcaaaacccaatatgtgagagacaccgtcgtaggaactatgggtcttaaagctacgggacgcctgtgtaccgtggcaaaagcaagaggcttgagggcctgtcgaggagaactccgcgataccatactggattgggaagattcgctgcccgatcgtgatcttgcactggcggatgaggcaagccgtaacgcagatctcagcatcactcttggcacgtcgctgcaaattcgaccttcaggtaacctgcccctcgcgactaagcgcagaggaggacggctcgtgattgtcaatctccaacccactaagcatgatcgtcacgctgacctgcggattcatggatacgtagacgaagtcatgactcggcttatgaagcaccttggcttggaaatccctgcgtgggatgggccccgagtcctggagcgagcactgcccccgcttccaagacctcctacccctaagctggagccaaaggaagaaagccccacccgcataaacggctcgattcctgcagggcctaagcaggaaccatgtgctcagcataatggatccgaacctgcatcaccaaagagagaaaggcccacctcacctgcaccgcatcggcccccaaagcgcgtgaaagcaaaagctgtgccatca

SEQ ID NO: 19316 - DNA, 1065 bp, Artificial Sequence
  Description of Artificial Sequence: Synthetic coding sequence
atgagcgtcaactacgccgcaggactctcgccgtacgcagataaagggaagtgcggcctgccggaaatctttgatcctccggaagaactggaaagaaaggtgtgggagctcgcacgcctcgtctggcaatcatcctctgtcgtgttccacaccggagccggaatctcaacggcctcgggtatcccagattttcgcggcccgcatggagtgtggaccatggaagaacgcggcttggcccctaagtttgacactactttcgaaagcgctagacccactcaaacccacatggccctggtgcagctggaaagagtcggtctgctccgcttcctcgtctcacaaaacgtggacggcctgcatgtgcgctccggattccctcgggataagctggcggaattgcacggaaacatgttcgtggaagaatgtgctaagtgtaagactcagtatgtccgcgacactgtggtcgggaccatgggactcaaggcgaccggacgcctgtgtactgtggcgaaggcccgcgggttgagagcatgccggggtgaactcagagacacgattttggattgggaagattcgctgccggaccgggacctggcacttgccgatgaggcgtcgcgaaacgcggacctcagcatcactttgggaacctcacttcagatcagaccttcgggaaacctgcctctggcgaccaagcgccggggaggaaggctcgtgatcgttaacctgcagccaactaaacacgatcgccacgccgacctgcgcatccatggatacgtggacgaggtgatgacgcgcctgatgaaacatctcggattggagatccccgcttgggacggaccccgcgtgttggaacgcgcactgcctcctctgccgcggcctccgactccaaagctggagccgaaggaagaatcaccgacgagaataaacggctccatcccggctggacctaagcaggaaccctgtgcgcaacataatggttcggaaccggcgtccccgaaaagggagaggccgacttcgcctgccccacatcggccgcctaagagagttaaagcgaaggccgtgcccagc

SEQ ID NO: 19317 - DNA, 1065 bp, Artificial Sequence
  Description of Artificial Sequence: Synthetic coding sequence
atgtctgtgaactatgctgctggcctgtccccttacgctgacaagggaaagtgtggcctgcccgagatctttgacccccccgaagagctggagaggaaggtgtgggaactagcacgcctggtctggcagagcagcagcgttgtctttcatactggcgccggcatcagtacagcgtccgggattccggacttccgtggcccacacggtgtctggacgatggaggagcgcgggctcgctcccaagttcgataccaccttcgagtctgcccgccccacccagacacacatggctctggtacagctggaacgcgtcggtctcctccgtttcctcgtcagccagaacgtagacggacttcacgtgcgttccggctttccccgtgacaagctcgctgagctgcacggcaacatgttcgtcgaggagtgtgctaagtgcaaaactcaatatgtgcgcgatacagtggtaggcaccatggggcttaaggctaccgggcgactgtgtaccgtcgcaaaagctcggggcttgcgtgcgtgccggggcgagctgcgtgacaccatcctcgactgggaggatagcctgccagatcgggacttggcactggctgacgaggcttctagaaatgccgatctgagcatcaccctcggtacatcgctccagatccggccctcgggaaacctccctctcgcaaccaagcgtcgggggggaagacttgtcatcgtcaacttgcagccgaccaagcacgaccgtcacgccgacttgcgcatccatggttacgttgatgaagtcatgacccgtttgatgaagcatttgggtttggagattcctgcttgggacggccctcgtgtccttgagcgcgctctgcccccgctcccgcgcccgcctactcctaagctcgagccgaaggaggaatcgcctactcgcatcaacgggagtattcccgctggcccaaagcaagagccttgcgctcagcacaacggctccgagccggcttcccctaagcgagagcggccgacgtccccggcaccgcatcgacccccgaagcgcgtcaaagcaaaggcagttccgtct

SEQ ID NO: 19318 - DNA, 1065 bp, Artificial Sequence
  Description of Artificial Sequence: Synthetic coding sequence
atgagtgttaactacgctgccgggctatccccttatgctgataaagggaaatgtgggttaccagaaatcttcgatccacctgaagagctcgagcgaaaagtttgggaacttgctcggctcgtttggcagtcctcgtctgtcgttttccacacaggggctggaatcagtactgcttccggaattcccgatttccggggacctcacggagtctggactatggaggaacggggactggcccccaaattcgacacaacatttgaatctgctagacctactcagacacatatggcccttgttcagctcgaacgggtcgggttgcttagattcctagtgtctcagaatgtcgatggacttcatgtaaggtctgggtttccccgcgataagttagcggaactccacgggaacatgtttgtggaggaatgcgccaaatgtaaaacacagtacgtaagagatactgttgtggggactatgggattgaaagcaacagggagactgtgtacagtggctaaggcacggggattgcgagcatgtaggggggagctgcgagatactatactggattgggaggactcactccccgatagggatttggccctggcggatgaagcctctaggaacgctgacctgagtatcactttgggaacttcactgcagatacggccctcaggaaacctcccattagctactaaaagacgaggaggacgcctcgtcatcgttaacctgcagccaacaaagcatgatcgacacgccgatttgcgcatacatgggtatgtcgacgaagtgatgacaaggcttatgaaacatctggggctggaaatacccgcctgggatgggcctagggtgctcgaaagggctcttcctcccctcccccgaccccctacacctaaactggaaccgaaagaagaatcacctactcggatcaatgggtctatcccagctgggccaaaacaggaaccctgtgcccagcacaatgggagtgaaccagcttccccaaaaagagagagaccaacatcacctgccccccaccgcccaccaaaacgagttaaagcgaaagctgtgccatcg

SEQ ID NO: 19319 - DNA, 1065 bp, Artificial Sequence
  Description of Artificial Sequence: Synthetic coding sequence
atgtctgtgaactacgccgctggcctgtctccttatgccgacaagggaaagtgtggactgcccgaaattttcgatcccccagaagagttagaacgtaaagtctgggaactggcgcgactggtgtggcaatcaagtagcgtggtgttccatacaggcgccggcatctccacagcgtctggcatccccgattttcgcggccctcacggcgtgtggacaatggaggaacgcggacttgcccccaagttcgataccacctttgagtctgccagacctacgcagacccatatggcattggttcaactcgaaagggtgggactccttagattccttgtcagccagaatgtggacggccttcacgtccgctccgggttccctagggacaagctcgctgaactccatgggaatatgtttgtggaggagtgcgccaaatgcaagacgcagtatgtgcgggacacggtagttggcaccatgggactgaaggctaccggccggctgtgtactgtggccaaagctcggggccttagggcttgcagaggagaattacgtgataccatcttggactgggaggattcactccctgatcgcgacttggccctcgcagacgaagccagcagaaatgcagatctctctattaccctgggaacttcactacagattcgcccaagcggaaacctcccactcgctactaagcgcagaggcggccgcttggtcatcgtgaatctgcaacccactaaacatgaccggcacgctgacctcaggatacacggatacgtggatgaggttatgacccggctgatgaagcatctgggattagagattcccgcatgggacggtccccgcgttctcgaaagggccctgcccccccttccaagacctcccacccctaagttggagcctaaagaggaatccccaacccgcattaatggcagcattccagccggtccgaaacaggaaccatgcgcccagcataacggaagcgagccggccagccctaaacgggaacgcccaacctcccctgcccctcaccggcctcctaagagagtcaaagccaaagctgtgccgtca

SEQ ID NO: 19320 - DNA, 1065 bp, Artificial Sequence
  Description of Artificial Sequence: Synthetic coding sequence
atgtcggtgaattatgccgccggacttagtccctacgcagataagggtaaatgtggacttcccgaaatctttgacccccctgaagaactcgaacgaaaggtgtgggaactagctcggttagtgtggcaaagttccagcgtggtctttcatacaggagcaggcatctcaaccgcttcggggattcccgatttcagaggcccccatggggtctggacaatggaggagagaggcctggcccctaaattcgatacaacgttcgagagcgcaaggcccactcagactcatatggccttggttcaattagaacgcgtaggcctcctgagattcctggtgtctcaaaacgtcgacggacttcacgtcagaagtgggttccccagggataaactggctgagctccacgggaacatgttcgtggaagagtgcgctaaatgcaagactcaatatgtgcgagataccgtcgtggggactatgggattgaaagcgaccggccgtctctgtacagtggcaaaggctaggggactgagagcatgccgcggcgagctgcgagacacaatacttgactgggaagactcccttccggatcgagatctcgccctggccgacgaggccagccggaatgctgacctgtccataaccctgggaacatcactgcaaatcagaccgtctggtaacttgcctctcgccacgaagaggcgaggagggcgccttgtgatagtgaatctgcaacctacgaaacacgatcgtcacgcagatctgaggatccacggctatgtcgatgaggttatgaccaggcttatgaagcatttgggactcgaaataccagcctgggatggacctagagtcctggagcgagccttgccccccctcccgcggcctccgacgcctaagttggaacctaaggaagagtctcctacccgaattaatgggtctatcccggccggacctaagcaagaaccctgtgcccagcacaacggcagtgaacccgcctcccctaagagagagagacctacctcaccggcgcctcaccgacccccaaaaagagtcaaagcaaaagcggtcccatcc

SEQ ID NO: 19321 - DNA, 1065 bp, Artificial Sequence
  Description of Artificial Sequence: Synthetic coding sequence
atgtccgtgaactatgctgcaggactcagcccttatgctgataaaggaaagtgtggtttgcccgagatctttgatcctccagaggagttggagcgcaaggtctgggaactcgcacgcctggtgtggcagtcctctagcgtggtcttccacactggcgccggtatcagcacagcctcaggaatcccagatttccgcggcccccatggtgtctggactatggaggagcgtggactcgccccaaagttcgacactactttcgaatctgcccgtcctactcaaacccacatggcactggtgcagctggaaagagttggcttgctgcgttttttggttagtcaaaacgtagacggcctgcacgtaagatccggatttccccgcgataaactggccgaattgcacggcaatatgtttgttgaggagtgcgccaaatgcaagacacagtatgtgagagacacagtcgttggtaccatgggacttaaggctacaggccgtctgtgcaccgtggctaaagccaggggcttgagagcctgcagaggtgagctgcgcgatacaatcctggactgggaagatagtctcccagacagagatttggcattggcagatgaagcttctagaaacgctgatctctcaattactctgggaaccagtctgcagatccgccccagtggtaatctgcccttggccaccaagcgtcgtggtggcaggttggtcatagtcaatcttcaacccactaagcatgatcgccatgctgacctgcgtattcacggttacgtggacgaagtaatgacccgcctgatgaaacatttgggtcttgagatccccgcctgggacggccctcgcgtgctggaacgtgccctcccaccacttccaagacctcccactcctaagctcgaacccaaggaagagagccctacaagaatcaacggaagtatcccagctggacctaagcaggaaccatgtgcccaacacaacggatccgagcctgcttcacccaagagagagagacccacaagtcccgccccacataggcctcctaaacgtgtgaaagcaaaagctgttccctcc

SEQ ID NO: 19322 - DNA, 1065 bp, Artificial Sequence
  Description of Artificial Sequence: Synthetic coding sequence
atgtccgttaactacgccgctggtttgagcccatacgctgacaaaggtaaatgtgggcttcctgagatctttgacccgcctgaagaactagagcggaaggtgtgggagctggctcggttggtgtggcaatcttcatcagtcgtttttcatacaggggctggcatcagtaccgcttcaggcattccagactttcgggggccccacggcgtgtggaccatggaagaacggggtctggcccctaagttcgatacaacgttcgagagcgcccgcccaacacaaacccatatggccctcgtacaacttgaacgcgttggactgcttaggttcctcgtgagccagaacgtagacggactgcatgtgaggtcgggatttccccgagacaaacttgccgagctgcatggcaacatgttcgtggaagaatgcgctaaatgcaagacacagtatgtgagggacactgtggttggaaccatgggcctcaaggctacaggcaggctgtgcaccgttgccaaagcacggggcctgagggcctgcaggggcgaattgagggatacaatcctggactgggaagactcactgccagatagagatttggccttggcagatgaggctagcagaaacgcagacctctcaatcactctcggcacaagcctccagatccgcccaagcggcaatctacccctggctactaaacgccgcggcggaaggctggtgattgttaatcttcagccaacaaagcatgacagacacgccgacctgcgtattcacggctatgtcgatgaagtcatgacaaggcttatgaagcatctcggtctggagattcccgcttgggacggcccaagggttcttgagagggcattgccacccctgcctaggcctccaactccaaaactggaacctaaagaggaatcccccacccggattaatggctcgatccccgccggtccgaagcaagaaccttgtgcccagcacaatggaagcgagcctgcctctcccaagagggaacggcctacaagtcccgcccctcacagaccacctaaaagggtgaaagctaaagcagttcctagc

SEQ ID NO: 19323 - DNA, 1065 bp, Artificial Sequence
  Description of Artificial Sequence: Synthetic coding sequence
atgtccgtaaactatgcagccggcctgtcaccctatgcagataaaggcaagtgcggtctccccgagatttttgatccccccgaggagctggagaggaaagtgtgggagctggccagactggtttggcagtcgtcctcagtggtgtttcacaccggcgctggtatctctacagcctccggaatccccgatttcaggggcccacatggggtgtggaccatggaagagaggggtttggctcctaaatttgataccacattcgaaagtgcgagaccaactcagacccacatggctcttgtgcagttggaacgggtcggcctacttagattcctggtatcccagaatgttgacggtctccacgttagatccggcttccccagggacaaactggctgaactgcatggaaatatgttcgtggaagaatgcgcgaaatgcaagactcagtacgtgcgcgacaccgtagttggtaccatgggcttaaaagcaaccggccgactgtgcactgtcgcaaaagcgaggggccttcgagcctgtcgaggagaattacgagatactatactggactgggaagattccctccccgaccgagaccttgcccttgccgacgaggcgagccgtaacgcagacctgtcaatcaccctggggacatccctccagattaggccctctggaaacctgccactcgccaccaaaagacgaggaggaaggcttgtcatcgtcaacttacagcctacaaagcacgaccgacacgctgacctaagaattcacgggtacgtggacgaagtaatgacgagattgatgaagcatctcggcctagaaatacccgcctgggacggaccccgggttctggagcgggcccttcccccactgcccagaccacccacacccaagctggagcccaaagaggagtccccaactaggatcaacggttctatcccagcaggtccaaagcaggaaccctgcgcccagcacaacggatccgagcccgccagccccaagagagagcgacccacctcccccgcgccacatagacctcccaagcgggtgaaagcaaaggccgtacccagt

SEQ ID NO: 19324 - DNA, 1065 bp, Artificial Sequence
  Description of Artificial Sequence: Synthetic coding sequence
atgtccgtgaactacgccgctgggctgtctccttacgctgataagggaaaatgcgggttgcctgaaatctttgatccaccagaagagcttgagcgcaaggtctgggaactggccaggcttgtgtggcagtcttctagcgtggtgtttcacaccggcgccggcatcagtaccgcctccgggatcccggattttcgagggccacatggggtgtggactatggaagagcgtgggcttgcacccaaattcgacaccacattcgagagtgcccgccccacacagacgcatatggccctggtgcagctggaaagagtcgggttactcagattcctggtttcccagaatgttgatggcttacatgtcagaagtggatttcccagagataagcttgctgagttgcacgggaatatgtttgtggaggagtgcgctaaatgcaagacccaatacgtgagggacactgttgttggaactatgggcctgaaggctactgggcgactctgtaccgtggctaaggcacgggggttgagagcctgcagaggagagctgcgagacacaatacttgactgggaagatagtctgccggaccgggatcttgctcttgctgacgaggcctccaggaatgctgatctatctattacgctcggcacctccctccagatccgaccgtcaggaaaccttcctctggcaacaaagcggcgcgggggacgcctcgtgatagtgaatctgcagccaaccaaacacgaccgccatgccgacttgcgaatccatgggtacgttgatgaagtgatgaccagactgatgaagcatttaggactagagattccagcctgggacgggccccgggtcttggaacgggcactgccccctctgcccagaccgcccacccctaaactcgaaccgaaggaagaaagcccgacgcggataaacggttctattcccgcggggcccaagcaggaaccctgcgctcagcacaacggaagcgaacccgcatccccgaaaagggagcggcctaccagccccgcgccacacagaccaccaaagagggtcaaggcgaaggcagtcccatcc

SEQ ID NO: 19325 - DNA, 1065 bp, Artificial Sequence
  Description of Artificial Sequence: Synthetic coding sequence
atgtcggtcaattacgccgccggtctgtctccatacgccgataaagggaagtgcggacttcctgagatcttcgatccaccggaagaactcgagcgcaaggtgtgggaactggcccggcttgtgtggcaaagctcgtcagtcgtgttccacaccggtgcagggatttccacggcgagcggcatcccggactttcgcgggccccatggggtgtggactatggaagaacggggactcgcgcctaagtttgacaccactttcgaatcagcgaggccaactcagactcacatggccctggtgcagctggaacgggttgggctgctccgcttcctcgtgtcccaaaacgtggatggtctgcacgtcagatcaggattcccccgggacaagttggccgaactgcacggcaatatgttcgtggaggagtgcgccaaatgcaaaacccagtacgtccgggacactgtcgtaggtacgatgggactcaaggccaccggacgcctttgcacggtggccaaggcacggggcctgcgggcttgcagaggcgaactcagagacactatcctcgactgggaggactccctcccagacagagatctcgccctggccgacgaagctagccgcaacgctgacctgagtattaccctcggaacctcactgcagatccgaccgtcaggcaatctccctctggcgaccaaacggagaggtggccgactggtgatcgtgaacctgcagcccaccaagcacgacagacatgcggatttgcgcatccatggttacgtcgatgaagtgatgactcggttgatgaagcatctcggactggaaataccagcttgggatggaccgagagtgctggaacgggcactccctcctctccctaggcctccaaccccgaagctcgagccgaaggaagagtcaccgaccaggatcaacggatcgatccctgcaggacctaaacaggagccgtgcgcgcaacataacggcagtgagcccgcgagcccgaagagagagcggcccacgtcgccggcaccgcaccgcccacccaagcgggtgaaagcaaaggctgtcccctcg

SEQ ID NO: 19326 - DNA, 1065 bp, Artificial Sequence
  Description of Artificial Sequence: Synthetic coding sequence
atgtcggtgaactatgccgcgggactttcaccctacgctgataagggaaagtgtggactgccagagatcttcgacccaccggaggagctcgaacggaaggtctgggagcttgcccggctcgtgtggcagagctcgtccgtggtgttccacaccggtgccggtatctccaccgcctcgggaatcccggactttcgcggaccgcacggagtgtggacgatggaggaacggggtctggccccgaagtttgatactactttcgagtcagctagacctactcagacgcacatggccttggttcaactggaacgcgtcggacttctgcggttcttggtgagccagaatgtggatggcctgcacgtcagaagcggattccctcgcgacaagctggcggaactccacggaaacatgttcgtggaagagtgcgccaagtgtaagactcagtacgttagagatacggtcgtcggcacgatgggcctcaaggccactggccgcctgtgcaccgtcgccaaagcccggggcctgcgggcttgccggggggaactccgggacactattctggactgggaagattccctgccggacagggacttggccctggctgatgaagcgtcgcgcaacgccgacctgtcgatcacccttggcacttcgctccagatcaggccttcggggaacctgccgctcgcgactaaaagacggggaggaagattggtgattgtgaacctccagcctaccaaacacgaccggcatgctgatttgcggatccatgggtacgtggatgaagtgatgacgcggttgatgaagcacctcggactggagatcccggcatgggatggacctcgggtgctggaacgcgctcttccgccgttgcctcggccacccacccctaaactggaaccgaaggaggaaagcccaacccggatcaatggatccatccccgcgggaccaaagcaagaaccgtgcgcccaacataatggaagcgagccggcgtccccaaagcgcgaaagaccgacttcaccagctccgcacagacctcctaagcgggtcaaagcgaaggcggtgccgagc

SEQ ID NO: 19327 - DNA, 1065 bp, Artificial Sequence
  Description of Artificial Sequence: Synthetic coding sequence
atgtccgtaaattatgcggctggtttatcgccctacgctgacaagggtaagtgtggcctaccagagatattcgatccccccgaagagctagagagaaaagtgtgggaattggctcggcttgtctggcaaagctcatccgtggtctttcataccggagcgggtatctccacggcttctggaattccagactttcgggggcctcatggcgtctggacgatggaggagcggggactggcccccaagttcgacacgactttcgaaagcgcaaggccgacgcagacccatatggcactcgtgcaactagaacgggttggcctgctgagatttcttgtgtcccaaaacgtagacggcttgcatgtgcgatccggtttccccagggataagcttgctgaattgcacggcaacatgtttgtggaagagtgcgcaaaatgtaagactcagtacgtgcgggatacagtggtaggaactatgggtcttaaggcgactggaaggctgtgcaccgtggcgaaggcccggggtctgcgtgcttgccgcggtgaactacgggatacgatcctggattgggaagacagtcttcctgatcgggatctcgctctggccgacgaggcgtctcgtaacgccgatttgagtattactctggggacctccctacagatacgtccatccggtaacctcccgctggcaactaagcgccgcggagggcggctcgtgatcgtaaacctacagcccaccaagcatgaccgccacgccgatttgcgaatacatggctacgttgacgaagtgatgactagactgatgaaacacctggggttagaaatcccggcatgggacggcccacgggtgctcgaaagagctctcccgccactcccaagaccaccaacccctaagctcgaaccgaaagaggagtcccctacaaggatcaatggtagcatccctgcgggccccaaacaggagccctgcgcacaacacaatgggtctgaaccagccagtccaaaacgcgagaggcccactagcccagcaccacatcggccccctaagcgcgttaaggccaaggccgttccctcc

SEQ ID NO: 19328 - DNA, 1065 bp, Artificial Sequence
  Description of Artificial Sequence: Synthetic coding sequence
atgtcagtgaactacgcagccggtttgagtccctacgctgataaagggaagtgcgggctgccggaaattttcgatccaccagaggaactcgagaggaaggtgtgggaattggctcgactagtctggcagagttcctcggtcgtgtttcacactggtgcaggtatttcaacggcttccggaattcctgattttagaggcccccacggagtttggactatggaagagagaggattagcaccaaaatttgataccacgttcgaatccgcaaggcctacgcaaacccatatggctctcgttcagttggagcgtgttggcttgttgagatttttagtgtcccaaaatgttgatggtctacatgttaggtctgggttcccacgtgacaaattggctgaactacatggaaacatgtttgttgaagagtgtgctaaatgcaagacgcaatacgttagagacactgtcgtcggaacaatgggtttaaaggctaccgggcgattatgcaccgtcgccaaagcacgaggattaagggcctgcagaggtgagttgcgcgacaccatcctcgattgggaggattctttacctgatagagacctggcacttgctgacgaggcatctagaaacgctgacttatccattactttgggtacatcgttgcaaattagaccttctggcaatctacctttggctactaagaggaggggcggaagacttgtgatcgttaacctgcagcccactaaacacgaccgtcatgcagatctaagaatacatggctatgtagatgaagtaatgactaggcttatgaagcacttaggtttggaaattcccgcctgggacggccctcgcgttcttgagcgtgctctccctcctcttcctaggcctcctacccctaagctcgagcctaaggaggagtctcctactcggatcaacggaagtattcccgcaggcccgaaacaagagccttgtgcacagcataacggcagtgaaccagccagtcccaaaagagagagacccacatcacctgctcctcatagacctcctaaacgcgttaaagccaaggcagttccttca

SEQ ID NO: 19329 - DNA, 1065 bp, Artificial Sequence
  Description of Artificial Sequence: Synthetic coding sequence
atgtcggtcaattatgccgccgggctttccccatacgcggacaaaggcaagtgtgggctgcctgaaatctttgatcctcctgaggaacttgaacgtaaggtttgggaactggccagactggtctggcaatcctcatctgtggtgtttcatactggcgcaggaatttccaccgcgtccggaattccagatttcagaggcccacatggggtctggacgatggaagaaaggggcttggcaccgaagtttgacaccactttcgaatccgcaagaccgacccagactcacatggcactggtgcagctggaaagagtcggacttctgaggttcctggtgtcacagaatgtggatggacttcacgtcagatcaggttttccacgagacaaactggcagaactgcacggtaatatgttcgtcgaagaatgtgcgaagtgcaaaactcaatacgtgcgtgataccgtggtgggaacgatgggacttaaagcaactggacgcctttgcacggttgcaaaggcccggggacttagggcgtgtagaggggaacttcgggatactattctcgattgggaagattcccttccagatcgcgacctggccctggcagatgaagcaagcagaaatgcagatctctcaatcaccctgggtactagcctgcagatccggccatcgggtaaccttcccctggcaactaaacggcgtggggggcggctggtgatcgttaaccttcagcctaccaagcacgacagacatgcagatttgaggattcacggttacgtggatgaggtgatgactaggctgatgaagcatctcggacttgagatcccagcatgggacggtcccagagtgcttgagagggccctccctcctcttccgcgcccccctaccccaaaacttgagcctaaggaggagtcgccaactcgcattaacggatccatccctgcgggaccaaagcaagaaccatgcgcacagcataatggctccgagccagctagcccaaaacgggaacgccccacttcacccgcaccacatagaccaccgaagcgcgttaaggcaaaggcagttccatcc

SEQ ID NO: 19330 - DNA, 1065 bp, Artificial Sequence
  Description of Artificial Sequence: Synthetic coding sequence
atgtcggtgaactacgcggccggcctgtcgccttacgcggacaagggaaaatgcggcttgccagagatctttgaccccccggaagagttggaaaggaaggtttgggagctggcccgcctcgtctggcagtcctcctcggtcgtgttccacaccggtgcggggatctccacggcatcaggcattcccgatttccggggaccgcatggagtgtggaccatggaggaacgcgggctcgcacctaagttcgataccactttcgagagcgcacgtccgacccaaacccacatggctctggtgcagcttgaacgagtggggctcttgaggttcttggtttcccagaatgtggatggacttcatgtgcggtcggggttcccaagggacaaactcgctgagttgcatgggaacatgtttgtcgaagaatgcgcgaagtgtaagactcagtacgtgcgggacactgtcgtggggactatggggctcaaagctaccggtcgcctctgcactgtcgctaaagcccgtggactgagagcctgcagaggagagctccgggacacgatcctggactgggaggacagcctgcctgaccgcgatttggccctggctgacgaagcaagccgaaacgccgatctctccatcacgctgggcacttccctccaaatccgaccaagtggaaatctccctctggcgaccaagcgccgcggtggtcggctggttatcgtcaatctgcagccaacgaaacatgaccgccacgccgatctcagaatccacggatacgtggacgaggtgatgaccaggctgatgaaacacctcggactggaaataccggcctgggacggacctagggtgttggagcgtgccctgcctccgctgccgcgcccacctaccccgaaactcgaaccgaaagaagagagtccgactcgcattaacggatcgatccccgccggccctaagcaagaaccatgtgcccaacataacggaagcgaaccagcctcgcccaagcgagagcggcccacttcaccagccccgcacagacccccaaagagagtgaaggccaaggcagtgccctcg

SEQ ID NO: 19331 - DNA, 1065 bp, Artificial Sequence
  Description of Artificial Sequence: Synthetic coding sequence
atgtccgttaattacgccgcaggactttcgccatacgccgacaaagggaagtgtggcctcccagaaatattcgaccctcctgaggagctggagcgtaaggtgtgggagctggcaaggttggtgtggcaatctagctccgtcgtgtttcacactggggcagggatttccactgctagcggcataccagattttcggggtccacatggagtgtggactatggaggagcgagggctggcaccaaagttcgataccacctttgaatccgcacgacccacacagacacacatggccctagttcagctggagcgagtcggtctgctgaggttcctcgtgtcacagaatgtagacggcctgcatgtaagatccggtttccccagagacaaactggccgagcttcatgggaatatgtttgtggaggaatgcgctaaatgcaagacacagtacgtgcgggacaccgtggtcggaactatgggactgaaagccacaggcaggctgtgtactgttgctaaggcaaggggcttgagggcttgccgtggcgaactccgggacacgatcctggactgggaagatagcctgccagatagagatctggcactggcggacgaggctagtcgtaacgccgaccttagtatcactctgggaactagcctgcagatcagaccgtcaggtaatctccctttggccaccaagcgcaggggcggccgcctcgtgatcgttaatcttcagcctaccaagcacgatcggcacgccgatctgcgcattcatggttatgtcgatgaggtgatgacacgccttatgaagcatcttgggttggaaatcccggcatgggacggtcctagggtgctggagagggccttacccccactaccccggccacccacccctaaactggagccgaaagaggaaagccccactcggatcaatggctccatccctgccggcccaaagcaggagccttgcgctcaacacaacggatctgaacctgcctctccaaaacgggaacgcccaacaagcccggccccccacagaccccccaaaagggttaaggccaaggcggttcctagc

SEQ ID NO: 19332 - DNA, 1065 bp, Artificial Sequence
  Description of Artificial Sequence: Synthetic coding sequence
atgtcggtgaattacgctgccggactttctccgtatgcagataaaggtaagtgcggactcccagaaattttcgatccgcccgaagaacttgaacgaaaagtctgggaactagcccgactcgtgtggcaatcctcatctgttgtgtttcacacgggtgctggaatatcaactgcatctggtattccggatttccgaggacctcatggtgtatggactatggaagaaagagggttggctccgaaattcgatacaacattcgaatctgcacgcccaactcagacacacatggcactcgtccaactcgaaagggttggattgttgagattcttggtgagtcaaaacgtagatggattacatgttaggtcagggttccctcgtgacaagctggctgaactccacggtaacatgtttgtagaagaatgtgcgaagtgtaagactcaatatgttcgagatacggtggtcggcacaatgggcctgaaagccaccggacgcctttgcactgttgctaaggcaagaggactcagagcatgtcggggagaattaagggacacgattcttgactgggaggatagtctccctgacagggatctggcgcttgctgacgaagcaagtcgaaatgcagatctttcaattacacttggaacctctctacagattaggccaagcggaaatcttccgttggcaactaaacgacgaggtggaagactcgttattgtgaatctgcaaccaacaaaacacgatcggcacgcagatttgagaatccacggatatgtggatgaagttatgacacgtttaatgaagcacttgggtcttgagatcccggcatgggatggaccacgcgtactggaaagagcgttgccacctctccccagaccacctacaccaaagcttgaacccaaggaagagagcccaactcggattaatggatcgattccagcagggcccaaacaagaaccatgtgctcagcacaacggatcggaacctgccagcccgaaacgtgaacgtcccacatcccctgcaccacaccggccgcccaagcgtgtaaaggccaaggcagtcccaagc

SEQ ID NO: 19333 - DNA, 1065 bp, Artificial Sequence
  Description of Artificial Sequence: Synthetic coding sequence
atgtctgtgaattatgccgccgggctcagcccatacgcggataaaggcaagtgcgggctcccggagatctttgatccgccagaagaactggagaggaaagtgtgggaactggctcggctggtgtggcagtcctcctcggtcgtgttccataccggagcgggtatttcaactgcgtcgggcatcccggacttccgcggaccgcatggagtttggaccatggaagaacgaggcttggccccgaaattcgacaccacctttgaaagcgcacgacccactcagacgcacatggctctggtccagctcgaaagagtcggactgttgcgttttctggtcagtcaaaatgtggacggactgcacgtgcgctcgggattcccgcgcgacaaacttgccgaactccatgggaacatgttcgtggaagaatgtgcgaagtgtaagacgcagtacgtacgggatactgtggtgggcactatgggactgaaggcaaccgggcgcttgtgcaccgtggccaaggccagaggtctgagagcatgccggggtgaactgagggacaccattctggattgggaagactccctgcctgacagagatctcgcccttgcagacgaggccagcaggaacgcggacctgtcgattacgcttggaacttcacttcaaattagaccatccggaaaccttccgctggccactaagcggcggggcggacgcctggtcatcgttaacctccagccgaccaagcatgacaggcacgccgaccttaggatccatggatacgtcgacgaggtgatgaccaggttgatgaagcacctgggactcgagatcccagcgtgggatggtccgagggtgttggaacgcgcgttgcctcccttgccaaggccgccgactccaaagctcgagccgaaggaggagagccccactagaatcaacggatctatcccagccggaccaaaacaagaaccatgcgcccagcacaatggctccgaacctgcatcccccaagagggaaagaccaacttcacctgcgccgcatcggccgccaaagcgggtgaaagcgaaggctgtgccatct

SEQ ID NO: 19334 - DNA, 1065 bp, Artificial Sequence
  Description of Artificial Sequence: Synthetic coding sequence
atgagcgtgaactatgctgctggtctctccccatacgccgacaaagggaaatgtgggcttcccgagatcttcgatccacctgaggagctggagagaaaggtttgggagctagcacggctggtctggcagtcttcatctgtggtgtttcacaccggggcaggtattagtaccgcctccggcattcccgatttccgggggcctcatggggtgtggacaatggaagagaggggcctggcccctaaatttgacaccaccttcgaaagcgctaggccaacccagactcacatggccctcgtgcagttggaacgtgtcggactgctgcgcttcctcgtgagtcaaaacgtcgacgggctgcacgtgcgaagcggttttcctagagataaacttgctgagcttcatgggaatatgttcgttgaggaatgcgccaagtgcaaaacgcaatatgttagagataccgtggtggggaccatgggtctgaaggccaccgggagactgtgcacggtggctaaggccaggggtctccgtgcatgccgtggagaattaagagatacaatcctcgattgggaagatagcttgccggatcgcgacctggcgctggcagatgaggctagtagaaacgccgacctgtctatcactctagggaccagcctgcagattcgtccatccggcaatttgcccctggcaactaagaggagaggcggcaggcttgtgatcgttaacctgcagccaaccaaacatgatagacatgccgatctgcgcatccatggctacgttgatgaggtgatgacacgcttgatgaagcatcttggactcgagataccagcgtgggacggtcccagggtgctggagagggccctgcccccactgccaaggccaccaacaccaaagctggagccaaaagaagaatcccctacgagaattaacgggtcaatccctgccggaccaaaacaagagccgtgcgcccagcacaacggctccgagcccgctagcccaaagcgcgaaaggcctacatccccggcgccccatagaccccctaaacgcgtgaaagcaaaagccgtgccctca

SEQ ID NO: 19335 - DNA, 1065 bp, Artificial Sequence
  Description of Artificial Sequence: Synthetic coding sequence
atgagcgtcaactacgcggcaggactgtcgccatatgcagataagggtaagtgtggactcccggaaatctttgatcctccagaagaactggagcgtaaggtctgggagctggcccgtcttgtgtggcaatcctcatccgtcgtgtttcatactggagccggaataagcactgcgtccggtattcccgattttagaggcccccacggcgtgtggaccatggaggaaagaggacttgcacctaagtttgataccacctttgaatcagcccgacctactcagacccacatggcactggtgcaactggagcgcgtcggattgctccgctttctcgtgtcgcagaacgtggacgggctgcacgtgcggtcgggttttccaagagacaagctggcagaactgcatggcaacatgtttgtggaagaatgtgcaaagtgcaagacccaatacgtcagagacactgttgttggtactatgggtcttaaggcaaccggacgcctttgcaccgtggctaaggccagaggattgcgcgcatgtaggggcgagttgcgtgatacgattcttgattgggaagatagccttcccgatagggatctggcacttgcagatgaagcgtcaagaaatgcggatcttagcattactcttggaacttctttgcaaattcgcccttccggaaacctcccgcttgcaaccaagcgcagagggggcagactggtcattgtcaatctccagccaaccaagcacgaccggcacgcggatctgcggatccatggttacgtggatgaggtcatgaccagactcatgaaacatttgggccttgaaatccctgcgtgggatggacctcgggtccttgaacgggcactgcctcctttgccacgtcctcctaccccgaagctggaacctaaagaagagtcgcccaccagaataaacggaagcattcccgcaggtcccaaacaagagccatgtgcacaacacaacggatccgaaccagcaagcccaaagagagagcgtccaaccagccctgcaccacacaggccgcctaagcgggtgaaggcaaaggccgtgccatcc

SEQ ID NO: 19336 - DNA, 1065 bp, Artificial Sequence
  Description of Artificial Sequence: Synthetic coding sequence
atgtctgtgaactacgctgcgggattgtctccatatgcagacaaagggaagtgtggcctccccgagatctttgacccacccgaagaactagagagaaaagtgtgggaactggcacgactggtttggcaatctagctcagtggtgtttcacactggggcaggtatttctaccgcctctggaattccagactttcgggggccccatggagtttggaccatggaagaacgtggactggctcctaagtttgatactaccttcgagtcagcacggcccacacaaacccacatggctctcgtgcagctcgagcgcgttgggctacttcgcttcctggttagccagaacgttgatggattacatgttagatctgggttcccacgcgataagcttgccgagttacacgggaacatgtttgttgaggagtgtgccaagtgcaaaacccaatatgtgagagataccgtggttggcactatgggcctgaaggccactgggaggttgtgtaccgtggccaaggcaaggggtctgcgtgcttgccggggcgagctgagggatacaatcttggactgggaagactcactgccagatcgcgacctagcactcgccgatgaagcctcaagaaacgcagatctgagcattacactaggaacttctcttcaaatccgacctagcggaaatctgccgctcgcaacgaagcggcgggggggccgtcttgtaatcgttaacttacaaccaaccaaacacgacaggcacgctgacctcagaattcacggatacgttgatgaagtgatgacccgtctgatgaagcacctaggtctggaaattcctgcctgggacggccctagagtcttagagcgagccctgccccccctgcctcgtccccccaccccaaagctggagcccaaggaagagtctcccacaaggattaacggatccattccagcaggccctaagcaagaaccctgtgcccagcacaacggctccgaacctgctagcccgaaaagggaaagacccactagtcccgctccacatcgcccgcctaaaagggtcaaggctaaggctgtgccctca

SEQ ID NO: 19337 - DNA, 1065 bp, Artificial Sequence
  Description of Artificial Sequence: Synthetic coding sequence
atgtccgtgaattacgcggcaggcctgtctccatacgcggataaggggaagtgcggactgccagagatcttcgatccgccggaagaattggagagaaaggtgtgggaactggcacggctggtctggcaatcgtcctcggtcgtctttcacacgggcgcagggatcagcactgcgtcgggaatccccgatttccgcggaccacacggtgtgtggaccatggaggagaggggtcttgccccgaagtttgacaccaccttcgaatccgcaaggcccactcagactcacatggcactggtgcaactggagagggtgggcctgctccgctttctggtgagccagaacgtggacggtttgcacgtgagatcaggattcccacgggataagctggcagaacttcacggaaacatgttcgttgaagagtgcgctaagtgcaagactcaatacgttagagataccgttgtgggaacgatggggctgaaggcaaccggacggctctgcaccgtggccaaagccagaggactccgagcgtgcaggggggaactccgcgacaccatcttggattgggaggactcattgcctgaccgagatctcgcgctggcagacgaggcatcacgcaatgcggatctctccatcaccctcggaacctccctgcagatccgcccgtccgggaacttgccactcgctacgaagcgccgcggcggtaggctggtcattgtgaacctgcagccgaccaagcacgacaggcacgctgaccttcgcatccatggctacgtagacgaagtgatgacgagactgatgaagcatctcggccttgagataccagcctgggacggaccacgcgtcctggagcgcgcactgcccccgctccccagaccgccaactcctaaactggaaccgaaggaggagagccctaccagaatcaatggttcaatccctgctggccctaagcaagaaccgtgcgctcagcacaacggatccgaacccgcaagcccgaagagagaacgcccaacttcaccggcgcctcaccggccgcctaagcgcgtgaaagccaaggccgtcccgtca

SEQ ID NO: 19338 - DNA, 1065 bp, Artificial Sequence
  Description of Artificial Sequence: Synthetic coding sequence
atgtctgttaattacgctgccggtctcagcccctatgccgacaagggaaaatgtgggctgccggagatcttcgaccctccagaagagctggagaggaaagtctgggagctggccaggctggtctggcagtcctcaagcgttgtattccacaccggagctggaatcagcactgcgagtggaatcccagatttcaggggaccccatggagtgtggaccatggaggagagaggcttggcaccaaaatttgacactaccttcgagagcgcccgaccaacgcaaacacacatggcactggttcagctcgagagagtaggactactgaggtttctcgtcagtcagaacgtcgatggtttgcatgtccgcagcggtttccctagagataaactcgcagaattacatgggaacatgtttgttgaggaatgcgctaagtgtaaaactcagtacgttcgcgacaccgttgtaggcaccatgggtctgaaggccaccgggcgtttatgcaccgtcgctaaggcaaggggcctgcgagcctgcagaggagagttgcgggataccattctggactgggaggatagccttcccgatagggatctggctcttgctgatgaagcctctagaaacgccgacctttctataacactcggcacctctctgcaaatacggccatcaggaaatctgcctttggccacgaagcgaagaggcggccgactggtcatagtcaatctgcaacccactaaacacgacaggcatgcagatctgcggatacacggatacgttgacgaagtcatgactcgactgatgaaacatctgggcctcgaaattcctgcctgggacggcccccgggtgctcgagagggcactgccccctctcccaaggccccctaccccaaaactggagcctaaagaagaatcacctacccgtattaatggctctattccagcaggccccaaacaggaaccatgcgcgcagcataatggcagtgagccggccagtcccaagagagagagacccacaagccctgctcctcataggccccccaaacgggtcaaagcgaaagctgtgccctct

SEQ ID NO: 19339 - DNA, 1065 bp, Artificial Sequence
  Description of Artificial Sequence: Synthetic coding sequence
atgtcggtcaattacgctgcaggactgtcgccgtacgcggacaaagggaagtgcggactcccggagatttttgatcccccggaggaacttgaacgtaaagtctgggagctggctagactggtgtggcagagcagcagcgtcgttttccacaccggagctggaatctcgactgcgtccggcatcccggattttagagggccccacggcgtgtggactatggaggagagaggacttgcccccaagtttgacaccacgttcgaatccgcccgcccaacgcagacccatatggcattggtgcagcttgaacgagtgggactgctgcgattcctcgttagccaaaacgtggatggactgcatgtgagatcgggattcccacgtgacaaactcgccgagctgcatggcaatatgttcgtcgaagaatgcgccaagtgtaagactcagtacgtgcgggatactgtggtggggacgatgggacttaaggcgaccggcaggctgtgtactgtcgcgaaggcacgcggactccgtgcttgcagaggtgagctgcgcgacactatcctcgattgggaggactcgctcccggaccgcgacctggccctcgcggacgaagcatccaggaacgcagacctctccatcactctgggaacttcactccaaatccgccctagcggtaacttgccgctggcgaccaagcggcggggaggacggctggtgatcgtcaacctgcagccgaccaagcacgaccggcacgcggatctgaggattcacggctacgtcgatgaggtcatgacccgcttgatgaagcacttgggcctcgaaatccctgcctgggacggcccgcgcgtgctcgaaagggccctgcctcctctgcctcgcccaccgaccccgaaactcgagccaaaggaggaatccccgacccggattaacggatcgatcccagccggtccaaagcaagaaccctgcgcccagcataatggctcagaaccggccagcccgaaaagagagcgtccgacgtccccggctccccaccgcccaccaaagagagtgaaggcgaaggcagtgccatca

SEQ ID NO: 19340 - DNA, 1065 bp, Artificial Sequence
  Description of Artificial Sequence: Synthetic coding sequence
atgagcgtcaactatgcggccggcctatcaccatacgctgataaaggcaagtgtggtctgcccgagattttcgaccctccggaggaactggaaagaaaggtgtgggaactcgcacgcctggtgtggcagtcttctagtgtagtgttccataccggcgctggtatttccactgcttcaggaatccctgatttccgtggcccccacggggtctggaccatggaagaacgcggacttgcccctaaattcgatacaacattcgagtcagctcgcccaacccaaacccacatggccctagttcagctcgaaagggtcggattgctcagattccttgtttctcagaatgtagatggcctccatgtaagaagtggttttcctagagataagctcgccgaactccacgggaacatgttcgtagaggaatgcgctaaatgcaaaacacagtatgtccgcgatacagtggtgggaaccatggggctaaaggcaactggcagactctgcacggtggctaaggctaggggactgagggcatgcaggggggagctgagagatacaattcttgactgggaagacagtctcccagatcgcgacctcgcgcttgccgatgaggcaagccggaatgcagacttaagtattactctgggaacctcgcttcagatcaggccatcaggcaacctccccctggcaactaaaagaagaggcggacggcttgtgatcgtcaacctacagccaaccaagcacgacagacacgctgacctccgaatccacgggtatgtggatgaagtgatgaccaggctcatgaaacacttaggactggagatacccgcatgggatggcccccgagtgctcgagcgggccctgcccccacttccgcgccctccaactcctaagctcgaacccaaagaggaaagcccaacacggatcaacgggagtataccagcagggccaaaacaggaaccatgtgcccaacataacggtagcgaaccggcatctcccaaacgcgagcgcccgacatctcctgcacctcacagaccacccaaacgggtgaaggcaaaagcagtcccgtcc

SEQ ID NO: 19341 - DNA, 1065 bp, Artificial Sequence
  Description of Artificial Sequence: Synthetic coding sequence
atgagtgtcaattacgcggccggacttagcccttatgctgacaagggtaagtgtggtctccccgaaatcttcgacccacccgaagagctggagagaaaagtatgggagttggcaagactggtttggcagtcttcttcagtcgtctttcacacaggcgctggcatctccacagccagtggaatccccgacttccgcggccctcatggagtctggacgatggaagaaagaggtcttgcgcctaagtttgatacgacattcgagtcagcacgcccgacacagacccatatggccctcgtgcagttggaacgcgtaggcctgctgaggtttctcgtatcacagaatgtggatggacttcacgtccgcagcggtttccccagagataagctggccgaactccacggaaatatgttcgttgaggagtgcgcaaagtgtaagactcagtatgttagggacaccgtggttggcactatgggcctgaaggccacaggcagactttgcaccgttgccaaagcgcgcggcctgagagcctgcaggggagaattgcgcgacacgattcttgattgggaggactccctccctgacagagatctggctctggccgacgaagccagccgcaatgcggacctcagtataaccctgggtacatcccttcaaattcgcccctccggcaatctgccattggcaaccaaaagaaggggcggccgccttgtgatcgtgaacttgcaacctactaaacatgacagacacgccgacctcagaattcatggctatgtggatgaggtaatgacccgcctgatgaaacatctgggtcttgaaattcctgcgtgggatggccccagagtgctggaaagagctttgccccccttgcccaggccgcctaccccaaagcttgagcccaaggaggagtcccctacaaggattaacggatctattccagctggacccaagcaggagccctgcgctcagcataacggaagcgagccagcttctcccaagcgcgagaggccgacatcacccgccccacacaggccgcccaagcgcgtgaaggccaaggctgtcccttcc

SEQ ID NO: 19342 - DNA, 1065 bp, Artificial Sequence
  Description of Artificial Sequence: Synthetic coding sequence
atgtctgttaactacgccgccggtctgtcgccctacgctgataaggggaaatgtggacttcctgagattttcgaccctccagaagagttggaaagaaaagtgtgggaattagctcggctcgtctggcaaagctcaagcgtagtatttcataccggcgctggcatttcaaccgcgtctgggatacccgacttccgggggccacatggggtgtggacaatggaagagaggggtctggcccctaaatttgataccacatttgagtcagcgcgtcccactcaaacacacatggctctggtgcagttggaaagagtggggctacttcggttcctggtgtcccagaacgttgacgggctccacgtgcgaagcgggttcccaagggacaagctggccgagcttcatggcaacatgtttgtggaggagtgtgctaagtgtaaaacacagtacgtgcgtgacacagtcgtgggcaccatgggtttaaaggctacagggcgcctctgcaccgtggctaaggcgagaggactgagagcctgccggggtgagttgcgggacaccatcctggattgggaggacagccttcctgatcgcgacttagccctcgcagacgaggcatctcggaatgctgacttgtctatcaccctagggactagcctgcagatcaggcccagcggcaatctgccgttggcaaccaagagacgtggaggccgtcttgtaattgtcaacttacagccgaccaaacacgatcggcatgctgacttgaggatacatgggtatgttgatgaggttatgactcgcttgatgaagcacctagggcttgagataccagcctgggatgggccacgggtcttggaaagagcgctgcccccactgccacgacccccgacacccaagctggaacccaaggaggaaagtcccacgaggattaacgggagcatccccgcaggccctaaacaggagccctgcgctcagcataacggaagcgaacctgcctcccccaagagagaacgaccgacatctcctgctccgcaccgcccacccaagcgcgtgaaggccaaagctgtgccttct

SEQ ID NO: 19343 - DNA, 1065 bp, Artificial Sequence
  Description of Artificial Sequence: Synthetic coding sequence
atgagcgttaactacgcagctggcctgtcgccttacgctgataagggaaagtgcggcctcccagagattttcgatcctcccgaggaattggagcgcaaagtgtgggaactcgcacgccttgtatggcagtcctcatccgtggtgtttcatactggggctggtatttcgactgcctcgggtatccctgatttcagaggtccacacggggtctggactatggaggaacgcggccttgcacccaagtttgataccacgttcgagtcggctaggccaacccaaactcatatggcgctggtgcagctcgaaagagtggggcttctgcggtttttggtgtcgcagaacgtggacggactgcacgtgaggtccggattcccccgggataagctcgccgaactccatggaaacatgtttgtggaggaatgcgctaagtgtaaaacccaatatgtgcgagacactgtggtgggaactatgggtcttaaggcgactggacgcctttgtactgtggccaaggcgcggggtctgcgagcctgtagaggtgagcttcgtgataccatcctggattgggaggatagccttccagatcgagatcttgcgcttgcagatgaagcaagcaggaacgcagacctcagcattactctgggtacgagcctgcaaattcgcccatcgggcaacctgccgcttgcaactaagcgtaggggtggtagactggtgattgttaatctccagcctaccaaacatgataggcacgcagatctcaggattcacggatacgtcgacgaagtgatgacccgccttatgaaacatctgggtcttgaaatacctgcctgggatggaccccgagtccttgagcgtgcccttcctccactgccacggcctcctactccaaaactggaacctaaagaggaatcccccacccgcattaacggatccatcccagctggaccgaagcaagagccttgtgcacaacataacggttcggagccagcatcaccaaaacgcgagcgtcctaccagccctgcacctcaccgaccacctaaacgggtcaaagccaaggccgtgcctagc

SEQ ID NO: 19344 - DNA, 1065 bp, Artificial Sequence
  Description of Artificial Sequence: Synthetic coding sequence
atgtcagtgaactacgctgccgggttgtctccctatgcggacaagggaaagtgtggtctgcccgaaatctttgaccctcctgaagagcttgaacgcaaggtgtgggagctggccaggctcgtctggcaaagcagcagcgtggttttccatacgggagcagggattagtaccgccagcggcatcccagatttcagaggaccccatggggtctggactatggaagagcgggggctggcccccaaattcgacacaaccttcgagagcgcacggccaacccagacacatatggctttggtccagctggaacgggtggggttgttgcgctttctggtctcacagaacgtcgatggtctccatgtgaggtcaggcttcccccgcgacaagctggctgagttacacgggaacatgtttgtggaggagtgcgccaagtgtaagacccaatatgtgcgagacaccgtggtgggaaccatgggcctcaaggccacaggacgcctttgcaccgtggctaaggcacgcggcctccgagcctgccggggagaactgcgcgacactatcctggattgggaagactccctccccgaccgagaccttgccctggcagatgaggccagtaggaatgccgatttaagcatcactctcggcacctcgctccagattcggccatcaggaaatctgcccctagccacaaagcggcggggcggacgcctggtgatagtgaacctgcagcccaccaagcatgatcgacacgcggatctgcgcatacatggctatgttgatgaggttatgactaggctgatgaaacatctgggcctcgaaattccggcatgggatggacctcgcgtgctggagagagcattacctcctcttccccggcctccaacacccaaattggaacccaaggaagagtccccaactagaataaatggcagcatacccgcgggacccaagcaagagccgtgtgctcagcataatggcagcgagcctgcctcccccaagcgagagagacccacctctccagctcctcacaggcccccaaagagagtgaaagccaaagcggtcccttcc

SEQ ID NO: 19345 - DNA, 1065 bp, Artificial Sequence
  Description of Artificial Sequence: Synthetic coding sequence
atgtcggttaattatgccgctggtctgtctccctatgcagacaaaggcaagtgcggtttgcccgagatatttgacccccccgaagagctggagcggaaagtgtgggaactcgcgcggctcgtgtggcagagctcaagtgttgtcttccatacaggggcagggatctctacagcatcaggtattcccgacttccggggaccccacggggtctggacgatggaggagcgggggctggctcccaagtttgatacaactttcgagtccgcccggcctacccagacgcacatggccctggtgcaattggagcgcgtcggccttctgcgattcctggtttcccagaatgtcgacggtctgcacgtccgtagcggcttccctagggataagctggccgagttacacggtaacatgttcgtggaagaatgcgccaagtgtaagactcaatatgtgcgagatactgttgtcggcactatgggtctgaaggctaccggcaggctctgcactgtggcaaaggcccggggtcttcgcgcttgtcgcggcgaattaagagataccatccttgattgggaggattcgctgcccgacagagacctcgcgctcgccgacgaggcttcacgcaatgctgatctgagcatcaccctggggacctctctccagattcgcccttctggcaacctgccgcttgcaacaaagcggcggggcggtagactcgtcattgttaacctacagcccacaaagcacgaccggcatgccgaccttcgcattcatggttatgttgatgaggtgatgacacgcttgatgaaacatctcggcttggagattcctgcctgggacggcccccgcgtcctggagcgtgcccttccaccccttccacgtcctccgacacctaagttggagcccaaggaggagtcaccaactcggataaatgggtcaattccagcagggccaaaacaggaaccctgtgcgcaacataatggctccgagcccgcctcaccgaagcgcgaacgcccgacatctccagctcctcacagaccccctaagagagtgaaagcgaaagctgtcccttct

SEQ ID NO: 19346 - DNA, 1065 bp, Artificial Sequence
  Description of Artificial Sequence: Synthetic coding sequence
atgtcagtgaattacgcagctgggctgtccccatacgccgataagggaaagtgcggattgcccgagattttcgatccccccgaagaactcgagcggaaggtctgggaattggcacggctcgtctggcagtcgtcatcagtcgtgtttcataccggagccggaatttcaactgcctctggtattcccgattttaggggcccacacggagtgtggactatggaggaacgaggactggcaccgaagttcgatactacttttgaatcggcacggcctacgcaaactcacatggcgctcgtgcaactggagcgagttggacttctgcggtttcttgtgtcacagaacgtggacggccttcatgtgcgttcgggatttccgcgcgacaagctggctgaactgcacggtaatatgttcgtggaagaatgcgcaaagtgtaaaactcaatacgtccgggacaccgtcgtgggtacgatgggactgaaggccaccggaaggttgtgtaccgtggcaaaggcgagaggtcttagagcgtgtcgcggagaacttcgggataccattcttgattgggaggacagccttcctgaccgcgatttggcacttgcagacgaggctagcaggaatgcagatcttagcatcactcttgggacgtccctccagatcagaccttccggaaacctgcccctggccactaaacggcggggaggacgcttggtgatcgtcaaccttcaacctacgaaacacgatagacatgccgatctgagaatacatggctacgttgatgaagtgatgactcgacttatgaagcatcttggactggaaatacctgcgtgggatggtccaagagtgcttgaacgtgcactgccacctcttcctcggcctccaacccctaaactggagccaaaagaagagagccctacgcgcattaatgggtcaatcccggcaggaccaaagcaggaaccatgcgcccagcataacggctccgagccagcatcccctaagagagagcgcccaacctcacctgccccacaccgccccccaaagagggtcaaggcgaaggcagtgccttct

SEQ ID NO: 19347 - DNA, 1065 bp, Artificial Sequence
  Description of Artificial Sequence: Synthetic coding sequence
atgtcggtgaactacgccgctggactgtcaccgtacgcagacaaaggcaagtgcgggctgccggagattttcgatcctccggaagaattggaacgtaaggtgtgggagctggcgcgcctcgtctggcagagttcatctgtcgttttccacaccggagccggaatctccaccgcgtcaggtattccggacttcagaggaccgcacggagtgtggactatggaggaacgcggtctggccccgaagtttgataccaccttcgagtccgcccggccgacccaaacccacatggccctggtgcaactggagcgcgtcggactgctcagattccttgtctcccagaatgtggatggactccacgtccggtctggcttcccgagagacaaactggccgaactccacggtaacatgttcgtggaggaatgtgcgaagtgcaagacgcagtacgtgagagataccgtggtgggcacgatgggcttgaaggcaaccggaaggctctgcactgtggcaaaggctcgcgggctgcgagcctgccgaggcgagctgcgcgacacgatcctcgactgggaggactccctcccagaccgggacctggcgctggctgacgaggcctcgcgcaacgcagatctgtccattaccctcggaacttcgttgcagatccggccttcgggcaacctgccgctggcaactaaaaggcggggagggagactcgtgatcgtcaacctccagcctactaagcatgacaggcacgccgacctgcggatccatgggtatgtcgatgaagtcatgacccgcctgatgaagcatttgggtctggaaatcccggcgtgggacggaccgagagtgctcgagcgcgccctgcctcccctgccccggccgccgactccgaagctcgaaccgaaggaagaaagcccgacccggatcaatggatcaattcctgcaggacccaaacaagagccttgtgcccaacataacggaagcgagccggcatcgccgaaacgggagcgccctacctccccggccccgcatcggcctcccaaaagagtgaaggccaaggcagtgccgtct

SEQ ID NO: 19348 - DNA, 1065 bp, Artificial Sequence
  Description of Artificial Sequence: Synthetic coding sequence
atgagcgttaactacgcagccggactttcgccgtacgcagataaggggaagtgcgggctcccagaaatctttgaccctcctgaagaacttgagcgcaaggtctgggaattggcacgtctggtgtggcaatcctccagcgtggtgtttcataccggagcaggaatttccacggcctcggggattcccgattttagaggtccacacggtgtgtggactatggaagaacggggactcgcccctaaattcgatacgacgtttgaatctgcacggcctacccaaacccatatggcacttgtgcagttggaacgcgtgggactcctgcgattcctcgtgtcccagaatgtggacggcctccacgtgagaagcggattccctagggataaacttgctgaactgcacggaaacatgttcgtggaagagtgtgctaagtgtaaaacccaatacgtcagagacactgtcgtcggaactatgggtctgaaggctaccggtagactgtgtactgtggcgaaggcaagaggtctgcgggcatgtagaggggaactcagggacactattcttgattgggaggactcacttcctgacagagacttggccctggcagatgaagcgtctcgcaatgcagatctgtccataactcttgggacctccctccaaattcgaccttctggtaatctccctctggcaaccaagcggagaggaggtagacttgtgattgtgaatctgcagcctaccaagcatgaccgccatgcggatctgcggattcatggttacgtggatgaagtcatgactcgcctgatgaagcatctcggcctcgagatccctgcgtgggacggtccacgcgtcctggagcgtgcactgcccccacttcctcgacctcctactccaaaactcgaacccaaggaagaaagcccaacccgtattaacggctcaattccagcgggccctaagcaagaaccttgtgcacagcataatggttccgaacccgcatcgccaaagcgggaaagacctacctcacccgcgccacaccgacccccaaagagagtcaaagcgaaggcagtgccaagc

SEQ ID NO: 19349 - DNA, 1065 bp, Artificial Sequence
  Description of Artificial Sequence: Synthetic coding sequence
atgtccgtcaactacgcggctggactcagcccttacgcggataaaggaaagtgcggcctcccggaaatctttgacccaccagaagaactggagaggaaagtctgggagctggcccgcctcgtctggcagtcctcctcagtggtgttccacacgggagcgggaatctcgacggcaagcggcatcccggattttagagggccgcatggcgtgtggactatggaagagagggggctggccccaaaattcgacaccacctttgaaagcgcccggccaactcagactcacatggcgctcgtccaacttgagagagtcggactgctgcgcttcctggtgtcacagaacgtggatggactgcacgtgcgctctggattccctagagataagctggccgaactccacgggaacatgttcgtcgaagaatgtgcgaagtgcaagacccagtacgtccgggatactgtggtcggcactatgggactcaaggctaccggaagattgtgcactgtggccaaagcgcgagggttgcgcgcctgtcggggagaactcagagatactatcctcgactgggaagattccctcccagatcgggacctggccctcgcagacgaagcgagccgcaatgccgacttgtcgatcacgcttggcacctccctccaaatccgaccaagcggcaatctgccgctggccaccaagaggcggggcggtaggctggtcattgttaacctgcaacctaccaagcacgatagacatgcggatctccggatccacggatacgttgacgaggtgatgactcgactcatgaaacacctggggctcgagatcccggcctgggatggcccacgggtgctcgagagggcactgccgccgctcccgcgcccaccgactccgaagctggagccaaaggaggagtcaccgacccgcatcaacggatcaatcccggcaggaccaaagcaagagccttgcgcacagcataatggaagcgagccggcatcgcccaagcgggagcggcctacctccccagccccacaccggcccccgaagcgcgtgaaggccaaggcggtgccgtcg

SEQ ID NO: 19350 - DNA, 1065 bp, Artificial Sequence
  Description of Artificial Sequence: Synthetic coding sequence
atgtctgtcaactacgcagcagggttgtccccttacgccgataagggcaagtgcgggttgcccgaaatcttcgatcctccagaggagctggagcgcaaagtatgggagctcgctagactcgtctggcagtcgtcttcggttgtttttcacacgggcgcaggcatcagcacggcttccggcatccccgactttcgcgggcctcacggcgtctggaccatggaggagaggggcttggcccctaagtttgatacaacatttgagagtgcacgccccacacaaacacatatggcactcgtgcagctcgagcgcgtcggcctgctccgctttctcgtctcccagaatgtggacgggttgcatgtgagatcgggctttccgagagacaagttggccgagttacacggaaacatgttcgtcgaggagtgcgccaagtgcaagactcagtatgtgcgcgacacagtggtcggaactatgggcctgaaggctaccggcaggctctgtacagtggccaaggcgcgggggttgagagcttgtcgtggggaattgagggacacaattctggactgggaggactccctgcccgaccgcgacttggcgctggccgatgaggcgagcagaaacgctgacttgtcaatcaccttaggtacgtccctccagattagaccatctggtaacctgcctctagctacaaaacggcgagggggtcggttggtgatagtcaacttgcaaccaaccaaacatgaccgacatgccgatctgcggattcatggatacgtggacgaagtaatgacccgcctgatgaagcacttggggctggagatcccggcctgggacggacctagggtcctcgagagggccctgccccctttacctagaccccctaccccaaagcttgagcctaaggaggagtccccaacccgcataaacggttctatccccgccgggcctaagcaggagccctgcgcgcaacacaacggaagcgaacccgcatctcccaagagagagcggccaaccagccccgcgccccacaggccgcccaaaagagtgaaggcgaaggctgtgcctagc

SEQ ID NO: 19351 - DNA, 1065 bp, Artificial Sequence
  Description of Artificial Sequence: Synthetic coding sequence
atgtcagtgaactacgctgccgggttgagtccttacgcagataagggtaaatgtggcctgcctgaaatctttgacccgcctgaagagcttgagagaaaggtctgggaactcgcccgcctggtctggcagtccagttccgtggtctttcacaccggtgcaggaatcagcactgcttccggaattcctgacttcagaggtcctcacggagtctggaccatggaggaaagaggtttggcaccaaaattcgatacgaccttcgaatccgcccggccaactcaaacccatatggcactcgtgcaactcgaacgagtggggctgctccgatttctggtgtcacagaacgtggacgggcttcatgtgaggagcgggtttcctcgagacaaacttgcggaattgcacggaaacatgtttgtggaagagtgtgcgaagtgtaaaacccagtacgtgcgcgatactgtggtcggaaccatgggcctgaaggcaactggacggctgtgtactgtggcaaaggcccgcggattgcgagcatgtcgcggtgaacttcgggatactattcttgattgggaagatagccttcctgatagagatttggcacttgcagatgaggcatcacgtaatgcagacctttctattacccttggaacttcgctgcaaattcgccccagcggaaacctgcctcttgcgaccaagcggaggggtggccggcttgtgatagtgaatcttcaacctaccaagcatgatagacatgcagatctgcggatacatggatacgtggatgaggtgatgaccagacttatgaagcatctgggcttggaaattcctgcctgggatggtcctcgtgtcctcgaacgggcactcccgcctcttccacgccctccgacccctaagctcgagccgaaggaagaatcacccactcggatcaacggatcgattccagccggacctaagcaggaaccttgcgcgcaacacaacggctccgagcctgcttcccctaagagagaaagacctacctcccctgcaccacatagaccaccaaagagagtgaaagcaaaggctgtgccatcg

SEQ ID NO: 19352 - DNA, 1065 bp, Artificial Sequence
  Description of Artificial Sequence: Synthetic coding sequence
atgtcagtgaattacgctgctggcttgagcccctacgcagacaaggggaagtgcggcctgccggaaatcttcgatccgccagaggaactggagcgaaaagtgtgggaactggctcggctggtgtggcaatcatcgtcagttgtgtttcacacgggagcgggaatttctactgcctcagggatcccagacttcaggggaccgcacggagtgtggaccatggaagaaagaggactcgcacctaagttcgatactacttttgaatccgctagaccaactcaaacccatatggcgctcgtgcagctggagagggtcgggcttctcagattcttggtgagccagaacgtggatggactgcacgtgagatcgggattcccaagagataagctcgccgaactgcacggaaatatgttcgtggaagagtgtgcgaagtgcaaaacccaatacgtaagggacaccgtcgtcggaaccatggggttgaaagccactgggaggctctgtaccgtcgctaaagccaggggactgcgcgcctgccggggagaattgagggacaccattctggattgggaggactcgcttcctgaccgtgacctggccctcgctgatgaagccagccggaacgcagacctgtcgattaccctgggcacctccctgcagattcgtccgtccggcaacctgccgcttgcgaccaagcggcgcggaggaagattggtgatcgtcaaccttcagcctactaagcacgatcgccatgcggacttgcgaatccatggctacgtggacgaggtgatgacgagactcatgaaacacctgggactggagatcccggcctgggacggaccccgtgtcctggagcgggccctgccacctctgccgcgtccaccaaccccgaaactcgaaccaaaggaagaatccccgacgcgcatcaacggttcaatcccagctggcccgaagcaggaaccttgcgcacagcacaatggcagcgagccagcctcccctaagcgggaacgcccaacctccccagccccacatcgcccgccgaagcgcgtcaaggctaaggcggtgcccagc

SEQ ID NO: 19353 - DNA, 1065 bp, Artificial Sequence
  Description of Artificial Sequence: Synthetic coding sequence
atgagcgtgaactacgcagctggcctctccccatacgcagataaaggcaagtgcggccttcccgagatatttgatccgcctgaagagttggagcgcaaggtgtgggagcttgcgcggctcgtctggcagtcctcgtcggtcgtttttcataccggagcgggtatctccaccgcatcgggcattcccgattttagaggtccccatggtgtgtggaccatggaagaaagagggctggcccccaagtttgacaccacctttgaatcggccaggcccacccagacccacatggcactggtccaacttgagcgagtaggtctgctgcggtttctggtgtcgcagaacgtggatggccttcacgtgaggtctggattccctagagataaactcgccgaactgcacggtaatatgtttgtcgaggaatgcgcaaagtgtaagacgcaatacgtgagagacactgtggttggaaccatgggactgaaggcaactgggaggctctgcaccgtggcaaaggcacgcgggctcagggcctgtaggggagagcttagagataccattctcgactgggaggactcactgccggatcgggatctggcactggcggacgaggctagccgcaatgcagacctttcaattaccctgggcacttcccttcagataagaccatccgggaacctcccactggcaactaagagaagaggaggccggcttgtgatcgtgaatctgcaaccaaccaagcatgaccggcatgccgaccttcgaatccacggttacgtggatgaagtgatgactaggctcatgaagcatctgggactcgaaatccctgcgtgggatgggccacgcgtgctcgaacgcgcactgcctcctctgccccgaccaccaacccctaaactcgaacccaaagaagaatcacctactcgcattaatggttccatacctgcaggaccaaaacaagagccctgtgcgcaacataacggtagcgagccagcatcacctaagagagaacgcccaacgtcacctgcacctcataggcctccaaaacgcgtgaaggcaaaggcagttccttcc

SEQ ID NO: 19354 - DNA, 1065 bp, Artificial Sequence
  Description of Artificial Sequence: Synthetic coding sequence
atgagcgtgaactacgccgccggactgtcaccgtacgctgataagggaaagtgtggactcccagaaatcttcgacccgcctgaagaactggagaggaaggtgtgggaactggcccggctggtgtggcagtcgtccagcgtggtctttcacactggcgccggaatctccaccgcgtccggaattccagatttccgcggcccgcacggagtgtggaccatggaggaacgcggtttggcccctaagttcgacaccaccttcgaatccgccagacctacccagacccatatggcgttggtgcaactcgagcgcgtgggtctgctgcgcttcctcgtgtcccaaaatgtcgatggactccacgtgcgctcgggattccccagagacaagctggcggaactgcacggaaacatgtttgtggaggagtgcgcaaaatgcaagacccagtacgtgcgcgacactgtggtgggaaccatgggactgaaggcgactggacggctgtgtaccgtggcgaaggcccggggcttgagagcttgtaggggcgaactgagagataccatccttgattgggaagattcattgcctgaccgcgaccttgcgctcgctgacgaagcctcccggaatgccgacctgtccatcacccttggaacttccctgcagatccgcccgagcggcaacctgccgttggccaccaaacgccgcgggggccgcctcgtgattgtcaatctccagcccaccaagcacgaccggcacgctgatcttcggatccatggatacgtcgatgaagtcatgacccggctcatgaagcatctcggcctggaaattcctgcatgggacggccctcgcgtgctcgagcgagccctgccaccattgccgcgaccgccgacgccgaagctcgaaccgaaggaggagagcccaactagaattaacggatcgatccctgcgggaccaaagcaggagccatgcgcgcaacacaacggcagcgagcctgcatccccgaaacgggaacgcccgacttcgcccgcccctcaccggccgccgaaacgggtgaaagccaaagcagtgccgagc

SEQ ID NO: 19355 - DNA, 1065 bp, Artificial Sequence
  Description of Artificial Sequence: Synthetic coding sequence
atgtccgtgaattatgccgcaggcctcagcccttacgcagacaagggaaaatgcggactccccgagatcttcgatccccctgaggaactggagcgcaaagtatgggaactcgccaggctagtatggcagagtagctctgtcgtgtttcacacgggggccggaatttccaccgctagcggaattcccgactttcgagggcctcatggcgtctggacaatggaggagcggggcctggccccgaagtttgacactaccttcgagagcgcccgcccgactcagactcatatggcactggtccaactggagagggtgggcctgctgcgatttttggtctcccagaacgtggacggactgcacgttcgatcagggtttccaagagacaagctggccgaactgcacggaaatatgtttgtggaagaatgtgctaagtgtaaaacgcagtatgtgagagataccgtggtgggcactatgggtctaaaggccacgggcagactgtgcacggttgcaaaggctagggggctgcgggcttgccggggcgaactgcgcgatacaatcctggattgggaggattcactgccggatagggacctggccttggccgacgaggcctctaggaatgccgacctcagcattacgctgggaacttccctgcagattagaccgtcgggaaatctgcccctggcgactaagagacggggcgggcggctcgtcatcgtgaacctccagccaactaagcacgacaggcatgcggatttacgtattcacggctacgtggatgaggttatgaccaggctcatgaagcatttgggcttagagattccggcttgggatgggcctcgcgtcttagagcgtgccctccctcctctacccaggcctcctactcctaagctggagcccaaggaagaatcccctacccgtattaacggttcaataccggccggcccaaagcaagaaccctgtgcgcagcataacggatccgaacctgcctcacccaagagagaacggcctacatctcccgcccctcatcgaccaccaaagagggtgaaggccaaggcagtgccctca

SEQ ID NO: 19356 - DNA, 1065 bp, Artificial Sequence
  Description of Artificial Sequence: Synthetic coding sequence
atgtccgtcaactatgcagcagggctcagtccatacgcagataaaggcaagtgtgggctcccagagatttttgatcctcctgaagaactcgagcggaaggtttgggaactggctagactagtttggcaaagcagcagcgtcgtgtttcacacaggcgcaggcatcagcaccgcctccggcatcccagacttccgcggaccccatggcgtatggaccatggaagagagaggcctggcacctaaattcgacactacattcgagtctgcccggccaacccagactcatatggccctggtgcagctggagcgggtgggccttctcagattcctggtttcccagaatgtcgatggactgcatgtcaggtccggctttcccagagataaactcgctgagctacacggaaacatgttcgtggaggagtgcgctaaatgtaagacgcaatacgtgagggacaccgttgtcggaacaatgggattgaaggcaaccggaagactctgtactgtggccaaagcccgaggacttagggcgtgccggggtgagctgcgagacacaattctggactgggaagacagtctgcccgaccgcgacctggcacttgcagatgaggcaagtcgcaatgcagatctgagtatcactctgggaacttccctgcagatcaggccatctggaaatctgcccctggctactaagcgaaggggcggaagattagtgattgttaacctccaaccaaccaaacacgaccggcacgccgacttgcgtattcatggctacgtcgacgaggtgatgacccgactgatgaagcacctcggcctcgagattcctgcttgggatggaccccgcgtcttagaaagagccttacccccgctgccacggccgccaactcccaagctagagccaaaggaggagtcacctactcgaatcaacggaagcatccctgctggccccaaacaagaaccctgcgcccaacataatggctctgaacccgcctctccaaaacgcgagaggcctacatcccctgctccacaccgcccaccaaaaagggtgaaagccaaggcggttccctct

SEQ ID NO: 19357 - DNA, 1065 bp, Artificial Sequence
  Description of Artificial Sequence: Synthetic coding sequence
atgagcgtgaactatgccgcgggactgtccccctacgcggataaggggaagtgtgggctgccggagatcttcgatcctccggaagaactggaacgcaaggtgtgggagctggcccgcctcgtgtggcaatccagctcggtcgttttccacactggagcaggaatctcaactgcatctggcatacccgatttcagaggaccacacggcgtgtggactatggaggaaagaggactggcacctaagttcgataccactttcgagtcggcaagaccgactcagacccacatggcactggtgcaactggagcgcgtgggcttgttgcgcttcctggtcagtcaaaacgtggatggactccatgtccggagcggatttcccagagacaagctcgccgaacttcacgggaatatgtttgtggaggaatgcgcaaagtgcaagacccagtacgtccgcgataccgtggttggaaccatgggactgaaagctaccgggcgactgtgcacggtggccaaagcaagaggattgagagcctgcaggggcgaactccgcgataccattctggattgggaagattccctgccggaccgggaccttgccctcgcggacgaggcgtcgagaaacgcagacttgtcaatcaccctcggtacttcgctgcagatccggccttccggaaacttgcctctggcgacgaagcggcgcggaggacgcctcgttatcgtcaacctccagccgactaaacatgatagacatgccgacctgcgaatccatgggtatgtcgacgaggtcatgactcggctgatgaaacacctcggattggaaatcccagcttgggacggccctcgcgtgctcgagcgcgctctgcccccgctgccacggccgccaaccccgaaactcgagccgaaggaagaaagcccaacccgcatcaacggatccatcccggctggaccgaagcaggagccgtgtgcccagcacaacggatccgaaccagcgtcgccgaaaagagaacgccctacttcacccgctccgcatcgaccgcctaagcgcgtgaaggccaaggctgtgcccagc

SEQ ID NO: 19358 - DNA, 1065 bp, Artificial Sequence
  Description of Artificial Sequence: Synthetic coding sequence
atgtcagtgaactacgcagcaggactgtccccttacgccgacaagggtaagtgcggcctgccagagatttttgatccccctgaagagcttgaacgtaaggtgtgggagcttgctcggcttgtgtggcagtcctcgtcggtggtctttcatactggagccgggatttcgaccgcaagcggtattcctgattttagaggaccccacggagtgtggaccatggaagaacggggactggcacctaagtttgataccacttttgaatccgcacgacccactcagactcatatggcacttgtgcaactggaacgcgtcggtctgctccgttttttggtatcgcagaacgtcgatggactccatgtccgctctggctttccacgcgataagctggcagaacttcatggcaacatgtttgttgaagaatgtgcaaagtgtaagactcagtacgtgcgcgacacggtggtcggtaccatgggcctgaaagcgaccggcagactttgtaccgtggccaaggcacgcggtctgagagcgtgtaggggagaacttcgagatactatccttgactgggaagatagtctgccggaccgcgatctggctctggcagacgaggcttcgcggaacgcagatctttcgatcacccttggaacctcacttcagatccgaccatcgggtaaccttcccctggccactaagaggagaggcggcagacttgtgattgtgaatctccaacctaccaagcatgatagacacgcagatctccgcatccatggatacgtcgatgaagtcatgactcgacttatgaaacaccttggcttggagatcccagcatgggacggaccgagagtgctggaaagggcgcttcccccactgccaagacctcccactcccaagctcgaaccaaaggaagagtcccctacgcgcattaacgggtcgattcccgccggacctaagcaggaaccttgtgcccaacataatgggtccgaaccggcatccccgaaaagagagcgcccaacgagccccgcaccacatcgaccacctaagagagtcaaggcaaaagcagtcccatcc

SEQ ID NO: 19359 - DNA, 1065 bp, Artificial Sequence
  Description of Artificial Sequence: Synthetic coding sequence
atgtcagtcaattacgcagctggactgagtccatatgccgataagggcaagtgcggcctgcccgaaatttttgaccccccggaagagctagagcgcaaggtatgggaactcgctagactagtttggcagtccagctctgtcgtcttccataccggcgcaggcatatcgaccgcctctggcatccctgacttccgtggccctcatggcgtgtggaccatggaggaaaggggcctggcgcctaagttcgacaccaccttcgagtccgccagaccaacccagactcacatggcacttgtgcagctcgagcgcgtgggccttcttcgattcttggtaagccaaaacgtcgacggcttgcacgtacgttcaggctttccacgcgataagttggcggagctacatggcaatatgttcgtggaggagtgtgccaaatgtaagacacagtacgtgcgtgatacggtcgtgggaacaatgggcttgaaggccacgggacggttgtgtactgttgctaaggcccggggcttgcgagcgtgccgtggagagttgcgagatacaatcctggactgggaagactctcttccagatcgcgaccttgcgttggccgacgaggcctcgcggaacgcagatctctcaatcaccctgggcacgtcacttcaaatccggccctcaggcaacctgcccctagcgacgaaacgtcgagggggaagactcgttattgtgaacctgcaaccaaccaaacatgaccgtcacgctgacctgcgtatccacggctatgtcgacgaagtcatgacacgacttatgaagcacctaggcctggagataccggcttgggatggcccccgggtgctcgagcgcgcgttgcccccgctgcccaggccccccacgccgaagctcgagcccaaggaggaaagccccacaaggattaacggcagcatccccgccggccccaagcaggagccctgtgctcagcacaacggctcggaaccggcctcccctaagagagagcggccaacctcaccagccccgcataggcctccgaagagagtcaaggcgaaggctgtaccatct

SEQ ID NO: 19360 - DNA, 1065 bp, Artificial Sequence
  Description of Artificial Sequence: Synthetic coding sequence
atgagcgtcaattacgcagcagggctgtcaccttacgcggataagggaaaatgtgggcttcctgagatattcgaccctccagaggaacttgagaggaaggtgtgggaactggcaaggcttgtctggcaatcgtcgtccgtggtctttcatactggcgcaggcatctccaccgccagcggaattccggattttagaggacctcatggtgtgtggactatggaagaaagaggacttgctccaaagtttgataccacctttgagtccgcccgccctactcagactcatatggcactggtccaattggaaagggttggtctgctgcgctttctcgtgtcacaaaatgtcgatgggttgcatgtgagatccgggtttcctagagataaactcgcggagctgcacggaaacatgttcgtggaggagtgtgcaaagtgcaaaactcagtatgtgcgtgatactgtggtggggacgatgggactgaaggcaacgggacgcctgtgtactgtggcaaaggccagaggactcagagcctgccgtggagaattgagagatactattctggattgggaggactcacttccagacagggatctggcgcttgctgatgaagcctcccgcaatgccgatctgagcattacgttgggcacgagccttcaaatcagaccttccggcaacctgcctcttgccactaagcggcgtggggggaggctggtgattgtgaaccttcaacccactaagcatgatcgtcatgccgacctcagaattcacggttacgtggatgaagtgatgactagacttatgaagcatctgggactggaaattcctgcgtgggatgggcctagggtccttgaaagagctctgcctccactgcctagaccaccaactccgaaacttgaaccaaaggaagagtccccgacccggattaatggttccatcccggcaggtcccaagcaggagccctgtgctcaacataacggtagcgagcctgcatcgccaaagcgagaacgcccaacttcgccggcgccacaccgaccacccaagcgcgtgaaggccaaagctgtgccttca

SEQ ID NO: 19361 - DNA, 1065 bp, Artificial Sequence
  Description of Artificial Sequence: Synthetic coding sequence
atgtctgtcaactacgcagcaggactgtccccatatgctgacaaagggaagtgtggacttccagagatatttgacccacctgaagagctcgaaaggaaggtgtgggaattggcccgcttggtgtggcaatcgtcctccgtcgtgttccacacgggtgcaggaatttcgacggcctccgggatccccgattttcggggccctcacggcgtgtggaccatggaggaacggggcctggcaccaaagttcgatactacttttgaaagcgccagacccactcagacccatatggcacttgtccagcttgagagagtggggctcctgcggtttttggtatcacagaatgtggatggtctgcacgtcagatcaggattcccaagggataagctggcagaattgcatggtaacatgtttgtggaggaatgcgcaaagtgtaagacccaatacgtccgggataccgtggtgggtactatgggccttaaggcaaccggccggctctgtactgttgcgaaagccagaggacttcgtgcttgtcgcggtgagctgcgggatacgattctcgattgggaagatagccttcccgatcgagatctcgcgcttgctgatgaggcctctcggaatgcggacctgagcatcaccctgggaacttctctgcagattcgaccatccggtaacttgccgctggcaacgaagaggagaggaggtcgcttggtcattgtaaacctgcaacccactaaacatgaccgacatgcagacctgcgcatccacggatacgttgacgaggtcatgaccagactgatgaaacatctcggccttgaaattccagcatgggacgggccaagagtgcttgaaagagcactgccccctcttcctaggcctcctactccaaaacttgaacccaaggaagaaagccctacccgcattaatggaagcataccagctggaccaaagcaagaaccttgcgcccaacacaacgggtccgaacccgcctcacctaaacgagagaggcctacctcaccggcaccccatcgcccccctaaaagggtgaaagctaaggcagtgccatcg

SEQ ID NO: 19362 - DNA, 1065 bp, Artificial Sequence; identical to SEQ ID NO: 19336
  Description of Artificial Sequence: Synthetic coding sequence

SEQ ID NO: 19363 - DNA, 1065 bp, Artificial Sequence
  Description of Artificial Sequence: Synthetic coding sequence
atgtcggttaactacgcagcaggactgagcccatacgctgataaggggaaatgcggactcccggaaatctttgacccgccggaagagctggaacggaaagtctgggaactggcgcggctcgtgtggcagtccagctccgtggtattccacactggagcaggaatcagcacggctagcggtattcccgatttccgcggacctcacggagtgtggaccatggaggaacgcggcctggccccgaaatttgatactactttcgagagcgcccgcccaactcaaacccacatggcgctggtgcaactggaaagagtgggtttgcttcgcttcctcgtctcgcagaacgtggatggtctgcatgtcaggtccggattcccgagggacaaactggcagagctgcatggaaacatgttcgtggaggagtgcgctaagtgcaagacccagtatgtccgcgatactgtggtgggaaccatggggctcaaagcgaccggaaggctctgcaccgttgcaaaggcacggggactcagagcgtgccgcggagaactgagagatactattctggattgggaggactcgctgccggacagagatctggctctcgcagacgaagcaagcaggaacgccgacttgtccatcacgctcgggacctcgctgcaaatccggccatcaggaaacttgccgctcgcaaccaagcggcggggaggacgtcttgtgattgtgaatctgcagcctactaaacatgatagacacgctgacctgcgcatccacgggtacgtggacgaggtcatgactcggctgatgaagcatctggggttggaaatcccggcatgggacgggccaagagtgctcgaaagggcactgccaccgctcccacggcccccaacccctaagctggagccgaaggaggaaagccccactcgcatcaacggttctattccggccggtcctaagcaggagccatgtgcccaacacaatggctcggaacccgcgagcccaaagagagaacggccgacctctccggcaccccaccggccgccgaagcgggtgaaggccaaggctgtgccatcc

SEQ ID NO: 19364 - DNA, 1065 bp, Artificial Sequence
  Description of Artificial Sequence: Synthetic coding sequence
atgtcggttaactatgccgccggccttagtccttacgccgacaaggggaaatgcggcctacctgagattttcgatcctcctgaggagctcgagagaaaggtatgggagcttgcccgattggtttggcagtcttcttcggtggtctttcacaccggggccggtataagcaccgccagtggtatccctgattttagaggaccgcatggcgtatggaccatggaggaacggggtttagcccctaaattcgacacaacattcgagagtgctagacccacccagacccacatggccttggtacaactagaacgggttgggctccttaggttcctagtctcacagaatgtggatggtctgcacgtgagatctggatttccgcgggacaagctggccgagcttcatggtaacatgtttgttgaggaatgtgcaaagtgtaagacccagtatgttcgtgatacggtggtgggtacaatgggactgaaggcgacaggccggctgtgtactgttgccaaagccagagggctaagggcctgtagaggagagctgcgggacaccatactggattgggaggactctcttccagacagggatctggcactagcagatgaagcctctcgcaacgcagacctctcaatcaccttgggaacttctcttcagatccgtccaagcgggaacctgcctctcgcgacaaaacggaggggagggagactggtgatcgtcaacctacagcctaccaaacatgaccgtcacgccgatttgaggatccatgggtacgtagacgaggtcatgacgaggcttatgaaacatctgggattggagatcccagcttgggacggtccccgcgtattggaacgagcgctgcctccgctcccacggccacctacccccaagcttgaaccaaaggaagagagtcctactcggatcaacgggtccataccggctggccctaaacaagagccatgcgctcagcacaacgggtcagagcctgccagccctaaacgtgagcgccctacttcccctgctccccatcgcccgcccaaaagagtcaaggccaaagctgtccccagc

SEQ ID NO: 19365 - DNA, 1065 bp, Artificial Sequence
  Description of Artificial Sequence: Synthetic coding sequence
atgagcgttaattatgctgctggactgagtccctacgcagataagggcaagtgcggcctaccggaaattttcgatcccccagaagagctagagcggaaggtctgggaactggcgcgcctagtgtggcagagctcttcggtggtttttcacactggagctggaatatctactgccagtggcatacccgattttcgggggcctcatggcgtgtggaccatggaagaacgaggtctcgccccgaaatttgatacaacattcgaaagtgctcgcccaactcagacacatatggccttggtacaactcgagagagtagggctgctcaggttcctcgtgtcccaaaatgttgatggactccatgtgcgctccggtttcccacgagacaaattggctgagctccatgggaatatgtttgtagaagagtgcgccaagtgtaaaactcagtacgttagggatactgtggttggaacgatgggtctgaaggcaacagggcgcttgtgtacagtggccaaagccagaggactgagggcatgtcgtggagagctgcgcgatacgatccttgattgggaggactccctacctgacagagatttggccctagccgatgaggcaagccgaaatgcagatctaagtatcaccctgggaaccagcctgcagattcgcccgtcgggcaatcttcccctagccaccaagaggcggggaggccgacttgttatcgtgaacttgcagccaacaaaacatgataggcacgccgacctgcgtatccacggatacgtcgatgaggtgatgaccagactgatgaagcatctgggcttggagatccccgcttgggacgggccgagggtcctggaacgagccctgcctccacttcccagacccccgacccccaaacttgagcccaaagaagaaagccctactcgaattaacgggagcattcccgctggcccgaaacaggaaccatgcgctcagcataatggctcagagcctgcgagccccaaacgcgaacggcctacttctcctgccccccaccgcccccctaaacgcgtgaaggctaaggcagtgccttcc

SEQ ID NO: 19366 - DNA, 1065 bp, Artificial Sequence
  Description of Artificial Sequence: Synthetic coding sequence
atgtctgtcaactatgcagcgggtctgtcaccttatgccgacaaaggcaagtgcggcctccccgaaatattcgacccacctgaagagttggaaagaaaagtgtgggaactggctcgtttggtctggcaatcatcaagtgtggtgttccacacgggggcggggataagcacagcctccgggatacctgactttagaggaccacacggggtctggacaatggaggaaaggggtctggctcccaaattcgacaccacatttgagagcgctcggcccacacagacacacatggcattagtgcagctggagcgcgtgggactcctgagattccttgtatcccagaacgtcgacgggctgcacgtgcgctcaggcttcccccgtgataaattggccgagctccacgggaacatgtttgttgaggagtgtgccaaatgtaagacccagtacgtgagggataccgtggtaggaacaatgggcctgaaggctactggacggctttgcactgttgcaaaggcccgtgggctgcgcgcttgtcggggcgaattgagggacactattctggactgggaggacagcctgcccgatagagatctggccttagccgacgaggccagtcgaaacgccgacctcagtattacgctgggaactagcctccagatccgacccagcggaaacctgccacttgcgacgaaaaggaggggagggcggcttgtaatcgtgaacctgcaaccaactaaacatgataggcacgcagatttgcggattcacggatacgtggatgaggttatgactcggctgatgaaacatctaggtttggagatcccggcctgggatggcccacgggtcctggagcgcgccctgccaccccttccgcgccctcccacccctaagctcgagcctaaggaagaatcgccaacccgcattaacggctccattccagccgggcccaaacaagagccatgtgcacaacataacggctccgagcctgcttcgccaaagagggaaaggccgacgagcccagctccgcatcgaccacccaaacgcgttaaagcaaaggctgtcccgtcc

SEQ ID NO: 19367 - DNA, 1065 bp, Artificial Sequence
  Description of Artificial Sequence: Synthetic coding sequence
atgagcgtgaattatgcggccggcctgagcccctacgcagacaaaggaaagtgcggcctcccagagatcttcgatccacccgaagaactcgaaaggaaggtttgggagctagcccggcttgtttggcagagtagtagtgttgtgttccacaccggagctgggattagcacagcatccgggatccctgactttagaggccctcatggggtgtggacaatggaagagcgtggtctggctccgaaattcgatactaccttcgagagcgcaaggcccactcagactcatatggctcttgtgcagctcgaacgtgtgggacttctcaggttcctggtttcacagaatgtcgatggcctccacgtgcgcagtggttttccccgcgataagctcgccgaactacatggaaacatgttcgtcgaagaatgtgccaagtgcaagactcagtacgtgcgggataccgttgttgggacaatgggccttaaagcaaccggaagactgtgcacggtcgcaaaggccaggggccttcgagcctgtcgcggagagcttcgagatactatacttgattgggaagattcactgccagaccgggatctggctttagcggatgaggcatctcggaacgccgatctgtccataaccttggggacttcactgcagatccgtccctcaggcaacctccctctggcgacgaaacggcgcggagggcgattagtcattgtcaacctgcaacctacaaagcacgatagacacgctgacctcagaattcacggatacgttgacgaagtgatgactaggctgatgaaacatcttggcttagaaatccccgcttgggacggccctcgggtcttggaacgggcgttacctccattgcctcgtccacccacccctaagcttgaacctaaggaggagagcccaactaggatcaatggtagcatccccgccggtcctaaacaagaaccctgcgcgcagcacaacggcagcgagcccgcgtctccaaagagagaacggcccacatctcccgctcctcacagaccccccaagagagtcaaggctaaggcagtcccatcg

SEQ ID NO: 19368 - DNA, 1065 bp, Artificial Sequence
  Description of Artificial Sequence: Synthetic coding sequence
atgtccgtcaactatgcagctggtctttccccatacgccgataagggaaagtgcgggctgccagaaatattcgaccctcccgaagagctggagcggaaggtttgggagttggcccgactagtgtggcagtccagcagtgtggtctttcatactggcgccggaatctcgactgcatctggcattccagactttcgcggtcctcatggagtctggacaatggaggagcgtggattggcgcctaagtttgacacaaccttcgagtctgccagacccacccagacccatatggctctggtgcagctggaacgagttgggctgctgcgctttctggtgtctcagaacgtcgacggactgcacgtgagatcaggcttccccagggataaactggccgagcttcacggcaatatgtttgtcgaggagtgcgccaaatgtaagacgcagtacgtaagagacactgtcgtggggactatgggattgaaagcaaccgggcgcttatgtacggtggcaaaggctcgggggttgcgggcttgcagaggagagttgagggataccatacttgactgggaggacagcctgccagaccgcgacctagccctcgctgacgaggcttccaggaacgctgatctgagtataacgttgggaacttcgcttcaaataagaccgtccggaaatcttccactggccaccaagagacgaggtggcaggctggtgatcgtgaacctgcagcccaccaagcatgacagacatgcagacctgcgaatccacggttatgtggatgaggtaatgactcggctaatgaaacatctcggattggagataccagcttgggatggccctcgggtattagagcgagccttacctcccctcccacggcctcccacacccaagctagagccaaaagaggagagtcccacaagaattaacggaagtatccctgccggacccaaacaggagccgtgtgcacagcataacgggtccgagcccgcatcccccaagcgcgagcgccccacaagccctgccccacatcgcccccctaagcgggttaaggcgaaggctgtgcccagc

SEQ ID NO: 19369 - DNA, 1065 bp, Artificial Sequence
  Description of Artificial Sequence: Synthetic coding sequence
atgtcagttaactatgcggcgggcctcagcccatacgccgacaaaggaaagtgcggactgccagaaatcttcgatccgccggaagaattggaacggaaggtctgggagctcgcccggctggtttggcagagctcatccgtcgtgtttcacaccggtgcaggcatttcgaccgcatcaggcattccggactttagaggtccacacggcgtgtggacgatggaggaaagaggactggcaccaaaattcgataccactttcgagagcgccaggccgacgcaaacccacatggcgctcgtccaactggaacgagtgggactcctgcgcttcttggtgtcgcagaacgtagacggactccatgtgcggagcggattcccccgcgacaagctcgcggaactgcacggaaacatgttcgttgaagagtgcgctaaatgcaagactcagtacgtgcgcgacaccgtggtgggaacgatgggtctgaaggccactggaaggctgtgcactgttgccaaggcccgcgggctccgcgcgtgccggggggagctccgggatacgatccttgactgggaggactccctgccggaccgcgatctggcactcgctgatgaagcctcgaggaacgctgacctctctatcaccctgggaacttcgctccagatccgcccgtccgggaacctgcctctggctaccaagcgccggggaggtcgcctggtgatcgtcaatctgcagccaaccaagcacgatcggcacgcagatctgagaatccacggttacgtggacgaggtcatgacccggctgatgaaacaccttggactcgaaatccccgcatgggacggcccgcgggtgctcgagcgggctctgcccccgttgccacggccgccaactccgaaactggaaccaaaggaggaatcaccgacccggattaacggttcgattccagcgggaccgaagcaagaaccgtgtgctcagcacaacggctcggagccggcctcgccgaagagagagaggccgacctcgccagcccctcaccgcccgccgaagcgagtgaaagctaaagctgtgccttct

SEQ ID NO: 19370 - DNA, 1065 bp, Artificial Sequence
  Description of Artificial Sequence: Synthetic coding sequence
atgagcgtgaactacgctgccggattgagcccatacgcagacaagggaaagtgcggactgcccgaaatcttcgaccccccggaggaactggaacgcaaggtgtgggagctggccagactcgtgtggcaaagctcatccgtggtgttccacaccggagccggtatctcgaccgcgtcaggaatcccggactttcgggggccgcacggtgtgtggactatggaagaacgaggacttgcgcccaagttcgacacgacttttgagtccgcccgcccaacgcagacccacatggcgcttgttcagttggagcgcgtgggattgctgagattcctcgtgtctcagaacgtcgatgggctgcatgtgaggtcgggcttccctagagataagctggcagagttgcacggcaacatgttcgtggaagagtgtgccaaatgcaagacccagtacgtcagagacaccgtggtcggtactatgggcctcaaagccactggacggctgtgcaccgtcgcaaaagcccgcggcttgcgggcctgtcggggggagctccgcgataccatcctcgactgggaagattcacttcctgatagggatctcgccctggcggacgaggcttcacgcaacgcagatctgtccattactctgggaacgtcgctgcaaatccgcccgtcgggcaatctcccgctggcgaccaagagacggggaggtcggctggtcattgtcaatctgcagccaaccaagcatgacagacatgccgacctgcgaatccacggctacgtggacgaggtgatgactaggctcatgaagcatctgggacttgagatcccggcttgggacggaccgcgggtactcgaacgcgcactcccgccgctgcctcgcccacccactccaaaactggaaccaaaggaggaatcccccacccgtatcaatgggtcgatcccggccggacctaagcaagaaccttgcgctcagcacaacggcagcgaaccagcgtccccgaaacgggaacggccgacttcgccggcgccacaccgccctccgaagcgcgtgaaggcaaaagctgtcccatcc

SEQ ID NO: 19371 - DNA, 1065 bp, Artificial Sequence
  Description of Artificial Sequence: Synthetic coding sequence
atgtccgtcaattacgctgccggtctcagtccttacgccgataagggaaagtgtggtttgccggagatctttgatcccccagaagaactggagcgcaaagtttgggaactcgccaggctcgtctggcaatcttcttcagttgtctttcataccggtgccggaatcagtacggcctctggaattcctgacttcaggggaccccatggcgtttggacaatggaagagcgtgggcttgcgccaaagttcgacacgacgtttgaatccgcccgccctactcaaacacacatggcccttgtccagctggaaagggtcggactcctgcggttcttagtgtcgcagaatgtagatggtttgcatgtaaggtcgggtttcccgcgcgacaagttggccgagctccatggcaacatgttcgtggaggaatgtgccaaatgcaaaactcagtatgtccgagatacagtcgtcgggaccatgggtttgaaggctacggggcgcctatgtacggttgctaaagctagggggctccgcgcgtgccgcggagaattgagggacaccattctggattgggaggactcattacctgatagagacctggcactagcagatgaagcctctcgtaatgcagatctctccattacgctgggtaccagcctgcagattcgcccgtcaggtaacctgccacttgcgactaagcgccgtgggggcagacttgttatcgtcaatctccaacccacaaagcacgatcgacacgccgatttgcgaatccatggatacgtagatgaggtgatgacccgcctgatgaagcacctcggtttggaaattccggcctgggatggcccacgagtgctagaaagagctttaccaccgctgccccggccacctaccccaaagctcgagccaaaggaggaatcgcctacacgtatcaacgggtcaatcccggctggtccaaagcaagagccttgtgctcaacacaatgggtcggaacctgcctccccgaaacgtgaacgaccaacttcgcccgctccgcaccgtccgccaaagagagtcaaggcaaaggcggtgccttcc

SEQ ID NO: 19372 - DNA, 1065 bp, Artificial Sequence
  Description of Artificial Sequence: Synthetic coding sequence
atgtcagtgaattacgccgcaggactgtcaccttacgccgataaaggaaagtgtggtttgccagagatattcgatccacctgaagaactggaaagaaaggtttgggaacttgctcgactggtgtggcagtcatcgagcgtggtgtttcatacgggcgcaggaatttcaactgcatccggaatcccagatttccggggtccacatggcgtgtggaccatggaagaaaggggtctggcacccaagtttgatacgacctttgaatcggcacgtcctactcaaactcacatggcgctcgtccagcttgagcgggttggcctgctccggtttctcgtgtcacaaaatgtcgatggacttcatgtgaggagcggatttccacgagataagctggctgaacttcacggaaacatgttcgtggaggaatgcgcaaagtgtaagactcagtatgtgagagacacggtcgtgggtactatgggactcaaggcaaccggacgtctctgcactgttgcaaaggcaagaggtcttagagcctgccggggcgagctgcgagacaccatccttgattgggaggattcgctcccggatagggatctggctctggccgatgaagccagccgaaacgctgatctctcaatcacccttggtacctcgctgcaaatacgtccttcgggaaatttgcccttggccactaagagaagaggaggaaggcttgtaatcgtcaaccttcaaccaaccaagcacgataggcatgccgatcttcgcattcatggctatgtcgacgaggtcatgaccagactgatgaagcacctgggtcttgaaattccagcgtgggatggaccgcgggtgctggaacgcgcactgcctccactccctcgcccacccacccctaagctggaaccgaaggaggagtcccctactagaattaacggatccattccagccggtccgaaacaagagccttgtgcacagcataacggttcagagcccgcatcgcctaagcgggaacgccctacctcccccgccccccataggcctcccaagcgggtgaaggcaaaggccgtcccgtcg

SEQ ID NO: 19373 - DNA, 1065 bp, Artificial Sequence
  Description of Artificial Sequence: Synthetic coding sequence
atgtccgtgaactacgcagctggactcagtccatacgccgacaaggggaagtgtgggctgcccgagatttttgatcctcccgaggaacttgaaagaaaggtctgggagctggccaggcttgtgtggcagagttccagcgtggtgtttcacaccggcgcgggcatcagcacagcttctggaattccagatttcagaggacctcatggcgtttggactatggaggaaaggggactcgcaccgaagttcgacacaacgttcgagtctgctagacccactcagacccacatggcccttgtgcagctcgagagagtcggattgctgcgcttcctggtcagccaaaacgtggacggcctgcatgtgcgatccggtttcccgcgcgacaagttggccgagctgcatggcaacatgttcgttgaggaatgtgccaaatgtaagacgcaatatgtgcgagatacggtggttgggacaatgggccttaaagctaccggtagactgtgcacagtggccaaagccaggggcctccgggcttgcaggggcgagctgagagacacgatccttgactgggaggatagtctgcccgatagagatctggcactcgctgacgaggctagcagaaacgcagatctctccatcactctcggcacgtctttgcagatcaggccctccggtaacttgccccttgccaccaagcgacggggcggaagactggtgatcgtcaacttgcaacccactaaacacgaccgacacgctgacttgcgcatccatggttatgttgacgaggtcatgacgcggttgatgaaacatctgggcctcgagatacctgcgtgggatgggccccgggtattggagagagccctgccgcctctgccaaggccacccactcctaaactggagcccaaggaggagtcacccaccagaatcaacggatctatccctgcagggcccaaacaagaaccctgcgctcagcacaatgggtcagaacccgcatccccgaagagggagcggcccacgtcccccgccccccacaggcctcccaaacgggtgaaggctaaagcagtgcctagt

SEQ ID NO: 19374 - DNA, 1065 bp, Artificial Sequence
  Description of Artificial Sequence: Synthetic coding sequence
atgagcgtcaactacgccgcggggctcagcccttatgccgataagggaaagtgcggactgcccgaaattttcgatcctcctgaggaactggagagaaaggtttgggagctcgcacggttagtttggcagtcttcatccgtcgtgttccataccggcgcaggcatcagcaccgcgagcggtattcccgatttcaggggcccccatggggtgtggaccatggaggaaaggggactagcccctaaattcgacaccaccttcgaaagcgctaggccgacccagacccacatggctctggtgcagctagagcgggtgggacttttgaggtttctggtgtcacagaacgtcgacggtctgcatgtgcgctcaggctttcctcgagacaagctggccgaactccatggcaacatgttcgtggaggagtgtgcgaagtgtaagactcagtatgtccgcgacaccgtagtgggaacgatgggcctgaaagcaacaggacgtctgtgcacagtggctaaagcaaggggattgcgcgcctgccgtggagagctgagggatactattctagactgggaagattctctacccgatcgggatcttgctctggccgatgaggcttcgaggaacgccgacctgtcgattaccctgggcacgagcctacagattcggcctagtggcaaccttccccttgccacaaagaggaggggcggacgtttggtgatagtgaatttgcagccaactaagcacgatagacacgctgacctcaggatacacgggtacgttgatgaagtgatgacgaggttaatgaagcaccttggattggagattcccgcatgggacggcccaagggtgctggaacgcgcactgccaccactgccgaggccccccaccccgaaactggagcccaaagaggaatcccccacacgcataaacgggtctataccagctggaccaaagcaggagccctgcgcccaacataatggaagtgagccagcatctcccaagcgggaaaggccgacatctccggcccctcatcgaccccctaaaagggttaaggccaaggccgtgcctagt

SEQ ID NO: 19375 - DNA, 1065 bp, Artificial Sequence
  Description of Artificial Sequence: Synthetic coding sequence
atgtcggtaaattacgccgcgggtctgtcgccatatgccgacaaaggcaaatgtggactacccgaaattttcgatcctccggaggaattggaaagaaaggtgtgggagttggcccggctcgtctggcagtcgagctcagtcgtgtttcacaccggggcaggcatttccacagcatccgggatccccgattttagagggccccacggagtatggacaatggaggagaggggcctggcaccgaaattcgacactacatttgagagtgcaaggcctactcagacccacatggctttagtgcagttggaacgcgttggcttactgcggtttcttgtatctcagaatgttgatggattgcacgtccggtccggcttcccacgggataagctcgcggagttgcatggaaatatgtttgtggaggaatgcgccaagtgtaagacacagtacgtaagggatacagtggtggggaccatgggcctgaaggccaccgggcgcctatgtaccgtcgcaaaggcccgcggactgcgcgcatgccgcggggaattgcgcgataccatcctggactgggaagattcactaccggacagagatctcgccctggccgacgaggcctctcgcaacgccgatttgagtatcactttgggcacttcccttcagatacgtcctagcggaaatctgccgctcgctaccaagagacgaggcggacgactggtcatcgtgaatctgcagcccacgaaacacgacaggcatgcagatctgaggattcacggatacgtggacgaagtcatgactcgacttatgaagcacctgggcctggagatccctgcgtgggacggccctcgtgtacttgaacgggccctgccgcctcttcccagacctccaactcccaaactagaacctaaagaggaaagccccaccagaatcaacggcagtatacccgccggtcccaagcaggagccgtgcgcccagcacaatggcagcgaacctgctagccctaagagggagcgaccaacatcaccagcaccccaccgtccccctaagcgggtaaaggccaaggccgtgccaagc

SEQ ID NO: 19376 - DNA, 1065 bp, Artificial Sequence
  Description of Artificial Sequence: Synthetic coding sequence
atgagcgtcaattatgcagcaggtcttagcccttatgctgataaaggtaaatgcggtctgcctgaaattttcgatccgcccgaggaacttgaacgtaaagtctgggagttagcacgccttgtatggcagagtagcagcgtcgtgttccatacaggcgcgggcatttcgactgcgtccgggatacctgactttcgtgggccgcatggggtctggaccatggaagaacgagggttagccccgaaatttgacacgacctttgaatcggcaaggccgacacaaacacacatggctttggtgcaacttgagagagtcggactgctacgatttcttgtgtcacaaaacgttgatggattacatgtccgcagcggctttccgcgtgataaacttgcggaactacatggaaacatgtttgtggaggagtgtgccaaatgtaaaacgcagtatgttcgagatactgttgttggaacgatgggcttgaaggcaacaggacggctgtgtacagttgctaaagcgagaggccttcgtgcatgccgtggagaactcagagacacaattttagattgggaggatagtctgcccgaccgagacctggcccttgccgatgaagcaagtagaaatgctgatttatcgattacccttggaacgtccctgcagattcgcccatcggggaatctcccgctcgcaacaaaacgccgtggcggccgactggtgattgttaatttacagccgacaaagcacgatcgacacgcagatctgagaattcacggatatgttgatgaagtgatgacacgactcatgaagcacctgggcttagaaattccagcgtgggatggtccgagagttttggaaagggctttgccgccgttacctcgtccgcctacgccgaagctggaaccgaaggaagaatcacctacgagaatcaacggctcaattcccgcgggtccgaaacaagaaccgtgcgcgcagcataatggtagcgaaccggcctccccgaaacgggaacgtcctacatcaccggcgccccatcggccaccgaaaagggttaaagctaaagcggttccgtct

SEQ ID NO: 19377 - DNA, 1065 bp, Artificial Sequence
  Description of Artificial Sequence: Synthetic coding sequence
atgagcgttaattacgctgctggactgtccccttatgctgacaaaggaaagtgcggcctccccgagatctttgatccaccggaggagctagagaggaaagtgtgggagctggcccgcctagtttggcagtcctcctccgtggttttccacaccggcgccggtatctccactgctagcggcattcctgactttcgaggaccccatggcgtctggactatggaagaacgcggactcgcccccaagttcgataccacttttgaatcagcgagacctactcaaacacacatggcattggtgcaacttgagcgcgtcggcctgctacggtttctggttagccagaacgtggatggtctgcatgtgaggtctgggtttcccagggataagctggctgagctgcacggaaacatgttcgtggaggagtgtgcaaaatgtaaaactcagtacgtgcgcgatactgtagtgggtaccatgggccttaaagccacgggacgcttgtgtacggttgccaaagcaaggggcctccgcgcatgccgtggcgagctcagagatactatcttggactgggaggactctctgccagatcgggacctggctctggcagacgaggcttctcgcaatgccgatctgtcgattaccctgggtaccagcttgcagatccgccccagcggtaatctccctttggctacgaaacgtaggggcggtagacttgttattgtaaacctgcaacccactaagcacgatagacatgctgatctgaggatccacgggtacgtagacgaagtcatgacacggctcatgaaacacttgggactggagatccctgcatgggatggaccacgcgtgctggaacgggctctgcctcccttaccccggcccccgacaccaaagctggagccaaaggaggaatcccctacccggatcaatggtagtatccctgctgggccgaaacaagagccctgtgcgcagcacaatgggagcgaaccagcaagcccaaagagggaacggcctacatctcccgcaccacatagaccaccaaaaagggtgaaggccaaggcagtgcctagc

SEQ ID NO: 19378 - DNA, 1065 bp, Artificial Sequence
  Description of Artificial Sequence: Synthetic coding sequence
atgtctgtcaactatgctgctggtttatctccgtacgccgacaaagggaagtgcggcttacccgaaatatttgatccacctgaagagttggagcggaaggtgtgggaactggcccgactcgtgtggcaaagcagctcagtggtcttccatacaggagcgggaatctcgactgcctcaggaattcccgatttcaggggtccgcacggagtctggaccatggaggaacgtggactggcgcccaaattcgacacgacttttgagtcagctcgcccgacacaaactcacatggcgctggtacagttggagcgcgtcggactgctgcggttcctcgtttcacagaatgtggacggcttgcacgtgcggtctggctttcctcgggataaactggcggagctccatggaaatatgttcgtggaagaatgcgcaaaatgtaagactcagtacgttagagacacagtcgtgggcaccatgggactcaaagccaccggaaggctgtgtacagtagccaaggctagggggctgcgggcttgtagaggagaactaagggataccatcttggattgggaagacagcctgcctgatcgggacctagccctggctgatgaggcttcaaggaacgcagatctctccattacgttgggcaccagcctgcagataaggccttccggaaaccttcccttggccacaaagcgacggggagggcgcttagtcatagtcaatttgcagcccacgaagcacgacagacacgctgacctacgcatccatgggtacgtcgatgaggtgatgacgcggcttatgaagcaccttggcttggaaataccggcgtgggacggacctcgggtgctcgaacgagccttgccgccactcccccggccaccgaccccaaagttagaaccgaaggaggaaagccccactcgcattaatgggagcattcctgccggccctaaacaagagccctgcgcccagcacaatgggagtgaacccgcctcgccgaaaagagagcggcctacgagccccgccccccatcgcccgccaaagagagtgaaggccaaggcagtgccttct

SEQ ID NO: 19379 - DNA, 1065 bp, Artificial Sequence
  Description of Artificial Sequence: Synthetic coding sequence
atgtccgtgaattacgcagcagggctgtcgccgtatgcagataagggaaaatgtggcctccctgagatcttcgatcctccagaagaactggagagaaaggtctgggagcttgcgagactggtgtggcaatcgtcatccgtggtctttcataccggtgcgggaatatcgactgccagcggtatccccgattttagaggcccacacggagtttggaccatggaggaaagagggctcgccccaaaattcgacactaccttcgagagcgcgcgtccgactcagactcacatggctcttgtccagctcgaacgcgtcggtctgcttcgtttcctggtgagccaaaacgtggacggcctccacgtgcgttcaggatttccaagagataaactggcggaattgcacggaaatatgtttgtggaagaatgtgcaaaatgcaagacgcagtacgtgagagacaccgtcgtgggaactatgggccttaaggctaccggacgtctgtgtaccgtggccaaggctagggggctgagagcatgtaggggcgaactgcgggacaccattctggactgggaggattcactgcctgaccgggaccttgcacttgcggacgaagccagccgaaacgcagacctttcgattacccttggaactagcctgcaaattcggccaagcggtaatttgccgctcgcaaccaagagacgcggaggtcggctggtgatagtgaacctccaacccaccaagcatgatcgccatgccgatttgaggatccatggttacgtcgatgaggtgatgacccggcttatgaagcatctcggcctggagataccggcgtgggatggaccgagagtgctggaaagggctctccctccccttccaagacctcctaccccaaagctcgaacccaaggaagaatcgccgacccggataaatggaagcattccagcaggcccaaagcaagaaccatgcgcacaacataacggttccgaacctgcgtcgccaaaaagggagaggcctaccagtcctgctccacaccgtcctccaaaacgcgtcaaggccaaggcggtgccctcc

SEQ ID NO: 19380 - DNA, 1065 bp, Artificial Sequence
  Description of Artificial Sequence: Synthetic coding sequence
atgtccgtgaactatgccgcggggctgtccccttacgcagacaaggggaagtgtggcctcccagagattttcgaccctcccgaggaacttgaacgaaaggtctgggagttggctagactggtgtggcagagctcaagcgtcgttttccatacaggagccggcatttccactgccagtggaatcccagattttcgaggcccacatggagtgtggactatggaagagagaggactcgccccaaaattcgatactacctttgagtccgcgcggccaacccaaacccacatggctctggtgcagctcgaaagggtgggcctgctgaggttcctggtaagtcagaacgttgacggactgcatgtaagaagtggtttcccccgggacaagttagcggagttgcacggaaacatgtttgtggaagaatgcgccaaatgcaaaacccagtacgtgcgcgacaccgttgtcggcactatggggttgaaagccacaggacggctgtgtacagtcgccaaggcaaggggccttagggcatgtcgaggcgagctgcgggatactattctggactgggaggatagcctccctgatcgggacttagcactggctgatgaggcctctaggaatgcggatctgtcaatcacactagggacctcactgcagatccgtccaagcggaaatttgcctctcgcaacaaagagacggggagggagactggtgatcgtcaatctgcagccgactaagcacgacagacacgccgatttgaggattcacggctatgtggacgaggtgatgactcggctgatgaagcatctcggcttggagattccggcatgggatgggcctagggtcctggagcgggcgttaccccctctcccaaggccccctaccccaaaactcgagccaaaggaggagtcaccaacacgaattaacggaagtattcccgcaggacctaagcaggagccatgcgctcaacataacggatctgagccggcctcccctaaacgcgaacggcccacttcccccgctccacatcggccccccaaacgagtgaaggcgaaggccgttccttcg

SEQ ID NO: 19381 - DNA, 1065 bp, Artificial Sequence
  Description of Artificial Sequence: Synthetic coding sequence
atgtcagtgaattatgcggcgggactgtcgccgtacgccgacaaaggaaagtgcggactgcctgaaatctttgacccgccggaggaactggagcggaaggtctgggaacttgcacgcctggtgtggcagtcatcgtcggtggtgttccatactggtgccggaatcagcactgcgtccggaatccctgacttcaggggaccccacggcgtgtggaccatggaggagaggggcctggctccgaagttcgataccactttcgaaagcgcccggccgacgcagacccacatggccctcgtgcaactggagcgggtggggctgctccggtttcttgtctcgcaaaacgtggacggactgcatgtgcgctcaggattcccgcgggataagctggctgagctccacggtaatatgttcgtggaagagtgcgccaaatgcaagactcaatacgtgcgggataccgtggtcggtaccatgggcctcaaggcgaccggaaggctctgtaccgtcgcgaaggcccggggactcagagcgtgccggggagaactccgcgataccatcctggactgggaagatagcttgccggaccgcgacctggctcttgcggatgaagcgtcgcgcaatgcggatctgtctataaccctcggaacgagcctgcaaatccgcccatccgggaacctccctttggccactaaacggcggggcgggaggctggtgattgtcaacttgcagccaactaagcacgaccggcatgcggatctgcggattcatggatacgtggatgaagtgatgactcgcctgatgaagcatcttggattggaaatccctgcgtgggacggaccacgcgtgctcgaacgcgctctgccgccactcccacgcccgccgacccctaagctggaaccgaaggaggaatcgccaactagaatcaacggtagcatcccggcaggaccgaagcaggagccctgcgcacagcacaacggatcagaacctgcgtcccctaagagagaaaggccaacgtccccggccccacaccgtccaccgaaaagagtgaaggccaaggccgttccatcc

SEQ ID NO: 19382 - DNA, 1065 bp, Artificial Sequence
  Description of Artificial Sequence: Synthetic coding sequence
atgagcgttaactacgccgccggcctttccccctacgctgataaaggcaagtgcggactcccagagattttcgacccgccggaagagctcgaacggaaggtttgggagcttgcacgcctggtctggcagagctcgagcgtcgtgttccacaccggcgccggaatctcgactgcgtccgggatccctgacttccgcggtccccatggagtgtggaccatggaagaaagaggactcgcccctaaattcgatacgactttcgagtcggccagacccacgcagacccacatggcattggtgcagctggagagagtcggactgctgcgatttcttgtgagccagaacgtggacggactccacgtgcgctcagggttcccgcgggacaagttggctgaactgcatggaaacatgtttgtcgaagaatgcgcaaagtgtaagacccagtacgtcagggacactgtggtgggcaccatggggcttaaggccacgggacggctctgtaccgtggcaaaggcaagggggctgcgcgcgtgcagaggcgagctgcgcgacactatcctggattgggaggacagcttgcccgatagggacctggcactcgcagatgaggcttcgcgcaatgcggacctctccataactttgggcacttcactgcaaatcaggccgtcaggaaacctgccattggcgaccaagagacgcggaggacggctggtgatcgtgaatctccagcctaccaaacacgaccggcacgcggacttgaggatccacggttacgtggatgaggtgatgaccaggctcatgaaacatctgggtctggagatcccggcgtgggacggcccccgcgtattggaaagagcactcccgccgctccctcgcccgccgactcctaaactggaaccgaaggaagaatcaccgactcggattaatggaagtatccccgccggacctaaacaagaaccttgcgcacaacacaacggatcggagcccgcgtccccgaagcgcgagcgtccaacgtccccagctcctcatcggccgcccaagcgcgttaaggccaaggcggtaccttct

SEQ ID NO: 19383 - DNA, 1065 bp, Artificial Sequence
  Description of Artificial Sequence: Synthetic coding sequence
atgtcagttaattatgcagccgggctctcgccctatgcggataagggaaaatgcgggctccctgaaatctttgaccccccagaagaactcgaacggaaagtttgggagcttgcccggttggtctggcagtcctcttccgtggttttccacactggagccgggatcagtacagcctccgggatacccgatttccgggggcctcacggagtttggacaatggaagaacgcggactggcccccaaatttgatacaacatttgaatcagctcggccgactcaaacacacatggctctcgtccagctcgaacgggtaggactgcttcgatttctcgtatctcagaatgtcgatgggcttcatgtccgatccgggtttcctagggataaacttgcagaactccatgggaacatgttcgtcgaagaatgcgctaaatgcaaaactcagtatgtgagggatactgtcgtgggaacaatgggactcaaagctacagggaggctatgtacagttgcgaaggcacggggactaagagcatgtcggggagagctgagagatacaatcctagattgggaagattctctgcctgatcgggacctggccctcgctgatgaggcatctcggaacgcagatctctccatcacactcggaacatcactccagataaggccttccggaaacttgcccctagcaacaaaaagaagagggggacggctcgtgatagtgaacctgcagcctacaaaacatgatcggcatgccgatctgcgaattcatgggtacgtggatgaagtgatgactcgccttatgaaacatctgggacttgaaattcccgcctgggatgggcctcgagtattggaaagggccctcccaccactccctcgaccccccacacctaaactggaaccaaaagaagaatccccaactcggatcaacggatccattcccgctgggcccaaacaagaaccatgcgctcagcataatggatctgagccagcatctccaaaacgtgagcggcctacttctcctgctccccaccggcctcccaaaagagtgaaagctaaagctgtaccctct

SEQ ID NO: 19384 - DNA, 1065 bp, Artificial Sequence
  Description of Artificial Sequence: Synthetic coding sequence
atgtccgtcaactacgcggctggtctgtcaccatacgctgataaaggcaaatgcggcctgccggaaatctttgatccacctgaagagttggagaggaaggtgtgggagctggccagattagtgtggcagagctcgtccgttgtgttccatacgggtgctggtatcagcactgcatccggcatcccggacttccggggcccacatggagtgtggacaatggaggaaaggggactggccccaaagtttgacacaacctttgaaagcgctaggccaacccagacccacatggctctggtccaacttgagagagtaggcctgttgcgtttcctggtgtcacagaacgtagatggactccatgttcgaagcggcttcccaagagataagctggccgaattacatggcaacatgtttgttgaggagtgtgccaagtgcaaaacccagtacgtgagggacacagtggtcggaactatgggtctgaaggcgaccggcaggctgtgtaccgtagcgaaggccaggggcctcagagcctgccgaggtgaactgcgcgatacaattctagattgggaagactctctacctgacagggatctggccctagcagatgaggcctcccggaacgcagatctgtctataaccctagggacatctctgcagatcaggccctctggcaacctgccacttgccacgaaacgcaggggaggaagactggtaatcgtcaacttgcagccgacaaagcatgatagacatgcggaccttaggattcacggctacgtagacgaggttatgactcgactaatgaaacacctgggcctggagatccccgcgtgggatggacccagggtcttagagcgggcgctgcctcctctaccacggccccctacccctaagttggaaccaaaggaagaatctccaacgagaatcaacgggtcgatcccagccggtcccaaacaggagccatgtgcacagcacaacgggtctgagcctgcgagtcccaagcgtgagagacctacctcaccagccccgcatagaccgcccaagagagtgaaagccaaagccgtcccgtcc

SEQ ID NO: 19385 - DNA, 1572 bp, Artificial Sequence
  Description of Artificial Sequence: Synthetic coding sequence
atgacagaggacaaggtgactgggaccctggtgttcacagtgataactgctgtcctggggtcgtttcagttcggatatgatattggtgtgatcaacgcgccccagcaggtgattatctcgcattataggcatgtgctgggcgtgcccctggatgatagaaaagcaatcaacaattatgtaattaacagcacggatgagctcccgactatatcctactcaatgaatcccaagcctaccccctgggccgaggaagaaactgtggcagctgcccagttgatcactatgctttggtcactcagtgtgtcctccttcgccgtgggaggcatgacagcctccttcttcggagggtggcttggtgacaccttgggtaggatcaaagcgatgttggtcgctaacattctttcactggtgggcgccctccttatgggcttcagtaagctcggacctagtcacatcttaataatcgcgggccggagcatatcagggctgtactgtgggctcatttctggtctggtgcccatgtatatcggggagattgctcctacggcactgcgcggggccctgggtacatttcaccagttggccatcgtgaccggtatcctgatcagtcagattattggcctggagtttattctcggaaactacgacctttggcacattcttctgggactaagtggcgttcgcgccattctgcagtcccttctcttattcttttgcccagagtctccaagatacttgtatattaagctggatgaggaggtcaaagccaagcagagcttaaagcgtcttagagggtatgatgatgtgacaaaggatataaatgaaatgagaaaggagcgcgaggaggcaagcagtgagcagaaagtgtccatcatccagctcttcaccaattcttcatatcggcaacccatcctggtcgccttgatgctgcacgtggcacagcagttctcaggcataaacggtatcttctactattccacttcaatcttccagaccgccggcatctccaagcccgtgtacgctaccattggcgtgggggcagtcaatatggtgttcaccgcggtgagcgtcttcctcgtggaaaaagccggaagacgctcgctatttttaatcggaatgagcggtatgttcgtttgcgctatcttcatgtcagtgggactcgtgctccttaacaagttctcttggatgtcatacgtttctatgattgctatctttctttttgtcagcttctttgaaatcggccctggaccaatcccatggttcatggtagccgaattctttagtcagggaccaagacctgccgccctggcaatagccgccttttccaattggacttgtaactttatcgtggcactgtgttttcaatacattgctgacttttgcgggccctacgtttttttccttttcgcgggcgtcctgctcgcctttacgctttttaccttttttaaggtgcccgagactaaaggcaagagttttgaagaaatagccgcagagttccagaagaagtctgggtctgcccaccgcccgaaggccgcagtggagatgaaattcctcggggccaccgaaactgtc

SEQ ID NO: 19386 - DNA, 1572 bp, Artificial Sequence
  Description of Artificial Sequence: Synthetic coding sequence
atgaccgaggataaggtgactggtactctcgtctttactgtcatcaccgccgtgcttggatccttccagttcggctacgacatcggagtgatcaatgctcctcagcaggtgatcatctcccactacaggcacgtgctgggcgtgccactcgacgatcggaaagctatcaataactacgtgatcaactcgaccgacgagctgccgactatctcatactctatgaatcctaagcccaccccgtgggcggaagaagaaactgtggccgcggcccagctgataactatgctgtggtccctgtcagtgtcctcgtttgcggtgggcggaatgactgccagtttctttggaggatggctgggggacaccctgggacggatcaaagcaatgctggtggctaacattctgtctttggtgggtgccctgctgatgggtttctcgaagctgggaccatcacacatcctcatcatcgcaggacgctcgatctcgggcctgtactgcggactcatttcaggcctcgtacctatgtacatcggtgagatcgcaccgaccgcgttgcgcggggctctgggtactttccatcaactggcaatcgtgacgggaatactcatttcacagatcattggtctggagttcatcttgggaaattacgacctgtggcatatactgctcggcctctcgggagtgcgtgcaattctccaaagcctgctcctgttcttttgtccagaatcaccgcggtatctgtatatcaaactggatgaagaagtcaaggctaagcagtcccttaagagattgcgtggatacgacgatgtcacgaaggatatcaacgagatgcggaaggaacgagaggaagcgtcgtcagagcagaaagtgagcatcatccaactctttactaactctagctaccgccagcccatcctcgtcgccctcatgctgcacgtggcccagcaattctcgggaattaacggaattttctactactcgacctccatcttccagaccgccggcatcagcaaaccggtctacgccactataggtgtgggggcggtgaacatggtgttcacggcagtctctgttttcttggtcgagaaagcgggtaggcgctccttgttcctgattggaatgtccggtatgttcgtctgcgctatctttatgagcgtgggactggtgctcctcaacaagttctcgtggatgagctacgtttcgatgatcgctatcttcctgtttgtgtcgttcttcgaaatcggacctggacccatcccatggttcatggtcgccgagttcttcagccaagggccgcgcccagcagcgctggccatcgctgccttttccaactggacttgcaactttattgtggcgttgtgcttccagtacatcgccgacttctgtggcccttacgtcttttttctctttgcgggtgtcctcctggccttcaccctgttcacgttcttcaaagtcccagagacgaaaggtaagagctttgaagagattgccgccgaattccaaaagaagtcggggtccgcccatcgaccgaaagccgcggtggaaatgaagtttttgggcgcgaccgaaaccgtg

SEQ ID NO: 19387 - DNA, 1572 bp, Artificial Sequence
  Description of Artificial Sequence: Synthetic coding sequence
atgaccgaggataaagtcactggcaccctggtgtttactgtcattaccgccgtgctgggttcatttcaattcggatacgacattggtgttatcaacgccccacagcaggtgataatctcgcattaccgacacgtgcttggcgtgccacttgatgatagaaaggcaatcaacaattatgtcattaacagtacggatgaactgcctaccatctcatactctatgaatcctaagccgacgccttgggctgaggaagaaactgtggcagccgcgcagctcattactatgctgtggtcactttcagtgtcatcattcgcggtcgggggcatgaccgcgtcgttttttggcggatggctcggtgacactctgggtcgcattaaggcgatgctggtggcgaacatcctttccctggttggggccctcctcatggggttttcgaaacttggtccttcacatattctcattatcgcaggaaggtcaatctcggggttgtactgtggacttatttcagggctggtccctatgtacatcggcgaaattgcaccaactgcgctgaggggggcactggggactttccaccagctggcgatagtgactggaattctgatatcccaaatcattggtcttgaattcattctgggtaattacgacctgtggcatattctccttggactctccggagtgagagccattctgcaatcactcctgctgttcttctgccccgaatcccccaggtacttgtacattaaactggatgaagaagtgaaggccaagcagagccttaagcgcctgaggggttacgatgatgtgaccaaagacattaacgaaatgcggaaggagcgagaggaagcatcgagcgaacagaaggtcagcattatacaacttttcaccaactcctcctacaggcaaccaatccttgtggcgttgatgctccatgtcgcacagcaattttccggaatcaacgggattttctattactcgactagcatctttcaaaccgcgggtatatccaagcccgtgtacgccacgattggagtgggagcagtgaacatggtctttaccgcggtatcggtctttcttgtggaaaaggccggccggcgtagcctgtttcttatcgggatgtccggtatgtttgtttgcgcaatattcatgtcggttggactggtcctgttgaacaaattctcctggatgtcgtacgtgtcaatgatcgcgattttcctgtttgtctcctttttcgaaatcggacctggaccaatcccatggtttatggtcgcggagttcttttcgcaaggacctcggccagcagcacttgccatcgcagcattttcgaactggacctgtaatttcatcgtggcgctttgttttcagtacattgcggatttttgcggaccatacgtgttctttctgtttgccggtgtgcttctggcgtttaccctgttcactttctttaaggtgccagagacgaagggaaaatcctttgaggaaattgcagccgaatttcaaaagaagtccggatccgctcacagaccgaaggccgcggtggagatgaagttccttggagcaaccgaaaccgtg

SEQ ID NO: 19388 - DNA, 1572 bp, Artificial Sequence
  Description of Artificial Sequence: Synthetic coding sequence
atgacggaggacaaggtcaccggtaccctggttttcacagtgataaccgcggtgctaggcagcttccagttcggttacgatattggcgtcataaatgccccccagcaagttattatcagtcattaccgccacgttctcggtgtcccgcttgacgaccgtaaggctatcaacaattatgtcatcaactccaccgacgaacttcccacgatatcatattcgatgaacccaaaacctacgccctgggctgaagaggaaacagttgcggcagcacaactcatcacgatgttgtggagtctgagtgtttcgtcgttcgctgtcgggggtatgactgcgtcttttttcggcggatggttaggcgacactctgggccgtataaaggcaatgctcgtggctaacatactttcgctagtcggagcattgctgatgggtttttcgaagctgggcccttcccacattctcattatcgctgggaggtcgatttctggtctctattgtggtcttattagtggtctcgttccaatgtacatcggggagattgcccctactgcgctgcggggtgccctcggtacctttcaccaattggcaatcgtgaccgggatcctcatttcccaaataatcggattggaatttattctgggaaattacgatctgtggcatatcttgctggggctttcaggggtgcgtgccatcctccagtcactgctgctctttttttgccccgagtcgcctcgttacttatacatcaaactggatgaggaggttaaggccaagcaatcgttgaaacgtctccgaggctatgacgacgtgacaaaagatattaacgaaatgcgaaaggaacgcgaagaagcctcgtccgagcagaaggtttccatcatccagctcttcaccaattcttcataccggcagccaatcttggtcgccctcatgctacacgttgcacagcagttttctggaatcaatggtatcttttactactccacttctatcttccaaacagccgggatctccaagccggtatatgcgacaatcggcgttggcgcggtaaatatggtgttcaccgcagtgagtgtattccttgtggagaaggctgggcgacgatccctctttcttattggcatgagcggcatgtttgtttgtgcaattttcatgtcggttggccttgtacttctcaacaagttcagctggatgagttacgtctccatgattgctatcttcctattcgtctcgttttttgaaattgggccaggaccaattccctggtttatggtggcggagttcttttcacaagggcctcgcccagcggccttggccatagcggcgttctcgaattggacatgcaatttcatagtggctttgtgcttccaatatatcgccgatttctgcggtccctatgttttcttcctgttcgcaggcgtcttgctcgcgtttaccctctttacgttctttaaggttcccgagaccaaaggtaagtcattcgaggagattgccgcggagttccaaaagaaatctgggagtgcccatcgaccaaaagcagccgttgaaatgaagtttctcggtgcgaccgaaaccgtg

SEQ ID NO: 19389 - DNA, 1572 bp, Artificial Sequence
  Description of Artificial Sequence: Synthetic coding sequence
atgactgaggataaggtgacaggcaccctggtgtttactgtgatcaccgccgtcctcggaagtttccagtttggatacgatatcggagtgattaatgcgccccagcaggtcatcatcagccattaccgacatgtgctgggagtacccctggatgaccgaaaggccatcaataactatgttataaattccacagatgaactccctacaatttcctactcaatgaatccaaaacccaccccatgggccgaggaggaaacagtcgccgcagcacaattgatcactatgctgtggtccctcagcgtgagttctttcgcggtcggcggcatgacagcctcatttttcgggggctggcttggagatactctgggacggataaaagccatgctggttgccaatatactgtcattagtgggtgcgctcctaatggggtttagcaaacttgggccttcacatattctgattatcgccggacgttccatctcaggcctctactgtggcctgattagcggtctcgtccctatgtacatcggcgaaatagcccccaccgctctgagaggtgcactcggaacctttcatcagctggccattgtgactggaatcctgatcagccagattatcggcctcgagttcatcttgggaaattacgacttgtggcacatcctgcttggcttgtctggagtcagagcaattctgcaatctctgctgctgtttttttgtccagaatctccgcgatatctttacattaagttagacgaagaagtgaaggcaaaacagagtctaaaacgacttcgaggttatgacgatgtgaccaaggacatcaatgaaatgagaaaagagagagaggaggcaagctctgagcagaaagtgtcaattatccagctgttcactaactccagttacaggcagccgatccttgtcgccttgatgctgcacgtggcccagcagttctccggcatcaatgggatcttttattacagtaccagcatctttcaaaccgctggcattagtaaacctgtgtatgctacaatcggtgtcggcgctgttaatatggtttttacagcagtgagcgtgttcctcgtggaaaaggctgggcgaagatccctgtttctgataggaatgtcgggaatgtttgtttgcgccatatttatgtcagtcgggttagtgctgcttaacaagttttcttggatgtcatacgtctctatgattgccatctttctcttcgtgagcttttttgagatcggaccaggccccattccctggttcatggtggccgaatttttttcgcagggccctaggcctgcagctcttgcaatcgccgccttctctaattggacctgtaactttatagtggcactttgcttccaatacatagctgacttctgcggcccatatgtgttctttctgtttgctggggtgctgctcgctttcactctgttcacattcttcaaagtgccggaaaccaaagggaaatcttttgaggaaatcgccgccgaattccaaaagaagtccggttctgcacacagacctaaagctgctgttgaaatgaagtttcttggtgccactgaaaccgtc

SEQ ID NO: 19390 - DNA, 1572 bp, Artificial Sequence
  Description of Artificial Sequence: Synthetic coding sequence
atgaccgaagataaggtcaccggtactctggtttttaccgtgatcactgccgtcctcggctcgtttcagttcgggtacgacatcggagttatcaatgcacctcaacaggtgatcatcagccactaccgccacgtgcttggcgtccctctggacgaccgcaaggccataaacaattacgtgatcaactccaccgacgaactgccgactatttcctactcgatgaacccaaaaccaactccttgggcggaagaggaaaccgtggccgccgcccagctgatcaccatgctgtggagcctcagcgtctcatcgtttgctgtgggagggatgacggcgtctttctttggcggctggctgggagatactctcggccggatcaaagccatgctcgtggccaacatcctctccttggtcggagctctgctcatgggatttagcaaactgggcccgtcccatatcctgattattgcgggaaggtcgatttcgggactgtactgcggactgatcagcggcctggtgccgatgtacattggagagatcgctccgactgcgctcaggggcgcgctgggaacctttcatcagctggcgatcgtgaccggaatcctgatctcccagatcatcggcctggaattcatccttggaaactacgatctctggcatatcctgctcggtctgtcaggagtgcgggctatcctgcagtccctcctcttgtttttctgcccggaatcaccgcgatacctgtacatcaaactggatgaggaagtgaaggccaagcaatcgctcaaacggcttagaggctacgacgatgtgactaaggacatcaatgagatgaggaaggaaagagaagaggcatcatcggaacaaaaggtgtcgatcatccagctgtttaccaattccagctacagacaaccgattctggtggccctgatgctccacgtggcacagcaattcagcggaatcaacggaatattctattactcaacttcaatcttccaaactgccggcattagcaagccagtgtacgcaaccattggagtgggcgccgtgaatatggtgtttaccgcagtgtcggtctttctggtggaaaaagcaggacggcggagcctgttcctgatcggcatgtcagggatgttcgtgtgtgcaatcttcatgagcgtgggcctggtgttgcttaacaagttctcctggatgtcgtatgtcagcatgatcgcgatcttccttttcgtctcattcttcgagatcggtcctggccctatcccttggttcatggtggcggagttcttctcgcaagggcctcggccggccgcgctcgcaatagccgcgttctccaactggacttgcaatttcatcgtggcgctctgtttccaatacatcgccgacttctgcggaccttacgtgtttttcctgttcgccggagtcctcctggctttcaccctgttcactttcttcaaggtgccagaaacgaagggcaagtcatttgaagagattgctgccgagttccagaagaagtcaggatccgctcacagacccaaggcggcggtcgagatgaagtttctcggagccaccgaaaccgtg

SEQ ID NO: 19391 - DNA, 1572 bp, Artificial Sequence
  Description of Artificial Sequence: Synthetic coding sequence
atgacagaagacaaggtaacaggcacccttgtgttcactgtcattaccgccgtgctgggctcattccagtttggctacgacataggcgtgatcaatgccccgcagcaggtgatcatctctcactataggcacgtgctgggggtccccctagatgaccgcaaggctatcaacaattatgtgatcaatagtaccgacgagcttccaactatctcctacagcatgaatccgaagccaactccctgggccgaggaagagactgtggctgccgcccagttaataactatgctatggtccctaagtgtatcttcatttgctgttggcggcatgaccgcgagcttcttcgggggatggctcggcgatactctagggagaatcaaggccatgctcgtcgctaacattctatctctcgtgggagccttactgatgggcttcagtaaactgggccccagtcacatcctgatcatagctggccgctcgatatccggcctgtattgcggccttatctcaggtttagttcccatgtacataggagaaatcgcaccaacagctttgcgaggggctctgggaacattccatcagctcgccatagtcacagggatcttgatctcccagatcataggactggaatttatcctcggcaactacgatctgtggcatattctcctaggtttatcaggagtaagggcgattctccagtctttgctcctgtttttttgtcccgagtcccctcggtacctgtatatcaagttggacgaagaggtgaaagccaaacagtcattaaagagattaaggggctacgatgacgtcaccaaggacatcaatgagatgagaaaggaaagagaggaggctagcagtgagcagaaagtgagtatcattcagttgttcaccaattcaagttaccgtcagcccatcctcgtcgcgctgatgctgcacgtcgctcaacagttctctggcattaacggaatcttttactactcgacaagcatctttcagaccgccgggattagcaagcctgtgtatgccacaattggcgtgggggccgtcaacatggttttcaccgcagtgtcagtgttcctggtagagaaggcaggcagacgcagcctttttctcattggaatgagcgggatgtttgtctgcgccatctttatgagcgtcggtctcgtgctcctcaacaaatttagctggatgagttatgtgagcatgatcgcaatattcctgttcgtgtcatttttcgagattggtccaggcccgatcccctggtttatggtggcagagttttttagtcagggacctaggcctgctgcactggccatagcagccttttccaattggacctgtaatttcatcgtagctctgtgcttccagtacatagcagacttctgcggtccttacgtgttcttcctgttcgctggagtgttgctcgccttcactctgttcaccttcttcaaggtgcctgagacgaagggaaaaagcttcgaagagatcgcggcggaattccagaaaaagagtggctccgctcaccgtcctaaagctgccgtggagatgaaattcctgggtgccacagagactgtt

SEQ ID NO: 19392 - DNA, 1572 bp, Artificial Sequence
  Description of Artificial Sequence: Synthetic coding sequence
atgaccgaagacaaggttaccggtaccctggttttcactgttatcaccgcagtactcggttcattccaatttggttacgacatcggtgtcattaacgcgccccaacaagtcatcatatcgcactatcgccacgtccttggcgtcccactggatgacaggaaggctattaataattacgtgatcaactccacggacgagctcccaactatcagttactcgatgaacccaaagcccacgccgtgggccgaagaagaaaccgtcgctgctgcccaattaatcacgatgctttggagtctgtccgtctcctccttcgccgtcggtggcatgaccgcttccttctttggaggctggctcggtgacaccttgggccgtattaaagccatgcttgtcgccaacattctcagcttagtcggcgccctccttatgggtttctcgaagcttggtccgagccacatcctgatcattgccggtcggtctatcagcggtttgtactgcgggctcatttcaggcttggtgcccatgtacataggtgagatcgcccccaccgctctccgtggcgccctcggaaccttccaccagctggctatcgtcactggaatcctcatttcacagataatcggtctggaattcatcctaggcaactacgatctgtggcatatcctcttgggcctgtccggtgtccgggctatcctgcagtccttgttgctgttcttctgccccgagtccccccgatacctgtatatcaagttggacgaggaggttaaggccaagcagtccttgaagcgcctccgtggctacgacgacgtgacgaaagatatcaacgagatgcgcaaggagcgtgaagaagcctcgtccgagcagaaggtgtctatcatccagctttttactaacagctcgtacaggcaaccaatcttggtagctctgatgctccatgtggcacagcagttctctggcatcaacgggatcttctactattcgaccagtatttttcagaccgcgggtatctccaagcccgtatatgccactatcggtgtcggtgctgtcaacatggttttcactgcagtctctgtcttccttgttgagaaggcgggacgacgctcgctgttcctcatcggtatgtccggaatgttcgtctgcgccatctttatgagcgttggactcgttctcttaaacaagttttcgtggatgtcctacgtctcgatgattgccatctttctcttcgtcagcttcttcgagatcggccctgggcccatcccatggttcatggtggcagagtttttttctcaaggcccacgccccgccgccctggccattgctgccttcagcaactggacctgtaattttatcgtcgccctttgcttccagtacatagccgacttctgcgggccttacgtcttcttcctcttcgctggcgtactccttgccttcacattattcacgtttttcaaggtccccgagacaaagggtaagtcatttgaggaaatcgccgccgaattccaaaagaagtccggctcggctcaccgtcctaaggctgctgtggagatgaagttcctgggggcaacggagactgtg

SEQ ID NO: 19393 - DNA, 1572 bp, Artificial Sequence
  Description of Artificial Sequence: Synthetic coding sequence
atgactgaagataaggtgactggcaccctggtctttactgttatcactgcagtgctgggttccttccaattcggttacgacattggagtcattaacgccccgcaacaggtcatcatcagccactacaggcacgtgttgggagtgccgctggatgaccgcaaagccattaacaactacgtcatcaactcgactgatgagctccctactatttcctactctatgaatcccaagccgacgccatgggcggaggaagagactgtcgccgcagcgcaactgattaccatgctgtggtcgctctcggtgtcatcctttgcggtcggagggatgactgcctcattctttggaggatggctcggcgacactcttggaagaatcaaggcaatgctggtcgccaacattctcagcttggtgggggcgcttctgatgggtttctcgaagctgggaccttctcacattctcatcatcgccggacgctccattagcggactgtactgcggcctcatctcgggattggttcccatgtacatcggagaaatcgctccgactgccctgcgcggagcgctgggaacttttcaccaactcgcgatcgtcaccggtatcctcatttcacagatcatcgggctcgaattcatcctgggcaattacgacctctggcatatacttcttggattgtcgggcgtgcgcgccatcttgcagagcctgctgctcttcttctgtccggaaagcccacgctacctttacattaagctggacgaggaagtgaaggccaagcaatcccttaaaaggctgcggggctacgacgatgtcaccaaggacatcaacgaaatgcgcaaagagcgcgaggaagccagcagcgaacaaaaagtgtcgatcatccagctgttcaccaattcgtcgtaccgccagccaatcttggttgctctgatgctgcatgtcgcccaacaattttccggcatcaatgggatcttctactactccacttccatctttcaaaccgccgggatttccaagcccgtgtacgcaactatcggagtgggagctgtgaacatggtgttcactgcagtgtctgtgttcctggtcgaaaaagcgggacggcgctcgctcttcctgatcgggatgtcaggaatgtttgtgtgcgccatcttcatgtcggtcggactggtgctcctcaacaagttctcatggatgtcgtacgtctccatgattgcaatcttcctgttcgtttcgttctttgaaatcggaccgggccccattccatggttcatggtggcggagttcttctcccagggaccacggccggcggctctggcaattgccgctttcagcaattggacttgcaatttcattgttgccctgtgcttccagtacatcgcggacttctgcgggccttatgtgttcttcctctttgccggagtcttgctggctttcaccttgttcaccttcttcaaggtgcctgaaactaagggaaagtccttcgaggaaatagccgccgaatttcagaagaaatcgggatcagcccaccgcccgaaagcagcggtggaaatgaagttccttggagccaccgagactgtc

SEQ ID NO: 19394 - DNA, 1572 bp, Artificial Sequence
  Description of Artificial Sequence: Synthetic coding sequence
atgacggaagataaagtaacaggtaccctggtattcacagttattacggccgtcctgggtagcttccaatttggttacgatataggcgttatcaacgcgccgcagcaagtgattatctcgcactatcgtcatgtacttggtgttccattagatgatagaaaagcgattaataactatgtgattaactctacagatgaactgccgacgatttcatatagtatgaacccaaagccgacaccgtgggctgaggaggaaaccgtcgctgccgctcagctgataacaatgctttggtcattatcagtatcatcgttcgctgttggcggtatgactgcgagctttttcggtggctggttaggggatacacttggacggattaaggcgatgcttgttgctaacattctgtctctggtcggcgcattacttatgggcttttctaaacttggaccctcacatatcttaattatcgccggacgtagcatctcaggactttattgtggattgatttctggtttagttccgatgtacattggcgagattgccccgactgccctgaggggcgcgcttggaacctttcatcaactggcaatcgttacgggcatcctgataagccagataatcgggctagaattcattcttggaaactatgatttgtggcatattttacttgggctttcaggagttagagcaatccttcaaagccttcttctgtttttttgtccggaaagtccgcggtatctatacattaagcttgatgaagaagtcaaagctaaacagtcattaaaaagactgagaggatatgatgacgtcacaaaggacataaacgaaatgcggaaagaacgcgaagaggcgtcgagcgaacaaaaagtctccatcattcagttgtttactaatagctcgtatagacagccaatcttagttgcgcttatgttacatgttgcacagcagttttcggggatcaacggaattttctattactcaacaagtatctttcagacagcaggcattagcaaaccggtgtatgcgactattggggtgggcgcggtgaatatggtgtttacagcggtttctgtctttttagttgaaaaagcaggacgccggagcctgtttctgattggcatgtccgggatgtttgtatgcgccatcttcatgtctgtgggtttggtactgcttaataaatttagctggatgtcttacgtttcgatgattgccatttttctgtttgtaagctttttcgagatcgggccagggccgatcccttggttcatggtagcagaattcttttctcaaggaccgcgcccggctgcattggcgattgcagcctttagtaattggacttgtaattttattgtcgccctctgctttcaatatattgccgatttttgcggcccttacgtattttttctgtttgcgggagtgctgttagcgtttacgttgtttacattttttaaagtgccagaaacaaaggggaagtcattcgaagagatcgctgcggagtttcaaaaaaaatccggaagtgctcatcggcctaaggccgccgttgaaatgaaattcttgggcgccactgaaacggtc

SEQ ID NO: 19395 - DNA, 1572 bp, Artificial Sequence
  Description of Artificial Sequence: Synthetic coding sequence
atgacggaagataaagtgactgggactctggtctttacggtcattactgcagtgctgggatcctttcaattcggatacgatataggagtcatcaatgccccccaacaggtgataatctcacactacagacatgtgctgggggtgcctttggatgacaggaaggcaatcaacaactacgtcattaactctaccgacgaacttcctaccatttcctactcaatgaaccctaaacctactccttgggccgaggaagaaaccgtcgccgccgcccagcttattaccatgctgtggtcactgtcagtctccagctttgcggtcggaggaatgacggcatcgttttttggaggttggttgggcgacacgctgggaagaatcaaagcaatgctcgtggctaatatccttagcctggtgggtgctctccttatgggattttcaaaactcggtccttcccatatcctgattatcgcaggacgaagcattagcggtctgtactgtggactcatttcaggcctggtccctatgtacattggagagatcgcgcctactgcactcagaggtgcgctgggcacctttcatcagctggccatcgtgaccggtatacttatctcgcagataatcggcctggagtttatactcggcaattacgatctttggcacattctccttggtttgtcgggtgtgcgtgctattctgcagtcgctgcttctgttcttttgtccggagtcaccacgttacctctacatcaagctggatgaggaagtgaaggcaaagcagtccctgaagagacttcgcggttacgatgatgtgaccaaggacatcaatgaaatgcggaaggagcgagaagaggcatcatcggaacaaaaggtgagcataatccagctctttaccaactcttcctacaggcaaccaatcctggtcgcccttatgcttcatgtggcacagcaattttcagggattaatggcatcttctactattccactagtattttccagactgcaggaatttcgaagccagtgtacgcgaccatcggtgtgggtgcagtgaatatggtgtttacggcagtgtcggtctttttggtggaaaaagcgggaaggaggtcgctgttccttattggcatgagcggcatgtttgtttgcgcgattttcatgtccgtcggacttgtacttcttaacaaattcagctggatgtcttatgtgtccatgattgcgatttttctctttgtttcattcttcgaaatagggcccggacccattccgtggttcatggtcgcagaattctttagccaaggccctcggccagcggccctggcgatcgccgcattctcaaactggacttgtaactttattgtggcgctttgctttcaatacattgcggatttttgtgggccttacgtcttttttctttttgcaggggtccttcttgcgtttaccctctttacgttctttaaggttccagaaaccaaaggtaaatcgtttgaagaaattgccgcagaattccagaagaaaagcggttctgcccatcgccctaaggcagctgtggaaatgaagttccttggagctactgaaaccgtc

SEQ ID NO: 19396 - DNA, 1572 bp, Artificial Sequence
  Description of Artificial Sequence: Synthetic coding sequence
atgactgaagataaggtgaccgggactctcgtgttcactgtcattactgcagtgctcggatcgtttcaattcggttacgacattggggtgattaacgctccacagcaggtgatcatatcacattaccgtcacgtgttgggggtgcctcttgatgatcggaaagcaatcaacaactacgtgattaactcgaccgatgaacttcctactatctcgtactcaatgaacccaaaacctactccctgggcggaagaagaaacggtcgctgctgcccaacttatcaccatgctgtggtccctgtcggtgagctcctttgcagtcggaggaatgaccgcatcgttcttcggaggctggcttggggataccctcggcagaataaaggcaatgctggtcgcgaatattctttcactggtgggggcactccttatggggtttagcaagctggggccatcccatattctcatcattgcggggcggtccatctcgggactgtactgtggactgatctcgggtttggtccccatgtacataggcgaaattgcaccaactgccttgcggggtgcactcggaacttttcatcaactggcaatcgtgactgggatacttattagccagattatcggcctggaattcattctgggcaactacgacctttggcatattcttcttggactgtcgggtgtccgcgccattttgcaaagccttctgctctttttctgtccggaatcaccgagatacctctacattaagctggatgaagaagtcaaagccaagcagagcctgaaacgtcttagaggatatgatgatgtgactaaggacattaatgaaatgaggaaggaacgggaggaagcctcgtcggaacagaaagtgtcaatcattcagctttttaccaattcttcgtacaggcagccgattctggtggcactgatgctccacgtggcacagcaattttcaggtattaacgggattttctattactccacttccattttccagaccgcaggaatttcaaaacctgtctatgcaactatcggtgtcggcgctgtgaatatggtctttacggccgtgtccgtgttcctcgtggagaaagcaggacggcgctcgctttttctgattggcatgtccgggatgttcgtgtgtgccatctttatgtcagtgggcctggtcctccttaacaaattctcgtggatgtcatacgtttccatgattgccatcttccttttcgtctcgttttttgagattggtcctggaccaattccctggtttatggtggcggagtttttcagccaaggacctagaccagccgctctcgccatcgcagcattctccaactggacctgcaactttattgtggcgctttgttttcagtacattgccgatttctgcggtccttacgtattctttctgtttgcgggcgtcctgctggcatttaccctgtttacgtttttcaaagtccctgaaaccaaggggaaatcctttgaggaaatagccgctgaatttcagaagaaatccggctcagcacatagacccaaggcagccgtggaaatgaaatttctgggtgcgaccgaaaccgtc

SEQ ID NO: 19397 - DNA, 1572 bp, Artificial Sequence
  Description of Artificial Sequence: Synthetic coding sequence
atgacagaggacaaggtgacaggaacgttggtgtttacggtgattaccgctgttctcggatcgttccagttcggttatgacataggagtgattaatgctcctcagcaggtcattatcagccactaccgccacgttctcggcgtgcccttggacgacaggaaagccatcaacaactatgtgattaatagcaccgatgagctcccaactatttcttattctatgaaccccaagcctaccccctgggctgaagaggagacagtcgcggcagcacagctgataacaatgctgtggagcctcagcgtttccagtttcgctgtaggtggtatgactgccagcttttttgggggctggctcggtgacaccttggggaggatcaaggctatgctcgtggctaatatcctatccttagtgggtgccctcttgatgggtttttcgaagttgggcccctcgcatattctgatcattgccggccgatccattagcggactttactgtggcctaatatcaggcctcgtgccaatgtatattggcgagatagcccctaccgcactaagaggagccctagggaccttccatcaactcgcaatcgtgaccggaatactgatatctcagatcataggcctggaatttattctgggcaactatgacctgtggcatatactgctcggcctgtcgggggtgcgcgctattcttcagagtctcctgctgttcttttgtcctgaaagtccgcggtacctgtacattaaactggacgaggaagtaaaggctaagcagagtttgaagcgactgaggggctacgatgatgtcactaaggatattaatgagatgcgaaaagaaagagaagaggcgagctccgaacaaaaagtgtccataatccagctgtttacaaattcttcctaccgacagcccatacttgttgctctgatgctgcacgtggcacagcagttcagtggtatcaacggaattttttactattccacctccatatttcagacagccggcataagcaagcccgtatacgcaaccatcggcgtgggcgccgtgaatatggtcttcactgctgtctccgtcttccttgtggagaaggccgggcgtcggagcctgtttttaattgggatgagcgggatgttcgtgtgtgctatatttatgtctgttggcctggtgctccttaataagttttcatggatgtcctacgtttccatgattgccatctttctgtttgtgtccttttttgaaataggacccgggcctataccatggtttatggtggcagagtttttctctcagggccctaggccagccgcgttggccattgccgcgttcagcaattggacctgtaactttattgtggcattgtgcttccagtacatagccgacttttgtgggccctatgtgtttttcctctttgcgggcgttctgctggccttcactctcttcacattttttaaagtccccgagacaaagggtaagtccttcgaagagatcgctgccgaattccagaagaaatccgggtccgcccaccggccgaaggcagctgtcgaaatgaagtttctgggagccaccgagacagtt

SEQ ID NO: 19398 - DNA, 1572 bp, Artificial Sequence
  Description of Artificial Sequence: Synthetic coding sequence
atgaccgaggataaggtgactggaaccctggtgttcactgtgatcaccgcggtgctgggttcatttcaattcgggtacgacatcggagtgatcaacgcaccgcaacaggttatcatttcacactacagacacgtgctgggcgtgccacttgatgatcgcaaagcaatcaacaattacgtgataaactcgacggatgagctgccaaccatctcatattcaatgaatccgaagcccacgccttgggcggaggaagagactgtcgccgccgctcagctcattaccatgctgtggtccctttcagtcagctccttcgctgtggggggaatgaccgctagcttcttcggtggctggttgggcgataccctcgggcgcatcaaagcaatgctggtcgcaaatatcctgtccctggtcggtgccctgcttatgggattcagcaagttgggtccgtcgcatattctcatcatcgccggaagaagcatatcaggactctactgcgggctcatctcaggactggtacccatgtacataggagagatcgcccccactgcactgagaggggctttggggactttccatcagctcgcaattgtcacgggtatcctgattagccaaatcatcggactggagtttatcctgggaaactacgacctctggcatatcctgctgggactgagcggcgtccgggcgatcctgcagtccctgttgctcttcttttgcccagaatcccctcggtacctgtacatcaaactggacgaggaagtgaaggctaagcaatccctgaagcggctccggggatatgacgacgttactaaggacatcaatgaaatgcgcaaggagcgggaagaggcttcctcagaacaaaaagtctcgatcattcaactgtttacgaactcgagctaccgccagcctatcctcgtggccctgatgcttcacgtggctcagcagttctcaggcataaacggaatcttttactactcgaccagcatctttcagaccgccggcatttcgaagccagtctatgcgactattggcgtgggagcggtcaacatggtattcaccgccgtctctgttttcctcgtggaaaaggccggcagaagatccctgtttctgatcgggatgtccggaatgttcgtctgcgcaatctttatgtccgttggactcgtgctcctgaacaagttctcttggatgtcgtacgtgagcatgatcgccatcttcctgttcgtgtctttctttgagatcggcccggggccgattccgtggtttatggtggctgagttcttctcgcagggaccccgccccgccgctctggccattgccgcatttagcaattggacttgtaactttattgtcgccctctgctttcaatacatcgccgacttctgcggcccgtacgtgttctttcttttcgccggcgtgctgcttgcctttactcttttcaccttctttaaagttcctgaaacgaagggcaaatcgttcgaagaaatcgccgcagaattccagaagaagagcgggagcgcacaccgacctaaggccgcggtggagatgaaattcctgggagctactgaaactgtg

SEQ ID NO: 19399 - DNA, 1572 bp, Artificial Sequence
  Description of Artificial Sequence: Synthetic coding sequence
atgaccgaagataaagtgacgggaacgctggtgtttaccgtcatcactgcagtgctgggctcattccagtttggatacgacattggagtcatcaacgctcctcaacaagtgattatttcccattaccgtcacgtgctgggagtgccgctcgatgacagaaaagccatcaacaactacgtcatcaacagcaccgacgagctcccaacgatttcgtacagtatgaatccgaaaccgaccccgtgggctgaagaagaaacggtggcagcggcgcagctgatcaccatgttgtggagcctgtcagtttcgagcttcgccgtgggaggcatgacggcctcctttttcggtggctggctgggcgacaccctcgggcgcatcaaggcaatgcttgtggcgaacattctgtcgctggtgggagcactgctcatggggttctccaaactcggaccttcgcacattttgatcatcgctgggcgttctatttccggattgtactgcggtctgatctccggcctcgtcccaatgtatatcggggagatcgcccctaccgcgctgcgcggcgccctcggtaccttccaccagctggcgatcgtgactggtatccttatctcacaaatcatcggacttgagtttatcctcggaaattacgatttgtggcatattctccttggactctcgggagtgcgcgccatcctgcaaagcctgctgctgttcttctgtcctgaatctccacgctacctttacatcaaacttgacgaagaggtgaaggcaaagcagagccttaagaggctccggggatacgatgatgtgaccaaggatataaacgagatgcgcaaggagcgcgaagaggcatccagcgagcagaaggtttccatcattcagctgttcaccaactcaagctatcggcaacccatcctcgtggcactgatgctgcacgtagcgcagcagttctcgggtatcaatggcatcttctactacagcacttcaattttccagactgccggcatctctaaaccggtctacgcaaccataggagtgggggccgtcaacatggtcttcactgctgtgtcggtgttccttgtggaaaaggctggacggcggtcgctcttccttatcggaatgtccgggatgttcgtgtgcgccatcttcatgtcggtgggactggtcttgctgaataagttctcctggatgtcatatgtatccatgattgcgatcttcctcttcgtgagcttctttgaaatcggtcccggacctataccctggtttatggtggcggagttcttttctcaaggaccccggcccgcagccctggccatcgcggctttctcaaattggacctgcaatttcatcgtggccctgtgcttccagtacatcgcggacttttgtggaccatacgtcttcttcctgttcgcaggggtcctgttggccttcactctgttcacttttttcaaggtgccggaaactaaggggaagtcgttcgaagaaatcgccgcagagttccagaagaagagcggaagcgctcacaggccgaaggctgctgtggagatgaagttcctgggagccactgaaactgtc

SEQ ID NO: 19400 - DNA, 1572 bp, Artificial Sequence
  Description of Artificial Sequence: Synthetic coding sequence
atgactgaagataaggtgaccggcaccctcgtgttcactgttataactgcagtcctgggatcctttcagtttggttacgatatcggggtgatcaacgcgcctcagcaggtgatcatcagccactacagacatgttttgggcgtgccactcgatgaccgaaaggcaatcaacaattatgtcatcaattcaaccgatgaactccctaccatctcgtactccatgaacccaaagcccaccccgtgggcagaggaagaaaccgtggccgccgcacaactcattactatgttgtggtcgctgtcggtgtcgtcatttgcagtgggagggatgacggcatcgttctttggtgggtggcttggagacactcttggtaggattaaggcaatgcttgttgccaacatattgagcctggtgggagcgcttcttatgggttttagcaagctcggtccgtcccatatacttatcatagcaggccggtccatttccggactctactgcggccttatctcggggctggtgcctatgtacattggtgagattgcaccaactgcactgcgtggagcattgggaacttttcatcaactggccatcgtcaccggaatacttatctctcagattattggacttgagttcatcctgggcaactacgacctgtggcacatcctgctggggctgtcgggcgtccgcgcaatactgcaatccctcctcctgttcttttgtccagagtcgccccggtacctttacattaaacttgatgaagaggtgaaggcaaaacagtcccttaagcgattgcgtgggtacgacgatgtgactaaagacattaatgagatgagaaaagaacgagaagaggcttcatctgagcagaaagtctcgataattcaattgtttaccaattcgtcctataggcagcctatcctggtggcccttatgcttcacgtggctcaacagttttcggggattaatggcatcttttactacagcacctcgatttttcagaccgcgggtatctcgaagccagtctatgcgaccattggagtgggcgcagtcaacatggtgtttacggctgtgtccgtctttttggtggagaaggcaggtaggagaagcctctttctcattggaatgtccggtatgtttgtctgtgcaatcttcatgtcagtgggtcttgtccttctgaataagttcagctggatgtcatacgtgtcaatgattgctattttcctctttgtgagcttttttgagattggacccggaccgattccgtggttcatggtggcggagtttttcagccagggcccacggccagccgccctcgcaatcgcagcattttcgaattggacttgtaactttatagtggccctctgttttcaatacattgccgatttctgtgggccatacgtcttttttctgtttgctggcgtgctgctcgcattcactctgtttaccttcttcaaagtccccgaaactaagggaaagtcctttgaagaaattgcagccgaattccagaaaaagtcggggtccgcccatcgcccaaaggccgctgtggagatgaaatttcttggggctactgaaacggtg

SEQ ID NO: 19401 - DNA, 1572 bp, Artificial Sequence
  Description of Artificial Sequence: Synthetic coding sequence
atgacggaagataaggttacgggaacattagttttcacggtgatcactgcggtgttgggtagtttccagtttgggtatgacataggtgtcatcaacgctcctcagcaggtgatcatctcacactaccggcacgtcctgggagtccccctagatgaccgcaaggcgatcaataactacgtcatcaattcgactgatgaattaccaacaatcagctactccatgaatcccaaaccaactccctgggccgaagaggagaccgtcgccgccgcacagctgattactatgctatggagtctcagcgtttcctccttcgccgttggcggtatgacggcaagctttttcggcggatggctgggagatacccttggcagaattaaggccatgctggtagctaacattttgtctctggtgggggctcttctaatggggttttcaaagctggggccgtctcatatattgattattgccggacgttcaatcagcggcctttactgcgggctcatcagcggactggtcccaatgtacattggcgagattgctcccactgccctgagaggcgcactcggtactttccatcagctggccattgttaccggcatcctgataagccagattattggactggagtttatcctgggaaattacgacctgtggcatatcctcctcggcttaagcggagtccgagccatacttcagtccctactcctgttcttctgccccgagtcccctaggtatctctacatcaagctcgacgaagaggtaaaggctaaacagtctcttaagcggctgagaggatatgacgacgtcaccaaggatataaatgagatgcgcaaggagagagaagaggccagcagtgagcagaaggtgtccattattcaattatttaccaattctagttacagacaacctattctggtagcactgatgctccacgtagcacaacagttctccggtataaatggcatcttctactattctacgtctatttttcagactgccggcatttctaaacccgtttatgctacgattggtgttggagccgtgaacatggtattcacggccgtcagtgtcttccttgtcgagaaggccggccgccggtccctctttcttatcgggatgagtgggatgtttgtgtgtgcaatcttcatgtcagtggggttagttctcttgaacaaattctcatggatgtcctacgtcagtatgatagccatttttctgttcgtgtcatttttcgagatcggacccgggccgatcccatggttcatggtggcagaattcttctcgcagggtcctcgaccagccgctctagcgattgcagccttctcgaattggacttgcaacttcatagtggccctgtgtttccagtatattgctgacttttgcggaccctacgtgttcttccttttcgcaggagtattgttggcattcactctttttactttcttcaaggtaccggaaacaaaaggcaagtcctttgaggagattgctgcagaattccagaaaaaatccggctcagcccatcggcctaaagctgcagtggaaatgaagtttcttggggctactgagacagtg

SEQ ID NO: 19402 - DNA, 1572 bp, Artificial Sequence
  Description of Artificial Sequence: Synthetic coding sequence
atgacagaagataaggtaactggcactcttgtgttcacagtgattacagctgttcttggtagcttccagttcggctatgatattggggttatcaacgctccgcaacaggtcattatctcgcattacagacacgttctgggcgttcctctggacgatcgaaaggcaattaacaactatgtaattaatagcactgacgagttaccaacgatttcctactcaatgaacccaaaaccgaccccatgggctgaagaggaaacagtggctgcagcacaacttatcactatgctatggtccttgtcggtttccagttttgctgtaggcggaatgactgcatccttttttggtggatggcttggtgatacacttggaaggatcaaagccatgctagtagctaacatcttgagtctggtcggagcgcttcttatgggattcagtaaacttggacctagccatatactcataattgcgggcaggagtatttccggactttattgcggattgattagcggacttgttccgatgtatataggagaaatagctccaactgcacttaggggagcgttgggaactttccatcaactggctattgtaaccggtatcttaatctctcaaatcattggactcgagtttattctcggtaattacgacttgtggcatattcttttaggactctcgggcgttagagctattcttcagtccttgctcctgttcttctgccctgagagcccgaggtacctgtatattaagctcgatgaggaggtgaaagccaaacaaagcttgaaaagactcagaggttatgatgatgtgacaaaggatatcaatgagatgaggaaagaacgtgaagaggcatcttctgagcaaaaggtttcaattattcagttattcactaacagtagctatcgccagccaatcttagtagcccttatgctacatgttgcacagcaatttagtggaattaatggcatcttttactattcaacaagtatctttcaaaccgccggtataagtaaacctgtttacgccaccataggagttggtgcagttaatatggttttcactgctgtttccgtttttctggttgaaaaggctgggagacgctccctcttcctgattgggatgagtggaatgtttgtttgtgccatctttatgagcgttggacttgtactattaaacaaattttcttggatgtcatatgtttcgatgattgctattttcttattcgtgagtttttttgagatcggtcctggaccaatcccatggtttatggtcgcagaattcttctctcagggaccacgtcctgcggctttagcaattgccgcattttctaactggacttgtaattttatcgtggcattatgttttcagtacattgctgacttctgtggtccctacgtgtttttcttgtttgccggtgttttgttagcttttactctattcactttctttaaggttcctgaaaccaaggggaagagtttcgaagagattgctgctgaatttcaaaagaaatccgggagtgcacacagaccaaaggccgccgtggagatgaaattccttggtgctacggagactgtt

SEQ ID NO: 19403 - DNA, 1572 bp, Artificial Sequence
  Description of Artificial Sequence: Synthetic coding sequence
atgactgaagataaggtgacgggcactcttgtattcacagtaataactgctgtgctcgggagcttccaattcggctacgacattggcgtcattaatgctcctcagcaggtcattattagccattacaggcacgtcctgggcgtgcccctcgacgatagaaaggcaatcaacaattatgtcattaacagtacagacgagttgcccacaatctcttacagcatgaatccaaagccaaccccatgggctgaggaagagacggtcgctgctgcacagttaattactatgttgtggagcctgagcgtctcatcatttgcagtgggcgggatgactgcgagcttttttggaggatggctcggtgacactcttgggagaatcaaggccatgctagtcgctaacatcctcagtctggtcggggcccttttgatgggcttttccaaactaggtcccagtcacatcttaatcatcgcaggcagatctatttccggactgtattgtggactgattagcggcctcgtgccaatgtatatcggagagatcgcccctacagccctgaggggggcactgggtacattccatcagctcgctatagtgaccggcatcctcatttcgcagatcattgggttggagtttattttggggaactacgatctctggcacatactgttgggcctgtccggcgttcgtgcgatcctccagagcctgttgctcttcttctgtcccgaatccccgcggtatctctatatcaaactggatgaggaggtcaaggcgaagcagagtctgaaacgtctgagggggtatgacgacgtaaccaaggacataaatgagatgagaaaggaaagagaagaagcctcctctgagcagaaggtaagcataatccagctgtttacaaattcctcctatcggcagccgatcctggtagccctgatgctgcacgtagcacagcaattttcgggcattaatgggatcttctattactctacaagcattttccagactgccgggattagtaaacctgtctacgccacaataggcgtaggggcggtgaatatggtgttcacagccgtgagtgtgtttttggtcgaaaaagctggacggcggagtcttttccttataggtatgtccggcatgttcgtctgtgctatttttatgagtgtgggactcgttctgttgaataagtttagctggatgagttatgtgagtatgatcgccatattccttttcgtgtccttttttgagataggccccggtcccatcccctggttcatggtagcggaatttttttcccagggccctaggcccgccgcgctggcaatcgccgcgttctctaactggacctgcaactttatcgtggcactatgtttccagtacatagccgacttctgtggaccatacgtgttcttcctctttgctggggtgctgctggctttcaccctgttcacattctttaaggtgcccgaaacaaagggcaagtccttcgaggagatcgcggccgagtttcagaaaaagtctgggtctgctcataggccaaaagcagcagtggagatgaaattccttggcgccactgaaaccgtg

SEQ ID NO: 19404 - DNA, 1572 bp, Artificial Sequence
  Description of Artificial Sequence: Synthetic coding sequence
atgaccgaggacaaggtgactgggacactggtcttcaccgtaattaccgccgtgctgggctcgttccaattcggttacgatattggagtcatcaatgctccacagcaggttataatttctcactatagacatgtgttgggagtcccccttgatgatcgcaaggccattaataattacgtgattaatagtacagatgagctcccaacaatctcttactctatgaaccccaagcccaccccctgggctgaggaggaaaccgtggcagccgctcagctgatcaccatgttgtggtccctcagcgtgagtagcttcgccgttggcgggatgactgccagctttttcggagggtggttaggcgacacccttgggaggattaaagcaatgctcgttgcaaacatactgtcacttgtgggggccctcttaatggggttcagtaaattgggaccctcacacatactcataatagccggccgctctatatcaggactctactgtggccttataagtgggctcgtaccaatgtacattggagaaatagccccgacagccctgcgcggagcgcttggcacatttcatcagctcgcaatcgtgaccggcatactcatttcacagataatcgggctagagtttattctgggcaattacgacctgtggcatatacttttaggactatcaggagtgagggcaatactgcaaagcttgctgctgttcttttgcccagagtcaccgaggtacctgtacatcaagctggatgaggaagtaaaagcaaaacagtctctcaaaaggctaagaggctacgacgatgtcaccaaggatattaatgaaatgcgaaaggaaagggaggaagcaagctcagagcagaaggtgagcattatccagctatttaccaactcttcctacaggcagcctatcctcgttgctcttatgctgcatgtggcccagcagttttcgggaattaatggcatcttttattatagcacctctatctttcaaaccgccgggatttccaaaccagtgtacgctacgatcggagtgggggccgtgaacatggtgtttactgccgttagcgtgttcctggtggagaaggcaggtaggagaagtctattcttaattgggatgtctggcatgtttgtttgcgccattttcatgagtgtaggcttggtactgctgaacaagttctcctggatgagctacgttagcatgattgcaatttttttattcgtttcattttttgagatcgggcctggccctattccttggttcatggtcgcagagttctttagtcagggacccagaccagccgctttggcaattgccgccttttccaactggacatgtaacttcatagtagcactgtgcttccagtatatcgccgatttctgcgggccctacgtctttttccttttcgccggggtactgctcgccttcacactgttcaccttcttcaaggtccctgaaacgaagggcaaaagtttcgaagaaattgctgcagagtttcagaagaagtctgggtctgctcacagacccaaagcagccgttgagatgaagttcctcggggccactgagaccgtg

SEQ ID NO: 19405 - DNA, 1572 bp, Artificial Sequence
  Description of Artificial Sequence: Synthetic coding sequence
atgactgaggacaaagttacagggacccttgtcttcacagtgatcacggctgttctggggtctttccagtttggatatgacattggtgtgatcaatgcgccacagcaagtgattatctcgcattaccgtcatgttctaggcgtgcctctggatgatcgaaaggcgatcaacaactacgtgatcaattctaccgatgaactccctacgatttcatatagcatgaacccaaagcccacaccctgggcagaagaagagactgtagccgccgcccaactcatcacaatgttgtggtctctatcggtatcatccttcgcggtgggcggcatgacagcttcattctttgggggatggctgggcgacaccctcggccggatcaaagctatgttagtggctaacatactatccctggtgggagctctcctgatgggttttagcaagctgggacctagccacattctgattatcgctggacgctcaatttctgggttgtattgtggactcatatcaggcttggtgccaatgtacatcggtgagatcgccccaactgcgctccgcggcgcccttggcactttccatcagctggcgattgtgacagggattctcatttcccagataattggattagagtttatcttaggaaactatgacctctggcacatactcctcgggctcagtggggtgagggcgattcttcagtcactgctgttgttcttctgcccagagagccctagatacttgtacatcaagctggatgaggaggtgaaggctaagcagtccctgaagcgcttaaggggatacgatgatgtgaccaaagatattaatgagatgcggaaggagagagaagaggcatcttctgagcaaaaggtaagtatcatacaactcttcacaaattcctcttatcgacagcctatcctggtagccctgatgctgcacgttgcgcagcagttcagcggtatcaacggaattttttactactccaccagcattttccaaactgctggcatttccaaaccagtctacgctaccataggtgtcggagccgtcaatatggtctttacggctgtgagcgtctttctggtggagaaggcaggacggcggagtctgtttctgatcggcatgtccgggatgtttgtgtgtgctatttttatgtctgtgggcctggtgctcttgaacaaattctcctggatgtcctacgtctcaatgattgccatcttcctgtttgtctccttctttgaaatagggcccggtccgataccctggttcatggtcgccgagttctttagccagggaccgcgacccgctgccttagccattgcagccttctcgaattggacctgcaattttattgtcgcattgtgttttcaatacattgcggatttctgcggcccgtacgtgttttttttatttgcaggagttctgctggcatttacactattcaccttctttaaagtgccagaaacaaaaggaaaaagcttcgaggaaatagccgccgaatttcagaagaagagcggctctgctcacaggcctaaggccgctgtcgagatgaaattcctcggagctaccgagaccgtg

SEQ ID NO: 19406 - DNA, 1572 bp, Artificial Sequence
  Description of Artificial Sequence: Synthetic coding sequence
atgaccgaagataaggtgaccggaaccctggtgtttaccgtgattaccgcagtccttggttcctttcagttcggatacgacattggggtgattaatgcacctcaacaagtgatcatttcgcattacaggcatgtgcttggggtgcctctggacgatagaaaagccataaacaattacgtcattaacagcaccgacgagctcccaactatttcctactcaatgaatcctaagcccactccatgggcagaagaagaaaccgtcgcggcagcccagctcattaccatgctgtggtcgctcagcgtctcttccttcgcagtgggaggtatgacggcatccttctttggaggctggctgggcgatactctcggcaggatcaaagccatgctggtggcaaatatcctcagcctcgtgggagctctgcttatgggattttctaaactcggaccaagccatatcctgataattgcgggacggagcataagcggtctgtactgtggcctcatcagcggtttggtgcccatgtacatcggagagattgcacccaccgcactccgaggcgcgcttgggacttttcaccagctggcaatcgtgaccggaatcctgataagccagattatcgggctcgaattcattctcggtaactacgacctctggcacatacttcttggattgtccggagtgagggctatccttcaaagccttcttttgtttttctgtcctgaaagccctcgctacttgtacattaagttggacgaggaggtgaaggcaaagcagagcctgaagcgactgagaggatacgatgatgtgacgaaggatatcaacgaaatgaggaaggaaagagaggaggcttcgtccgaacaaaaggtgagcattattcaactctttaccaactcgagctacagacagcctatcctcgtcgcacttatgctccatgtggcccaacaattctcaggtattaacggaatcttttactactccacctcaattttccaaactgccggaatttccaagccagtgtacgcaactataggggtcggtgcagtcaatatggtctttaccgcagtctcggtctttctggtggagaaggccgggagacgtagcctttttctgattggaatgtcaggcatgtttgtgtgcgccatctttatgtccgtgggactcgtcctgcttaacaagttctcgtggatgtcctacgtgtcgatgatagccatctttttgttcgtctctttcttcgaaatcggacccggtcccattccatggtttatggttgccgagttcttttcgcagggacctcggcctgctgcccttgctatcgccgcattctccaattggacgtgcaactttatcgtggctctgtgttttcaatacattgcagatttctgtggaccttacgtgttcttcctcttcgccggtgtcctccttgcatttaccctctttacctttttcaaagtgccagaaacgaagggcaagtccttcgaagagattgcagcggagttccagaagaaaagcggatccgcacataggccaaaggcagccgtggagatgaagtttctcggtgccactgagactgtt

SEQ ID NO: 19407 - DNA, 1572 bp, Artificial Sequence
  Description of Artificial Sequence: Synthetic coding sequence
atgactgaggacaaggtgaccggaactctcgtgtttactgtgataacggcagtcctcggctcgttccagtttggttacgatatcggagtgatcaacgcacctcaacaagtcatcatttcacattacaggcatgtgctcggagtgcctcttgacgatcggaaggcaatcaacaattacgtgatcaattcgaccgacgagctccccactatttcctactcaatgaatcctaagcctaccccatgggccgaagaagaaactgtggcagccgcacaactgatcactatgctttggtccctgtcggtcagtagcttcgcggtggggggaatgaccgcatccttttttggaggatggctgggcgacactctcggtaggataaaggccatgctggtggcaaacatccttagcctggttggtgcactgctgatgggattttcgaagctcggtccctcgcacatattgattattgctggtcgtagcatatcgggcctgtattgtgggcttattagcgggctggtccctatgtacatcggcgaaattgcacccaccgcacttcggggggcacttgggacgttccaccagctggcaattgtcactgggattctcatctcccagattataggactggagttcattctgggaaattacgatctttggcacatacttcttggcctttccggtgttagagcaatccttcagtcgcttcttctcttcttttgtcctgaatcgccgaggtacctgtatatcaagctcgatgaagaggtgaaggcgaagcagagcctcaagcgtctgagaggatacgacgacgttaccaaggacattaatgaaatgcgtaaagaaagggaagaagcgtcctccgaacagaaggtcagcatcattcaactgtttactaattccagctacagacaacctattctggtcgcgctgatgttgcacgtggcacaacaattttcgggaatcaatggaatcttctactacagcaccagcatctttcagacggcaggaatctctaagccggtctacgctactattggcgtgggcgcagttaacatggtttttaccgctgtgtcggtgttcctcgtcgaaaaggctggacgacgatcactgtttttgataggaatgtcgggaatgtttgtctgcgcaatctttatgtcggtcggtcttgtcctgttgaacaagttttcgtggatgagctacgtgtcaatgatcgctattttccttttcgtgtcctttttcgaaattggtcctgggcctattccgtggtttatggtggcggagtttttctctcagggccctcgccctgcagcgctcgcaattgcggcattttcgaactggacttgtaatttcattgtcgcgctgtgctttcagtacattgccgatttctgtggaccatacgtgtttttcctgttcgccggagtcctgcttgccttcacgctcttcactttctttaaggtgccagaaactaagggcaagtcgtttgaggaaattgccgcagaatttcaaaagaaatccgggtcggcacatcgtccaaaggccgcagtggagatgaagtttctcggggcaaccgaaaccgtg

SEQ ID NO: 19408 - DNA, 1572 bp, Artificial Sequence
  Description of Artificial Sequence: Synthetic coding sequence
atgactgaagataaagtgactggaacccttgtttttacagtgataactgcggttctgggaagctttcaatttggatatgacatcggtgtcattaacgctccacagcaagtcattatttcgcactatagacacgttttgggtgttccattagatgatagaaaggcgatcaataattatgttattaatagtactgacgagcttccaactatttcatactctatgaacccaaagccaactccatgggcagaggaagaaacagtagctgcggcccaattgatcactatgctgtggagcctttctgtatcttcattcgccgttggcggaatgaccgcttcgttctttggaggttggcttggagacactttaggcaggattaaggctatgctggttgccaatatcctatcactcgtcggagctcttcttatgggtttttccaaattaggaccatcacacatactgataatcgcgggacgaagtatttctggtctttattgcggacttatcagtggactagtgccgatgtacatcggagagattgctccaactgcgctcaggggagcactaggaacattccatcagctcgccattgtcaccggtattctcattagtcaaatcataggtctagagtttatccttggaaattatgacttgtggcatatcttgctaggactctctggtgtcagagctattttgcaatcgctcctgttgtttttctgcccagagagtccacgttacctttacatcaagttagatgaagaagtcaaagctaaacaatcccttaaacgattgcgtggctacgatgatgtcactaaggatattaatgagatgcgaaaagaacgagaagaagctagcagcgaacaaaaagtcagtataatccaactttttacgaactcatcgtaccgacaaccgatcttagtagccttaatgttacacgtagcacagcagttttcgggcattaatggaatcttctattattctacttcgatttttcaaactgctggaataagcaaaccggtttatgccactattggcgtaggggctgttaacatggtgttcactgcagtgtccgtgttcctagttgaaaaggcgggaagacgtagtctctttcttattggaatgtcaggaatgttcgtgtgtgcgatcttcatgtcggtcggcctggtcctcctaaataaattctcctggatgtcttacgtgagtatgatcgcaatttttttgtttgtgtcgttttttgagattggaccaggtccaattccgtggtttatggttgctgaattcttttctcaaggaccacgtccggccgccctcgccatcgcagctttcagtaattggacgtgcaatttcattgtcgcattgtgtttccaatacatcgctgatttctgtgggccttatgtcttctttctctttgcaggagttttgttagcttttacgttatttacattcttcaaagttccagaaacaaagggaaagagcttcgaggagattgcagctgagttccaaaagaaatcgggctctgctcatagaccaaaggctgcagttgagatgaaattcttaggtgctaccgaaacagta

SEQ ID NO: 19409 - DNA, 1572 bp, Artificial Sequence
  Description of Artificial Sequence: Synthetic coding sequence
atgacagaggacaaggttacaggcactctcgtgtttaccgtcatcacagctgtgctgggatccttccagttcggttatgacatcggcgtgattaatgccccacagcaggtgatcatctcccactatcgccacgttcttggggtgcctctcgatgaccggaaagctataaataattacgtaattaactcaactgatgaactgccaactattagctactctatgaaccctaagccaacaccctgggccgaggaggagacagtggccgctgctcagcttattacaatgctatggtccctttccgtttctagctttgccgtaggaggaatgaccgcctcattttttggggggtggctgggtgataccttaggtagaatcaaggctatgctggtggccaacattttatctctggttggcgctctcctcatgggtttctctaaattagggccttctcacatcctcatcattgccggccggagtatctccgggctgtactgcggcctcatctctggtctggtgcctatgtatattggagaaattgccccaaccgcactgcggggtgccctgggcaccttccaccagcttgctatcgttactggcatcctcattagccagattataggtttagagtttatactgggcaattatgatttatggcacattctgttaggcctgtctggagttcgtgccatacttcaatctctcctgctgttcttttgccccgagagtccccgctacctgtacatcaagcttgatgaagaagttaaagccaagcagagccttaaaaggttgcgcggatacgatgatgtgaccaaggacattaacgagatgcgaaaagagagagaggaggcttcttccgagcagaaggtcagcatcatccagctcttcaccaatagctcctaccgtcagcccatactagtggccctgatgctgcacgtcgctcagcaattttctggtatcaatggcattttttattatagtacatcgatttttcagacagccggcatctccaaacctgtgtatgccaccattggcgtaggcgccgttaatatggtcttcaccgccgtgtcagtcttcctcgtcgaaaaagctgggcgtagaagtctgttcctgatcggcatgagcggaatgtttgtgtgcgccatcttcatgagcgtgggattggtactgctgaacaaattttcctggatgagctacgtatcaatgatcgctatatttctgttcgtctctttcttcgaaattgggcctgggccaataccctggttcatggtcgccgagtttttttcgcagggtccaaggcccgcggctctcgctatcgctgctttctccaactggacttgtaatttcatcgttgcactgtgttttcagtacattgcagacttttgtggtccgtacgttttcttcctcttcgccggtgtgctgctggcattcactctgttcacttttttcaaagtgccagagaccaaggggaaatctttcgaagaaatcgccgcggagttccagaaaaagagcggctcagctcatagacctaaggccgccgtcgagatgaagttcctgggtgccacagagacagta

SEQ ID NO: 19410 - DNA, 1572 bp, Artificial Sequence
  Description of Artificial Sequence: Synthetic coding sequence
atgactgaggacaaagtgactggaaccttggttttcaccgttattaccgcagttcttggatcgtttcaatttggttacgatattggcgtcattaatgcaccccaacaagtgatcattagccattatcgccacgtgttgggcgtcccactggatgacagaaaagcaattaacaattacgtgattaactcgacggatgaactgccaaccattagctactcgatgaatcctaagccaacgccttgggcggaagaggaaacggtcgcagcagcacaactcatcaccatgctttggtcactgtccgtgagctcgttcgctgtcggaggaatgaccgcatcattctttggaggttggttgggtgacacgttgggcaggattaaggcaatgctcgtcgccaacattctctcgctcgtgggggcacttctgatgggcttttccaaacttggaccttcgcatatccttatcatagccggtcggtctatctcgggtctgtactgtggactgatcagcggactcgtgcctatgtacatcggagaaatcgcgccaacggctctgagaggtgctcttggcacctttcaccagttggcaatcgtcaccgggatcctgattagccagatcattggactcgaattcatcctcggcaattacgacctttggcacatattgcttggcctgtcgggagtgcgcgcaattcttcagagcctgctcctgtttttctgtcccgagagcccccgatacctttacattaagctcgatgaagaagttaaagcgaagcagtcccttaaacgccttagaggatacgatgacgtgaccaaggatatcaatgaaatgcgcaaagaacgggaagaagcaagctcggaacagaaggtgtccattatccaactgtttaccaatagcagctacagacagccaattctggtcgccctgatgttgcatgtggcacaacagttttcgggaatcaatggaatcttctattactcaacttcgatttttcagaccgcgggaatcagcaagcctgtgtacgcgactatcggtgtcggtgccgtgaatatggtgttcaccgcagtctcggtgttcctggtggagaaggcggggcgtaggtcgctgttcctgataggaatgagcggtatgtttgtctgcgcaatcttcatgtccgtgggtctggtgctgctgaataagtttagctggatgtcatacgtgtccatgatcgccatttttctcttcgtgtcgttctttgaaattggtcctggtcctattccatggtttatggtcgcagaattcttttctcaaggaccacggcctgcagctttggccattgccgcattttccaactggacttgtaacttcattgtggcgctgtgttttcaatacattgccgatttttgtgggccttacgtgttttttctgtttgccggagttctgctggcattcacccttttcacctttttcaaagtgccagaaaccaaaggcaagtccttcgaagaaatcgcggcagaattccagaagaagagcggatccgcccatagaccaaaggcagcggtcgagatgaagttccttggtgccactgaaaccgtc

SEQ ID NO: 19411 - DNA, 1572 bp, Artificial Sequence
  Description of Artificial Sequence: Synthetic coding sequence
atgactgaggataaagtcactggcaccctggtttttaccgtgatcacagctgtgctggggagctttcaattcggatacgacattggcgtgattaatgctccgcagcaggtgatcatttctcattatcgacacgtattgggtgtaccgttggacgacagaaaggccattaataactacgtaataaatagtacagatgagctgccgacaatatcttattctatgaatcccaagcctactccctgggctgaggaagagactgtggcagcggctcagcttattaccatgctctggtctctctccgtgagcagttttgcggtcggggggatgaccgccagctttttcggaggatggctgggcgataccctggggagaatcaaggccatgctggtggctaatattctgtcccttgtcggagctctcctgatgggcttcagtaagttgggccctagtcacatcctgatcatcgctggccgttccattagcgggttgtattgtggtttgatctctggacttgttccaatgtatatcggcgaaatcgctcctactgccctgcggggagcccttgggacttttcatcagttggcaatcgttacggggatcctcatctcgcagattattggcttggaattcatactgggtaactatgacctgtggcacattttgctggggctgtcaggtgtgcgtgccattctccaaagtcttctgctgttcttttgtccagagtctccccgttatctgtacattaagctcgatgaagaggtcaaagcaaaacagagtctgaagagactgcgggggtacgatgacgtcactaaggatattaatgagatgcgaaaggaacgagaggaagcctcatctgaacagaaggtttccatcatccagctgttcaccaacagttcgtacaggcagccaatcctggttgcactgatgttacacgttgctcagcaattcagcgggatcaacggcatcttctattacagtaccagcatcttccagaccgctgggatatccaaaccagtctatgccacaatcggggttggtgccgttaacatggtcttcacggccgtctctgtgttcctggtcgagaaggcaggtcgaaggtccttattcctgatagggatgagcggcatgttcgtgtgcgccattttcatgtcagtgggcctggtcctgctcaataaattctcctggatgtcttacgtctctatgatagccatattcttgttcgtctccttttttgaaatagggcctgggcccattccctggttcatggttgcagagttcttcagccagggacctagaccagccgccctcgcaattgccgcattcagcaattggacctgcaacttcatcgttgccctgtgctttcaatacatcgcagacttctgcggcccgtatgtgttcttccttttcgcaggggttctgctggcattcactctgttcaccttcttcaaggtgcccgagactaaggggaagagcttcgaagagatagctgccgaattccagaaaaaatctgggtcggcccacaggcccaaagcagcagtggaaatgaagtttcttggggctactgaaaccgtg

SEQ ID NO: 19412 - DNA, 1572 bp, Artificial Sequence
  Description of Artificial Sequence: Synthetic coding sequence
atgaccgaagataaggtaaccggtacccttgtttttaccgtgattacggcggtgcttggtagcttccagttcggctacgacatcggagtcataaacgccccgcaacaggtgatcatttcacactaccgccatgtcctcggcgtgccccttgacgacaggaaggctatcaacaactacgttatcaactcgaccgatgaactcccaactatctcatacagcatgaaccccaagcctaccccatgggcagaagaagaaaccgtggctgcagcccagctcataactatgctgtggtcgctttcggtgtcatcgtttgcagttggaggtatgactgcgtcgtttttcgggggatggctgggagatactctgggccgcattaaggcgatgctggtggccaatattctttcactggttggtgccttgcttatgggttttagcaagctggggcctagccatattcttatcatcgcggggagatcgatttccggcctgtactgcggtcttatttccggactggtgccaatgtacatcggagaaattgccccaacggctctcagaggtgcacttggaacttttcatcaactggcaatcgtgactggaatacttatttcacaaatcatcggacttgaattcattcttggcaattacgatttgtggcatattctgctgggacttagcggagtgcgagcaattctccagtccctgctgctgtttttctgtcctgaatcccctaggtacctttacatcaagctggatgaagaggtcaaggcaaagcaaagcctcaaaagacttagggggtacgacgatgtgaccaaggacattaacgaaatgcgtaaggaacgggaggaagcgtcgtccgaacaaaaggtgagcataatccaactgtttactaactcgtcatatcggcagcctatactggtggcactgatgctgcacgtggcccagcaattctccggaatcaatggcatcttctattactcaaccagcatttttcaaaccgcagggatttccaaacctgtttacgctactattggggtcggggcagtgaatatggtctttaccgccgtgtccgtgttcctggttgaaaaagccgggcgcagatccctgttcctgatcggcatgtccgggatgtttgtctgtgcaatctttatgtcagtgggactggtgctccttaacaagtttagctggatgtcgtacgtgtccatgatagctattttcctttttgtctcatttttcgaaattggtcctgggcccattccttggttcatggtggcagagtttttctcacaaggaccaagaccagcagcactggcaattgccgcattttcgaactggacgtgcaactttatagtggcattgtgctttcagtacatcgcagacttctgtggcccttacgtgtttttcctcttcgcaggcgtgctgctggcatttactctttttaccttctttaaggtccctgaaactaaggggaagagctttgaagaaattgcagcagagttccaaaagaaatccggctccgcacatcgcccgaaggctgcagtggaaatgaaattcctgggcgcaactgagactgtt

SEQ ID NO: 19413 - DNA, 1572 bp, Artificial Sequence
  Description of Artificial Sequence: Synthetic coding sequence
atgacagaagacaaggtgaccgggacgctggtgttcacagtcattaccgcggtcttgggaagcttccagtttggatatgacattggcgtgataaacgcaccacagcaggttatcatctcccactacagacatgttctgggtgtgccgctggatgacagaaaagctatcaataattacgtcatcaatagcaccgatgagctgcctactataagctactctatgaacccgaagcccacgccctgggccgaagaagagaccgtggccgctgctcagctgattacaatgctgtggtctctgagtgtttcatcattcgctgtgggaggaatgaccgcaagcttctttggcggctggctgggggatacattgggacggattaaagccatgctggttgccaacatcctgtccctcgtcggcgcactgctgatgggattctccaaactcggaccgagccatatcctgatcatcgctggcagaagcatcagcggactgtattgtggactgatttccggactggtgcccatgtacatcggggaaatcgcaccaaccgcactgcggggcgccctggggaccttccatcagttggccattgtgaccggtatcctcatctcacagatcatcggccttgagttcattcttggaaactatgatctgtggcatatcctccttggtctgtccggcgtacgggcaattttgcagtccctgctgctgtttttttgccctgaatcccctagatacctgtacataaagctggacgaggaggtgaaggcaaagcagtctctgaaacggttgcgcggctacgatgatgtgacgaaagatatcaatgaaatgaggaaggagcgcgaagaagccagtagcgaacaaaaggtcagcataatacagctcttcaccaactcctcttatcgccaacctattctggtggccctgatgctgcatgtggcacagcagttcagcgggataaacggtatcttttattattcaacctccatcttccagactgctgggatcagcaagccggtatatgcaacaatcggcgtaggtgccgtgaacatggtctttaccgccgtttctgtctttctcgtggagaaagctggtcggcgcagcttgtttctgattgggatgagcgggatgttcgtgtgcgcaatcttcatgtctgtgggtctggtgctgctcaacaaattctcatggatgtcatacgtgtccatgattgccatttttctttttgttagtttcttcgagatcgggccaggacccattccttggtttatggtggcggagtttttctcacagggcccgcgccccgctgccttggcgattgccgcctttagtaactggacgtgtaactttattgtggcgctctgtttccagtacattgccgatttttgcggtccatacgttttttttctgttcgccggcgttctcctcgcctttactctcttcacatttttcaaagttcccgagacaaaggggaagtcttttgaggaaattgccgctgagtttcagaagaagagcggctcagcacaccgccccaaggctgcggttgagatgaaattcctcggggctacggagactgtt

SEQ ID NO: 19414 - DNA, 1572 bp, Artificial Sequence
  Description of Artificial Sequence: Synthetic coding sequence
atgactgaggataaagtgacggggaccctggtatttaccgtaatcacggccgtactcggatccttccagtttgggtatgacattggcgtgattaacgctccacagcaagtcatcattagtcactaccggcatgtcctgggcgtcccacttgacgacaggaaagcaattaacaattacgtgataaactcgacagatgaactccctacgatatcctattctatgaacccaaaacctaccccctgggctgaagaagagactgtggcagctgcccaactgataaccatgctgtggtcgctgagcgtgtcctcgtttgccgttggcgggatgacggcttccttttttggcggctggctcggggatacccttggacgaatcaaggccatgctcgtggccaacatcctttcgcttgtcggcgccctgctgatgggattctccaaactgggaccttctcacatccttataatcgccgggcgaagtatatctggtctttattgcggcctgatatcggggcttgtccctatgtatatcggcgagattgcaccaaccgcattgaggggagcacttggtactttccaccagctggccattgtcacgggtatcctgattagtcagatcataggtttggagtttatactgggcaactatgatttgtggcatatccttctcggactcagtggggtccgggcgattctgcaatctctgcttctattcttttgccccgagtcaccaaggtacctttacattaaattggatgaggaggtgaaggctaagcaatcattgaagcgtctgcgcggctatgacgatgtgacaaaggatattaacgaaatgagaaaggagcgggaggaggcctcttcagaacagaaggtgtccatcatccagttatttacaaacagctcctacaggcaacctatcctagtggccttgatgctgcacgtcgcgcaacaatttagcggtatcaatgggatcttttattactcaacctccatatttcaaaccgccggcatctccaaacctgtgtatgcgacaattggcgtcggggccgtgaacatggtgtttacagcagtctctgttttcttagtggagaaggctggacggcggtccctgtttctgatcggcatgtcaggcatgtttgtgtgtgcgatcttcatgagcgtgggactggtcctattgaataagttttcatggatgagctacgtaagcatgattgctatatttctgtttgtgagttttttcgagatcgggcccggacccatcccctggtttatggtggcagagttttttagtcagggcccccgcccagctgccctggctattgccgctttctcaaactggacttgtaacttcatcgttgccttgtgcttccaatatatagccgatttttgcggcccgtacgtcttcttcctgttcgcgggagtcctcctggcctttaccctgttcacttttttcaaggtgcctgagaccaaggggaagtccttcgaggagatcgctgccgaattccaaaagaaaagtggatctgcacatcgacctaaagcagcggtggagatgaagttcctgggcgccaccgagacggtc

SEQ ID NO: 19415 - DNA, 1572 bp, Artificial Sequence
  Description of Artificial Sequence: Synthetic coding sequence
atgactgaggacaaagtcaccgggaccctcgtgtttaccgtgatcactgcagtcctgggctcgtttcaattcggatacgacatcggagtgatcaatgcgccacagcaggtgatcatctcgcactatcggcacgtcctgggggttccgctggacgaccggaaggcaatcaacaactatgtgattaactcgaccgatgaactgccgaccatctcttactcaatgaatcccaaaccgaccccctgggccgaagaggaaactgtcgctgcagctcaactgatcactatgctgtggtccctttcggtgtcgtcgttcgcggtagggggaatgactgcatccttcttcggggggtggctgggagacactctcggacggatcaaggcaatgctggtcgctaatatcctgagcctcgtgggagccctgctcatgggattctcgaaattgggaccttcgcatatcctgatcatcgcaggacgatccatctcaggcctgtactgcgggctgatctcagggttggtgccgatgtacattggggaaatcgcgcctaccgcgctgcggggagcccttggaactttccaccagctcgccatcgtgaccggtatcctgatcagccagattatcggactggaattcatcctcggcaactacgacttgtggcacatcctgctggggttgtcgggcgtccgcgcgatcctgcagtccctcctgctgttcttctgcccagagtcccctcggtacctgtatatcaagctcgacgaagaagtgaaggctaagcaatctctcaagcgcctgcgcggttacgacgacgtgacgaaggacattaacgagatgagaaaggaacgggaagaggcgagcagcgaacaaaaagtgtcaatcatccagctctttaccaatagctcctaccggcagccgatactcgtggctctcatgctccatgtcgctcagcaattctcagggatcaatggaatcttctattactcgacttccatcttccagactgctggcatcagcaagcctgtttacgccactatcggcgtcggagccgtgaatatggtgtttaccgcagtgtcagtgttcctggtggaaaaggcgggacgcaggtcattgtttctgatcggtatgtccgggatgttcgtgtgcgctatcttcatgtcggtgggactcgtgttgcttaacaagttttcctggatgagctacgtgtcgatgatcgctattttccttttcgtctccttctttgagattgggccaggaccgatcccatggttcatggtggccgaattcttttcacaagggccaagaccagccgccctcgcaattgcggccttctcgaactggacgtgcaacttcatcgtggcactgtgcttccagtacatcgcggacttctgcggaccgtacgttttcttcctctttgccggtgtcctgctggcgttcaccctcttcactttctttaaggtcccggaaaccaaaggcaagtcgtttgaagaaatcgctgccgagttccagaaaaagtcgggctcggctcaccgccccaaagcggctgtcgagatgaagtttctgggagcaaccgagactgtg

SEQ ID NO: 19416 - DNA, 1572 bp, Artificial Sequence
  Description of Artificial Sequence: Synthetic coding sequence
atgaccgaagataaagtcaccggaaccctggtgttcactgtcatcaccgcagtccttggatcgtttcaattcggttacgatatcggagtgatcaatgcacctcaacaggtgattatctcccattaccgacacgtgctgggagttccactcgatgatagaaaggccataaacaactacgtgatcaattccacggatgagttgcccactatctcctactccatgaatccaaagccgaccccttgggcagaagaggaaactgtcgcggccgcgcagctcatcaccatgctttggtccctcagtgtctcctccttcgctgtcgggggaatgactgcatcattcttcggaggctggttgggcgacacgctggggaggattaaggcgatgctggtcgctaatatcctgtcgctggttggagcgctgttgatgggtttctcgaaattgggaccttcgcacatcctgatcattgcagggaggtccatctcgggtctgtactgcggcttgatctccggtcttgtcccaatgtatatcggagagatcgcaccgactgccctgaggggagccttgggaaccttccaccaactcgccatcgtcacgggaatcttgattagccaaatcattggactcgaattcatccttggcaactacgacctgtggcatattcttttgggcctctcgggagtgcgggccatcctgcagtcactgctgctctttttctgcccggagtcgccgcgctacctgtacattaagttggatgaggaagtgaaggccaagcagtcactcaagcgcctccggggatacgacgacgtgaccaaggacattaacgaaatgcgcaaggaacgggaggaagcgtcgtccgagcagaaggtgtccatcatccagctgtttacgaactcctcctatcgccagccgatcctggtcgctctcatgttgcacgttgcacaacagttctcaggaattaacggaatcttctactactccaccagcatcttccaaactgcgggtatctctaagcccgtgtacgcgaccatcggagtgggcgcggtgaatatggtgtttacggccgtgtctgtgttcctcgtggaaaaggcgggaagaaggtccctgtttcttatcggaatgtcaggaatgtttgtgtgtgctattttcatgtcagtgggtctggtcctgctcaataagttctcatggatgagctacgtgagcatgattgcgatcttcctgttcgtgtcttttttcgagatcggaccgggaccgatcccgtggttcatggtggcagagtttttctcacagggacccagaccggcggctcttgctatcgctgctttttccaactggacttgcaactttatcgtggccctctgtttccagtacatcgccgacttctgcgggccgtacgtgttctttcttttcgccggagtgttgctggccttcaccctcttcacgttcttcaaggttccggaaaccaagggaaaatccttcgaagagatagccgccgagttccagaagaaatcgggctccgcccaccgcccgaaggctgccgtcgaaatgaaattcctgggagctactgaaactgtc

SEQ ID NO: 19417 - DNA, 1572 bp, Artificial Sequence
  Description of Artificial Sequence: Synthetic coding sequence
atgaccgaggataaagttaccggcactctcgtcttcactgtgataactgcagttctaggttcttttcagtttggttatgatatcggcgttattaatgccccccagcaggtcataattagccactataggcacgtgcttggggttccactggatgatcgtaaggcaataaacaactacgtgattaactctaccgacgaactgcctactatctcttactctatgaacccaaaaccaactccatgggccgaagaggagactgtggcagccgctcagctaatcaccatgctttggtccctgtccgtgtcctcattcgccgtcggcggtatgaccgccagtttcttcggcggatggttaggcgatactctgggccggatcaaggcaatgctcgttgccaatatcttgtctctcgtcggcgcactactcatgggctttagcaagctgggccccagccacattttaattatagcagggaggtccataagcgggttgtactgcgggctgatttcaggtctggtgccaatgtacattggcgagatcgcacccacagccctgaggggagccctgggcactttccaccagctagctattgtgacaggcattctgatatctcagatcatcggtctggaattcattctgggcaattacgacttatggcacattttgcttggactgtccggagtgcgggcaatacttcaatcactgctgctttttttctgccctgaatcaccaaggtatttgtatattaaactggatgaggaagtcaaggccaagcagtctctgaaacgcctgaggggctacgatgacgtgactaaggacatcaatgaaatgcgtaaggagcgagaggaggcctcatctgagcaaaaggtgtctattatccaacttttcactaatagcagttataggcagccaatcctggttgctctgatgctgcatgttgcccagcaattcagtgggataaacggcattttctattacagcacctccatattccagaccgctggcatctccaaaccagtttacgccactattggtgttggcgccgtcaacatggtattcaccgccgtatcagtgtttctggtcgagaaagcaggaaggcgttccctgtttctgatcggcatgtcaggcatgttcgtgtgcgccatcttcatgagcgtgggtctggttctcttgaacaaattcagctggatgagctatgtgtccatgatagctatatttctgttcgtgagtttcttcgaaattggccctggacctattccctggtttatggtggcagagtttttttcacagggtccccggcctgcagcccttgcaattgcagcattctctaactggacatgtaatttcattgtcgcactgtgtttccagtacatagccgatttttgtggcccatacgtttttttcctgtttgctggcgttctcttggcctttaccctgtttacttttttcaaagtgccggaaacaaaggggaaaagcttcgaagaaattgcagctgagttccagaaaaagtctggctctgcccatcgtcctaaagcagctgttgagatgaagtttctgggcgccactgaaactgtc

SEQ ID NO: 19418 - DNA, 1572 bp, Artificial Sequence
  Description of Artificial Sequence: Synthetic coding sequence
atgactgaagataaggttactgggacccttgtgttcaccgtgatcactgcagtgctcggttcgtttcagtttgggtacgacattggagtgatcaatgcgccgcagcaagtgatcatctcccactacagacacgtgctcggcgtcccactcgatgaccgaaaggccatcaacaattacgtgatcaattccactgacgaactgccgaccattagctacagcatgaaccctaagccaactccatgggctgaggaggaaaccgttgccgcggcccaattgattactatgctgtggtcgctctccgtgagctcctttgccgtgggaggcatgaccgctagcttcttcggcggatggctgggagacaccttgggcaggataaaggccatgttggtggcgaatattctctcactcgtcggcgccctgctgatgggattcagcaagctcggcccatcgcatattctgatcatcgcaggaagatccatctccggactctactgcggactgatctcgggactcgtgccaatgtatatcggcgagatcgcccccaccgcccttagaggagccctggggactttccatcaactggcaatcgtgactggaattctcatctcacaaatcattggcctcgaattcatcctcggaaactacgacctgtggcacatcctcctgggattgtccggagtgagagccatcctccagtcgttgctgctgttcttctgcccggaatcaccaaggtacctgtacatcaaacttgacgaagaggtcaaggcgaagcaatcactgaagcgcttgcgcggatacgacgacgtgactaaggacattaatgagatgagaaaggaacgcgaggaagcgagctcggaacagaaggtgtcgatcatccagctgttcactaactcctcctaccgccaaccaatcctggtggccttgatgctgcatgtcgcccaacaattctcggggatcaatgggatcttctactacagcacctccatttttcagaccgccggaattagcaagcctgtgtacgcgaccatcggagtgggagccgtgaatatggtgttcaccgctgtgtcggtgttcctggtcgagaaagccggacgtcgcagtctttttcttattggaatgtccggtatgttcgtgtgcgccatcttcatgtcggtggggctcgttctgctgaacaagttctcctggatgagctacgtgtcaatgatcgcgatcttcctcttcgtgagcttttttgagatcggcccggggccaatcccgtggttcatggtggctgagttctttagccaaggccctcggcctgcagcgctggctatcgcagcattctcgaactggacctgcaacttcatcgttgcattgtgcttccagtatatcgctgatttttgtggaccttacgtcttttttctcttcgccggggtgctgctggctttcaccctgttcactttcttcaaggtgccagagactaagggtaaatcgttcgaagaaatcgcagcggaattccagaagaagtcgggatcggctcatcgcccgaaggcagccgtggagatgaagttcctgggcgccaccgagactgtg

SEQ ID NO: 19419 - DNA, 1572 bp, Artificial Sequence
  Description of Artificial Sequence: Synthetic coding sequence
atgaccgaggacaaggtgaccggtacactagttttcacggtcatcaccgccgtgctgggcagcttccagttcggctatgacataggagttattaacgcccctcagcaagtgatcatatcccattatcgccacgtactcggtgtacctctagatgatagaaaagctatcaataattatgttatcaacagcacagacgagttaccaaccatctcttacagtatgaatccaaagcctacaccttgggctgaggaggaaacagtggctgccgctcagctgatcaccatgctctggtccctttctgtcagctccttcgcagtgggcgggatgaccgcttcgttctttggcggctggttaggagacaccctcggaaggatcaaggctatgctggtggcaaacatcttatccctggtgggggctctgttaatgggattcagtaagttagggccgtctcatattctcatcattgcaggccgaagtataagcggcctgtactgtggtctgattagtggactagtgcctatgtacataggcgagattgctcccaccgcactaagaggagcccttggaactttccatcagctggcgatcgtcacaggaattctcatcagccagattattgggctggaattcattctcggcaattatgatctttggcacattctattgggtctgtctggtgttagggccattctccagagccttctgctcttcttctgtcctgaatcccccaggtatttgtatatcaagctggacgaagaagtcaaggctaagcagtccctgaagagactcagagggtacgatgatgttactaaggacatcaacgagatgcgcaaggagagggaggaagctagtagcgaacaaaaggtatcgattattcagctgtttacgaactctagctacaggcaaccaattctggtcgctctgatgttgcatgtggcccaacagttcagtggcatcaacggaatcttctattatagcacctctatatttcaaaccgcaggcatctctaagccagtgtacgccacgatcggcgtcggggccgtgaatatggtgtttacagctgtctctgtgtttctggtcgagaaggccgggaggcgatccttgttccttataggtatgtcgggtatgtttgtatgcgctatctttatgagcgtagggctcgtgctgttaaacaagttttcatggatgtcctacgtcagcatgattgcgatctttcttttcgtttcctttttcgaaatcggtccgggccccattccctggttcatggtggcagagttcttctcacagggccccagacctgctgcacttgcgattgccgctttttccaattggacatgcaatttcatcgtggcgttgtgctttcagtatatcgctgacttctgtggcccgtacgtcttttttctgtttgcaggtgtgctcctggcatttactctgttcaccttcttcaaagtgccagagaccaaaggaaaatccttcgaagagatcgcagcagagtttcagaaaaagagtggctcagcacaccgacctaaggcagctgtggagatgaagtttctgggcgccacagagacagtt

SEQ ID NO: 19420 - DNA, 1572 bp, Artificial Sequence
  Description of Artificial Sequence: Synthetic coding sequence
atgaccgaggataaggtgactggcaccctggtgtttaccgtcattactgcagtgttgggttcctttcagtttggttacgatataggtgtgattaacgcaccacagcaagtgattatctcccactaccggcatgtgcttggtgtccctctggatgatcggaaagccatcaacaattacgtgataaacagcaccgatgagctgccgactatttcgtactcaatgaatccaaagccaacgccgtgggcggaagaggaaaccgtggccgccgcacagctgattactatgctttggtctttgagtgtctcctcctttgcagtcgggggcatgactgcgagcttctttgggggatggctgggagacaccctcggacgaatcaaggcaatgcttgtggcaaacatacttagcctggtgggtgctcttctgatgggttttagcaagctcggaccttcccatattctgattattgcaggacgtagcatcagcggactgtattgtggtctgatttcggggttggtgcccatgtacattggtgaaatcgcgcccacggcgctgcggggtgctcttggcacttttcaccaacttgccatcgtgaccgggattcttatctcgcaaatcatcggactggaattcattctcggaaattacgacttgtggcatatccttcttggtctgtccggggtgcgggcgatacttcaaagcctgttgcttttcttttgtcctgaatccccaagatatctgtacataaagctggacgaggaggtgaaagcgaagcagtcgctcaagcggcttcgaggatacgatgatgtgactaaagatatcaatgaaatgcggaaagaaagggaagaagcgagctcggaacagaaggtgagcattattcagttgttcaccaattcgagctacagacaaccaattcttgtcgctctcatgttgcatgtggcacaacaattttccggcattaacggaattttctactactccactagcatattccagaccgcaggcatctcgaagcctgtgtacgcaactatcggcgtgggagcagtgaacatggtgttcaccgcagtgtccgtttttcttgtggagaaagctggacggcgttcattgttccttattgggatgtcaggaatgtttgtgtgcgccattttcatgagcgttggactggttctcctgaacaagtttagctggatgtcttacgtctcgatgatcgcaatcttcttgttcgtctcttttttcgaaatcggacccggcccaatcccttggtttatggtagcagagtttttcagccaaggaccccggccagcagcccttgccattgccgccttttcgaactggacctgtaatttcattgtggcactttgtttccagtatatagcagacttttgcggtccctacgtgttttttcttttcgccggtgtgctgctcgcatttaccctctttaccttctttaaggtcccagaaaccaagggaaaatcattcgaggagatcgccgcagaatttcagaagaaatcaggttccgcacatcgtcctaaggcagcagtggagatgaaatttcttggtgcgactgaaactgtg

SEQ ID NO: 19421 - DNA, 1572 bp, Artificial Sequence
  Description of Artificial Sequence: Synthetic coding sequence
atgaccgaagataaggtgaccggtaccctggtgttcaccgtcattactgcagtgctgggttccttccagtttggctacgacattggcgtgatcaacgcaccacagcaggtgatcatcagtcactatagacacgtgttgggtgtgcccctggatgacaggaaagcaataaacaattacgtgatcaattctactgatgagctgccaacaatttcttactcaatgaaccctaaacctacgccttgggccgaggaagaaaccgtggccgctgcacagcttattactatgctgtggtcccttagcgtcagctcttttgcagtgggcggtatgaccgctagttttttcggaggatggctcggtgacacccttggaaggataaaggctatgctggtggcaaacatcttgtcccttgttggtgccctgcttatggggttctcaaaattagggcccagtcacatcctcatcattgcgggcagatcaattagtggactgtattgcggactgatttccgggctcgttccaatgtacatcggcgaaatcgcgccaaccgctctgcgtggtgctctgggcacttttcatcagctagcgatagttacaggcatcttgatttcgcagatcatcggcctggagtttatcctgggaaactatgacttgtggcatatcctgctgggcctgtccggcgttcgcgccattctgcagagcctcctcctgtttttttgtccggaatcacccagatacctgtatatcaaactggacgaagaggtgaaggcgaagcagagccttaaaagactgagagggtacgacgacgtcaccaaagacatcaacgaaatgaggaaggagcgggaggaagcttcatccgagcagaaagtcagcataatccagctgttcacaaacagcagctaccggcagcctatcttggtggccctcatgctccacgtcgcccagcagttctctgggatcaacggtatcttttattactcaacctcaatatttcagacagccggcatctccaagcctgtctacgccactataggcgtcggcgccgtgaatatggtgtttaccgcggtcagcgtatttctggtcgagaaggccggccgccgttctttgttcctcatcgggatgagtggcatgttcgtttgtgccatcttcatgagcgtaggactcgtgctcctgaacaagttcagctggatgagctacgtgtccatgatagctattttcttattcgtaagcttttttgagattggacctgggcccattccgtggtttatggtggctgagttcttctctcaaggacctcgccctgccgctctggcaatcgctgcgtttagcaactggacctgtaacttcattgtagccctatgctttcagtatatcgccgacttctgcgggccttacgtattcttcctgttcgccggcgtcttgctggcttttaccttgtttacattcttcaaagttcctgaaaccaagggcaaaagtttcgaggagatcgccgccgaatttcaaaaaaagagcggaagtgcccatcgacccaaagccgcagtggaaatgaagttcttaggcgctactgaaacggta

SEQ ID NO: 19422 - DNA, 1572 bp, Artificial Sequence
  Description of Artificial Sequence: Synthetic coding sequence
atgacggaagataaggttaccggcaccctcgtgtttacggtgatcacagcggtccttggaagcttccagttcggctacgacattggcgtgatcaatgccccgcaacaggtcattatctcccactacaggcacgtgttgggtgtgccactggatgaccgaaaagccatcaacaattacgtcattaattcgactgatgaactgccaacgatcagctattcgatgaatcccaagcccacgccttgggccgaggaggagacggtggctgcagcgcaactgattacaatgctgtggtcgctgtctgtgagcagctttgcggtgggtggtatgacggcatccttcttcgggggctggctaggagatacactgggccgtattaaggccatgctggtcgccaacatcctttcgctggtcggagctttgctcatgggtttttcaaaattggggcccagtcacatactaatcattgccggccggtccatcagcggcctgtactgcggtctaatctcgggtctcgtcccaatgtatatcggtgaaatagcacctactgccctgcgcggagcgttaggcacgtttcatcagctggccatcgtcacaggcatcttgattagtcaaataatcggacttgagttcatactggggaactatgacctctggcacatattattggggctctccggagttcgggcaatcctgcagagtctgctgctgtttttctgcccagagtccccgagatacctgtacatcaaactcgatgaggaagttaaggcaaagcagtctctgaagcggctgcgggggtatgacgatgttaccaaggatataaacgagatgaggaaggagcgggaagaggcctcttcggaacaaaaggtttccataattcagctctttacgaattcctcttaccgccagccgattttggtggccctgatgctccacgtggcgcagcagttctcgggcatcaatggtatattttactacagcacgagcatcttccagacagccggcatttcgaagccggtgtacgccacgatcggtgtaggagccgtgaacatggtgttcacggccgtgagcgtgttcctggtagaaaaggcgggccgcagatcgctgtttcttatcggcatgtctggcatgtttgtttgtgcgatattcatgtccgtgggactggtgttgctaaataagttcagttggatgagctacgtgtcgatgatcgctattttcctgttcgtgagctttttcgaaattggacccggtccgatcccgtggtttatggttgccgaattcttcagtcaaggccctcgtccagccgcgttggcgatagcagctttttccaactggacgtgcaatttcattgtggcactatgttttcaatatattgccgatttctgcggcccgtacgtattcttcctgtttgccggcgtgctactggcattcactctgttcacgttctttaaggtcccggagacgaagggcaagtcttttgaagagattgccgccgagttccagaagaaatccggaagcgcgcacaggcctaaggcagctgtggagatgaagtttttgggggccacggagaccgtg

SEQ ID NO: 19423 - DNA, 1572 bp, Artificial Sequence
  Description of Artificial Sequence: Synthetic coding sequence
atgaccgaggacaaggtcaccgggacgctcgtgttcaccgtgattactgcagtgctgggaagttttcaatttggatacgatattggcgtcataaacgcaccacagcaggtgatcataagccactacagacatgtgcttggcgtgccactggacgataggaaagcaattaacaattatgtcattaactcaaccgacgagctccctactatttcgtacagcatgaaccccaagcctactccctgggcggaagaagagactgtcgcagcggcccagctcattactatgctctggtccctttcagtgtcctcatttgccgtcggtggaatgactgcgagcttctttggtgggtggcttggcgataccttgggaagaattaaggcaatgcttgtcgccaacatcctgtccctcgtgggggcgcttctgatggggttttcgaaactgggcccctcccacattctcataattgcgggtagatccatttccggcctctactgcggacttattagcgggctggtccctatgtatattggcgagatcgcacctaccgcactcagaggagccttgggaacctttcatcaattggcaatcgtgactggaatccttatttcccagattattggcctggagttcatccttggtaactacgatctttggcatattcttctcggactttcaggagtgcgtgcaattctgcaatccctgcttcttttcttctgccctgaatcgccccgttatctctacatcaaattggatgaagaagtcaaggccaagcaatcgctgaagaggcttaggggatacgacgacgtgaccaaggacattaacgaaatgcggaaggaacgagaagaggcctccagcgagcaaaaggtgtcaatcattcagttgtttaccaactcatcgtacagacaaccaatcctggttgcattgatgctgcatgtggctcagcaattttccggtattaacggaatcttctactactcgacttccatatttcaaaccgcggggatctccaagcctgtctacgcgacgatcggcgtgggagcggtgaacatggtgtttaccgcagtgtcggtctttcttgttgagaaagccgggagaagatcactgttcctgattggcatgtcagggatgttcgtgtgcgcaattttcatgtccgtgggactcgttcttctcaacaaattcagctggatgagctacgtgtccatgattgcaattttcctgttcgtttcgttcttcgaaattggtcctgggcctataccgtggttcatggtggcagaattcttcagccaaggacctcgccctgcagcactggctatcgcagcattttcgaactggacctgtaactttattgtggccctgtgttttcaatacattgcggatttctgtgggccttacgtgtttttcctttttgccggggtgctgctggcatttaccctgtttaccttctttaaggtcccagaaactaaaggaaagtccttcgaagaaattgcagccgaatttcaaaagaagtcgggttcggcacacagaccaaaggcagccgtggagatgaagtttcttggagcgactgaaactgtc

SEQ ID NO: 19424 - DNA, 1572 bp, Artificial Sequence
  Description of Artificial Sequence: Synthetic coding sequence
atgactgaagacaaggtcactggtaccctcgtgttcactgtaataactgcagtcctggggtcttttcaattcggctacgatatcggggtcataaacgctccccagcaggttataattagccattaccgacacgtgttaggagtccccttggacgataggaaagcgattaataactatgtgataaattcaaccgacgagttgcctactatttcttattctatgaacccgaagcccactccctgggcggaggaagagacagtggccgctgcacaactgatcactatgctctggagcttgagcgtatctagcttcgctgtaggggggatgacagccagctttttcggtggttggttgggcgacaccctcgggagaattaaagcaatgctggtcgccaacatcctaagcttggttggcgctcttctgatgggctttagcaaactgggcccttcacacatcctcatcattgctgggaggtcaatctcaggcctctattgtggcctgatatcaggccttgtgcctatgtatataggggaaattgcacccactgcgctgcgcggagccctcggcacgtttcatcagttggccatcgtgacaggcattctcatctcccagattattggcctggaatttatcctgggaaactacgacctgtggcacattttgttaggcttatcgggggtgcgagctattttgcaaagcctgctcttatttttctgccctgaatcacccagatatctgtacatcaagctggacgaggaagtgaaggctaagcagagcctgaagaggttacgcggatatgatgatgtgactaaggacatcaatgaaatgcgcaaggaacgcgaggaagcaagctctgaacagaaagtctctatcattcagctcttcacgaactcatcataccgacagcctattctggtagcattaatgctgcatgtagcacagcagttttctggaattaatggaattttttactattcgaccagcattttccagacggcaggaatctccaagcccgtctacgcgaccatcggagttggggcagtgaacatggtcttcacagctgtgagtgtattcctggtcgagaaggctggtaggaggtccttgttccttattggaatgtctggtatgtttgtatgcgctatctttatgtcggtgggcctcgtactgttgaacaagtttagttggatgagctatgtgtctatgatcgcgatcttcctgttcgtcagcttcttcgagattggtccaggacctataccttggttcatggtggccgaattcttcagccagggacctaggcctgctgccctggctattgccgctttctctaattggacttgcaactttatagtggccctgtgcttccagtacatcgccgacttttgtggaccatacgtgttctttcttttcgcgggggtattgctggcgtttacattgtttaccttctttaaggtgcctgaaactaagggtaagtcctttgaggagatcgctgccgaattccaaaagaaaagcggctctgcgcaccggcccaaggcagccgtcgagatgaagttccttggggctaccgagacagta

SEQ ID NO: 19425 - DNA, 1572 bp, Artificial Sequence
  Description of Artificial Sequence: Synthetic coding sequence
atgacggaggacaaagtgacaggtacgctggtatttaccgtgattactgctgttctgggaagcttccaattcggctacgacattggggtgataaatgcacctcagcaggtaattatcagtcactataggcacgtgctgggggtgccgctggacgatcgcaaggcaattaacaactatgtgattaatagtaccgatgaactgccaactatttcttacagcatgaacccgaaaccaacgccctgggccgaagaggagacagtcgctgccgctcaactgatcaccatgctttggtccctcagcgtctctagcttcgcggtgggcgggatgaccgcgtccttcttcggcggctggctaggtgatacgttagggagaattaaggcaatgctggtggccaatatccttagtctggtcggggcacttttgatgggcttcagcaaactgggacctagtcacatcctgataattgcgggacggagcatcagtggattatactgtgggctcatttctggcctagtgcccatgtatatcggagagatcgccccaacagcattgcggggcgctctcggcacctttcaccagctcgcgatcgtaactggcatcctgatttcccagatcatcggcttagaattcatcctcgggaattatgacctttggcacattctgctgggtctttctggggtgcgcgccatactgcagagtcttctactgttcttctgtcccgagagcccaaggtatctatatatcaaactggacgaagaggtcaaagctaagcagtccctgaaaaggttacgtggttacgatgacgtgactaaagacataaacgaaatgcgcaaggaacgggaagaggcttcatccgagcagaaggtgtctatcattcagttgttcacaaactcctcttacagacagccaattctagtcgccctgatgctgcacgtggctcagcagttctcaggcattaacggaattttctactattccactagtatattccagaccgctggcatatcgaagcctgtctatgccaccatcggggtgggtgctgttaatatggtctttacggccgtttccgttttcttagtcgaaaaagccggtagacggtctctcttcctgattggcatgagcggcatgttcgtgtgcgcgatctttatgtctgtgggcttggtcttgctcaacaagttcagctggatgagctacgtttccatgatcgcgatattcctgttcgtcagcttttttgagatcggcccagggccgatcccgtggttcatggtcgctgagtttttctcccagggccctagacctgccgccctggcaattgccgctttttcgaactggacctgtaactttattgtcgcactgtgtttccagtatattgctgatttttgcggaccttacgtgttcttcttgttcgcgggggttctgcttgccttcacactgtttacctttttcaaggtgcccgagaccaagggtaaatccttcgaggagattgctgcggagttccaaaagaagtccgggagtgcccatcgacctaaagctgcagtggaaatgaagttcctgggagctacagaaacagtg

SEQ ID NO: 19426 - DNA, 1572 bp, Artificial Sequence
  Description of Artificial Sequence: Synthetic coding sequence
atgaccgaagataaggtcaccgggactctggtgttcacggtgattactgctgtgctcgggtcgtttcaattcggttacgatatcggagtcatcaacgcgccccaacaagtgatcatttcccactacagacatgtcctgggagtgccactggacgatcggaaagccataaacaactacgtcatcaattccacggatgaacttcctactatctcgtattcaatgaatcctaaaccaaccccctgggcggaagaagaaaccgtggctgcagcacagctgataactatgctttggtcgttgtccgtgtcctcgtttgcagtgggagggatgaccgcatcattctttggcggatggctgggggatacgctggggagaatcaaggcgatgctcgtggcaaacatcctgtccctggtgggtgctcttctgatgggtttttccaaactcggtccgtcacacatattgattatagcaggccggagcatctctggtctttactgcggccttattagcggcctcgtgccaatgtacatcggagaaattgcgcctaccgcactgcgaggtgcacttggtacctttcatcagcttgccattgtgaccggtatcctgatttcccagattattggactggaattcattttggggaactacgacctttggcacattctgctgggcctgtcaggggttagggctattttgcaatcccttctgctcttcttctgtcctgaaagccctcgttacctgtacattaagctggatgaggaagtgaaggcgaaacagtccctgaagaggctgagaggttatgatgacgtgactaaagacattaatgaaatgcggaaggaaagagaagaagcatcctccgaacaaaaggtgtccattatccaactttttaccaattcttcgtataggcagccaatcttggtggccctgatgctccatgtcgcccaacaattttccggcataaatgggattttctactactcgacctcaattttccaaaccgccggaatttctaaacccgtgtacgcaaccatcggggtcggtgcagttaacatggtgtttactgcggtgagcgtgttcttggtcgaaaaggcaggacggcgcagcctgtttcttattggtatgtcgggtatgtttgtgtgtgccatctttatgtccgtgggcctggtcctgcttaacaagttttcctggatgagctacgtgtctatgattgcaatcttcctttttgtgtccttttttgaaataggacctggacctatcccctggtttatggtggccgaattcttttcccaagggccacggccggccgcccttgctattgcggcattcagcaactggacctgcaactttattgtggcgctttgttttcagtacatcgcagacttctgcggtccttacgtgttctttcttttcgcaggtgttctgttggctttcaccctttttaccttctttaaagtgccagagactaaggggaagtcgtttgaggagatcgccgccgagtttcaaaagaagtcaggatcggcacatcggccgaaagcagcagtggaaatgaagtttcttggcgcaactgaaactgtt

SEQ ID NO: 19427 - DNA, 1572 bp, Artificial Sequence
  Description of Artificial Sequence: Synthetic coding sequence
atgaccgaggacaaggtgaccggcaccctggtctttactgtcatcaccgcagtcctggggtcgtttcagttcggctacgatatcggagtcatcaacgctccgcaacaggtgatcatctcgcattacaggcatgtgctgggcgtgccactggacgataggaaagccatcaataactacgtgatcaattccactgacgagttgccaaccatctcctactcgatgaacccgaaaccgactccttgggcagaagaggagactgtcgctgcagctcaactgattaccatgctttggtcgctcagcgtctcctcgttcgccgtgggaggcatgactgcctccttcttcggtggatggctgggagataccctggggagaatcaaggcaatgctcgtggcgaacatccttagcctggtgggagcgctgttgatgggtttctcgaagctcgggccatcacacatcctgatcattgcaggccgctctatctcaggactctactgcggcctgatcagcgggctggtgcccatgtatatcggagaaatcgcccccactgccctgcggggagccctgggaaccttccaccaactggccatcgtgaccgggatcctgatctcgcagatcattggactcgaattcattttgggcaattacgatctgtggcatattctcctcgggctctcaggcgttcgcgctattcttcagtcgctcctcctctttttctgtccggaatccccacgctacttgtacatcaagctcgacgaagaggtcaaagccaagcaaagtctgaagagactgcggggatacgatgacgtgacgaaggacatcaacgaaatgagaaaggagcgggaggaagccagctcagaacaaaaggttagcattatccagctgttcacgaacagcagctaccgccagccgatcctggtggcgctgatgttgcacgtggcccagcagttctccggaatcaacggaatcttctactactcaacctcgatcttccagaccgcgggaatctcaaaaccggtgtacgcgactattggagtgggagccgtgaacatggtgttcactgccgtgagcgttttcctggtggaaaaagcaggtcggcgttctctcttcctgatcggaatgtccggcatgttcgtctgcgcaatctttatgtccgtgggacttgtgttgctcaataagttttcatggatgtcatacgtgtccatgatcgccatcttcctcttcgtgtcgtttttcgagatcggtcctggcccgattccctggtttatggtcgcggaatttttctcgcagggtccacgccctgcagcccttgccatcgccgcgttctccaactggacctgtaatttcatcgtcgctctgtgcttccaatacatagctgacttctgcggcccttatgtgttcttcctgttcgctggtgtactgctggcctttactctcttcactttcttcaaggtcccggaaactaagggaaaatcctttgaagagatcgcggcggagtttcagaagaagtcgggaagcgcacaccgaccgaaggctgcggtcgagatgaaatttcttggagcgacggaaaccgtg

SEQ ID NO: 19428 - DNA, 1572 bp, Artificial Sequence
  Description of Artificial Sequence: Synthetic coding sequence
atgaccgaggacaaggtgaccggcacgctggtcttcactgtgattaccgctgtactgggcagcttccagtttggctatgacattggagtcattaacgctcctcagcaggtgataatttcccactatcggcatgtcctgggcgtcccactggacgataggaaggccataaacaattacgtgataaatagtacagacgagctcccaacaatctcttattccatgaaccccaagcctaccccttgggcagaggaggaaactgtggctgcagctcaactaataaccatgctgtggagccttagtgtttcatccttcgccgtgggcggtatgacagcaagcttctttggcggctggttaggcgatactctggggcggataaaagctatgctggtggccaatattctgtccttggtcggcgcgctgttgatggggttctccaagctcggcccaagtcacatcctgattatcgccgggaggtctatctcagggctatattgcgggttaatttctggcctggtaccgatgtacatcggcgaaattgctccaacggcactgcgtggagcccttgggacttttcatcagctggcaattgtaaccggtatcctgataagccaaatcattgggcttgaattcatcctgggaaactatgacttgtggcatatcctgttaggacttagtggggtccgtgccatcctgcaatccttgctgctatttttctgccctgaatctccacgctacctgtacattaagctcgatgaagaggttaaagccaagcagagccttaaacggttgagaggctacgatgacgttacaaaagacataaacgaaatgagaaaggagagagaggaggccagctccgagcagaaggtttctattattcaacttttcaccaacagtagctaccgccagcccatcctggttgctctcatgctgcatgtggcccagcagttctcagggattaatggtattttctactattccactagcattttccaaacagccggaatctcaaagcccgtgtacgctactattggggttggcgcagtaaatatggtcttcaccgcagttagcgttttcctggtggaaaaggcaggccggcggtccctgttcctgattggaatgtctgggatgttcgtgtgcgccatcttcatgagcgtgggcctggtgttgcttaacaagttctcttggatgtcttacgtgagtatgatagctattttcctgtttgttagtttctttgaaatagggccggggccaattccgtggtttatggtggctgaatttttcagtcagggaccaagacctgccgccctcgcgatcgccgccttctcaaattggacgtgtaacttcatcgtggctctgtgtttccaatacattgctgacttctgtggaccatatgtcttctttctatttgcgggggtgttgctggctttcaccctttttaccttttttaaggtgccagagacaaagggcaaaagttttgaagaaatcgctgctgaattccagaaaaagtctggtagcgcccaccggcctaaagccgctgtagagatgaaatttctgggtgcaacagaaactgtg

SEQ ID NO: 19429 - DNA, 1572 bp, Artificial Sequence
  Description of Artificial Sequence: Synthetic coding sequence
atgaccgaggataaggtgaccggaactcttgtctttactgtgatcactgctgtgctcggatcattccaattcggctacgatatcggagtgatcaatgccccacaacaggtcatcatttcgcactatcgccatgtcctgggagtcccgctcgatgatcggaaagctataaacaactacgtcatcaactcaaccgatgagctgccgactatcagctactcgatgaacccgaaaccgaccccttgggcagaggaggagactgttgcagcggcccagctgatcaccatgctctggagcctctcggtgtcctccttcgctgtggggggaatgactgcctcattctttggtggatggctgggcgacactctgggacggattaaggcaatgctggtggctaacatcctgtcgctggtgggcgccctgctgatgggtttcagcaagctggggccctcacatatcctgatcatcgccggccgctccatttccggattgtattgcggactgatctcaggactcgtgccgatgtatataggcgaaattgccccaactgcccttcgaggggctctgggcacttttcaccaactggctattgtcacgggaattctgatcagtcaaatcatcggacttgagtttattctgggcaattacgacctgtggcatatcctgctgggactgtccggcgtgagggcgatcctccagtcgctgctgcttttcttctgtcccgaaagcccccggtacctctacattaagttggacgaggaggttaaagctaagcagtcgctcaaaagactgcgcggatacgacgacgtgaccaaagacataaacgaaatgaggaaggaacgcgaggaagcctcgagcgaacaaaaggtcagcataatccagctgtttaccaatagctcctacagacagccgatcctggtggcactgatgctgcacgtggcccagcagttctccggaatcaacggtatcttctactactccacgtccatcttccagaccgccggtatttccaaacctgtgtacgccacgatcggcgtcggagctgtgaacatggtgtttacggctgtgtcggtctttctggtggagaaggcaggccgcagatcactgttcttgatcggcatgtccgggatgttcgtgtgtgccatcttcatgtcggtcggccttgtattgctcaacaagttctcgtggatgtcgtacgtgagcatgatcgccatctttcttttcgtgagttttttcgaaatcggaccgggacctatcccgtggttcatggtggccgaattcttttcccagggaccaaggccagcggcgctcgccattgcggcattcagcaattggacctgcaacttcatcgtcgccctttgtttccagtacatcgccgacttctgcggaccatacgtattctttctcttcgcaggcgtgctgcttgccttcaccctgttcacttttttcaaggtgccagaaaccaagggtaaatcatttgaagagatcgcggcggaattccaaaagaagtcaggatccgcgcaccgaccgaaggcagctgtcgaaatgaagttcctgggtgctacggaaacggtg

SEQ ID NO: 19430 - DNA, 1572 bp, Artificial Sequence
  Description of Artificial Sequence: Synthetic coding sequence
atgactgaggacaaagtcactggaactctggtattcactgtcatcactgcagtcctcggatcgttccagttcgggtacgatatcggagtgatcaatgcgccgcaacaggtgatcatctcccattacagacacgtcctgggagtgccgctggacgaccggaaggccatcaacaactacgtgatcaactcgaccgatgagctgcctaccatatcgtactccatgaaccctaaaccgaccccttgggccgaggaggaaaccgtggccgcggcccaactgatcacgatgctctggtcactcagcgtctcatccttcgccgtgggaggaatgaccgcttccttcttcgggggctggttgggagatactctcggacggatcaaagccatgctggtggcaaatatcctgtcactcgtcggagccctgctcatggggttctcaaagctcggcccctcgcatatcctgatcatcgcggggagatccatctccggcctgtactgtggactcatcagcggcctggtgccgatgtatattggcgaaatcgcaccgaccgcactgcgaggagcactgggcacttttcatcaactcgcaatcgtgacgggaatcttgatctcgcaaatcatagggttggaattcatcttgggaaattacgatctttggcatatcctgcttgggctctccggagtgcgcgccatcctgcagagcctccttctcttcttctgcccagagtcaccacgctacctctatatcaagctggatgaggaagtgaaggccaagcagagcctgaagcgactgcgcgggtacgacgacgtgactaaggacatcaacgaaatgcgcaaagaacgcgaagaagcgagctccgaacaaaaggtttcgattatccagctgtttaccaattcctcataccggcaaccaatcctggtggccctgatgcttcacgtggcgcagcaattctcaggaattaacggaatcttctactactccacctccatcttccaaaccgcggggatctcgaagccagtgtacgcgactatcggagtgggagctgtgaacatggtgtttaccgcggtgtccgtattcctggtggaaaaagcaggcaggcgctccctcttcctgatcggaatgtcaggaatgttcgtgtgcgccatcttcatgtcggtcggtttggtgctgctgaataagttctcatggatgagctacgtgtcgatgatcgccattttcctcttcgtgagctttttcgagatcggtccaggcccaatcccctggttcatggttgccgagttcttttcgcaaggccctcgaccggctgctctggcgattgcagcattctcaaattggacgtgtaacttcatcgtcgcgctgtgcttccagtacatcgcagatttttgcgggccctatgtgttcttcctctttgccggtgtgctgctggccttcaccctgtttaccttctttaaagtgccggaaacgaaagggaagtctttcgaggagattgccgcggaatttcagaagaagtcggggtccgcgcaccggccgaaggctgcagtggagatgaagttcctgggcgcaaccgagactgtg

SEQ ID NO: 19431 - DNA, 1572 bp, Artificial Sequence
  Description of Artificial Sequence: Synthetic coding sequence
atgaccgaagataaggtcactggaactctcgtgttcaccgtcatcactgccgttctcgggtcatttcaatttggctacgacatcggagtaatcaacgcaccgcaacaggtgatcatttcgcattacagacacgtcctcggcgttccgctggacgaccgcaaagccatcaataactacgtcatcaattctaccgatgaattgcccaccatctcatacagtatgaacccaaagccgactccatgggccgaagaggaaaccgtggctgccgcacagttgatcacgatgctgtggtccctgtcggtgagctcgttcgccgtgggaggaatgactgcgagtttcttcggggggtggctcggagacaccctgggaagaattaaggccatgcttgtggcgaacattctgtccctggtcggagccctcctgatgggtttttccaagctgggtccatcacacatcctgatcatcgcgggacgctcgatctcgggcctgtactgcggattgatctccggactggtgcccatgtatatcggcgaaatcgcccctacggcactccggggtgctctgggaactttccatcagctggcgatcgtgacgggcattttgatctcgcagatcattgggctggagttcatcctgggtaactacgatctgtggcacattctgctgggactgtcgggagtgcgtgctattttgcagtcgttgctcctgttcttttgccctgagagcccacggtacctctacattaagctggatgaagaagtcaaggctaagcagtccctgaaacggcttcggggttacgacgatgttactaaagacatcaatgagatgcgcaaggagcgcgaagaagcctcgtccgagcaaaaggtatcgatcatccagctttttactaacagctcatataggcaacctatccttgtcgccttgatgttgcatgtggctcagcagttctcgggaatcaacggtatcttctactactctacctccatctttcaaactgccggcatttcaaaaccggtgtacgcgaccatcggcgtgggggcagtgaatatggtgttcactgccgtgtctgtgttcctggtcgagaaggccggaaggcgcagcttgtttcttatcggaatgtccggaatgttcgtgtgcgcgatattcatgtccgttggactggtgcttctcaataagttttcctggatgtcgtacgtgagcatgatagctatcttccttttcgtgagcttcttcgaaataggccctggaccgatcccgtggttcatggtcgcggagttcttctcacaaggcccacgaccggcagccctggcgattgccgcgttttccaactggacctgtaactttatcgtggctctgtgcttccaatacatcgccgacttctgtggaccatacgtctttttcctgttcgcaggagtgcttctggcgttcaccctcttcacctttttcaaagtaccggaaaccaaggggaagtcttttgaagagatcgcagccgaattccagaaaaagtccggtagcgcacacagacccaaagccgccgtcgagatgaagttcctcggcgcaactgagactgtg

SEQ ID NO: 19432 - DNA, 1572 bp, Artificial Sequence
  Description of Artificial Sequence: Synthetic coding sequence
atgaccgaggataaagtcacggggacgctcgtgttcacggtgatcacggctgtgctggggtcattccagtttgggtatgatattggggttattaatgccccgcagcaggtgataatatcccactatcggcacgtgctgggagttccgctcgacgataggaaagccattaataactatgtgatcaatagcaccgacgaactaccgaccatatcttattctatgaatcctaaacctactccgtgggctgaagaggagactgtggccgcagcccagcttattaccatgctttggtccttatccgtcagcagcttcgctgtgggaggaatgaccgcgtctttttttggcggttggttaggcgacactctgggcaggattaaggccatgctagtagcaaatatcctctcactggtgggggcattactgatgggattcagcaaactcggccccagtcacatactgatcatagccgggcggtcgatcagtgggctgtactgtggactaatctccggcttagttcctatgtacatcggagagatcgcccctaccgcattacgaggagcactgggcacttttcatcaacttgccattgtgacggggattctgatcagccagatcattggtctggaatttatcctgggcaattatgatctgtggcatatactgctgggcctgagcggtgtgcgcgccatcctgcagtccttactcctgttcttttgccccgagagccctaggtatttgtatattaagctggacgaagaagtgaaagccaagcagtcactgaaaagactgaggggttacgacgacgtcactaaggacataaatgagatgcgaaaagagagagaagaagcatcatcagagcagaaggtgtccatcattcaactctttacgaattcttcttatcgtcagcctattctggtggcgctgatgctacatgtggcccagcagttcagcgggatcaatgggatattctactacagcactagtatattccagacagcaggtatttctaagcccgtatatgcaactattggagtgggtgccgtcaatatggtgtttacagcggtttcagtgtttttagtcgagaaggccggacggagatcattgttcctaatcggcatgagcgggatgtttgtgtgcgccatatttatgtccgtgggcctggtgctgctcaacaagttctcttggatgagctatgtgagcatgatcgccattttcttgttcgtatctttctttgagattgggcccgggcccatcccttggttcatggtggccgagttcttctctcagggtcccagacctgccgccctggccatagcagctttctcgaattggacctgtaacttcatagtggctttatgcttccagtacatcgccgatttttgcgggccatacgtgtttttcctctttgctggtgtactgctggcttttactctattcacatttttcaaggtgccggagacaaaagggaaatctttcgaagaaatcgcagccgaattccagaagaagtcagggtcggcacatcgcccaaaggccgccgtggaaatgaaattcttgggcgccaccgaaactgtt

SEQ ID NO: 19433 - DNA, 1572 bp, Artificial Sequence
  Description of Artificial Sequence: Synthetic coding sequence
atgaccgaagacaaggttaccgggaccctggtgttcaccgtgattacagccgtcctggggtccttccagttcgggtacgacataggagtgattaatgcaccgcagcaggtgataattagtcactatcgccacgtactgggtgtacccctggatgatcgtaaagccatcaacaattacgtcataaattctacagacgagttgccaaccatttcttattcaatgaacccgaaacccactccctgggctgaggaggagacggtagctgctgcgcagctcatcactatgttgtggtccttgtccgtgtccagcttcgctgtcggcgggatgacagcctccttttttggaggatggctcggcgacacactggggaggatcaaagctatgcttgtggcaaatatcttgagcttggtgggggcactcctgatgggattctcaaagctggggcctagccacatcttgattattgctggccgctctatctcaggactgtactgcggcctcatatccgggctagttcctatgtacatcggggagatcgcgcctactgctctgcgcggggccctcggcacatttcaccagctggcaattgtgacgggtatccttatcagtcagatcatcgggctagaatttattttagggaactatgatctctggcacatcctcctaggcctttcaggagtacgcgcaatactccagtcactcttactttttttctgccccgagtccccccggtatctctacatcaaactcgatgaagaggtgaaagccaaacagagcctcaaacggcttcgcggctacgacgatgttactaaggatatcaacgaaatgaggaaggaaagagaggaagcgagcagtgagcagaaggtgtccattatccaactttttacaaacagcagctatagacaacctattcttgtggcgctcatgctccacgtggcccagcagtttagcgggattaatggaatcttttattattccaccagcatattccagaccgcaggtatctccaaaccagtctatgccacaatcggagtaggagccgtgaatatggtatttaccgccgttagcgtgtttctggtggagaaagccgggcgaaggtccctattcctgattgggatgagcgggatgttcgtctgtgcgatcttcatgtcggttgggttggtccttctgaacaagttttcctggatgtcatacgtgagcatgattgctatattcctattcgtgtccttttttgagatcggccctgggcctataccctggtttatggttgctgagttctttagtcagggcccgcggcccgcggcactggcaatagccgctttctcaaactggacctgcaactttatcgtcgccctgtgttttcaatacatcgccgatttctgtggcccatacgtgttcttcctgttcgccggggtcctattggcattcacactttttactttctttaaggttccagaaaccaagggcaaatcttttgaggagattgctgcagagttccagaaaaagtccggttcagcacaccgaccaaaggctgcagtagagatgaagttcctcggggcaaccgagacagtg

SEQ ID NO: 19434 - DNA, 1572 bp, Artificial Sequence
  Description of Artificial Sequence: Synthetic coding sequence
atgaccgaagataaggtcacaggaaccctggtcttcacagtgatcactgctgtccttggcagcttccagtttggctatgatattggcgtcatcaatgccccccagcaggtcatcatttctcattacagacacgttttgggcgtgccactcgacgacaggaaggccataaacaattacgtcattaatagcaccgacgagctgccaaccattagttattcaatgaatccaaaacccactccttgggccgaagaggagaccgtagccgctgcccagctgatcacaatgctctggtcattgtccgtgagcagtttcgctgtcggtggtatgacagctagcttcttcggaggctggctcggtgataccctgggccgcatcaaagctatgctcgtcgctaatatcctttcactggttggcgctctcctgatgggttttagtaagctcggcccctctcacatccttataattgcaggccgctccatctctggactctattgcggcctgatatccggtttggtaccaatgtatatcggcgagatcgcccctaccgccctcaggggtgcccttggtaccttccatcaactggctatcgtgactggtattctgatttctcagataatcggattggaatttatcctgggcaactatgacctctggcacattctgctcggtctgagtggcgtgcgcgcaatccttcagtccctccttctgtttttttgcccagaatcccctcgttatctgtatatcaaacttgacgaagaagtcaaggcaaaacaatctctcaagaggcttagaggatacgatgatgtgaccaaggacatcaacgagatgaggaaagagcgtgaagaggccagctccgagcagaaggtttcaatcatccagctgtttaccaactcctcttaccgtcagccaatcttggtggccctcatgctgcacgttgctcagcaattcagtggcattaacggaatcttctattactcaacaagcatcttccaaactgccggcatctctaagcccgtctatgccacaatcggtgtcggtgcagtcaatatggtcttcacagccgtttccgtctttcttgtagagaaggctggtaggcgctctctgtttttgattggcatgagtggtatgtttgtttgcgctatctttatgagtgttggtcttgtgcttttgaacaagttttcatggatgtcctacgtgtccatgatagctatattcctttttgtgtctttctttgaaattggacctggcccaatcccctggttcatggtagccgaatttttctctcagggtccccgtcccgccgcacttgcaatcgctgccttctctaactggacttgtaattttattgtcgccttgtgtttccagtacattgcagatttttgcggcccctatgtgttcttcctcttcgctggcgtgttgttggcttttacacttttcactttcttcaaggtgcctgaaacaaagggcaaatcatttgaggagatcgcagccgagttccagaagaagtctggttccgctcacagacccaaggctgctgttgaaatgaagttccttggcgcaaccgagacagtg

SEQ ID NO: 19435 - DNA, 1572 bp, Artificial Sequence
  Description of Artificial Sequence: Synthetic coding sequence
atgaccgaggataaggtgaccggtaccctcgtgtttaccgtgatcaccgctgttctcggatcattccagtttggatacgacatcggtgtcatcaacgcacctcagcaagtcatcatctctcactaccggcatgtcctgggagtccctctcgacgatcgtaaggcaatcaacaattacgtcattaactccaccgacgagttgccaactatctcgtactccatgaatccaaaacccaccccgtgggcagaggaggaaactgtggctgccgctcaactgatcactatgctgtggtcgctgtcggtgtcgtcatttgctgtcggcggtatgacggcatcgttttttggagggtggctgggcgacaccctgggccgcatcaaagccatgctcgtggcaaatatcctgtcgctggtgggagcgctcttgatggggttctctaaactgggtccgtcacacatactcatcatagctggtcgctcaataagcggactgtactgcggcctcatttccggattggtgccgatgtatattggagagatcgccccaactgcgctcagaggtgctctgggtacctttcatcaattggcgatcgtcaccgggatcctgatctcgcagatcattggactggaattcatcctcggtaattacgatctctggcacattctgttgggactctcgggagtccgcgcgatcctgcagagcctgctgctgttcttttgtccggaatccccgcgctacctttacatcaagctggatgaggaggtgaaggccaagcagtcgttgaagaggcttcggggctacgacgacgttaccaaagacattaatgaaatgcgcaaagaacgggaggaagcctccagcgagcagaaggtgtcaattatccaactgtttaccaactcatcgtaccgccagcctattctggtggcactcatgctccacgtggcccaacagttctcaggcatcaacggaatcttctattactccacttccatcttccagacggctggaatttctaaacctgtgtacgcgaccatcggagtgggcgcagtcaacatggtctttactgcagtgtcggtgttcctcgtcgaaaaggctggcaggcggtcactgttcctgatcggaatgtccggcatgttcgtgtgtgcgatcttcatgtccgtcggactggtcttgttgaacaaattctcgtggatgtcctacgtgagcatgatcgctatcttcttgttcgtttccttcttcgagatcggaccgggacctattccgtggttcatggtggcagaattctttagccagggcccacggcccgccgccctggccatagcggcgttctcaaactggacttgcaactttatagtggccctgtgcttccaatacatcgcggatttctgtggtccgtacgttttcttcctgttcgctggcgtgcttctcgcattcactctcttcaccttctttaaagtaccagaaactaaggggaagtcgttcgaagaaattgcggcggaatttcagaagaagagcgggtcagctcatagacctaaggccgccgtggaaatgaagttcctcggcgcaaccgagacggtg

SEQ ID NO: 19436 - DNA, 1572 bp, Artificial Sequence
  Description of Artificial Sequence: Synthetic coding sequence
atgactgaggacaaggtcaccggaacacttgtgttcacagtgatcactgccgtgctgggctccttccagtttggatacgacataggggtgatcaacgcacctcagcaggtaattatcagccactaccgccatgtcctcggagtgccactcgatgaccgcaaggcgattaacaattacgtgatcaatagcactgatgagctcccaaccatttcctattcaatgaaccccaagcccacgccatgggcggaggaggaaacagtagctgccgcccagttgatcacgatgctctggtccctttctgtcagcagctttgccgtgggaggcatgaccgctagcttttttggcgggtggctgggagatacgctcgggaggataaaagccatgctggtggccaacatactgagccttgtgggagccctcttgatgggcttttctaaactggggcccagccatattcttatcattgccggtaggtcaatttccgggctgtactgtggcctcattagtgggcttgtccctatgtacatcggagaaattgctcctacagcgctgagaggcgccttgggtaccttccaccagctcgccatagtgaccgggatcttgatctctcagattatagggcttgagttcatccttggcaactacgacctctggcacatcctgctgggcttgagtggcgtgcgcgcaattttgcagtccctgctcttgttcttctgccccgaatctcccaggtacctgtatatcaagctggatgaggaggtgaaagccaagcagagccttaagcggcttcgggggtacgacgatgtaactaaggatatcaacgaaatgcgaaaggaacgagaggaggcgagttctgagcagaaagttagcattatccaactcttcacaaactcatcttatcgccagcctatactggtggctcttatgcttcacgtggcccaacagttctccggaatcaacggaattttttactactcaacttcaatattccagactgctgggatttcaaagccagtgtacgcaactatcggggtgggcgccgtaaacatggttttcactgcagtgagtgtgttcctggtggaaaaggctggcagacggagtctctttttgatcggcatgtctggtatgttcgtctgtgcaattttcatgagtgtggggttggtcctgctgaacaagtttagctggatgtcatatgttagcatgatcgcgatctttctctttgtgtccttttttgaaatcggacccggtccgatcccctggttcatggtcgcggagttcttctctcaaggcccaaggcctgccgccctggccatcgccgcattttcaaattggacatgcaacttcatcgtggccctttgcttccagtatatcgctgatttttgtgggccttacgtgtttttcttgtttgccggggtcctgctggcgtttacacttttcacattctttaaggtccccgagacaaaggggaagagctttgaagagatcgcagctgagttccagaagaagtcaggttccgcccaccgacccaaagctgccgtagaaatgaaatttctgggagcaaccgagacagtc

SEQ ID NO: 19437 - DNA, 1572 bp, Artificial Sequence
  Description of Artificial Sequence: Synthetic coding sequence
atgactgaagataaggtgaccggcaccctcgtgtttacggtgatcacggcagtgcttggttctttccagtttggttacgatattggagtgattaacgcaccacaacaagtcatcatatcgcattaccgccatgtcctgggtgtgcccctcgatgatcggaaggcaataaacaactatgtgatcaattcaactgatgagcttccaaccatatcgtactccatgaacccaaagcctacgccatgggcagaagaggaaactgtggccgcagcacagttgataaccatgctttggagcctttccgtcagttcattcgccgtgggtggcatgactgcatcgttttttggaggttggctcggtgacactcttgggcggataaaggcaatgcttgtagcaaatatcctgtccttggtgggtgcccttcttatgggattttcgaaactcggtccatcgcacatcctgattattgcaggacgtagcatatcaggcctgtactgtgggcttatttccggcctggtgccaatgtacatcggagagattgcacctactgcgctgagaggagcccttggtacttttcatcaacttgccatagtgacgggcattctcatttcgcagatcattggtctggagtttatccttggcaattacgacctgtggcacatcctcctgggactttcgggagtccgggcaatactccaaagccttcttcttttcttttgtcctgaatccccacggtacttgtacattaaacttgacgaggaagtcaaggccaagcagtcactgaagcgactgcgcggatacgacgatgtcacgaaagacattaatgaaatgagaaaggagcgggaggaagcgagctcggaacagaaagtgtccataatccagctctttaccaacagctcctaccgccagccaattctggtggcgcttatgttgcatgtggcgcaacagttttcaggaattaacggaattttctactattcaacttccatatttcagaccgcaggtatttcgaagcctgtgtacgcaaccattggagtcggagccgtgaatatggtgttcactgcagtttcggtctttctggtggaaaaggcgggccgaagatcactgttcctgatcggcatgtcgggtatgttcgtgtgcgcaatctttatgtcggtggggctggtgcttctgaacaagttttcgtggatgtcgtacgtctcaatgattgccatctttctgtttgtgtccttcttcgaaattggacccggtccaattccttggtttatggtggccgaattcttttcacagggaccaagacctgcagcactggcgatcgctgcgttttcgaattggacttgcaatttcattgtcgcactgtgctttcagtacattgcagatttttgtggcccatacgtgttttttctcttcgcgggggtgcttctggcatttactctcttcactttctttaaagtgccagaaaccaaaggaaaatcgttcgaagaaatcgcagccgaattccaaaagaaatccggctcagcgcaccgcccaaaggccgctgtcgaaatgaagtttctcggagcaaccgaaaccgtg

SEQ ID NO: 19438 - DNA, 1572 bp, Artificial Sequence
  Description of Artificial Sequence: Synthetic coding sequence
atgacagaagacaaagtgacgggcactctggttttcacagttatcaccgccgtgcttggaagttttcagtttggttacgatattggtgtcatcaacgcccctcagcaggttatcatcagccactacagacacgtactgggcgtgccacttgacgacagaaaagccattaacaattacgtgatcaattctaccgatgaactgccgacgatttcttactccatgaaccccaagcccactccgtgggccgaggaggagacagtggcggctgcccagttgatcacgatgctgtggagcctttcagtctcttcattcgcagtcggcggtatgaccgcttccttctttggcggctggctgggagataccttgggccgcatcaaggcgatgctggtcgccaacatcttgtccctggtcggtgctctgctcatgggcttctccaagcttggtccatcacatatattgatcatcgccggtaggagcatctctggcctttactgtggacttataagcggacttgtgccaatgtacatcggagagattgccccaacagcgctcaggggagcgctgggtacattccaccagttggctatcgtaacaggtattctgatctctcagataatcggtctcgagttcattctgggcaattatgatctgtggcatattcttctgggtctctccggtgttcgcgcgatcctgcagtccctgctgctcttcttctgtcctgagtctcctcgctacttgtatattaagcttgatgaggaggtgaaagccaagcagtcacttaagaggctgcgcggttacgatgacgtgacgaaggacataaacgaaatgagaaaggagcgcgaggaggctagctctgaacagaaggtgtctattattcagctcttcaccaattcttcatacagacaaccaattctcgtggcgctgatgctccacgttgcacagcagttcagcggaattaacggcatcttctattactcaacttcaatctttcagactgccggcatctctaagccggtctatgctaccattggtgttggcgcagtcaacatggtcttcaccgctgtgtctgtgttcctggtcgaaaaggccggtagacgcagcttgtttctgattggtatgagcggcatgtttgtctgcgccatcttcatgtcagtgggcctggtcctgctgaacaagttctcttggatgagctacgtgagtatgatagccatcttcctttttgtcagtttttttgaaattggtccaggtccgataccctggttcatggttgcagagtttttctcccagggccctagacccgctgccctggctatcgctgctttttctaactggacgtgcaattttatcgttgcgttgtgctttcagtatatcgcggacttctgtggtccctacgtgttctttttgttcgccggtgttttgctggcctttaccctcttcactttcttcaaggtacccgagaccaagggtaaaagcttcgaagaaatcgcagccgagtttcaaaaaaagagtggatccgctcacaggcctaaagccgccgtcgaaatgaaattcttgggagccaccgaaacggtg

SEQ ID NO: 19439 - DNA, 1572 bp, Artificial Sequence
  Description of Artificial Sequence: Synthetic coding sequence
atgactgaagacaaggtgaccggcaccctggtttttacagtgataactgctgtactgggttcctttcagtttgggtacgatatcggtgttatcaacgcgccccagcaagtgattattagtcattaccggcacgtcttgggtgtccccctggatgaccggaaagccattaataactatgtaattaactcaactgacgagctgcccaccatcagttacagtatgaatcccaagcctaccccctgggcagaagaggaaactgtggccgctgcgcagctgataacaatgctgtggagcctgagcgtgtcatcgtttgccgttggcggaatgactgccagtttctttggcgggtggctaggcgataccctgggccggatcaaggctatgctggtcgctaatatactgtctctggttggggcactgctaatgggattttcaaagctgggtcccagccacatccttatcatcgccggtcgatctattagtggtctctattgcggtctgatctctgggctggtccctatgtacatcggcgaaattgcccctaccgccctccgcggggctctgggcacttttcaccagctggcaattgtgaccggaatactcatatcacaaattatcggactggaattcatcctcggcaactacgatctgtggcacatactgctaggtttgtctggagtgcgagccattctccaatccctgctgttgtttttctgcccagaaagccccagatatctttatatcaaactggacgaggaggtcaaggccaagcaaagccttaagcggctcagggggtacgacgatgtgactaaggatattaatgaaatgagaaaagaacgggaagaagcctcttccgaacaaaaggtgagtatcattcagctatttactaacagtagttatcggcagccgatactggtcgccctgatgctccacgtggcccagcagttcagcgggatcaacggcattttttattacagcacgtctatcttccaaacggccgggatctctaaacctgtgtatgctaccataggtgtgggtgcggtgaacatggtatttaccgccgtttccgtgtttttggtcgagaaagctggaagaaggtcattgtttcttatcgggatgtctggtatgtttgtgtgcgcaatctttatgagcgtgggcctggtcctcctcaataagttttcctggatgagctatgtgtcaatgatcgccatattcctgttcgtgtccttctttgagattggaccagggcctataccgtggttcatggttgcggaattcttctcccaaggccccaggccggctgccctggcgatcgccgcattttcgaactggacctgtaactttatagtggctctgtgcttccagtacatcgcagacttctgtggcccttacgtgttttttctgttcgcgggggtgctcctcgccttcaccctgtttactttctttaaggtaccagaaaccaaaggaaaatctttcgaggagatcgcagccgaattccaaaagaaatcaggcagcgcgcacagaccaaaagcggctgtagaaatgaaattcctcggcgccactgagaccgtg

SEQ ID NO: 19440 - DNA, 1572 bp, Artificial Sequence
  Description of Artificial Sequence: Synthetic coding sequence
atgaccgaagataaagtgacgggaaccctggtttttaccgtgatcacagctgttctcggctccttccagttcggctacgatatcggcgtaattaacgctccccaacaggttatcattagccactaccgacatgtacttggagtgccactggatgataggaaggcgattaacaattacgtgataaattctactgatgaactgccaactatttcttactctatgaatcctaagcctacgccctgggctgaggaggagacggttgccgctgcgcagctgatcacaatgctctggtctcttagcgtgtcctcctttgctgtgggtgggatgaccgcgtctttcttcggtgggtggcttggagataccctcggacggattaaagctatgctcgtagcaaatatcctcagcctcgtcggggctctccttatgggatttagtaagctgggtccaagtcatatcctgatcatcgcaggccggtctatctctggcctgtattgtgggctgattagtggcctggtgcctatgtacattggtgagattgcgccgaccgcacttcggggagctcttggcacttttcaccagctcgctatcgtcactggaatcctgatctcacaaattatcggccttgaatttatactgggtaactacgacctctggcacatcttgcttggactgtcaggcgttagggctatcttgcaatccctgctgctgtttttctgccccgagagtccacggtacctgtatataaaacttgacgaggaggtcaaggccaagcaatcccttaagcggctgcgcgggtatgacgatgttaccaaagatattaatgagatgcggaaggaaagagaggaagcttccagtgaacaaaaggtctccatcattcagctgtttactaactcttcctatagacagcccatcctcgttgcgcttatgctgcacgttgctcagcaattcagtggcattaatgggatattctattactcaacttccatcttccagaccgcaggcataagtaagcccgtgtacgccaccattggtgtgggcgctgtgaacatggtgttcaccgccgtttccgtattcctcgtcgagaaggctggacgacgatcactcttccttatcggaatgtccggtatgtttgtgtgcgctattttcatgtcagtgggactcgtgctgttgaataagttttcctggatgagttacgtgagcatgatcgccatctttttgtttgtctctttctttgagataggcccaggaccgatcccatggtttatggttgcggaatttttttctcaaggacccaggccagcagccctggctatcgccgcgtttagtaactggacttgcaacttcattgtggctctgtgttttcagtacatcgcagatttctgcggcccctatgtgtttttcctgtttgccggcgtcctgctcgccttcacgctgttcacttttttcaaagtccccgagacaaaaggcaagtcattcgaggagatcgcagctgagtttcaaaagaagagtgggtctgcgcatcggccaaaggcagctgtagagatgaagttccttggagctacagagacggtc

SEQ ID NO: 19441 - DNA, 1572 bp, Artificial Sequence
  Description of Artificial Sequence: Synthetic coding sequence
atgaccgaggataaggttactggcacgctcgtttttactgtgatcactgctgtcttggggagttttcagtttggttatgatattggggtgatcaatgcacctcaacaggtaatcatctctcattacaggcatgtgctgggcgtgccccttgatgacaggaaggccatcaacaattacgtgattaatagcacagatgaactgccaactattagctatagcatgaatcctaagcctaccccttgggctgaggaagaaactgtggccgcagcccagctgattactatgctctggagcctatcagtgtcctcattcgctgtaggagggatgacagctagtttttttggcgggtggcttggtgacacactcgggcggataaaggcaatgctcgttgccaacatcctgtccttagtgggagcacttttgatgggcttcagtaagctggggccaagtcatatcctgattattgccggacggagcatctcgggtctatattgtggattaataagtggcctcgtcccaatgtatatcggtgagatcgctccaactgcccttcgcggggccctaggtacctttcatcagctggcaattgtcactgggatcctgatttcccagatcattggcttagaatttatcctgggaaattacgatctctggcacattctcctggggctgtctggagtccgggctattctgcaatcattgttgctgtttttctgcccagagagcccccgttacctgtacattaagctggatgaggaggtgaaagcaaaacagtcactgaagcgcttgcgcggttacgatgacgtcacgaaagacatcaatgagatgagaaaagaaagggaggaagcctcctctgaacagaaagtgtcgattatccagctgttcacgaactcctcttatcgacagcctatactcgtggctctgatgctccacgtggcccagcaattctctggaatcaacggcatattttactacagtacctcaatcttccaaactgcggggatatctaagccagtgtatgcaactattggcgtaggagcagtgaacatggtcttcacagccgttagtgtgttcttggtggaaaaagccgggaggagaagtctatttttgatcggtatgagcggaatgtttgtgtgtgcgatcttcatgtccgtcgggttggtgctgctgaacaagtttagctggatgtcttatgtgagcatgattgccattttccttttcgttagcttcttcgagatcggcccagggccgataccatggttcatggtagccgaatttttttcccaggggccaaggcctgcggcactggctatcgcagcattcagcaactggacctgcaatttcatcgttgcactgtgttttcagtatattgccgatttctgtggcccttacgttttcttcctgtttgctggagtacttcttgccttcaccctgttcaccttttttaaggtacctgagaccaaggggaagtccttcgaagaaattgccgccgaatttcagaaaaaaagcgggtccgctcacagacctaaggccgctgtcgagatgaaatttctgggtgctacagaaaccgtg

SEQ ID NO: 19442 - DNA, 1572 bp, Artificial Sequence
  Description of Artificial Sequence: Synthetic coding sequence
atgaccgaggataaggttactggaaccctcgtgtttactgtgatcactgcagtgttgggtagcttccagtttggttacgacatcggcgtcattaacgccccgcagcaggtcatcatctcccactaccggcacgtccttggtgtgccgctggatgatcgcaaggccatcaataactacgtgatcaattctaccgacgaactgccgacgatttcatacagcatgaacccgaagccgacgccgtgggccgaggaggagacggtggcggccgcccaactcatcactatgctgtggtcgctgtcggtgagctcgttcgcggtgggagggatgactgcgtcattcttcggcggatggctgggcgacaccctgggacggatcaaggccatgttggtggccaatatcctgtcgctcgtcggggccttgctgatgggattctcgaaacttggtccttcccacatcctcatcatcgctggtcgctccatctcgggactctactgtggactgattagcgggttggtcccgatgtacattggtgaaatcgctccaaccgcgctgagaggagcactgggcacgtttcatcaactcgcgatcgtgaccgggatcctgatctcacaaatcattggactcgagttcatcttgggaaattacgacctctggcatatcctgctgggcctgtccggagtgagagccatcctgcaatccctgctgttgttcttctgcccggaaagcccgcggtatctgtacatcaagctggacgaggaagtgaaagctaagcagagcctgaagcgcctgcgcggctacgacgacgtgactaaggatatcaacgagatgcgcaaggagcgcgaggaggcatcgagcgaacaaaaagtctcaatcatccagttgttcactaattcctcgtatcggcagccgattttggtcgctctcatgctccacgtggcccagcagttctccggaatcaatggaatcttctactactccacttcgatcttccagaccgccgggatttccaagccggtttacgctactattggcgtcggagcagtgaacatggtgttcaccgcagtcagcgtgttcctggtcgagaaggccgggagacggagcctcttcctgataggaatgtcaggaatgttcgtctgcgcaattttcatgagcgtggggctggttctgttgaacaagttcagctggatgagctacgtcagcatgatcgccatattcctcttcgtgagctttttcgagatcgggccagggccaatcccgtggttcatggtggccgagtttttctcccagggtcccagacctgccgcactggccatcgcagccttctccaactggacttgcaatttcatcgtggcactctgcttccagtacatcgccgacttctgcggaccatacgtgttcttcctctttgcgggagtgctgctggccttcaccctgttcacttttttcaaagtgccggagactaagggaaagtcgtttgaagaaatagctgccgaattccagaagaagtcgggcagcgcacatcggcccaaggctgcggtggagatgaagttcttgggagccacggaaacggtc

SEQ ID NO: 19443 - DNA, 1572 bp, Artificial Sequence
  Description of Artificial Sequence: Synthetic coding sequence
atgactgaagataaggtgactggtaccctggtgtttacggtgattaccgcagtacttggtagctttcaatttggttatgacatcggtgtcattaacgcacctcaacaagtgatcataagccattaccgccacgtcctgggagtgccccttgacgatcgaaaggcaattaacaactacgttatcaacagcacggatgaacttccaaccatttcctacagcatgaaccctaagcctacgccttgggcggaggaagagactgtcgcagcagcacagctgatcactatgctgtggtcactgtctgtctctagctttgcagttggggggatgacggctagcttctttggaggctggcttggggacactctgggtagaataaaggcgatgcttgtggcaaatatcctgtcgctggtgggtgcactgcttatgggcttcagcaagctggggccttcccatatactcattattgccggaagatcaattagcggactttactgcggcctgatctccggactggtgcctatgtacattggggaaatcgcacccaccgcacttagaggcgcactcggaaccttccatcagctcgcaatcgtgaccggaattttgatctcgcagatcataggactggagtttattctcggaaattacgatctttggcacattttgttgggtctttctggtgtccgtgcgattctccaatcactgctcctcttcttttgcccagagtcccctcgatacctgtacatcaagctggacgaagaagtgaaggctaagcaatccctgaagagactgaggggctacgacgatgtcacgaaagatatcaacgaaatgaggaaagaacgggaagaggccagcagcgaacagaaggtgagcatcatccagctttttaccaattcgtcgtaccgccagcccatccttgttgccctcatgttgcatgtcgcacaacaattttcaggaattaacgggattttctactactccacctccatctttcaaaccgccggcatcagcaagccggtgtacgcaaccatcggcgtcggcgctgtgaacatggtgtttaccgcagtgtcggtgttcctggtggagaaggccggacgaagatccctttttctcattggcatgagcggcatgttcgtctgtgcaattttcatgtcggtcggacttgtgttgctcaacaagtttagctggatgtcgtacgtctcgatgattgcaattttcctcttcgtgtcgtttttcgagatcggccccggacctatcccatggttcatggtcgcggagttcttttcacagggacctcggccagcagcactggcaatcgcagccttttccaactggacctgcaatttcatcgttgcactttgttttcaatacattgctgacttctgcgggccctacgtattctttctttttgcaggagtgcttctggcattcaccctgtttactttctttaaagtgcccgaaaccaaggggaaatcctttgaagagattgcagcagaattccagaagaagtcgggatccgcacatcggccaaaggcggcagtggaaatgaagttcctcggcgcaactgagactgtg

SEQ ID NO: 19444 - DNA, 1572 bp, Artificial Sequence
  Description of Artificial Sequence: Synthetic coding sequence
atgacggaggataaagtgactggaaccctggtgttcactgtgatcaccgcagtccttggttcgtttcaatttggatacgatattggcgtcattaatgcaccacagcaagtgattatcagccactaccggcacgtgcttggcgttccactggatgatcggaaggctataaacaattacgtgatcaacagcactgacgagctgccaaccattagctactcgatgaatcctaagccaaccccttgggcagaagaagagactgtcgccgcagcccagctgatcaccatgctgtggtcccttagcgtgtcctcgtttgcagtaggtggtatgacggcatccttcttcggcgggtggctgggcgatactctcgggcgaattaaggctatgctggtggccaacatccttagcctggtgggtgcgcttctgatgggattttcgaagctcggacctagccatattctgattatagccgggagaagcatttctggcctgtactgtggcctcatctcaggactcgtcccaatgtacatcggtgaaattgcccccactgctctgcgtggagccctggggaccttccatcaacttgcaatcgtcactggcattctcatatcgcagatcattggccttgagtttattcttggtaactacgatctgtggcatatcctgcttggcctttccggggtccgggcaattttgcaaagcctgcttttgttcttttgtccggaatcgccgaggtacctgtacatcaaacttgacgaggaggtcaaggccaagcaaagtctcaagagacttcggggctacgacgatgtgaccaaagacataaacgagatgagaaaggaaagggaggaggcttcctcagaacaaaaggtgagcattatccaacttttcactaattcgtcgtatcgacaaccgattctggtcgccctgatgctgcacgtggcacagcagtttagcgggattaacggaatcttttactactcgactagcatttttcagaccgcaggaatctctaaaccagtgtacgcgacgatcggtgtgggtgcagtgaatatggtttttactgcagtcagcgtctttctcgtggaaaaggcaggccgaagatcgctttttcttatcggcatgtccgggatgttcgtgtgcgcaattttcatgtcagtcggtctggtgctgctgaacaagttctcatggatgtcctacgtgtccatgatcgcaattttcctcttcgtgtcgtttttcgaaattggacctggtccgataccgtggtttatggtcgcagagtttttctcgcaaggaccccgtcccgcagcgctggccattgcagcatttagcaattggacctgtaatttcattgtggcattgtgctttcagtacattgcagacttttgtggaccctatgtgttttttctgttcgcgggtgtcctgctggcctttacccttttcaccttcttcaaggtgcccgaaaccaagggtaagtcctttgaagaaatcgccgccgaattccaaaagaagtcagggtccgcacatcgaccgaaggctgcggtggagatgaaatttctcggggctactgaaactgtg

SEQ ID NO: 19445 - DNA, 1572 bp, Artificial Sequence
  Description of Artificial Sequence: Synthetic coding sequence
atgaccgaggacaaagtcacaggaaccctcgtgttcaccgtgattaccgcagtgctcggcagctttcagtttgggtatgatatcggagttatcaatgctccccagcaagtcattatatcccattacaggcatgtcttgggggtgcccctggatgatcgtaaggcaattaataactacgtaattaacagcaccgacgaacttcctacaatcagctacagcatgaaccccaaacccacgccgtgggctgaggaggagactgttgccgccgcacagttgatcacaatgctgtggtctctgtcagtctcatcctttgcagtgggaggcatgacagccagcttcttcggagggtggctaggggacacgctcggcaggataaaagctatgttggtggcaaatatactctcattggtaggagcactgttaatggggttctccaagttgggaccaagccatatactgatcatagctggtaggtccatctctggtctctactgtggactaatttccgggctggttccaatgtatatcggtgagatagcccctactgctctgcggggcgcattaggaacttttcaccaactcgctatagttaccgggatcctgataagtcagattataggtctggaattcatcttgggcaattatgacttgtggcatatactcctggggttgagcggtgtcagggctatacttcagagcctgctcctcttcttctgccccgagagtccacgatacttatatatcaagctagatgaagaggtgaaggcgaagcagtcactgaagagactgcgaggctatgatgacgtcacaaaggatatcaacgaaatgcgaaaagaaagagaggaagcttcctcggagcaaaaagtcagcataattcagctattcaccaacagctcctaccgacagcctatcctagttgcccttatgctccatgtggcacagcagttctccggaattaacgggatcttctactattccacttctatctttcagacagccggaatctctaagccagtgtatgccactatcggcgtaggcgcagtgaacatggtctttacggccgtcagcgtatttctggtggaaaaggcgggtcgacgatccctgttcctgatcggcatgtccggtatgtttgtgtgcgcaatatttatgtcggtgggactagtgctcctgaacaagttctcctggatgagctacgtgtctatgatagcgattttcctctttgtttcattcttcgaaatcggtcctggcccaatcccatggtttatggtcgcggagttcttttctcaggggccgcgccccgccgccctggccatagccgcattctcaaattggacctgtaatttcatagtggccctgtgtttccaatatatcgccgatttctgtgggccatacgtgttctttctattcgctggcgtacttttggcgttcacgcttttcactttttttaaggttcctgagaccaagggcaaatctttcgaggagattgctgccgaattccagaaaaagagcggcagcgctcacaggcccaaagccgctgtggagatgaagtttttaggcgcgacggaaaccgtt

SEQ ID NO: 19446 - DNA, 1572 bp, Artificial Sequence
  Description of Artificial Sequence: Synthetic coding sequence
atgactgaggataaggtgaccggcacactagtcttcactgtaatcacggccgtgttggggtcatttcagttcgggtacgacattggggtgatcaatgctccgcagcaggtgattatcagccattatcggcatgttctgggagtccccttggacgatcgtaaggccattaacaattacgtgattaacagtacggatgagctacccaccatttcttattcgatgaatcccaagcctactccatgggctgaggaggagaccgtggccgctgcccagctcatcactatgttgtggtcactctctgtgagctctttcgcagtgggaggaatgacagcaagtttctttgggggatggttgggtgatacgctgggcagaatcaaagccatgcttgttgctaacatcctgtctctggtcggggcccttctgatggggttctcaaagcttggcccctcccacattctgattatagccggccgctctattagcgggttgtactgtggcctcatttcgggccttgtcccgatgtacataggggagatcgctccaacagcacttagaggcgctctgggcactttccaccagttggctatagtcaccggtattttaatatcccaaattattggactggagttcatcctcgggaactatgacctatggcacatacttctggggctctcgggggtccgcgctatcctgcagagcctactgttgttcttttgccccgagtctcctaggtacctttacatcaagctggatgaggaggtcaaggcaaagcagtctttaaagaggctgagagggtatgacgacgtaacaaaggatatcaacgagatgcgcaaggagagagaggaagcgtccagcgagcagaaggtatctatcatccagctctttaccaatagttcctatcggcagccaatccttgttgcccttatgcttcacgttgcacagcagttttctggcatcaatggcatcttttactactccacttccatttttcaaacggccggcataagcaaacccgtttatgccacaattggggtgggcgccgttaatatggtcttcactgcggtgtcagtttttctggtggagaaggcaggccgccgctctctgttcttaatcggaatgtccggcatgtttgtgtgtgcgatcttcatgtccgtgggcctggtcctcctcaacaaattctcttggatgagctatgtttccatgattgctatctttctcttcgtgtctttctttgaaattggaccaggacctatcccttggttcatggtggccgaattcttttcacaggggcccagaccggccgccttagctattgcagccttttcaaactggacctgtaatttcatcgtcgcgctttgttttcagtatatcgctgatttctgcgggccttatgtgtttttcctattcgctggtgtgctgttggcttttacactttttacatttttcaaagtacctgaaaccaaaggaaagagcttcgaggagatagcagctgaatttcagaagaaatccggcagtgcccatcgtccaaaggcagcagtggaaatgaagttcctgggtgctactgaaactgtg

SEQ ID NO: 19447 - DNA, 1572 bp, Artificial Sequence
  Description of Artificial Sequence: Synthetic coding sequence
atgacagaggacaaggtaacaggtacccttgtgtttaccgttatcactgcagtgcttggatccttccagtttggatatgatattggtgtgatcaacgccccacaacaggtgatcataagccactacaggcatgtcctgggggtgccactggacgatcgcaaagctataaataactatgtgatcaactccactgacgaactccctactatctcttactctatgaacccgaaacccaccccttgggccgaagaggagaccgtggcagctgctcagctgattacgatgctttggtcccttagcgtttcttcctttgccgtggggggcatgaccgcctccttcttcgggggttggctgggcgatacacttggtaggatcaaagccatgttggtggccaacattctgtcactggtgggagctttgttgatgggcttttctaaactagggccctcgcatatcctgattatcgcaggtcggtccatatctggtctgtactgtggactaatcagcggcctggtgcccatgtacataggagagatcgctcccaccgccctccgcggggcgcttgggacttttcatcaacttgccattgttaccggcatcctgatttcccagatcatcggactggagtttatactgggcaattatgatctctggcatatccttcttggactctccggggtgcgggcaattctgcagagcctcttactattcttctgtcctgagtctccaagatacctctacataaaactagacgaagaagttaaggccaaacagagtctgaagagactgcgtggatacgacgatgtgaccaaggacatcaatgaaatgagaaaggagagagaagaggcttcttccgaacagaaggtcagtatcatccagcttttcactaactcctcctataggcagccgatcctggttgctctcatgttacatgtggcgcagcagtttagtgggatcaatggaatcttttattacagcacatccatcttccaaacggccggtatcagtaagccagtatatgccacaattggggtgggagccgtgaatatggttttcacagccgtctctgtattcctggtcgagaaggcaggcagacggtcgctgtttctgattggaatgtcaggtatgttcgtttgcgcaattttcatgagcgtgggcctggtgctgttaaataaattctcttggatgtcatatgtgagcatgatcgcgatcttcctgtttgtatcattctttgaaattggtccaggccctatcccgtggtttatggtggctgaattctttagccagggcccccgaccagccgccttggctatagctgccttttcaaattggacgtgcaacttcattgtggccctgtgtttccagtacatcgctgacttttgcgggccatacgtcttctttctcttcgcaggggtgcttctggccttcaccttgttcactttctttaaagtaccagagacaaaaggaaaatcatttgaagagattgctgcggagtttcagaaaaagtcaggcagtgcgcaccggccaaaggccgcggtcgagatgaagttcctgggcgccactgagactgtt

SEQ ID NO: 19448 - DNA, 1572 bp, Artificial Sequence
  Description of Artificial Sequence: Synthetic coding sequence
atgacggaagataaggtgactggtacgcttgtgttcaccgtcattaccgcagtgctggggagctttcagtttgggtacgatattggagtgataaacgccccccagcaagtgatcatatctcattaccgccatgtcctgggcgtgcccctggacgatagaaaagcaattaacaattacgtcatcaattcgactgatgaactcccgacgatctcgtattcgatgaaccctaagcctaccccgtgggccgaggaagaaaccgttgccgcagcccaactgattaccatgctgtggtcactgtccgttagctccttcgcagtgggaggcatgaccgcctctttcttcggaggatggttgggagacactctgggacggattaaggccatgctggttgcaaatatcctgtccctcgtgggcgctctgcttatgggcttttcgaagctcgggccttcacatatcctcattatcgccggacgatccattagcggcctgtactgcggtcttatatcggggctggtgcctatgtacattggagagatcgcacctacggcgctccgtggtgccctcggaaccttccaccaactggcaattgtcaccggtatactgatttcacagataattggtctggaattcatcctgggcaactatgatctttggcatatcttgttgggtctgtctggcgtgagggcgatcctccagagccttcttctcttcttttgtccggaatcccctaggtacctttacatcaaacttgatgaagaagtgaaagctaaacaatccctcaagcgactgcgtggctacgacgatgtgaccaaagacataaacgaaatgcgcaaggagcgcgaagaggccagcagcgaacaaaaggtgtccattattcaactttttacgaattcgtcgtacaggcagcctatacttgtggcactgatgctgcacgtggcacagcaattttcgggcattaatggtatcttttactactcaacttccatctttcagactgcaggaatttcgaaacctgtgtacgcaactataggtgtgggagcagtgaatatggtgtttactgcagtcagcgtgtttttggtggagaaggcaggaagaagatcgctcttcctcatcggtatgtcgggtatgtttgtctgcgctatctttatgagcgtcggccttgtgctccttaacaagtttagctggatgtcatacgtttccatgatagccattttcctctttgtctcgttctttgaaattggaccaggaccaatcccttggtttatggtcgcggagttcttttcccaagggcccaggcctgccgctcttgctattgctgcattttcgaactggacttgtaacttcatcgtggcactctgctttcagtacatcgccgacttctgcggaccttacgttttctttttgttcgcgggcgtgcttcttgcgttcaccctttttacctttttcaaagtgccagagactaagggaaagtcattcgaggaaatcgcagcagaattccaaaagaagtcgggaagcgcccatcgccccaaggcggcagtcgagatgaagtttctgggcgcaactgagactgtg

SEQ ID NO: 19449 - DNA, 1572 bp, Artificial Sequence
  Description of Artificial Sequence: Synthetic coding sequence
atgaccgaggataaagttactggaacactggtcttcacagtcatcacagcggtgttgggctcctttcagttcggctacgacattggcgtcattaatgccccacaacaggtcatcatcagccattatcgtcatgtgctgggggtaccgctcgacgatcgcaaagctattaacaactacgtaatcaatagcacagacgaattgcctaccataagctacagtatgaaccctaaaccgactccgtgggctgaagaagagacagttgctgctgctcagctgataactatgctgtggagcttgagcgtgagcagctttgcggtgggaggaatgaccgcatccttttttggaggatggctcggcgatacgctcggtaggattaaggccatgctggtggcgaatatcctgagcctggtcggcgccctgctcatgggctttagcaagctgggcccgtcccatatcctgatcatagccggaaggtccatttcaggcttgtattgcggccttatctcaggactggtccctatgtacatcggcgagattgcacccactgctcttcgcggagcccttggcactttccaccagctggcaatcgtgactggaatcctcatctcacagattatcggcctggaatttattctggggaactatgacttgtggcacattctccttggcctgtcaggcgtcagagccatcctccaatccttgcttctgttcttttgcccagaatctccccgatacctgtacattaaactggatgaggaggtcaaagctaaacagagcctgaaaaggctccgcggttacgacgacgtcactaaggatattaatgaaatgagaaaagagcgcgaagaggctagctctgaacagaaagtcagcatcatccagttgtttactaattccagttatcgccaaccaattcttgtggctttaatgttgcacgtggcgcaacagttctccggaatcaacgggatcttttactacagcacctccatcttccaaaccgctggcatcagtaaaccagtctacgccaccatcggggtcggcgccgtgaacatggtgttcacagccgtgagcgtcttcttggtggagaaagcaggccggcgcagtctctttttgatcggcatgtctggaatgttcgtgtgtgccatctttatgtctgtaggtctggttctgttgaacaaattttcatggatgagttacgtctcaatgatcgctatctttctcttcgtatctttctttgagattggccccggcccaatcccttggttcatggtagccgaatttttctcacagggcccaagacccgccgccttagcaatcgcggcctttagcaactggacctgcaactttattgtagccctgtgtttccagtacattgctgatttttgcggaccttatgtattttttctgttcgcaggcgtgctgctggctttcaccctctttaccttttttaaggtgccagagactaaggggaagagttttgaggaaatcgctgctgagttccagaagaagtccggctctgcacacaggcccaaagcagctgtagaaatgaagttcctgggcgcaaccgagaccgtg

SEQ ID NO: 19450 - DNA, 1572 bp, Artificial Sequence
  Description of Artificial Sequence: Synthetic coding sequence
atgactgaagataaggtgactgggacacttgtgtttactgtgatcacagctgtactagggagtttccaatttggatacgatataggagttataaacgctccacaacaggttatcatatctcattatcgacacgtactgggagttcctttggatgataggaaagctattaacaactatgtaataaactctacagatgagctcccaacaatatcgtattctatgaaccccaagcctacaccttgggctgaagaagagacagtggcagccgcacaactcattactatgttatggtccctttccgtcagttcctttgcggtggggggaatgactgcttctttctttggaggatggcttggagacacattagggaggataaaagccatgttagtggccaatattctctcactagtgggggccctactgatgggattttctaaactgggaccatctcatatcttaataatcgctgggcgctcaatttcaggactatattgtgggctcatctctgggctggtgcctatgtacatcggagaaatagcaccaacagccctccgcggagcactagggacatttcaccagttagcaatagtcacaggaatcctaatatctcagataatagggctcgaatttatacttggaaactatgacctatggcatatactactcgggcttagtggggtcagggccatcctccagagtctgctgctcttcttctgtcccgaatccccccgctatctctatataaaactagatgaggaagtgaaagctaaacagagtctgaagcggcttcgagggtatgatgatgtcacaaaagatataaacgaaatgcggaaggaaagagaagaagcctcctcagagcagaaagtgtccatcatccagttgttcacaaactcctcttatagacagcctatcctcgtggcattgatgttacatgtagctcagcagttctcagggatcaatggaatattctattattccacatccatatttcagactgctggaatctcaaagccagtatacgcaactattggagttggagcggtcaatatggtctttacagcagtgagtgttttcttggtggaaaaagccggacggcggagtttattcttgatcgggatgtctggaatgttcgtctgtgctatctttatgagtgtaggactcgttctgcttaataaattctcttggatgtcctacgtgagtatgattgctatattcctctttgtgagtttctttgaaatagggccagggccaataccctggttcatggtcgccgaatttttctcacaggggcctcggcccgctgccctcgcaatagctgcattctctaactggacatgcaattttattgtcgccctgtgtttccagtatattgccgatttttgtgggccatacgtgttttttctgttcgccggggtattactggcattcacactttttacattttttaaagttcctgaaactaaaggaaaatccttcgaagaaattgctgctgagttccagaaaaaaagtggatccgcgcacagacccaaagctgccgtcgaaatgaaatttttgggggccactgaaacagtc

SEQ ID NO: 19451 - DNA, 1572 bp, Artificial Sequence
  Description of Artificial Sequence: Synthetic coding sequence
atgaccgaagataaggtgactggaactctggttttcaccgtgatcactgctgtgctgggatcgtttcagttcggttatgacatcggtgtgattaacgctccccagcaggtcattatctcccactacaggcacgtgctgggggtgcccctcgatgatcgcaaggccatcaataactacgtgataaactcgaccgacgaacttcctaccatcagctacagcatgaacccgaagcccaccccttgggcagaggaagagacggtcgccgccgcccagctgatcaccatgctctggtcgctgtccgtgtcgtcgttcgcggtgggcggaatgacggcctcgtttttcggcggatggctcggagacaccttgggtaggatcaaagctatgctggtggctaatatcctcagcctcgtgggagcgcttctgatgggcttctctaaactgggaccttcacacatcttgatcatcgcaggacgctcaatctccggtctgtactgtggactcatctccggattggtccctatgtacatcggagaaatcgccccgaccgccctgcggggagcgctcggaacttttcaccaactggcaatcgtgacgggtattctgatcagccaaatcatcggattggagttcatcttgggaaattacgacctgtggcatatcctgctgggtttgtccggtgtgagggccatcctgcagtcgctgctgctcttcttctgcccagaatccccgagatacctttacattaagttggacgaggaagtcaaggcgaaacagtccttgaagcggttgcggggttacgatgatgtgaccaaggacattaacgaaatgcgcaaggagcgggaagaggcaagctccgagcagaaggtgtcaattatccagctgttcactaactcgtcatatcggcaacccattcttgttgcgctcatgctgcatgtcgcccaacaattctcaggaatcaatggtatcttttactactcgacctcgatttttcagactgctgggatctcgaaaccagtgtacgccaccatcggcgtcggtgctgtgaatatggtctttaccgccgtctcagtgtttctggtggaaaaggccggccggaggtcgctgtttctgattggtatgtccggaatgttcgtctgcgcaatcttcatgtcggtgggactggtcctgttgaacaagttctcatggatgagctacgtgagcatgatcgcgatcttcctgttcgtgtccttcttcgaaatcggacctggcccaattccgtggttcatggtcgcagaattcttctctcaggggcctagacctgcggcgctcgcgatcgccgcgttctctaattggacctgtaacttcatcgtcgccctgtgctttcagtacatcgcggacttctgcggtccatacgtattctttctgttcgccggcgtcctcttggcatttactctgttcactttcttcaaggtccccgaaaccaagggcaagtcgttcgaggaaatcgcggcggaattccagaagaaatccggctcggctcatagaccgaaagcagccgtggaaatgaaatttctgggagccactgaaaccgtc

SEQ ID NO: 19452 - DNA, 1572 bp, Artificial Sequence
  Description of Artificial Sequence: Synthetic coding sequence
atgactgaagataaggtgaccggcacactggtgtttactgtaataacggcggtcctcggaagcttccagtttggatacgatatcggggttataaacgcgccgcagcaggtgatcatttcccactataggcatgtgcttggggtacctttagatgatcgaaaagccatcaataactatgtaattaattctaccgacgagttgccaacgatttcatactccatgaatcccaaacctaccccatgggccgaggaagaaactgtcgccgccgcacaactgataacaatgctgtggtccctcagtgtaagttcattcgccgttggagggatgactgcgagcttttttggcggctggctgggggatacattgggccgcataaaagctatgctcgtggctaatatactcagcctggtcggcgcgctgttaatgggcttttctaagttagggcccagtcatatactcatcattgctggccggtcaatttctgggctgtactgtggactgatcagcggtctggttcctatgtacattggcgagatcgctcctaccgccctgcggggggcattagggacgtttcatcagctggcgatcgtcaccggtatcttgatcagccagattatcggcttagagttcattctcgggaactatgacttatggcacatcctgctgggccttagcggcgttagggccatactgcagtctttgctgttgtttttttgccccgagtcaccgaggtacctgtacatcaagctcgatgaagaggtgaaagctaagcagtctctgaaacgactccgtggctatgatgacgtgactaaagatatcaacgaaatgagaaaggaaagagaagaagcctcttctgaacagaaagtgagtataatccagctgtttaccaacagttcctatagacagccgattctcgtggccctgatgttgcacgtggcccagcagttctccgggatcaacggcattttctattactctacgagcattttccagaccgctggcatctctaagcccgtgtacgctacgatcggggtgggagctgttaatatggtgttcacagccgtgtccgtctttctcgtggagaaggcggggcgccggtccctgttcctgatcggaatgtccggcatgtttgtctgcgccatcttcatgtccgttggactggtgctgctgaacaaattttcttggatgtcctacgtcagcatgatcgctatattcttgtttgtgagtttcttcgaaattgggccagggcccataccgtggtttatggtggctgaatttttctcccaaggaccaagaccagccgctctagccattgcagcattctctaactggacatgtaacttcattgtcgccttatgctttcagtatatcgctgatttttgtggaccgtatgtgttttttctattcgctggtgtgctgctagctttcactctcttcacttttttcaaggtgcctgaaaccaaagggaaatctttcgaggagatcgccgccgagttccaaaagaagtcagggtctgcccatcggccgaaggccgctgtggagatgaagttcctaggcgccaccgagaccgtg

SEQ ID NO: 19453 - DNA, 1572 bp, Artificial Sequence
  Description of Artificial Sequence: Synthetic coding sequence
atgaccgaggacaaagtaactggcacactagtgtttacagtgatcactgcagtgcttgggagttttcaattcggctacgatattggggtgattaacgcccctcagcaggtaattataagccactaccgacatgtgctgggggttccccttgacgaccgcaaggctattaataactacgttataaattcaacagacgagctgccgactatatcgtatagcatgaaccctaaacccactccatgggcagaggaagaaactgttgctgccgcccagcttataaccatgctgtggagcctctctgtttcctcttttgccgtcgggggtatgacagctagcttcttcgggggatggctaggcgacactctcggccggatcaaagctatgctggtcgctaatattctgtccctggtcggtgcgctccttatgggatttagcaagcttggcccaagtcatattctgatcatcgccggacgttccattagtggcttgtattgcggcttgatttccggacttgtcccgatgtatataggagagatagcaccaacagcccttcgtggtgctctgggtactttccaccaactagccatcgtgactgggatcttgatcagtcagatcattggcctggaattcatcctgggcaattacgacttatggcatattctgcttggcctctctggcgttagggctatcttgcagtccctcctgctgtttttttgtcccgaatcccctcggtacctgtatattaagctggacgaggaggtaaaagcgaaacaatcactcaagaggctccgaggatacgatgatgtgaccaaggacatcaatgaaatgagaaaggagcgcgaggaggccagttcagaacagaaggtgagcattatccaactctttactaacagttcttacaggcagccaatcctcgtggcgttaatgctgcatgtcgcccaacaatttagtggcataaacgggatattctactattccacatctatcttccaaactgcaggcatctccaagcccgtctacgcaacaatcggcgtcggtgcagttaatatggtgttcacagctgtgtctgtattcctcgtagagaaagcagggcgcaggtctctgttcctgatcggcatgtccggtatgtttgtctgcgccatctttatgtctgtcggattggtgctgctaaataaattcagctggatgtcttacgtgtccatgatcgccatctttctttttgttagctttttcgagataggtcctggccctatcccatggttcatggttgcagagtttttctcccaggggccccgcccagccgctctcgcaatagccgcattctcaaattggacatgcaactttattgttgcactgtgcttccaatatattgcagatttttgtgggccatatgttttttttctttttgcaggggtgttgttggccttcaccttgtttacgttcttcaaggtgcctgaaactaagggcaaaagcttcgaggaaattgccgcagaatttcaaaaaaaaagcggaagcgctcacagacccaaggcagctgtggaaatgaaattcctgggggcaactgaaaccgtt

SEQ ID NO: 19454 - DNA, 1572 bp, Artificial Sequence
  Description of Artificial Sequence: Synthetic coding sequence
atgacagaggataaggtgacaggaaccctagtgttcacggtgatcaccgccgtcttgggcagttttcaatttgggtacgatattggtgtgatcaacgctcctcagcaggtgatcatcagccattacaggcatgtgctcggagtccctttggacgatcgcaaagcgataaacaattatgtcataaactccacagacgaactccccactatttcttactcaatgaatccaaagccaaccccctgggccgaagaagagaccgtggcagctgcgcagttaataaccatgctttggtctctgtctgtgtcttcttttgccgtgggggggatgaccgcctcgtttttcggcgggtggttgggtgataccctgggaagaattaaagcaatgctcgtagcaaacatcctgagtctggttggagccttgctcatgggcttttctaagctcggtccctctcacatattgatcatagctgggcgcagcatctccggtctgtactgtgggctgatttccggactggtgcctatgtacattggggagatcgctcctaccgcgctccgcggtgctttaggcaccttccatcagctcgctatcgtgactggaattttgatctcccagattatcggcctggaatttattctcgggaattacgacctgtggcacattctcctgggactttccggagtgcgcgctatccttcagtcgttgctgctgttcttttgccctgagagtccgcgatacttgtacatcaaattggacgaggaggtgaaagccaaacagtcactgaaacggctccgcggatatgatgacgtgaccaaagacattaacgaaatgcggaaggagcgagaagaggcctcaagcgaacagaaggtgagcataattcagctctttaccaatagcagctatagacaacccatcctggtggcgctgatgctgcatgttgcccaacagttctcaggcattaatggcattttctattactccacctccatcttccaaacagcgggcatcagcaaacccgtctacgctaccattggcgtgggagcagtgaacatggtgtttaccgccgtttcagtgttcttagtcgagaaagcagggcgtcgttcactgtttctgatcggcatgtccggaatgttcgtttgtgctatcttcatgtcagttggactggtgcttctcaacaaattcagttggatgtcatacgtaagtatgatcgcaatcttcctgtttgtgagctttttcgaaatcgggcctggcccaattccatggttcatggtggccgaattcttcagccagggaccacgcccggccgccctggccatagcagccttctctaattggacttgcaacttcatcgttgccctgtgtttccagtacattgcagatttctgcggcccctacgtgtttttcctctttgctggtgtactgttggccttcaccttgtttacctttttcaaggtgcctgagacgaagggcaagtcattcgaagagattgccgcagagttccagaaaaagagcgggtctgcacacagaccaaaggccgccgttgagatgaaatttttgggagcgaccgagacagtg

SEQ ID NO: 19455 - DNA, 1572 bp, Artificial Sequence
  Description of Artificial Sequence: Synthetic coding sequence
atgaccgaggacaaggtgaccgggacactggtcttcaccgtgataacagcggtgctgggctccttccagtttggctacgacatcggggtgatcaacgcaccccagcaagtgattatctcgcactaccgacatgtgctcggagtaccactcgatgaccgcaaggccatcaataactatgtgatcaacagcacagacgagctgccgaccatttcgtattcaatgaatcctaagccaactccctgggccgaggaggagactgttgcggcggcccagctgatcaccatgctgtggtccttaagcgtgtcttcctttgctgttgggggcatgacagcctcgttcttcggtgggtggctcggcgacacacttgggaggatcaaggctatgctagtggccaatatcctctccttagttggtgctctgctcatgggcttcagtaaactggggccctcccatattctgatcatcgcgggacggtctattagtggactatattgcgggttgatctcaggcctcgtgccaatgtacatcggtgagatcgcccccactgcacttcgcggcgcactcggaaccttccaccagttggcaatcgtcaccggaattctcataagccagatcattggcctagaattcattttaggcaattacgacctgtggcacatcctcctgggcctttctggcgtaagggccatcctacagtcccttctgctctttttctgccctgaatcaccaagatatctatacatcaagctagacgaagaggtgaaggccaaacagtctctcaaacggctgcggggatacgacgacgtgactaaagacatcaacgagatgcggaaagaacgagaagaagcgtcctctgagcagaaggtatcgattattcagctgtttactaattctagttatcgacagcctatactagtggcccttatgctccacgtggctcagcagttctcaggcatcaatggtatcttttattactctacaagcatctttcagacagctgggatctctaagccagtgtacgccactattggggtgggggcagtaaatatggtgttcactgcagtgtctgtatttctggttgagaaggccgggagacggagcttgtttctgattggaatgtctggcatgttcgtatgcgctatctttatgagcgtgggcctggtgctgttgaataagttttcctggatgagttacgtttcaatgattgcaattttcctgttcgtaagcttctttgaaattgggccaggcccgattccgtggttcatggtcgctgaattcttctcacaaggtccccgaccggctgccctggccattgcagctttctctaactggacctgcaattttatcgtcgcgttgtgttttcaatacatagctgacttttgtggcccctatgtgttcttcttattcgccggcgtgctactggcctttactttatttaccttctttaaggtcccagaaacgaaaggcaaatccttcgaagaaatcgccgccgaattccagaaaaaatccgggagtgctcaccgacccaaagctgctgtcgaaatgaaattcctcggcgccaccgaaacagtc

SEQ ID NO: 19456 - DNA, 1572 bp, Artificial Sequence
  Description of Artificial Sequence: Synthetic coding sequence
atgactgaggacaaggtgaccggtactctggtgttcaccgtcatcaccgcggtcctgggttcgttccagttcggttacgatataggtgttattaatgcgccacagcaggtgatcattagccactaccggcacgtactaggtgtccctctggatgatcgcaaggctatcaataactatgtgatcaactctacggacgaactccctacgattagttatagcatgaatccaaagccgactccgtgggcagaagaggaaaccgtcgcggccgcccagctgatcacgatgttgtggagcctgagcgtgtctagcttcgccgtgggtggaatgactgcgagcttttttggtgggtggcttggagataccctgggtcgcatcaaggcgatgctggtggcaaatatcctatcgctggtgggagctctgctgatgggcttttctaagcttggcccgtcgcacattctgatcatcgcgggccgtagcatcagcggcctgtactgtggcctgatttctggtctggtgccaatgtatatcggtgagatagctccgaccgcactgcgcggcgcattgggcacgttccaccagttggcaatcgtgaccggtatcctgatttcccaaatcatcggcctcgagtttattctgggcaactatgacctgtggcacatcctgttgggcctgagcggtgtgcgcgccatactgcaaagcctgctgctgttcttctgtccagagagcccacgctacttgtacatcaagttggatgaagaagtaaaggcaaaacagagcctgaagcgcctccgcggctatgacgatgtgacgaaagatatcaacgagatgcgcaaggagcgagaggaggccagcagcgagcagaaggtgtcgatcattcaactgtttaccaacagctcttacaggcagccgatcctggtcgcattgatgctgcacgttgcacagcaattttccggcatcaacggaattttctattactctacttcgatttttcagaccgccggtatctctaaaccagtgtacgccacaattggggttggcgcagtcaacatggtattcactgctgtctctgtgttcctcgtagaaaaggccggtcgccgaagcctgttcttgattggtatgagcggtatgtttgtatgtgccatttttatgagcgttggactcgtgctgctcaacaagttcagctggatgagctatgtttcgatgatcgccattttcttgttcgtgtctttcttcgaaatcggaccgggtcctattccttggttcatggtcgcagaattcttcagccaagggccgcgcccagccgcgttagcgatcgctgccttcagcaattggacctgcaatttcatcgtcgccctgtgttttcaatacatcgcggacttctgcggtccgtatgttttctttttatttgctggagtgctgttggcgtttaccttgtttacattctttaaagtgcccgagacgaagggcaaaagcttcgaagagatcgctgcggagtttcagaaaaaaagcggctcagctcaccgtccaaaagccgcggtggagatgaagtttttgggcgccaccgaaactgtg

SEQ ID NO: 19457 - DNA, 1572 bp, Artificial Sequence
  Description of Artificial Sequence: Synthetic coding sequence
atgacagaagacaaagtgacgggcacgctagtttttacagtcataaccgccgtgttagggtcctttcagttcggatacgatattggcgtcatcaacgcccctcagcaggtaatcatttcccactaccgtcacgtgctgggagtgccgctagatgatcggaaagcgatcaataattacgtaatcaactctacagatgagcttcctacaattagctattcaatgaaccctaaaccgactccgtgggcagaagaggagacagtggccgcagcacaactaattacaatgttgtggtccctgagcgtgagtagcttcgcggtgggcggcatgacagcctcgttcttcggcggatggctgggggataccctgggcaggatcaaggccatgctcgtcgcaaatatcctcagcctggtgggtgccttactcatggggttctctaagttggggccttctcatattcttattatcgccggcagaagcatatccgggctgtattgtggtctgatatcaggccttgtccccatgtatattggcgaaatagcccctactgcattgcgcggggccctgggtactttccatcagctagcaatcgtcaccggaattctaatctctcagatcatcggactggagtttatactgggcaactacgatctgtggcatatacttttagggctgtctggcgtgcgagccattctacagagccttctgctcttcttttgcccagaatccccccgatacctctatatcaagctcgacgaggaggtaaaagccaagcagagtctgaagaggcttaggggctacgacgatgtaacaaaggatataaatgagatgcggaaagaaagggaggaggcctcctcagagcagaaggtgtctatcatccagctgttcaccaacagttcctataggcagcccatcctcgtggccctcatgctgcacgttgcccagcaatttagcggaatcaacgggattttctattactcaactagtatcttccagaccgctggaatctctaaacctgtgtatgctacaatcggcgtaggtgcagtcaatatggtattcactgccgtgtcggtttttcttgtggagaaagcagggcgccgttccctgttcttgattggaatgagcggtatgtttgtgtgcgccatcttcatgagtgtaggtctagtcctgctcaataagttctcctggatgtcttacgtttccatgatcgcaatcttcctgttcgtgtccttctttgaaatcggacctggtcctattccttggtttatggtggctgagtttttcagccagggacctagaccggccgccctcgcaatcgccgctttcagtaactggacctgtaactttatagtcgctctctgcttccagtacatcgcggacttctgtgggccttacgtgttttttctgtttgccggggtcctgttggcttttactctgtttactttctttaaggtccccgagactaaggggaaatccttcgaagagatagccgcagaatttcagaagaagagcggaagtgcgcaccgcccaaaggcagctgtggagatgaagttcctcggagcgacagagactgtg

SEQ ID NO: 19458 - DNA, 1572 bp, Artificial Sequence
  Description of Artificial Sequence: Synthetic coding sequence
atgacggaagacaaggtgacaggaactctggttttcacagtgataacagccgtgctcggatcctttcagttcgggtacgacattggagtgatcaacgcaccccaacaggtgatcatatctcattataggcacgtcctgggagtgcccctagacgatagaaaagctatcaataattacgtcatcaactcaactgatgaactgcccactatctcctattctatgaaccctaaaccaacaccctgggctgaggaagagactgtcgccgctgcacagctcattacaatgttgtggtccctgtccgtgtcatcatttgctgttggggggatgactgcttcctttttcggaggatggctgggggatacacttggacggataaaagccatgctcgtcgctaatatactgtcactggtgggagcccttttaatggggttttccaaactggggccttctcacatccttataatcgcaggacggagtattagtggactatattgtgggttgattagtggattagtgcccatgtacattggagaaatagcaccgacagccctacggggagccctgggaactttccaccagttagctatcgttacaggaattcttatctctcagattatcgggttagaatttattctagggaactatgatctgtggcatatcttattaggactgtctggggtgcgcgccatcttacagtctttacttctattcttttgtccagaatctcctagatatctctatattaaactagatgaagaggtcaaagcaaaacagagtttgaaaaggctcagggggtatgatgacgtcacaaaggatatcaacgaaatgcgaaaagaacgagaagaagcttcaagtgaacagaaagttagtatcatccagttgttcacaaactcatcgtaccggcagccaattcttgttgcactcatgctccatgtcgcccagcaattctcagggatcaatgggatattctattacagtacatctatatttcagactgctggaattagtaaacctgtctatgcaacaattggggtgggggccgtcaatatggtgttcactgcagtttctgtattcttagtcgaaaaggcagggagacggtctctattccttatagggatgtcaggaatgtttgtatgcgctatcttcatgtcagtggggcttgtcctccttaacaaattctcttggatgtcatacgtgtctatgatcgctatctttctctttgttagtttcttcgaaatcggacctgggccaataccctggtttatggtcgccgaattcttctcacaggggcccaggcctgctgccctcgccattgccgccttttctaactggacttgcaactttatcgtagccctttgtttccagtacatcgccgatttttgcggaccttacgtgttttttttattcgccggagtacttctcgcatttacgctgttcacattctttaaagttccagaaactaaggggaaatccttcgaggaaatcgctgccgagtttcagaagaaatccgggtcagcacataggcctaaagcagctgttgagatgaaatttcttggagctacagaaacagtg

SEQ ID NO: 19459 - DNA, 1572 bp, Artificial Sequence
  Description of Artificial Sequence: Synthetic coding sequence
atgacggaagataaagtaacgggtacgctagtttttacggtaataacggcggtattaggttcgtttcaatttggttatgatataggtgtaataaatgcgccgcaacaagttataatatcgcattatcgtcatgtattaggtgtaccgctagatgatcgtaaagcgataaataattatgtaataaattcgacggatgaactaccgacgatatcgtattcgatgaatccgaaaccgacgccgtgggcggaagaagaaacggtagcggcggcgcaattaataacgatgttatggtcgctatcggtttcgtcgtttgcggttggtggtatgacggcgtcgttttttggtggttggttaggtgatacgctaggtcgaataaaagcgatgctagtagcgaatatattatcgctagtaggtgcgttactaatgggtttttcgaaattaggtccgtcgcatatattaataatagcgggtcgttcgatatcgggtctatattgtggtctaatatcgggtttagtaccgatgtatataggtgaaatagcgccgacggcgttacgaggtgcgctaggtacgtttcatcaactagcgatagtaacgggtatattaatatcgcaaataataggtctagaatttatattaggtaattatgatttatggcatatattactaggtctatcgggtgtacgagcgatattacaatcgctactactatttttttgtccggaatcgccgcgttatctatatataaaattagatgaagaagtaaaagcgaaacaatcgttaaaacgattacgtggttatgatgatgtaacgaaagatataaatgaaatgcgtaaagaacgtgaagaagcgtcgtcggaacaaaaagtttcgataatacaactatttacgaattcgtcgtatcgacaaccgatactagtagcgttaatgttacatgttgcgcaacaattttcgggtataaatggtatattttattattcgacgtcgatatttcaaacggcgggtatatcgaaaccggtttatgcgacgataggtgtaggtgcggtaaatatggtatttacggcggtatcggtatttttagttgaaaaagcgggtcgtcgttcgttatttctaataggtatgtcgggtatgtttgtatgtgcgatatttatgtcggtaggtttagtattactaaataaattttcgtggatgtcgtatgtatcgatgatagcgatatttttatttgtttcgttttttgaaataggtccgggtccgataccgtggtttatggtagcggaatttttttcgcaaggtccgcgtccggcggcgctagcgatagcggcgttttcgaattggacgtgtaattttatagttgcgttatgttttcaatatatagcggatttttgtggtccgtatgttttttttctatttgcgggtgttctattagcgtttacgttatttacgttttttaaagtaccggaaacgaaaggtaaatcgtttgaagaaatagcggcggaatttcaaaaaaaatcgggttcggcgcatcgaccgaaagcggcggttgaaatgaaatttttaggtgcgacggaaacggta

SEQ ID NO: 19460 - DNA, 1572 bp, Artificial Sequence
  Description of Artificial Sequence: Synthetic coding sequence
atgaccgaggacaaggtgactggcacgcttgttttcactgtcatcactgccgttcttggctcgtttcagttcgggtacgatattggtgtgatcaacgctcctcagcaggtcatcatctcgcactaccggcacgtgctgggtgtgccgctggatgaccgtaaagccatcaacaattacgtgatcaatagcaccgacgagctccctaccattagctattccatgaaccctaaaccaaccccatgggccgaagaggaaaccgtcgccgcggctcaactcatcaccatgctgtggtcattgtcggtgtcgtcatttgcagtgggcggaatgaccgctagtttcttcggcgggtggctgggagacacgctcgggcgcattaaagccatgctggtggcgaatatcctgtctctggtgggagctttgctgatgggattctcaaaactcggtccctcacatatccttatcatcgctggcaggtccatctccggactgtactgcggactgattagcggactggtgcccatgtatataggagaaatcgcgcctactgcactgcggggcgcgctgggaacctttcatcagctggcaatcgtgaccgggatcctcatctcacaaatcatcggacttgagtttatcctcggcaattacgacctgtggcacatcctgctgggactctcgggcgtgcgggccatcctccaatcgcttctcctcttcttctgcccagaatcgccgcgctacctgtatatcaagctcgatgaggaagtcaaggccaagcaaagcctgaaaagacttcgcggatacgacgatgtcacgaaggatatcaacgaaatgcgcaaggaacgggaagaggcctcgtccgagcaaaaggtgtccatcatccagcttttcactaactcctcgtaccgccagccgatccttgtggccctcatgctgcacgtggcacagcagttctcgggaatcaatgggattttctactacagcaccagcattttccagactgcaggtatctcaaagccagtgtacgcgactattggagtgggcgcagttaacatggtatttaccgccgtcagtgtgttcctggtcgagaaggccggtagaaggagccttttcctgattggcatgagcggcatgtttgtatgcgctatcttcatgagcgtgggcctggtgctgctgaacaagttttcctggatgtcttacgtctcgatgatcgccatcttcctctttgtgtcgtttttcgaaatcggaccggggccgattccgtggttcatggtggctgaattcttcagtcaaggtccacggccggcggccttggccatcgccgccttctccaattggacttgcaacttcattgtggcgctctgttttcagtacatcgcagacttttgtggaccatacgtgttcttccttttcgccggggtcctcctcgcgttcaccctgtttacgttcttcaaggtaccggaaactaagggaaaatccttcgaggaaatcgcagcagagttccagaaaaagtcgggctccgcgcatagaccgaaggccgccgtcgaaatgaagttcctcggagcgaccgagactgtc

SEQ ID NO: 19461 - DNA, 1572 bp, Artificial Sequence
  Description of Artificial Sequence: Synthetic coding sequence
atgactgaggacaaagtgaccggtactctcgtgttcactgttatcactgcagtgctcggatcatttcaattcggatacgacattggagtcatcaacgctccgcaacaggtgataatcagccattaccgccacgtcctcggagtgccactcgacgaccgaaaggcaatcaacaattacgtgatcaactccaccgacgagctcccgactatctcatactccatgaatccgaagcctactccgtgggcggaagaggaaaccgtcgccgcggcacaactcatcaccatgctgtggtccctctccgtgtcgtcctttgccgtgggtggaatgactgcatcctttttcggaggatggttgggcgacacccttggccggatcaaggcaatgcttgtcgctaacatcttgtccctggtgggagcactcctgatggggttttccaagctgggaccgtcgcacatcctgattatcgccgggagatctattagcggactgtattgtggtctgatctcggggctggtgcccatgtacattggtgaaatcgcacctactgcgctgagaggagcactgggtaccttccatcagctcgcgatcgtgacgggaatcctcatctcacagatcattggtctggagttcatactgggaaactacgatctttggcatatcctgctcggtctttcgggcgtcagggcgatcctgcagtctctcctgctcttcttctgtcctgaatcgcctcgctacctctacatcaagctcgatgaggaagtgaaggcgaagcagtcgctcaagcgattgaggggctacgacgacgtcactaaggatatcaatgagatgcgcaaagaacgggaggaggcttcgagcgagcaaaaagtctcgattatccagctgttcactaactcgtcgtaccgccagcctatcctcgtggccctgatgcttcacgtggcgcagcagtttagcggaatcaatggtatcttctattactcgacttctattttccaaaccgccggaatctcaaagccagtgtacgcgaccatcggggttggagccgtgaatatggtgtttaccgccgtgtccgtgtttctggtggaaaaagcgggtcggaggtccctgttcctcatcggaatgagcggaatgttcgtctgcgccatcttcatgtcggtgggcctggtcttgcttaacaagttctcatggatgagctacgtgtcgatgatcgcaattttcctctttgtgtccttctttgaaattggcccaggacctatcccctggtttatggtggccgagttcttctcccaagggccgcggccagccgcgctggcaattgcagccttttccaactggacgtgtaacttcatcgtcgcgctgtgctttcagtacatcgcagatttctgcgggccatacgtctttttcctcttcgcgggcgttctgctggcattcaccctcttcacgttctttaaagtgccggaaaccaaaggcaagtcctttgaagagattgccgctgagttccagaagaaatcagggtcagcgcaccgccccaaagccgccgttgagatgaaattcctgggcgccaccgaaaccgtg

SEQ ID NO: 19462 - DNA, 1572 bp, Artificial Sequence
  Description of Artificial Sequence: Synthetic coding sequence
atgacggaggataaggtgactgggaccctagtgtttacagtgattaccgccgtacttggctcatttcagtttggatacgacattggggtgatcaacgcgccccaacaagtgatcatatctcactatagacacgttctgggggtgcctcttgacgaccgcaaggctatcaacaactacgtcatcaacagcacagatgagttacccacaatttcatactctatgaaccctaagccaactccctgggcagaagaggagacggttgccgcagctcagctgattacaatgctctggtctctgagtgtgagcagctttgccgtgggcggtatgaccgcgagctttttcggcggttggttgggagatacgctgggccgcattaaggcaatgctggtggcaaacatccttagtctggtcggagccctgctcatggggttctctaagctaggcccaagccacatcctaatcatcgcgggcagatctatctccggactgtactgcggactgatctctggcctggtgcccatgtatattggagaaattgcaccaactgcactcaggggcgcattgggaacattccaccagctggcaatcgttacaggcatactgatcagtcagatcattgggctcgagtttatcctggggaattacgatttatggcatattctcctggggctcagtggcgtcagggccattctccagagcttgctcctgttcttttgtccggaaagcccgagatatctgtacatcaagcttgacgaagaggttaaggccaagcagtctctcaaacgtcttagggggtacgacgatgtgactaaggatatcaatgagatgagaaaagagcgcgaggaggcctcctcggagcagaaggtgtccatcattcagctatttacaaactcttcgtaccgccagcccattctggtcgcgttgatgctgcacgtggcacagcagttctccggaatcaacggcattttctattattctacaagtatcttccagactgcaggcatcagcaagccagtttacgccaccatcggggtgggagctgtgaatatggtgttcaccgccgtgagcgtctttctagtcgaaaaggccggtcggcgaagccttttcctcattggaatgtccgggatgttcgtctgcgccatttttatgtccgttgggttggttctgctcaataaattcagttggatgagttatgtgtctatgatcgcaatctttctgtttgtgtcctttttcgagattggcccgggtcctattccctggtttatggtggccgaattcttttcacagggaccacgcccagctgctcttgcgatcgctgcgttctcaaactggacctgtaattttatcgtcgctctgtgctttcagtacatcgccgacttctgcggcccctacgtgtttttcctgttcgccggcgttctgctggcctttaccctgttcacctttttcaaagtaccggagaccaagggcaaatctttcgaggagatcgctgccgagttccagaaaaaaagcggaagtgcccataggccaaaggcagccgtagaaatgaagtttctgggagccaccgaaacggtt

SEQ ID NO: 19463 - DNA, 1572 bp, Artificial Sequence
  Description of Artificial Sequence: Synthetic coding sequence
atgacagaggacaaagttacagggactttagtttttacagtaataactgcagttcttggatcatttcaatttggatatgatatcggagttattaatgcaccacaacaagttattattagtcactatagacatgttttaggagtaccacttgatgatagaaaagctattaataattatgttataaatagtacagatgaattaccaactattagttattctatgaatccaaaaccaactccatgggcagaagaagaaacagttgctgcagctcaacttattacaatgttatggagtctttcagttagttcatttgcagttggaggtatgactgcatcattttttggaggttggttgggagatacattagggagaattaaagctatgttagtggctaatattctatctttagttggagctttattaatgggattttcaaagttaggaccaagtcatattcttatcattgcagggagatctatttcaggattgtactgtggattgatttctggacttgttccaatgtatattggagaaattgctccaactgctttaagaggagctcttggtacatttcatcaacttgccattgtcactggaattcttataagtcaaattattggtcttgaatttattttaggtaattatgacttatggcatatattattaggtcttagtggagttagagcaattttacaatctttattattatttttctgtccagaatctcctagatatctttatattaaattagatgaagaagtaaaagctaagcagtcacttaaaagattaagaggatatgatgatgttactaaagacattaatgaaatgcgtaaggaaagagaagaagcatcttcagaacaaaaagtttctataattcaactttttacaaattcaagttataggcaaccaatccttgttgcacttatgcttcatgtggctcagcaattttcgggaataaatggaattttttactattcaacaagtatttttcaaactgctggaatttctaaacctgtttatgctacaattggtgttggagcagttaatatggtttttacagctgtttcagtctttcttgtagaaaaagcaggtagaagaagtctttttttaattggaatgtctggaatgtttgtatgtgcaattttcatgagtgttggattagttcttttaaataagtttagttggatgtcatatgtttcaatgattgctattttcttatttgtttcattttttgaaattggtccaggtccaataccttggttcatggttgcagaattttttagtcaaggaccaagaccagcagcattagctatagcagcattctcaaattggacatgtaattttattgtagctctatgttttcaatatatagcagacttttgtggaccatatgtatttttcttatttgcaggtgtattacttgccttcacactttttacattttttaaagttccagagacaaaaggtaaatcatttgaagaaattgctgctgaattccaaaaaaaatccggttctgcacatagaccaaaagctgcagtagaaatgaaatttttgggagctacagaaactgtt

SEQ ID NO: 19464 - DNA, 1572 bp, Artificial Sequence
  Description of Artificial Sequence: Synthetic coding sequence
atgaccgaggacaaagtcaccggaactctcgtgtttaccgtgatcactgcagtcttgggtagcttccaattcggatacgatatcggagtgataaacgcgccacagcaggtgataatctcacactatagacacgtgctgggtgtgccgctggacgatcgcaaggcaattaacaactacgtgatcaactcgactgatgaactgccgaccatttcctattcgatgaacccaaagcctaccccgtgggcggaggaagaaactgttgccgcggcacagctgattactatgctctggtcccttagcgtgtcgtcgttcgccgtggggggaatgactgcgtcattcttcggggggtggctgggagacaccctgggtcgaatcaaagcgatgctggtggccaatattctctccctggtgggggcactgctcatgggtttttccaaactggggccgtcgcacatcctgatcatcgctggccgatcaattagcggactgtactgcggcctcatcagcggtctggtgccaatgtacatcggcgagatcgcccccactgcacttcggggagcactgggaaccttccatcagttggccatcgtgacgggaatcctgatctcgcaaatcatcggtctggaattcatcttgggaaattacgacctctggcatatccttctgggactgtcaggagtgcgcgccattcttcagagcctgctcctgttcttctgtcccgagtcccctaggtacctttacatcaagctcgatgaagaggtgaaggcaaagcagtccctcaagcgcctgcggggatatgacgacgtgacgaaagacatcaatgagatgagaaaagaaagggaagaggcctcgtctgaacaaaaggtgtcgatcattcagctctttaccaactcctcgtaccgccagccgatcttggtggctcttatgttgcatgtcgcccagcaattctccggcattaacgggatcttttactatagtactagtatcttccaaaccgccggaatcagcaagccagtctacgcaaccatcggagtaggagcggtcaacatggtgttcaccgccgtcagcgtgtttctggtggaaaaggccggtcgccgctctctgtttctgatcggaatgtccggaatgtttgtgtgcgccatcttcatgagcgttggactggtgctgctcaataagttttcctggatgtcatacgtgagcatgatcgcaatcttcctcttcgtgagctttttcgaaataggacctggcccgattccgtggttcatggtcgcggagttcttttcgcaggggccgcgcccagcggcgcttgccatagccgcgttttcgaattggacttgtaatttcatcgtcgcactctgcttccaatacatcgccgatttctgcggcccgtacgttttctttcttttcgccggagtgttgctcgcgttcacgctctttactttctttaaggtgccggaaactaagggaaagtcgttcgaggagatcgcggcagagttccaaaagaaatccggttcggcccacagaccgaaggcagccgtggagatgaagttcctcggagccaccgagactgtg

SEQ ID NO: 19465 - DNA, 1572 bp, Artificial Sequence
  Description of Artificial Sequence: Synthetic coding sequence
atgacggaggataaagtgacgggtactctggtgtttaccgtaattactgccgtgcttggttcctttcaatttggctacgacatcggagtcataaatgcgcctcaacaggtgataatctctcactaccgtcatgtcttgggggtgccactggacgatagaaaggcgattaacaactacgtgattaactccactgatgaactgccaactatctcatactcgatgaatccaaagccaactccatgggcagaagaagaaacggtggcagcagcccaactgatcaccatgctgtggtccctgagcgtgagctcgtttgctgtgggtgggatgactgctagcttctttggcggatggctgggtgacacgcttgggcgcattaaggcaatgctggtggcgaacattctgtctcttgtgggtgcactgctcatgggatttagcaaactggggcctagccacattctcataattgcaggtcgctctatctcgggactgtattgcggacttattagcggtttggtgccgatgtacattggtgagattgcgcctaccgcactgagaggtgcacttggaacctttcatcagctggcgattgtcaccgggatccttatatcccagataatcgggctcgaattcattcttggtaattacgatttgtggcatattcttctcggtctttccggagtgagggccatactccagtcgcttttgctgttcttttgtcctgaatcaccccggtacctctacattaaactcgacgaggaggtcaaagccaagcagtcattgaagcgcctgcggggatacgacgatgtgactaaagatatcaatgagatgcgcaaggaaagggaagaagcatcgagcgagcaaaaggtgtcaattatccaactgtttaccaacagctcatacagacagcctattttggtcgcactgatgcttcatgtcgcccagcaattctccggaataaacggtatattctactactcaacctcgatctttcagaccgctggaatctctaaacccgtgtacgcaaccattggagtcggcgcagtgaacatggtattcaccgcagtgtcggtgtttctcgtcgagaaggcaggaagaagatcgctcttcctgattggcatgagcggcatgttcgtctgtgcaatctttatgtcagtgggcctcgtgctcttgaataagttttcctggatgtcatatgtgtcgatgatcgcaattttcctttttgtgagcttctttgaaataggaccggggcctataccgtggtttatggtggcagagtttttctcccaaggtccacgaccggcagctcttgccatagcggcatttagtaactggacctgcaactttattgtggccctctgtttccaatacatcgcagacttttgtggcccttacgtctttttcctctttgccggcgtgttgctcgcgtttactctgttcactttcttcaaagtcccagaaaccaaggggaagtcgttcgaggaaattgccgcagaattccaaaagaagtcgggctccgcccaccgccccaaggccgcagtagaaatgaagtttcttggagcaactgaaactgtt

SEQ ID NO: 19466 - DNA, 1572 bp, Artificial Sequence
  Description of Artificial Sequence: Synthetic coding sequence
atgacagaagataaagttacaggaactctcgtgtttaccgttattactgccgttctgggcagttttcagttcggatacgatattggcgtgataaatgcaccccagcaggtgatcatctcgcattaccggcacgtgttgggagtcccactggatgacaggaaagccataaataattatgtaataaattctactgacgaattgcccaccatctcatattctatgaatccgaagcctaccccttgggcagaggaggagacagtggccgcggcccagctgatcacaatgttgtggagcctatcagttagctctttcgccgtcggtggaatgactgcctccttttttggtggctggctgggcgacacactggggcggatcaaagcaatgctggtggctaacatcctgtctctggtcggagctctgttgatgggctttagtaaactcggaccctctcacatcctcattatagctggccggtccatcagcgggctatattgcgggctgatatccggactcgtccctatgtacattggcgaaatcgcccctacagccctgaggggggcgttgggaacttttcatcagctcgctatcgtcactggcatactgataagccaaatcatcggactcgagttcatcctcggaaattacgacctatggcacattctgctcggattgtcaggcgtcagggccattctacagagcctcctccttttcttttgtccagaaagtccccgatacctgtatatcaaactagacgaggaggtaaaggcaaagcagagtctgaaaaggctcaggggctacgatgatgtaactaaggacataaatgagatgagaaaggaacgcgaagaggcctcctccgagcaaaaggtcagcatcattcaactatttacaaactccagttacagacaacctatactcgtggccctcatgctacatgtggctcagcagttctccggtatcaacggaatcttctattattctacaagcatctttcagactgccggtattagcaaacccgtttacgccaccatcggagttggggcagtgaacatggtttttacggccgttagcgtctttcttgtcgaaaaagccggtcggcgatcactatttctgatcggtatgagcggcatgtttgtgtgtgccattttcatgtcggtgggattggtcctgttaaataagttttcatggatgtcttacgtgtctatgatcgctatctttctgtttgtctcttttttcgagatcggcccaggaccgattccatggtttatggtggcagagttcttcagtcaggggcctagaccagccgcactcgcaatcgcagcttttagcaattggacatgcaatttcatcgtcgctttgtgttttcagtatatcgctgatttttgtggaccgtatgtattcttcctattcgccggcgtgctcctcgcttttactctgtttacatttttcaaggtgccggagaccaaggggaagagctttgaggaaatagctgctgaattccagaagaaatctggatcggcccaccggcctaaggcagccgtagagatgaagtttctgggcgcgacagagaccgtg

SEQ ID NO: 19467 - DNA, 1572 bp, Artificial Sequence; identical to SEQ ID NO: 19462
  Description of Artificial Sequence: Synthetic coding sequence

SEQ ID NO: 19468 - DNA, 1572 bp, Artificial Sequence
  Description of Artificial Sequence: Synthetic coding sequence
atgacggaagacaaggtgaccgggaccctggtcttcaccgtgatcactgccgtgctgggatctttccagttcggatatgacattggagtcataaatgcccctcagcaggtgataatctcccattatagacacgtgttaggagttcctcttgacgaccggaaggctatcaacaactacgtgatcaactccactgatgagctgcctacaatatcttactctatgaatcccaagccaaccccttgggctgaggaagagaccgtcgcagccgcccagctgattaccatgttgtggagcctgtccgtttcctctttcgcagtgggagggatgacagcttcatttttcggcgggtggctgggcgataccttgggtcggatcaaggccatgctcgtcgcaaatattctgtcactcgttggcgccctgctcatgggttttagcaagttgggcccgtctcatatccttataattgcggggagaagcatctctggcttgtactgcggattaatatccggcctggttccgatgtatattggagaaatcgcaccaacggccctccgaggcgctctgggtacctttcaccagctggcaatagtcactgggattctgatctcacagattattgggctcgagttcatactcggtaactatgacctgtggcacatcttgttaggcttaagtggggtgcgagccatactccagagtctgctgttgtttttttgtcctgagtctcctcggtacttgtacatcaagctggacgaggaggtgaaggcaaagcagtctctcaaaaggctgcgcggttacgacgacgtcaccaaagacatcaatgagatgcgaaaggagcgtgaggaagccagcagcgaacagaaagtatccataattcagctctttactaatagtagctaccgccagcccatcctggtagcactcatgctgcatgtcgcgcaacaatttagcggaattaatgggattttttactacagtacgtctattttccaaaccgcaggaatcagcaagcccgtgtacgcgacgataggggttggcgcggtgaatatggtgttcactgctgtgtctgtcttccttgtcgagaaggctggacggaggagtcttttcctgattggtatgtccggaatgtttgtttgtgctatttttatgtcagtcgggctggtgctactgaataaattctcctggatgtcctatgtcagtatgatagccatttttcttttcgtctctttcttcgagatagggcccggtcctatcccttggtttatggttgccgagttcttctctcagggcccaagaccagctgcactggctattgcggcttttagcaactggacatgcaactttattgtagctctgtgcttccagtatatagctgatttttgtggcccctatgtttttttcctgtttgctggggtcctgctggcattcactctctttactttcttcaaggtaccagaaactaaaggcaaatcttttgaggagatcgcagccgagttccaaaagaagagtgggtccgctcaccggcctaaggccgctgtggagatgaagtttttgggcgccaccgaaaccgtt

SEQ ID NO: 19469 - DNA, 1572 bp, Artificial Sequence
  Description of Artificial Sequence: Synthetic coding sequence
atgaccgaagataaggtgacgggcactctcgtgttcaccgtcattaccgccgtgctcggcagctttcaattcggctacgacatcggagtgataaatgcaccacagcaggtgatcatttcgcactaccggcatgttctcggggtcccgcttgatgaccgcaaggcaatcaataactacgtgatcaactccaccgatgaactgcccaccatcagctactcaatgaacccgaagccaaccccctgggccgaggaagaaaccgtggcagctgcgcaattgatcactatgctgtggtcgctgtcagtgagctcatttgcagtgggaggcatgaccgcatccttcttcggaggatggctcggcgatactctgggacgcatcaaagctatgttggtggctaatatcctgtccctggtcggggccctcttgatgggcttctcaaaactcggaccgtcgcacatcttgatcatcgcgggtcgctcaatctcagggttgtactgcgggctcatcagcggactggtccccatgtatattggcgagatcgccccaactgctttgcggggtgctctgggcactttccaccaactcgccattgtcaccggcatcctgatctcccagatcatcggactcgaattcattctgggaaattacgacctgtggcatatcctgttgggcctctctggcgtgcgcgccatcctgcagtcgctgctcctgttcttctgcccagagtcgccaagatatctctacatcaaactggacgaggaagtgaaggccaaacagtcattgaaaaggctccggggatacgacgacgtgaccaaggacatcaacgaaatgcgcaaggagcgggaggaggcttcgtccgagcagaaggtgtcgattatccagctcttcactaattcatcctaccgccagccaatcctggtggctctgatgctgcatgtggcccagcagttctccgggatcaacggtatcttctactactcaaccagcatctttcaaactgcaggaatctccaagccggtgtacgcgactatcggtgtcggtgcagttaacatggtgtttacggcagtgagtgtgttcttggtggaaaaggctggccgccggagtctgttcctcatcggaatgtctggcatgttcgtctgcgctatctttatgtcggtgggactggtgctgctcaacaagttttcgtggatgagctacgttagcatgattgccatctttctcttcgtctcgttctttgaaatcgggccaggacctatcccgtggttcatggtcgctgaattcttttcgcagggaccgcgccccgctgcgctggccattgctgctttttcgaactggacttgcaactttatagtggccttgtgcttccagtacatcgctgatttctgtggaccttacgtattcttcctcttcgctggagtgcttctggcgttcacgctgtttactttctttaaggtgccggaaaccaagggaaaatcgtttgaagagatcgcagcggaatttcagaagaagagcggcagcgcccaccgcccgaaggcagccgtggagatgaaattcctcggggcgaccgaaactgtc

SEQ ID NO: 19470 - DNA, 1572 bp, Artificial Sequence
  Description of Artificial Sequence: Synthetic coding sequence
atgaccgaggataaagttaccgggacactggtgtttacagtaattacggctgtgctggggtcgttccagttcggctacgacattggcgtgattaatgcccctcagcaagttatcatttcccactatcgccatgtgctgggggtacctctagacgatcgaaaagccatcaataattatgtaattaattcgaccgatgagctcccgaccatctcatactccatgaaccctaaacctacaccttgggccgaggaagaaacagtcgcggccgcacaattaattacaatgctgtggtcactgtcggtgagcagctttgcggtcgggggtatgacagcctctttctttggaggctggctgggagatacgctgggtcggatcaaggccatgctcgtagctaatatcttgagccttgttggcgccctgctgatgggattctccaagctgggtccttcccacattctcatcattgccggccgcagtatctctgggctctattgtggattaatctctggcttggttcctatgtacatcggagagattgcacccacagccctgcgcggcgcgttgggtacttttcatcagttagccatcgtgacaggaatcctcatttcccagattatcggccttgagttcatactcgggaattacgacctctggcacattctgctgggcctctccggtgtccgcgccatactccagagcctgctgctcttcttctgcccggagtccccgcggtacctgtatatcaagctggatgaggaggtcaaggccaagcagtcgctaaagaggcttcgcggatacgatgatgtcaccaaggacataaatgagatgcgaaaggagagagaggaggcgtcatccgaacagaaggtatctattatccagctgtttaccaactcttcatatagacaacccatccttgttgccctgatgttacacgtggctcaacagttctctggcattaatggaatcttttattatagcacgagcatcttccagactgctggcatcagtaagcccgtgtacgctactatcggagttggagctgtcaacatggtctttacggcagtgtccgtcttcctcgtagagaaggccggccggcgcagtctcttcctgatcggcatgtccgggatgtttgtgtgtgcaattttcatgtccgtgggacttgtactccttaacaaattttcctggatgtcttacgtgagtatgattgcgatattcctttttgtgagcttctttgaaatcggtccgggccccattccttggtttatggtcgctgagttctttagccagggacctagacctgcagcactggccattgccgccttttcaaactggacttgtaatttcatcgtcgcattatgcttccaatacattgctgatttttgtggtccttatgtcttcttcctgttcgctggcgtcctgctcgcttttaccttgtttacattcttcaaagtacctgaaacaaaaggaaagagcttcgaagagatagcagctgagttccagaaaaagtctgggtctgcgcaccgacccaaggccgccgtagaaatgaagttcttaggcgctacagagaccgtg

SEQ ID NO: 19471 - DNA, 1572 bp, Artificial Sequence
  Description of Artificial Sequence: Synthetic coding sequence
atgaccgaagataaggtcaccggtactctggtctttaccgtgatcactgcagtgctgggatcatttcaatttggatatgacataggagtgatcaatgccccacagcaggtgataatctcccattatcggcacgtcctgggcgtgccccttgatgaccgtaaggctatcaacaactatgtcatcaattctaccgacgaactgccaaccatctcatattcaatgaaccccaagcctactccttgggcagaagaggaaactgtggcagcggcacagctgataaccatgctttggtcactctcagtctccagctttgccgtgggaggtatgaccgccagtttctttggcggctggctcggcgataccctcggacgaataaaggcaatgctggttgctaatatcctctcccttgtgggagcactgctcatgggcttttccaagctcggcccgagccatattctgatcattgcaggtaggtccatatcgggtctttactgcggcctcatttcaggactcgtgcctatgtacatcggagaaattgcccctaccgcacttcgcggcgccctcgggacttttcaccaactcgcaattgtcacgggaattttgatttcacaaatcatcggactggaattcattcttggtaactacgatctttggcatatcctgctcgggctgagcggtgtgcgagcgatactgcaatccttgttgctctttttctgtcctgaatcccctagatacctgtatatcaaactggatgaggaagtcaaggcaaagcagagcctcaagagacttcgaggatacgatgatgtgacgaaggacatcaacgagatgcgaaaggagagggaggaggcctcatccgaacagaaagtgagcattattcaactgtttactaattcgtcctacagacagccgattcttgtcgcgttgatgctgcatgtcgcccagcaattctccggaattaacggaattttctactactccacttcgatattccaaactgctgggattagcaaaccagtgtacgcaaccataggcgtgggagctgtgaacatggtgttcaccgctgtgagcgtgtttcttgttgaaaaagcaggacgcagatcgctgtttctgattggcatgtcgggaatgtttgtctgcgcaatctttatgtcagtgggtcttgtccttctgaacaagttctcgtggatgtcctatgtctcgatgatagcgatcttcctttttgtgtccttcttcgaaattggacctggccccataccttggtttatggtggcagaattcttttcccaaggaccgcggcctgccgcacttgcaattgctgcattttccaactggacgtgtaactttattgtagcgctctgctttcaatacattgccgacttctgtggaccctacgtgtttttcctcttcgcaggggtcctgctggcattcaccttgttcaccttctttaaagtgcctgaaactaagggtaagagcttcgaagagatagccgcggaatttcagaagaaaagcggctctgcccatcgtcccaaggcagcagtggagatgaagtttctgggtgctaccgagactgtg

SEQ ID NO: 19472 - DNA, 1572 bp, Artificial Sequence
  Description of Artificial Sequence: Synthetic coding sequence
atgaccgaagataaagtcacgggcacactagtctttaccgtaatcaccgcggtgctcggatcgttccagttcggttatgatatcggggtgattaacgcaccccagcaggttatcatctctcactacagacacgtcctcggtgttccacttgatgacaggaaggccataaataattatgtgattaattccactgacgagttaccgacgatctcgtacagcatgaatcctaagccaacaccctgggcagaggaagagaccgtggctgccgcccagctcataacaatgctgtggtccctttcagtcagtagctttgccgttggcgggatgactgcttctttttttggtggctggctaggcgacactctgggcaggatcaaggccatgctagtagctaacatcctgtccctggtgggcgctcttctgatggggttctccaagcttggacctagccacatacttataatcgccggccgctccatttctgggttgtattgtggtctcatctcgggactcgtacctatgtatataggagaaattgcaccaactgctcttaggggggctctcggtacctttcaccaactagcgatagttactggcattttgattagccagatcattggccttgagtttatcttggggaattatgacctgtggcatattttactgggactgtccggtgtgcgtgctatactgcagagcctgctcttgtttttttgccctgagagcccacgctacctgtacataaaactggatgaagaggtcaaagctaaacagagcttgaaaagattgcgagggtatgacgacgtgactaaggacatcaatgaaatgagaaaagagagagaagaagctagctccgagcagaaggtgtctataattcagctgtttaccaacagctcctatcgtcagcccattctggttgctttgatgttgcacgtggcccagcagttctcagggatcaatgggatattttattactccacctctatcttccagactgccggaatttctaaaccggtgtacgctacaattggagtaggtgccgtcaacatggtctttaccgccgtgagcgtatttttggttgagaaggctggacgcagatctctgtttctgataggaatgagtgggatgttcgtttgtgctattttcatgtcggtagggctggtactgttgaacaagttctcctggatgtcgtatgtttccatgatagccatctttctctttgtgagcttctttgagatcggacccggtcccatcccatggtttatggtagctgaatttttttctcaggggcctcggcccgccgcccttgcgatagccgcattcagcaactggacttgcaatttcattgtagcactgtgttttcaatacatcgcggacttctgtggcccctacgtcttctttttgttcgccggcgtgctcctcgcctttacactgttcacatttttcaaagttccggaaacgaaagggaaatcctttgaggagatagccgccgaattccaaaagaagtcaggctctgcgcatcggcctaaggcagccgttgagatgaagttcttgggcgctaccgaaaccgtc

SEQ ID NO: 19473 - DNA, 1572 bp, Artificial Sequence
  Description of Artificial Sequence: Synthetic coding sequence
atgacagaggataaggtgaccgggacattggtgttcactgttattaccgctgtcctaggcagttttcagttcggctatgacatcggtgtgattaacgcaccgcaacaggtcatcatctcacattacagacacgtgcttggggtccctctggatgaccgaaaggccatcaacaattacgtaatcaacagtactgatgagctcccaaccatctcttacagcatgaacccgaaaccgactccctgggccgaggaggaaacagtggctgcggcacagctcatcacaatgctctggtcactcagcgtctcttcatttgcagttgggggcatgacagctagtttcttcgggggctggctgggggacacgctgggtaggatcaaagctatgctagtggcaaatattctatcactcgttggtgccctgttaatgggattcagtaaactggggcctagccacatcttgatcatcgccggtcgaagcatttctgggctgtactgcggactcattagcggattagtgcccatgtatattggggagattgcacctaccgccctaagaggcgcactaggaacttttcaccagttggcaattgtgactggaatcctgatcagccagattatcgggctagagtttatcctgggtaactatgacctttggcatatcttgttgggcctgtctggcgtacgggcaatactgcagagtctgcttcttttcttctgtccagaatcacccaggtatctgtatatcaagctggatgaggaggttaaggcaaaacagtccctcaaaaggttaagaggctacgacgacgttactaaagacattaatgagatgcggaaagagagggaagaggcaagctcagaacaaaaggtcagtatcattcagttgtttaccaactcatcttacagacagcctatcctcgtggctctgatgctgcacgttgcgcagcagttttccggcatcaacggaatcttttattatagtaccagcatcttccaaactgcaggaatctccaagccagtgtacgcgactataggagtgggagcggtgaacatggtttttactgccgtctccgtcttcttggtggagaaggcagggaggcggtccctgtttcttatcggaatgtcaggaatgtttgtttgcgccatctttatgtccgtaggcctggttctgctgaacaagttttcttggatgagctacgtctcaatgatagcgatcttcctattcgtcagtttctttgagatcggacctggccctattccttggttcatggttgcggaattcttttcgcaaggaccaaggccagccgcccttgctatcgcagcattctctaactggacatgtaactttattgtggccttgtgtttccagtatatcgccgatttctgcggcccctatgttttttttttattcgctggcgttctgctggcctttacactctttaccttcttcaaggtgccagaaacaaaggggaagtcatttgaggagattgcggcagaatttcagaaaaaaagtggcagcgcacatagacccaaggccgcagtagagatgaagtttctaggcgcgaccgaaacagtc

SEQ ID NO: 19474 - DNA, 1572 bp, Artificial Sequence
  Description of Artificial Sequence: Synthetic coding sequence
atgactgaggataaggtgaccggtaccctggtgtttaccgttatcacggctgtgttgggtagtttccagttcggatacgatatcggcgttataaacgcaccacagcaggttatcatatcacattatcgccatgtgcttggcgttcccctcgatgaccgcaaggcaattaacaattacgtgatcaattcaacagacgaattgcccacaatctcctacagcatgaaccccaaacccacgccttgggcggaagaggagaccgtcgcggcagctcagttgatcacgatgctctggagcttatccgtctcatcatttgccgtcggaggaatgactgctagctttttcggagggtggctgggagataccctgggccggatcaaagcaatgctggttgccaatatcttgtctctggtcggagctctgctgatggggttcagtaagctcgggccctctcacatactgattatcgccggccgctcaatcagtggattatattgcgggctgatctcaggactggttcctatgtacattggcgaaatcgctccgacagccctgcggggggccttgggaactttccaccaactggctatcgtcacaggtatcctgatttctcagattatcggcctcgagttcatcttgggtaactacgatctctggcatattcttctgggacttagtggggtgagagcaattctgcagtcattactcttgttcttttgcccagaatctccccgttacctgtatattaagctcgacgaggaggtgaaggcgaagcaatctctgaaacggctccggggctatgatgatgtgaccaaagacattaatgaaatgagaaaggaacgtgaggaagcaagctcagagcagaaagttagcattattcagctgttcacaaacagcagctatcggcagcctattttggtggccctgatgctacacgttgcccagcaattctctgggataaatgggatcttttactattccaccagtatctttcagacggcgggcataagtaaacctgtatacgccaccattggcgtgggagcagttaatatggtttttaccgctgtgagtgtgtttctcgttgaaaaggcaggtcgcaggtcccttttcttaatcggcatgtccgggatgtttgtatgcgccatcttcatgtctgtgggcttggtcttgctgaataaattttcatggatgtcttatgtgagtatgattgctattttcttgttcgtgagctttttcgaaatcgggccaggccctatcccatggtttatggtcgctgaatttttctcccagggaccccgtcctgctgccttggcaatagctgcctttagtaactggacttgtaacttcatagtagccctgtgcttccagtacatcgctgacttctgcggaccctatgtgtttttcctcttcgccggagtactgctggcgtttaccctgtttactttctttaaagtgcccgagaccaaagggaaatcttttgaggagatcgctgccgaattccagaagaaatcagggtctgcacaccgtcctaaggctgccgtggagatgaaatttctgggcgctacagagactgtc

SEQ ID NO: 19475 - DNA, 1572 bp, Artificial Sequence
  Description of Artificial Sequence: Synthetic coding sequence
atgactgaagataaagtgaccggcaccctcgttttcaccgtgataaccgcagtgctgggtagctttcagttcggatatgatatcggcgtgataaatgctcctcaacaggtgattatatcccattatcggcatgtactgggggtgcccctggacgaccggaaagctatcaataattacgtgatcaattccaccgacgaactccccaccatttcctatagtatgaatcccaagcctacaccctgggcagaggaagagaccgttgctgccgctcagcttataacaatgctgtggagcctgtccgtgtcttctttcgccgtgggagggatgacagcttccttctttggcggctggctgggagacacccttggaagaattaaggccatgctcgtggcaaacatcctgtccctggtcggagctctgctaatgggctttagcaagttaggtccaagccacattctgatcattgctggccgatctatcagtggcctctattgcggtctaattagtggtttagtccctatgtacattggggagatcgccccaaccgctctgagaggcgctctcggcactttccaccagctcgccattgtgaccgggatcctgatttcccaaattatcggacttgagtttatcctaggcaactacgatctgtggcacatcctactggggctgtccggagttcgtgcaatactgcaatcactgctcctgttcttctgccctgagtcaccacgttatctgtatataaaactcgatgaggaggtgaaggcaaagcaatctctgaaacggctacgcgggtacgatgatgtaaccaaggatattaacgagatgcgcaaagaaagggaggaagccagcagtgaacaaaaagtgtctataatacaactgttcactaactcctcctatcggcagcctattcttgtggctctgatgctgcacgtggctcaacagttcagcgggattaatggcattttctattactctacttcaatatttcagacagccggaattagtaaacctgtgtatgctactatcggcgtgggagccgttaatatggtttttactgcagtgtccgtattcctggttgaaaaggccggaagaagaagcctattcctgattggcatgtctgggatgtttgtttgcgccatattcatgagcgtgggcctggtgctactgaacaagttttcctggatgtcatatgtcagcatgatagctatattcctgttcgtttcctttttcgagatcggccccgggcctattccctggttcatggtcgccgagttcttttctcaggggcctcgaccagccgcactagctattgctgcattctctaattggacttgtaacttcatcgttgccctgtgtttccaatacattgcagatttctgcggtccatatgttttctttctatttgccggcgtgctgctggctttcactctgttcacatttttcaaggtcccagagaccaaggggaaaagcttcgaagagattgcagctgaattccagaaaaagagtggttccgctcaccgacccaaagccgcagttgagatgaagttcctgggcgctaccgagactgtt

SEQ ID NO: 19476 - DNA, 1572 bp, Artificial Sequence
  Description of Artificial Sequence: Synthetic coding sequence
atgacagaagacaaggtaactggcacactggtgtttaccgttatcaccgcggttctgggctcctttcagtttggctatgacatcggcgtgataaatgcgccgcagcaggtgattatcagccactatcgacacgttctaggcgtgccgttggacgatcgcaaggcaatcaacaactacgtgattaactccactgatgaactacctaccatctcatactcaatgaaccccaagcccacgccatgggctgaagaggaaactgtggccgccgcccagctcattacgatgctgtggtcattgtcggtcagctcgttcgcggtgggcggaatgaccgcctcatttttcggtggttggttgggcgacaccctgggaaggatcaaagccatgttagtagccaacatcctgtccctcgtgggcgccctgttgatgggcttcagcaaactgggtccgtctcacatcctaatcatcgccggaaggagtatctccggcttgtattgtggtttaatcagcggtctggtgccaatgtatataggcgagattgccccgacggccttgcggggtgcgctaggcacgtttcaccagcttgctatcgtgaccggcatcctgatatcgcagatcatcggcttggagttcattctgggtaattacgatctgtggcacatccttctcggactgtcgggtgtgcgcgcaatcctgcaatctctgctgctgtttttctgccccgagagtccgcgatatctgtatataaagttggatgaagaggtgaaggccaagcagagtttgaagcgccttcgtggctatgacgatgtaaccaaagatatcaatgaaatgcgcaaggagcgtgaggaggcttcgtccgagcagaaggtctcgatcatccagttgttcactaactcatcctacagacaaccgattctggtggccctcatgctgcacgttgcccagcaattcagtgggataaacggcatattttactacagcacctcaattttccaaacagctggcatctctaagcctgtctacgcgactatcggcgtcggcgctgtcaatatggtttttaccgccgtgtccgtatttctggttgaaaaagccggccgccgaagcctattcctgattggtatgtcgggaatgttcgtgtgcgcgatctttatgtctgtcggactggtgttgctgaataagtttagctggatgtcttacgtgagtatgatcgcaatttttcttttcgtcagcttcttcgagattggtcccggtccaattccctggttcatggtggccgaattcttcagccagggtccccgccccgccgctctggccatcgccgcattctccaactggacgtgcaactttatagtagccctgtgctttcaatacatagccgatttttgtggaccctacgtgttcttcctgttcgccggagtactgctggccttcacactgttcaccttctttaaggtaccagaaacaaagggcaagagtttcgaagaaatcgccgcagaatttcagaagaaatcaggctccgcccaccgtccaaaggcggccgtggaaatgaagttcttgggcgctactgaaaccgtt

SEQ ID NO: 19477 - DNA, 1572 bp, Artificial Sequence
  Description of Artificial Sequence: Synthetic coding sequence
atgactgaggacaaggtcacaggtacactggtcttcacagtcatcaccgccgtcctcggttctttccagtttggttacgacatcggagtaatcaatgcaccccaacaggtcataattagccattacaggcacgtactcggcgtacccctggacgacaggaaagctatcaataactacgtgatcaactctaccgatgagttgcctactatatcttactccatgaacccaaagcctactccttgggctgaggaagaaaccgtcgcagctgcccagctcatcaccatgctctggtcactcagcgtttcctcattcgctgtaggtggaatgacagcatcctttttcggcggctggcttggcgataccctgggtagaattaaggccatgcttgtcgccaatatccttagccttgtgggtgccctccttatgggattcagtaagctgggtccttctcatatcttgatcatcgctggccgttctatttccggtctgtactgcggattgatctccggcctcgtgcccatgtatatcggcgaaatcgcaccaacagctctcaggggagccctgggcactttccatcagctggctatagtgacaggaattttgattagtcaaataattggcttggagttcatactgggcaattacgatctgtggcacatactgcttggactgtctggagtgcgtgctattctccaatcactgttgttgttcttttgtcccgagtcaccccgttacttgtatattaagttggatgaagaggtgaaggctaaacagtccttgaagaggcttagaggctatgacgatgtgactaaggacatcaacgaaatgcgcaaggaacgcgaagaggcttcatctgaacagaaagtgtctataatccagctcttcaccaactcttcttatcgtcaaccaatccttgttgctctgatgctccacgtcgcccagcaattttccggaattaacggaatattttactacagtaccagtatatttcagactgccggcatctccaagccagtgtacgcaaccattggcgtcggagccgtaaacatggtattcacagccgtaagtgttttcttggtggagaaggcaggcaggcgttctctgttccttataggcatgagtggaatgttcgtatgtgccatcttcatgtctgtgggcctggtccttctgaacaagttttcttggatgtcctacgtttcaatgatagccatctttttgtttgtttcatttttcgagatcggtcctggccctattccttggttcatggttgcagagttcttttctcaaggacccaggcctgcagcccttgctatcgctgccttctctaattggacttgcaatttcattgtggccttgtgtttccaatacattgccgacttctgtggtccctatgtcttcttcctctttgctggcgttcttctcgcattcacactttttactttctttaaggtgcccgagaccaagggcaaatctttcgaagaaatcgccgcagaatttcaaaagaaatctggctcagcccataggcctaaggccgccgtggagatgaaatttttgggtgccactgaaacagtg

SEQ ID NO: 19478 - DNA, 1572 bp, Artificial Sequence
  Description of Artificial Sequence: Synthetic coding sequence
atgaccgaggacaaagtgactggtacccttgtgttcacagtcatcactgccgtccttgggtctttccagttcggatacgacattggcgtgatcaatgccccccagcaggttattatctctcattatcggcatgtgcttggggtgccactggatgatcgcaaggccattaacaactacgtgatcaatagtaccgacgagttgcctacaatttcctattcaatgaatcctaagccaacaccatgggctgaggaagagacagtggctgccgctcagctcattacgatgctgtggtccttatcagtcagctctttcgccgtgggaggcatgactgcttcctttttcggaggatggctcggcgacactctgggcagaatcaaggcaatgctggtagctaacattctctccctggttggggccctgctgatggggttctcaaagttggggccatcacacatccttataatcgctggtcggtcaatcagtggactgtactgtggcttaatatcaggcctcgttcctatgtatatcggcgagatcgcaccaacggctcttaggggtgcactggggacctttcatcaactggccattgtaaccggcatactcatctcccagattattggtctggagttcattctgggcaactatgacttatggcatatcctccttggactcagcggagttcgagctatccttcagagtctcctgctattcttttgccccgagtctcctaggtatctgtatattaagctggacgaggaagttaaggctaagcagtctcttaagagactgcggggctatgatgatgttacaaaagatatcaacgaaatgaggaaggagagagaggaggcatccagcgagcagaaggttagcataatccagctgttcaccaattctagttaccgtcagcctatcctcgtggcactcatgctgcacgtggcccaacagttcagtgggattaacggcatcttttattatagcacttccattttccagacagctgggatctccaagccagtttacgctactataggcgtgggcgctgtgaatatggttttcactgccgtgtccgtgtttctagtcgaaaaagccggacgccggagcctgttcctgatcggcatgtcgggtatgttcgtgtgtgcaatctttatgtccgtggggttggtgctgctcaataaattttcctggatgtcctacgtttctatgatcgcgattttcttgttcgtatcattcttcgaaatcggtcctggccccataccatggtttatggtggccgagtttttttcccaggggcccaggcccgccgccctagctattgcagcgttcagcaactggacctgtaatttcatcgtggccctatgtttccagtacatcgcagatttttgtgggccctacgtgttttttttgtttgcaggagtccttctggcatttaccctgttcaccttcttcaaagtgcccgaaaccaaagggaagagttttgaagagatagccgccgaatttcagaagaagtctggatctgcccataggcctaaagctgccgtggaaatgaagtttttgggcgccacagaaacggtc

SEQ ID NO: 19479 - DNA, 1572 bp, Artificial Sequence
  Description of Artificial Sequence: Synthetic coding sequence
atgacagaggataaggtcactggtacgcttgtgttcacagtaattaccgccgtcctgggatcctttcagtttggttacgacatcggtgtgatcaacgccccccagcaagtgataatttcacactatagacatgtgcttggtgtcccattggacgatcgcaaggctattaataattatgtcattaattctacagacgagctgccaaccatttcttattctatgaatcccaagccgacaccgtgggccgaagaggaaactgtggccgcggctcaactcatcaccatgctgtggtctctatcggtttcttcgttcgctgttggcggaatgactgcatcgtttttcgggggctggctgggggatacactcggcaggatcaaggctatgcttgtcgccaatatcttgtcactggtgggcgcccttcttatgggattcagcaagttggggccgagccacatccttataatcgccggtaggtcgatcagtggcttgtactgtggccttataagcggtctggtccccatgtatatcggcgagatcgcgccaactgcgctccgcggggcgctaggcacattccaccagctcgccatcgtgacgggcatcctcatttcccagattattggtctggagttcatcttgggcaattacgacttgtggcacatccttctgggattgtctggcgttcgtgcgatccttcaaagcctgctgttgttcttttgtcccgaaagtcctcgctatctttacataaagctagatgaagaagtgaaggcaaagcagtcgttgaaacgtctccggggctacgacgacgtcacaaaggacattaacgagatgcgtaaggaacgagaggaagcttcgtccgaacagaaggtttcgatcatccagttgttcaccaactcgtcatatcgccaacccattctagtcgccctcatgttacatgttgcacagcagttttccgggatcaacggcatcttctattattctacatcaatctttcaaactgctgggataagtaagccggtctacgctaccatcggagttggagcggttaacatggtgttcactgctgtctcggtgttcttggtcgagaaggctggacgtcgctctctcttccttatcgggatgtctggaatgttcgtttgcgccatttttatgagtgtaggtctggttctattaaataagttctcttggatgagttacgtgtctatgatcgccatatttcttttcgtgtcttttttcgaaatagggccggggcccatcccctggttcatggtcgcggaatttttttcacaaggaccgcgcccggcggcattggctatcgccgcgttctctaactggacatgtaatttcatcgtggccctctgtttccagtacatcgctgatttctgcgggccctacgtcttctttttgtttgctggcgttttgctcgcgtttaccttgttcaccttcttcaaggtgcctgaaactaaggggaagtcgttcgaggagatcgctgctgaattccaaaagaagagtggtagtgctcatcgccccaaagccgcagttgagatgaaattccttggcgcaaccgaaacagtc

SEQ ID NO: 19480 - DNA, 1572 bp, Artificial Sequence
  Description of Artificial Sequence: Synthetic coding sequence
atgacggaggacaaggttactggaaccctggtatttaccgtgattacagccgtcttgggttcctttcagttcggatacgatatcggggtcatcaatgcacctcaacaagtgattatttcccactatcggcacgtcttgggtgtaccactcgacgatcggaaagcaattaataattacgtgatcaactcaaccgatgagctgcctaccatttcctacagtatgaatcccaagcccaccccctgggctgaagaggaaacggtagcagccgctcaacttattaccatgctctggtcacttagcgtgtcttcgttcgccgttgggggcatgacagctagctttttcggagggtggctgggcgataccctaggtcgcatcaaggctatgctagtcgctaacatacttagcttggtgggtgcgctgctcatgggcttcagcaaactgggaccatctcacatccttatcattgccgggcgcagcatctcaggcctgtactgtggccttattagtggactggtgccaatgtatatcggcgagatagcacctacagcgctgaggggcgcgctcggcactttccaccagctagccattgtgacaggcatactgatctcgcagataatcgggctcgaatttatcctggggaactacgacctctggcatattcttctgggtctgagcggggtgagggccatccttcagtcactcttgttgttcttctgccccgaaagcccaaggtacctgtacattaagcttgacgaggaggtaaaggcgaaacagtccctcaagcgtctgcgcggttacgacgacgtgacgaaggatattaatgagatgcgaaaggaacgcgaagaggcaagtagcgagcagaaggtctccattatccagctgttcaccaacagcagctatagacagccgatactcgttgccctgatgttgcacgtggctcagcaattctctggcatcaatgggattttctactacagcacttccatattccagaccgcaggaataagcaaaccggtgtatgctactatcggcgtcggcgccgttaatatggtgtttacagctgtttctgtattcctggtggagaaggcaggacgccgcagcttatttctaataggtatgtctgggatgttcgtgtgtgctatcttcatgtcagtggggctggtcctactgaacaagttttcctggatgtcctacgtcagtatgatcgcaatctttctgttcgtcagtttctttgaaattgggcccggccctatcccatggtttatggtcgctgaattcttctcccaaggtccgagacccgcagcactcgccatcgccgcgttctccaactggacttgcaatttcatcgtggcattgtgctttcaatatatcgcagacttttgcggaccctatgtgttctttctatttgccggggtgctgctcgcattcacactgtttaccttctttaaggtgccggagacaaaggggaagagctttgaggaaatcgccgcagaatttcaaaaaaaatccggctccgcgcataggccgaaggcggcggtggagatgaagttcctcggggctacagagaccgtt

SEQ ID NO: 19481 - DNA, 1572 bp, Artificial Sequence
  Description of Artificial Sequence: Synthetic coding sequence
atgacagaggataaggttactggaacactggtctttacagtgatcacagccgtgctgggaagttttcaatttgggtatgatatcggggtgataaatgcgccccagcaggtgattatatcccattatcggcacgtgttaggagtaccactagacgatcggaaagccatcaataattatgtgatcaatagtactgatgaactccccacaataagttatagtatgaacccaaaacccactccatgggccgaagaagagacagttgccgctgcacagctcatcacaatgctctggtccctgtctgtgtcttcctttgcagtgggaggaatgacagcctccttcttcggagggtggctcggagatactcttggaaggattaaagccatgctggttgcaaatatactgtcactggtcggagcactgctgatggggttcagtaaacttgggccttctcacattctgatcatagctggacgctcaatatcgggactttattgtggactcataagtggactcgtaccaatgtatatcggggaaattgcacccacagcccttcggggggctctagggacttttcaccagcttgcaatcgtgactgggatcctcatttctcagatcataggactagaattcatcttgggaaattatgacttatggcacatcctgctggggctctcgggagtgagagcgattctacagtctctcttactttttttttgccccgagtctcctcggtacctctacattaaactcgatgaagaagtcaaagcaaaacagtccctgaagagactacgcgggtatgatgatgttacaaaagacattaatgagatgaggaaagagcgggaagaagcatcctctgaacagaaagtgagtatcattcagctcttcacaaactcctcttatagacagccaatactggtggcactgatgctgcatgtggctcagcagttcagtgggattaacggaatattctattattctacaagtatcttccaaactgcagggatttctaaacccgtgtatgcaacaatcggggtgggggcagtcaacatggtgttcacagccgtgagtgtgtttttagtggagaaggctgggaggaggtctctctttctgatcggaatgtccgggatgtttgtctgtgctattttcatgtcagttgggctcgtgctgctaaacaaattctcctggatgagttacgtttccatgatagcaatcttcctgttcgttagtttcttcgaaatagggcctgggcccataccctggttcatggtcgccgaatttttctctcagggaccccggcccgccgcactcgctatagccgctttttctaattggacttgcaattttattgtggccctctgctttcagtatattgctgatttctgtggaccctatgtctttttcctgtttgccggggtacttctagcttttacactcttcacattctttaaagtacccgagacaaaaggaaaatcgtttgaagaaatcgccgccgagttccagaaaaaatcaggatcagcccatcggcctaaggccgccgtggaaatgaaatttctgggagctactgaaacagtc

SEQ ID NO: 19482 - DNA, 1572 bp, Artificial Sequence
  Description of Artificial Sequence: Synthetic coding sequence
atgacagaggacaaggttacaggcactcttgtgttcacagtaataacagccgtgcttggctcattccagttcggctacgacattggagtgataaatgccccacaacaagtgatcatctcccattaccgacatgtgctcggagtgcccctcgatgaccgcaaagccatcaacaactacgttattaacagcactgatgaactcccgaccatcagttactccatgaatccaaagcccacaccgtgggcagaggaggaaacggtggcagccgctcagctgatcactatgctctggtcactcagcgtctctagttttgccgtgggaggcatgacggcgtccttttttggtgggtggcttggtgatactctgggacgcatcaaagcaatgctggttgctaatatcctgagcctggtgggtgctttgttgatgggattcagtaagctgggtcccagccatattctgataatcgccggtcgctccatatccggcctgtattgtggtctcatcagtggtctggtcccaatgtatatcggcgagatcgcccctacagctctccgcggagcgttgggcacgtttcaccagctcgcgatcgtaaccgggattctcatctctcagatcattggcctggagtttatcctcgggaactatgatctctggcacatcctgttgggactgagtggcgtccgcgccatccttcagagcctgcttcttttcttctgccccgagagtccacggtatttgtacatcaaactcgatgaagaagtcaaagctaagcagagtctcaagaggttgcgcggatatgacgatgtgacaaaggatatcaacgagatgagaaaggagcgcgaggaagcgtcaagtgagcaaaaggtctctatcatccagcttttcactaacagctcctatagacagccaatcctggttgcgctgatgctgcatgtggctcagcagttctctgggatcaatggtatcttctactactctacctctatcttccagacagctggaattagcaagccagtctatgcaaccataggcgtgggtgcagttaacatggtgtttaccgctgtctctgtgttcttggtcgaaaaggccgggcggcgcagcctgtttctgataggaatgagcggcatgttcgtatgcgctatattcatgagcgtgggcctggtgctgctcaacaagttttcctggatgagttacgtatccatgattgccatcttcctgtttgtcagcttttttgagatcggcccaggtccgatcccctggttcatggtagccgagtttttttctcagggaccccgccccgccgctttggccatcgccgccttcagcaactggacatgtaactttattgtcgctttgtgtttccagtatatcgcggatttttgcgggccatacgtgttcttcttgtttgctggcgtgctgctggcttttaccctcttcacttttttcaaggtgcccgagaccaaaggcaaatctttcgaggagattgccgccgagtttcaaaagaagagtgggagtgcccacaggccaaaagccgctgttgagatgaagttcctgggagctacggagacagtc

SEQ ID NO: 19483 - DNA, 1572 bp, Artificial Sequence
  Description of Artificial Sequence: Synthetic coding sequence
atgacagaagataaagttaccgggacccttgtatttaccgtgattactgctgtgttggggagtttccaattcggatatgacattggcgtcatcaatgcaccccagcaggtgataatcagtcattacagacacgtccttggtgtgcctctggatgatcgaaaggctatcaacaactacgtgattaacagtacggacgaactgccaacaatttcatacagcatgaatcctaagcccactccctgggccgaggaagagaccgttgcggctgctcaactgatcaccatgctgtggtccctgtctgtttcaagctttgctgtcgggggaatgactgcaagcttcttcggcggatggttgggggacacccttgggcgcataaaagcaatgctcgtcgctaatattctgtctctggtgggtgctcttcttatggggtttagtaaactcggcccttcccatatcctgattatcgcgggtagatccatctcaggactgtactgcggcctcatatccgggttagtgcccatgtatatcggagagattgccccaacagctttgcgcggcgctcttggcacattccatcagctggctatagtcaccggcatcctcatcagtcaaataatcggtcttgaattcatccttggcaactatgatttgtggcacatactgctcggactgtccggcgtgagggcaatcctccaaagcctgctgttgtttttctgccctgagtcccctcggtacctgtatataaaactcgacgaggaggttaaggcaaagcagagcctgaagagactgagaggatacgacgacgtgactaaggatattaacgaaatgagaaaagagagagaggaagcttcaagcgagcagaaggtcagcatcatccagctgttcacaaatagcagctatagacagccgatccttgtggcacttatgttacacgtggcacaacagtttagcggaataaacggaatattctactactccacctccatcttccagacagctggcatcagtaaaccggtctatgcaacaattggagtcggagccgtgaatatggtgtttacggccgtgtcagttttcctggttgaaaaggcaggtcgtaggagcttgtttctgattgggatgagtggcatgtttgtgtgcgctatcttcatgtctgtgggactggtcctgcttaacaaattttcttggatgagctacgtctctatgatcgctatctttcttttcgtgagtttctttgagatcggcccaggtcccatcccttggtttatggttgctgagttttttagtcaagggcctcgccctgccgctctggctatcgcagcttttagcaactggacctgtaatttcattgtggcactttgcttccagtatattgcagacttttgtggcccttacgttttctttctgtttgccggcgtgctcctggcttttactctgttcacatttttcaaggtcccggaaaccaaggggaagtccttcgaagaaattgccgctgaattccagaaaaaatccggaagcgcgcacaggcccaaggccgctgtcgagatgaagtttctgggcgcaactgagacggta

SEQ ID NO: 19484 - DNA, 1572 bp, Artificial Sequence
  Description of Artificial Sequence: Synthetic coding sequence
atgaccgaagacaaagtgaccgggactctcgtcttcactgttattaccgctgtcctcggctcctttcagttcggttacgacatcggggttatcaatgctccccagcaggttatcatctctcactaccgacatgtcctcggcgtccccctcgatgatcgaaaggcgatcaataactatgtgatcaactccaccgacgaactgcccaccatttcctacagtatgaatccaaagccaacaccgtgggctgaagaggaaaccgtggcggcagcacagctcataacgatgctatggtccctgtcggtaagcagcttcgcagtgggcggtatgacggcctccttctttggaggttggctgggcgataccttgggccggattaaggccatgctggttgctaacattctcagcctcgttggcgcccttctcatgggcttcagcaagctcgggccttcccacatccttattatcgcaggcaggtccatctctggcctgtactgcggcttgatttcgggcctcgtccctatgtacattggcgagattgcccctaccgcgctgcgcggtgccttgggcacctttcatcagctggcaatcgttactggcatcctcatctcccagataattggcttggagttcattctgggtaactacgatctatggcacatcttgctcgggctcagcggtgtgcgtgcgatcttgcagagtttgctgttgttcttctgccctgagagtccccggtacctgtacataaagctggacgaggaagttaaggcgaagcagagtctgaagcgtcttcgtggttacgacgatgtgactaaggacatcaatgagatgagaaaggagcgtgaggaggcctcgtcggaacaaaaggtctcaatcatccagctcttcacgaactcgtcataccgccaacccatcctggtggcgctgatgctccacgtcgcccaacaattcagcggcatcaacggcattttttactactccacctcgatctttcaaaccgcgggtatcagcaaacccgtgtatgccacaatcggagtcggcgctgtcaacatggtcttcactgcagtctctgtcttccttgttgagaaggccggtcgccgcagcctgtttttgattggcatgtccggcatgtttgtctgcgcgatcttcatgagtgtcggcttggtcctgctgaataagttctcttggatgtcttacgtctccatgatcgctatattcctgttcgtgtctttcttcgaaatcggccctgggccaatcccctggtttatggtcgctgagttcttctctcagggtcctcggccggctgccttggcgatcgccgccttctccaactggacttgcaacttcattgtcgctctgtgctttcagtacatcgccgatttctgcggcccgtacgtcttcttcctcttcgctggagttctgttggcctttacactgtttaccttctttaaagtgcctgagaccaagggaaagtcgtttgaagagattgccgctgaattccagaagaagagcggttcggcgcatcggcctaaagctgcggtcgagatgaagttcctaggcgctaccgagaccgtt

SEQ ID NO: 19485 - DNA, 1572 bp, Artificial Sequence
  Description of Artificial Sequence: Synthetic coding sequence
atgaccgaggataaggtgacagggaccttagtcttcactgtcatcaccgcagtgctgggcagcttccagtttggatatgatattggagtgatcaacgctccccaacaggtgatcataagccattaccgccacgtgctgggggtgccactggacgacagaaaggctatcaacaattacgtgatcaattccacagatgagttaccgactatcagctatagtatgaatcccaagcccaccccttgggcagaggaggaaaccgttgcggcggcacagcttatcactatgctgtggagcttatctgtgagctccttcgcagtgggtggcatgactgcatcctttttcggaggatggttaggcgacactctaggccggataaaagctatgctggtggccaacatcttgtccctggttggtgcgctcctgatgggctttagcaagctgggtcctagtcacatcctgatcatcgcagggcgtagcattagtgggctttattgcggcctaatatctggactcgtaccaatgtacatcggggagatcgcccccacagccctacggggagctttagggacgtttcaccaactggcaatcgtaaccggcatactgatttctcaaataatcggcctggagttcatcctaggtaattatgatctttggcacatcttgctcgggctgtccggcgtgagagcgatactccagtcactcctgctgttcttttgtcctgaatcacccaggtatctgtacattaaactggacgaggaggtgaaagccaaacagagtttaaaaaggctgcgggggtacgatgacgtaaccaaggacatcaacgagatgagaaaagagagagaggaagctagcagcgagcaaaaggtctctattatacagctgttcacaaactcttcctaccggcaacctatcctggtagccctgatgttacatgtcgctcagcagttctccggtatcaacggcattttttattattcgacctctatctttcaaactgccggcatttcaaagcccgtctatgcaactatcggcgtcggcgcagttaacatggttttcaccgccgtctccgtgtttctcgtggaaaaagctggacggcgctccctgttcctgatcggaatgagcggcatgttcgtgtgtgccatcttcatgagcgtgggtttggtcctgctgaataagttcagttggatgagttacgtcagcatgatagccatttttcttttcgtgagcttcttcgaaatcggaccaggccctattccttggttcatggtggcagagtttttttcccagggaccacgccccgccgcattggcaattgcagctttctccaattggacctgcaacttcatcgtcgcgctctgcttccagtatatcgccgatttctgcggtccatacgtattctttctgtttgcaggagttctgctagccttcacactcttcaccttcttcaaggtccccgagaccaagggtaagtccttcgaggagatagccgcagagttccagaagaagtctggcagcgcgcatcgacccaaagctgccgtggagatgaagttcctgggtgctaccgagacggtt

SEQ ID NO: 19486 - DNA, 1572 bp, Artificial Sequence
  Description of Artificial Sequence: Synthetic coding sequence
atgactgaggataaggtcaccgggacacttgtgttcactgtgattaccgccgtgctgggcagtttccaatttgggtacgatataggggtgataaatgcaccgcagcaagttattataagccactaccggcacgtgttgggcgtgcccctggatgatcgcaaggccatcaacaactacgtcattaactccaccgacgaattgcccactattagctacagcatgaatccgaagccaacgccgtgggccgaggaagagacagtggctgctgctcagctgattaccatgctgtggagtttgtcggtgtccagttttgccgtcggagggatgacagccagtttctttggcggttggctcggcgacactttaggacggatcaaagctatgcttgtggcgaatattttgtctctcgtgggcgccttactgatggggttctcgaagctggggccctcccatattctgatcatcgcaggccgaagcattagtggcctgtattgtggactcatctcaggcttagtccccatgtacatcggcgagatcgccccaactgcccttcggggcgctctaggcaccttccatcagttagccatcgttaccggcatactgatcagccagattattgggctggaattcatcctggggaactacgatttgtggcacattctgctcggcctgtcaggagttcgagctattcttcagagtctcctgttgtttttttgcccagagagcccgaggtacctctacataaaactggatgaggaagttaaggccaagcagtccttgaagaggctgagggggtatgatgacgttaccaaggacatcaacgaaatgagaaaagagagagaagaagcgtcctccgaacagaaggtgagtatcatccagctttttacgaatagctcctaccgacagcccatcctggtggctctgatgctgcatgtagcacagcagttttctggcattaacggaatattctactacagcaccagtatctttcagaccgcaggaataagcaagcctgtgtacgctactattggtgttggcgctgtgaatatggtgttcaccgcagttagcgtatttctcgttgagaaggctggacgaagaagcctgtttctgattgggatgtcaggaatgtttgtgtgcgctatattcatgagtgtgggcttagtgctgctgaataaattctcatggatgagctacgtgtccatgattgctatctttctattcgtgtcttttttcgaaattggtcctggccccataccttggtttatggtggcggaattcttttctcaagggccgagacccgccgctcttgctatcgcagccttctcgaactggacctgtaactttatcgtggccctgtgctttcagtatatcgcagacttctgtggaccgtacgtcttttttctctttgcaggcgtgctcctcgcattcaccttgttcactttctttaaggttccggagactaagggcaagtcgtttgaagaaattgccgccgaattccagaaaaagtctggttcagcccacaggcctaaggcagcagtagaaatgaaatttttaggagcaacagagaccgtg

SEQ ID NO: 19487 - DNA, 1572 bp, Artificial Sequence
  Description of Artificial Sequence: Synthetic coding sequence
atgaccgaggacaaagtgacgggaaccctagtgtttactgtgattaccgccgtcctaggtagtttccagttcggatacgatatcggggtgataaatgctccacagcaggtcatcatctctcattaccggcacgtcctgggcgtgccactggacgatagaaaagcaatcaataactacgtcatcaatagtacagacgaactgcctacaattagctactccatgaatcccaaacccaccccgtgggctgaggaggagaccgtcgctgccgctcaactgataaccatgctatggtctctatcagtcagctccttcgcggtgggagggatgacggcgtcttttttcggaggctggttaggggatactctgggcaggataaaggctatgttggtagcaaacattttgagtctggtgggcgcactcctcatgggcttttctaagctgggaccatctcacattctgattattgctggaaggtctatctcagggctttattgcggactaataagcggcctcgtacctatgtatattggcgagatagcccccaccgccctgaggggagcccttggtaccttccatcagttggctatagtcactgggatcctgatctcccaaattattggccttgagtttatcctggggaactacgacctctggcatatcctcctcgggcttagcggtgtgagagcaatcctgcaatccttgctcctattcttttgtccagagtcaccccgttatctgtacattaagctggacgaagaagtcaaggcaaagcaatctctgaagcggctgcgtggttacgacgatgtcaccaaggacataaacgaaatgcgcaaggaaagagaggaggcgtccagcgagcagaaggtgagcatcatccaactgtttactaatagctcgtacaggcagccaatcctggtggccctgatgctgcacgtggcacaacagttttcgggcatcaacggcattttctattacagtaccagtattttccagaccgctggtatatctaaacccgtttacgccactatcggcgtgggagcggtgaatatggtattcactgcagtgtccgtgttcctcgtagagaaagccggccgaagaagtctctttctcattggtatgtctggcatgtttgtgtgcgcgatttttatgtctgttggactggttctgctcaataaattctcctggatgtcttacgtttccatgatcgctattttcttatttgttagcttcttcgaaattggaccaggaccgatcccctggttcatggtcgcggagtttttctcccagggacccaggccagctgctctggcaatcgccgcattctcgaattggacctgtaatttcatcgtggcgctctgctttcagtatatagcggatttctgcggtccatatgtattcttcctgttcgccggggtccttctcgcattcaccctctttacgttctttaaagtgccggagaccaaggggaaatcatttgaagagatcgccgccgaattccagaaaaaatcaggaagcgcacaccggccaaaggcggccgtggagatgaagtttctaggcgcaaccgagactgtg

SEQ ID NO: 19488 - DNA, 1572 bp, Artificial Sequence
  Description of Artificial Sequence: Synthetic coding sequence
atgaccgaggataaagtcactggaaccctagtctttactgtgattacagccgtcctgggctctttccagttcggctacgatattggagtgattaatgctcctcaacaggtgatcatctctcattaccggcatgtcctaggagtgcctttagacgatcgaaaggccataaacaattatgtgattaactcaaccgacgagctccctacgatctcctactcaatgaatcccaaacccacgccttgggctgaagaggaaacagtggccgcagcccaacttatcaccatgctatggtcgttatcagtctcatcctttgccgtgggcggaatgaccgcatcattcttcggtggttggctcggggatacattgggtagaatcaaagcaatgttggttgccaatatcttgagcctggtgggagctctgctgatggggttctctaagctcggcccctcccacatattaatcattgctgggagatcaataagcggactctactgtgggttgatcagcggcctggtccctatgtatatcggcgaaatagccccaactgctctgcggggagccctggggacatttcaccagctcgccatagtaacaggcatccttatctctcagatcataggcttagagtttatactcggtaattatgatctttggcatatattattggggctgagtggcgtgcgggccattttgcagagcctgttgctcttcttttgccccgaatcaccacgctacctctatattaaactggacgaagaggtgaaggctaaacagtccctgaagcgactgcgcggatatgacgatgtcacaaaagatatcaatgaaatgcggaaggagagggaggaagcgtcctcagagcagaaagtctccattatacagctcttcaccaattcctcctacaggcaacctatactggtggccctaatgctgcatgtagcccagcagttctccggcattaatgggatcttttactacagcacaagcatctttcagacggccggcatctcaaagccggtttatgccacaattggggttggcgctgttaatatggtatttaccgctgtaagcgttttcctggttgagaaggctgggcggcgttccctctttctgatcgggatgtcggggatgtttgtgtgtgccatctttatgtccgtggggctcgttcttttaaacaaattcagctggatgagttacgtgagcatgatcgccatctttctgtttgtaagctttttcgagatcggaccgggaccaatcccctggtttatggtcgctgaattcttctcacaaggcccaaggcccgctgctttggctatcgctgccttctctaactggacctgtaacttcatcgtggcattatgctttcaatatatagcagacttctgtggcccgtatgtcttctttctgtttgcaggggtgttgcttgctttcacattgtttacgttttttaaggtgccagaaacaaaaggcaagtcattcgaagaaattgccgccgagttccagaaaaagtcgggctcagcccatcgtcccaaagcagcggtggagatgaagtttctcggtgccacagaaactgtg

SEQ ID NO: 19489 - DNA, 1572 bp, Artificial Sequence
  Description of Artificial Sequence: Synthetic coding sequence
atgaccgaggataaggtgacaggcaccctggtatttacggttatcactgctgtcctgggctccttccagtttggatatgacattggtgtgattaatgctccccagcaggtgattatttcacactaccgtcacgttctaggtgtgcccctggatgacaggaaagctatcaataattatgtcatcaacagtactgatgaactccctactatctcttacagtatgaatcctaagccaaccccctgggcagaagaggagacggttgccgccgctcagcttatcacaatgttatggagtctaagtgtgtcaagcttcgcagtcggggggatgaccgcatcattcttcggcgggtggcttggggataccttaggccgtattaaggctatgctggtagctaatatcttgagcctggtgggagcactgctgatggggttctccaagctcgggccatcgcacatactaatcattgctggtcggtcgatctcaggtttgtattgcggcttgatttcaggtttggtccccatgtatatcggcgagatagctcctaccgcgctgcggggcgccctcggtacctttcatcagctggccattgtgaccggtattttaatcagccagattataggcttagagtttattctaggcaactacgatctgtggcacatcctgctgggcttgagcggggtcagggccatattgcagtccctactgcttttcttttgtcctgaaagcccccgctacctttacatcaaacttgacgaagaagtgaaagcgaaacagtcacttaaaagactccgtggatacgacgacgtgacaaaggacatcaacgagatgagaaaggaacgagaggaggcatcctccgagcagaaggtcagcatcatccaactgtttacaaactcaagttaccgtcagcctatcctcgttgcacttatgctgcatgtcgcacagcagttttccggcatcaacggcattttctattactccacgtccatattccagacggctggcatcagcaagccagtatacgccaccatcggagttggtgctgtcaacatggtgttcaccgccgtgtcagtgtttctggttgagaaagcagggaggaggtccctttttctgataggtatgagtgggatgtttgtgtgcgccatatttatgtccgtgggcttggtgttgctaaataaattctcatggatgtcgtacgtttccatgattgcaatatttctgtttgtctccttctttgagattggaccaggccctatcccttggtttatggtggctgagtttttcagccagggacccagacctgcagccctggccatcgcggcgtttagcaattggacgtgtaatttcatcgtcgcgctgtgttttcagtacattgcagacttttgcggtccatacgttttcttcctcttcgccggggtgttgctggcattcaccttgttcaccttcttcaaagtgcccgagacaaaggggaaatccttcgaagagatcgcagctgaattccagaagaagagcggtagcgcgcatagacctaaggctgccgtcgagatgaagttcctcggggctacggagaccgta

SEQ ID NO: 19490 - DNA, 1572 bp, Artificial Sequence
  Description of Artificial Sequence: Synthetic coding sequence
atgaccgaggacaaggttacaggtaccctcgtgtttactgtgatcactgccgttttgggctcatttcagtttgggtacgacatcggagtcatcaacgcacctcagcaggtgattatatctcactatagacatgtgctaggcgtgccactggatgacagaaaagccattaataactacgtgatcaattcgacagacgagttgcctactatatcgtactcgatgaacccgaagcccaccccttgggctgaagaagagaccgtagcagccgctcagttaattaccatgttatggagcctgtccgtgtcctccttcgccgtgggaggcatgaccgcatccttcttcggaggctggctgggagataccctgggcagaattaaggccatgctggtcgccaatatcctcagcctggtgggcgccctgttgatggggtttagcaaactggggccctcccacatcttgattatcgccggaaggtcaattagcggcctgtactgtggtctgatcagcggacttgtacccatgtacataggcgaaattgcccctacagcactccgtggggcgctcgggaccttccaccaactggctatcgtgactggaatcctcattagccagatcattggattagagtttatccttgggaactacgacctttggcacatactgttgggcttgtcaggtgttagggccattttacagtcactgctgctttttttttgccctgagtccccacggtatctgtatataaagctcgacgaagaagttaaggccaaacagtcactgaaacgactgaggggctatgatgatgtgactaaagacattaatgagatgcgaaaagagagggaggaagcatccagcgagcagaaagtgtccataattcagttgtttacaaatagttcttatcgtcaacccatactcgtcgccttgatgctccacgtggctcagcagtttagcggcataaacgggatattttactatagcacatcaattttccaaactgctggaatctccaagcccgtctatgcaaccatcggagtgggggccgtgaacatggtcttcaccgcagtatctgtcttcctggtggagaaggccgggaggcgtagcttatttctgattggaatgtccggtatgtttgtttgcgcgatctttatgagcgttggtcttgtcctgctgaacaaattcagctggatgtcgtatgtgtccatgatcgccatctttttgttcgtctctttcttcgagataggcccgggacctattccctggttcatggtcgccgagttcttctctcaggggccccgtcccgcggctctagccatcgcagcattttcaaactggacttgcaatttcatcgtggcgctttgcttccagtatatcgcagacttctgcggaccctacgtgttttttcttttcgcaggcgtgctgctggctttcacactcttcacattctttaaggtgcctgaaactaaaggcaaaagttttgaggagatcgctgctgaatttcagaagaagtccgggagcgcccatagaccaaaggccgccgtggagatgaagtttctgggggctacagaaacagtg

SEQ ID NO: 19491 - DNA, 1572 bp, Artificial Sequence
  Description of Artificial Sequence: Synthetic coding sequence
atgacagaggacaaagtgacaggcactctggtttttaccgtgattaccgcagtactggggtcattccagttcggctatgatataggagtgattaatgctccacagcaagtcattatatcacattatcgccatgtgctgggggtgccgcttgacgaccgtaaagccatcaacaactatgtaatcaatagtacagatgaactgccaacaatctcgtacagcatgaatcccaagcccacaccatgggctgaagaggaaacagtagccgctgcgcaactaatcacaatgttatggagtctctccgtctcgtcattcgccgtgggtgggatgacagcgtcattttttggcggatggctgggagacacacttggtcggattaaagccatgctggtggcaaacattctgtcgctagttggtgccttgctcatggggttttcaaagctcggtcccagccacatcctgatcatcgcaggacggtctatctccggcctctactgcgggctgatatcaggacttgtccccatgtacattggcgaaattgcccctacagccctgcgcggggccctgggaacttttcaccagctcgcgatcgtgacagggattctgattagtcagatcatcggactcgaattcatcctgggcaattacgacctgtggcacattttactgggactcagcggtgtgcgcgccattctgcagagtctcctgcttttcttctgccccgaatccccgaggtacctgtatataaagctggatgaggaagtgaaggccaagcagagtctgaaacgcctgcgggggtatgatgacgtcacaaaggacattaacgagatgcgtaaggagagagaagaggctagtagcgagcagaaggtttctatcatccagctgttcacaaattcctcttaccggcagccaatactggtggcgttgatgctgcatgtggcccagcaatttagtggcatcaacggcattttctactactctaccagtattttccagacggctgggataagcaaaccagtctatgcgactatcggggtgggagcagtgaatatggtgttcactgccgtatctgtgttcctggtggaaaaggctggccgtcgttctttattccttatcgggatgtcaggaatgtttgtctgcgctatctttatgtccgttggactggttctgctgaacaagtttagttggatgagctatgtatctatgatagccatcttcctttttgtctccttctttgagataggaccagggcctatcccctggttcatggtagcagaatttttttcccaggggccacggccagcagcactcgctatcgctgctttctccaattggacatgcaattttatcgtggccttatgcttccaatatatcgccgacttttgcgggccctatgtattttttctgttcgcaggcgtgctcctcgcttttaccttatttacatttttcaaggtgccagagacaaagggcaagtcgttcgaggagattgccgccgagttccagaagaaaagtggatctgcacatcggcctaaggccgcggtagagatgaagtttctaggagccactgaaacagtt

SEQ ID NO: 19492 - DNA, 1572 bp, Artificial Sequence
  Description of Artificial Sequence: Synthetic coding sequence
atgactgaagataaggtcacgggcaccctcgttttcaccgtgatcactgccgtgctcggttcctttcagttcggatatgatatcggagtgatcaacgctccgcagcaagtcatcatctcacactaccgccatgtgctgggcgttccgctggacgatcgaaaggccatcaacaactacgtgatcaactccacggacgaactgcccactatctcgtacagcatgaacccaaaaccgaccccgtgggcggaagaagagactgtagcggccgcacagcttattaccatgctctggagcctgtcggtgagctcattcgcagtcggagggatgactgcgtcgtttttcggaggttggttgggagacactctcggacgcatcaaggctatgctggtcgcgaatatcctgtcactggtgggcgcgctcctgatgggcttctcgaagctcggaccatctcatatcctgatcattgctggcaggtcaataagcggattgtactgcgggttgatctctggccttgtgccgatgtacattggagagatcgccccgactgcgttgcgcggtgcgctcggaacttttcatcagctcgccatcgtgaccgggatcctgatctcgcaaatcatcggactggagtttatcctgggaaattacgacctgtggcacatcctccttgggctttcgggcgtgagggccatccttcagtcgctgctgctcttcttttgtcctgagtccccgcgctacctgtatatcaaactggacgaagaggtcaaggcaaagcagtcgctgaaacggctgagaggatacgatgatgtaacgaaagacatcaacgagatgagaaaggaacgggaagaagccagctcggagcaaaaggtgagcatcattcagttgtttaccaatagttcgtaccggcagcctatcctggtggctctgatgctccacgtggctcaacagttcagcggtatcaacgggattttctactactccacctccatcttccagactgcgggaatctcaaaacccgtgtacgcaaccattggagtcggagccgtgaatatggtgttcaccgccgtttcggtctttctggtcgaaaaggccggccggagatccctcttcctcatcggcatgtcagggatgtttgtctgcgcgatcttcatgagcgtgggcttggtgctgctgaacaaattctcatggatgtcctacgtgtccatgatcgccatcttccttttcgtgtcgttcttcgagatcggccccggaccaattccttggttcatggtggcagaattcttttcccaaggaccgcggccagctgccctggcaattgctgccttctcaaattggacctgcaacttcatcgtcgccctctgcttccagtacattgcagacttctgtggtccatacgtgttctttctgttcgccggagtgctcctggccttcaccctcttcaccttctttaaggtgccggaaactaagggaaaatcctttgaagagatcgcagcagaattccaaaagaagtccggaagcgctcaccgccctaaggcggccgtggagatgaagttcctgggggccaccgagactgtc

SEQ ID NO: 19493 - DNA, 1572 bp, Artificial Sequence
  Description of Artificial Sequence: Synthetic coding sequence
atgaccgaagacaaggtgaccggaacgttagtgtttacagtcatcacagccgtcctcggtagctttcaatttggctatgatatcggggtgattaacgcccctcagcaggtgataataagccattacaggcacgtcctgggtgtgccactcgatgaccgcaaggccataaacaactacgtcatcaacagcacggacgagctccccacgatcagttactctatgaatcccaaacccacaccctgggccgaggaggaaactgtcgcagccgcccagctcattacaatgctctggtccctcagtgtgagctcttttgcagtcggtgggatgactgcctctttttttggaggttggcttggcgacacactggggaggatcaaagccatgttagtggcaaatatcctgtccttggtaggggccctgctcatgggcttcagcaagctggggccctcccacatcttaattatcgccgggagaagcatcagcggcctttactgcgggctcatctccggacttgtgcccatgtatatcggtgagattgctcctactgctctgcgaggtgccctggggacatttcatcaactagcaatcgtaacaggcatactgatctctcagatcatcggcctggaatttatcctgggcaactacgatctgtggcatatcctgctcggtctcagcggcgtgagagctatccttcagtcattattgctgttcttctgtccggaaagtccgcgctatctttatatcaagcttgacgaagaggtgaaagccaaacaaagtctgaagagactgagaggctacgatgacgtgacgaaggatatcaatgaaatgagaaaggagagagaggaagcctctagcgaacaaaaggtcagtatcatccagctctttaccaattcaagttatcggcaacccattctggttgccttgatgctgcacgtggctcaacagttttccggcattaatggtatattctattatagcacaagtatatttcagacagctggcatttccaaacctgtgtatgctacaatcggcgtgggtgccgtgaatatggtcttcaccgcagtgtctgtatttctggtggagaaggccggacgtcgctcattgtttttaattggcatgtcagggatgtttgtgtgcgcgatattcatgtccgttggactggtgctgctcaacaaattcagttggatgtcctatgtgagtatgatcgcaatctttctgttcgtgtccttctttgaaataggacctggaccgattccttggttcatggtcgccgagtttttttcccaggggccaagacctgctgctttggctatagcagctttctccaactggacgtgtaatttcatcgtcgccctctgctttcagtacattgccgacttttgtggcccctatgtgtttttcctgttcgcaggggtcctcctcgcctttacactgtttacattttttaaagtgccagaaaccaagggtaagtcctttgaggaaatcgccgcagagttccagaagaagtctggaagtgcacacaggcccaaagcggccgttgaaatgaaattcctgggagctaccgaaactgtg

SEQ ID NO: 19494 - DNA, 1572 bp, Artificial Sequence
  Description of Artificial Sequence: Synthetic coding sequence
atgacagaggacaaagttaccggaaccttggtgtttacagtgattacagcagtgctcggctccttccaatttggatatgatataggggtgatcaacgcccctcagcaggtgatcattagccattaccgacacgtgttgggagtccctctggacgatcgcaaagcgatcaataactatgttattaacagtactgatgagttgccgaccatctcctactctatgaaccctaagccaaccccttgggccgaggaggagaccgtcgcagctgctcaactgattactatgctgtggagcctgagcgtgtctagctttgctgtgggcggaatgacagcgagctttttcgggggctggctgggcgacactttaggccgtataaaagctatgcttgtggctaatattctgagcctggttggagcactcctcatggggttcagcaagctcgggcccagccatatacttattattgcagggcgctctatcagtggcctgtactgtggtctgatttccgggttagtgcctatgtatatcggtgagatcgcgcccaccgcgttgagaggcgcgctgggaacattccatcagctggccatcgttaccggcatcctgatatcacagattattgggcttgaatttatcctaggaaattatgacctgtggcacatcctgttgggactctcaggtgtgcgtgcaatcctccagtctttattgctgttcttctgtcctgaatctcccagatatctctacatcaagctggatgaagaggtgaaagctaaacagtcactgaagcgcctgcggggttatgatgatgtaacgaaggacatcaatgagatgcggaaggagcgagaagaagcttcctcggagcagaaggtctccataattcagctcttcaccaactctagctaccgacagcctattttggtcgcattgatgttgcatgtagctcagcagttctccgggatcaacggtattttctactactctacatctatcttccagaccgccggaatcagtaaacctgtttatgctacaattggtgtcggcgccgttaatatggtgtttacagctgtctcggtcttcctggtcgaaaaggcaggacgacgttcgctattcctcatcggcatgagcggaatgttcgtctgcgctatattcatgtccgtgggactggtgctactaaacaagttctcatggatgtcgtacgtgtctatgattgccatcttcttgttcgtgtctttcttcgaaattggcccagggcctataccctggttcatggtggcagaatttttctcacagggtcccaggcccgcggctctggcaatcgccgcttttagcaactggacgtgcaactttatcgtggcactgtgtttccagtacatcgccgacttctgtggtccctacgtgttctttctgttcgcaggcgttctgctggcctttactttgttcacatttttcaaagttcctgagaccaaggggaagagctttgaggaaatcgccgccgaattccagaagaaatccgggtccgctcatcggcctaaagctgccgtggagatgaaattcctcggagctactgagactgtc

SEQ ID NO: 19495 - DNA, 1572 bp, Artificial Sequence
  Description of Artificial Sequence: Synthetic coding sequence
atgacggaagataaagtaacgggtacgttagtttttacggttataacggcggttctaggttcgtttcaatttggttatgatataggtgttataaatgcgccgcaacaagtaataatatcgcattatcgacatgtattaggtgtaccgctagatgatcgaaaagcgataaataattatgtaataaattcgacggatgaattaccgacgatatcgtattcgatgaatccgaaaccgacgccgtgggcggaagaagaaacggttgcggcggcgcaactaataacgatgttatggtcgttatcggtatcgtcgtttgcggttggtggtatgacggcgtcgttttttggtggttggttaggtgatacgctaggtcgtataaaagcgatgttagtagcgaatatattatcgttagtaggtgcgttattaatgggtttttcgaaattaggtccgtcgcatatactaataatagcgggtcgttcgatatcgggtttatattgtggtctaatatcgggtttagtaccgatgtatataggtgaaatagcgccgacggcgttacgtggtgcgttaggtacgtttcatcaattagcgatagtaacgggtatattaatatcgcaaataataggtctagaatttatactaggtaattatgatttatggcatatattattaggtctatcgggtgttcgtgcgatattacaatcgctactactatttttttgtccggaatcgccgcgttatctatatataaaactagatgaagaagttaaagcgaaacaatcgctaaaacgtttacgtggttatgatgatgttacgaaagatataaatgaaatgcgaaaagaacgtgaagaagcgtcgtcggaacaaaaagtatcgataatacaattatttacgaattcgtcgtatcgacaaccgatactagttgcgttaatgctacatgtagcgcaacaattttcgggtataaatggtatattttattattcgacgtcgatatttcaaacggcgggtatatcgaaaccggtatatgcgacgataggtgttggtgcggtaaatatggtttttacggcggtttcggtttttctagttgaaaaagcgggtcgacgttcgttatttctaataggtatgtcgggtatgtttgtatgtgcgatatttatgtcggttggtttagttttattaaataaattttcgtggatgtcgtatgtttcgatgatagcgatatttttatttgtttcgttttttgaaataggtccgggtccgataccgtggtttatggtagcggaatttttttcgcaaggtccgcgaccggcggcgctagcgatagcggcgttttcgaattggacgtgtaattttatagttgcgttatgttttcaatatatagcggatttttgtggtccgtatgttttttttctatttgcgggtgtattattagcgtttacgctatttacgttttttaaagtaccggaaacgaaaggtaaatcgtttgaagaaatagcggcggaatttcaaaaaaaatcgggttcggcgcatcgaccgaaagcggcggtagaaatgaaatttttaggtgcgacggaaacggta

SEQ ID NO: 19496 - DNA, 1572 bp, Artificial Sequence
  Description of Artificial Sequence: Synthetic coding sequence
atgactgaagataaagtcacaggcaccctggtgttcactgtgatcaccgcggttttgggttcctttcagttcggctacgatattggcgtgatcaacgcgccccagcaggtaattatttctcattaccgccacgtacttggcgtacccttggatgacagaaaggctatcaataattacgtcatcaattccaccgatgaactgcctactatctcatacagcatgaatccaaagccaacaccctgggctgaagaggagacagttgctgcagcccaactgatcacaatgctgtggagcctctccgtgtctagttttgctgttggtggaatgacagcgagcttcttcggaggttggttgggtgacactctgggtaggattaaggcgatgctggtggcgaatatcctgagcctggtgggtgcgctgttgatgggtttttcaaagctgggccctagtcacattctcatcatagccggaaggtctatcagcggactttactgtggactgatatctggtctggtgcccatgtacataggcgagatcgcgccgacagctctcagaggagcattgggaacattccaccagctggctattgttacaggaattctgatctcccagatcatcggactggagttcatcttgggcaactacgacctctggcacatcttgctcggactcagcggtgtcagagccattttgcagagtctgctcctctttttctgtcccgagtcccctagatacttgtacatcaaactggatgaggaagttaaagcaaagcaaagcctgaagagattgcgcggatacgatgatgtgacaaaggacattaacgaaatgcgcaaggaacgcgaagaggcatctagcgagcagaaggtctctatcatccaattgttcactaactcttcctaccgccagcctattttggtagccttgatgctgcacgtggcccagcaattttcaggaattaacggcattttttactactcaacctccatttttcagacggcgggaatctctaagcccgtctacgctacgatcggcgtcggtgcggtgaacatggtgttcactgctgttagtgtattcctggttgaaaaagccggcaggcgctcacttttcctcattggtatgtccggcatgttcgtttgcgcaattttcatgagcgtaggattggtgctgctcaataagttcagctggatgagctacgtcagtatgatcgcgatattcctgttcgtgagtttcttcgagatcggacccggcccgattccgtggttcatggtcgcagaatttttctcacagggcccccgcccggccgcattggcaattgccgctttctctaactggacctgcaatttcattgtagcactctgctttcagtacatcgccgacttttgcggcccttacgtgtttttcttgtttgcaggtgttcttctcgcattcaccttgtttaccttcttcaaagtgcctgagaccaaaggcaagtccttcgaagaaatcgcagctgaattccagaaaaagagcggctccgcccatcgccccaaggccgccgttgagatgaagtttctgggtgccaccgaaaccgtg

SEQ ID NO: 19497 - DNA, 1572 bp, Artificial Sequence
  Description of Artificial Sequence: Synthetic coding sequence
atgactgaagacaaagttaccggaactcttgtttttactgtgatcacggcagtgttaggatcttttcagttcggatacgatatcggagtaattaacgcgccacagcaggtcattatttcgcactacagacatgttctgggtgttcctttagatgataggaaggctattaataattacgttattaattcaaccgatgaattgcctactatcagctatagtatgaatcctaaacctaccccgtgggccgaagaagagaccgttgcagctgctcaactgattaccatgctttggagcctttcagtttctagtttcgcagtgggcggtatgactgcaagtttttttggcgggtggctgggtgatacgttggggagaattaaagcaatgttggttgccaacattctttcattggtcggagcccttctcatgggatttagtaagttgggaccctctcatatccttataatcgccggtcgtagtatcagcggactttattgcggtctcataagcgggcttgttcccatgtacattggagaaatcgcgccaacggcactaagaggtgctcttggaacctttcaccagctggcaattgtaactgggattttaatatcgcaaatcatcggacttgaattcattttgggtaattatgatctatggcacattcttcttgggctgtcaggtgttcgagccatactccagagtttgttgctttttttttgcccagagagtccgcgttacctttacatcaaactcgacgaagaggttaaggccaaacagtcattgaaacgattgcgcgggtatgacgacgtcactaaagacattaatgagatgcgtaaggagcgagaagaagcaagcagtgagcagaaggtttcaattatacagttatttacaaactcctcttatcgccaaccaattctagttgcccttatgctacatgttgcacagcagttcagcggtataaatggaattttctactattccacatctatatttcagacggctggtatatcaaaacctgtgtacgctacgataggcgttggtgcagtgaatatggtgtttacagccgtaagcgtttttctcgtggaaaaagcaggtcgccgaagtctgttccttattggaatgtccgggatgttcgtttgcgcaatattcatgagtgtcggcttggttcttcttaataagttctcctggatgagctacgtttccatgattgcgattttcttatttgttagctttttcgaaattgggcctggtccaatcccttggtttatggttgcagagttcttttcacagggaccgcgccccgctgctcttgctattgcagctttctcaaactggacttgcaacttcatcgtagccctttgcttccaatacatcgctgatttctgtggaccatacgtcttctttctctttgcgggagtgttgcttgcctttacattgtttactttttttaaagtccctgaaacaaagggaaaaagctttgaggagattgccgcggaattccaaaagaagtccggaagtgctcataggcccaaagcggcagtggagatgaagtttcttggggctacggaaactgtg

SEQ ID NO: 19498 - DNA, 1572 bp, Artificial Sequence
  Description of Artificial Sequence: Synthetic coding sequence
atgactgaggacaaagtgacagggacactggtatttacagtgataacagcggttttgggtagttttcaatttgggtatgacattggggttatcaacgcgccgcagcaggtgatcatttcgcactacagacacgtactcggggtgcccttggatgacaggaaggccataaataactacgtcatcaatagcaccgatgagctgcctacaatctcttacagtatgaaccctaaaccaacgccttgggctgaagaagaaacagtagcagccgcccagctcatcaccatgctctggtccctcagtgtgtcttccttcgcagtaggaggtatgactgccagctttttcggcggatggctgggagatacgcttggacgcatcaaggcgatgctggtggccaacatcctgtctcttgtcggcgccctccttatggggttctccaagctggggccatcccacatcctgataattgcaggacgaagcatttctggactatactgcggcctgatctccggactggtgcctatgtatatcggcgagattgcaccaaccgcccttcggggagcgctgggcaccttccatcagctagctattgtcacaggcatcctcataagtcaaatcatcggcctcgagttcatcttgggcaattatgatttgtggcatatattactgggactgagtggcgttcgagccatccttcagtcactcctgctctttttttgtccggagtcacccaggtatctgtacattaagttggatgaggaggttaaggccaaacagagcctgaaaaggcttaggggttacgacgacgtgacaaaggatattaacgagatgcgaaaggaaagggaagaagcttcttcagagcagaaggtgtcgatcattcaactgttcactaacagttcatatcgacagccaatcttggtggcgctgatgcttcatgtggctcagcagttttctggcataaacggtatcttctactacagcacatcgattttccaaacagccggtatctccaagccggtgtacgcaaccatcggcgtgggcgctgttaacatggtgttcactgctgtctccgtgttccttgtggaaaaggccggtcgcagatcattgtttctcattgggatgtctggcatgtttgtgtgcgctatctttatgtcagttgggctggtgttactgaataagttttcttggatgtcgtacgttagcatgatcgccatctttctgttcgtaagtttttttgaaatcggccctggcccaatcccttggtttatggtagcagaattctttagccagggaccccgacccgctgccttagcaatcgccgcgttcagtaattggacttgtaacttcattgtggcactgtgctttcagtatatcgcagacttttgtggcccctacgtgttcttcctctttgctggcgttctgctggccttcactctattcacatttttcaaggtgcccgagaccaagggcaaatctttcgaggaaatcgcagctgagtttcaaaagaaaagcgggagtgctcaccgcccaaaggccgcggttgaaatgaagttcctcggagccactgaaaccgtg

SEQ ID NO: 19499 - DNA, 1572 bp, Artificial Sequence
  Description of Artificial Sequence: Synthetic coding sequence
atgaccgaggataaagtcacaggaactttggttttcaccgtgataacagccgtactggggtctttccagtttgggtatgatatcggggtaattaatgcaccacaacaagtgatcatttcccattatcggcacgtgctcggcgtccccctggatgatagaaaagccatcaataattacgtgattaacagcactgacgagctgcccaccatctcatacagcatgaatccaaagcccactccatgggctgaggaggaaactgtggcagctgcccaactcatcaccatgttgtggtccctgagcgtgagcagcttcgctgttggggggatgaccgcctcttttttcggcggctggttaggagataccctcggccgaatcaaggcaatgcttgtagccaacattctctcgctcgttggtgcgctgctgatgggattcagcaagctgggcccctctcacatcctaatcatagcagggaggtcaatctctggcctgtactgtgggctcattagtggtctggtacctatgtatattggggaaattgctcctaccgcgctgaggggtgcgctgggtacctttcaccaacttgcaatagtgaccggaatcctaatttctcaaattattggcctggagttcatactgggcaattatgatctctggcatatcctgctggggttgtcgggcgttagggccattctacagagcctgttgttattcttctgtcccgagtctcctaggtacctgtacataaagttggacgaggaggttaaggcgaagcaatccctcaaacggctgagaggctatgacgacgtgacaaaggatattaacgaaatgcgaaaagaacgtgaggaggccagttctgagcagaaagtcagtatcatacagttgttcacaaattcttcttacagacaacctatcctcgtcgccctgatgcttcacgtggcacaacagttttccggaatcaatggcattttttactattcaacgtcaatatttcagaccgcaggaatctctaaacccgtgtatgctaccatcggagttggtgcagtgaatatggtttttacagcagtgtctgtattcctcgtcgaaaaagctggccggaggagcctgttcctaattggaatgtctgggatgtttgtctgtgccattttcatgtctgttggattggtcctccttaataagttctcatggatgtcttacgtgagtatgatcgcgatttttctgtttgtttcgtttttcgaaattggacccggtccaattccctggtttatggtggcagaattcttctcacaggggcctaggcccgcagccttagctattgccgctttctccaactggacatgcaactttattgttgccctttgcttccagtatattgccgacttctgcggaccctatgtattttttctttttgctggagtgttgttagcgttcacccttttcactttcttcaaagtgcctgagactaagggtaaatcattcgaggagattgccgctgagtttcagaaaaaaagcggcagcgcccataggccaaaggccgccgtggagatgaagtttctgggagcgacagaaactgtg

SEQ ID NO: 19500 - DNA, 1572 bp, Artificial Sequence
  Description of Artificial Sequence: Synthetic coding sequence
atgacagaggataaagtaacaggaacattggtcttcacagtaattaccgcagttcttggaagcttccaatttggctatgatattggcgtgatcaatgctccgcagcaggtaatcatctcccattaccgtcatgtgttgggcgtcccgcttgatgatagaaaagccatcaataattatgttatcaattccacagacgaattaccgacgatcagctattctatgaatccgaaacctactccatgggcagaggaagagacggtcgctgccgcccaattaattacaatgctttggtcccttagtgttagctcgttcgccgtggggggtatgacagcgtcgtttttcggaggatggcttggtgacacactcggacggataaaagcgatgcttgttgcaaatatactgtcattggtcggagccctcctgatggggttctctaaattgggcccatcacatattctgattatagccgggcgctctatctctggattatattgcggactgatttcaggcttagttcccatgtatattggtgaaattgcacctacagctctgagaggtgctctcgggacgtttcatcagttggcaatcgttacaggaatcctgatttcacaaatcattggcctggagtttattctgggaaactacgatctgtggcatattttgttgggcctgtccggagtcagggcgattctgcagtcattgcttttgtttttttgccctgagtctccgagatacttatatataaaacttgatgaggaggtcaaagcaaaacagagccttaaacgattacgaggttatgatgatgtcacaaaagacataaatgagatgagaaaagaaagagaagaagcttcgagtgaacaaaaggtgtcaatcatccaactcttcaccaactcttcttatcgtcagccgattttagttgcattgatgctgcacgttgcgcagcaattttctggtattaacggaatattttattattcaacttctatctttcagactgcagggataagcaaaccggtatatgcaacaattggagtcggcgcagtcaacatggtctttacagcggtctccgtttttcttgtagagaaagctggaagacgctctttatttcttatcggcatgagtggcatgtttgtctgcgccatcttcatgtccgtgggcttagtgttgctcaacaagttcagctggatgtcttatgtgtcaatgatcgctattttcctttttgtttcgttttttgaaatcggacctggtcctatcccatggttcatggtcgccgaatttttttcacaaggtccgcgacctgcggccttggcaatcgcggctttttctaactggacgtgcaactttattgtggcattgtgctttcagtatattgcggatttctgtggcccgtatgtctttttcctctttgcgggcgttctgctggcttttacattgtttacgttttttaaagttccggaaacaaaaggcaaatcttttgaagagattgccgctgaattccagaaaaaaagcggctctgcacatagacctaaagcagcagttgaaatgaagtttttaggcgccaccgagactgtt

SEQ ID NO: 19501 - DNA, 1572 bp, Artificial Sequence
  Description of Artificial Sequence: Synthetic coding sequence
atgaccgaagataaggtgacgggcacattggttttcacagtaattacagccgttcttggttcctttcaatttggctatgatataggggttatcaatgcaccccaacaggtgattattagtcactatagacatgtgctgggagttcccctggacgatcgaaaagcaataaacaattatgtgatcaattctaccgacgagttgccgactatttcctactccatgaaccctaaaccgactccgtgggccgaggaggagactgtcgcagccgcacagttgatcaccatgttgtggagtttgagcgtgagcagcttcgctgttggcggaatgactgcgtccttctttggtgggtggctgggagacaccctgggcagaatcaaagcgatgcttgtggcgaacatcttgagcttagtgggagctctcctgatgggattcagtaagttaggtcctagccatattctcatcattgccggccgctctatttccggtctgtactgtggcctgatatccggcctggttcccatgtacatcggcgagatcgctcctaccgctctaagaggtgcacttggtacgttccatcagctggccatcgtcactggcattctgatttcccaaattatcggcctagaattcattctgggcaattacgatctgtggcacatcctccttggtctctctggagttagggcgatcctgcagtcactcctgctgtttttttgtcccgagtcaccccgatatctgtatataaagctggacgaggaggtgaaagccaaacagtcactgaagaggctccgagggtatgacgacgtgacaaaggatattaatgaaatgaggaaggaaagggaagaagctagttctgaacagaaggtaagtatcatacagctcttcaccaactcctcgtacaggcagcccattctggttgctttgatgctgcacgtggcccagcagttcagcggcatcaatggcattttctattatagtacctcaatctttcaaactgcagggatctccaaaccagtatatgccacaattggagttggcgctgtgaacatggtcttcacagcagtatccgtctttttggtggaaaaggcagggagacgaagcctgttcctgatcggcatgtccggaatgttcgtgtgtgcaatattcatgagcgtgggactggtcctattgaacaagttttcttggatgagttacgtttcgatgatagctatcttcctcttcgtgagcttctttgagataggaccggggcccatcccatggttcatggtcgccgagttctttagccaggggcccagacctgccgcattagccatcgctgccttcagcaattggacttgtaacttcatcgttgcactttgtttccagtacattgccgacttttgtggtccctacgtattcttcctttttgcaggcgttctgctggccttcaccctgtttacttttttcaaggtcccggagactaagggcaagtcattcgaggagatcgccgctgaatttcaaaaaaaaagtggctcagctcacagacccaaggcagctgtcgaaatgaagttcctcggagctacagaaacagtg

SEQ ID NO: 19502 - DNA, 1572 bp, Artificial Sequence
  Description of Artificial Sequence: Synthetic coding sequence
atgactgaagataaagtaactggaacattagtatttactgttattacggcagtcttaggaagttttcaatttggatatgatattggagttataaatgcaccacaacaagttataatttcacattatagacatgttttaggagtaccattagatgacagaaaagcaatcaataattatgttattaattcaacagatgaacttcctactatatcatatagtatgaaccctaaaccaacaccttgggctgaagaagaaacagttgcagctgcacaacttattacaatgctttggagtttatcagtttctagttttgcagtaggaggaatgactgcatcattcttcggaggttggttaggtgatacacttggaagaataaaagcaatgttagttgctaatattcttagtctagttggtgctcttttaatgggattttcaaaattaggaccaagtcatattcttattattgccggacgttctatttctggattatattgtggtttaatttctggattagttccaatgtatattggagagattgctccaactgctcttagaggagcattaggaactttccatcaactagcaattgttacaggtattttaatttctcaaattattggattagagtttattttaggtaactatgatctttggcatattcttttaggattatcaggagttagagcaattcttcaatcattattattattcttctgtccagaatctccaaggtatttatatattaaacttgatgaagaagttaaagctaaacaaagtctaaaacgtctccgtggatatgacgatgttactaaagatattaatgaaatgagaaaagagagagaagaagcatcttcagaacaaaaagtttcaataattcaattatttacaaatagtagttatagacaaccaattcttgttgctttgatgttgcatgtggctcaacaattttcaggtattaatggaattttctattattcaacatctatttttcaaactgctggaatatcaaaacctgtttatgcaactattggagttggagccgtaaacatggtattcacagctgtatctgtttttttagttgaaaaagcaggaagaagatcattatttttaattggaatgtcaggaatgtttgtttgtgcaatctttatgagtgttggattagttttattaaataaatttagttggatgtcatacgtaagtatgattgctatttttttatttgtttcatttttcgaaattggaccaggtccaattccttggtttatggttgctgaatttttcagtcaaggaccaagaccagccgcacttgctatagcagcattttctaattggacttgtaatttcatagttgctttatgctttcaatatattgcagatttttgcggaccatatgttttttttttatttgctggagtactattagctttcactttgtttacattttttaaagtaccagaaacgaagggaaaatcattcgaagaaattgcagcagaattccaaaaaaaatcaggatcagcacatagacctaaagcagctgttgaaatgaaatttcttggagcaacagaaacagtt

SEQ ID NO: 19503 - DNA, 1572 bp, Artificial Sequence
  Description of Artificial Sequence: Synthetic coding sequence
atgactgaagataaagtaacaggaacacttgtgttcactgtcataacagccgtactgggatcctttcagtttggatatgatataggagtaattaacgctccacagcaggtgataatctcccactataggcacgtgctaggagtcccacttgatgatcgaaaagccataaataattatgtcatcaactccactgatgaactgcctactatttcttactcaatgaatcctaaacctacaccatgggccgaagaagaaactgttgctgcagctcagcttatcacaatgctatggtctctctccgtgtcctcttttgcggtgggagggatgactgcttccttttttggaggatggttaggggatactctcggacggatcaaagccatgctggttgctaatatattaagtctagtgggggccctcctcatggggttctccaagctggggccttcccatatactcataatcgcaggacggtccatatcaggactttattgcggactcatatcaggattggtacccatgtatataggagaaatagcccctacagccctccggggagcgcttgggacattccatcagctcgcgatcgttactgggattctaatatcccaaataatcgggcttgagttcatacttgggaactatgatctctggcacatcttactcggactttctggagtaagagcaatactgcagtccctactgctattcttttgtccagaatcaccaaggtatctttatatcaaattggatgaagaagttaaagcaaaacagagtttgaaacggttacgtgggtacgatgatgtaactaaagatattaacgagatgaggaaagaacgggaggaagcatcctctgaacagaaagtgagtataattcagttgtttacgaattcctcatacagacagcccatactggtagctctcatgctacatgttgctcagcagtttagtggaatcaacggaatcttctattattctactagtattttccagacagctgggatttccaaacctgtgtacgcaacaataggagttggagccgttaacatggtgtttactgctgtctctgtgttcctagttgagaaggcagggcggagaagtctgttcctcatcgggatgtctggaatgttcgtctgtgctatatttatgtctgtagggctcgtgctactcaataaattttcctggatgtcctacgtatccatgatagctatcttcctattcgtgtccttttttgaaatagggcctggacccataccttggttcatggtagctgaatttttttcccagggacctagacccgcagccctggcaatagccgcattctccaactggacttgtaactttatcgtggccctttgtttccaatatatagcagatttctgcggaccttatgtcttctttctcttcgccggggtactactagcttttacacttttcactttcttcaaagtccccgaaactaaagggaagagtttcgaggaaattgccgcagaattccagaaaaaaagtggatcagcccataggcccaaagccgcagtagaaatgaagttcttgggagcaacagaaacagta

SEQ ID NO: 19504 - DNA, 1572 bp, Artificial Sequence
  Description of Artificial Sequence: Synthetic coding sequence
atgactgaggataaagtgacagggacattggtgtttacggtgattacagccgtgttaggatcattccaattcgggtacgatataggcgttattaacgcacctcagcaagtgattatctcccattaccggcatgtgctgggcgtgcccctggatgacaggaaggccatcaacaactacgtgatcaattcaacagacgagctaccaacaatttcatatagtatgaacccaaagccgacgccatgggcagaggaagaaaccgtggcagctgcacagttgatcactatgctctggtcccttagtgtgagctcgttcgcggtaggtggcatgacagcgtccttctttggggggtggttaggggacaccttgggtcggatcaaggccatgctggtcgccaacattctttctctcgttggtgccctcctcatgggattttctaaactcggcccttcccacattttgataattgccggccgctcaattagcggactgtactgcgggctgataagcgggctggtgcccatgtatatcggcgagatcgccccaaccgcacttagaggggctctaggcacctttcaccagctcgcaattgtgacaggaattttgatctcacaaatcataggactggagttcatcctgggaaattatgacttatggcacatcctcctcggactctctggcgtgagagcgatcctgcagtcgctgctccttttcttttgccctgagagcccacgctacctttacatcaagctagatgaggaagtcaaggcgaagcagtctcttaagaggctgcgggggtatgatgacgtgactaaagacattaacgaaatgcggaaagagagggaagaggcgtctagtgaacagaaggtgagcataattcagctcttcacgaacagttcttacaggcagccaatcctagttgccctgatgctgcacgtggctcagcaatttagcggcataaacggtatcttttattactcaacttcgatattccagacggccggcatcagtaaaccggtatatgccacaattggggtgggcgcagtaaacatggtcttcactgctgtctctgtcttccttgtcgagaaggcgggacgtcgaagcctgtttctgatcggaatgtctgggatgtttgtatgcgccatttttatgtccgtggggctggtcctgctgaacaagttctcttggatgagttatgtcagcatgattgccatttttctctttgtgagctttttcgaaattggcccaggaccaatcccatggtttatggttgcagagttcttttcacagggcccccgccctgccgcactggccatcgcagccttttccaactggacctgtaattttatcgtagctctgtgcttccagtacattgcagatttctgtggcccctatgtgttctttctgttcgctggcgttctgctggccttcacactttttacattctttaaagtgcctgaaacaaagggcaagagctttgaagagatcgccgcagaattccagaagaaaagtggtagtgctcatcgccctaaggcggccgtggaaatgaaattcctcggggcaacagagactgtc

SEQ ID NO: 19505 - DNA, 1572 bp, Artificial Sequence
  Description of Artificial Sequence: Synthetic coding sequence
atgaccgaagacaaggtgaccggcactctggttttcacagttatcaccgccgtcctgggatctttccagttcggatatgatattggcgtgatcaacgcgccccagcaggtaatcataagccactatcgacacgtgctcggggtcccactagacgacagaaaggcaataaacaactacgtgattaactctactgacgagctgccaaccatctcgtattcaatgaatcccaagccgacaccctgggcggaggaggaaactgtggctgctgcccaactgataaccatgctctggagtctatctgtctccagctttgcagtagggggtatgacagcttccttctttggaggctggctgggggacactcttggccgcattaaggctatgttggtagcaaacatcttatcattggtcggggctctgctgatgggctttagtaagttaggtccttctcacattctgataattgcaggcagatcaatcagcggactgtattgtgggctgatcagcggtctggtgcctatgtacataggagagatcgcacctacagcactgcgcggggcacttggaacatttcatcagttggccatcgtgactggcattctgatttcccagatcattggccttgaattcatcctagggaactacgacctctggcacatcttgctgggactgtccggagttcgagctatcttgcagtcgctcttgctttttttttgccctgagtccccacgttacctgtatataaagttagacgaagaagttaaggccaagcaaagtttaaaacgattaaggggctatgacgatgtcaccaaggacattaacgagatgcgcaaggagcgggaggaggcaagtagcgagcagaaggtgtctatcatacagctatttacaaactccagttaccgacagcctattctggtggcgctgatgctgcacgtggcccaacaattttccggaattaacggaatattttattattctacctctatcttccagactgccggcattagtaaacccgtgtatgctaccatcggcgtgggagccgttaatatggtatttaccgcagtaagtgtgttcctcgtggagaaggcggggaggaggtcactatttctcattggtatgtctggcatgttcgtatgtgccatttttatgtccgtgggcctggtgctattgaacaagtttagttggatgtcttatgtttctatgattgcaatttttctgtttgtgtcgttctttgaaataggtcccggaccaataccgtggttcatggtggccgagtttttcagtcagggtccccgaccagccgctctggcaatcgcggccttctctaactggacatgcaatttcatagtggctctttgctttcagtatatcgcagatttttgcggcccgtatgtattcttcttattcgccggggtgttgctcgcttttaccctttttaccttcttcaaggtccctgagactaaggggaagagcttcgaggagattgccgcagaattccagaagaaatcagggtccgcccaccgaccaaaggccgcagtggaaatgaaattcttgggagccaccgagacagtt

SEQ ID NO: 19506 - DNA, 1572 bp, Artificial Sequence
  Description of Artificial Sequence: Synthetic coding sequence
atgacagaagataaagtgactggcacattggtgttcaccgtgattactgctgtgctcggttcatttcagttcggatacgacatcggcgtgattaatgcaccccagcaggtgattatcagtcattatagacacgtgttgggagtgccactcgatgataggaaggcaataaacaattatgtcattaactccacagatgaattacctacaataagctactctatgaaccctaagcctaccccatgggccgaggaagagaccgtggcagccgcccagctcattactatgctgtggtctctctcagtgtctagttttgcagtgggcgggatgactgcctcattttttggcggctggctgggggacaccctggggcggattaaggccatgctggtcgcaaacattctgtccctcgtgggtgccctcctcatgggctttagcaagctcggaccaagtcacatcctgatcattgccggaagaagtatcagcggtctatactgtggcctgatttcaggcctggtgcccatgtatatcggcgagatcgcacctacggcactacggggtgccctgggtacctttcaccagctcgccattgtgaccggaatactgatctcccaaattataggactggagttcatcctaggtaactacgacctgtggcatatcctgcttggcctttcaggtgtgcgtgccatcctgcaatcgcttcttctgtttttctgtcccgaaagtccccgctatttatacataaagttggatgaagaggtgaaagccaagcaatctctcaagagattacgcggctacgatgatgtcaccaaagacattaacgaaatgcggaaggagcgggaggaggcctccagtgagcagaaggtgtccatcattcagctgttcacaaactcttcctataggcagcccattcttgtcgctttaatgctccacgtcgctcagcagttctccggtataaacggtatcttctactacagcacatcgatcttccagactgccgggatcagcaagccagtctatgctacaatcggagttggcgcagtcaatatggtgttcaccgcagtcagcgtgttcttagtcgaaaaagcagggcgtaggtccctttttttgatcggaatgtcaggaatgtttgtgtgtgctatctttatgtctgtgggtttggtcctcctgaacaagtttagttggatgtcatacgtcagtatgattgcaatttttctatttgtaagcttctttgaaatcggacccggccctattccttggtttatggtcgctgaatttttttcgcagggacctagaccagccgctctagcaatcgcggcctttagcaactggacttgcaattttatcgtcgccttatgcttccagtacattgcagacttctgtggcccgtatgtgttttttctgtttgcaggcgtcttgcttgcgtttaccctcttcacatttttcaaagtcccagagaccaaagggaagtcatttgaagagatcgccgcagaatttcagaagaagtccggtagcgcccacaggccaaaggctgccgttgaaatgaagttcctcggggccaccgagacagtt

SEQ ID NO: 19507 - DNA, 1572 bp, Artificial Sequence
  Description of Artificial Sequence: Synthetic coding sequence
atgacagaggacaaggttacaggaaccctggtgttcaccgtaatcaccgcagtactgggcagttttcagttcgggtatgacatcggggtaatcaacgcccctcagcaggtgattatctcacactatcggcatgtgctcggggtcccccttgatgatcggaaggccataaacaactacgtcattaattctacagatgaactacctacaatttcttattctatgaatcccaaacctaccccatgggcggaggaagagacggtggccgccgcccaactgatcacaatgctctggtcactctcggtttcatcattcgccgtcggcggcatgaccgcttcctttttcggaggatggctgggcgatacactgggccgcataaaggcaatgctggtggcgaatatactctcattggtgggcgcactcctgatgggattcagtaagctgggaccctcccacattctcatcattgctgggagaagtatctctggactatattgcgggctgattagcggactagtgcctatgtatataggcgagatcgcaccaactgcactaagaggggccctcggaacctttcatcagctggccatagtaaccggtattctgatctctcagattatcggccttgagtttatcctgggcaactacgatctgtggcacatccttctgggcctgagtggcgtgcgggcaatactgcagagcttgctgctgtttttctgccctgaaagtccacggtatctgtatatcaagctggatgaggaggttaaggccaagcagagcttgaagagattgcgtggctatgatgacgtgaccaaggatattaatgaaatgagaaaggaacgagaggaggcctccagcgaacagaaggtatcaattattcaactctttacgaattcttcttatcggcagccgatcctggtggccttaatgcttcacgtggcacagcagttttccgggattaacggcatcttttattattctacttctattttccagactgccgggatcagcaaacctgtttacgctacaatcggcgtcggcgccgtgaatatggtctttacagccgtgtccgttttcttggtggagaaggctggacgtagaagtctctttctgatcggaatgtccggaatgtttgtttgcgcaatatttatgtctgtgggcctcgttcttctcaacaaattctcctggatgtcgtacgtatctatgatcgccattttcttatttgtttcctttttcgaaattggacctggaccaattccttggtttatggtggccgaatttttttctcaggggccccgcccagctgccctcgcaatagccgcgtttagcaactggacatgtaatttcatcgttgcgctctgtttccaatatattgctgatttctgcggtccgtacgtgtttttcctcttcgctggcgtgctgctagcttttaccctgttcactttttttaaggtgcccgaaacgaaggggaagagtttcgaagagattgctgctgaatttcagaagaaatccggatcggcacaccggccaaaagccgccgtcgagatgaagttcctcggagccaccgaaaccgtt

SEQ ID NO: 19508 - DNA, 1572 bp, Artificial Sequence
  Description of Artificial Sequence: Synthetic coding sequence
atgacagaggataaagtgaccggtaccctcgtttttactgtgatcacagccgtacttggctcctttcagtttggctacgacattggggtcattaatgctccccagcaggtcatcatttcacactacaggcacgtgctgggtgtacctctagacgatagaaaagcaattaacaattacgtcattaattcaaccgatgaactccccacaatatcatatagtatgaaccctaagccgacgccctgggcagaggaagaaactgtggccgccgcccagcttattaccatgttgtggagcctgtcagtgtcctccttcgctgttggcgggatgacggctagcttcttcggaggatggctaggggatacactcggacgcatcaaggcgatgcttgtcgcgaatattctgtcgctggtgggtgctctgcttatgggattttccaagctgggaccatctcacattttaataatcgccggaaggtccatttcgggcctttattgcggtctcatctcaggcctggttccaatgtacataggcgagattgcaccaaccgctttgcggggggcactggggacgttccatcagttagcaattgttacggggatcctcatcagccagattatcggtctggagtttatcctcggcaactatgatctgtggcacatcctgctgggattgtccggagtgcgcgccatcctgcagtcactactactcttcttctgcccagagagcccacgctacctgtatattaagttagacgaggaagtgaaggctaaacagtcattgaagcgactgcggggctatgatgatgtgactaaagatattaacgagatgcgcaaggagagagaggaggcttcctccgagcagaaagtctcgatcatacagctgttcacaaactcgagctaccggcagccaattcttgtggcgttgatgttgcatgtagcccaacagttcagcgggatcaatggtatcttctattactctacaagcatcttccaaactgctggaatttccaagccagtatacgccacaatcggagtgggagcagtcaatatggtgtttaccgcagttagtgtatttctggtcgaaaaagctggtcgtcgcagcctcttccttataggcatgtctggaatgtttgtgtgtgcaatattcatgagcgtcggcttggtcctcctgaacaagttcagttggatgtcttacgtcagcatgattgcgatatttttattcgtttctttcttcgagatagggcccggccctataccatggtttatggtggccgagttcttcagtcagggccctcgcccggccgccttagctattgcggcgttttctaactggacatgcaactttatcgttgcactgtgtttccagtatattgccgatttctgtggaccgtacgtctttttcctgtttgctggggtcctgctggcgttcaccttatttacatttttcaaggtaccagaaacgaagggaaaatcattcgaggagattgccgctgagttccaaaaaaagtccggatctgctcacagaccaaaagctgccgtcgagatgaagttcctgggggccactgagacagtg

SEQ ID NO: 19509 - DNA, 1572 bp, Artificial Sequence
  Description of Artificial Sequence: Synthetic coding sequence
atgacagaggacaaggtaaccggcactctggtgtttacagtaattaccgccgtccttggttccttccagttcggctatgacatcggcgtcattaacgcgccacagcaggtgatcatttcacattacagacacgtgctgggcgttcctttggatgacaggaaagctatcaataactacgtcatcaactccacggatgagctgcctactatctcctattccatgaatccaaagcccaccccatgggccgaagaagaaaccgtggcagccgcgcaactgattactatgctgtggagtctgagtgtgtcatcattcgccgtggggggaatgaccgcctccttcttcggcgggtggctcggagatacgctgggccgcatcaaggccatgctcgtggccaacatcttatctctggtcggcgctctactcatgggcttctcaaaactcgggccctcccatatacttatcatcgcgggcagatctataagcggactatactgtgggctcattagtggcctggtgccgatgtacatcggggaaatcgcgcccactgccctgaggggggcgctgggcacttttcaccagctggcaattgttaccggtattctcatctctcagattattggcctagaattcatacttgggaattatgacttgtggcacatacttctcggcttgtccggggtgagggcgatattgcaaagcctccttctttttttttgcccggagtcgccccgctacttgtacataaagctggacgaggaagtaaaggctaagcagagcttaaagcggctgagaggatacgatgatgtcaccaaagatatcaacgaaatgcgcaaggagcgggaggaggctagctcagaacagaaggtgagcatcattcagctgttcacaaacagcagttatagacaacctatccttgtagcactgatgctgcatgttgcccaacaattcagcgggatcaatggcattttctattattcaacttccattttccagacagcaggtatttccaagcctgtctacgcaacgatcggtgtgggagctgtaaacatggtgttcacagcagtctccgtattcctggtcgaaaaagctggcagaaggtccctgttccttatcggcatgtctggaatgttcgtgtgcgccatcttcatgtccgtggggctggtgctgctcaacaaattcagttggatgtcctacgtctccatgatagccatttttctgtttgtttctttctttgaaattggcccaggcccaattccctggtttatggtggctgagttcttttcccaggggccaagaccagccgcattggctattgcagcattctcaaattggacctgtaattttattgtcgctctctgttttcaatacattgccgatttctgcgggccctatgtcttcttcctcttcgccggcgtgctcctagcctttaccctcttcacattcttcaaggtaccagagaccaaggggaaatcattcgaggagattgccgcagagttccagaaaaagagcggatccgcgcacagacctaaggcagctgtcgagatgaaattcttgggcgccactgagaccgtc

SEQ ID NO: 19510 - DNA, 1572 bp, Artificial Sequence
  Description of Artificial Sequence: Synthetic coding sequence
atgactgaagacaaagtgacagggacattagtatttaccgtgataactgctgtgcttgggtcttttcagtttggctacgatatcggggtgattaatgctccgcagcaggtcatcatatcccattaccgacacgtccttggcgtgccactggatgataggaaggcaattaataactatgtaatcaacagtacagacgaactccctaccatatcctatagcatgaacccgaaacccacaccatgggccgaggaggagaccgtggcagcggctcagcttattacaatgttgtggtccctgtctgtgtcatctttcgcagttggtggtatgactgcttctttctttggcggctggctaggggacactctcggcagaataaaagcgatgttggtggcgaacattctaagtctcgtcggggcgcttctcatgggattctcaaagttggggccttcccacattctgataatcgctgggaggtccatctcagggctctactgtggccttattagcgggctggtgcccatgtatattggagagatcgcacccacagctctgcgtggagccttgggaacattccatcagttagctatcgtaacagggattttgatctcccagatcattgggctagaattcatcctcggcaattatgacctctggcacattctgttgggattgagcggggtgagggctatcctccagagcctgctcctgttcttctgtcccgagtcgcccagatacctctatatcaaacttgacgaggaagtgaaagctaaacagtccctgaagcgacttagaggctatgacgatgtgaccaaagatatcaacgagatgcgcaaagagcgagaagaggcttcttctgagcagaaggtgtcaatcattcagttgtttaccaactcctcttataggcagccaatccttgttgctttaatgctgcatgtggcccaacagttctcaggcattaacggaatcttctactattctaccagtatcttccagaccgccgggatctctaagcctgtgtatgccacaatcggcgtgggtgccgttaacatggtgttcacagctgtgtcagtcttcctggtcgaaaaggctggtcgccgtagcctcttcctgatcggtatgtctggaatgtttgtgtgcgctatttttatgagcgtggggctggtcctactgaacaagttttcctggatgagttacgtgagcatgatcgccattttcctttttgtgagtttttttgaaatagggccggggccaataccctggtttatggtggcagaatttttttctcaggggccccggccagcagccctcgctattgctgcgttttccaactggacgtgcaatttcatcgtggctctatgctttcagtacatcgctgatttctgtggaccgtatgttttctttctgtttgctggcgtgctcctcgccttcactttgttcacgttcttcaaggtgcccgagaccaagggcaagtcatttgaggaaatagccgccgagttccagaagaagtctggctccgcccatagacctaaggctgccgtggaaatgaagtttctcggagctacagagaccgtg

SEQ ID NO: 19511 - DNA, 1572 bp, Artificial Sequence
  Description of Artificial Sequence: Synthetic coding sequence
atgacagaggacaaggtgacggggacgctggtgtttaccgtgataactgcggtcctgggttcatttcaatttggctatgatattggtgtgattaatgcccctcagcaggtgattatcagccattatcgccatgttctcggcgtgccactggacgaccgtaaagctatcaataactatgtgatcaatagcaccgatgaactcccaaccatctcctactctatgaaccccaaaccgaccccctgggcagaggaggaaaccgttgccgcagcgcagttgattacgatgctctggtcattgtccgtatccagctttgcggtcggcggcatgacggctagctttttcggcggttggctgggcgataccctgggccgtattaaggcaatgttggtggcgaatatcctgagcttagtgggagcccttttaatggggtttagcaagcttggcccgtcccacatcctgatcatcgccggccgatcaatttctggactgtactgcggtctgatatcgggcttggttccaatgtacatcggcgaaattgccccaaccgcgctgcgtggtgcactgggtacattccaccaactggcaatcgtaactggtattctgatcagccaaataatcggtttggagttcatcttggggaactacgacctgtggcacatcttgctgggcctgagcggagtacgcgccattctgcagtctctgctactgtttttctgtccagaaagcccacgctatctgtacatcaagctcgacgaggaggttaaagccaagcagagcttgaaaagactgaggggatatgatgacgtgaccaaggacataaatgaaatgcgaaaggaacgcgaggaggcgagctccgaacagaaagtttccatcattcagctgttcactaatagctcttatcgtcagccaattctggtagctttgatgctacatgtcgcacagcaattcagcggcatcaatgggatcttctactactcaacctccatttttcagacagctggtatctcaaagccggtttacgcaaccatcggtgttggtgcagtcaatatggtgtttaccgcggtgagcgtcttcctggtagaaaaggctggtcgcagatcattgtttttaatcggaatgtctggcatgttcgtatgcgcaatttttatgagcgttgggctggtcttgttgaataaattcagctggatgagctacgtaagcatgattgctatttttctttttgtgtctttttttgaaatcggtcctggtcccattccctggtttatggttgctgagttttttagtcaaggtccacgcccggcggccctcgcaatcgccgcattcagcaactggacgtgcaactttatcgtagcgttgtgctttcagtatatagccgatttctgcggcccgtacgtcttctttttgttcgcgggtgtgctgttggcctttaccttgttcacgttttttaaggttcccgagacaaaaggaaagtctttcgaggaaatcgcggcggaattccagaagaaaagcggttccgctcaccgtcctaaggccgccgtggaaatgaaatttctcggcgcgacagaaaccgtg

SEQ ID NO: 19512 - DNA, 1572 bp, Artificial Sequence
  Description of Artificial Sequence: Synthetic coding sequence
atgacagaggacaaagtcacaggtacgctagtctttaccgtgattaccgcagtgctgggcagctttcagtttgggtatgacattggtgttattaacgcgcctcaacaggtgatcatcagccactatcgtcatgtgttaggagtcccactggacgaccgtaaggccataaacaactatgttatcaactccaccgatgagctgcccactatcagttactccatgaaccccaagcccacaccatgggctgaggaggagaccgtagccgccgcgcagctgattacaatgctctggtccctatctgtgtcttcattcgccgtggggggtatgacggccagcttcttcggcggctggcttggagataccctagggcggatcaaagctatgctggtcgcaaacatcctgtcactggtgggcgcactgctgatgggattttcaaaattgggaccgagtcatattttaatcatcgccggtaggagcatctctggactgtactgcggtctaattagcggtttggttcccatgtacatcggcgaaattgcccctacagcacttcggggtgccctgggtacctttcaccagctagcaattgtcaccggaatcctgatcagccagattatagggctggaattcatcctgggcaactacgacctctggcatattctcctcggcctcagcggagtgcgcgccatactgcagtctcttctgctgtttttctgtcctgaatcccctagatatctgtatatcaagctcgatgaagaggtcaaggcaaagcagtcgctaaagcgacttaggggatacgacgacgttaccaaggatatcaacgaaatgcgtaaggagcgggaagaggcctcgtccgaacaaaaggtctctatcattcagctgtttaccaattcttcatacagacaaccaatcctcgttgccctgatgctgcacgtcgcccaacagttctcagggataaacggcatcttttattactcaacgagcatttttcaaaccgcaggaatatccaagccggtgtatgcgaccatcggcgtgggcgcagttaacatggtctttaccgcagtttcagtgtttttagtagaaaaggctggccgtaggtctctattccttattggtatgtcgggaatgttcgtgtgcgcaatattcatgtctgtgggtttggttctactgaataaattttcctggatgtcctacgtttctatgatcgccatcttcctgtttgtgtccttttttgaaattggtcccggaccaattccctggtttatggtggccgagtttttctcacagggcccacggcctgccgccttggccatcgctgctttttctaattggacttgcaattttatcgtggctctgtgctttcaatatatagctgacttctgcggcccgtacgtcttcttcctcttcgccggcgtgctcctggcatttacactgttcaccttctttaaagtgccagaaacgaaagggaagtcgttcgaagagattgccgccgagttccaaaagaaatccggctctgctcaccggcctaaggctgccgtggagatgaagttcctcggggccactgagactgtc

SEQ ID NO: 19513 - DNA, 1572 bp, Artificial Sequence
  Description of Artificial Sequence: Synthetic coding sequence
atgaccgaggataaggttactgggactctcgtctttactgtgataactgccgtactcggatcttttcagtttgggtatgatataggtgtaatcaacgctccgcagcaggtcatcatctcccattataggcacgtgctcggggttcccctggacgataggaaggcaatcaacaattatgttattaactcgaccgatgagctccctaccatttcttactccatgaatcccaagcctacaccatgggccgaggaggaaaccgtggccgccgcccagttgatcacaatgctgtggtcgctgtccgtgtcgtcattcgccgtcggaggcatgacagcatcgtttttcggcggctggcttggcgataccttggggcgcattaaggccatgcttgtggctaacatactgtcactggttggtgcactgcttatgggcttttccaagctagggccaagccacattctaattatagctgggcgcagcatcagcgggctgtattgtggcctaatctctgggcttgtcccaatgtacattggagagatcgcccccactgcgctccgtggcgctctaggaacgttccaccagttggccattgttactggcattttaatcagtcagatcatcggcctggagtttattctcggcaactatgatctgtggcatatcctgctcggattgtccggagtacgcgcgattctgcaatctttgcttcttttcttttgtccagagtcccccaggtacctgtatatcaagctggacgaggaggtcaaggcaaaacagtctcttaagcggcttagggggtatgatgacgtgacaaaagatattaacgagatgcgcaaagagcgggaggaggcctccagcgagcaaaaagttagtataatccagctgttcaccaacagcagctatcgacagccaatactcgtggccctgatgctgcatgtggcacagcagttttcaggcatcaacgggatcttctattacagcacatcaatttttcagaccgctggcatctctaagccagtctatgccacgataggcgtgggtgccgttaatatggttttcactgctgtgtctgtgtttttggtcgagaaggccgggcggcggagtctcttccttatcggtatgtccggcatgttcgtgtgcgcaatattcatgtctgttggattggttctgttgaacaaatttagttggatgtcttacgtatctatgatagccatcttcttatttgtgtctttttttgagataggtccgggacctatcccctggttcatggtggccgagttcttttctcaggggccaaggcctgcggcgttggccattgccgctttcagtaactggacgtgcaatttcatagtcgcactgtgtttccagtatatcgccgatttctgtgggccctacgtgttctttctgtttgccggcgtcttattggcctttacactctttactttcttcaaggtaccagaaaccaagggcaaatcattcgaagagattgccgcagaattccagaagaagagcggctccgcacatcgaccgaaagcagccgtggagatgaaatttcttggtgccacagaaacagtt

SEQ ID NO: 19514 - DNA, 1572 bp, Artificial Sequence
  Description of Artificial Sequence: Synthetic coding sequence
atgacagaagacaaggtgacagggacccttgtcttcacagtgatcactgctgtgcttggttccttccagttcggatacgacatcggtgtgattaatgcccctcagcaagtcatcatttcccactatagacacgtacttggcgttccgctcgatgatcgcaaagccataaacaattatgtgattaacagtacggatgagcttcctactatctcttatagtatgaatccgaaacccacaccctgggctgaagaggagacagtggcagccgctcagttgatcaccatgttgtggtccttgagcgtctccagcttcgctgtgggcggaatgaccgcaagtttctttggcggttggctgggcgatacccttggtagaatcaaggccatgctcgtcgctaacatactctcactggtgggggctctcttgatgggatttagtaagctgggcccttctcacatcctcatcattgccggcagaagcattagtggcctttactgtgggcttatatcagggttggtcccaatgtatatcggggaaattgcgccaacagcactgagaggggctctgggcacatttcaccagttggctatagtcactggcattttgatttctcagatcattggactcgagtttatcctcggaaactacgatctctggcacatcctcttgggactttcaggagtgagggctatattgcaatctttgttgctgtttttctgccctgaatccccccggtacctgtatattaaacttgacgaagaggtgaaggccaagcagtctctcaagaggcttcggggctacgatgacgttaccaaggacatcaatgaaatgcggaaggaacgggaggaggcatccagtgaacagaaggtctcaatcatccaactttttactaacagttcctaccgacaacctatcttggtggctctgatgctccacgtggcacagcagttcagtgggataaatggaatcttctattatagtacctctatttttcagaccgctggcatcagcaagcctgtgtacgcgacgatcggtgtgggagcggtcaacatggtgtttacagcagtaagcgtgttcctggtggaaaaggctggccggagatctttgttcctgatcggaatgagcggcatgttcgtgtgcgctatcttcatgtccgttggcttggttctccttaacaagttttcctggatgtcatacgtatccatgattgctatcttcctcttcgttagtttcttcgaaatcggtcctggcccgattccgtggtttatggtggccgagtttttctcccaaggtccccgcccagccgcactggcaatagctgcctttagcaattggacctgcaattttatagtagccctttgtttccagtacattgccgacttctgtggtccgtacgtattttttctgttcgccggtgtactccttgctttcacgctgtttacgttctttaaagtgccggagacgaagggaaagtccttcgaggaaatcgccgctgagttccagaagaagtcaggcagcgcgcataggccaaaagccgccgtggagatgaaatttctcggtgcgacagaaactgta

SEQ ID NO: 19515 - DNA, 1572 bp, Artificial Sequence
  Description of Artificial Sequence: Synthetic coding sequence
atgacggaagacaaggttacgggaaccctggtattcacagtgatcacagcagtcctggggagcttccaatttgggtatgacatcggtgtcatcaacgcccctcagcaggtgatcatcagccactaccggcacgtgttgggcgtcccactcgatgacaggaaggctattaacaactacgttattaatagcaccgatgagctccccaccatcagttacagcatgaacccgaagccaacaccctgggccgaggaggaaaccgtggctgcagcacaactcatcacaatgctgtggagcctttccgtctctagcttcgcagtcggaggcatgaccgcatcattcttcggaggctggctgggggacactctgggccgcataaaggctatgctcgttgctaatatccttagtctggttggagcactcctgatgggatttagtaagctgggccccagtcatatcctgattatcgctggaagaagcatcagcgggctgtattgcgggttgatatcgggactggtaccaatgtatatcggagaaatcgccccaaccgcgcttcgcggagcacttggcaccttccaccagctggcaattgtgacaggaatactaatttcacagattatcggcctcgaatttatcctgggaaactacgatttgtggcacatcttgcttggcctttcgggagtccgggccatcctccagagcttactcctcttcttttgtccagaatccccgagatacctctacattaaattggatgaagaagttaaagccaaacagagtctgaaacgcttgcgtggctacgatgacgtgacaaaggacataaatgagatgcgcaaggagagagaagaggcctcaagcgaacagaaggtgagcatcatacagctttttactaatagctcatacagacagccaattcttgtggccctcatgctccatgttgcacaacagtttagtggcatcaacggtattttctactactcaacgagcatcttccaaacagcagggatcagcaagccagtgtacgctaccattggcgtgggcgctgtgaacatggtttttaccgcagtctctgtcttcctagtggaaaaggctgggagaaggagcctgtttctcattggcatgtccggtatgtttgtctgcgccatctttatgtctgtgggcctcgtcctgctcaataaattctcttggatgagctatgtgagcatgattgccatctttctgtttgtttcctttttcgaaatcggccccggtccgataccttggtttatggtggctgagttcttttcacaaggccctagaccagccgcactcgcaatcgctgctttttccaactggacatgtaacttcatcgtcgctctttgctttcagtacatagcagatttctgcggaccttacgtcttctttcttttcgccggagtcctgcttgcattcactctgtttaccttttttaaggtacccgaaacaaagggcaagtcttttgaagaaatcgcagctgagttccaaaagaaatcaggcagtgcccacaggcctaaggctgcggtggagatgaagtttctgggtgccaccgaaaccgta

SEQ ID NO: 19516 - DNA, 1572 bp, Artificial Sequence
  Description of Artificial Sequence: Synthetic coding sequence
atgactgaggataaggtcactggcaccctcgtattcaccgtaataacagccgtgttggggtctttccagtttggctatgatataggtgttatcaacgcacctcagcaggttattattagtcactataggcatgtgctaggcgtgcctctggatgataggaaggccatcaacaactatgtgataaattcaactgacgaactgcccacaatttcttactctatgaaccccaagcctaccccctgggctgaggaagagacggtcgccgctgcccaactcatcaccatgttatggtccctgtctgtgtccagcttcgcggttggcggcatgacagcaagttttttcggtggatggctgggcgacaccctgggtcgcattaaagcgatgctggttgcgaatatattgagcttggtcggagcactgttgatggggttcagcaagctgggcccttcacacatcctcatcatagcaggcagatctatttccggactgtactgtggcctgatttctggtctcgtgcccatgtacattggagagatcgcccccaccgcacttaggggcgcactggggacttttcatcagctggcaattgtgacaggaattttaattagccagattatcggcctagaattcattctcggcaattacgacctctggcatattctcctggggctgagcggagtccgcgccatattgcaatctctcctgcttttcttctgccccgaatccccgcggtatctgtatattaaattggatgaggaagtgaaggcgaagcagtccctcaagcggctaaggggttacgacgatgtgaccaaggatatcaacgaaatgcgcaaggaacgcgaggaagcttccagcgaacagaaggtgtccattatccagctcttcaccaactcctcgtataggcaaccaatccttgtggccctgatgctgcacgtggcacagcagttctctggaatcaacggcattttttattattctacatctatctttcaaactgccggaattagcaagccagtttacgccacaattggggtaggagcagtcaatatggtgtttaccgccgtgagcgttttcttggttgagaaggccggtcgacgctccctgtttctcattgggatgtcaggtatgttcgtgtgtgcgatctttatgtcagtggggctggttctactgaataagttctcctggatgtcatatgtgtccatgatcgctatatttctttttgtgagtttcttcgagatcggaccagggcctattccgtggtttatggtcgccgagttcttctcccaagggccaaggcccgccgcgctggcgatagccgcttttagcaactggacttgcaattttatagtggccctgtgctttcagtatatagcagacttttgcgggccctacgtgttttttcttttcgcaggtgtgctgctggcttttacactgttcactttctttaaggtgcccgaaactaaaggcaaatccttcgaggagattgcagccgagtttcaaaagaagtcgggaagcgctcaccgccctaaggctgcggtcgagatgaaatttcttggcgctacggagactgtc

SEQ ID NO: 19517 - DNA, 1572 bp, Artificial Sequence; identical to SEQ ID NO: 19473
  Description of Artificial Sequence: Synthetic coding sequence

SEQ ID NO: 19518 - DNA, 1572 bp, Artificial Sequence
  Description of Artificial Sequence: Synthetic coding sequence
atgactgaagataaggtgaccggcactttggtctttacagtgatcaccgcggtcttaggcagttttcaattcgggtatgatatcggcgtgattaatgctccccagcaggtgattatctcccattaccgtcatgttttgggggtgcctctggacgatcgaaaggctatcaataactacgtgatcaactctacagacgagttgccaacaatcagctacagtatgaaccccaagcctaccccctgggcggaagaggaaacagtggctgcagctcaattgataaccatgctctggtcactgagtgtttcatcctttgccgttggcgggatgacagccagcttttttggtggatggctgggggatacccttggcaggatcaaagccatgctggtggctaatatcttgtctctggtcggagctttattaatgggattctcgaagctgggtccctcccacattttgatcattgcaggcagaagcatctccggcctgtactgcggattgattagtggcctggtgcctatgtacatcggagaaatagcccctaccgccctgaggggcgctcttggcactttccaccagctcgcgattgtaaccgggatcttaatatcccagatcattggcctggagttcattttgggcaactacgacttgtggcacatcctgctcggcctatcaggcgttagggccatcctgcagagtctgctattgttcttctgtcccgagtccccaaggtatctctacataaagctggatgaggaggttaaggctaaacagagcctgaaaaggctcaggggatacgacgatgtaactaaagatattaatgaaatgcggaaggaacgggaagaagcttccagcgaacagaaagtgagtatcatccagctgttcaccaattcctcttataggcagccaattctcgtcgccctcatgctgcacgtggcccagcagttctctggcatcaatgggatcttttattattccactagcatcttccagacagccggcatcagtaaacctgtttacgcaacaatcggagttggcgcagtgaacatggtgttcactgccgtctccgtctttcttgtagagaaggcgggaagaaggtcactctttcttattggcatgagcggtatgttcgtgtgcgccatattcatgtctgttgggctcgtcttactgaacaagttctcttggatgtcctacgtgtcgatgatcgccatattcctcttcgtatcatttttcgaaataggacccggacccatcccgtggttcatggtggctgaattctttagccaagggcctcgacccgccgctctggcaattgccgccttctccaactggacttgtaattttatagtcgccctctgtttccagtatatcgcagacttctgtggtccatatgtatttttcttgtttgccggggtgctgctggcctttaccctcttcacgttctttaaagtaccggaaaccaaggggaaatccttcgaggagattgctgctgaatttcagaaaaagtcagggtccgctcacaggccaaaagccgccgtggagatgaagttcttgggtgctacagagacggtg

SEQ ID NO: 19519 - DNA, 1572 bp, Artificial Sequence
  Description of Artificial Sequence: Synthetic coding sequence
atgacagaagacaaggtgacaggtacactcgtgtttactgttattaccgcagtgctgggctcttttcaattcggatatgacatcggagtgataaacgccccacaacaggtcatcatctcccactaccgccacgtcctcggggtccctctggacgaccgtaaagcgatcaacaactatgtgatcaacagtaccgatgagcttcccactataagctacagcatgaaccccaagccaactccatgggccgaagaggagactgtggccgcagctcagcttattacgatgttgtggtccctgtccgtaagcagctttgctgtgggcggcatgaccgcctcattcttcggtggatggctcggggatacactggggcgaatcaaagccatgctggtcgctaacattctgtcactggtgggcgcgctgctaatgggattttcaaagctcggaccatcgcacatcttgattatagcaggcagatctatatccggcctttactgtgggctcatttctggtctcgtgcctatgtatatcggagagatcgcccccaccgcattgaggggtgctctgggcaccttccaccagctggccatcgtaaccggcatcttgataagccaaatcattgggcttgagtttattctcggaaattatgatctctggcacattctgctgggtttgtccggcgtaagggctatcttgcaaagcttgctattgttcttttgcccagagtcaccacggtatttgtacatcaaactggacgaggaggtcaaagcaaagcaatccttaaaacggctccgaggttacgacgatgtgaccaaggacattaatgaaatgcgcaaggagcgagaggaggctagttccgagcagaaggtctccatcatccagttatttacgaactcatcgtaccgccagcctatcctggtggccctgatgttgcacgtggcccagcagttcagtggcatcaacgggatcttctactattcaaccagcatctttcagactgccgggataagcaaacctgtgtacgccaccatcggcgtgggggctgtgaacatggtgttcacagccgtgtctgtttttctggtggagaaagcgggaaggcgctctcttttcctgatagggatgagtggaatgttcgtctgcgccatcttcatgagtgtgggcttagtgctactgaacaagtttagctggatgtcctacgttagtatgatcgccatttttttgtttgtcagtttttttgagattggccccggtccaattccgtggttcatggtggcagaattcttcagccaggggccccgcccagcagcgctggcgatagctgccttcagcaactggacatgcaactttattgtggccttgtgttttcagtatatcgctgacttctgcggcccctacgtctttttcctctttgctggagttctgctcgcttttaccctcttcaccttttttaaggttcctgagactaaaggaaagagctttgaagagatcgccgccgagttccagaagaaaagcgggagcgctcaccgtcctaaggccgcagtagaaatgaaattcctgggtgcaaccgagactgta

SEQ ID NO: 19520 - DNA, 1572 bp, Artificial Sequence
  Description of Artificial Sequence: Synthetic coding sequence
atgaccgaggataaagtgactggtaccctggtatttaccgtgattacagctgtcctgggcagcttccagttcggttatgacatcggggtaattaatgcccctcagcaggttatcataagtcattatcggcacgtgttgggtgtgccactcgatgatcgaaaggctattaataactatgtcattaattccactgacgagctgcctaccatttcatattctatgaaccctaagccaacaccctgggctgaggaggaaactgtagctgcagcccagctgattacgatgctgtggagcctgagtgttagctccttcgcggttggaggaatgacagcctcattcttcggcgggtggctgggggacacgctgggacgcatcaaggccatgctggttgcaaacatcctgagcttggtcggagcactcttgatgggctttagcaagctgggtcctagccacatactgatcatcgccggccggtctatatcagggctctactgtggcctgatttccgggcttgtgccaatgtacattggcgaaatcgccccgacagctctgagaggcgctctcggcacctttcatcagttggctattgtaactggaattctcatttcacagatcatcggactggagttcatcctgggaaactacgatctgtggcacattctgctcgggctgagcggtgtgcgggccattttgcaaagtctgcttctgtttttctgccctgagtcaccccggtacctgtatattaaactggacgaagaggttaaagccaagcagtccctgaagaggttgcgcggatatgacgatgtgaccaaggacattaacgaaatgagaaaggagcgggaagaagccagcagcgagcagaaggtatccattattcaactcttcactaactcttcatatcgccaacccatcctcgtcgccctgatgctgcatgttgcgcagcagttcagcggaatcaacgggattttctactattctacaagcatatttcagaccgcgggcataagcaaaccagtatacgctacgatcggcgtgggtgccgtcaacatggtcttcacagcagtgtccgttttcctcgtggagaaagctggacgacggtctcttttcctgatcgggatgagtggcatgtttgtgtgtgccatcttcatgagcgtgggacttgtcctcctcaataagttcagctggatgtcatatgtctccatgatcgctatcttcctgttcgtcagtttctttgagatcggccccggccctatcccctggtttatggtggctgagtttttttctcagggcccgcgacctgcggcattggcgattgccgcttttagtaattggacctgtaactttattgtggctctgtgtttccaatatatcgccgatttctgcggaccttatgtcttcttcctgtttgccggtgtcctgctggcattcactcttttcacattctttaaagtgcccgagactaaaggcaagtcttttgaggaaatcgccgccgagtttcagaaaaagagtggatcagcccatagacccaaggcagctgtggaaatgaaattcctcggcgccaccgagactgta

SEQ ID NO: 19521 - DNA, 1572 bp, Artificial Sequence
  Description of Artificial Sequence: Synthetic coding sequence
atgactgaggataaggtgaccggcacattggtgttcacagtgataacggccgtgctcggatctttccaattcggctatgatatcggagtgatcaacgctccccagcaggtaatcatctcccactacaggcatgttcttggcgtcccgctggacgacagaaaagctatcaacaactacgtgattaactccaccgatgaactgcccacaatcagctatagcatgaatcccaagcctacgccttgggcagaggaggagacggtggcggctgcgcagctcatcacgatgttatggtccctgtctgtgtcctcatttgccgtgggcggtatgaccgcatctttctttggcggttggttgggggatacactagggcgcatcaaagctatgctggtggcaaatatcctgagtctcgtgggggccctgctgatgggcttctcaaagctggggccatcccatatcctgatcatcgcgggcaggagtatcagtggactgtactgcgggctgatctcgggactcgtaccgatgtacatcggggaaatcgcgcccaccgccctgcggggcgcactaggaacctttcaccagctggctattgtaacgggcatcctcattagccagatcatcggcctggaattcatactgggtaattacgatttgtggcatattctgttgggactgagtggcgtgagagccattttacaatctctgttgctgttcttttgccctgaatctccgcggtacctgtatatcaagctggacgaggaggtcaaagcaaagcagtccctcaaacggttacggggatatgatgatgtcactaaggatatcaatgaaatgcgaaaagagcgcgaggaggcgagttctgagcagaaggtttcgattattcagctgtttaccaacagtagctacaggcaaccgatcctggtcgccctgatgctgcacgtggcacagcaattctcaggcattaacggaatcttctactatagtacaagtatctttcagaccgctggtatatccaagcccgtgtacgcgaccattggcgtgggtgcagtgaatatggtgttcaccgcagtgtccgtgttcttggtggagaaggctggtagacgtagcctctttctcatcggcatgagcggaatgttcgtgtgcgctatctttatgtccgtgggactggttctgctcaacaagttttcctggatgtcctacgtctcgatgatcgctatatttttattcgtgagcttttttgagataggacccgggcctatcccctggttcatggtagcagagttcttctctcaaggcccgcgcccagccgctctcgcaatagccgctttcagcaattggacctgtaacttcatcgtggccctgtgctttcagtatatagctgatttttgtggaccatacgtgttctttctgtttgcaggcgtgttgctcgccttcaccctgttcacgttcttcaaggttcccgaaacgaaggggaaatcattcgaggaaattgcagccgagttccagaaaaagagtggatcagcacatcgacctaaagccgcggtggaaatgaaattcttgggagccaccgagaccgtg

SEQ ID NO: 19522 - DNA, 1572 bp, Artificial Sequence
  Description of Artificial Sequence: Synthetic coding sequence
atgacagaagacaaagttactggaactctggtcttcaccgttatcactgcagtgctaggatcatttcagtttggatacgatatcggggtcatcaatgctccacagcaagtaatcattagtcactataggcatgtactaggagtaccactcgatgatcgaaaagctattaacaattatgttatcaattcgactgatgagctaccaacaatttcatattccatgaatccgaagcctacaccatgggcggaggaagaaacagtggcagcagctcaacttatcaccatgctctggtcactctctgtcagcagctttgctgtcggtgggatgactgcgagttttttcggaggttggcttggtgatacacttggaagaatcaaagctatgcttgtagcaaatattctatctttggttggagccctcctaatgggattctcaaaactgggaccttcgcatattttaattatagccggaagatcaatctcgggactctactgtggattgatctccggcttagtaccaatgtacattggagagattgcaccgactgcactccgtggcgctttagggacattccatcaattagcaattgttacgggaattttgatttcgcaaattattggtctcgagttcatcctgggaaattatgacctttggcatattttacttggattatctggagtccgagctattttgcaatcactgcttctgttcttttgtcctgaatcaccaagatatctctacattaaacttgatgaagaggttaaggcaaagcaaagtcttaagagacttagaggatatgatgatgtaactaaagatataaacgagatgcgtaaagagagagaggaagctagttcggagcaaaaagtatccatcatacagctgttcacaaattcctcatatcgtcaacctattctagtagcgttgatgcttcatgtggcccagcaattcagtggtattaatggaattttctactactctacttccattttccaaactgccggaatttctaaaccggtttatgccacgattggggttggcgcagtcaatatggttttcacggctgtttcggttttccttgtggaaaaggctggacgcagatcactttttttgattgggatgtctggaatgtttgtttgtgccatttttatgtcagtcggactggtcttgcttaacaagttcagttggatgagttacgtttctatgattgccattttcctttttgtttctttttttgaaattggcccagggccaatcccatggtttatggtggcagagtttttcagtcagggaccccgaccagctgccttagctattgcggctttcagtaactggacatgcaattttatagttgcactctgttttcaatatattgctgatttttgtggaccgtatgtgttcttccttttcgctggtgtgttgttagcattcactctattcaccttctttaaagtgccggaaacaaagggaaagtcgttcgaagagatcgctgctgagttccagaaaaagagcggatcggcacacaggcctaaagctgcggtggagatgaagtttcttggtgctactgaaacagta

SEQ ID NO: 19523 - DNA, 1572 bp, Artificial Sequence
  Description of Artificial Sequence: Synthetic coding sequence
atgaccgaggacaaggtcacggggaccttagtgttcaccgtaatcacggccgtgctcggcagctttcagtttgggtacgatattggtgtcatcaatgccccacaacaagtgataatatcacactatagacatgttctgggggtgcccttagacgacagaaaggcaatcaacaactacgttatcaactctaccgacgaactgcctaccatatcgtattccatgaatcctaagcctaccccatgggccgaggaggaaacggtggcagcggcgcaactcattacaatgctgtggagcttgtccgtgtcgagctttgccgttgggggtatgaccgcttcattctttggtggctggttgggtgacaccctcggccgcattaaagcgatgctcgttgctaatatactctcactggtgggagcattacttatgggcttcagcaagctgggcccatctcacatcttgattatcgctggacgttctataagcggactatattgcggactcatatccggccttgtgcccatgtacatcggcgaaatcgctccaactgccctgagaggagcactcgggacattccatcagcttgcaatagtgactggcatccttatctcccagatcattggcctcgagtttatcctgggcaattacgacttgtggcatatcctcctgggactgtcaggggtccgggccatcctgcaatctcttcttctgtttttctgcccagaaagccccaggtacctctacatcaagttggacgaagaggtaaaagcaaagcagagtcttaaacgcctccggggttatgatgatgtaacgaaagatatcaacgagatgcggaaggaacgggaggaggcatcatcagaacagaaagtcagtatcatacaactctttaccaattcatcgtaccgccaacccatactggtggccctgatgctccatgtggcgcagcagttttcagggatcaacggcatcttctattattccacttccatctttcagaccgctggcatttcaaagccagtttatgctaccattggagttggtgctgtcaacatggttttcactgctgtgtctgtctttctggtggagaaagccggcagacggtcgctatttctgatcggcatgtccggaatgtttgtgtgcgctatttttatgtctgtggggctagtgctgctgaataaattctcttggatgtcctacgtgtccatgatagccatttttttatttgtctctttcttcgagataggccctggtcctattccttggtttatggtcgccgagttcttttctcagggacctcggcccgccgctctagccattgcagccttctccaactggacctgcaactttattgtggctctgtgtttccagtacatcgccgacttttgtggcccctatgtgttctttctatttgcaggcgtcctgctggcatttacattattcacattcttcaaggtgcctgagacgaaggggaagagtttcgaggagattgccgctgagttccagaagaagtctggcagcgctcaccggccaaaagccgcggtggagatgaagttcctgggagcaacagagaccgtg

SEQ ID NO: 19524 - DNA, 1287 bp, Artificial Sequence
  Description of Artificial Sequence: Synthetic coding sequence
atggccgctcaaggatacggctactacagaaccgtaatcttttctgcaatgtttggtggatattccttgtattactttaatagaaagacattcagttttgtcatgccaagtctcgtggaggaaatacccctggacaaggacgatctgggattcattacgagcagtcagtccgctgcctatgcgatctccaaatttgtgagtggcgtactgagcgaccagatgtccgcccgatggttgttctccagtggactcctcctcgtcggtctggtcaatatatttttcgcgtggagttccactgtccctgtgtttgcggctttgtggtttctgaacgggctggcgcaaggacttggctggcctccctgcggcaaagtgctgcgcaagtggtttgagccaagccagtttgggacttggtgggcaatcttgtccaccagcatgaacctggccgggggactgggtcccatcctggccacaatcctggcgcaatcctatagctggcgaagcacattggcactttcaggcgctctgtgcgtggtggtctctttcctgtgtctgctgctgattcacaatgagcctgccgacgtcggcctgaggaatctcgaccctatgccctctgagggcaagaaaggcagcctcaaagaggagtctaccctgcaggagctgttgttgtctccctatctctgggtgctgtccacaggctatctggtggtatttggcgtgaagacctgctgcacggattggggacagttcttcctgattcaggaaaagggtcagtccgcactggtcggcagcagctacatgagcgcccttgaggtgggcgggctggtcggctccattgcagccggctatcttagcgatagggcaatggccaaggctggcctgagtaactacgggaacccgagacatggcctgttgttgtttatgatggctggcatgaccgtctctatgtacctgttcagggtgaccgtgactagtgatagccctaaactctggattctggtattgggggcagtcttcggattctcatcatacggacctatcgcactgtttggcgtaatcgccaatgagagcgctcccccaaatctgtgcggcacttctcatgcaatcgtaggcctgatggcaaatgtgggcgggtttcttgccgggctgccattcagcactatcgcaaagcactacagctggtctacagctttctgggtcgccgaagtcatttgtgccgctagtaccgccgcttttttcctcctcaggaatatccgaaccaagatgggtagagtctccaaaaaggcagag

SEQ ID NO: 19525 - DNA, 1287 bp, Artificial Sequence
  Description of Artificial Sequence: Synthetic coding sequence
atggcagcacagggctatgggtattaccgcacagtgatctttagtgcaatgttcggaggatactccctttattacttcaaccgaaagaccttcagtttcgttatgccgtccctagtcgaagagatacccctggacaaggatgatctagggttcatcaccagctctcagtccgccgcgtatgctatctccaagtttgtgtctggggtgctgtctgatcagatgagtgctagatggctgttcagttctgggttgcttcttgtggggctcgtaaacatcttttttgcctggtctagcacagttcctgtgtttgccgctctgtggttcctcaacggactggcgcagggtttggggtggccaccgtgtggcaaggttctgagaaagtggtttgaaccatcccagttcggcacatggtgggccattttgagcactagtatgaaccttgctggcgggctaggccccatcctggcaactatcttagcacagagttacagttggagatctactttggcattatccggagccctgtgtgtcgtcgtctctttcctatgcctgctcttgatccataacgagcctgccgacgtgggattacggaatcttgacccgatgccttccgagggcaagaaggggtccctaaaggaagagtctacactgcaggaactgctgctcagcccgtatctctgggtactgtcaactggctatctggttgtctttggagtgaagacctgttgcaccgactggggccagttcttcttgatccaagaaaagggtcagagtgctctggttggctccagctacatgtccgctctggaagtgggcgggctcgttggttccattgccgcagggtatctgtccgacagggccatggccaaggctggactatctaattatggtaaccctcggcacggtctgttgctgttcatgatggctggaatgacagttagcatgtatctctttcgggtcactgttacatcggactcgcccaagttatggatcctggtgctaggcgccgtcttcgggttctcatcctatggccctatcgctctttttggcgtgattgctaatgagtccgcacccccaaacctgtgcggcacctcacatgcaatagtcggcttgatggcgaacgtgggcgggtttctcgccgggttgcccttttctactatagctaaacactacagctggtcgacggccttttgggtggccgaagtcatatgcgccgcttctacggctgctttttttttactacgcaatatacgaacgaagatgggcagggtatcaaaaaaggctgag

SEQ ID NO: 19526 - DNA, 1287 bp, Artificial Sequence
  Description of Artificial Sequence: Synthetic coding sequence
atggcagcacagggttacggatactaccgtactgtcatctttagcgcaatgtttggaggatactccctgtactactttaaccggaaaactttctcgtttgtgatgccttccctggtggaggaaattcctcttgataaggatgaccttggtttcattacctcttcacagagtgcagcatacgctatcagcaagttcgtgtcaggtgtcctttccgaccagatgagcgccagatggctgttttcctccggcctgcttcttgtcggcctggtcaatatcttttttgcatggtcgtcgaccgtgcctgtgtttgcagcactttggttcctgaacggtttggcgcaaggactcggttggcctccttgcgggaaggtgctcagaaagtggtttgagccgagccagttcggtacctggtgggcaattctctcaacctccatgaacctggctgggggtctgggaccaattctggcaaccattctcgcgcaaagctacagctggcggtcgactctcgcgcttagcggcgccctgtgtgtggttgtgtcgtttctctgcctgctcctcatccacaacgaaccagccgatgtgggtctgcgaaacctggacccaatgccatctgaaggaaagaaggggtccctcaaagaagaaagcactcttcaagaactgcttctcagcccatacttgtgggtgctgagtactggataccttgtggtgttcggtgtcaaaacctgctgtactgattggggccaattctttcttatccaagagaaagggcagtctgcgcttgtgggatcctcctacatgtctgccctcgaggtgggcgggttggtcggatctatcgcggcaggctacctttcagaccgggcaatggccaaggcaggcttgtcgaactatggtaatcccagacacgggctgttgctcttcatgatggccggcatgaccgtttccatgtacctgtttagggtaaccgtgacgtccgattctcctaaactttggattcttgtgctgggagcggtgtttggttttagctcctacggccccatcgcccttttcggagtaatagcaaacgaatccgctcctccaaatctgtgtgggacgtcacatgcaattgtgggtctgatggccaatgtcggaggcttcctggcgggattgcccttttctaccattgccaagcattactcgtggtcgactgcattttgggtcgcagaggtgatatgtgcagccagcaccgcagcattctttctgctgcgtaacattaggactaaaatgggaagagtcagcaagaaggctgaa

SEQ ID NO: 19527 - DNA, 1287 bp, Artificial Sequence
  Description of Artificial Sequence: Synthetic coding sequence
atggcagcacaaggctacggctactaccgcactgtgatcttctccgcgatgttcggtgggtacagtctgtactacttcaacagaaaaactttctcgttcgtgatgccttccctcgtggaggagatcccgcttgacaaggacgacctggggttcatcacttccagtcagtccgccgcctacgctatctctaagtttgtgtcaggagtgctgagcgatcaaatgtcggcacgctggttgttcagctcggggctgctgcttgtgggacttgtgaacattttcttcgcatggagctccaccgtcccggtattcgctgccctctggtttctcaacggactggcccaaggactcggatggcccccttgtggaaaggtgctgcgcaagtggttcgagccgtcgcaattcggcacgtggtgggcgatcctgtccacctcgatgaatcttgctggagggctgggaccaatcctcgcgaccatcctcgcacagagctattcttggcgctccaccctggccctgagcggcgccctctgcgtggtggtttctttcctctgcctgctgctcatccacaatgaacctgcggatgtggggctgagaaacttggatcctatgccgtcggagggtaaaaagggatccttgaaagaagaatcaactctgcaagagctcctgctgagcccctacttgtgggtgctgtcgactggctacctcgtcgtattcggagtaaaaacctgttgcactgactggggacagtttttcttgattcaggagaaggggcagtcggcactcgtcggttcgtcttacatgagcgccctggaagtcggaggactggtcggtagcattgcggcgggctatctgtcagatagggcgatggctaaggcagggctctctaattacggcaacccgcgccatggcctcctgttgtttatgatggcaggaatgaccgtgagcatgtacttgttccgggtgaccgttacttcagactcgccgaagctctggatccttgtgctcggtgctgtgttcggatttagctcctacggtccgatcgccctcttcggcgtgatcgccaacgaatcggcgcctcccaacctgtgcgggacgagccatgctatcgtcggtctgatggcaaatgtgggagggtttctggccggtctgccattctcgactatcgcaaagcactactcatggtcaactgccttctgggtggccgaggtgatctgcgccgcaagcaccgcagcgttcttcctgcttcgaaatatccggaccaagatggggcgggtgtccaaaaaggcggag

SEQ ID NO: 19528 - DNA, 1287 bp, Artificial Sequence
  Description of Artificial Sequence: Synthetic coding sequence
atggcggcgcaaggttacggatactaccgcactgtgattttcagcgctatgttcgggggatactcactgtactacttcaaccgcaagaccttctcattcgtgatgccctcactggtcgaggaaatcccgcttgacaaggatgatctggggttcatcacctcgtcccagtcagccgcatacgcgatctcgaaattcgtgtccggtgtgctgtccgaccagatgtccgcccgctggctgttcagctccggactgctcttggtgggactggtgaacattttcttcgcctggtcctccaccgtcccggtgttcgcagcactgtggttcctcaacggattggctcagggcctgggttggcccccatgcggaaaggtgctgcgtaagtggttcgagcctagccagttcggcacttggtgggcgatcctttcgacttcgatgaacctggcaggaggactcgggccgatcctggccacgatcttggcgcaatcctactcctggaggtccacgttggcactgagcggagcgctgtgtgtggtggttagcttcctttgtctgctcttgattcacaatgaaccggccgacgtcggtcttagaaacctcgacccaatgccgtccgagggaaagaaaggttccctgaaggaagaatcgaccctgcaagagttgctgttgtcaccatacttgtgggtgctgtcgactggatacctggtcgtgttcggggttaagacttgctgcacggattggggccagttcttcctgatccaggagaaaggccagagcgccctcgtgggctcctcatacatgtcggctcttgaagtgggaggactggtcgggtcgatcgcagcaggctacctgtcagatcgagcaatggccaaagcgggactctcgaattacggaaaccccaggcatgggctcctgttgtttatgatggccggcatgactgtgtcgatgtacctcttccgggtcaccgtgacctccgactcgcccaagctgtggatcctggtgctgggagccgttttcggcttctcctcttacgggcccatcgcgctgttcggcgtgatcgcaaacgaatccgccccgcctaacctgtgcggaacgtcgcacgccatcgtgggactcatggcgaacgtcggtggtttcctggccgggctgccgttctccactatcgccaagcactactcatggtcaactgcgttctgggtcgctgaggttatttgtgcagctagtaccgctgcgttcttcctcttgcgcaatatcagaacgaaaatgggccgggtgagcaagaaggctgag

SEQ ID NO: 19529 - DNA, 1287 bp, Artificial Sequence
  Description of Artificial Sequence: Synthetic coding sequence
atggcggcgcagggttatggttactatcgcacggtgattttctccgctatgttcgggggctattcgctctattactttaatagaaagaccttttcgttcgtgatgccgtccctggtggaagaaattccacttgacaaggatgacttaggtttcatcacaagctcccagtcagcagcttacgccatctctaaatttgtctcaggagtactcagcgatcagatgtctgctcggtggctcttctcgagcggactgctgctggtcgggctcgtgaacattttctttgcatggtcaagcactgtgcctgtgtttgcagctctgtggttcctaaacgggctagcacaagggttggggtggccaccttgcgggaaggtgcttcgcaaatggtttgaacccagccagtttggaacgtggtgggccattctgtccacgagtatgaatttagccggcgggctgggtcccattctcgccacgatcttggcacaatcttattcatggagaagcacactggccttatctggggctctgtgtgtggtggtctcctttttgtgcctcctgcttattcataacgaaccggcagacgtgggactgcgcaatttggaccctatgccttcggaggggaagaagggctctctaaaggaggagtccaccctgcaggagcttctgctgtccccatacctttgggtcctcagtactggatacctcgtcgttttcggggttaaaacctgctgtaccgattggggccagttcttcttaatacaggaaaagggtcagagtgcactcgtgggcagttcatatatgagcgcactggaagtggggggtcttgttggaagtatcgccgccggatatcttagcgaccgcgccatggccaaggcaggtctgagtaactacggtaaccctaggcacggcttactgcttttcatgatggctgggatgactgtctccatgtatctcttcagagtaacagtgactagcgattcgcccaagctgtggatcctcgttcttggtgcagtgttcggtttctcctcttatggtccaattgccctgtttggcgtgattgccaacgaaagcgcgcctcctaacctttgtgggacgagccacgctatcgttggtttgatggcgaatgtaggagggtttctggccggactcccgttcagcacaatcgcaaaacactattcatggagcacagctttctgggtggccgaagttatctgtgccgcaagcactgccgcattctttctgcttaggaatatcagaaccaaaatgggaagggtgagtaaaaaggctgag

SEQ ID NO: 19530 - DNA, 1287 bp, Artificial Sequence
  Description of Artificial Sequence: Synthetic coding sequence
atggctgcacaggggtacggatactacagaaccgtcatctttagcgcaatgtttggaggttactcactctactactttaatcgaaagaccttttcgtttgtgatgccctcactcgtggaagagattccactggacaaggatgatctgggattcatcacttcctcccaatccgccgcatacgctatttcgaagtttgtgagcggagtgctttctgaccagatgtccgctcggtggctttttagcagcggcctgcttctggtgggattggtcaacatctttttcgcgtggtcaagcactgtcccagtattcgcagctctttggttcctgaacggacttgcacaaggtctgggttggccaccttgcggcaaggtcctcagaaagtggtttgaaccttcccaatttggtacttggtgggccattctttccacgtcaatgaatctggcaggaggcctcggcccaatccttgccactatcctggcacagagctactcatggagaagcaccttggcactttcgggtgccctgtgtgtggtggtttccttcctttgtctgctgctcattcataatgagccagcagacgtcggccttcgaaatcttgatccaatgccatcggaaggaaagaagggttcgctgaaagaagagtcgaccctgcaggaactccttctgtcaccctacctctgggtgctctccaccggttacctggtggtgttcggagtcaaaacgtgctgtaccgattggggtcagtttttcttgatccaagaaaagggccaatccgctcttgtcggttcctcgtacatgtcggcactggaagtgggagggctggtgggttccattgccgcaggatacctgtctgatagagcaatggcgaaggcaggactttcaaactacggtaatcctaggcatgggctccttctgtttatgatggcaggaatgaccgtgagcatgtatctgtttagagtgaccgtgactagcgattccccaaagctgtggatccttgtgcttggagcagtctttggctttagctcctacggtccaattgctctttttggcgtcatagccaacgaatcggcaccgcctaatctttgtggcacgtcgcatgccattgtgggtctgatggccaatgtgggcggattccttgcgggacttccattttccacgatagcaaagcactactcctggtccacggcattttgggtggccgaagtcatatgcgcagcatcgactgcagcattctttctgctgcggaacatcaggacgaagatgggacgggtgtcaaagaaagcggaa

SEQ ID NO: 19531 - DNA, 1287 bp, Artificial Sequence
  Description of Artificial Sequence: Synthetic coding sequence
atggctgcgcaaggctacggctactaccgcactgtcatattctccgccatgttcggcggatactcactgtactactttaaccgcaagaccttctcgttcgtgatgccgtcgctggtggaggaaatcccgctggacaaggacgacctgggcttcattacctccagccaaagcgccgcgtacgctatctcgaagtttgtgtctggcgtgctctccgaccagatgagtgcgcgatggctcttttcgtcgggacttctgctcgtcgggctcgtcaacattttcttcgcgtggtcgagcacggtgcctgtctttgcagctctctggttcctgaacggactggcgcagggcctcggatggcctccatgcggtaaggtcctgaggaagtggttcgagccgagccagttcgggacctggtgggcgatcctctcaacctcgatgaatctggctggaggactgggaccgatcctggccaccatacttgctcaatcgtattcatggcggtccactctcgctctgagcggagcgctgtgtgttgtggtcagcttcttgtgtttgttgctgatccataacgaacctgcagacgtgggccttcgcaatctggaccctatgccgtccgaaggtaaaaagggatcgctgaaagaggaaagcaccctgcaggaacttcttctttcgccatacctgtgggtcctcagcaccggttacctggtggtgttcggggtcaagacctgctgcactgattggggacaattctttctcatccaggagaaaggacagtcggcattggtggggtcgtcatacatgagtgccctggaggtcggaggactggttggatcaatcgcggccggatacttgtccgatcgggccatggccaaggccggattgtccaactacggcaatccccggcacggactccttctgttcatgatggccggcatgactgtcagcatgtatctgtttagagtgacggttacttccgattctccgaagctgtggattttggtgctcggagcggtgttcggattctcctcttacggtccaatagcattgttcggtgtgatcgccaatgagtcagctcccccgaacctctgcggtacttcgcacgcgattgtgggacttatggccaatgtgggcggcttcctcgccggcctgccattctcgaccatcgccaaacattactcgtggtcgacggctttttgggtggcagaggtcatctgcgctgcgagcactgccgcatttttcctcttgaggaacatcagaaccaaaatgggccgagtgtctaagaaagctgaa

SEQ ID NO: 19532 - DNA, 1287 bp, Artificial Sequence
  Description of Artificial Sequence: Synthetic coding sequence
atggccgcgcaaggctacggatactatcgcaccgtcatcttcagcgcgatgttcggcgggtactccttgtattacttcaataggaaaactttctcgttcgtcatgccttctttggtggaagaaatcccgttggacaaggacgatctgggcttcatcactagctcccagtcagccgcttacgccatcagcaagttcgtgtcgggtgtgctgagcgaccagatgagcgccagatggcttttctcctcgggactccttctggtcggactggtgaatatcttcttcgcctggtcctcaaccgtgccagttttcgctgccctctggtttctcaacggcttggcccaaggactgggctggccaccgtgcggcaaagtcctgcggaaatggtttgagccgtcccaattcggcacttggtgggcgatcctctccacctccatgaacctggcgggtgggctcggcccgattcttgcaactatcctggcccagtcctactcctggcggtcaaccctggccctctctggtgcactgtgtgtggtggtgtcgttcctttgccttttgctgatccacaacgagccggccgatgttggactgagaaacctggaccccatgccatcggagggcaagaaggggtccctgaaagaggaatcgacgctccaggaattgttgcttagtccttacctctgggtcctcagcactggctacctggtcgtctttggggtaaagacttgttgcaccgattggggacagttcttcttgatccaagagaagggacagtcagcactggtcgggtcaagctacatgtcggcgctggaagtcggaggactggtggggtctatcgccgccggttacctttcggaccgcgcgatggccaaggccggactgagcaattacggaaacccgcggcatggactcttgctcttcatgatggcgggaatgactgtgagcatgtacctcttccgcgtcaccgtcacctcggactcgccgaagctctggatcctggtccttggcgcagtgttcggattctcctcgtacggaccgatcgcactgttcggagtgatcgctaatgagagcgcccctccgaatctgtgcgggacttctcatgcaattgtgggactgatggcgaatgtgggaggcttcctggccggcctcccgttctccactatcgctaagcactactcgtggtcaaccgcgttctgggtcgccgaggtgatttgcgcagcctctaccgccgccttcttcctgctgcggaacatccgcactaagatgggccgtgtgtccaagaaagccgaa

SEQ ID NO: 19533 - DNA, 1287 bp, Artificial Sequence
  Description of Artificial Sequence: Synthetic coding sequence
atggccgctcagggatatggatattataggacagtcatcttttcagctatgtttggagggtatagtttatactactttaatcggaaaacattctcgttcgtgatgccttctctggttgaagaaatacccctcgacaaagatgatcttggatttatcacttcctctcagtcagctgcatatgcgatctccaaatttgtgtccggagtactttcagatcagatgtctgcaagatggctcttctcctctgggctcttgctcgtcggattggttaacatattcttcgcatggagttcaacagtgcccgtgtttgccgctttatggttcctcaatggattggcccagggactcggatggcctccctgcgggaaagtgttaagaaaatggtttgaaccttcccaattcggaacttggtgggcgatcctatctacatcaatgaaccttgccggggggctcggacccattctggctacaatcctggcacagagttattcatggcgatctacattggccttatcaggagctctttgcgtggtagtgtcctttctctgcctacttctcatacacaatgaacctgcagacgtggggctcagaaatctggacccaatgccaagtgaaggaaaaaaaggatccctgaaagaagaatccacacttcaggaattactgctttctccttatttatgggtgctgtccactggatatctcgtggttttcggagtgaaaacttgctgtacagattgggggcagttctttcttattcaggagaaagggcagagtgcacttgtcggatccagttacatgagtgcactcgaagtagggggactagtggggtccatagccgctggatatctaagtgatagagccatggccaaagctggattgtctaattatgggaatccgcggcatggattgctactcttcatgatggcgggaatgacagtgtctatgtacctgttccgagtgacagttacttctgattctcccaaactctggatactagttctcggggctgttttcggattctcctcttatgggccaattgcccttttcggggtaatagcaaacgaatctgccccccccaatttatgcgggacaagtcacgccattgtcgggctaatggctaacgtgggaggattcctcgctgggctccctttttccacaatcgccaagcattactcttggtctacagctttttgggtggccgaagttatctgtgccgcttcaacagcagctttcttcctcctacggaacattcggacaaagatgggacgggttagtaaaaaagctgag

SEQ ID NO: 19534 - DNA, 1287 bp, Artificial Sequence
  Description of Artificial Sequence: Synthetic coding sequence
atggctgctcagggctacggttattatcggacagtgattttcagtgctatgttcggcggttacagcctctactacttcaatcgtaagacctttagtttcgtgatgccatcactggtggaggaaataccactggacaaggacgatctaggatttattacaagttcacagtctgctgcgtacgccatcagtaagtttgtaagcggcgtgttaagtgaccagatgtctgctagatggttgttctcctctggcctgcttctggtgggtttagttaatatattttttgcctggagttcaacagttccggtgttcgctgctctgtggtttctaaatggcctggcccagggtctcggatggccaccctgcggcaaggtcctcaggaaatggtttgagcccagtcagttcggcacctggtgggctatactgtctacaagcatgaacctggccggaggcttgggacctattctggcaaccatcctcgcgcagtcctattcttggcgctccacactggccctttctggagccctctgcgtggtggtgtcttttctgtgtctgctgctgatacacaatgagccagccgacgtcggattgcgcaacctcgatccaatgccatcagaaggaaagaagggaagcttgaaagaggagtctacgctccaggaactgttgcttagcccctatctttgggtcctgtctaccggttacctcgttgtattcggagtgaagacatgttgtactgactggggacaatttttcctgatccaggaaaaaggtcagagcgctttggtgggcagtagctacatgtcggctctggaggtgggcggccttgtgggcagcatcgcagccggctatcttagtgatcgtgccatggctaaggctgggctttcaaactacggcaatccccggcatggtctgctgctctttatgatggccgggatgactgtctctatgtatctgttccgagtaacagtgacgtcggatagcccaaagctgtggattcttgtcctgggcgccgtgtttgggttctcctcttatggaccgattgccctctttggagttatcgcaaacgaatccgccccccccaacctctgcgggacctcacacgcgattgttgggttgatggctaatgtcgggggcttcctggcaggcctcccgttcagcaccattgctaaacactattcctggtccacggctttctgggtcgccgaagttatctgcgcggcttcaacagccgcgttcttcctcctgagaaatatccgaactaagatgggaagggtgtcaaaaaaggccgaa

SEQ ID NO: 19535 - DNA, 1287 bp, Artificial Sequence
  Description of Artificial Sequence: Synthetic coding sequence
atggctgcccagggatacggctattatagaacggtgattttctctgcaatgtttggcggatatagtctgtactacttcaataggaagacattctctttcgttatgccatccctcgtggaagaaatcccgcttgataaggacgacttgggattcatcacctcatcccagtcggcggcgtatgctataagcaagttcgtctcaggagtgctctcagatcagatgtccgctcggtggctcttttcctccgggctgttactggtgggacttgtgaatatcttctttgcctggtcctcaactgttcccgtgttcgctgccctgtggtttctgaatgggctggctcagggtttgggctggcccccatgtggaaaggtgctgagaaaatggttcgagcctagtcagttcggaacatggtgggcgattttatctacttctatgaatctggccggaggcttaggaccaatcttggcaactattctggctcaaagctattcatggcggtcaacccttgctctatcaggagccctgtgcgtggtcgtctcctttctttgcctcctgctgatccataatgaacccgcagacgtcggactccgaaatctcgatccgatgccatcagagggtaaaaaagggagtctgaaggaagagtctaccctgcaggagctcctgctgagtccctacttgtgggtgctgagtacaggctacctggtggtgtttggcgttaagacctgttgcactgactggggccagtttttcctcatccaggagaagggacagagcgcgcttgtgggctcgagctacatgtcagccctggaagttggcgggctggtggggagcatcgccgcggggtatctcagtgacagagccatggcaaaggccgggctttcaaattacggtaacccccgccatgggctgcttttgtttatgatggccggaatgaccgtcagtatgtacctgtttcgcgtgaccgttacaagcgactcccccaaattatggattttggtactgggggcagtgtttgggttttcctcatatggtccaattgccctctttggcgtgatcgccaatgagtccgccccaccgaacttgtgcgggacatctcacgcaatcgtggggctgatggcgaacgtcggcggcttcctcgccgggctacctttttctaccattgccaagcattactcatggtctaccgcattttgggtcgcagaagtgatttgcgcggcgagcaccgcagccttctttctactccgcaacatccgtaccaagatgggacgggtatcgaagaaggctgaa

SEQ ID NO: 19536 - DNA, 1287 bp, Artificial Sequence
  Description of Artificial Sequence: Synthetic coding sequence
atggcggctcagggatatggctattaccgaactgtgatctttagtgccatgtttggtggctactccctatactactttaaccggaagacttttagctttgtcatgccctctcttgtggaagagattccgctggataaggacgatttagggtttatcacctcaagccagagtgctgcatacgctatttccaagttcgtgagcggcgtgcttagcgaccaaatgtccgcccgatggttattctccagtggacttctgcttgtgggcctggttaacatttttttcgcatggtcgagcacagtacctgtgttcgccgccctgtggttcctgaatgggctggcacagggtcttgggtggcccccttgtggcaaggttttacggaaatggttcgaacccagccaatttggtacctggtgggctattttgagcacctctatgaacctagcgggcgggctagggccgatccttgcaactattctggcccagtcctactcttggaggtcaaccctagctttatccggcgccctgtgcgtggtggtatcctttttatgcctcctgcttatccataacgagccagccgatgtcggacttagaaatctggaccctatgccaagcgaagggaagaagggcagcttaaaagaggagagcactcttcaagagctgctcttgagcccctatctgtgggtgctaagtacaggctatctggtggtattcggcgtgaagacttgctgtacggattggggacaattcttcctgattcaggagaaggggcaatcggcgctggtgggctcctcttatatgtccgccctggaggttgggggcttggtgggctcaatcgccgccgggtatctttccgatagagccatggccaaagccggtctctctaattacggcaaccctcgacacggccttctgctgtttatgatggctggcatgaccgtgtcaatgtacctttttcgggttacagttactagtgattcaccgaaactctggattctagtgctgggcgcagtcttcgggttctcctcctacgggccaatcgcattatttggcgtaatcgcaaatgagagtgcccctcccaacctgtgtggcaccagccatgctattgttgggctcatggcaaatgtcggaggcttcctcgccgggctccccttcagcacaatcgcaaagcactactcttggtctacggccttttgggtggctgaggtgatttgtgctgcttccactgccgccttctttttgcttaggaatatccggaccaagatgggccgtgtttctaaaaaggcagaa

SEQ ID NO: 19537 - DNA, 1287 bp, Artificial Sequence
  Description of Artificial Sequence: Synthetic coding sequence
atggcagcccaaggatacgggtactatcgcaccgttattttctccgcaatgtttgggggctactcactctactacttcaaccgcaagaccttctctttcgtgatgccatcccttgtcgaagaaatcccacttgataaggacgatctcggtttcataacgtccagccagtctgctgcctacgccatttccaagtttgtctcgggtgttctcagcgaccaaatgtcggctcggtggctcttctcgtccgggctcctcctcgtcggcttagttaatattttcttcgcgtggagctcgacggtgcccgtcttcgccgccctttggttcttgaacggtttggcgcaaggtcttggatggcccccatgtggaaaggtgttgcggaagtggttcgaacctagtcagtttggcacttggtgggccatcctgagcacttctatgaaccttgccggcggccttggacctattctggcaacgattctggcccagtcatacagttggcgttctaccctggctctctccggtgcgctctgcgtggtcgtgagcttcctctgcctgctcctgatccacaatgagcctgctgatgtgggtctgcgcaacttggatcctatgccttcagaaggtaagaagggtagtctcaaggaagagagcacgcttcaggagctgctgctgtccccttatctctgggtcctgagtacaggttacctggttgtttttggagtcaagacctgctgcaccgactgggggcagttcttcctcatacaggagaagggtcagtccgccttggtgggcagctcgtacatgtccgccttggaggtaggaggtttggtcggctcgatagccgccggttacctgtccgaccgtgctatggctaaggccggtctaagcaattacggtaaccctaggcacggcctccttctgttcatgatggccgggatgactgtttccatgtacctgttccgtgtcaccgtcacatctgactcccctaagctgtggattctggtgctgggcgccgtattcggtttcagcagttacgggcctattgccctgttcggcgtcattgccaacgagtcggcgcccccgaacctgtgtggcacttcgcacgcgattgtcggacttatggcaaacgtcggtggcttccttgctgggttgccgttttcgaccatcgccaaacactactcctggtcgaccgccttctgggttgccgaagtcatctgtgctgcatccactgccgcctttttccttctgcgtaacattcgcaccaagatgggtcgcgtgtccaagaaggctgag

SEQ ID NO: 19538 - DNA, 1287 bp, Artificial Sequence
  Description of Artificial Sequence: Synthetic coding sequence
atggcagcccaggggtatggatattaccgtacagtaatcttttcagccatgtttgggggctactctctctactacttcaaccgcaagaccttctcttttgtaatgccgagcctagtggaggagatcccactggataaggacgatctcggattcattacctcatctcagagtgctgcctacgctatctctaagttcgtcagcggagttttgagcgatcagatgtctgcgagatggctgttttccagcgggctgctgctagtgggcctcgtgaacatcttcttcgcatggagctctactgtccctgttttcgctgcattgtggtttctcaacggtttggctcagggattggggtggccaccttgcggcaaggttttgcgcaagtggttcgagccatctcagtttggtacctggtgggccattctttcgacatctatgaatttggctgggggtctggggcctatcctggctaccatcctggctcagtcatactcatggcgatctaccctagccctgtccggggccctgtgcgtagtcgtaagctttttgtgtcttttactcattcacaatgagccagctgacgtcggtctgcggaatctagatccaatgccgtccgaggggaagaaaggatccctgaaggaggaaagcaccctgcaggaactgctcctctccccctatctttgggtcctcagcactggatacctggtggtgtttggggtcaaaacttgctgcaccgattgggggcagttcttcctgatacaagaaaaaggccagtctgccctcgtggggtcttcctatatgagtgccttggaagtcggcggactggtaggtagtattgctgcgggttacctgtccgatcgtgctatggcaaaagccggactcagtaattacggaaaccccaggcatggactactgctgttcatgatggcaggcatgacggtctctatgtacctgttcagggtaacggtaacgtccgactccccaaaactctggatactcgtgctcggagctgtgtttggcttctcctcttatgggccgatcgcattgttcggagtgatcgctaacgaatccgcacctccaaatctgtgtggcacaagtcacgctatcgtgggcctgatggccaacgtggggggattcttggccggactgcccttctctacaattgcaaagcattactcatggagcactgctttctgggtcgccgaggtgatctgtgccgcctccactgctgctttcttcctgctgcggaacatcagaacaaaaatggggagagtgagtaagaaagctgag

SEQ ID NO: 19539 - DNA, 1287 bp, Artificial Sequence
  Description of Artificial Sequence: Synthetic coding sequence
atggccgctcagggttacggctactatcgaacagtgatcttctccgcaatgttcggtggttacagcctctattacttcaaccgtaagacgttcagctttgtcatgccatcactcgtggaagagatccctctggacaaggatgacctagggtttattacgtcgtctcagtccgccgcttacgctatcagcaaattcgtctccggcgtgctttcggaccagatgtccgcacgctggctgttctcgtccggactgctcctcgtcgggcttgtgaatatttttttcgcatggtctagcacagtgcccgtttttgccgcactgtggtttttgaacgggttagcccaaggtctgggatggccgccatgcggcaaggtcctgcgcaagtggtttgaaccgagccagtttggaacatggtgggccatactctcaacatccatgaatctggcgggcggactcggcccaattctcgccacaattctggcgcagtcatacagctggagatcaactctggctctctccggagctctgtgcgtggtcgtttccttcctgtgcctgcttctgatccacaacgagccagccgacgttggcctcaggaatttagaccccatgccttctgagggcaaaaagggaagccttaaggaagaaagtactcttcaagagcttcttctctctccctacctttgggtgctcagtacgggctacctggttgtcttcggggtgaagacttgctgcaccgactgggggcagttcttcctaatacaagaaaaagggcaaagtgccctggtgggcagctcttatatgtccgccctcgaagtcggtggattggtcggcagcattgccgcgggctacctttccgatagggctatggcgaaagctggcctgtccaattatggaaatccccgccatggactgttacttttcatgatggctggaatgacagtgtctatgtatctattccgtgtgacggttactagcgacagccccaagttgtggattctagtgctcggggcggtctttggtttcagctcgtatgggcccatcgccctttttggagttatagcgaatgaatctgcccccccaaacctctgcggaacctctcatgctattgtgggtctaatggccaacgtaggagggtttctggcagggctgcctttttcgacgattgctaaacactactcctggagcaccgcattttgggtggctgaggtcatctgtgccgcgtccaccgcggcatttttcctgcttagaaacatccgtactaaaatgggcagggtgagcaaaaaggctgaa

SEQ ID NO: 19540 - DNA, 1287 bp, Artificial Sequence
  Description of Artificial Sequence: Synthetic coding sequence
atggcggcacagggctacggttactaccgcactgtgattttctcagccatgtttggaggatactcactgtactactttaaccgaaagacctttagtttcgtcatgccaagcctggtcgaagagattcctctcgacaaggacgatcttggtttcattaccagctctcaatctgcagcctacgcaatctcaaaattcgtctcaggggttctttcggatcagatgtccgcccgctggctttttagctcagggcttcttctcgtgggacttgtcaacatctttttcgcgtggtcatctacggtgcctgtgttcgcagcgttgtggtttttgaacgggctggcacagggactgggctggcccccttgtggaaaggtgctgagaaaatggttcgaaccgtcccagtttggcacctggtgggctattctttcgacgtcaatgaatttggccggtggtcttggtccgatcctcgcaaccattctcgcacaatcatattcatggagatcgaccctcgcactttccggtgcactctgtgtcgtggtgtcgtttctgtgtcttttgttgattcacaatgaaccagcggacgtcgggctgcgaaatttggatcctatgccttccgagggtaagaagggatccctgaaggaagagtcgaccttgcaggagctgctgctttcaccttatctctgggtcctgtccactggctacctggtggtctttggagttaaaacttgttgtactgactggggacaattcttccttattcaggagaaaggtcagtcggcccttgtgggttctagctacatgtcagccctggaggtgggtggtctggttgggtccattgcagcaggatacttgtcggatagagctatggcaaaggcagggctttccaactacggtaatcctcgtcacggtttgctgctgtttatgatggcaggcatgaccgtgtcaatgtacctgttccgagtgactgtcacctcggactccccaaagctgtggatccttgtgcttggagcagtgtttggattttcgagctacgggccaatcgcactgtttggggtgattgcgaacgaatctgcgcctccaaacctgtgcggtacctcccatgcaattgtgggactgatggcaaacgtgggaggattcctggcaggactccccttttcgacgatagcaaagcattactcctggtcgactgctttttgggtggcggaagttatttgcgcagcatccaccgccgccttttttcttctgagaaatatcagaaccaagatgggcagagtgtcgaaaaaggcagaa

SEQ ID NO: 19541 - DNA, 1287 bp, Artificial Sequence
  Description of Artificial Sequence: Synthetic coding sequence
atggcagcgcagggatacggatactaccgcaccgtgattttctcagccatgttcggcggctactccctgtactacttcaatcgaaagactttcagcttcgtgatgccgtcgctggtggaggagatcccactggacaaggatgacctcggttttatcacctcttcgcagtcggccgcttacgccatctcgaagttcgtgagcggcgtgctgagcgatcagatgtcggcgcgctggctcttctcgtccggtttgctgctggtagggctcgtgaatatcttcttcgcatggtcgtcgaccgtgccggtctttgctgccctctggtttctgaatggattggcccagggactgggatggccgccttgtggaaaggtgctgcgtaagtggttcgagccgtcacagttcggaacttggtgggccatcctcagcacctcgatgaacctggccggaggactgggcccaatactcgcaaccatcctggcgcagtcgtatagctggaggtccactttggcgctgtctggggcactctgcgtggtggtgtccttcttgtgccttctgcttatccataatgagcccgccgatgtgggacttagaaacctcgatccgatgccgtcggagggaaagaaaggcagtcttaaggaagaatcgaccctgcaggaactccttctgagcccgtacctgtgggtgctgagcacggggtacctcgtcgttttcggggtgaaaacttgctgcaccgactggggacagttcttcctgattcaagagaagggacagtcggcgctggtcggatcctcctacatgtccgcgttggaagtgggagggctcgtgggatccatcgccgccggatacctcagcgaccgggctatggccaaggctgggctgtcaaactacggcaatccgagacacggactgcttctgtttatgatggccggaatgactgtgtcaatgtacttgtttagggtgaccgtgacttctgactcgcccaaactgtggatccttgtgctgggagcagtctttggcttttcttcgtacggacctatcgcactgttcggagtgattgcgaacgaatcggcaccgccgaatctctgcggcacctcgcacgccatcgtggggctcatggctaatgtcggcggatttctcgccggactcccattctcaactattgcaaagcactactcgtggagcaccgcgttctgggtcgcggaggtgatctgcgccgcatccacggccgcgttttttctgctccggaatatcaggactaagatgggacgcgtgtccaaaaaagcggag

SEQ ID NO: 19542 - DNA, 1287 bp, Artificial Sequence
  Description of Artificial Sequence: Synthetic coding sequence
atggcagcccaggggtacgggtactatcgcaccgttatttttagcgccatgtttggtggatacagcttatactacttcaatcgcaaaacgttctcattcgtaatgccctctctggttgaggagatccctcttgacaaggatgatttgggcttcatcacttctagccaaagtgccgcctatgccatttccaagttcgtgtccggggtcctgtcagaccagatgagcgctcggtggctttttagcagcgggttactcttggtcggactggtgaacatcttctttgcttggtctagcacggtgcccgtctttgccgccttatggttccttaatggcctagcccagggcctggggtggcccccttgcgggaaagttctgcgcaagtggtttgagccttctcaatttgggacatggtgggccatcctcagtactagtatgaacctggctgggggccttgggcccattctcgccacgattctggcccaaagctatagttggaggtctactctcgcgctgtctggagccttgtgcgtcgtggtgtctttcctctgccttttgttaatccataatgaacctgcggacgtgggcctgagaaacctggatccaatgccctctgagggtaagaaagggtccctaaaggaggaatccactctacaggagctgctgctctccccatacctttgggtactttccaccggctatctggtggtattcggtgtgaagacctgttgcacagattggggccagttcttcctgatccaggaaaaaggccagtcggctctggtcggcagttcttatatgagcgcactggaagtgggcggcctggttggtagtatcgcagccggctacctgtcagatcgtgccatggccaaggccggcctttccaactacgggaatccgcgacatggtctgttgctgttcatgatggcaggaatgacagtctcaatgtacctcttcagggtcaccgtaacaagcgactcacctaaactctggatactcgtgttgggggccgtatttggtttttccagctacggtccaatcgcgttgttcggagtgattgccaacgagtcagccccacctaacctttgcgggaccagccatgcgatcgtgggactaatggcgaacgtcggcggcttcctcgcggggctgccttttagtactatagccaagcattactcatggtctacagcattctgggtcgctgaagtcatttgcgctgcatccactgcggcgttttttcttctcagaaatatcaggaccaagatgggccgcgtcagcaaaaaagcagag

SEQ ID NO: 19543 - DNA, 1287 bp, Artificial Sequence
  Description of Artificial Sequence: Synthetic coding sequence
atggcagcacagggctatgggtactaccgcaccgtcatcttttcggcaatgtttggaggttatagcctctattacttcaataggaaaacgttctccttcgtgatgccatcgcttgtggaagagattcctctggataaggatgatctggggttcataacctcgtcgcagtcggcagcttacgccatcagcaagtttgtgtccggagtcctttcggatcagatgtcagcacgctggctgttttcaagcgggctgcttcttgtgggtcttgtgaacatcttttttgcctggtcgtccaccgtgcctgtttttgcggcactttggtttctgaacggactggcgcaaggactgggatggcctccgtgtggtaaggtgctgagaaagtggttcgaacctagccaattcgggacctggtgggcaattctttctacctcgatgaatcttgcgggtgggttgggcccaattctcgcaactattctggcacaatcctactcatggcgctccacgctcgccctttcgggtgcactttgtgtggtggtgtcatttctgtgtctgctcctgatacacaatgaaccggcggatgtcggcctccgcaaccttgacccaatgccaagcgagggtaagaaaggttcactgaaggaggaatctactctgcaggaacttctgctttcaccttacctgtgggtgctgtcgactggatacctggtggtgtttggagtcaagacctgctgtaccgattggggacagttttttctcatccaagagaaaggacagagcgcactcgtcggatcatcatacatgtcagcgctggaagtgggtggcctggtgggatctatcgcagccggatacctgtccgatagagcaatggctaaggcaggattgtccaactacggaaatccaagacatgggctcctgctgtttatgatggcaggaatgaccgtgtccatgtacctttttcgggtcaccgtgacgtcagacagtcctaagctctggattctcgtgcttggggctgtctttggtttctcgtcgtacggtccgattgcattgtttggggtgattgccaacgagagcgcacctcccaatctttgcgggacttcccacgctattgtgggtctgatggcaaatgtgggcggattcctcgcagggctccccttttcgaccattgcaaagcactactcatggtccaccgcattctgggtggcggaagtgatctgtgcagcatcaaccgcagcattctttcttcttagaaacattcggaccaagatgggtcgcgtgtcaaagaaggcagaa

SEQ ID NO: 19544 - DNA, 1287 bp, Artificial Sequence; identical to SEQ ID NO: 19538
  Description of Artificial Sequence: Synthetic coding sequence

SEQ ID NO: 19545 - DNA, 1287 bp, Artificial Sequence
  Description of Artificial Sequence: Synthetic coding sequence
atggcagcgcagggatacggttactatcgcaccgtgatctttagcgcaatgttcggtggttacagcctgtactactttaatcggaaaaccttctcctttgtgatgccttcccttgtggaagaaattcctctcgataaggacgacctgggcttcataacttcaagccagagcgccgcatacgcaatttctaagtttgtctcaggggtgctttccgatcaaatgagcgcaagatggctgtttagctcaggactgctccttgtcggcttggttaacattttctttgcatggtcgtcgaccgtgccagtgtttgctgcgctctggttccttaatggacttgcacaagggcttggttggcctccctgtggaaaagtactccgaaagtggtttgagcccagtcaatttggaacctggtgggccatcctttctacttccatgaacctggccggtggcctgggaccaatcctcgctacgatactggcgcagagttactcctggcggtccaccctggcactctcgggagcactctgcgtggttgtgtcttttttgtgcctgctgttgattcataacgaacctgccgatgtggggcttagaaaccttgatccgatgccttcggaaggaaagaagggtagccttaaagaggaaagcactctgcaggaacttctgttgagtccatacttgtgggtgctgagcaccggataccttgtggtctttggggtcaagacttgttgcactgattggggacagtttttcttgattcaagagaagggtcaatctgcccttgtcggatctagttacatgtcagcacttgaagtgggcggactcgtgggctctatcgccgcaggatatctttcggatagggcaatggcgaaggctggtctttcaaattacggtaatcctcgacacggactcctgctgtttatgatggcgggcatgactgtgtccatgtacctgttcagagtcaccgtgacctcagactcaccaaaattgtggatcctggtgctgggcgctgtattcggattttcgtcgtacggtcccattgcactgtttggggtgatagccaacgagtcggcaccacctaacctttgtggcacctcgcacgcgattgtgggtctgatggccaacgtcggcggattcttggccgggctgccgttttcaactattgcaaagcattacagctggtccactgccttctgggtcgctgaggtcatctgtgcggcctcgaccgcagcattctttctgctgagaaatatccgcacgaaaatgggccgtgtgtcaaagaaggcagaa

SEQ ID NO: 19546 - DNA, 1287 bp, Artificial Sequence
  Description of Artificial Sequence: Synthetic coding sequence
atggcagcgcagggatacggatactaccgcactgtgatcttcagcgcgatgtttggcgggtatagcctgtactacttcaaccggaaaactttcagcttcgtgatgccgtcgctggtggaagagattccactggataaggacgacctgggattcatcacctcatcgcagagcgcagcttacgccataagcaaatttgttagcggagtcctgagcgatcagatgtccgccaggtggctgttctcgtcggggctgcttctggtgggactggtcaatatcttttttgcctggtcctcgactgtccctgtctttgcagcgctttggtttctcaacggcctggcgcaaggccttggttggcccccttgcgggaaggtgttgcgcaagtggtttgaaccatcgcaattcggcacgtggtgggcaatcctctcgaccagcatgaacctggcgggaggtcttgggccgatcctcgccaccatcctggcacagtcgtactcgtggaggtccactctggcgttgagcggggcgctgtgcgtggtggtgagcttcctgtgtttgctgctgatccacaatgagccggcagacgtcggcttgcggaatctcgatccaatgccctctgaaggaaagaagggatccctgaaggaggagtcgactctccaagaactgctgctgtcaccatacctgtgggtcctgtcgacgggctacctggtggtgttcggagtcaagacctgctgcaccgattggggacagttctttctgattcaggaaaagggtcagagcgccctggttggaagctcatacatgtcagctctcgaagtcggaggactcgtcggcagcatcgccgccggatatcttagcgacagagcgatggctaaggctggcctgagcaactacggaaacccccggcacggattgctgcttttcatgatggccggaatgactgtgtccatgtacctgttcagggtcaccgtgacgagcgacagcccgaagctgtggattctcgtgcttggcgccgtgttcggattttccagctacggaccgatcgccctgttcggcgtcattgctaacgaatccgccccgccgaacctgtgcggaacttcgcacgccatcgtgggtctgatggccaacgtgggaggcttcctggcaggactgcccttctccaccatcgccaagcattactcatggtctactgccttctgggtggcagaagtgatctgcgcagcttctactgcagcgtttttcctgcttcggaacattagaactaagatgggacgggtgtcgaagaaggccgaa

SEQ ID NO: 19547 - DNA, 1287 bp, Artificial Sequence
  Description of Artificial Sequence: Synthetic coding sequence
atggcagctcaagggtacggctactaccggacggtgatcttctccgccatgttcggtgggtactccctctactacttcaacaggaaaaccttctcattcgtgatgccaagtctggttgaagagatcccgctcgacaaggacgatctgggtttcatcactagctcacagtcggcggcctacgccatctcgaagttcgtctcaggagtgctgtccgatcaaatgtccgcaagatggctgttcagcagcggacttctgctcgtgggcctcgtcaatatcttttttgcctggtcgtcgacggtgcccgtgttcgctgcgctgtggttcctcaacggactcgcccagggcctcggctggcccccatgtggaaaggtcctgcgcaaatggtttgaaccttcgcagtttggtacctggtgggccatcttgtccacctccatgaatctggccgggggactcggcccgatcctggcaaccatcctcgcccagagctacagctggagatcgaccctcgcactgagcggtgcgctgtgtgtggtggtgtcatttctctgcctgctgctgatccacaatgagccagctgatgtggggctccgcaatctcgatcctatgccgtcagaggggaaaaaaggatccctgaaggaggagtcgacccttcaggagctgctgctctcgccgtacctctgggtgctgtccaccggttacttggtggtcttcggcgtgaagacttgctgcaccgattggggacaattctttctgatccaggagaaaggtcaatcggcgcttgtcggctccagctatatgtcggctctggaggtgggaggactggtgggatcaattgccgctggatacctgtccgatcgggccatggccaaggcgggactttccaactacggcaacccgagacatgggctcctgcttttcatgatggcggggatgaccgtctcgatgtacttgtttcgggtgactgtgacctcagattcaccaaagctgtggattctcgtgctcggagcggtgttcggattctccagctatggcccaattgccctgtttggagtgatcgccaacgaaagcgcgcctccgaatctgtgcgggacctcccatgccatcgtgggccttatggctaatgtcggaggattcctcgcaggtcttccgttctccactatcgcaaagcactattcctggtcaactgccttctgggtggcggaggtcatttgcgctgcatcaactgctgcgttcttcctcctgcggaacatccggaccaagatgggtcgcgtgtcgaaaaaggccgag

SEQ ID NO: 19548 - DNA, 1287 bp, Artificial Sequence
  Description of Artificial Sequence: Synthetic coding sequence
atggccgcgcaaggatacggttactaccggacggtgattttcagcgccatgtttggtggctacagtctttactactttaacaggaaaactttctcgtttgtgatgccatcgctggtggaagaaataccacttgacaaggacgacctggggtttatcacctcctcgcaatccgccgcatatgcaatttcgaagtttgtttcaggagtcctgtcagaccaaatgtctgccagatggcttttttcctcgggcctgctgcttgtgggtctggtgaacatcttttttgcctggtcaagcaccgtgccagtctttgcggcactctggtttctcaacggccttgctcaaggacttggatggcctccttgcggaaaagtgctccggaagtggtttgagccctctcagtttggtacctggtgggcaattctgtccacgtccatgaacttggcaggaggtctgggcccaatactcgcaaccatcctggcgcaatcgtacagctggagatcgacgctcgcactgtccggagcactctgtgtggtagtctcgttcctgtgtctgctccttattcataacgagccagcagatgtgggcctgaggaacctggatccaatgccttccgaaggaaagaagggctcgctgaaggaggagtcaactctgcaggaactgctcctctcaccgtacctctgggtgctgtcgaccggataccttgtggtgttcggtgtgaaaacctgctgcaccgattggggacagttttttctgattcaagaaaagggccagtcagcacttgtcggctcaagctacatgtccgccctcgaagtgggtggattggtgggtagcatcgcagcaggatacctctcggatagggctatggcaaaggcgggcctgagcaattacggaaatccacgtcatggactgttgctgtttatgatggcagggatgacggtgtccatgtacctgttccgcgtgaccgtcacctctgattcaccaaagctgtggatactggtgctgggggccgttttcggattctcgtcgtacggaccaattgccctgtttggtgtgatcgcaaacgagtccgccccacccaatctgtgtggtacctcacatgcaatcgtgggactgatggcaaacgtgggaggttttctggctggcctccctttttccactatcgcaaaacactactcgtggtcaaccgccttctgggtggcagaggtcatttgtgctgcatctactgcagcgttcttccttttgaggaacatccgcacgaagatgggtcgggtgagcaaaaaggcagaa

SEQ ID NO: 19549 - DNA, 1287 bp, Artificial Sequence
  Description of Artificial Sequence: Synthetic coding sequence
atggcagcacaaggatacgggtactaccggaccgttatttttagcgcaatgttcggggggtacagcctctactattttaatagaaaaaccttctcttttgtgatgccgtcacttgtggaagaaattcctctggacaaggacgatctgggttttatcactagctcccagagcgcagcatacgctattagcaagttcgtgagtggggtcctgagcgaccagatgtccgcgcggtggcttttttcgtcgggccttctattggtgggtctagtgaacatcttcttcgcctggagttctactgtgccagtatttgccgccctctggttcctgaatgggcttgctcaaggtctaggatggcctccctgcgggaaagtactgcggaagtggtttgagcccagtcagttcggtacgtggtgggccatactgagtacaagtatgaacttagcgggcggcctgggacctatacttgcaactatcttggcacagtcctactcctggcgaagcactttagctctttccggtgctctgtgcgtagtagtgtctttcctgtgtctgctactgatccacaatgaacctgctgatgtcggactcaggaacttagatccgatgcctagcgaagggaagaaaggtagtctcaaggaagaaagcaccctgcaggagctgctgttaagcccttatttatgggtgctgtccaccgggtatctggtcgtttttggtgtcaagacctgttgtacagactggggccagttttttcttatacaagagaagggtcaatcagctctcgttggttcttcctatatgtctgccctagaggtgggcgggctggtgggatccatcgcagccggctacctgagcgaccgagcaatggctaaggctggactcagcaattatggaaatcctcgccatggcctgctgttgtttatgatggccggtatgaccgtgtccatgtacctcttccgcgtgactgtgacatccgactcaccaaaactctggatcctagtgctcggagctgtgtttggtttctcctcttacggaccaatagccctgtttggcgtgatcgctaatgagagtgcgccgcctaacctctgcgggacctcccacgccattgtgggcctgatggcgaacgtcgggggctttctcgcagggctgccgttttcaaccattgccaagcactacagttggtctaccgcattctgggttgcagaagtcatctgcgccgcttcgactgctgcttttttcttgctacgaaatattaggacaaagatggggcgagttagcaagaaagccgag

SEQ ID NO: 19550 - DNA, 1287 bp, Artificial Sequence
  Description of Artificial Sequence: Synthetic coding sequence
atggctgcgcagggttatggctactataggaccgtgatctttagcgcgatgttcggcggctactcattatattatttcaacaggaaaactttcagctttgtgatgcctagcctcgttgaagaaattccactcgacaaagatgacttgggattcatcacctctagccagagcgcagcttacgccatcagcaaatttgtatcaggagttctgtcagaccagatgagcgccagatggttattcagctctggcttgcttctggtgggtctggtgaacatcttcttcgcttggtccagcactgtgcccgtgttcgccgcgctttggtttcttaatggattagcacaagggttgggctggcccccttgtggaaaagtgttgaggaaatggtttgagccaagtcagtttggtacatggtgggccatactgtcaacaagcatgaacctggccggaggcctggggcctatcctggccacaatactggcacagagttatagctggcggtctactctggctctgtccggagctctatgtgtcgtggtctcctttttatgccttctccttatccataatgaacccgcagatgtaggcttacgtaatttggatcctatgcccagcgagggtaagaaggggtccctgaaggaggaaagcaccctgcaggaattgctcctcagtccatatctgtgggtgctgagcactggctacctggttgtgttcggagtgaaaacctgctgtactgattggggtcagttttttttaatacaggagaaggggcagtccgccctcgtgggatcctcttacatgtctgccctggaagtcggcggcttggttggcagcatcgctgctggttatttgtcagaccgtgcgatggcaaaggccggactgagcaactacggaaaccctagacatgggttactgttgtttatgatggcgggaatgaccgtctctatgtacctcttccgagtgacagtaactagcgattcaccaaaactgtggatcttggtgttaggagccgtgttcggcttttcgtcatatggccctattgccctcttcggagtaatagctaatgagtccgctccccctaatttgtgcggtacttcccacgctatcgtggggctaatggctaacgtgggaggcttccttgctggattgccttttagcacgatcgccaaacattattcgtggagtacagcattctgggtggcggaggtgatctgtgctgcttccactgccgcctttttcctgttgcggaatataaggaccaaaatgggaagggtgagcaagaaagctgag

SEQ ID NO: 19551 - DNA, 1287 bp, Artificial Sequence
  Description of Artificial Sequence: Synthetic coding sequence
atggcagctcagggatatggatactaccgaactgtgattttttctgccatgttcggcgggtactctctttactattttaaccgcaagacatttagttttgttatgccatccctggtagaagagattccactcgacaaggacgatctgggtttcattacatcatcccagagtgcagcatacgctatatcaaagtttgtgtccggtgtgctttccgatcaaatgagcgctaggtggctgttttcaagtgggctgctcctggtgggcctcgtcaatattttttttgcttggtcttccaccgtgcctgttttcgctgctctgtggttcctaaacgggttggctcagggtctggggtggcctccctgcggtaaggtcttacgaaagtggtttgaaccttctcagttcgggacttggtgggctatcttgagcacttccatgaacctggctggcggcctgggtcctatactagctaccatactggcccagagttatagttggaggtcaaccctcgctctgagcggagccctatgtgtggttgtgagctttctgtgtctgctgctgattcacaatgaacccgctgatgtaggcctgcgaaacctggatcctatgccgtctgaagggaagaaggggagcctaaaggaagagagcaccctgcaggaactcttactatcaccatacctctgggtgctgtctaccggttatctggtggtgttcggcgtgaagacctgttgtaccgactggggccagttttttctaatccaggaaaaggggcagtctgccctggtgggctctagctacatgtctgccctggaggtgggcggattggtgggcagcatcgccgctgggtacttgtcagatagggctatggccaaggctgggctgtccaactatggcaatcctagacatggcctgctgctgttcatgatggcagggatgacagtcagcatgtacttattccgggtgactgtgacaagcgactcccctaaactctggatactggttctgggcgcagttttcggtttttccagctacgggcctatcgctctgttcggcgttattgccaacgaatccgcaccacctaacctgtgcgggacctcccacgctatcgttgggttaatggccaatgtaggaggcttcctggccggtctacctttcagtacaattgccaaacactacagttggagtaccgctttttgggttgcagaggtcatatgcgccgccagtaccgcagctttttttttactacggaatattagaaccaaaatggggcgggtgtctaagaaagcagag

SEQ ID NO: 19552 - DNA, 1287 bp, Artificial Sequence
  Description of Artificial Sequence: Synthetic coding sequence
atggccgcacagggttacgggtactaccgcaccgtgatcttcagcgccatgttcggcggatactccttgtactacttcaaccggaaaaccttctcgttcgtcatgccgtcgcttgtggaagagatcccgctcgacaaggatgacctgggcttcatcacctcctcccagtcggcggcatacgcgatctcgaagttcgtttcaggtgttctgtcggatcaaatgtcggcgcgatggctgttctcgtccggacttctgctggtcggactggttaacatctttttcgcatggtcatcaacggtgccggtgttcgcggcattgtggttcctcaatggactggcacaggggctgggatggccgccatgcggaaaagtgctgcggaagtggttcgaacctagccaattcggaacctggtgggccatcctctccaccagcatgaacctcgcaggtggcttggggcccatcctggccactatcctggctcaatcctactcctggcggtcgaccctggcgctgtcgggcgccctttgtgtcgtggtttcatttctgtgcctcctgctgatccataatgagccggccgatgtgggactccggaacctggacccgatgccgagcgagggaaagaagggaagcctgaaggaagaaagcaccctgcaggaactgctcctgtctccgtacttgtgggtgctgagcactgggtatcttgtggtgtttggcgttaaaacctgctgtactgattggggacagttctttctgatccaggaaaaggggcaatcggcactcgtgggttccagctacatgagcgcactcgaggtgggcggacttgtcgggtccatcgccgcgggataccttagcgacagggctatggccaaggcgggactgtccaactacggaaatccacgccacggactgctcctgttcatgatggccggaatgacggtgtcgatgtacttgtttagagtgactgtgacctcggactcaccgaagctctggatcctggtcctcggagccgttttcggattctctagctacggaccaatcgcgctgtttggcgtgatagccaacgaaagcgcaccgccgaacctgtgcgggacctcccatgcgatcgtcggactcatggccaacgtgggaggattccttgcagggctcccattctctaccatcgctaagcactactcgtggagcaccgcgttttgggtcgctgaggtgatttgcgccgcttcaacggctgctttctttctgctccgcaacatccggaccaaaatgggacgagtgagcaaaaaagcggag

SEQ ID NO: 19553 - DNA, 1287 bp, Artificial Sequence
  Description of Artificial Sequence: Synthetic coding sequence
atggccgctcaggggtacggctactaccgcacagtgatttttagcgctatgtttggtggatatagtctgtactactttaacagaaaaactttcagttttgtgatgccctcacttgtggaagaaatacctctggataaagacgatcttggtttcattacctcctcgcagtctgcggcttacgcgatatcaaaatttgttagcggcgttctaagcgatcagatgagtgcccggtggctgttcagttccgggttgcttcttgtgggtctggtgaatatcttttttgcctggtctagcacagtgccggtctttgcagctctgtggtttttgaacgggttggcacaaggactgggttggcccccatgcggcaaggtcttgaggaaatggtttgaaccatcacagttcggaacatggtgggccattttgtcaacatccatgaatctggcgggcggcctgggtcccatcttagctaccattctcgcacagtcttactcctggcgatctaccctggccttgagtggagctttatgcgtcgtggtctccttcctctgtctcttgctgatccacaatgagcccgctgatgtagggctgcgtaatcttgatcccatgccctcagaagggaaaaagggctccctcaaggaagagagtacactccaggaactgctgctctcaccgtatctgtgggtgttatcgaccggctatctcgtggtctttggtgtgaagacatgttgcaccgactggggacaatttttcttgatccaggagaaggggcagtccgcattggtgggatccagttacatgtccgctctcgaggtgggagggttggtggggagcattgcagccgggtacctgtcggatcgcgccatggccaaagccggattatctaactacggcaatccaaggcacggccttctgctgtttatgatggcggggatgactgtatctatgtatctgttccgggtcaccgttacatccgacagccctaagctctggatccttgtactgggagcggtttttggattcagctcgtatggccctattgctctgtttggggtcatagcaaacgaaagcgcaccaccaaacctttgtgggacaagtcacgccatagtcggtctgatggctaatgtggggggctttctggccggcttgccattcagcactatcgctaagcactactcctggagtacagcattttgggtcgcagaagtaatctgcgctgccagtactgccgcattcttcctgttgaggaatattcgaacaaagatgggcagggtgtcaaaaaaggccgaa

SEQ ID NO: 19554 - DNA, 1287 bp, Artificial Sequence
  Description of Artificial Sequence: Synthetic coding sequence
atggctgctcagggatacggttattatcgtactgtcattttctcagctatgtttggaggatactctttgtattatttcaataggaaaacgttctcatttgttatgccatctcttgtggaagaaattccattagataaggacgatctgggattcattacctcttcacagagtgcagcttatgcgatcagtaaatttgtttctggtgttctttctgatcagatgtccgcacgctggctcttcagttcaggtttactgttggttggcttggtgaatatcttctttgcctggtcgtcaactgtccctgtattcgcagcactgtggtttttgaacggacttgctcaaggtttgggatggccaccatgtggaaaagttctgcgaaaatggtttgagccgtcacagtttggaacgtggtgggcaatcctttccacgtcgatgaacctagcgggaggacttggaccaatcctagctacaatacttgcccaatcttactcatggcgctcaacattagcacttagcggtgcactctgcgtcgttgtcagttttttatgcctgttactcatacataacgaaccggccgatgttggattgcgtaaccttgatccaatgccttccgaaggtaagaaaggttcattaaaagaggaatccacattgcaagagctacttctatccccatacctttgggttctctcgacaggataccttgttgtattcggagttaaaacttgttgtacggactggggacaattcttcttaatacaagagaagggtcaatcagccctcgtaggatcgtcttatatgtctgcccttgaagtaggaggactggttggctcaatagcagcaggatatctcagtgacagagctatggcaaaggcgggactgtctaattacggaaatccacgtcatggtttactgctgttcatgatggctggaatgacagtttctatgtacttatttcgtgttaccgtcacatcagatagtccgaagctctggatattggtccttggagctgtatttggcttctcttcttacggaccaattgcattattcggagtcattgctaacgagtctgcacccccgaatctctgcggaacatctcatgcaattgtggggctaatggctaatgttggaggattcttggcaggtcttcccttttcaacgattgcaaaacattattcttggtccactgcattttgggttgcagaggtaatttgcgcggcaagtactgcagcattctttctcttgcgtaacatcaggacaaagatgggccgtgtctcaaagaaagccgaa

SEQ ID NO: 19555 - DNA, 1287 bp, Artificial Sequence
  Description of Artificial Sequence: Synthetic coding sequence
atggcagcacagggttacggctactaccgcactgtaattttcagcgccatgttcggtgggtactcgctctactatttcaatagaaagaccttttctttcgtgatgccttctctggttgaggagatccccctcgacaaggatgatctggggttcatcacctcctcccaaagcgccgcctacgctatctctaaatttgtgagcggagttctcagcgaccaaatgtcagctaggtggctgttttcttccggactcctcctggtggggctagtgaacatcttctttgcttggagtagtaccgtgcctgtgttcgcagctctgtggttcctgaacggtctggctcagggcctggggtggcccccatgtggcaaggttctgcgaaaatggttcgagccaagtcagtttggtacctggtgggccatcttgtcgacgagcatgaatcttgccgggggtttgggtcctattctagccacaatcttggctcagagctactcctggagaagtactcttgccctgtcaggagccctgtgtgtggtggtgtcgtttctgtgtcttctcctcatccacaacgagcctgctgacgtgggactacgcaatttggaccctatgcctagtgaggggaagaaggggagcctgaaggaggagagtacattgcaagaactactgctcagtccctacttgtgggtattaagcaccggctacctcgtggtgtttggcgttaaaacttgctgcactgactgggggcagttcttcttaatacaggagaaagggcagtccgcactcgtaggaagcagttacatgtccgctttagaagtgggagggctagtgggcagcattgctgccggctatctatcagatagggcgatggccaaagccggacttagcaattacgggaatcccaggcatggtctgctactgtttatgatggcaggaatgaccgtgagcatgtacctattcagagtgactgtcacatctgattcgcccaagctatggatcctggtgctgggcgcggttttcgggttttctagttatgggcctattgcgctgtttggagtcatcgccaatgagtcagcccctcctaacctttgcggtacatctcatgcaatcgtgggtttaatggctaacgtgggtggcttccttgctggcctgccctttagcactatagctaagcattactcttggagtaccgctttctgggtggctgaggtgatttgtgcagcgtccacagccgcattcttcctccttcggaacattaggaccaagatgggcagggtatcaaagaaggcagag

SEQ ID NO: 19556 - DNA, 1287 bp, Artificial Sequence
  Description of Artificial Sequence: Synthetic coding sequence
atggccgcacagggatacggatactaccggactgtgatcttttcggcaatgttcggaggatactcgctctattacttcaataggaaaacctttagctttgtgatgccgtccctggtggaggagatccctctcgataaggatgacctcgggttcataacttccagccaatcagcggcatacgcaatctcgaagttcgtgtccggagtgctgagcgatcagatgtccgcccgttggctgttttcaagcggactcctcctggtgggactcgtgaacatcttcttcgcctggtcaagcaccgtgccggtctttgcggcactgtggttcctcaatggcctggcgcaaggtttgggctggccgccgtgtggaaaggtgctcaggaaatggttcgagccttcccaattcggaacctggtgggccatcttgtccaccagcatgaatctggccggagggctcggcccaatcctcgcgacgattttggcgcagtcttactcgtggcgctccaccctggccctgtctggcgcactctgcgtggtggtgtcctttctgtgcctgctcctcatccataacgagcctgcggacgtcggactcagaaacctggatccaatgccttcggagggaaagaagggaagcctgaaggaggaatcgactctccaggaactgttgctctccccgtatctttgggtcctgtccacgggatacttggtggtctttggagtgaaaacttgctgcactgactgggggcaattcttccttatccaagaaaagggccagtccgcccttgtcggatcaagctacatgagcgcactggaggtgggaggacttgtggggagtatcgcggctggatatctttcagaccgcgcgatggccaaggccggactctcgaactacggaaacccgagacacggtctgttgctgttcatgatggcggggatgaccgtgtcaatgtatctgtttagagtcaccgtgacttccgactcgccaaagctctggatcctcgtgctgggagcggtgttcggcttttcatcctatggaccgatcgcgctgttcggggtgatcgctaacgagtccgcacctcctaatctgtgcggcacctcgcatgctattgttggcctcatggcaaacgtgggaggatttcttgcgggactgcccttctccactatcgccaagcattactcgtggtcgactgcgttctgggtggccgaagtcatttgcgccgcctcaaccgccgcgttcttcctgctgagaaatatccggacgaaaatgggccgcgtgtcgaaaaaggccgaa

SEQ ID NO: 19557 - DNA, 1287 bp, Artificial Sequence
  Description of Artificial Sequence: Synthetic coding sequence
atggcagcacaaggctacggatattatagaactgtgatctttagcgccatgttcggtggctacagtctgtattatttcaataggaagaccttctctttcgttatgccaagcctggtcgaggagatcccattggataaggatgatctcggcttcattaccagctcccagtccgctgcttatgccatctcaaaattcgtaagcggcgtcctttcagaccagatgtccgctagatggctgttctcctctggtctgctcctcgttggcctggtcaacatattcttcgcttggtcttccacggtacctgttttcgccgccctctggttcttgaatggtcttgcccagggtttgggctggccaccatgcggcaaggtgctgaggaaatggttcgagccatctcaattcggcacctggtgggccatcctctccacgtctatgaacctcgctggtggactgggccctattctcgccacaattttggcacagtcttactcatggagaagcaccttggctcttagcggcgccctgtgcgtggttgtgtctttcttgtgtcttctgttgatacataacgagccagctgacgttggtttgagaaacctcgatcccatgccatcagaaggaaaaaaaggtagtttgaaggaggaatcaacactgcaggagttgttgctctctccatatctttgggtgttgtctactggatacctggtggtatttggcgtcaagacatgctgcaccgattggggccaattcttcctgattcaggagaaaggacagtcagcactggtgggcagtagctatatgagtgccctggaggtcggcggcctggtcggcagtatagcagctggctatttgagtgatagggctatggccaaggctggactctccaactacggcaacccgaggcatggcttgctgttgttcatgatggctggaatgactgtctctatgtacctgttcagagtgaccgtgaccagcgactcccccaagctctggattctcgtcctcggagcggtgttcggtttttcatcatatggaccgattgcattgtttggcgtaatcgcaaatgaatcagccccgccaaacctttgcggtacatctcacgctattgtgggcctcatggcgaacgtgggaggcttcctggccggcctcccattctcaactatcgccaagcactactcttggagtacggccttctgggtggctgaggtcatatgcgcagcgagcactgcggctttcttcctgctgaggaacattagaacaaaaatgggtagagtgtccaagaaagccgag

SEQ ID NO: 19558 - DNA, 1287 bp, Artificial Sequence
  Description of Artificial Sequence: Synthetic coding sequence
atggcagcacagggatacggatattaccggaccgtcatcttctcagcaatgtttggtggatactccctttactactttaaccgaaagactttctcatttgtcatgccttcgctcgtcgaggaaattccacttgacaaggacgatcttggtttcattacctcctcgcaatccgcggcatacgcaatttcaaagttcgtgtccggagtgctcagcgatcagatgtcggcacgatggctgttttcgtccggactgctgctggtcggtcttgtgaatatctttttcgcctggtcgtccaccgtgcctgtgtttgcagccctttggttcctcaatggacttgctcaaggattgggatggcccccatgtggtaaagtgctgcgaaagtggtttgaaccctcacagtttggtacctggtgggcaattctgtcaaccagcatgaacctggcgggagggctgggacctatcctggcaactattctcgcacagtcgtactcgtggagatcgacgctcgcactgtccggagctctgtgtgtcgtggtgtcgtttctgtgtcttttgcttatccataacgagccagcagatgtgggacttcggaacctcgacccaatgccatcagaaggcaagaagggctcacttaaggaggagtcaaccctgcaagaactgcttctgtcaccctacctctgggtgttgtctactggatacctggtggtgtttggagtcaaaacctgttgtactgattgggggcagttcttccttatccaagaaaaaggccagtcggcactcgtgggatcgtcgtacatgtctgcactggaggtgggcgggctggtcggctcaattgctgcaggctaccttagcgatcgtgcaatggcaaaggcggggctttcaaactacggtaaccctcgccatggtctgcttctgtttatgatggcaggtatgactgtgagcatgtacctgttccgcgtcaccgtgacctccgactccccaaaactttggatcctggtgctcggagcagtgtttgggttttcgtcgtacggacctatcgcactgtttggcgtcattgcgaacgagtccgcacctccgaatctgtgtggcacctcccacgccattgtgggactgatggcaaacgtggggggatttcttgcgggtttgcctttcagcaccattgcaaagcactactcgtggtcgacggccttttgggtggctgaagtgatctgtgcggcgagcactgcagcgttcttcctcctccggaacattaggaccaagatgggccgggtgtccaagaaagcagaa

SEQ ID NO: 19559 - DNA, 1287 bp, Artificial Sequence
  Description of Artificial Sequence: Synthetic coding sequence
atggctgcacagggctatggatactataggaccgtaatcttcagcgccatgttcggcggatatagcttatactatttcaacaggaagacgttctctttcgtgatgccatccctagtggaggaaatccctttggataaggacgatcttggcttcataacaagtagtcagtctgccgcatatgccattagcaagttcgtgagcggcgtgctgagcgaccagatgagcgcaaggtggctcttttcgtccggattgctgctcgtgggactggtgaacattttcttcgcttggtcctctaccgtgcctgtgttcgccgccctgtggttcctgaacggactcgctcaggggctgggctggcccccttgtggcaaagtcctgcggaagtggtttgagccatcccagtttggtacctggtgggcaattctgtcaacatctatgaacctggctggaggactggggcctattctggcaaccattctggctcagtcatactcctggagaagtacactggcattatccggggctctttgtgtagtggtgtccttcctctgcctcctgctgatacacaatgaaccagcagatgtgggcttgcgaaacttggatccgatgccctcagagggcaagaaaggatcccttaaagaagagtccaccctgcaggaactgcttctgagcccatatctgtgggtgcttagtactggatacctcgtggtgttcggggtcaagacctgctgcaccgactggggccagttcttcctcatccaggagaaaggacaaagtgccctcgtgggcagcagctacatgagtgctttggaggttggaggcctcgtgggctccattgccgccgggtacctgtcagatcgcgctatggccaaagccggactaagcaactatggcaacccccgccatgggctgcttctgttcatgatggccggcatgactgtgtccatgtatcttttccgcgtcacagtaacctcagatagtcctaagctgtggatcctggtgctcggcgccgttttcggcttctcctcctatggaccgatcgctctgttcggcgtgatcgctaatgagtcagcaccaccaaacctgtgcgggacctcccacgcgatcgtcggactcatggcaaacgtcggaggttttttggccggccttccgttctctacaatcgcgaagcattatagctggagcacggccttctgggtggcggaggtgatttgcgcagcctccactgcagcgttctttcttctgcgaaacatacggaccaagatggggcgcgttagcaaaaaggctgaa

SEQ ID NO: 19560 - DNA, 1287 bp, Artificial Sequence
  Description of Artificial Sequence: Synthetic coding sequence
atggccgcacaaggctacggatactacagaaccgtgattttctctgcgatgttcggggggtacagcctctactactttaaccgaaaaactttctcatttgtgatgccttcacttgtggaagaaattcccctggataaggacgatcttggttttatcacttcctcgcagtccgcagcttatgcaattagcaagtttgtctcgggcgtcctcagtgatcagatgtcggctcggtggctgttctccagcggtttgttgcttgtggggcttgtgaacatattcttcgcatggtcctctaccgtgcctgtctttgcagcattgtggtttctgaacggacttgcccagggattgggttggccaccatgtggtaaagtgctgcggaaatggtttgagccttcacaattcggaacttggtgggcaattctgtcgacctcgatgaaccttgccggaggactgggaccgatcctggctactattcttgcacaatcatactcttggagaagcacgctggcactttctggagccctttgcgtggtggtgtcatttttgtgtctcttgctcattcacaatgagcccgccgacgtcggactgcgcaaccttgatcccatgccgtcagaggggaaaaagggatcgcttaaggaggaatcgacccttcaggaactgctcctttcgccctacctttgggtcctcagtacgggatatttggtggtgttcggtgttaagacttgctgtactgattgggggcaattctttctgattcaagaaaaggggcagagcgcgctggtggggagctcctacatgtcggcactcgaggtggggggactcgtgggttccatcgccgccggctacctttcggaccgagcaatggcgaaggcaggacttagcaactacgggaacccacggcatggccttcttcttttcatgatggcgggaatgactgtgagcatgtacctgttccgggtcaccgtcacgtccgattcgccaaaactgtggatactcgtgttgggcgcagttttcggattttcatcctatggacctatcgccttgttcggagtcattgctaatgaatcggcaccacctaatctctgcggcacgtcacacgcgattgtgggactgatggcaaatgtgggaggttttcttgcaggcctgcccttttccaccatagcaaagcattactcctggtcaactgcattctgggtggcggaagtcatctgcgccgcctccactgccgccttttttctcctgcgcaatatccggaccaagatggggcgagtgtcgaaaaaggcagag

SEQ ID NO: 19561 - DNA, 1287 bp, Artificial Sequence
  Description of Artificial Sequence: Synthetic coding sequence
atggcggcgcaaggatacggctattacaggactgttatattcagtgccatgtttggagggtactcattgtattactttaacagaaaaacattctcttttgtcatgccctcactagtagaagaaatacctctggataaagacgatttgggattcataacatcctcccaatccgccgcctatgccattagcaagttcgtgagcggcgtcctctccgaccaaatgtctgcgaggtggcttttctcatcaggtctgctgctggttgggctcgtgaacattttctttgcctggtcaagcactgttccagtgttcgcagctctatggttccttaacgggctggcccagggcctgggatggcctccctgcggcaaggtactgaggaaatggtttgaaccatcccaatttggaacctggtgggccatccttagtactagtatgaacctggctggcgggctcgggccaatcctggctaccatactggcccagagttactcctggcgatctacattagccctttccggggcgttgtgcgttgttgtgtcatttctttgcctactcctgatccataacgaacctgcagacgtgggcttacgaaatctggaccctatgccgtctgaggggaagaagggaagcctgaaggaggagtctacactgcaggagctcttactttctccttacctctgggtcctgtccactggatatctggtggttttcggtgtgaaaacttgctgtactgactggggccagtttttcctcatacaagagaaaggccagagtgccctggtcgggtcctcctatatgtcagcactggaggtcgggggactcgtcggatcaatcgctgctggatacttgagcgaccgcgcaatggcaaaggcagggctgagtaattatggcaacccacggcacggacttctcctgttcatgatggctggcatgacagtgtccatgtacctttttcgtgtcactgtgactagcgactctcccaaactatggatcctggtgcttggagccgtgttcggcttttccagctacggccccatcgctctgtttggcgtgatcgcgaatgagtctgcacctccaaacctgtgtgggacaagtcatgcaattgtgggtctgatggcaaatgtaggtggctttctcgcaggactgcccttctctactatcgccaaacattactcctggtcgaccgctttttgggtagccgaggttatctgcgcggcatctactgccgcattctttctcctacgtaacatacggaccaagatgggccgcgtgtctaagaaagccgag

SEQ ID NO: 19562 - DNA, 1287 bp, Artificial Sequence
  Description of Artificial Sequence: Synthetic coding sequence
atggccgcccaggggtacgggtactaccggaccgtgattttctccgccatgttcggcgggtacagtctgtactactttaatcgtaagacattcagtttcgtgatgccctctctagtggaggaaatccctctcgataaagacgacctgggtttcatcacaagcagccagtccgcagcctatgccatttcgaagttcgtgtctggcgtgctcagcgaccagatgagtgccaggtggttgtttagttcaggcttgctattggtggggctggtgaacattttcttcgcttggtcttctactgttcctgtgttcgccgctctctggttcttgaatggtctggcgcagggtctgggctggcccccatgtggtaaggtcctccgaaaatggttcgaaccctcgcagttcgggacttggtgggcgatcctgagcacatcgatgaatctagccggagggttaggaccaatactggctactatacttgctcaatcctacagctggcggtctacgctggccctgagcggtgcattgtgcgtcgtggttagcttcctctgtctgctactcattcacaacgaacccgctgatgtggggctcagaaacctagaccccatgccttctgaagggaagaaaggatctctcaaggaggagtccacactgcaggaattgctcttatctccgtacctttgggttctcagtaccggctacctcgtggtgtttggagtcaagacgtgttgtaccgattggggacagttcttcctcatccaagagaagggccagtctgcattagtcggctcgagttatatgtcagcactcgaagtaggcgggctggtcgggtcaattgctgcaggctacctgtcagaccgggctatggcgaaagccggattaagtaactatgggaatcctagacatggactcctgctcttcatgatggcaggcatgactgtatccatgtacctctttagagttacggtcacgtctgattcacccaagctttggatcctcgtgctaggggccgtcttcggattttcctcatacggacctatagccttgtttggagtgatcgcaaacgagtcagcccctccaaatctgtgtggcacctcacatgctattgtagggttaatggccaatgttggcgggttcttagccggcttgcccttttcaactatagcgaagcattactcctggtcaacagccttttgggtcgccgaggtaatatgcgcggctagtacagccgcctttttcttgctgcggaacatacgcaccaagatgggccgagtctcaaaaaaggccgag

SEQ ID NO: 19563 - DNA, 1287 bp, Artificial Sequence
  Description of Artificial Sequence: Synthetic coding sequence
atggccgctcagggatacggatactacaggactgtcatattctcagccatgttcggggggtatagtctttattatttcaatcggaaaacattctcctttgttatgccatcactcgttgaagagatacctttagataaagatgatctggggtttatcacaagttctcagtctgctgcttatgctatatccaaattcgtttcgggagtactgtctgatcagatgtcagcaagatggcttttttcgagtggacttcttctggtgggacttgtgaacatcttttttgcatggtcttctacagtacccgttttcgctgctctttggtttctcaatgggctagcacaggggcttggatggccaccctgtggaaaagtgctcaggaaatggttcgagccctctcagttcgggacatggtgggcgatcctctccacatcaatgaatctagcaggggggctcgggccaatactcgccactatccttgcccagagttactcttggaggtccacacttgcattatctggggctctttgcgtggtggtgtcttttctgtgcttacttcttatacacaacgaacctgccgatgtagggctgagaaatctcgatccaatgccctccgaagggaaaaaggggtctctgaaagaagaatccacactgcaggaattactcctgtccccctatctttgggtgctttctacaggatatctagtggtattcggagttaaaacttgctgtacagattggggacagttcttcttaatccaggaaaaagggcagagtgcactagtgggatcttcatatatgtcagctctcgaagtgggaggacttgtgggatccatcgccgcaggatatctttcagatcgagcaatggccaaagctgggctttcaaactatgggaatcccaggcatgggcttcttcttttcatgatggcaggaatgactgtatccatgtatctattcagagtaactgtaacttctgattctcctaaactttggatactggtcctgggggctgtttttgggttttcctcatacgggcctattgcccttttcggagtaatcgccaacgaatcggcccccccaaacctctgcggaacttctcatgcaattgtggggttgatggccaacgtcggaggattcctcgcagggcttcctttctctacaatcgcaaagcactattcttggtctactgccttctgggtggccgaagtcatctgtgctgcatccactgctgcatttttcctactcaggaacatccgaacaaaaatggggagagtatcaaagaaagctgaa

SEQ ID NO: 19564 - DNA, 1287 bp, Artificial Sequence
  Description of Artificial Sequence: Synthetic coding sequence
atggccgcgcagggttacggctattatcgcaccgtgatcttctcggccatgttcggaggctacagcctctactactttaatcggaaaaccttctcattcgtgatgccttcccttgtggaagaaatcccgctggacaaggacgatctcggtttcatcacgtcatcccaaagcgcggcttacgcaatatcgaagttcgtgtcgggtgtgttgtcggatcaaatgtcggcccgctggttgttctcctcgggactgctcctggtgggactcgtgaatatctttttcgcctggtcctcgactgttccagtgttcgctgcgctgtggttccttaatggcctggcccaggggctgggctggcctccatgcggaaaggtgctgagaaagtggtttgaaccgtcgcaattcggcacctggtgggcaatcctctcgacctccatgaacctggcgggcggactgggtccgatcctggcaactatcctggcgcagtcctactcctggcgctcaaccttggccctgtcgggagctctgtgtgttgtggtcagcttcctgtgcttgctgctgattcataatgagccagccgatgtgggtctgcgaaacctggacccaatgccgtcagaaggtaaaaagggatcgctgaaggaggaatccacgttgcaggaactcctcctgtcaccttatctgtgggtcctgtcaactggatacctcgtggttttcggggttaagacgtgctgcaccgactggggacagttcttcctgatccaagagaagggccagtccgccctggtggggtcatcctacatgagcgcactcgaggtgggaggccttgtgggcagcatcgcagccggctacctgtccgaccgggcaatggccaaagctggactctcaaactacggaaatccgaggcacggactgctgcttttcatgatggcggggatgaccgtgtcaatgtacctctttcgggtcaccgtcactagcgactcgccgaaactctggattcttgtcttgggggcagtttttggattcagctcctacgggccaatcgccctgtttggcgtgattgccaacgaatcggctccccccaacttgtgtggaacctcgcacgcaatagtgggactgatggccaacgtgggaggctttctcgccgggttgccattttcgactatcgctaagcattactcctggtcgactgcattttgggtcgcggaagtcatctgtgcagcatcaactgcggccttcttcctcttgcggaacatccgcaccaaaatgggacgcgtgtcaaaaaaggcggag

SEQ ID NO: 19565 - DNA, 1287 bp, Artificial Sequence
  Description of Artificial Sequence: Synthetic coding sequence
atggccgcacagggctatggttactatcggacagtgatattttccgccatgttcgggggatactctctttactatttcaatcggaaaactttttcattcgtgatgcctagcttggtagaagaaattccactggataaggatgacctcgggttcatcactagttcacagtcggccgcttatgcaatctcaaaatttgtcagcggggtgttatctgatcagatgagcgctcgctggctgttttcctcgggcctgctgcttgtcgggctagtcaacattttttttgcctggtcttcaacagtgccggtctttgccgcactctggttcttgaacgggttggcacagggactgggctggcctccctgtgggaaggtgctcagaaagtggttcgaaccatcccagttcggcacttggtgggccatacttagtacatccatgaaccttgccggaggactcggaccaattctcgccaccatccttgcgcaatcttacagctggcgctccacactggcgcttagcggggcactgtgtgtggttgtgtcattcctttgcctcctgctgatccataatgaacctgctgatgtagggttgagaaacttagatcctatgccaagcgaagggaaaaagggctcactgaaggaagagtcaacactacaggagctgctcctgagcccatatctgtgggtcctgtcgacagggtacctggtggtgttcggggtgaaaacctgctgcaccgattggggacagtttttcctaatccaggaaaagggacagtctgcgctcgtgggatcttcctacatgtcggcactcgaggtgggcggtctggtcggttccatagccgccggctatctgagcgaccgggccatggccaaggctggactgtcaaattacggcaatcccaggcacggactgcttctgttcatgatggcgggaatgactgtcagtatgtacctctttagagtgacagtcacttccgattctcctaagctgtggattctggtgctgggcgctgtttttggattctcttcctatgggccaattgcactgttcggcgtgattgcaaatgagtccgccccacctaacctctgtgggacaagtcacgccatcgtgggacttatggccaacgttggcggcttcctagcaggcctgcccttctcaacgattgctaagcactactcgtggagtacagctttttgggtcgccgaagtgatctgtgccgccagtaccgcagccttcttcctcctgaggaatatccgcactaagatgggaagagtgagcaaaaaagcagag

SEQ ID NO: 19566 - DNA, 1287 bp, Artificial Sequence
  Description of Artificial Sequence: Synthetic coding sequence
atggccgcacagggatacggctactatcgcaccgtgatcttcagtgccatgttcggggggtactcactgtactactttaacaggaaaacttttagctttgtgatgcctagcctcgtggaggaaatcccgctcgacaaggacgatctcggattcattacgtcgtcccagtccgctgcatacgctatctcaaaattcgtctcaggtgtgctgtcggatcagatgagcgcacgctggctgttcagctcggggctgttgctggttggattggtgaacatctttttcgcctggtcgtccaccgtccctgtgtttgcagccctgtggtttttgaacggactggctcagggactgggctggcctccgtgcggaaaggtgctgagaaagtggttcgagccgagccagtttggaacctggtgggcgatcctgtcgaccagtatgaacctcgcaggaggactgggcccgatactggccaccatccttgctcagtcgtactcatggcgatcaaccctcgccctctcaggagcactttgcgtggtggtgagcttcttgtgccttctcttgatccacaacgagcctgcagatgtcgggttgagaaacctggatccgatgccgagcgaaggaaagaagggttccctgaaggaggagtctaccttgcaagaattgctgttgtcgccctacctgtgggtcctttccacggggtacttggtggtgttcggtgtaaagacctgctgtactgactgggggcagtttttcctcatccaagagaaaggacagtcagccctggtgggcagctcgtacatgtcggccctggaagtcggaggactcgtgggatccattgcagcgggctacctgtcagaccgcgctatggcaaaggcaggcctctcgaattacggcaatcctcgccatgggttgctcctgttcatgatggcaggcatgaccgtgtccatgtatttgttccgggtcactgtgacctctgacagcccgaagctgtggatcctggtgcttggtgcggtgttcgggttcagctcttacggaccaatcgcactcttcggcgtgatcgctaatgaaagcgcaccaccaaacctgtgtggaacttcccacgccattgtgggcctgatggccaacgttggtggctttctggcgggattgcctttctccaccattgcgaagcattattcctggtccaccgccttttgggtggcggaagtgatctgcgccgcgtcgactgcggctttcttcctcctgagaaatatccggacgaaaatgggccgggtatcgaaaaaggcagaa

SEQ ID NO: 19567 - DNA, 1287 bp, Artificial Sequence
  Description of Artificial Sequence: Synthetic coding sequence
atggccgcccaagggtatggttactacagaaccgttatcttctccgccatgtttggggggtatagcctgtactactttaatcgtaagactttctccttcgtaatgccttcacttgttgaggagatccctctggacaaggatgacctaggattcataacaagcagtcagtctgctgcctatgcaattagtaaattcgtgagcggagtgcttagtgaccagatgtccgctcggtggctgttttcgtcgggcttgttgctggttgggcttgtgaatatcttcttcgcatggtcatctacagtacctgtgttcgccgctctgtggtttctgaacggacttgctcagggactgggctggccgccatgcggaaaagtcttacgaaagtggtttgaaccctcgcagttcgggacatggtgggctattctttccacgtccatgaatctcgctggcggactgggtcctattctggccaccattctggcacagagctattcttggcggtctacactggccttatccggagccctatgcgttgtagtgtcattcctgtgtctcctattaatccataacgaacccgcagatgtgggcctcagaaatcttgacccaatgcctagtgaaggaaaaaagggaagcctcaaagaagaaagcaccctgcaggaacttctcttgtctccatacttgtgggtgctttctaccggatatctcgtcgtgtttggcgtcaaaacatgctgtaccgattgggggcagttcttccttatccaggaaaaaggacagagtgctcttgtaggttccagctacatgtctgccctcgaagttggcgggctcgtaggttcaatagctgccggctaccttagcgacagagccatggccaaggccggactatccaactacggcaatcctcggcatggactgctgctattcatgatggccgggatgacagtgagtatgtaccttttccgggtcactgtaacctccgatagccccaagctctggatcctggtgctgggagccgtgtttggattttcctcttatggtccgatcgcgttgttcggagtcattgccaatgaaagcgctccacctaacctgtgcggtaccagccacgcaatcgtaggattgatggctaacgtggggggattcctggccgggctgccattcagcaccatcgcaaaacactactcgtggtccactgccttctgggtagctgaggtcatttgtgccgctagtactgccgccttttttttactgagaaatattcggacaaagatgggtagggtgagcaaaaaggcagag

SEQ ID NO: 19568 - DNA, 1287 bp, Artificial Sequence
  Description of Artificial Sequence: Synthetic coding sequence
atggccgcccagggttacggttactaccgcaccgttatattcagcgctatgttcggaggatattcgctgtactacttcaacaggaagactttcagctttgtgatgcctagcctcgtagaggagattcccctcgataaagatgatctcgggttcattacaagttcgcagagtgccgcttatgccatttcaaaattcgtgtctggtgtactgtcagaccagatgagtgctcggtggttgttctcctcggggttgttactggttggtctagtcaacatcttttttgcatggtcctcaaccgtaccagtattcgccgccctttggttccttaatggcctggcccaaggccttggttggcccccttgtgggaaggtccttaggaaatggttcgaaccctcccagttcgggacttggtgggccattctgtctaccagcatgaacctcgcaggtgggctgggtcccatcctggccaccatactggcccagtcttactcttggcgttctacacttgcactttctggagctctctgcgttgttgtgtccttcctgtgtctgctgctaatccataacgagccagccgacgtaggcctccgcaatctggacccgatgccgtctgagggtaaaaagggctcactgaaagaggagagcactctgcaggaactgctcctgtccccatatctgtgggtcttaagtacaggatacctggttgtctttggcgtgaaaacctgttgtacagattggggacagttcttcctgatccaggagaagggccagagcgcgttagtagggagtagctacatgagcgctctcgaggtggggggacttgtgggcagcattgctgcgggctacctgagcgatcgcgctatggccaaagccggcctcagtaactacggcaaccccaggcatggcttgctgctcttcatgatggctggcatgacagtatccatgtacctcttcagggtgaccgtgacttccgattctccaaagttgtggatactggtcttgggagccgtgttcggtttctcttcatatggccccatcgcactgtttggtgtgatcgctaatgaatccgctccacctaatctgtgtggcacttcacacgctatcgtggggctgatggctaatgtcggcggcttccttgcagggcttcccttttccaccatcgctaagcactatagttggagcacagctttttgggtagctgaagtgatatgtgctgcctctactgccgctttcttcctgttacgcaacattaggactaagatgggacgggtgtccaagaaggctgaa

SEQ ID NO: 19569 - DNA, 1287 bp, Artificial Sequence
  Description of Artificial Sequence: Synthetic coding sequence
atggcggcccagggctacggatactaccgcactgtcattttctcggctatgttcgggggatattcgctgtattacttcaaccgcaagacttttagctttgtgatgcccagcctcgtggaggaaataccgctcgacaaagacgacctggggttcatcacgtcgagccaaagcgctgcatacgctatcagcaaattcgtgagcggggtgctctccgatcaaatgagcgccagatggctgttctcaagcggactcctgctggtcggtttggtgaacatcttctttgcttggtcgtccaccgttccagtgttcgccgccctttggttcctgaacggcctggcacaggggctcggatggccaccgtgtggaaaggtacttcggaaatggtttgaaccctcccagtttggtacttggtgggccatcctttcaacctcaatgaacctggcaggaggactgggtcctatcctggcgactattctggcacagtcctactcctggcgctccaccctcgccttgtcgggggcgctctgtgtggtcgtgtcgtttctgtgcctgctgctgatccacaatgaaccagccgatgtgggactccggaatctggaccctatgccatcagaaggaaagaagggatcgctcaaggaggagtccacccttcaagaactcttgctgtcgccgtacctctgggtgctgtctaccggctacctggtcgtgttcggagtcaagacctgctgcaccgattggggccaattcttcctgatccaggagaagggccagtctgcactggtgggttcctcatacatgagtgcccttgaggtcggaggattggtgggctccatcgcggcgggatacctctcggacagggctatggccaaggcgggactgtcgaactacggcaacccgcgccacggtctgctgctcttcatgatggcggggatgactgtcagcatgtacctcttcagagtgaccgtcacttcggattcacctaagttgtggatcctggtcctgggcgccgtgtttggattctcatcctacggtccgatcgccctcttcggagttatcgccaacgaaagcgccccaccgaacttgtgcggaacctcccatgccatcgtgggacttatggcaaatgtggggggcttcctcgcgggactgccgttctccactattgctaaacattactcatggagcactgcattttgggtggcggaagtgatctgcgcggcttcgaccgccgccttcttcctgctgcggaatatccgaacgaaaatgggccgggtgtcgaagaaggcagag

SEQ ID NO: 19570 - DNA, 1287 bp, Artificial Sequence
  Description of Artificial Sequence: Synthetic coding sequence
atggccgctcagggctacggatactataggacagttatcttcagcgctatgtttggtggatactcactgtactattttaatcgaaaaacgttctcattcgtaatgccctctctggtagaggagattccactcgataaagacgatttaggatttatcacctcatcacaatctgccgcctacgccatctccaaattcgtgtcgggagtcctctccgaccagatgtccgcgcggtggctgttttcttctggtttgttgctggttgggctggtaaacattttcttcgcctggtctagtacggttccggtgttcgccgccctctggttccttaacgggctggctcagggcttgggatggccgccatgcgggaaggtcctgcgcaagtggtttgagcccagccaatttggcacgtggtgggctatcctaagcacttcaatgaatctcgccggaggccttggacctatactcgctacaattctcgcacagagctactcctggaggagtaccttagcgctatctggggccttgtgtgtagtggtatccttcttgtgccttctcctcatccataacgaaccagccgacgtcgggttacggaatctggaccccatgccttctgagggaaagaagggttctctaaaagaggaatcaacacttcaagagctcctactttctccctacctctgggtgctatccaccgggtatctggtcgtgtttggggtgaagacctgttgcaccgactggggtcaattcttcttaattcaagaaaagggtcagtcagccctggtaggttccagctacatgtctgctctggaggttgggggcctcgtaggttctatagctgctggctatctgtccgatcgagccatggccaaagccggactcagcaactatggaaacccaagacatgggctgttattgttcatgatggccggcatgaccgtctccatgtatctcttcagagtgacggtgacctccgatagccccaaactgtggatattagtgctaggagcggtttttggattttcatcctacgggccaatcgcattgtttggggtgatcgctaacgagtctgcccctcctaacttgtgcgggacatcccatgcgattgtgggattaatggccaacgtgggaggatttttggctgggctgcctttcagcacaattgctaaacattactcatggagcaccgctttctgggtcgcagaggttatatgcgcggcctctacggcagctttcttcctactccgtaacattaggacaaagatgggtcgagtgtcaaagaaggcggag

SEQ ID NO: 19571 - DNA, 1287 bp, Artificial Sequence
  Description of Artificial Sequence: Synthetic coding sequence
atggcagcacaaggatacggatactaccgcaccgtgattttctcggccatgttcggcgggtactcgctttactacttcaaccgcaagactttctcgtttgttatgccctccctggtggaagaaatacctctggacaaagatgatctgggctttatcacttcgtcccaatcggctgcgtacgctatctccaaatttgtctcgggagtcttgtccgaccaaatgtcggcaagatggctgttttcaagcgggcttttgctggtcggattggtgaacattttctttgcctggtcgtcgaccgtgcctgtctttgcagccctctggttcctcaacggtcttgctcaaggcctcggttggcctccctgtggtaaagttctccgaaaatggtttgagccttcgcaatttggaacctggtgggcaattctctcaactagcatgaaccttgccggaggactgggacctatccttgcgaccattcttgcacagtcatactcatggagatcaaccttggcgcttagcggcgcactgtgcgtggtggtgtcgtttctgtgtctgctcctgatccataacgagcctgcggatgtgggactgcgtaaccttgaccccatgccatccgagggtaaaaagggttcgctcaaggaggagagcactctccaagaactcttgctgagcccttacctttgggtgctgtccacgggttaccttgtggtgtttggagtcaagacgtgttgtactgattgggggcagttttttctgattcaagagaaaggccagtcggcactcgtcgggagctcttacatgtcggccctcgaagtggggggactcgtggggagcattgcagccggttacctgtcggacagggcgatggctaaggccggtcttagcaattacgggaatcctagacatggccttctgcttttcatgatggcaggcatgactgtttccatgtacctctttagggtcacggtgacttcggattcgcctaagctgtggattctcgtcctcggagcagtgtttgggttctcttcgtacggaccgattgcactcttcggtgtaattgccaacgagagcgctccaccaaacctttgtgggactagccatgcaatcgttggcctcatggccaatgtgggagggtttctggcagggctgcctttctcgaccatagccaagcattactcgtggtccaccgcgttttgggtggcagaggtgatatgcgcagcatcgacggcagcatttttcctccttcggaatatcaggaccaagatgggacgagtctcaaaaaaggccgaa

SEQ ID NO: 19572 - DNA, 1287 bp, Artificial Sequence
  Description of Artificial Sequence: Synthetic coding sequence
atggcagcccaaggctatggctactaccggacggttatcttctcggcaatgttcggaggttattcactgtattatttcaaccgcaaaacattctctttcgttatgccgagcctcgtcgaggaaatccctctcgataaggatgatctgggctttattacgtcgtcccaaagcgccgcgtacgcaatttcgaagttcgtgtccggcgtgttgagcgaccaaatgagcgctcgttggctcttttcctctggactgcttctggtcggcttggtgaatatcttttttgcatggagctcgaccgtacctgtgtttgcagcactgtggtttctgaatggtcttgcgcaaggactgggttggcccccgtgcggaaaagtgctgcgtaagtggtttgaaccctcccagttcggcacctggtgggcaatcctgagcacttcaatgaacctggcaggcggcctcggtccaattctagccacgatcctggctcaaagctatagttggcgtagcaccctcgccctctcaggcgctctgtgtgtggtggtgtcgtttctatgtttgctgctaattcataatgagcccgccgatgtcggcctaaggaatcttgatcccatgccttcagagggaaagaagggaagcttgaaagaggaatctactttgcaggagttgctgctgtcaccatacctctgggtacttagtaccggatacctcgtggtttttggagtcaaaacctgctgcacagattggggccagttctttttgatacaagaaaaaggccagtcggcactggtcggatcctcatacatgagcgccttagaagtcggtggccttgtgggtagtatagccgctggatatctgtccgacagggcaatggctaaggccggactgtccaactatggaaacccgagacacggattgttgctgttcatgatggccgggatgaccgtgtcgatgtatctattccgcgtgacggtgacgtccgattcacccaaactttggattttagttctgggcgccgtgttcggcttttcgtcatacggcccgattgcactgtttggcgtcattgctaatgaaagcgcgccaccaaacctatgcggaaccagccacgccattgtgggactcatggccaatgtcggcggcttcctggccggattgcccttttctaccatcgctaagcattactcatggagtacagcattttgggttgccgaggtaatctgcgccgcctccacggctgctttcttcttattaaggaacatcaggactaagatgggcagagtgagcaaaaaggcggaa

SEQ ID NO: 19573 - DNA, 1287 bp, Artificial Sequence
  Description of Artificial Sequence: Synthetic coding sequence
atggcggctcagggttatggttattatcgtacggtaatcttcagcgcaatgttcggaggttatagcctttactatttcaaccgcaaaacctttagtttcgtcatgccaagtctcgtggaggagatacccttggacaaggacgatctgggattcatcaccagttcccagtctgccgcttatgcgatttccaaattcgtaagcggtgttctaagcgaccaaatgtctgccaggtggttgttctcctctggtcttctcctagttggtcttgtcaacatcttctttgcatggagctccaccgttccagttttcgcagctctttggttcctcaatggcttggctcagggtctcgggtggcccccctgcggtaaagtgctacgcaagtggtttgagccttctcagtttggcacctggtgggctatactgtcgacatcgatgaacctggcaggtggcttggggccaattctagccactatcctggcccaatcgtactcgtggcgaagtacgctggctctgagtggcgctctgtgtgtggttgtctccttcctttgcttgcttctaatacataatgagccggccgacgtcggtctaaggaacctggatccaatgccttcggaaggcaagaaaggcagcctcaaagaagagagtactctgcaggagctgcttttgagtccttacctttgggttctgtccactggttacttggtcgttttcggcgtgaaaacctgctgcaccgactgggggcaatttttcctaattcaagagaagggccaaagtgcactggttgggtcctcatatatgtccgcccttgaggtcgggggcctagtggggagtatcgcagctggctacctttccgacagggcgatggcaaaggccggtctctcgaactacggtaatcctcgtcacggcctgttacttttcatgatggctgggatgacagtcagcatgtatcttttcagagtcaccgtcactagtgatagtccaaagctgtggattttggtgctaggtgcggtgttcggttttagtagctatggcccaattgcgctttttggggttatcgctaacgaatctgcgcctccgaacctatgtggtacgagtcacgccatcgtgggattgatggcgaatgtgggtggtttcctggccggcttgcctttttcaactatcgctaagcattattcttggagcactgcattttgggtcgccgaggtcatctgcgccgcatcgacggcggcttttttcctcctccgtaacattcgaacgaagatgggtcgggtctccaagaaagcagag

SEQ ID NO: 19574 - DNA, 1287 bp, Artificial Sequence
  Description of Artificial Sequence: Synthetic coding sequence
atggccgctcaagggtacggctattaccggactgtcatcttctcagcgatgttcggcggctatagcctgtactacttcaaccgaaaaacgttctccttcgttatgcccagcttagtagaggagataccactagacaaggacgaccttggttttatcacgtcttctcagagcgcggcttacgctatctcaaaattcgtatcgggtgtcctgtccgaccagatgtcagctcggtggctatttagctctgggcttctcctggttggactggttaatatcttttttgcttggagctcgaccgtccccgtctttgcggctctgtggttcctaaacggactagcccagggtctgggctggccaccttgtgggaaagtcttgaggaaatggttcgaaccttctcaatttggaacatggtgggcaattctgtccaccagtatgaacttggccgggggtttgggacccatcctcgcaactattctggcccagtcctactcctggaggtccacgctagcactgtctggagcgctgtgcgtcgtggtgagcttcttgtgcttgttgctgatccacaatgagcctgccgacgtcggcctgcgaaacctcgatcccatgccatccgaaggaaaaaaggggtcactgaaggaagagtctactctgcaagagctgttgctgtctccgtatctgtgggttctgtcaacaggctacctggtagtgtttggggtgaagacctgttgtactgattggggccagttcttcctgatccaggagaaggggcagtcagctctggtgggtagttcctacatgagcgcccttgaggtgggtggactggtgggcagtatcgccgcaggctatctgtcagaccgggcaatggccaaggcgggcctctctaattatggaaaccccaggcacggactgctcctgttcatgatggcaggaatgacggtctctatgtacttgttcagagtgaccgtgacaagtgattccccaaaactctggatcctggtgctgggggctgtgtttggtttttcatcatatggccctattgccctgttcggagtgatcgctaatgagtccgccccacccaatctctgtggaacaagccatgctatcgtgggcctcatggcaaatgtgggaggattcctcgccggcctgcccttctcaacaattgctaagcattatagttggtcaactgccttttgggtggccgaagttatttgcgccgccagcactgcagcctttttcttactgcgtaacattagaactaaaatgggaagggtctctaaaaaggcagag

SEQ ID NO: 19575 - DNA, 1287 bp, Artificial Sequence
  Description of Artificial Sequence: Synthetic coding sequence
atggccgctcagggatacggatattaccggacagtcattttctccgcgatgttcggaggatattctctgtattatttcaatcggaaaactttcagttttgttatgcccagcctagtggaggaaattccgttggacaaagatgatcttggctttatcacctccagccagtctgccgcctacgctatctccaaatttgtgagcggggttctttctgatcaaatgagcgctcggtggttgttctcgtcaggactgctgctcgtgggtcttgtgaacatatttttcgcctggtccagtacagtccccgtgtttgccgcgctgtggttcctcaatggattagcccagggacttggctggcccccatgtgggaaagtgctgcgaaaatggtttgagccaagtcagtttggaacttggtgggcgatcttgagcacctcaatgaatttggcaggcgggctcggcccgatcttggcgacgattctggcacaatcctattcgtggcgtagtactctggcactgtccggcgctttgtgtgtggtggtgtcttttctctgcttgttgcttatacacaacgaacccgctgacgtaggcctccggaacctcgaccccatgcccagcgaaggcaagaaaggaagcctaaaggaggagtcaacattgcaggagctcctgctcagtccgtacttatgggtccttagtactgggtatctggtggtgtttggtgtcaaaacttgttgtaccgattggggacagtttttcctgatccaggagaaaggccagtctgcgcttgtcgggtccagctatatgagtgccctggaagtcgggggtctggtcgggagcatcgccgccggctacttgtcagaccgcgccatggcgaaggcaggcttatccaattatggcaacccccgtcatggactgttgctgttcatgatggccggaatgacagtgtctatgtatttgtttagggtgacagtaaccagcgattctccaaaactgtggatcctcgtactcggtgccgtttttggattttccagttatgggcccattgcactttttggcgtcattgcaaatgaatccgcaccacctaatctttgcggtaccagccatgcaatcgtgggtttgatggcaaatgtgggtgggtttcttgctgggctgccattttcaacgattgccaagcactattcttggtctacagctttttgggtggcagaggtaatttgcgccgcgagtacagcagctttttttctgctgcgcaatatccgaacaaaaatggggagagttagcaaaaaggccgaa

SEQ ID NO: 19576 - DNA, 1287 bp, Artificial Sequence
  Description of Artificial Sequence: Synthetic coding sequence
atggcggcgcaaggttatggttattatcgaacggtaatattttcggcgatgtttggtggttattcgctatattattttaatcgaaaaacgttttcgtttgtaatgccgtcgttagtagaagaaataccgttagataaagatgatctaggttttataacgtcgtcgcaatcggcggcgtatgcgatatcgaaatttgtatcgggtgtattatcggatcaaatgtcggcgcgttggctattttcgtcgggtctactattagttggtttagttaatatattttttgcgtggtcgtcgacggtaccggtatttgcggcgctatggtttctaaatggtctagcgcaaggtttaggttggccgccgtgtggtaaagtactacgtaaatggtttgaaccgtcgcaatttggtacgtggtgggcgatactatcgacgtcgatgaatttagcgggtggtttaggtccgatactagcgacgatactagcgcaatcgtattcgtggcgatcgacgctagcgttatcgggtgcgctatgtgttgttgtatcgtttttatgtctactactaatacataatgaaccggcggatgttggtctacgtaatctagatccgatgccgtcggaaggtaaaaaaggttcgctaaaagaagaatcgacgttacaagaattactactatcgccgtatttatgggttttatcgacgggttatttagtagtttttggtgttaaaacgtgttgtacggattggggtcaattttttctaatacaagaaaaaggtcaatcggcgctagtaggttcgtcgtatatgtcggcgctagaagtaggtggtttagttggttcgatagcggcgggttatctatcggatcgagcgatggcgaaagcgggtttatcgaattatggtaatccgcgacatggtttattactatttatgatggcgggtatgacggtatcgatgtatctatttcgtgttacggttacgtcggattcgccgaaactatggatattagtattaggtgcggtatttggtttttcgtcgtatggtccgatagcgttatttggtgttatagcgaatgaatcggcgccgccgaatttatgtggtacgtcgcatgcgatagttggtctaatggcgaatgtaggtggttttttagcgggtctaccgttttcgacgatagcgaaacattattcgtggtcgacggcgttttgggtagcggaagttatatgtgcggcgtcgacggcggcgttttttttattacgaaatatacgtacgaaaatgggtcgtgtttcgaaaaaagcggaa

SEQ ID NO: 19577 - DNA, 1287 bp, Artificial Sequence
  Description of Artificial Sequence: Synthetic coding sequence
atggctgcccagggatacgggtattatcgcactgtgattttttccgcaatgttcggcggctattccctgtactattttaatagaaagaccttcagcttcgtgatgccttcactggttgaggagattcctctggacaaggatgacctgggctttattactagctcgcaatctgctgcttatgccatctcaaaatttgtctcaggagtgctaagcgaccagatgagtgcccgctggctattcagcagcgggctcctgctggtgggtttggtgaacatttttttcgcctggtcatccacggtgcctgtttttgccgctctgtggttcttaaatgggttagctcaggggctcggatggcctccttgtggtaaggttctgagaaagtggttcgagcctagtcagtttggtacatggtgggccatcctatccacaagcatgaatcttgcaggcggactcggccccatactggcaaccatccttgcccagtcctattcctggagatcaacccttgccctgtcgggcgctctctgcgtggttgtgtctttcttgtgtctgcttctgatccacaacgagccggcggatgttggtcttagaaatctagatccaatgccttctgaagggaaaaagggctcactgaaggaagaatctactttgcaggaactcctgttgagtccatatctgtgggtcctaagcactgggtacctcgtggttttcggggtaaaaacgtgctgcaccgactggggccagttttttctaatccaggaaaagggacagtcagccttggtcgggtcctcttacatgagcgccttagaggtaggtggccttgttgggtccatcgcagcgggctacctttcggacagagctatggccaaggcagggctgtccaactacggcaacccccggcatgggctgctgttattcatgatggcaggtatgacggtctccatgtacttgttccgagtcaccgtcacttctgatagcccaaagctttggattctggtgttaggagccgttttcggcttcagctcatatggaccgatcgcattgtttggagtcatcgccaatgaatctgctccccctaatttgtgcgggacctctcacgcaatcgtgggcctgatggccaatgttggcggattcctagctggccttcctttctcaacaatcgccaaacactactcttggtccactgcgttctgggtggccgaagtcatctgcgcagcatctactgctgcgttcttccttctgcggaatatccgcacaaagatgggccgagtttcaaagaaggccgag

SEQ ID NO: 19578 - DNA, 1287 bp, Artificial Sequence
  Description of Artificial Sequence: Synthetic coding sequence
atggcagcacagggttatgggtattatcgaacagtaatctttagcgctatgttcggaggctactctctttactactttaataggaagactttctccttcgtgatgcccagccttgtagaggagattcctcttgataaggatgacttggggttcattacttcctcccaatccgccgcgtatgccatcagcaagtttgtgtctggagtgctctccgaccagatgtctgcaagatggctcttttcttcaggtctcctcctggttgggctggttaacattttcttcgcctggtcttctacagtgccagtgttcgccgcgctgtggtttctcaatggccttgctcagggtttaggttggcccccttgtggaaaggttttgagaaagtggttcgagccgagccagtttgggacatggtgggcgatactgtcaacctcaatgaacttggcagggggcttgggcccgattttggccactatcctggcccaatcgtacagttggcggtccacccttgcactcagcggcgcgttgtgcgtggtggtctctttcctttgtcttctgctaatacataacgaaccagccgacgtagggctccggaatctcgaccccatgccctcagagggtaaaaaggggagcctgaaggaagagtccacacttcaggaattgttgctgtcgccatatctgtgggtcctaagcacaggctacctggtagtgttcggggtcaaaacgtgttgtaccgactgggggcaattcttcctgatacaagagaaaggtcagagcgcgctcgtaggaagttcatatatgtcagccctcgaagtgggcgggctggtgggctctatcgccgccgggtacctaagcgacagagctatggctaaagcaggactgagtaattacggtaatccccgccacgggctgctcctgttcatgatggccggtatgaccgtgtccatgtatctatttagagtgacagtcacttccgattccccaaagctgtggatccttgtgctgggggccgtcttcggcttttcctcctacgggccgatcgctctctttggagttatagcaaacgaaagtgctccacctaacctgtgcgggacatcgcacgccatcgtggggctaatggccaacgttggcggttttctcgccggactcccattttcgacgatcgcaaagcactatagctggtccacagccttctgggtggctgaggtgatctgtgccgcgtcaacagcggccttcttcctgctgaggaacataagaacaaaaatgggccgggtgagcaagaaggctgag

SEQ ID NO: 19579 - DNA, 1287 bp, Artificial Sequence
  Description of Artificial Sequence: Synthetic coding sequence
atggctgctcaaggatatggatattatcgaacagttattttctctgctatgtttggtggatattcactttattattttaatagaaaaacatttagttttgttatgccatcattagttgaagaaattccacttgataaagatgatttaggtttcattacaagttctcaaagtgcagcttatgctatttcaaaatttgtcagtggagtacttagtgatcaaatgagtgctagatggttatttagttcaggacttcttttggtggggcttgttaatatattctttgcatggtcttctactgttccagtttttgcagcattatggtttcttaatggattagcacaaggattagggtggccaccttgtggaaaggttctaagaaaatggtttgaaccatctcaatttggaacttggtgggcaattctttcaacgtcaatgaatttagcaggagggttaggtccaattcttgcaacaattttagctcaaagttacagttggagatcaacacttgcattatctggagctttatgtgttgttgtttcgtttttatgtcttttacttattcataatgaaccagcagatgttggattaagaaatttagacccaatgccatcagaaggaaaaaaaggatctttaaaagaagaatctactcttcaagaacttttattaagtccatacttatgggtcttatcaactggatatttagtagtttttggagttaaaacttgttgtacagattggggtcaatttttccttattcaagaaaaaggtcaatctgcattagttggatctagttatatgagtgctcttgaagttggaggacttgttggatcaattgcagctggttatcttagtgatagagcaatggcaaaagcaggactttcaaattatggtaatccaagacatggactattattatttatgatggcaggtatgacagtttctatgtatctttttagagtaacagttacttctgattcaccaaaattatggattcttgttttaggagcagtttttggattcagtagttatggaccaattgcactttttggagtaatagcaaatgagagtgcacctccaaatctatgtggtacttcgcatgcaattgttggtttaatggctaatgttggaggatttttagcaggacttccattttcaacaatcgcaaaacattattcatggtctactgctttctgggttgcagaagttatttgtgctgcatcaactgcagctttttttttattaagaaatattagaactaaaatgggacgagtatcaaaaaaagcagaa

SEQ ID NO: 19580 - DNA, 1287 bp, Artificial Sequence
  Description of Artificial Sequence: Synthetic coding sequence
atggcagctcagggctacggatattacaggactgttatcttttctgctatgttcggaggctacagcctctactatttcaaccgtaaaacattctctttcgtgatgccaagcctcgtcgaagagattcctctggataaggacgacctgggcttcatcaccagtagccagtcggctgcatatgccatttctaaatttgtatctggagtcctgtccgatcaaatgtcagcaaggtggctcttctcctcaggcctgctgctggtggggcttgtcaacattttctttgcctggtcgtctaccgttcctgtcttcgcggctctgtggtttctgaacggcctggctcagggcctggggtggcccccatgtggtaaggtcctgcgcaaatggttcgagccgtcccagttcggaacgtggtgggccatcctgagcacatctatgaacctggcgggcggtttgggaccaattctggccactatcctcgcgcagtcctactcatggagaagtaccttggccctgagtggcgcactgtgcgtcgtcgtgtcattcctgtgtttgttactgattcacaatgagccagccgatgtggggctgcggaacctggatccaatgccgagtgaagggaaaaagggctcccttaaagaggaatccaccttgcaagagttactgttgtcaccgtatctgtgggtcctaagcactggttacctggtggtttttggggtgaagacatgctgcactgactggggtcaattcttcctaatccaggagaaagggcagtcagcgctggttggatctagttacatgtcggctttggaggtgggaggtttggtgggtagcattgccgccggctatctgtcagacagggcaatggcaaaggctggtctgtccaactacgggaatcctcggcatggcctccttctattcatgatggctgggatgacagtgagcatgtatctgttcagggttactgtgaccagcgactctcccaaactatggatcctcgtcctgggggcggtgttcgggttctcgtcatacggaccaatagcattgttcggcgtgatcgccaatgagtctgctccgcccaatttgtgtggcacaagccacgccatcgttgggctgatggcgaatgtaggaggcttcctagcaggactgcccttcagcacgattgccaaacactattcatggagtaccgcattctgggtggctgaagtgatctgcgccgcctccaccgccgcctttttccttctcaggaacatacgcaccaaaatggggcgcgtgagtaagaaagccgag

SEQ ID NO: 19581 - DNA, 1287 bp, Artificial Sequence
  Description of Artificial Sequence: Synthetic coding sequence
atggcagcacagggatacggatattaccgcacagtaatattttcagccatgtttggcgggtactcactttattactttaatagaaaaacctttagttttgtgatgccctccctggttgaagagatccccctcgataaggacgacctgggcttcatcacttcttcccaatctgccgcctacgccatctcaaagttcgtgtctggcgtcctgtctgatcagatgtcagctcggtggcttttctcatcagggctcctgcttgtgggtctggtgaatatctttttcgcttggagttccaccgtccccgtgttcgctgctttgtggttcctcaatggcctcgcgcagggacttgggtggccgccctgcgggaaagttttgagaaagtggttcgaacctagccagtttggtacctggtgggcgattctgtctacctcaatgaatctggctggcggtctcggccccatcctggccacaatcctggctcagtcatatagctggagatctactttggctctcagcggtgcactgtgtgtggtggtctctttcttgtgcttgctcctgatccacaatgagccggccgacgttggtctgcgcaatctggacccgatgccttccgagggtaagaaaggctcactcaaggaggaatctaccctgcaagaattgctgttgagcccttatctgtgggtgctcagcacaggctacctcgtcgtgttcggagttaagacctgctgtaccgattggggtcagttttttctcatccaggaaaagggccaatctgctctggtggggagctcctatatgagcgcccttgaagtgggcggactcgtggggtccatagctgctggttacctttccgatcgagccatggcgaaagcggggctgagcaactacggaaacccacggcacggactgctgctgtttatgatggctgggatgactgtgagtatgtatctgttcagagtgacagtgacgtcagacagcccaaagctgtggatcctggttctgggtgcggttttcggcttttcttcttatggcccaattgcccttttcggagttatcgccaacgaatcagcccccccgaatctgtgcggaacctcccatgcgattgtggggctcatggccaacgtcggcggatttctggccgggctgcccttctctaccatagctaaacactattcctggagtacagccttctgggtcgcggaagtcatatgcgccgcatctacggccgccttcttcctgttgaggaacattagaactaaaatggggagagtatccaagaaagctgaa

SEQ ID NO: 19582 - DNA, 1287 bp, Artificial Sequence
  Description of Artificial Sequence: Synthetic coding sequence
atggctgcccagggttacggctactataggacggtaatcttctctgccatgtttggcggatactcattatattacttcaatagaaagaccttcagctttgttatgccgtccttggtggaggaaattcctttggataaagacgatcttgggttcatcacctcatcacagtctgccgcttatgcgatcagtaaatttgtgagcggggtgttgagcgatcagatgtcagctcgctggctgttttcctctggcctgttgttggtgggcctggtgaacatattttttgcctggtccagcacggtccccgtgtttgccgctctttggtttctgaacggactggctcaggggttggggtggcctccctgcggtaaggtattgcgcaaatggtttgagccatcccagttcggaacttggtgggccattttgagtactagcatgaatcttgccggggggctgggccccattctggctacaattttagcacagtcatattcctggagatctacattggccttatctggagcactttgtgtcgttgttagctttctatgcttactgctgatccacaatgagcctgccgacgtggggttgaggaacctggatccaatgccttctgaaggtaaaaagggatctctgaaagaggagagtacacttcaagaactgttgttgtcaccgtacctgtgggtcctctccacgggctatctcgtagttttcggagtaaaaacgtgctgcactgattggggtcaatttttcctaatccaggagaaggggcagtcagctctggttggctctagttatatgagcgccctggaggtgggcgggctggtgggcagcattgccgcaggatatctgtccgatagagccatggccaaagctggcctgtctaactatggcaatccccgccatggcttactgcttttcatgatggccggcatgactgtgagcatgtacctcttcagagtcaccgtaacgtccgactcaccgaaactctggatcctcgtgttgggagctgtgtttggcttttctagttacggaccaattgccctcttcggtgtgatcgcaaatgaaagcgctccgccgaacctgtgcggaactagtcacgccatcgttgggctaatggcgaatgtcggtggattccttgcaggcctcccctttagtactatagctaagcactatagctggagcactgccttctgggttgccgaggtgatctgtgccgccagcactgccgctttcttcctgctcaggaatattagaacaaagatgggacgcgtgtctaaaaaagccgag

SEQ ID NO: 19583 - DNA, 1287 bp, Artificial Sequence
  Description of Artificial Sequence: Synthetic coding sequence
atggcggcacagggttacggctactacaggactgtgatcttttccgcaatgtttggaggttactcactttactacttcaacaggaaaactttcagctttgttatgccaagcctggtggaagaaattcctcttgataaggatgatctgggattcatcaccagctcgcagtcggcagcatacgctatcagcaaatttgtctccggcgtgctgtcagatcagatgtccgcccgctggctttttagctcaggactccttctggtaggactcgtcaacatcttttttgcatggtcctcgaccgtcccagtgttcgcagcactgtggtttttgaacggactggcacagggactgggctggcctccttgtggtaaggtgcttagaaaatggtttgagccatcgcaatttggtacctggtgggccattctgagcacctcgatgaatcttgccggcggtctgggcccgatactcgctactatcctggcgcagagctacagttggagatccacccttgccctttcaggtgcactttgcgtggtggtgtctttcctttgtctcctcctgatccacaacgagcccgcagatgtgggactgagaaacttggatccaatgccctccgaaggcaagaagggatcgctgaaggaggaatccactctgcaggagctgctgctgtccccatacctgtgggtgctctcgactggatacctcgtcgtttttggagttaagacttgctgtaccgattggggtcaattctttttgattcaagaaaaaggacaaagcgctctggtcggcagctcctacatgtcggcactggaggtcggaggtcttgtgggcagcatcgcagcaggatatctctccgaccgagcaatggcaaaggctggactttcaaactacgggaacccacgtcatgggctgttgctctttatgatggcaggaatgactgtgagcatgtacctcttccgcgtgactgtcactagcgattcaccaaagttgtggattctcgtgctcggtgccgtctttggtttttcgagctacggaccaattgcactttttggcgtgatcgcaaacgagtctgcaccacctaatctgtgcggaacgtcccacgcaattgtggggctcatggcaaacgtgggaggattcctggccggactgcctttcagcaccattgcgaagcattactcatggtccaccgcattctgggtggcagaggtgatatgtgccgcatccactgcggcgttcttcctgctgcggaatatcagaaccaaaatgggtagggtgtccaagaaggcagag

SEQ ID NO: 19584 - DNA, 1287 bp, Artificial Sequence
  Description of Artificial Sequence: Synthetic coding sequence
atggccgctcaaggctatggttattatagaactgtaatctttagcgcaatgtttggtggatacagtctatattattttaacaggaagacgttctcttttgtgatgccctcactggtcgaggagatccctcttgacaaagatgatctgggttttataacttcctcacagtcagctgcatatgccatatctaaatttgtgagtggcgtactgtccgaccagatgtcagctcgatggttgttcagtagcggtctcttgcttgtggggctagttaacattttcttcgcttggagctctacagtccccgtgttcgccgcgctctggttcctgaatggtctggctcagggactggggtggcccccttgcggcaaagtgcttaggaagtggttcgaaccatcccagtttgggacttggtgggcgatcctcagcacctctatgaacctcgcagggggactgggccccatactggcgaccattttagcacagtcctatagctggcgaagcacactggcgctatctggagctctgtgcgtggtcgtcagctttctgtgccttttgctgatccacaatgagccagcagatgtcggcttgcgtaatctcgaccctatgcccagcgagggcaagaagggctcattgaaagaagaaagtacactgcaggaactgttgctgtctccgtacctctgggtactcagtacaggttatctggttgttttcggtgtgaagacgtgctgcactgactgggggcagttctttctgattcaagagaagggacagtctgcactggtagggtcttcctacatgagcgcccttgaagtcggcggactggtgggctctattgcggcgggttacctctcggaccgggccatggctaaagccgggctgtctaactacggaaaccccagacatggcttgttattattcatgatggccgggatgaccgtttctatgtatctgtttcgggtgacagtgacttccgattctccaaagctgtggatcttagtcctgggcgctgtcttcggattttcaagctacggacccattgcactgttcggagtcatcgctaatgaaagcgctccacccaacctgtgtgggacgtctcatgcgatcgtcggccttatggccaatgtaggcggattccttgccggcttgccattcagcactattgctaagcattactcttggtccacagccttctgggtcgcggaagtgatttgtgctgcaagtacagcagccttttttctgctccgtaacatccgcacgaagatgggccgggtatcaaagaaggccgaa

SEQ ID NO: 19585 - DNA, 1287 bp, Artificial Sequence
  Description of Artificial Sequence: Synthetic coding sequence
atggctgcccagggctacggatattaccgcaccgtgatcttttcagcaatgttcggaggatactccctctactactttaaccgtaagactttttcgttcgttatgccatcgcttgtggaagaaataccactcgataaggacgacctgggattcatcactagctcccagtcggccgcatacgccatctcgaagttcgtgtcgggggtgctgtcagatcagatgtcggcgcgctggttgttctcatcgggattgctgctcgtcggtctggtcaatatcttcttcgcgtggtcatccaccgtgcccgtgttcgcagccctctggttcctcaatggactggctcagggtctgggttggccgccgtgtggaaaggtgctgcgcaagtggttcgagccctcccaattcggtacttggtgggcaatcttgagcactagcatgaacctggccggcggactgggaccaatcctggccaccatcctggcccagagctatagttggagatcaaccttggcgttgtcgggtgccctttgcgtggtggtgtcgttcctgtgtctgctgcttatccacaacgaacctgcagatgtgggactgagaaatctggatccgatgccgtccgaaggtaagaaaggatccctgaaggaagaatcaactctgcaggagctgctgctctcgccatacctgtgggtgctttctacggggtacctggtggtgttcggagtaaagacctgctgcactgactggggacagttttttctgattcaagagaaaggtcagtcagccttggttggttcgtcgtatatgtccgctctcgaagtgggaggactcgtcggtagcatcgcggctgggtacctctcagaccgcgcaatggcaaaggctggcctgagcaactacgggaacccaagacacggtctgctgctgtttatgatggccggtatgaccgtctcaatgtacctcttcagagtgactgtcacttcagattctccgaaactctggattctcgtgctgggagctgtattcggattttcctcgtatgggcctattgctcttttcggcgtcatcgccaacgagagcgcgccgcctaatctttgcggcacctcacatgccatcgtgggcctgatggctaacgtcggcggattcctcgccggacttccgttctccactatcgccaagcactactcgtggagcaccgctttctgggtcgccgaagtcatctgtgccgcgagcactgccgccttctttctgctgaggaacatcagaaccaagatgggacgggtgtcaaagaaagccgag

SEQ ID NO: 19586 - DNA, 1287 bp, Artificial Sequence
  Description of Artificial Sequence: Synthetic coding sequence
atggcagcccagggttatggatactacaggacagttatattcagtgctatgtttggaggatacagcctctactacttcaatcgaaaaacatttagctttgttatgccgagtttagtcgaggagatcccgcttgacaaagatgatctcggatttattacaagtagccagtcagctgcttatgctatctccaaatttgtcagcggggttctgtctgatcagatgagcgctagatggttgttctccagcggactcctgttggtgggcctcgtcaacatcttcttcgcgtggtcttccacagtgccggtattcgcagcgctgtggtttctgaatgggctggcccaaggactcggttggcctccctgtggcaaggtgctccgcaaatggttcgagccttctcagttcggaacatggtgggccattctgagcacctctatgaatttggcgggggggctcggccccatactggcgaccatcctggcccagtcgtactcatggcggagcactttggcattgtcgggggcactgtgtgtggtggtttctttcctctgtctccttctgatccacaacgagcctgcggacgtggggttgcgaaatctcgacccgatgccatcagaggggaaaaagggatctttgaaggaggagtctacgctgcaggagctgctgctgagcccctatctctgggtgttgtctacaggttatctggtagtatttggcgttaagacctgctgcactgattgggggcagttctttctcattcaggagaaaggtcagagtgctctggttggtagtagctatatgtcagcactggaggtggggggcctcgtagggtccattgcagccggatatctgagcgacagagcgatggcaaaggccggactgagcaattacggcaatcctaggcatggcttattgctctttatgatggccgggatgaccgtgtccatgtatctttttagagtcaccgttacctctgattccccaaaactttggatcctggtcctcggggccgtatttgggttctcaagttacggtcccatcgccctttttggtgttattgccaatgagtccgcccctcccaatctgtgcggtacatcccacgcaatcgtgggtctgatggccaacgtcggggggtttctggctggcctgcctttctcgacaatcgccaaacattatagctggtcaacagccttctgggttgctgaagtaatttgtgctgcaagtactgcagccttctttctactaagaaacatccgcactaagatgggtcgcgtgagcaaaaaagcagag

SEQ ID NO: 19587 - DNA, 1287 bp, Artificial Sequence
  Description of Artificial Sequence: Synthetic coding sequence
atggccgctcagggatacggatactaccggaccgtgattttctcggctatgttcggaggctactcgttgtactacttcaatcgcaagactttctcattcgtgatgccaagcctcgtggaagaaatcccactcgacaaggacgacctcggattcattacttcctcgcagtccgcggcttacgcgatctcgaaattcgtgtccggtgtgctctccgaccagatgtcggcccgctggctgttctcatcaggcctgctcctcgtgggactcgtcaatatcttcttcgcatggtcgagcactgtgccggtctttgcagccctgtggttcctgaacggactggcccagggtctgggatggcctccttgcggaaaagtgctcaggaaatggtttgaaccgtcccagttcggcacttggtgggctatcttgtctacctcaatgaacctggcaggcggcctgggcccaattctcgccaccatcctggcgcagtcctacagctggcggtcgaccctcgccctgtcaggtgccttgtgtgtcgtggtgagcttcctttgcttgttgctgattcataacgagccagcagacgtgggactgcggaacctggacccaatgccttccgaaggaaagaaaggaagtcttaaagaggagtcgaccctgcaagaactcctgctgtcgccatatctctgggtgctctcgacgggctacctcgtggtgttcggggtaaagacttgctgcaccgactggggacaattcttcttgatacaagaaaagggacagtccgcgctggtgggctcgagctacatgtccgccctcgaggtgggcggcctggtcggctccatcgcggcaggatacctgtccgaccgcgccatggccaaggccggactgagcaattacggcaacccaagacatggattgctgctcttcatgatggccggcatgaccgtttcgatgtacctgttccgcgtcaccgtgacctccgattcgccaaagctgtggatcttggtgctcggggctgtctttggcttctcgtcctacggcccgatcgctcttttcggagtcattgccaacgagtccgcgcctccgaatctgtgcggcacctcacacgccatcgtgggactcatggcgaatgtgggcggattcttggcgggtctgccgttcagcactatcgcgaagcattactcttggtcaactgccttctgggtagctgaagtcatctgtgccgcatcgactgccgcctttttcctcctgagaaatatccggacgaagatgggaagagtcagcaagaaggcggaa

SEQ ID NO: 19588 - DNA, 1287 bp, Artificial Sequence
  Description of Artificial Sequence: Synthetic coding sequence
atggcagcacaaggatacggatactacaggaccgtcattttctcagcaatgttcggagggtactcgctttactacttcaaccggaaaactttttcctttgtgatgccctccctggtggaggagatccctcttgataaggatgacctggggttcatcacgtcgagccagtccgctgcatacgccatttccaagtttgtctcgggcgtgctgtcggatcaaatgtccgcaagatggcttttttcgtcgggtctgcttttggtcggacttgtgaacattttcttcgcatggtccagcactgtgcctgtgttcgccgcattgtggtttctcaatggtcttgcccaaggcttgggctggccaccttgtggtaaggtccttcgcaaatggttcgagccttcacagtttggtacctggtgggcaatcctttccacttctatgaacctggcagggggactcggtccgattctcgcgaccattttggcgcagtcgtacagctggcgcagcactctggcactgtcaggagcactttgtgtggtggtgtcctttctttgtctgctgttgatccataacgaacccgcggatgtgggacttcgaaatctggacccaatgccctcggaaggaaaaaagggatcactcaaagaggaatccacgttgcaggagctgcttctgtcgccttacttgtgggtcctctcgaccgggtatctcgtggtgtttggtgtcaagacctgttgtaccgattggggccaattcttcctgattcaggagaaagggcaatccgcgcttgtgggctctagctacatgagcgcactggaggtgggcggtctggtcggttccattgcagctgggtacctctcggatcgcgcgatggcaaaggcggggctgtcgaactacggtaatccaagacatggccttctgctgtttatgatggccgggatgaccgtcagcatgtacctcttccgtgttactgtcacctcagactcccctaagctgtggattctcgtgcttggagcagtgtttggtttttcctcgtacggtcctatcgccctgttcggcgtgattgccaacgaatccgcacccccaaacctttgcggaacctcgcatgcaatcgtcggcctgatggccaatgtcggtggctttctcgctggcctcccattttcgacgatcgcaaagcactacagctggtccaccgcattctgggtggccgaggtcatttgtgctgcctcaaccgcagccttctttctgcttcgcaatatacgaactaagatgggtcgggtgtcaaaaaaggccgaa

SEQ ID NO: 19589 - DNA, 1287 bp, Artificial Sequence
  Description of Artificial Sequence: Synthetic coding sequence
atggccgcacagggctacgggtactaccggaccgtcatatttagcgcaatgtttggcggctattctctatactatttcaacagaaaaacgttttcctttgttatgccttcattggtagaagaaattcctttagacaaagacgatttggggtttataacttcgtcacaatctgccgcttatgccatctccaaattcgtttctggcgtcctgagcgatcagatgagtgcaaggtggctgttcagctcggggttattgcttgtgggcctggtgaacatctttttcgcctggtccagtaccgtcccagtcttcgcggccctttggttcttaaatgggctggcacagggattgggatggcccccctgtgggaaggttctgcgaaagtggttcgaaccatcccagttcggcacatggtgggccatcttgagcactagcatgaacctggcaggcggactcgggcccatactggcaaccattctggcccagtcctatagctggcggtcaaccctggcactctctggcgcactgtgcgtcgtggtaagcttcttgtgtctccttctaatccataacgagccagctgatgtcggcttaaggaacctcgatcccatgccgagtgaaggtaaaaagggatcgctgaaggaagaatcaaccctgcaggaactgttactgagcccttacctgtgggtcctttctaccggctacctagtcgtgttcggggtcaagacctgctgcacagactggggccagtttttccttatccaggaaaaagggcaaagcgcccttgtgggaagctcctacatgtccgccttagaggttggagggttggttggcagtatcgcagcgggttatctatcagaccgggctatggcaaaggctggcctgtccaattatgggaaccccaggcatgggctgcttctctttatgatggcaggtatgaccgttagcatgtatctgttccgagttacggtgacgagcgacagtccgaagctctggatcctcgtgctcggtgccgttttcggattctcatcctatggccctattgctctattcggggtcatcgctaacgagtccgcgccccccaacctgtgcggcacatcccacgctatcgtcggcctgatggcaaacgtagggggatttctggcgggtttaccatttagtacaattgccaagcactactcctggtccactgcgttttgggtggcggaggtaatctgtgctgcatccacggcagccttctttctgctccggaacatccgaacaaaaatgggtcgagtgtccaagaaggcagag

SEQ ID NO: 19590 - DNA, 1287 bp, Artificial Sequence
  Description of Artificial Sequence: Synthetic coding sequence
atggccgctcagggctatggctattaccggacagtcatcttctcagcgatgtttggaggttacagcctctattacttcaatcggaagactttctcatttgtgatgccttctctcgtcgaggaaatcccgctggataaagatgatttagggtttattacatctagtcaatctgccgcttacgccatctccaagtttgtctctggagtgttatcagatcagatgtctgcgagatggctgttctcttcaggcctcctcttggtagggttggtgaacatcttcttcgcctggagcagcactgtgcccgtgtttgccgccttgtggtttttgaacggcctcgcacagggactgggttggccaccatgcgggaaggtcttgcggaagtggttcgagccttcccaattcggaacttggtgggctatcttgagcacctccatgaacctcgctggaggcctagggccaattctggcgacaatactggcacagagctattcctggcgcagcactttagccttgtccggcgctttgtgcgtggtcgtgagttttctttgtttacttcttatccacaacgagccagcagacgtgggcctacgtaacctcgatcccatgccctcagagggcaagaaaggttctctcaaggaagagtccactctacaggaacttttattatccccttacctgtgggtgctgagtaccgggtacctagtcgtgtttggcgtgaagacctgctgcactgattgggggcagttctttctgattcaggaaaaaggacagagtgcacttgtgggcagctcctatatgagtgccttagaggtcggcgggttggtcggctcaattgccgctgggtatctctcggacagagctatggccaaggctgggctaagcaactacggcaatcccagacatggcctgctgctgtttatgatggctggaatgacagtgagtatgtacctcttcagggtgaccgtcacatcagactcgcccaagctttggatactggtgcttggagctgtgttcggattttcatcctatggccccatcgccctgttcggggtcatcgcaaacgagtctgctccccctaacctgtgtggcaccagtcatgctattgtgggcttaatggccaatgtgggcggatttctggcgggcctgcccttcagtaccatcgcgaaacattactcttggtccaccgccttctgggtggcagaggttatttgtgccgccagtacagccgctttttttcttttgcgcaacatccggaccaaaatgggccgtgtgtctaagaaggctgag

SEQ ID NO: 19591 - DNA, 1287 bp, Artificial Sequence
  Description of Artificial Sequence: Synthetic coding sequence
atggctgcccagggatatggatattataggaccgttatttttagcgctatgttcggcggttattcactatactattttaacaggaaaactttctcgtttgttatgccatctttggttgaggaaattcctctggataaggatgacctcggtttcatcacctcatcccagagcgcagcgtacgccatatccaaatttgtatctggggtcctgtccgatcaaatgtcggctagatggcttttcagctccggtttgctattagtggggttagtgaatatcttctttgcttggtcatctactgtcccggtttttgctgctttatggttcttgaacggactcgctcagggcctgggttggcccccatgcggaaaagtgttgcgcaaatggttcgagcctagccaatttggaacctggtgggctatactgagcacttcaatgaacctagcaggtgggctcggacccattctggccaccattcttgctcagtcttactcatggaggtcaactcttgcgttgtctggagctctctgtgtcgtcgtctcatttctatgtcttctgttaattcataacgagcccgctgatgtcggtcttaggaatcttgatccaatgccatctgaagggaagaagggctccctcaaggaagagtccacgcttcaagagctcctcctgagcccctatctttgggtcctgagtacaggctacttggtggttttcggtgttaagacttgttgtacagactggggacaatttttccttattcaagaaaaaggacagagtgctttggtgggatcttcatacatgtctgccctggaggttggtggccttgttgggtctatagctgctgggtacttatcagatagagcaatggctaaagcaggcttgtcaaattatggtaatccaaggcatggacttcttttgttcatgatggctggtatgacagtctcaatgtatttgtttagagtgacagttacctcagatagtccaaaattgtggattctagttctcggcgctgtgttcggtttttcatcatatggccctatagctttgtttggtgtcatagctaacgaatccgctccacctaatttatgtggaacgagtcacgccatagtaggtctgatggcaaatgttggtggtttcctcgcaggtctacccttctcgacgattgcaaaacattactcgtggtctacggccttctgggtggccgaagttatctgtgcagctagcacagctgccttcttcctgttgagaaatattagaaccaaaatggggcgtgtttctaagaaggctgaa

SEQ ID NO: 19592 - DNA, 1287 bp, Artificial Sequence
  Description of Artificial Sequence: Synthetic coding sequence
atggcggcccagggatatggctactaccggactgtgattttcagtgcaatgttcggcggctactcgctttactatttcaatcgtaagacttttagcttcgtcatgcccagcttggtggaagaaatcccattggacaaagacgacttgggtttcattacgtcatcccagagcgcggcctacgcaatttcgaagtttgtgtccggtgtgctctcagatcaaatgagcgcaaggtggctgttttcttcgggacttctgctggtgggtctggtcaacatctttttcgcgtggtcgtccactgtcccggtgtttgctgcgctttggttccttaacggacttgcacaagggctcggctggcccccttgcggtaaagtgcttcgaaagtggttcgaaccctcccaatttgggacttggtgggctattctctcgacctctatgaaccttgccggaggtcttggtcctatcctggcaactattctcgcgcagagctacagctggagaagcaccctggctctttcgggtgcactgtgtgtggtggtttcgttcctttgtcttttgcttatccataacgagccagccgatgtcggactgaggaacttggatccaatgccctccgagggaaaaaaggggagccttaaggaggaatcaacccttcaggagctgctgcttagcccctacctctgggtgcttagcactggttacttggtggtgtttggtgtgaaaacttgttgcaccgactggggtcagttttttctcattcaggaaaaaggccaatcggctcttgtcggctcatcgtacatgtccgcactggaggtgggaggcttggtgggaagcattgcagcaggatacctttcggatcgcgcaatggcaaaggcaggtctgtcgaattacggaaatccacgccacggactgctgctgttcatgatggctggaatgactgtgtcgatgtatctgtttagggtgaccgtcacttccgattcacccaaactctggattctggttcttggggcagtgtttggattctcctcatacggaccgatcgccctctttggggtgatcgctaacgagtcggcgcctcctaatctgtgtggaaccagccatgcaattgtggggctcatggccaatgtgggaggatttctggcagggcttccgtttagcacgattgcaaaacattactcatggtccactgccttttgggtcgcagaggtgatctgtgccgcgtccactgcagcgtttttccttctccgaaacatccgcaccaagatgggacgagtctccaagaaagcagag

SEQ ID NO: 19593 - DNA, 1287 bp, Artificial Sequence
  Description of Artificial Sequence: Synthetic coding sequence
atggccgcccaaggatacggctactacaggactgtcatcttctcagcaatgtttgggggttactcgctgtactatttcaacaggaaaactttctccttcgtgatgccgtccctggtggaagaaatccctctcgacaaggacgatctgggttttatcacttcatcccagtccgccgcatacgcaatctcgaaattcgtttccggagtgctgtccgaccagatgtcagcgcgctggctgttttcgtccggtctgttgctggtggggctggtgaacattttcttcgcctggtcatcaaccgtgcctgtgttcgccgcgctgtggttcctgaacggactggctcagggccttgggtggccgccatgtggaaaggtcctcaggaagtggttcgagccgtcgcaattcgggacctggtgggccatcctctccacttccatgaacctcgcagggggactgggcccaattctcgcgaccatcctggcacaaagctactcttggcgttcgactctggccctgtcgggagcactgtgcgtggtcgtgtcgttcctgtgcctccttctgattcataatgagccggccgatgtgggacttaggaacctggacccaatgccgtccgagggtaaaaagggttcgctgaaggaagagtcgaccctgcaggaactgcttctgagcccgtacctctgggtcctgagcactggatacctcgtggtgttcggggtcaagacgtgctgcaccgactggggacaattcttcctgatccaggagaaaggacagtcagccctggtcggttcgtcgtacatgagcgccctcgaggtcggaggcttggtggggagcatcgcagccggatacctgtccgatagagcgatggctaaggcggggctcagcaactacggcaacccacgacacgggctgctgcttttcatgatggcaggaatgaccgtgagcatgtacctgttcagagtcacggtgaccagcgacagccctaagctgtggatcctcgtcctgggagccgtctttgggttctcaagctacgggccgatcgccctgttcggggttatcgcaaatgagtcggccccacccaacctctgcggcactagccatgccatcgtgggactcatggcaaacgtgggcggctttttggccggccttcctttctcgaccatcgccaagcattactcatggtcaaccgcattctgggttgcagaagtgatctgcgctgcctccaccgccgcgttctttctgctccggaacatccgcacgaagatgggccgcgtgagcaagaaggcggag

SEQ ID NO: 19594 - DNA, 1287 bp, Artificial Sequence
  Description of Artificial Sequence: Synthetic coding sequence
atggccgcacaaggatacggttactacaggaccgtcattttcagcgcgatgttcgggggatactcattgtactactttaacagaaagacctttagcttcgtcatgccttcgcttgtggaagagattccacttgacaaggatgatcttgggttcattactagctcacagtccgcggcttatgcaattagcaagttcgtgagcggcgtgctctcggaccagatgtcggcccgctggctcttctcctcaggattgcttctggtgggccttgtgaatatcttcttcgcgtggtcgtcgactgtgccagtgttcgctgctctctggtttctcaacggactcgcgcagggacttgggtggccaccttgcggaaaagtgctgaggaaatggtttgagccatcgcaatttggaacctggtgggcaatcctgtcaacctccatgaatcttgcaggaggacttggacccatcctggcaactattttggcgcagtcgtactcctggcgctccactcttgctctgagcggggccctgtgtgtggtggtgtccttcctctgccttcttcttattcacaacgaaccagcagatgtgggactgagaaatttggaccctatgccatcggaaggaaagaagggttcccttaaggaagagtccaccctgcaggaacttctgttgagcccttacctgtgggtgctcagcaccggttacctcgtggtatttggagtcaaaacctgttgtaccgactggggtcagttttttcttatccaggaaaagggacaatcggccctggtcggttcctcttacatgtccgcactggaagtcggcggactggtgggctccatcgccgcgggttatctgtcagatcgggcaatggctaaggctggcctgtccaactacggaaacccccgacacggtctgctcctgttcatgatggcaggaatgactgtctcgatgtacctcttcagagtcactgtgacttcagactccccaaaactttggatcctggtcctcggagcagtgttcggcttttcctcatacggaccgattgcactgttcggggtgattgcaaatgagtccgcccctccaaacctgtgtggaaccagccacgcaatcgtcggactgatggcaaacgtgggaggattccttgcagggctgcctttttccaccattgcaaaacattactcctggtcgactgcattttgggtggccgaggtgatctgtgccgcttctactgcagcattcttcctgctcagaaacattagaaccaagatgggtcgtgttagcaagaaggccgag

SEQ ID NO: 19595 - DNA, 1287 bp, Artificial Sequence
  Description of Artificial Sequence: Synthetic coding sequence
atggcagcacaggggtacggttattacagaactgtgatcttcagcgctatgttcggaggctacagcctctactacttcaatcggaaaaccttttcctttgtcatgccgtcgttggtggaggaaatcccgcttgataaggatgaccttggctttatcaccagctcccagtccgccgcctacgcaatctccaaattcgtgtcaggagttctttcagatcagatgtcagcgcgctggctgttttcatcgggattgctcctggtgggccttgtgaacatattcttcgcctggtcctcgactgtgccggttttcgcggctctctggttcttgaacgggttggcccagggactgggctggccaccctgcggcaaagtgctgcgcaagtggttcgaacctagccagttcggtacctggtgggcgattctgtcgacctcgatgaatctcgctgggggcctcgggccgatcctcgcaaccatcctcgcccagtcctactcatggagatccacgctcgccctgtcgggagccctgtgcgtggtggtgagcttcctgtgcctgctgttgatccataatgagccagccgacgtcggactgcgcaacttggaccctatgccgtcagaagggaaaaagggatcattgaaggaagaatcgacgttgcaagagctgctgttgtcaccttacttgtgggttctttcgactggttacttggtggtctttggcgtcaagacttgctgcaccgattggggtcaattcttcctgatccaggaaaaaggccaatctgccctggtgggcagctcttacatgagcgccctcgaggtcggcggattggtgggatcaatcgcggccggatacctgtccgaccgggcgatggcgaaggcgggactctcgaactatggaaacccccgccacgggctgctcctgttcatgatggccggaatgactgtgagcatgtatctcttccgagtgaccgtcacctcagacagcccgaagctgtggattctcgtcctcggagcagtctttggcttctcatcatatggaccgatcgctctttttggtgtgatcgctaacgaatcggccccacctaacttgtgtggtacctcccacgcgattgtgggactcatggccaatgtgggcggattcctggctggcctgcctttctccactatcgccaagcactactcatggtccaccgcgttctgggtcgcagaagtgatctgtgcagcgtcaactgctgccttctttctccttcggaacatccggactaagatgggcagggtcagcaagaaggcagag

SEQ ID NO: 19596 - DNA, 1287 bp, Artificial Sequence
  Description of Artificial Sequence: Synthetic coding sequence
atggctgcgcagggctacggttattatcgcactgtgatttttagcgcaatgttcggcggttatagcctctactacttcaacaggaagaccttctccttcgtgatgccaagcttggtcgaggagatccccttggataaggatgatctgggatttataactagctcccagtccgcggcatacgcaatcagcaaatttgtcagcggtgtcctgagcgatcagatgagcgcgcgctggctctttagcagcggtctgttgttggtgggcctcgttaacatcttctttgcatggagctccaccgtgccggtattcgctgctctctggtttttgaacggtctggcgcagggtctgggttggccaccgtgcgggaaagttctgcggaagtggttcgagccgtctcaatttggcacgtggtgggctatcctcagcacaagcatgaacctggccggaggtcttggtccgatcttggcaacaatattggcgcagagctacagttggcgttccactttggcactgagcggtgccctgtgcgtggtggtttccttcctgtgcttactgctcatccataacgagcctgcggatgtcgggttgagaaatctggaccctatgcctagcgaaggtaagaagggtagcctgaaagaggagtctactttgcaggagctgctcctgagcccttatctttgggtgttgagcaccggttacctggtggtgttcggagtgaagacttgctgtacggattggggtcagttttttttgatccaagagaaaggccagtccgccctggtgggctccagctacatgagcgcccttgaggtgggcggcctggtgggcagtatagcggctgggtacctgtctgaccgcgcgatggcgaaggctgggttgagcaattatggtaaccctcgccacggtttgctcctctttatgatggccggcatgacggtcagcatgtatctctttcgggtgactgttacctccgacagccccaagctgtggattttggtcctgggcgctgtgtttggattctcgagctacggccctattgctctgtttggggtcatcgccaacgaatctgctccacctaatctgtgcggtactagccacgctattgtggggctgatggcgaatgttggcggctttctcgcaggtctgccgttcagcacaattgccaaacactacagctggtccaccgccttctgggtcgcagaggtcatctgcgcggcgtccaccgcggcgttctttctgctgcggaatattagaaccaaaatgggacgcgttagtaagaaggcagag

SEQ ID NO: 19597 - DNA, 1287 bp, Artificial Sequence
  Description of Artificial Sequence: Synthetic coding sequence
atggccgcccaaggctacggatactacagaaccgtgatcttctccgccatgtttggtggatactcgctgtactactttaacagaaaaactttctcgtttgtcatgccttccctggtggaagaaatcccactggacaaggatgatctgggctttatcaccagctcgcaatcggctgcatacgcaatttctaagtttgtgtctggagtcctgtccgaccaaatgagcgccaggtggctgttttcctccggactcctgttggtgggtctggtgaatatcttctttgcatggtcgtcgaccgtccccgtgtttgcggcactgtggttccttaacgggctcgctcaggggctgggttggccaccctgtggaaaagtgctccgaaagtggtttgaaccttcgcagtttggaacctggtgggcaattctgtccacttcgatgaatcttgccggcggacttggtccaatcctcgcaactatactggcgcagtcatactcgtggagatcgacccttgccctgtcgggggcactgtgtgtcgtcgtctcgttcctctgtctgctcctcattcacaacgaaccagctgacgtgggacttagaaacctggaccctatgccaagcgaaggaaagaagggaagtcttaaggaggagtcgacccttcaggaacttttgctcagcccatacctctgggtgctgtcgacgggatacctggttgtctttggagttaagacctgctgcaccgattgggggcagttttttctgatccaagaaaagggacaatccgcacttgtcggttcctcatacatgtcagcactggaggtgggaggcctggtcggctccatagcagcaggttacctctccgatcgcgcaatggcgaaggcaggcctgtccaactatggaaatccaaggcatgggctgctcctgtttatgatggctggcatgactgtcagcatgtacctttttagagtgactgtgacgtccgactcccctaagctgtggatcctggtgctcggtgcagtgtttggcttttcctcctacggtcctattgcactgttcggtgtgattgctaacgaatccgcccctcccaatctgtgtggcacctcccatgcaatcgtgggccttatggcgaatgtcggcggatttctggcaggactgccattttccactattgctaagcattactcatggtccactgcgttctgggtggcagaagtcatttgcgcagctagcactgcggctttctttcttctgagaaacatcagaacgaaaatgggacgggtgtcgaaaaaggcagag

SEQ ID NO: 19598 - DNA, 1287 bp, Artificial Sequence
  Description of Artificial Sequence: Synthetic coding sequence
atggctgcccaagggtatgggtactatagaactgtgatcttctcagctatgtttgggggctacagtctctactactttaataggaagacctttagcttcgtgatgccatcattagtggaagaaattcccctggataaggatgacctgggctttattacatcatcacagagcgccgcctacgccatttcaaagttcgtctccggcgtcctgtccgaccagatgagcgcccggtggctgttctcctcaggacttctcctggtaggcttggtaaatatcttcttcgcctggtcttctactgttccggtctttgctgctctttggtttctgaacggattggcacaagggttaggttggccaccctgcgggaaggttctacgtaagtggttcgaacctagtcagttcggcacgtggtgggccattctcagcacctctatgaatctggcaggtggcctgggcccaatattagctaccatccttgcccagtcgtatagctggaggtctacattggcgctgtcgggagctctgtgtgtggtcgtcagctttctgtgtttgctgctaattcacaacgagcccgctgacgtcgggcttaggaatctggatcctatgccttccgagggtaaaaaggggtcgctgaaggaagaaagtacactgcaggagttgctgcttagcccctacctttgggtcctcagcaccggttacctggtggtcttcggcgtcaagacgtgctgcactgactggggacagttcttcctcatacaggagaaggggcagtcagctttggtaggttcatcctacatgtcggcgctggaagtagggggattggtgggttcaattgctgcgggatacctatccgatcgagcaatggcaaaggctggcctgtccaattatggcaacccacggcatgggttgttattgttcatgatggcaggcatgacagtgtcaatgtacctcttccgagtgaccgttaccagtgactcaccaaagttatggattctagtgctgggggccgtgttcggcttttcctcttatgggcccatcgccctgtttggcgttatcgccaatgaatctgcacctcctaatctctgcggcacctcccacgccatcgtaggattgatggccaatgtgggcggctttcttgcaggtctaccattctcgaccattgccaaacactattcttggagtaccgccttttgggtggctgaggttatctgcgccgcaagtacagcggctttttttcttcttcgaaacatacgaactaagatggggcgtgtgtccaagaaagctgaa

SEQ ID NO: 19599 - DNA, 1287 bp, Artificial Sequence
  Description of Artificial Sequence: Synthetic coding sequence
atggccgcccagggatacgggtactaccggaccgtcatcttctccgcgatgtttggtggatatagcctgtactacttcaatcgaaaaactttcagcttcgtgatgccttcgctcgtggaggagatcccgctcgacaaggacgacttgggattcatcacctcatcgcaatcggccgcgtacgctatctcaaagtttgtgagcggcgtgctgtccgaccagatgtccgcacgctggctgttttcctcaggtctgctgctggtgggactggtgaacatcttcttcgcctggtcgtcaactgtgcctgtgttcgcggctctctggtttcttaacggtctggcacagggccttggatggccgccatgcggaaaggtgctcagaaagtggttcgaaccttctcagttcggcacttggtgggccatcttgagcacctccatgaacctggccgggggactgggacctatcctggcaaccatcctggctcaatcgtacagctggcggagcactctggccctctcgggcgccttgtgcgtcgtcgtctccttcctctgcttgctgcttatccacaacgagcccgctgacgtgggactgagaaacctggatcctatgccgtcagagggaaaaaagggctcgttgaaggaagagagcaccctgcaagaactgctgctttcaccatacctctgggtgctgagcactggatacctcgtggttttcggagtgaaaacgtgctgtactgattggggacagttcttcctgattcaagagaaaggccaatcggcgctggtgggtagctcgtacatgtcagcacttgaggtgggtgggctcgtcggaagcatcgcagcggggtacttgtccgatagggcgatggccaaggcaggactctcgaattatgggaacccgaggcacggcctccttctgttcatgatggccggaatgactgtttcaatgtacctgtttcgcgtgactgttacctccgattcgccgaagctgtggatcctcgtcctgggagcagtgttcggttttagctcatacggaccaatcgccctgtttggagtgatcgccaacgagtcggctccgccgaatctgtgcggcactagccatgcgatcgtgggactgatggccaacgtcggtgggttcctggccggactgccgttctcgaccatcgcaaaacactacagctggtcaaccgctttctgggtggctgaggtgatttgtgccgcgtccactgcagctttctttttgctgcggaacatccgcacgaagatgggaagagtgtcgaagaaggctgaa

SEQ ID NO: 19600 - DNA, 1287 bp, Artificial Sequence
  Description of Artificial Sequence: Synthetic coding sequence
atggccgcacaggggtacggttactaccggacggtcattttctcggcgatgtttggcggatacagcctgtactatttcaacaggaaaaccttctccttcgtgatgccgtcactcgtggaagaaattcccctggacaaagacgacctgggatttatcacctcctcacagtcggctgcatacgccatctccaagttcgtctccggtgtgctttccgaccaaatgtcggcccgctggctcttctcttcgggactcctgctggtgggcctggtcaacatcttcttcgcatggtcaagcactgtgccggtgttcgccgccctgtggtttctcaacggactcgcgcaaggactcggttggcccccgtgcggaaaagtgctgcgcaagtggtttgagccaagccagttcggcacctggtgggccatactctcgactagcatgaatctcgctggaggacttggaccgatcctggccactattctggcccaatcctattcctggcgcagcactctggcgctgtcgggagccctttgcgtggtggtgagcttcctctgcctgctgcttatccacaacgaaccggccgatgtgggactgagaaacctcgacccaatgccctccgaaggaaagaagggatctttgaaggaggagtcaactctgcaggaactcttgttgtccccatacctctgggtactgagcaccggctacctggttgtgtttggagtcaagacttgttgcactgactgggggcagttttttctgatccaagaaaagggacagtccgcgctggttggttcatcatacatgtccgcgctggaagtgggaggcctcgtcggtagcatcgccgctggatacctctcggatcgcgccatggctaaggccggactgtcaaactacggtaatccacgccatggactcctgttgttcatgatggccggcatgactgtgtcgatgtatctgttcagagtgaccgtgacctcggactcgcctaagctgtggattctcgtcctcggagctgtctttggattcagctcctacggacccattgctttgtttggggtaatcgccaacgaatcggcgccaccgaatctctgtgggaccagccatgcgatcgtgggtttgatggctaacgtgggcggattcctggcgggactgccattttcgaccatcgccaaacactactcctggagcaccgccttttgggtcgccgaagtgatctgtgcggcgtccaccgcagcgttctttctgctccggaacatcaggaccaagatgggaagagtgtcgaagaaggccgag

SEQ ID NO: 19601 - DNA, 1287 bp, Artificial Sequence
  Description of Artificial Sequence: Synthetic coding sequence
atggccgcgcaggggtacggctactaccggaccgtcatcttttccgcaatgtttggaggatactccttgtactacttcaaccgaaaaactttctcattcgtgatgccgtcgttggtggaggaaattccactggataaggacgacctgggcttcataacttcatcgcaatccgcagcatatgccatttcaaagttcgtgtcgggggtgttgtccgatcaaatgtccgccagatggctgttctctagcggcttgctcctggttggcctggttaacattttctttgcgtggagctcaaccgtcccagtctttgccgctttgtggttcctgaatgggctcgcacagggacttgggtggcccccttgcggtaaggttctcagaaagtggtttgaaccctcgcaatttgggacttggtgggctatcctcagcacgagcatgaatctggcaggcggtctgggacctatactcgcgactatccttgcccaaagctactcatggaggtcaacgttggccctgtcgggggcactttgcgttgtggtcagctttctctgtcttttgcttattcataacgagcctgccgatgtcgggcttcggaaccttgatcctatgccaagcgaaggcaagaagggatcgctgaaagaggaatcgacgctgcaggagctgctgctctcaccttatctttgggtgctttcgactggttacttggtggtgttcggagtgaaaacctgttgtaccgattggggacagttttttctgatacaggaaaagggtcaaagcgcgctcgtcggttcgtcctacatgtctgccctcgaagtcggaggtctggtgggaagcattgcggcggggtacctgtcagaccgcgcaatggcaaaagcaggactttcgaattacggaaatcctcgtcacgggcttcttttgtttatgatggcagggatgaccgtctctatgtacctttttcgcgtgactgttaccagcgactcgccaaagctctggatcctggtgcttggtgcagtgtttggattttcgtcctatgggccaattgccctgtttggtgtgattgcaaacgaatccgcacccccgaacttgtgtggaacttcccacgcgatcgtcggcctcatggcaaacgtgggcggtttcctggcaggactgccattttcgaccattgcaaagcattactcgtggtccaccgccttctgggtggcagaagtgatttgcgcagcctccaccgccgcgttctttctgctccggaatatccgaacgaaaatgggaagagtcagcaaaaaggcagag

SEQ ID NO: 19602 - DNA, 1287 bp, Artificial Sequence
  Description of Artificial Sequence: Synthetic coding sequence
atggccgcccagggctacggctactacagaacagtcatctttagcgctatgttcggtggctactcactgtattatttcaatcgcaagaccttttcatttgtgatgccaagtctggtcgaagagatacctctggacaaagatgacctgggctttattacatcttcccagagtgctgcctacgctattagtaagtttgtgtcaggcgtcctctcagatcagatgtcagctagatggttgtttagctcaggcctccttcttgtgggacttgtaaacattttctttgcttggagctcaactgtcccagtcttcgcagcgctgtggtttcttaatggtctggcacagggccttggctggcccccgtgtggaaaagtcctgaggaaatggtttgaaccttctcagtttggcacctggtgggcaatcctgagcacttccatgaacctggctggggggctgggaccaatcctcgccacaatccttgcacagtcttacagctggagatctacactggcactctctggcgctttatgcgttgtggtgtcctttctctgtctcctgctgattcacaacgaacccgcagacgtggggctgaggaatctggatcctatgccaagcgagggaaaaaagggcagcctgaaggaagaatccacactgcaagagctcttgttgagcccctacctctgggtgttgagtacgggctatcttgtcgtttttggagtaaaaacctgttgtaccgactgggggcagttctttctcattcaggagaaagggcaatctgcgcttgtgggctccagctatatgagtgctctggaagtgggaggcctggtgggttcgatcgcagctgggtatttgagtgaccgcgcaatggccaaagccggcctttctaactacggcaaccccaggcacggccttctgctgttcatgatggctggaatgacagtctccatgtacttgttcagagtaacagttaccagcgattctcctaaactttggatccttgtgcttggagccgtatttggcttttcttcttatgggcccattgctctgtttggagtcattgcaaatgaaagcgccccaccaaacctttgtggaacgagccatgcgatagtgggcctgatggcaaacgtgggtggatttctggccgggctgcctttcagtactatcgctaaacactacagttggtcaacggccttttgggtcgctgaggtaatatgtgctgcatccaccgcggctttcttccttcttcggaatataagaacaaagatgggaagagtcagtaaaaaggctgaa

SEQ ID NO: 19603 - DNA, 1287 bp, Artificial Sequence
  Description of Artificial Sequence: Synthetic coding sequence
atggctgcgcagggttatggctattaccgaacagtcattttttctgcaatgttcggaggctattccctttactactttaataggaaaacattcagctttgtcatgccgtcattagtggaagaaatccctttagacaaagatgatctcgggttcataacatcttctcaatctgcagcgtatgcaatctccaaatttgtttcaggcgttttgtctgatcagatgtctgcaaggtggctcttttcgagcggactgttactggtggggttagtgaatatttttttcgcttggtcatcaactgtcccggtgtttgctgctctttggtttcttaacggactcgcacaagggttaggatggccgccgtgtggaaaagttcttagaaaatggttcgaaccgtctcaatttggcacgtggtgggcgatcttgtcaaccagcatgaacctagcgggtgggttggggccgattctcgctacgattttagctcaaagctactcctggcgatcaacactggccttatcgggagcactgtgcgttgtcgtttccttcttatgcttgctattaatacataatgaaccggccgatgtgggacttcgtaacctcgacccaatgccttcagaaggcaaaaaaggctctttaaaagaagagagcaccctacaggaattgttactttctccttatctttgggttttatccacgggttacttggtcgtgtttggggtaaaaacatgctgtacagattggggccagtttttccttatccaagaaaaagggcaatctgctctcgttggatcgagctatatgtctgctcttgaagtgggcggtcttgttggttcgatagccgcgggatacttaagcgatcgggctatggcaaaggctggtctgtcaaattatggtaacccacggcatggacttttactttttatgatggcaggtatgaccgtatcgatgtatctatttcgcgtgacggtaacgagcgacagtcctaaattgtggatcctcgttttgggcgcagtttttggtttttccagctacggtccaatcgcactttttggtgtgattgccaatgaatctgctccaccgaacctctgtggaacgtcccatgcgattgtgggacttatggcgaacgtggggggcttcctcgccggcttaccgtttagcacaatcgccaaacattatagctggtcaacggccttttgggtggcagaagtaatctgcgctgcatctacagctgcgttttttctgctccgcaatatcagaacaaaaatgggacgcgtctctaaaaaagctgaa

SEQ ID NO: 19604 - DNA, 1287 bp, Artificial Sequence
  Description of Artificial Sequence: Synthetic coding sequence
atggctgcccagggatacggttactaccggaccgttatctttagtgccatgtttggggggtattccctgtactatttcaatcgcaagactttctcgttcgtgatgccatccctggtcgaagaaattcctctcgataaggatgatctcggattcatcactagctctcagtccgcggcgtacgcaattagcaagttcgtgtccggcgtgctgtccgatcagatgagcgcaagatggctgttctcctcggggttgctgttggtcggactggtgaacatctttttcgcttggtcgtcgaccgtccctgttttcgccgccctctggtttcttaacggactggcgcagggactgggatggccaccgtgcgggaaagtcctccgtaagtggttcgaaccttcacagttcggcacctggtgggctatcctctcaacctcaatgaacctggccgggggactggggcccatcctggcgacgatcctcgcccaatcgtacagctggagaagcactctcgcactctctggagcgctgtgcgtcgttgtgtcctttctgtgcctgttgctgatccataatgagccagccgatgtgggactccgaaacttggaccctatgccgtcggaaggaaagaaaggctcgcttaaggaggagtcaacccttcaggaactgctgctttccccatacctctgggttctgtccaccggttacctcgtggtattcggagtaaaaacgtgttgcacggactgggggcaattcttcttgatccaagagaagggacagtcggcactcgtcggctcctcatacatgtcggctctggaggtgggaggcttggtgggaagcatcgctgcgggctatctgtcggaccgggccatggccaaagccgggcttagcaactacggcaatccccggcatggtctgctcctgttcatgatggcgggtatgactgtctcaatgtacctgttccgcgtcactgtgacctcagactccccaaagttgtggatcctcgtgctgggcgccgtgtttggtttttcctcctacggtccgatcgcactgttcggggtgatcgctaacgagagcgcccctccgaacctctgcgggacttcgcacgcgattgtgggactgatggcgaacgtgggcggatttctggctggcctgccattctcgaccatcgcgaagcactactcgtggtccaccgccttctgggtggccgaggtgatctgcgccgcctccaccgccgctttcttcctgctgcgcaacattaggactaaaatgggaagagtctccaagaaggccgaa

SEQ ID NO: 19605 - DNA, 1287 bp, Artificial Sequence
  Description of Artificial Sequence: Synthetic coding sequence
atggccgctcagggctacggctactatcgcacagtgatattttccgctatgtttggaggatattcactgtattatttcaatcgcaaaacattctcatttgtgatgccttcactcgtagaggaaatcccactggataaagatgacctcggctttatcacctcctcacaatccgctgcctacgccatatctaagtttgtcagtggcgtactttctgaccaaatgtccgctaggtggctcttctcctcagggctgctgctagtggggcttgtcaacattttcttcgcctggagtagtaccgtgcccgtatttgccgctctttggtttctcaatgggctggcccaggggcttgggtggcctccgtgcggcaaggtgctccgcaagtggttcgaacctagtcagttcgggacctggtgggccattttgtcaaccagcatgaatcttgctggaggattaggccccatcctggcgacaattttagcccagtcctatagttggaggagcactctggccctgagtggcgctctgtgtgttgttgtttccttcctgtgcttgctgctcatccataacgagccagctgatgttggactgcgtaacctggaccccatgccttctgaggggaagaagggaagcctgaaagaggaatcaacactgcaggagctgcttctgtctccgtacctgtgggtgttaagtacaggttacctagtggtcttcggtgtgaagacctgttgtactgattggggacagttcttcctgatccaggagaaaggtcagtctgcgctcgtgggatcctcctatatgagcgctctggaagtcggaggcctggtgggctctattgccgcggggtatctcagtgaccgggctatggcgaaggcgggactgagtaattacggtaatccccggcacgggttactcttatttatgatggctgggatgacggtgagcatgtacttgttccgggtcactgtaacctcagacagtcctaagctgtggatactagtgctcggagcagtgttcgggttctcttcatacggcccaattgcattgttcggagtcatcgcgaatgaaagcgcacctccgaacctgtgtggaacctcccatgccatcgtcggactcatggcgaacgtgggcggctttctcgccgggctgcctttcagtaccattgccaagcactactcttggagtaccgcattttgggtggccgaggtgatttgtgcagcttctacggctgccttcttcctattgaggaacattcggaccaaaatgggcagggtttcgaagaaagcagag

SEQ ID NO: 19606 - DNA, 1287 bp, Artificial Sequence
  Description of Artificial Sequence: Synthetic coding sequence
atggctgcacaaggttacggctattacaggacggtcatcttttccgccatgttcggagggtacagcctgtactacttcaatcgcaaaaccttctccttcgtgatgcccagccttgtggaagaaatcccgcttgataaggatgatcttggtttcatcacttcctcgcagtccgccgcatacgccataagcaaatttgtctcaggtgtgcttagcgaccaaatgtctgcgcggtggcttttcagctcggggctgttgctcgtgggcttggtgaacatctttttcgcatggtcctctaccgttccggtgttcgcagcactttggtttcttaatggactggcccaaggcctcgggtggcctccgtgcggtaaggtgttgagaaagtggtttgaaccttcacagtttggaacttggtgggcaattctgagtacttctatgaacttggcaggtggccttggcccaattctggcgactatactggcccagtcgtactcatggcgaagcacgcttgcgctcagcggagccttgtgcgtggtggtcagcttcctgtgcctgctccttattcataatgagccggcagatgttggattgagaaacttggaccccatgccatcggagggcaagaagggctcactgaaagaggaatcaacccttcaagagcttctcctgagcccttacctgtgggtcctctctaccggatacctggtggtgtttggagtgaaaacttgctgtaccgattgggggcaattctttctgattcaggaaaaaggacagtccgctctggtgggtagcagctacatgagcgcccttgaggtcggaggcctggtcggatcgatcgccgcaggatacctgtccgaccgggccatggcgaaagcgggtctgagcaattatggtaacccacggcacggacttcttctctttatgatggcgggaatgactgtgtcaatgtaccttttccgagtcaccgtcacgtctgactcccctaaactgtggatcctggtccttggggcagttttcggattttcgtcctatggacccatcgccctgtttggagtcattgccaacgaatccgcaccaccaaacctctgtggaacctcccacgccattgtcggactgatggctaacgtgggaggctttctcgcgggtctgccattttcgaccattgcgaagcattactcctggtcaaccgcattttgggtggcggaagtcatctgtgcagcttccactgcggcatttttcctgcttaggaacattagaaccaagatgggccgtgtgagtaaaaaggccgaa

SEQ ID NO: 19607 - DNA, 1287 bp, Artificial Sequence
  Description of Artificial Sequence: Synthetic coding sequence
atggcagcacagggatacgggtattacagaaccgtgatcttctccgcaatgtttggcggctacagcctttactactttaaccgaaaaaccttttcctttgtcatgccttcgctggtggaagagattccactcgacaaggatgatctcggatttatcacctccagccagtcggccgcatacgcgatctccaaatttgtgtccggagtgctctctgaccaaatgtcggcaaggtggctgttctcgagcggtctgctgctcgtgggactggtgaacatcttttttgcctggtcctccactgtgcccgtgttcgcagctctttggttcctcaacggtttggcacagggtctggggtggccaccatgcgggaaggtgctgcggaagtggtttgagcctagccagttcggtacttggtgggcgatcctgtcgaccagcatgaatctcgcagggggccttgggccaatccttgcgactatacttgcacaatcgtactcatggagatccacccttgcactgtccggtgcattgtgtgtggtcgtcagttttctgtgtctgttgcttattcataatgaaccagcagacgtcggtctgcggaatctcgatcctatgccatccgagggaaagaagggatcattgaaggaagaatccactcttcaagaactgcttctctcaccttacctttgggtgctttcaactgggtaccttgtggtgttcggcgtcaaaacttgctgcaccgattggggtcagttttttctgattcaggagaagggacaatccgcactcgttggatcctcgtacatgtcagccctggaggtgggaggtttggtcggatccatcgcggccggttacctgtccgatagagcaatggccaaggcggggctctctaactacggcaatccccggcatggactgctgctgttcatgatggccggtatgaccgtgagcatgtacctttttagagttactgtgacgagcgatagcccaaagctctggatcctcgtcctcggagcagtgttcgggttctcgtcgtacggacctattgcactgttcggagtcatcgccaatgagtccgctcctccaaacttgtgcggtaccagccatgcaatcgtgggtctgatggcaaacgtcggggggtttctggccggtctgccttttagcactatcgcaaaacattactcctggtccacggccttttgggtcgcagaagtcatttgtgccgcttcaactgctgcgttttttcttcttcgaaacattcggactaagatgggtcgggtgagcaaaaaagcagaa

SEQ ID NO: 19608 - DNA, 1287 bp, Artificial Sequence
  Description of Artificial Sequence: Synthetic coding sequence
atggcagcccagggatatgggtactacaggaccgtgatatttagtgccatgttcgggggttatagtttatattactttaatcgaaaaacattctcatttgtcatgccctccctagtagaagaaatacccctggataaagacgaccttggattcatcaccagtagtcagtctgcggcctacgctattagcaagtttgtcagcggtgtgctgtctgatcagatgagcgcacggtggcttttctcaagtggcctcctgctggttggtctggttaacattttcttcgcctggagttcaactgtccctgtgttcgccgcactctggtttctgaacggcctggcacagggactgggctggcctccatgtggcaaggtgctgcgcaagtggtttgagccatcccagtttgggacctggtgggcaatattgagcacctctatgaacctggccggtggcctgggccccattctggcgaccatacttgcccagtcctattcctggagatcgacactggccctgagcggagctctgtgcgtcgtcgtatccttcctgtgtctcctgcttatacataatgaacctgccgatgtggggctgagaaatctggatccgatgcccagcgagggcaagaagggcagcttaaaggaagagtcaacactacaggagcttttgttgtccccctatttgtgggtgctgagcacggggtacctcgttgtctttggcgtgaagacctgttgcactgactggggccagtttttcctaattcaggagaaaggccagtcagctcttgtaggctcatcctacatgtccgcactcgaagttggaggccttgtggggagcatcgctgctggatacctctccgatcgcgcgatggccaaagccggactttcgaactacggcaaccctagacacggtctcctgctcttcatgatggcaggcatgacagtgtcgatgtatctgttccgtgtgaccgttacaagtgacagccctaaactctggatccttgtgcttggcgccgtgtttgggttctcctcctacggtcccatcgcacttttcggtgttattgccaacgagtcagcaccaccaaacctctgtgggacgtcccatgcaattgttggcctgatggctaacgttggcggttttctggccgggctacccttctccactattgccaagcactatagctggagcacggctttttgggtggctgaggtaatatgcgcagccagcacagccgccttctttttgctgcgcaatattaggacaaaaatgggccgggttagtaaaaaggctgaa

SEQ ID NO: 19609 - DNA, 1287 bp, Artificial Sequence
  Description of Artificial Sequence: Synthetic coding sequence
atggcagctcagggttacggctactaccgtaccgttattttttcagctatgttcggaggttactctctgtactacttcaatcgcaagaccttctctttcgttatgccatccttggttgaagaaattcctctcgataaggatgacctcggctttattacatcttcccagagtgccgcttacgctatttcaaaattcgtcagcggagtgctgtcagaccaaatgtcagctaggtggctgttcagtagcggactcctcctggtaggcctcgtgaacattttcttcgcctggtccagcactgtccctgtcttcgctgcattgtggtttctgaatggcttggctcagggcttgggctggccaccttgcggcaaagtgttgaggaagtggttcgagcccagccagtttggcacttggtgggctatcctctccacctctatgaatctggcaggaggccttggacccatcctggcaacaatcttggcccagagctatagttggcgctccactcttgccctgagtggcgctctctgcgtagtggtaagcttcctctgcttgctcctgatccacaatgagcctgcagacgttggactgaggaatctcgacccaatgccaagtgagggtaagaagggttccctgaaggaagagtctacacttcaggagctgcttctttctccttacctgtgggttctctccactggttaccttgtagtgttcggtgtgaagacctgctgcaccgactggggccaattctttctgatccaggagaagggacagagcgctctggtaggatcttcctatatgtctgccctggaagttggaggtctcgtcggatcaattgccgctggctatctgtctgatcgtgctatggccaaggccggtctgagtaactatggtaaccccaggcacggtctgctgctctttatgatggccggcatgacagtatctatgtacctcttcagagtcactgtgacatcagacagccccaagttgtggatactcgtgctgggtgctgtctttggattttcctcttacggaccaatagccttgttcggcgttatcgccaatgagtctgccccccctaacctttgcggaacatcccacgcaatcgtaggtttgatggccaacgtaggcggtttcctcgctggtctcccattctctactatcgcaaaacattacagttggtcaacagcattctgggtggctgaagtgatctgtgctgctagcaccgccgctttcttcctgctgcgcaacatcagaaccaaaatgggccgtgtgtccaagaaagctgaa

SEQ ID NO: 19610 - DNA, 1287 bp, Artificial Sequence
  Description of Artificial Sequence: Synthetic coding sequence
atggctgcgcagggctatgggtactaccgcaccgtgatattttccgccatgtttggtggatattccctctactactttaaccgcaaaactttctcatttgtgatgcctagcctggtcgaggagattcctttggataaagacgatctgggtttcatcacttccagccaatccgccgcttatgcgatcagtaaattcgtgtctggagtgctctctgaccaaatgtccgcgagatggctcttcagttcaggtctgctcctggtgggcctcgtcaacattttctttgcttggtcctccacagtgccggttttcgctgcattgtggtttctgaatgggctggcccaggggttgggatggcctccctgcggaaaggtcctgcgcaaatggttcgaaccttcacaatttggcacttggtgggccatcctgtctacttccatgaatcttgccgggggtctggggcccattttggctacaatcctcgcccagagctactcctggaggtctacattggcactgagcggagcattgtgtgtcgtggtaagtttcctgtgcttgctcctcatccataacgaaccagcggatgtgggcctcagaaatttggaccccatgccatccgaaggcaagaaaggatctctcaaggaggagtccaccctgcaggaattgctgctgagtccttatctgtgggtgctgagtactgggtaccttgtggttttcggggtcaaaacttgttgtacagactggggacagttcttcctgatccaggagaaggggcagtccgccttggtaggcagctcttacatgtccgcacttgaagtcggtggtctggtcggctccattgcagcgggttaccttagtgatcgggctatggcaaaggccggtttgtctaactacggaaatcctaggcacggattgctgttgtttatgatggcagggatgaccgtttctatgtacctgtttcgcgtgacagttacatccgacagccccaaactgtggatactggtcctgggcgcggtctttgggttctctagttatggccccatagcactgttcggggtcattgccaatgagagcgcccctccaaatttgtgcggcacttcccacgcgatcgtcggcctgatggctaatgtggggggattcctggccggcttgcccttttctactattgccaaacattactcatggagtaccgcattctgggttgctgaggtgatctgcgcggcttcaaccgcagccttcttcctgcttcgaaatatccgcacaaagatggggcgggtgtcaaaaaaggctgag

SEQ ID NO: 19611 - DNA, 2082 bp, Artificial Sequence
  Description of Artificial Sequence: Synthetic coding sequence
atgacttttggtcagtccaaactttataggtcggaggattacgggaagaacttcaaggacattaccgacctcattaacaacactttcatccgaactgagtttggtatggctattggcccagaaaactccggtaaagtggtccttactgcagaagtgtcaggaggatcccgcggcggccggatttttcggtcgtcagattttgcaaagaattttgtgcaaactgatcttcccttccatccactcactcagatgatgtattcccctcaaaactcggactaccttctggccctttccaccgaaaatggtttgtgggtttcaaaaaactttggaggaaagtgggaagaaattcataaggcagtctgcctggcaaaatgggggtcggacaacaccatctttttcactacgtatgcgaatggctcttgtaccgatctgggagctcttgagctttggcgtactagcgaccttggaaaatcatttaagaccataggtgtgaagatttactccttcggactgggcgggcgcttcctgtttgcatcagtcatggcggataaggatactacgcgcaggatccatgtctcaaccgatcaaggcgatacttggtcgatggcacaacttccctcggtcggacaggagcagttttactccatactcgcagcgaatgacgacatggtgtttatgcatgtcgatgaaccgggagacactgggtttggtaccattttcacctcggacgatcgcggtattgtgtactcaaagtcgcttgatcggcacttgtacaccacgaccggtggagaaactgatttcaccaacgtgacttcactgagaggagtctacatcacgtccgtgctgtcagaagataattccatccaaaccatgattacttttgaccaaggtggacgatggacccaccttcggaaacccgaaaactccgagtgcgatgcaactgccaagaacaagaacgaatgtagcctgcacatccacgcatcatactcgatttcgcaaaagctgaatgtgccaatggccccgctttcagaacccaacgcagtgggtattgtgatagcacacggatcggtcggtgatgcgatttcagtcatggtgcctgatgtgtacatcagcgatgacggggggtactcatggaccaaaatgcttgagggtcctcattactacaccattttggattccggcggaatcatagtcgcaatcgaacactcctcaaggccgattaatgtgataaagttctccactgatgaggggcaatgctggcagacctacacttttacccgtgaccctatttactttaccggactggcatcggagccgggtgccaggtcgatgaatatctccatttggggattcaccgaatcgtttctcacgtcgcagtgggtcagctacacgatagactttaaggatatcctcgaacgcaattgcgaggaaaaagactacaccatctggctcgcacattccaccgatccggaagattacgaggacggatgtatcctgggctacaaggagcagtttctgaggctgcgaaagagctccgtctgtcaaaacggaagggattacgtggtcaccaaacaaccctcaatctgtctttgctctctggaagatttcctctgcgattttggctattacagaccagaaaacgatagcaagtgtgtcgagcaacctgagcttaagggtcatgacttggagttttgtctttacggcagagaagagcacctgacgaccaacgggtaccgcaagatccctggcgataagtgtcagggaggggtgaaccctgtgcgggaggtgaaggatctgaaaaagaaatgtacctcgaactttctctccccggagaagcagaattcgaagtccaattccgtgcctatcattctcgctattgtgggactgatgctggtgaccgtggtggctggtgtgcttattgtgaagaaatacgtctgtgggggaagattcctcgtccatcgatacagcgtgcttcaacagcatgcagaagccaacggtgtggacggcgtcgatgccctcgatacggcatcccatactaataagtcaggttaccatgacgactctgacgaggatcttcttgaa

SEQ ID NO: 19612 - DNA, 2082 bp, Artificial Sequence
  Description of Artificial Sequence: Synthetic coding sequence
atgaccttcggtcagtccaagctgtatcgctccgaggattacggtaagaacttcaaggatatcaccgacctgattaacaatacattcattaggacagagttcggtatggcaatcggccctgagaactcaggcaaagtggtgctcacagctgaagtcagtggcggttcaagaggcggccgcattttccgttccagtgatttcgccaagaacttcgtccagaccgatctcccctttcaccctctcacccagatgatgtatagtccccaaaactccgattacctcctcgctcttagcaccgagaacggcctgtgggtgagcaagaacttcggtggaaagtgggaggagatacataaggctgtctgcttggccaaatggggtagtgacaatactatctttttcaccacatacgcaaatggaagttgtactgacctgggcgctctggaactttggcgcactagcgatctgggtaaatccttcaagaccatcggcgtgaagatctattcatttggtcttggaggtagattcctttttgcttcagttatggcagataaggataccactagaaggatccacgtaagcaccgaccagggcgatacctggagcatggcccaattgccttctgtgggacaggaacagttttacagcatcctggcagcaaacgacgacatggtgttcatgcatgtggacgaaccaggagataccggtttcggaactatattcacctcagacgacaggggtatcgtctactccaagtcactcgatagacacctctataccaccaccggtggtgagacagactttaccaatgtgacatcactgcgtggcgtgtatatcacttctgtgctgtctgaggataattccattcaaaccatgattaccttcgaccagggcggcaggtggacccatctgcgcaagcccgagaactccgagtgcgatgcaactgctaagaacaagaacgagtgttctcttcatatacacgctagttacagcattagtcaaaaactgaatgtcccaatggcccctctgtccgaaccaaatgccgtgggtattgtgattgcccacggttctgttggcgacgctataagcgtcatggtccctgacgtctacattagcgatgacggcggctacagttggactaagatgctcgagggcccacattattacacaattcttgattctggtggtattattgtggccattgagcactcaagcagaccaatcaatgtgataaagttttctacagatgagggccaatgctggcagacttacactttcactcgcgatccaatatactttactggactggcttcagaaccaggtgctcgttctatgaatatttccatttggggcttcaccgagtccttcttgaccagccaatgggttagctacactattgacttcaaagatatcctcgaacgcaactgcgaggagaaggactatactatctggctcgcccacagtaccgatccagaggattatgaagacggatgcatcctgggttacaaagagcagttcctcagactgcgcaagtcatccgtgtgtcagaacggcagagactacgttgtcacaaaacagcccagcatctgcctgtgctccttggaagatttcctgtgtgatttcggatactacaggcctgagaacgacagcaagtgcgtagaacagcccgaactcaaaggtcacgacctcgaattctgcttgtacggacgcgaagagcacttgactacaaatggttaccgtaagattccaggtgataagtgtcagggaggtgtcaatccagtgagagaggttaaggaccttaaaaagaagtgtacatctaacttcctcagccctgagaagcagaacagcaagtctaatagcgtgcccatcatcctcgcaatcgtgggacttatgttggtgaccgtcgttgccggcgttcttattgttaaaaaatacgtgtgtggcggccgttttctggtccacaggtacagcgtgttgcaacagcacgccgaggccaacggagtggatggcgtggacgctctcgatactgctagccatacaaacaagagcggctatcacgacgattctgacgaagatctcttggaa

SEQ ID NO: 19613 - DNA, 2082 bp, Artificial Sequence
  Description of Artificial Sequence: Synthetic coding sequence
atgacgttcgggcaatcgaagctgtatagatccgaggactacggcaagaacttcaaggatatcaccgacctgatcaacaacaccttcatccgcactgaattcggaatggctatcggaccggaaaactcgggaaaggtggtccttactgccgaggtcagtggcggatctcggggaggaagaattttccgctcctccgatttcgccaaaaacttcgtgcagacggacctgccgttccaccccctgacccagatgatgtactcgccccaaaattcagactacctcttggcgctctcaactgagaatggtttgtgggtcagcaaaaacttcggcggaaagtgggaggaaattcataaagccgtgtgtctcgctaagtggggttcagacaacaccatctttttcactacctacgccaatggctcatgtaccgacctcggagcactcgaactttggcgcacctcggatctcggaaagagcttcaagactatcggggtgaagatatactcattcggactgggaggaagattcctcttcgcatctgtgatggcagataaggacactacgcgcaggatccacgtctcaacggatcagggcgacacgtggtccatggcacagctgccgtccgtgggacaggaacagttttactcgatcctggcggccaacgacgatatggtgttcatgcacgtggatgaaccgggggataccggcttcggaacgatcttcacttcggacgatcggggaatcgtgtactccaagtcactcgaccggcacctctacaccaccaccggcggtgaaactgactttactaatgtgacctcccttagaggtgtctacatcacgagcgtcctctcagaagataactcgatccagaccatgatcaccttcgatcagggaggtcgctggacgcatttgcggaagccagaaaacagcgagtgcgacgctaccgccaagaacaaaaatgagtgctcgctccacattcacgcttcctactccatctctcaaaagctgaatgtgcctatggctccgctcagtgagccgaacgccgtggggatcgtgatcgcgcacggctcagtgggagacgctatctccgtgatggtgccagacgtgtacatctcggacgatggcggttactcgtggaccaaaatgctggagggaccgcactactacactatcctggactccggagggatcatcgtggccatcgaacattcgagccggccgatcaatgtgattaagttctccaccgacgagggacagtgctggcagacctacaccttcaccagagatccgatctactttaccggactcgccagtgaaccaggcgcgcggtccatgaatatcagcatctggggattcactgagagcttcctgacttcacagtgggtgtcgtacaccattgacttcaaagatatcttggagagaaattgcgaagagaaggattacaccatttggctggcgcacagcaccgatcccgaagattacgaagatggctgcatcctgggatacaaggagcagttcctccgcctgcggaagtcctcggtctgtcaaaatggccgggactacgtggtgactaaacagccaagcatctgcctttgctcgctggaagatttcctgtgcgactttggatactaccgcccggagaacgacagcaagtgcgtcgagcaaccggaactcaagggacatgatctcgagttctgcttgtacggacgcgaggagcatcttactactaacggataccgcaagattccaggggacaagtgtcagggaggagtgaacccggtgagagaggtgaaagacctgaaaaagaagtgtactagcaattttctgtcgccagagaagcagaactcaaagtccaactcagtgccgatcatcctcgccatcgtcggacttatgctggtcactgtcgtggcaggcgtgctgatcgtgaagaaatatgtttgcggcggccgctttctggtccaccgctactcggtgctgcagcaacacgcagaagccaatggagtggacggagtcgatgccctggataccgcctctcacaccaataagtcgggttaccatgatgactccgatgaggacctgctggag

SEQ ID NO: 19614 - DNA, 2082 bp, Artificial Sequence
  Description of Artificial Sequence: Synthetic coding sequence
atgacttttggacagtcgaaactctaccgtagcgaggactatgggaagaactttaaagatatcaccgatttaattaacaacactttcattcgtactgagttcgggatggccattggacccgaaaactccgggaaggtggtgctcacagccgaggttagtgggggcagtcgaggtggtcgcatctttcgttcctcggactttgccaagaatttcgttcagactgatctccctttccaccccctaacacagatgatgtattcacctcagaactcagactacctgttggcgctgagcaccgaaaacggtctctgggtctctaaaaatttcggagggaaatgggaagaaattcataaggcggtttgtctggcaaaatggggctctgacaacactatcttcttcactacatacgccaatggaagctgtaccgatctgggagccttagaattatggagaacctcagatttaggcaagtctttcaagacgattggggttaagatctactcattcgggctcgggggccgcttcctgttcgcttccgtcatggctgataaggacactacgcggagaatccacgttagcaccgaccagggcgacacctggtctatggctcagttgccgtctgtaggccaagagcaattctattctatacttgccgcaaacgacgacatggtgtttatgcatgtggatgagccgggggacactggtttcggaaccattttcacgagcgacgatagggggatcgtgtattctaaaagtttggacagacacttgtatactacaaccggtggtgagactgactttacaaatgtgacatctctcagaggagtttatattacttccgtgctctcagaagacaactctatacagacgatgattacttttgaccagggtggtcgttggacccatctgagaaaacctgagaatagcgaatgtgatgccaccgccaaaaacaaaaacgaatgctctctgcacattcacgcgagctattcaatctcccagaagctgaatgtgcccatggctcctctttcggagcctaatgccgtaggtatcgtgattgctcatggtagcgttggagatgcgatatcagttatggtccccgatgtgtatatcagcgacgatggaggctattcctggacgaagatgttggagggcccacactattataccattctggattcaggcggtattatagtggcgatcgagcactcttcacgccccattaacgtaatcaagttcagtaccgatgaaggccaatgttggcagacatacacctttaccagggaccccatctattttaccggccttgcatctgaacccggcgctagatccatgaacatctcaatctggggttttacagagtcatttctgacttcacagtgggtgtcgtatacaatcgatttcaaggatatccttgagcgaaattgcgaggagaaggactatactatttggctggctcacagtaccgacccggaagactatgaggatggatgtatcctgggctataaggagcagtttcttcgcctcagaaaaagttccgtttgccagaatggcagagactacgttgttacgaaacagcccagtatctgcttgtgcagcctggaggacttcctctgcgatttcgggtactataggcccgaaaatgactccaagtgtgtggaacaacccgagctaaaaggccacgacctcgagttctgcctgtatggtcgggaagagcacctcacaaccaatggctatagaaaaatccccggggacaagtgtcagggtggcgtgaatcccgtgcgggaggtaaaggacctcaagaagaagtgcacgagtaactttctaagtcctgagaagcaaaattccaagtctaacagcgttcccataatcctcgctattgtggggctgatgctggtgacagtcgtggcgggtgtcctcatagtgaaaaagtacgtctgtggcggacgctttcttgtgcataggtattcggtcctccagcagcacgcagaggcaaatggcgtggatggcgttgacgcgctagacacagcatcacacacgaataagagtggataccacgatgatagtgatgaagatctcttggaa

SEQ ID NO: 19615 - DNA, 2082 bp, Artificial Sequence
  Description of Artificial Sequence: Synthetic coding sequence
atgacctttggacagtcgaaactttatagatcggaagattatggaaaaaacttcaaagacatcactgacctcattaacaacaccttcatccgcactgagttcggaatggccatcggaccagagaattcaggaaaggtcgtactgactgcggaagtgtctggcggatcaagagggggacgcatcttcaggtcgtccgatttcgctaagaacttcgttcagactgatctgccgttccatcctcttacgcagatgatgtactcaccgcagaactcggattaccttctggccctgtccaccgaaaacgggttgtgggtgtctaaaaacttcggaggcaagtgggaagaaattcacaaggccgtgtgcctcgcgaagtggggctccgataacaccattttctttaccacttacgcaaacggatcctgcactgacctgggggccctggagctgtggcggacttcggatctggggaagtcgttcaaaacgatcggcgtgaagatttacagctttggactgggcgggcgcttcctgttcgctagcgtcatggcagacaaggataccaccaggcgcatccatgtatcaactgaccagggggacacgtggtcaatggcgcaacttccgtcggtgggacaagaacagttctattcgattctcgcagcaaacgacgatatggtgtttatgcacgtggacgaacctggcgatacgggcttcggcaccatcttcacctcagacgaccgaggaatcgtgtactccaagtccctggatcgtcacctttacactactaccggtggtgaaactgactttaccaatgtgacgtccctccgcggagtgtacatcaccagtgtcctgtctgaggataattcgatccagaccatgatcacctttgatcagggaggtcgctggacccacctgagaaagccggaaaactcagaatgtgacgctaccgccaagaataagaacgaatgctcgttgcacatccacgcgtcttacagtatctcccagaaactcaacgtcccaatggcaccactcagcgaacctaacgccgtgggaatcgtgatagctcatggctcagtgggcgacgccatctcagtgatggtccccgatgtctacatcagcgacgatggtggttatagttggactaagatgcttgagggaccgcattactacactattctggactccggcggaatcatcgtggcgatcgaacactcttcccgaccgatcaatgtgataaagttctccaccgacgaaggccagtgctggcaaacctacactttcactagggacccgatttactttactggtttggcctctgagccaggagcaagatcgatgaatatctcgatctggggattcactgaatccttcctgacctcgcagtgggtgagctacactatcgatttcaaggacatcttggaacggaactgcgaagagaaggattacactatctggctggcgcactccacggacccggaggattacgaagatggctgcattctggggtacaaggaacaattcctgagactccgcaaatccagcgtctgccaaaatgggcgggactacgtggtcaccaagcagccaagcatctgtctctgcagcctcgaggactttttgtgcgacttcggatactaccgccccgagaacgactcaaagtgcgtcgaacaaccagaactgaagggacatgacttggagttctgcttgtacggaagagaagagcacctcaccaccaacggataccggaagatcccgggcgacaaatgccagggaggagtgaacccggtgcgcgaggtgaaggacctgaaaaagaaatgtaccagcaacttcctctcacccgagaaacaaaattccaaatcgaattcggtccctatcatcttggctatcgtcggtctgatgctggttaccgtggtggccggggtgctgatcgtaaagaagtacgtgtgtggaggccggtttctcgtccatagatacagcgtgttgcaacagcacgccgaggcgaatggggttgatggtgtggacgccctcgatactgcaagccataccaataagtcagggtaccacgatgactcggacgaggaccttctggaa

SEQ ID NO: 19616 - DNA, 2082 bp, Artificial Sequence
  Description of Artificial Sequence: Synthetic coding sequence
atgacttttggacaatcaaagctctacaggtctgaagactacgggaaaaatttcaaagatatcaccgacctgattaacaatacatttataaggaccgagttcggcatggccatcggccccgagaattctggtaaggtggttcttacagcggaagtgtctggtggttcgcgtggaggacggatttttcggtcctcagacttcgctaaaaacttcgtacagaccgacttacctttccatccacttacacagatgatgtacagcccccagaattccgactacctgctagccctcagtacagagaatggcctgtgggtgtccaagaacttcgggggtaagtgggaagagatacataaggccgtttgtttagccaagtggggatccgataacacgatcttttttacaacatacgcaaacggatcttgcaccgacttaggcgcccttgagctctggcggacatccgacttgggtaagagcttcaaaaccattggtgtcaaaatttactcttttggactaggaggccggttcctgttcgctagcgtgatggccgacaaagatacgacgagacgtatccacgtgagcaccgatcaaggggacacatggtcgatggcacaactgcccagcgttggccaagagcaattttacagcatcctggccgctaacgacgatatggtcttcatgcacgtggacgagcctggtgacaccggatttggaaccatattcacttccgacgacagagggatcgtttactccaagagcctagatagacacctatacacgaccactggcggtgaaaccgattttactaatgtgacaagcctcagaggtgtgtacatcacttccgttttgtctgaagacaactcgatccagacaatgataacatttgatcaggggggccgctggacccatcttcgaaagccggagaattctgagtgcgatgctactgcaaagaataagaatgagtgctccctccatatccatgcaagctactctattagtcagaagctgaacgttcctatggcccctctgtctgagccgaacgccgtggggatcgtcattgcccacggttctgtcggtgacgccatatcagtcatggtcccagacgtatatatcagtgatgatggcggatatagctggacaaagatgctggaggggccgcattattacaccatcctggactctggggggataatcgtggcaattgaacactccagccgcccgattaatgttataaagttcagtaccgacgagggccagtgctggcagacctacaccttcacccgcgatcctatttactttactgggttggcatcagagccaggggcacgttctatgaacataagcatatgggggttcacggaatcctttcttacttctcagtgggtcagctacaccattgactttaaggatattctagaaagaaattgcgaagagaaagattacacaatctggttggcacactccaccgatcccgaggattacgaagatgggtgcatactggggtataaggagcagtttcttcggcttcgaaagagctctgtgtgccagaatggccgcgactacgttgtaaccaagcagcccagcatttgcctgtgcagtctagaggattttctctgtgacttcgggtattaccggcctgagaacgactcaaagtgtgtcgaacaacccgaactgaaaggccacgatctggaattttgcctttatggccgtgaggaacacctgaccacgaatgggtacagaaaaatccctggagataaatgccaagggggggtaaatccggtccgagaggtcaaggatctgaagaagaaatgcaccagcaactttttgagtcctgagaaacagaactccaaaagcaactcggttcctattattcttgcaatcgtcgggctcatgctggtgaccgtagttgcaggggtgttgattgtgaagaagtacgtatgtggggggcgctttttagtacacagatactctgtactacagcagcacgctgaggccaacggcgttgacggagtggacgccctggataccgcctcccatactaacaagagtggctaccatgacgactcagatgaggatctgcttgaa

SEQ ID NO: 19617 - DNA, 2082 bp, Artificial Sequence
  Description of Artificial Sequence: Synthetic coding sequence
atgacgtttggccagtcgaaattgtacagaagcgaagattacggcaaaaatttcaaagatatcactgatttaatcaataatacttttattagaaccgagtttgggatggcaattgggccggaaaatagtggcaaggttgtgttgacagcggaagtctctggagggtctaggggaggaaggatcttcagaagctctgatttcgcaaagaattttgtacagacggacttaccctttcacccgctcacacaaatgatgtacagtccccaaaattccgactatctcctggcactcagcacggagaacggcctctgggtcagtaaaaatttcgggggcaaatgggaggagatccacaaggcagtgtgtctcgccaaatgggggtccgacaacacaatttttttcaccacctacgcaaacgggtcttgtaccgacttgggcgctctggagctctggcggactagcgatcttggaaagagctttaagacaatcggcgtcaaaatctattccttcggtctggggggccggttcctgttcgcttcagtgatggctgacaaggacacgacccgccgcattcacgtcagcacggatcagggagatacctggtccatggcccagctaccttctgtcggccaagagcagttctactctatcctggccgcgaacgacgacatggtcttcatgcacgtcgacgagcccggtgacactggctttggcacaatattcacaagcgacgatcggggaattgtgtattccaagagcctcgacagacatctatacactacgaccggaggagagaccgattttacaaatgttacatctctacgtggagtctatatcacgagtgtgttgagtgaggataattcaattcagaccatgatcacctttgatcagggtggaagatggacccatctgcgcaaaccggagaacagcgagtgtgacgcaacagctaaaaacaagaacgaatgtagtctccacatacatgctagttacagtatcagtcagaaattgaacgtgcctatggcccccctgagcgaaccaaatgcagtgggcatcgtgattgcgcacggaagtgttggagacgctatttcagtgatggttcctgacgtctacatctctgatgatgggggctactcttggacgaagatgctggaaggcccgcattactacacaattctggactctggtggtatcatcgtggctatagagcattcttctcggcccattaacgtcattaaatttagcaccgatgagggacagtgttggcagacctatactttcacaagggaccctatttactttaccggattggcctctgagccgggagctaggtcaatgaatatcagcatctggggttttacagagtcgtttctgacgtcacaatgggtctcatatacaatcgattttaaagatatcctggaaagaaactgtgaagagaaagattatacaatctggcttgcgcactcgacagaccctgaagattatgaagatgggtgtatactcgggtataaggaacagttcctgcgtctccggaagtcaagtgtgtgtcagaacggaagggactatgtcgtgacgaagcagcctagcatctgcttatgctctttggaagactttctgtgcgacttcggatactatcggccggagaacgattctaagtgtgtagaacagcccgagctgaaggggcacgacctggagttctgcttatatggccgcgaggagcatttaacaacaaatggttaccggaaaatccccggggataagtgccaaggaggagtcaatccagtgcgcgaggtgaaggacctgaaaaaaaagtgtactagcaattttctgtctcccgaaaaacagaacagtaaaagcaactccgtacccattatccttgcgattgtggggttaatgctcgtaaccgtcgtggccggcgtgctgatcgtcaaaaaatatgtatgcggcggccggtttctagtgcatcggtactcagttttacagcagcacgccgaggcaaatggcgttgacggagtcgatgcactggatacagcctctcacaccaataaatccgggtatcatgacgactctgacgaagatctgctggag

SEQ ID NO: 19618 - DNA, 2082 bp, Artificial Sequence
  Description of Artificial Sequence: Synthetic coding sequence
atgaccttcggacagtcgaagctgtaccgctccgaggactatggaaaaaacttcaaggatatcaccgacctgatcaacaatactttcatccgcactgaatttggtatggccattggcccggaaaactctggtaaggtggtgctcaccgccgaagtctcgggcggctcgcgcggaggaaggatcttcaggagctcggacttcgccaagaacttcgtgcagactgacctgccgttccacccactcactcagatgatgtactcgccgcaaaattcggattatctgctggcgttgtcaaccgaaaacggactgtgggtgagcaagaactttggcggtaagtgggaggaaatccacaaggctgtgtgtttggccaagtggggaagcgataacaccatcttctttaccacttacgcaaacggaagctgcactgacctcggagctctggaactgtggcgcacttcggacctcggcaagtccttcaaaaccattggagtgaagatttacagctttggtctgggtggacggttcctctttgcctcggtgatggccgacaaagataccacccggcgcatccacgtctcaaccgaccagggggatacgtggtctatggctcaactgccctctgtggggcaggagcaattctactctatcctggcagcgaatgacgatatggtctttatgcatgtggatgaacctggtgacactggattcggaactattttcacttcagacgacagagggatcgtgtactcgaaaagcctggatcgccacttgtatactactactgggggcgaaactgactttaccaacgtcacctcgttgcgcggagtgtacatcacgtccgtgctgtcggaggacaactccatccagacgatgatcacgttcgatcagggtggccgctggactcatcttcggaagcccgagaactccgagtgcgacgccactgctaagaacaaaaacgaatgttccttgcatatccacgcctcgtattcaatcagccagaagttgaatgtgcctatggcaccgctttcagaaccgaacgctgttggcatcgtgatcgcccacggctctgtcggggatgcaatctccgttatggtgccagatgtgtacatcagcgatgatggaggttactcttggaccaaaatgctggagggaccacattactacactatcctggacagcgggggcatcattgtcgcaatcgaacactcgtcgcggcctatcaacgttatcaagttctctacggacgaaggtcaatgttggcagacctacaccttcacgcgcgacccaatttacttcaccggactggcaagcgaacctggagcaagatcaatgaacatctcgatctggggcttcaccgaatcgtttctgacctcccagtgggtcagctacactatcgatttcaaagatatcttggagagaaactgtgaggaaaaagactacaccatctggttggcccattcgactgatccggaggactacgaggacggatgtatcctgggatataaggaacagttcctccgcctgagaaaaagctcagtgtgccaaaacggaagagactacgtcgttaccaagcaaccgagcatctgcttgtgctcgctcgaggacttcctctgcgactttggatactaccgacccgagaatgattccaagtgcgtcgagcagccggaactgaagggccatgacctggaattctgcctgtacggtcgtgaggaacatctgacgaccaacggatacaggaagatcccaggagataagtgccaaggaggcgtgaacccggtccgcgaggtgaaggacctgaaaaagaagtgtacttcgaatttcctcagcccagaaaagcaaaactcgaaatcgaactcggttccaatcatcctggctatcgtgggcctgatgcttgtgaccgtggtcgccggggtgctgattgtgaagaagtacgtgtgcggcggacgctttttggtgcacaggtactccgtccttcagcagcacgccgaggcgaatggggtagatggagtcgacgctctcgacaccgcaagccacaccaacaaaagcgggtaccacgacgactccgacgaggacctcctggaa

SEQ ID NO: 19619 - DNA, 2082 bp, Artificial Sequence
  Description of Artificial Sequence: Synthetic coding sequence
atgacctttggccaatccaagttgtaccgcagtgaagattatggcaagaatttcaaggacatcacagacctcataaacaacaccttcatacggaccgagtttggcatggccatcgggcctgagaactccgggaaagtggtgctcaccgcagaggttagcggaggcagtcgaggaggacgcatcttcaggtcctccgatttcgccaaaaactttgtccaaacggacctcccttttcacccactgacgcagatgatgtacagtccgcaaaactcagattacttgctcgccctttccacagagaatggcctatgggtctccaagaatttcggcgggaaatgggaagaaatccataaggctgtttgcctggctaagtggggtagtgataacacaatcttctttactacatatgccaatggtagctgtaccgacctaggcgcactggaactttggaggacaagtgatctgggaaaatcgttcaagactattggagtcaagatctattcattcggcctgggcggccgtttcctgttcgcatcagtcatggcggataaggatacaactagacggatacacgtcagtactgaccagggtgacacctggagcatggctcagttaccatcagtcggccaggaacagttctactcgattctcgctgcaaacgacgacatggtctttatgcatgtcgatgaaccaggtgacaccggattcggcaccatttttacctctgatgaccgcggtattgtttactccaagtcacttgaccgacacctttacactacgactggtggagagacagacttcaccaacgtaacctcactacgcggagtttacatcacatccgtgctatctgaggacaattccatccagacgatgattacttttgatcaaggtggcagatggactcatctgcgtaagccagagaactctgagtgtgatgccaccgcaaagaataagaatgagtgctcactccatatccatgctagctatagcatctcccagaaactcaatgttcctatggccccattatccgagcccaatgctgtcgggatagtcattgcacacggctcagtgggcgatgcaataagcgtcatggtgcccgatgtctatatctcagatgacggcggatacagctggaccaagatgttagagggacctcactattatacaattctcgatagcggtggaatcatcgtggccatcgaacacagtagtcggccaatcaatgtcatcaaattcagtacagatgaaggccagtgctggcagacctatacattcaccagggatccgatatacttcacaggtctggcgtctgagccaggcgcaaggtcaatgaatatcagcatttgggggttcaccgagtcatttttgacttcacaatgggtcagctatacaattgattttaaagatattctcgaaaggaattgcgaagaaaaggattacactatttggctggcccactctaccgaccccgaggactacgaggatggttgtattctcggttataaagaacagtttctcagattaaggaagtcttctgtgtgtcagaatggccgcgactacgtcgtcacaaaacagccttctatttgcctctgctccttagaggatttcctttgcgatttcggctactacaggcctgaaaatgatagtaagtgtgttgagcagcctgaactaaaggggcacgacctggagttttgcttatacgggagggaggagcaccttaccacaaacggctaccggaagatccctggcgacaaatgccaggggggagtgaaccccgtgagggaggtgaaagatcttaagaagaagtgtacaagtaacttcctctctccagagaaacagaattcaaagagtaactccgtccccattatcctggccatcgtagggctgatgttggttaccgtagttgctggagtgctgattgttaagaagtatgtgtgcggggggagattcctggtgcatagatacagcgtacttcagcagcatgccgaggccaacggggtggatggcgtggatgctcttgatacagcgagccacacgaacaagtctggataccatgacgacagtgatgaggatctccttgaa

SEQ ID NO: 19620 - DNA, 2082 bp, Artificial Sequence
  Description of Artificial Sequence: Synthetic coding sequence
atgactttcggacaatcgaaactttatagaagcgaggattacggcaagaactttaaggacatcaccgatctgatcaataacaccttcatccgcaccgaattcggaatggcaatcggaccggaaaactccggcaaagttgtgctgaccgccgaagtgtccgggggtagccggggcggaaggatttttcgctcgtcagacttcgccaagaattttgtccagactgatctcccttttcatccactgactcaaatgatgtactccccgcaaaacagcgactacctgctcgcactgtccactgagaatggcctgtgggtgtccaagaatttcggaggaaagtgggaagagatccataaggccgtgtgcctggcaaagtggggctcggacaatacgattttcttcaccacctacgcgaacggatcatgcaccgacttgggcgccctggaactgtggcgcacctctgacctggggaagagctttaagactatcggggttaagatatactctttcggcctgggagggcgattcctcttcgcttccgtgatggcggataaggacactactcggcggatccatgtcagcactgaccaaggggatacttggtcaatggcacagctcccgtccgtcggccaagagcaattctactcgatcctggcagcgaacgatgatatggtgttcatgcacgtggatgagcctggggataccggattcggtacgatctttacctcggatgaccggggcatagtgtactccaagtccctcgaccgtcacctgtacaccactacgggaggagaaaccgatttcaccaacgtgaccagcctccgcggagtgtacatcacgagcgtcctcagcgaggataactccatccaaaccatgattactttcgaccagggcgggcgctggactcatttgagaaagcctgagaactctgaatgtgacgcgactgccaagaacaagaatgaatgttccctgcacatccatgcttcctactcaatcagtcagaagctgaacgtgccgatggcgccgctgagcgagccgaacgcagttggtatcgtcattgctcacggctcggtcggagacgcaattagcgtcatggtcccagacgtctacatctcagacgacgggggatactcatggaccaagatgttggaaggaccgcattactacactatcctggactccggaggcatcattgtggctatcgaacacagctccagacccatcaacgtcatcaagttctcaactgatgaaggccagtgttggcagacctacactttcacccgggacccgatctatttcaccggactggcctcggagccgggggcacggtcgatgaatatctcaatctgggggttcactgagtcattcctgactagccaatgggtgtcgtacactatcgatttcaaagacatcctcgagcggaactgtgaagaaaaggattacactatctggctggcccacagcaccgatccagaggactacgaggacggctgcattctgggttacaaggaacagtttttgcgcttgcgcaagagttccgtctgccagaacggaagagactacgtggtcactaagcagccctcgatttgcctttgctcgcttgaagatttcttgtgtgatttcgggtactaccgccctgaaaacgactctaagtgcgtcgagcagccagaactgaagggacacgacttggagttctgtctgtatggacgagaggaacacctgactaccaatggataccgcaagatcccgggagacaaatgccagggaggtgtgaacccagtgcgcgaagtgaaagatctgaaaaagaagtgtacctcgaacttcctgtcaccggagaagcagaattcaaaatccaattcagtgccaatcatactggctatcgtcggtctgatgctggtgactgtcgtggcaggggtcctcatcgtgaaaaagtacgtgtgcggtggacgtttcctcgtgcaccggtactcagtcctgcagcagcatgcagaggccaatggcgtcgatggcgttgatgccctcgacaccgcgtcacataccaacaaatccgggtaccacgacgacagcgacgaggacctgctcgag

SEQ ID NO: 19621 - DNA, 2082 bp, Artificial Sequence
  Description of Artificial Sequence: Synthetic coding sequence
atgaccttcggccaatccaagctgtacaggtccgaagattacggtaagaatttcaaggacatcacggacctgatcaacaataccttcatcagaactgagtttggcatggctatcggcccggagaactcaggaaaggtggtgctgaccgcggaagtctcgggcggctcccgcggtggacgcatctttcggtcgagcgattttgccaagaactttgtgcagactgatctgcccttccaccctctgacccagatgatgtactccccgcagaattcggattatctcctcgctctgtcgaccgagaatggcctctgggtgtcaaagaacttcggaggaaagtgggaggaaatccataaggcggtgtgtctcgccaagtggggtagcgataacactatcttcttcaccacttacgcaaacggtagctgcaccgatttgggcgcactcgagttgtggcgcaccagcgacctcggcaagtcgttcaaaaccatcggagtgaagatctattcgtttggtcttggtgggaggttcctcttcgcctccgtgatggctgataaggacaccacccggcggatccacgtctccaccgaccagggcgacacttggtcgatggcacaactcccgtcggtgggacaggagcaattctacagcattctcgccgcgaacgatgatatggtctttatgcacgtggatgaaccgggagatactggatttggcacgattttcacttccgatgaccgtgggatcgtgtacagcaaaagccttgaccgccatctctacaccaccactggaggcgagactgatttcactaacgtgacctccctgcgcggcgtgtacatcacctcagtgctctccgaagataatagcatccaaactatgattacctttgaccagggaggccggtggacccaccttcggaaaccagaaaacagtgaatgtgatgccactgcaaagaacaagaatgaatgctccctccatatccatgcgtcgtactccatctcgcaaaaactcaatgtgccgatggcccccctctccgagccgaacgcggtgggaattgtgatcgctcacggatcagtgggggatgccatatccgtcatggtgccagatgtgtacatctccgatgatggagggtactcgtggacgaagatgctcgagggtccgcactattacaccattctggactcgggagggataatcgtcgccatcgaacatagcagccggcctataaacgtgatcaagttctcgaccgacgagggacagtgctggcagacctatacgttcactcgcgaccctatttacttcaccggactggcctcggaacctggagcgaggtcaatgaatatctcgatttgggggttcactgaatcctttctcacctcgcagtgggtgtcctatacgatcgacttcaaagatatcctcgagcgcaattgcgaggaaaaggattacaccatctggctcgcacacagtaccgaccctgaggactacgaggacggatgcatcttgggttacaaggaacagttcttgagactgcgcaaaagcagcgtctgccaaaacggaagagactacgtggtcactaagcagccgtcaatctgcctgtgttccctggaagatttcctttgcgatttcggatactacagacctgagaacgattccaagtgcgtcgagcagccagagttgaagggacacgacctcgaattctgcctgtacggtcgcgaagagcacctcaccactaacggttaccgcaagatcccgggtgacaagtgtcaggggggcgtcaaccccgtgagagaagtcaaggacctgaaaaagaagtgcaccagcaacttcctttcacctgaaaagcagaactcgaaaagcaactctgtgccgattatcctggcgatcgtgggcctcatgttggtgaccgtggtggctggagtgctgatcgtcaaaaagtacgtgtgcggcggaagattccttgttcaccggtactccgtgctgcaacagcacgctgaagcaaacggagtggacggagtggatgccctcgataccgcttcacacaccaataagagcggataccatgacgactccgacgaagatctgttggaa

SEQ ID NO: 19622 - DNA, 2082 bp, Artificial Sequence
  Description of Artificial Sequence: Synthetic coding sequence
atgacttttggacagtccaagctgtacagatcggaggactacggaaagaatttcaaagatattactgacctgatcaataacaccttcatccgcactgaatttggcatggcgatcggacccgaaaattcgggcaaggtggtgttgaccgccgaggtcagcggaggaagtcgcggcggacggatcttccgcagctcagacttcgcgaaaaactttgtgcagactgacctgccgttccacccactcacgcaaatgatgtactcgccccagaattcagactacttgctggcactctcaactgaaaacggactttgggtgtcaaagaacttcggaggaaagtgggaggaaatccataaagccgtgtgcctcgcgaaatggggatcggacaatactatcttctttaccacctacgctaacggctcatgcaccgaccttggagcccttgaactgtggcgcacttcagacttgggaaagtcgttcaaaactataggagtgaagatttactcctttggactggggggacggttcctgtttgcttccgtcatggccgacaaggataccaccaggcgcatccacgtctcaaccgaccagggcgacacctggagcatggcgcaactcccgtcggtgggacaagagcagttttacagcatcctggccgcaaacgacgatatggtgtttatgcatgtggatgagcctggagacaccggtttcggcactatcttcacgtcggatgatcggggaatcgtgtactcaaagagtttggaccggcatctgtacacgaccactggcggggagactgatttcacgaatgtgactagcctgcgcggtgtctacattactagcgtgctgtcggaagataactccattcagacgatgatcactttcgaccaaggaggaaggtggacccatctgcggaaacctgaaaactccgaatgcgatgcaaccgctaagaacaagaatgaatgctccctccacatccacgcgagctactcgatcagccaaaagctgaacgtcccgatggcgccgctgtccgagccgaacgccgtcggaatcgtgattgcgcacggctcggtcggagacgcaatttccgtcatggtgccagacgtgtacatctccgatgacggcggatactcgtggacgaaaatgctggagggtccacattactacaccattctcgatagcggggggataatcgtggccatcgaacattcatccaggccgatcaacgtgatcaagttctcgactgacgaagggcagtgctggcagacttacactttcacccgcgatccgatctactttactggactggcgtccgagccaggagcgagatcgatgaatatctcgatttggggtttcaccgaatcattcctgacctcccagtgggtgagctacaccattgacttcaaggatatcctcgaacgcaactgtgaggaaaaagactacaccatttggctcgcccactcaactgatccagaagattacgaggacggatgcattcttggatacaaggaacaattcctccgccttcggaagtccagcgtctgccagaacgggagggattacgtggtgactaagcaaccgtccatctgtctctgctcccttgaggatttcctctgcgactttggctactacagaccggaaaacgactcaaaatgtgtggaacaaccagaactgaagggccacgacctggagttttgcctgtacggacgggaagaacacctgaccaccaacggctaccgcaagatcccaggcgacaaatgtcagggcggggttaaccctgtgagagaggtcaaagacctcaaaaagaagtgcaccagcaatttcctctcgcccgagaaacagaatagcaaatccaattcagtcccgattatcctggcgatcgtgggcctgatgctggtcactgtggtggctggcgtgctgatcgtgaaaaagtacgtctgtggcggaagattcctggtgcatcgctactcagtcttgcaacaacatgcggaggccaacggcgtggatggcgtcgacgcgttggacacggcatcccataccaacaagtcgggctaccacgacgactcagatgaggacttgctggag

SEQ ID NO: 19623 - DNA, 2082 bp, Artificial Sequence
  Description of Artificial Sequence: Synthetic coding sequence
atgaccttcggtcagtccaaattatatagatctgaagactatggcaagaacttcaaggatattactgaccttattaataacacttttatcaggactgagttcggcatggctatcggtcccgagaatagtggcaaggtcgttttgacggcggaggtgtcaggcgggtcgaggggaggacggattttccggagcagtgatttcgctaaaaattttgtccaaactgatctgcccttccacccactaacgcagatgatgtactcaccccaaaattccgattacttattggccttgtcaacagaaaacggcctctgggtatccaaaaatttcggcggtaagtgggaggagattcataaggctgtatgcctggcgaagtggggctccgataacaccattttcttcacaacctacgccaacggctcatgtactgatctgggagctctggaactctggagaacatctgatcttggtaaatcttttaagactattggtgtcaaaatttattcttttgggctcggcggccggtttttgtttgcttccgttatggccgataaagataccacccgccggatacacgtaagtaccgaccagggggatacgtggagtatggcgcagctgccaagtgttggtcaggaacaattctactcaatcctggctgcgaacgacgacatggtgtttatgcacgtcgatgagcctggggacacgggtttcggcactatctttactagcgatgatcgcgggattgtatactccaaatccttggacaggcacctttacacaacaactggcggagaaactgatttcactaatgttactagcttgcggggggtatatataaccagcgtcctgtctgaggataattccatacagaccatgatcacgttcgaccaaggaggaagatggactcatctgaggaagccggagaattctgaatgcgacgcgacggctaagaacaagaacgagtgctccctgcatattcacgcatcttacagtatctcacagaagttgaacgtgccaatggcccctctgtcagaacctaacgcagtggggatcgtcattgcccatggttctgtcggggatgccattagcgtcatggtccctgacgtgtatataagcgatgatggagggtattcatggacgaagatgctggaaggacctcactactataccattctggactcaggtgggatcatcgtggctattgagcactcatctcgccccattaatgtcatcaagttctcgaccgacgaaggccagtgctggcagacatacaccttcacacgcgatcccatctatttcaccggccttgcctctgaacctggtgccaggtctatgaatatatccatctggggctttaccgagagtttcctcacatcgcaatgggtgtcttatacaatagactttaaggatatactggaacgcaattgtgaagaaaaagactacactatatggttggcgcactccactgaccctgaggactacgaggatggatgtatccttggatacaaggagcagttcctgagactccgcaagagctccgtgtgccagaacgggagagactatgtcgtgactaaacagccctctatatgcttgtgctctctggaggatttcctttgtgattttggttattacaggccagaaaacgattcaaagtgtgttgaacaacctgaactcaagggtcatgatctagaattctgcttgtatggaagagaagagcatttgacaacgaatggctaccggaaaataccaggtgataagtgtcaaggcggagttaatccagtacgagaagttaaagatctcaaaaagaagtgtacgtcaaatttcctgagcccggagaagcagaactcgaaatcaaattcagttcccataattcttgctatcgtcggcttaatgttagttactgtcgtggcgggcgttctgattgtgaaaaagtatgtgtgtggaggaagatttctcgtgcatcggtatagcgtgctacagcagcacgcagaggctaatggcgtcgacggagtggacgctctagacactgcgagtcataccaacaaatccggataccatgatgatagcgacgaggacctgttggag

SEQ ID NO: 19624 - DNA, 2082 bp, Artificial Sequence
  Description of Artificial Sequence: Synthetic coding sequence
atgacttttggccagagcaaattgtatcgatccgaggattacggcaagaactttaaggacatcacggatcttattaacaacactttcattagaactgaattcgggatggcgataggtccagagaactctggtaaggtggtactcaccgccgaggtcagcggagggagccgcggaggcaggatcttccgctcgagtgacttcgcaaagaattttgtgcagactgacctcccctttcaccctcttacgcagatgatgtacagtccccaaaactctgattacctgttggccctgtccacagaaaacggtttatgggtgagcaagaattttggagggaaatgggaagagatccacaaggcagtctgcctggctaagtggggatccgataataccatcttcttcacgacatatgccaacggctcttgcaccgacctgggagcactagagctctggagaaccagcgacctgggcaagtcctttaagaccattggggtgaagatttactctttcggtttggggggacgatttctcttcgcctccgtcatggcggataaagacaccacccgccgcatccatgtgagcacagatcagggagatacttggagcatggcccagctgccctccgtcgggcaggagcagttttattcgatccttgctgctaacgatgacatggtttttatgcatgttgacgagccgggagatacggggttcggtactatcttcacaagcgacgatcgaggcatcgtgtacagcaagagcctggatagacatttgtatacgacgactggaggagaaacagatttcactaatgtaacatccctgagaggcgtgtatatcaccagtgtgctgtcagaagacaacagcatccagaccatgatcacctttgaccagggcggacgctggactcacctccggaagcccgaaaatagcgagtgtgacgcaacagccaaaaacaagaatgaatgttctctgcatatccatgctagttattccatatcccagaagttgaatgtgccaatggctccgcttagtgagcccaacgcagtgggcattgtgatagctcacggcagcgtaggggacgccatttccgttatggttccggatgtctacatatccgatgacggtgggtactcatggaccaagatgctcgaagggccccactactacacaatactggacagcggcggaataattgtggccatcgaacattcttcaaggcctatcaatgtcatcaagttctctacggacgagggccagtgctggcagacttacacctttacccgtgacccaatctacttcaccggcctggccagcgagcccggggcccgatctatgaatatctctatatggggtttcaccgagagttttctcacctcgcagtgggtctcctacaccatcgacttcaaggacattttagagaggaactgtgaagagaaggattacacaatatggttggcacactctacagatccggaggattacgaggatgggtgcatactgggttacaaagaacagttcctgagactccggaagtcctctgtctgtcaaaatggcagggattatgtagtgaccaagcagccttcaatctgtctgtgttctctggaagactttttgtgcgattttgggtattacagaccggagaacgacagcaaatgtgtggaacagcctgaactaaagggacacgatctcgagttctgcctgtacggcagagaagagcacttgaccaccaatgggtaccgaaagatccccggagataaatgccaagggggcgtaaatccggtccgcgaggttaaggacctgaagaagaagtgcacctctaatttcttgagccccgaaaagcagaattctaagtcaaactccgtgccgataatcttggccattgtcggactgatgttggtcacagttgtcgcaggtgtcttgatcgtgaagaaatacgtctgtggaggacggtttcttgtgcatcgttactcggtgctccagcagcacgcagaggctaatggggtggatggagtggatgcccttgatacagcttcccatacaaataaaagtggctaccatgatgactccgatgaggatctgttggag

SEQ ID NO: 19625 - DNA, 2082 bp, Artificial Sequence
  Description of Artificial Sequence: Synthetic coding sequence
atgacatttggccagagtaagctgtacaggagtgaagactacggtaagaactttaaggatataactgacctcatcaacaatactttcatcagaactgagttcgggatggcgatcgggccagagaactctggcaaggtggtgttgaccgctgaggtgtccgggggcagcaggggcggacgaatctttcgttctagcgattttgccaagaattttgtgcagactgacctgccattccatcccctgacacagatgatgtactccccacagaacagcgactatttacttgcactgtcaaccgagaacggcctgtgggttagtaagaacttcggcgggaaatgggaagagatccacaaggcagtatgcctggccaaatggggttccgataatactatcttttttaccacatatgccaatggttcctgcactgatctgggagcactggaattatggcggactagtgatctgggtaaatcctttaagactatcggagtgaaaatttattcctttggccttggcggtcgtttcctcttcgcatctgtcatggccgacaaagatacaactcggcgcatacacgtttcaactgaccagggggacacctggtcaatggcacagctgcctagcgtggggcaagagcagttttattcgatcctcgctgccaacgatgatatggtatttatgcatgtggatgagcctggcgatactgggtttggcaccatatttaccagcgatgatagaggtattgtgtactccaagtcattggaccgtcacctgtataccaccactggaggggaaaccgactttaccaacgtgacatcgctcagaggggtgtatattacaagcgtactgtctgaggacaactccattcagaccatgatcactttcgaccagggtgggagatggacccatctgagaaagcctgagaacagtgagtgtgatgccaccgcaaaaaataaaaacgaatgttccctgcatatacacgcgtcctattctatctctcagaagttaaacgtgcccatggcaccactgtcggagcctaacgcagtcggaatagttatcgctcacggaagtgttggcgacgcaatcagcgtgatggtacccgacgtctatatttccgacgatggcggctattcttggacaaagatgttggaagggccacactattataccatcctggactctggcgggatcatagtggccattgagcactcttcacgcccaattaatgtgatcaaattcagcactgatgagggccagtgttggcagacatacacatttacacgtgatccaatttacttcaccggattggcttcagagccgggagccaggtcaatgaatatcagtatttgggggttcacggaatctttccttacgtcacagtgggtaagttatactatcgatttcaaagatattctggaacggaactgtgaagagaaggattatactatctggcttgcccacagtacagatccggaggattacgaagatggttgcatcctgggttataaggagcagttcttgcgcctgagaaagagttcggtgtgccagaatggaagagattacgtggtcactaagcagcccagcatatgtctgtgttccctcgaggactttctgtgcgactttggctattaccgccccgagaatgattctaaatgtgtagaacagcccgaattaaagggacatgatctggagttctgtttatacgggagagaggagcacctgacgactaatgggtacaggaaaattcctggggataaatgccagggcggagtgaacccggtccgggaagtcaaagacttaaaaaaaaagtgtacatctaacttcctctcgcccgaaaaacagaacagcaagtcaaattccgtccccattatcctggcaattgtgggtctcatgctggtgaccgtagtggccggtgtccttatcgtgaagaagtatgtctgcggggggcgatttttagtacatcggtattccgttttgcagcagcacgccgaggcaaatggcgtcgacggcgtggacgctcttgataccgcctcccatacgaacaaaagtggataccacgacgacagcgacgaagatctgttagaa

SEQ ID NO: 19626 - DNA, 2082 bp, Artificial Sequence
  Description of Artificial Sequence: Synthetic coding sequence
atgaccttcggacagtcgaaactctacagatcagaggactatggcaaaaacttcaaggatataaccgatctgattaacaatactttcatccggaccgagttcggaatggccattggaccggagaactccggaaaggtcgtgctgactgccgaagtctcgggaggcagcagaggcgggcgcatcttcagatcgtccgacttcgctaagaatttcgtgcagaccgatctcccttttcacccactcacccaaatgatgtactcgccgcaaaacagcgactacctcctggcactgagcactgagaacggactgtgggtgagcaagaatttcgggggaaagtgggaagaaattcacaaagcggtgtgcctggcgaagtggggctccgacaatactatcttctttacgacctacgcgaacggatcgtgtaccgacctgggggcgctcgaactgtggcgcacctcggatcttggcaagagcttcaagaccatcggcgtgaaaatctactcgtttggacttggaggcagattcttgtttgcctctgtgatggctgataaagatactacccgcagaatccacgtctccactgaccagggagatacgtggagcatggcacagctgccgagcgtggggcaggaacagttctactccatcctcgcagctaacgacgatatggtgttcatgcacgtggacgaaccgggagacactggatttggaaccatcttcacttcagatgaccgcggaattgtgtattcaaagtcactggatagacacctctacaccaccaccggcggggaaactgatttcactaatgtgacctcattgcggggggtgtacatcactagcgtcctctcagaagataactcaatccagactatgatcactttcgatcaaggaggacggtggacccacctcagaaaacccgagaacagcgagtgtgacgctaccgcaaagaacaagaacgaatgttcattgcacatccacgcctcatactcgatctcgcagaagctcaacgtgcctatggccccactgtcggaaccaaacgctgtcggcatcgttatcgcacatggaagcgtgggagatgccatctctgtgatggtccccgacgtctacatctccgacgacggaggatacagctggaccaagatgctggaaggaccgcattactacaccattcttgactcaggagggatcattgtggccatcgagcattcgagccggccaataaacgtcattaagttctcaactgatgaggggcagtgctggcaaacttacactttcactcgcgacccgatctacttcactggactcgccagcgaacctggcgcgcgcagcatgaacatctcgatttggggtttcaccgaatcgttcctgaccagccaatgggtgtcgtacacgatcgatttcaaagatattctggagcgcaactgcgaagagaaagactacacgatctggctcgcacactccaccgacccggaagattacgaagatggatgcatcctcgggtacaaagaacaatttcttcggctccgcaagtcgtcagtgtgccagaatggacgcgactacgtcgtgacgaaacagcccagcatctgtctttgctcgctggaggacttcctgtgcgacttcggatactaccgtccggagaatgattcgaagtgtgtggagcaaccggaactgaaaggccatgatttggagttctgcctctacggacgggaggagcacctgacgacgaacggttaccggaaaatcccaggcgacaaatgccaaggtggagtcaacccagtcagagaagtcaaagatctgaagaagaagtgtactagcaacttcctgtccccagagaagcaaaatagcaaatctaactccgtgcccatcatcctggcaatcgtgggtctgatgcttgtcaccgtggtcgccggggtgctgatagtgaagaagtacgtgtgcggaggtcggttccttgtgcatcgatactccgtcctgcaacagcatgcggaagcgaacggcgtggacggcgttgatgccttggataccgcctcacacaccaataagtccgggtaccatgacgactccgatgaagatttgttggaa

SEQ ID NO: 19627 - DNA, 2082 bp, Artificial Sequence
  Description of Artificial Sequence: Synthetic coding sequence
atgacctttgggcagtccaagctataccggtccgaagactatggcaaaaacttcaaggacattaccgatctcattaacaatacctttattcggacggaattcggaatggccatcggacctgaaaattcagggaaagtggtgttgaccgccgaagtgtctggaggctctagaggcgggcgcatcttcaggtcttccgacttcgccaagaacttcgtgcaaacagatctcccctttcaccccctaactcagatgatgtatagccctcagaacagcgattatctactcgcgctctccacagagaatgggttatgggtgtctaaaaattttggggggaaatgggaggagattcacaaggccgtatgtctggcgaaatgggggtctgacaatacaatattcttcacaacctatgccaatggctcttgcacagatctcggggcactcgaactgtggaggacaagtgatcttggcaagagcttcaagacaataggagtcaagatttattcttttgggctgggcgggaggtttctgttcgccagcgttatggctgacaaagatacaacacgccgaatccacgtgtccaccgaccagggcgatacttggagcatggctcagctgccgtctgtgggacaagaacagttttattcaatcctggctgccaatgatgatatggtgtttatgcatgtggacgagccaggcgacacaggtttcgggactatctttacatctgatgatcgcggaattgtgtatagtaagagtctggatagacacctgtatacaactaccggaggcgaaaccgacttcacgaacgtgacgtccttgagaggagtttacataacaagcgtcctgtcggaggacaatagtattcagactatgattacctttgaccagggcggcagatggacccacctccgcaaaccagagaattcagagtgcgatgcaacagccaaaaacaaaaacgagtgcagtctgcacattcacgcgagctactcaattagccagaagttaaatgtgcctatggctcccctgtcagagcctaacgccgtgggcattgttattgcccacgggagtgtgggggatgctatcagtgtaatggtgcccgatgtatatatcagcgacgacggtgggtactcttggacaaaaatgttagaggggccacattactacactattctcgattccggggggataattgttgcgatcgagcactccagcagacccataaacgtgatcaagttcagcaccgatgagggacagtgctggcagacctacactttcactcgggatcccatctattttacaggactcgcaagtgaacccggtgccaggagcatgaatatctccatctgggggtttactgagtcattcctcaccagtcaatgggttagttatactatagactttaaggacatcttggaaagaaactgcgaggagaaagactatacaatctggctcgcccatagtactgatccagaagactatgaggatgggtgcatacttgggtacaaggagcagttccttagactcaggaagagctctgtgtgccagaacggcagggactatgtggtaacaaagcagccgtcaatctgtctatgttccctggaggactttctctgtgactttgggtactataggcccgagaatgattctaagtgcgtggaacagcctgagcttaagggtcatgatctggaattttgcctctatgggcgggaggagcatttaacaacaaatggatatcgcaagatcccgggagataagtgccagggtggcgtgaaccccgtccgcgaggttaaagacctaaagaagaaatgtacctctaactttttgtcccccgagaaacaaaatagtaagtcaaactcagtgcccatcatcctggcaattgtgggattaatgttggtgacggtggtggccggcgtcctgattgtgaagaagtacgtgtgcggcggccgttttctcgtacacaggtatagtgtgctgcagcagcacgccgaagcgaatggtgtggacggcgtcgatgcactggacacagcttcacacaccaacaagagtgggtaccacgatgattcagacgaagacttgctagaa

SEQ ID NO: 19628 - DNA, 2082 bp, Artificial Sequence
  Description of Artificial Sequence: Synthetic coding sequence
atgaccttcggacaatccaagctgtacaggtccgaggactatggaaaaaactttaaagacatcacggatcttatcaacaacacctttatcagaactgaattcggcatggccattggtccagaaaattccggaaaggttgtccttactgccgaagtctcgggaggatcgcgcggcggccggatttttcgctccagcgatttcgcaaagaactttgtgcaaaccgatctgccttttcacccgctgactcaaatgatgtactcccctcagaattcggattacctgctcgcattgtccactgaaaatggattgtgggtgtccaagaactttggcggaaagtgggaagaaatccataaagccgtctgcttggccaaatgggggagcgataacactattttctttactacttacgcaaatggttcgtgtaccgacctgggtgccctcgagctctggagaacttcggatctgggaaagtcgttcaaaaccatcggcgtcaagatttactcatttggacttggaggacgatttctttttgcgtcggtcatggccgataaggatactactagaagaatccatgtgtcaaccgatcaaggtgatacttggtcaatggcacagctgccgtcagttggtcaggagcagttttactcgatcctcgcagccaacgatgatatggtgttcatgcatgtggatgagccaggcgatactggtttcggcaccatctttacttcggatgatagaggaattgtgtattctaaaagccttgataggcatctgtacacgactactggtggcgagactgacttcacgaatgtgacttccctccggggcgtctatatcacttccgttctgtcggaggacaacagcatccaaaccatgattaccttcgaccaaggcggcagatggacgcaccttcgcaaaccggagaactccgaatgcgatgcaactgcaaagaataagaacgagtgtagcctgcatatccacgcctcctactccatttcccagaaactcaacgtgcccatggcgccgctgtcagagcccaacgcagtgggtatcgtgattgcacatggttcggtgggcgatgcaatttcagtgatggtcccagacgtttacatctcagacgatggaggttactcctggaccaagatgcttgaagggccacattactacactatacttgattcgggaggaattatcgtggccattgagcattcgagcagacctatcaacgtgattaagttttccaccgatgaaggccaatgttggcaaacctacactttcacccgcgaccctatttactttactggtctggcatccgaacctggcgcaagatctatgaatatcagcatatgggggttcaccgagagcttccttacctcacaatgggtaagctacactatcgatttcaaggatatactggaacgcaattgtgaggaaaaagactatactatatggctggcacactcaaccgatccagaagattacgaggatggatgcatccttggatacaaagagcagttcctgcgactgcgcaagtcgtccgtctgtcagaatggcagggactacgtggtgaccaagcaaccctccatctgtctttgttccctcgaagattttctctgtgactttgggtactaccgtcctgaaaacgattccaagtgtgtggagcaacccgaactgaagggacatgatcttgaattctgcctgtacggtagagaagaacatctcactactaatggatatcgcaaaatccctggggataagtgccaaggcggcgtgaatcctgtgcgagaagttaaagatcttaagaaaaagtgcaccagcaactttctttcccctgagaagcagaactcaaaaagcaacagcgtgcctatcattctggcaatagtcggactgatgctggtgaccgtcgtggctggagtcttgatagtgaaaaagtacgtgtgtggaggacggtttctcgtgcacagatattccgtgctgcagcagcacgctgaagcaaatggagtcgacggagtggatgcacttgatacggcgtcgcataccaacaagtccggctaccatgatgactccgacgaagatctgcttgaa

SEQ ID NO: 19629 - DNA, 2082 bp, Artificial Sequence
  Description of Artificial Sequence: Synthetic coding sequence
atgacctttggccagtcaaagctttaccgaagcgaggactacggtaagaacttcaaagatattaccgatttgatcaataacactttcatcagaacggagttcggtatggccattgggcctgagaactctggcaaagttgttcttactgccgaagtctctggtggttcgcgaggcggtcggattttccggtcaagcgactttgcgaagaacttcgttcaaactgacctgccgtttcatccccttacacagatgatgtactcccctcaaaactctgattacctgctcgctctctctaccgaaaatgggttatgggtgtccaagaacttcggaggtaaatgggaggagatccacaaggccgtctgcctcgcaaagtggggctcggacaatacaattttctttactacttacgccaatggctcctgcactgatctgggcgctctagagctttggcggacctcagaccttggcaaatcatttaagactataggcgtcaaaatttactcttttggtctaggaggacggttcctgttcgcatcagttatggctgataaggacaccacgagacggatacatgtgtcgaccgaccaaggcgatacttggagtatggcccagttaccctcggtcggccaggagcagttttatagtattctggcagccaacgatgatatggtttttatgcatgttgatgagcccggagacactggcttcggtacgatcttcacgagtgacgatcgggggattgtctattcaaaatccttggaccgacatctctatactacaactggtggtgaaaccgatttcaccaatgttacatcacttcggggtgtatatatcacctccgtcctttcggaagacaactccattcagacgatgatcacatttgaccaagggggccgttggacgcatctacgtaagcctgaaaacagcgaatgcgacgcaaccgccaagaacaagaatgagtgttccctgcacattcatgcgtcctactcaatatcacaaaaactcaatgtgccaatggccccgctaagtgagcctaatgccgtagggatagtcatagcccacggatccgtcggggatgcgatttctgtaatggtcccggatgtttatatctccgacgacggaggttactcctggacaaagatgctagaagggccacattactatacgatcttagattctggcgggattatcgtggcgatagaacactcctcgcgtcctattaatgttataaagttttcgaccgacgaaggacaatgttggcagacttatacctttacaagagaccctatctatttcacgggtctggcttctgagcccggtgcacgcagcatgaatatcagtatttgggggttcactgagagtttcttgacaagccaatgggtttcgtacaccatagatttcaaagacatccttgaacgcaattgtgaagagaaagattataccatctggttggctcatagtacagaccctgaggattacgaagatgggtgtatactcggttacaaggagcaatttttgcgattgcgtaagtcctctgtgtgtcagaacggacgcgactatgtggtaaccaagcaaccgagcatatgcctttgttctttggaagacttcttgtgtgattttggttattatcgccccgaaaacgactcaaaatgcgtggagcagcctgagttgaagggacacgacttagaattctgcctttatggacgtgaagaacacttgacaacaaacggctaccgaaagatccccggcgacaagtgccaaggcggagtcaacccagtgcgcgaggtgaaggatttgaagaaaaagtgcacctcgaacttcctctctcccgaaaagcagaactcgaaatcgaactccgtacccattatcctggccatcgttggcctcatgctggtcactgtcgttgcaggtgtactgattgtgaagaagtacgtctgcggcggccgctttctcgtccatcgctacagcgtgctccagcagcatgctgaggcgaacggtgttgacggtgtcgatgccctggacactgcctctcataccaacaagagcggataccatgacgacagtgacgaggacctgttagag

SEQ ID NO: 19630 - DNA, 2082 bp, Artificial Sequence
  Description of Artificial Sequence: Synthetic coding sequence
atgacattcggtcagtcaaaactgtatcgatctgaagattatggcaaaaattttaaggacatcactgacctgataaacaacacttttatcaggacagaattcgggatggccatcgggccagaaaattcgggcaaagtggtcttaaccgcagaggtgtccggaggttcaagaggcgggcgcatatttagaagctccgactttgcaaaaaatttcgtgcaaactgatctgccctttcaccccctgacccagatgatgtactccccccagaattcggattacctgttggctttgtccacagagaacggactgtgggtctcgaagaactttggcggcaaatgggaggaaatccacaaggccgtgtgtctggccaaatggggtagtgacaacacaatttttttcactacgtatgcaaatggaagctgcacagacttgggggccctagagctgtggagaacaagtgacttggggaaatccttcaaaactattggcgtgaaaatctattctttcggactgggtggtcgatttctcttcgcaagtgtaatggctgacaaggataccaccagacggatccacgtcagcacagaccagggagacacttggagcatggcccagcttccatccgtgggtcaggagcaattttatagtatcttagccgccaacgatgacatggtctttatgcacgttgacgaacccggcgatacagggttcggaactatattcactagtgacgaccgtggcattgtgtactcgaaaagcttggatcgacatctgtatacaaccaccggcggcgaaacggattttacaaatgtcacttccctccgaggagtatacataacctctgtgctgagcgaggataactccattcaaacaatgattacttttgatcagggaggccgttggacccatctccgcaagccagagaactccgagtgcgacgccactgcaaaaaacaaaaatgaatgctcgctacatattcacgcgagctattcaatctcccagaaactcaacgtgccaatggcacctctgtctgagcccaatgctgtaggcatcgtcattgcacatgggtccgtgggcgacgcaatatcggtgatggtacctgacgtatacatcagcgacgacggaggctatagctggaccaagatgctagagggcccgcattattacacgatcttagattctggggggattatcgtcgctatcgagcacagcagtaggccaataaatgtcataaaattttctactgatgaaggccagtgctggcagacctacaccttcacaagggaccccatctacttcacagggctggccagcgaacctggcgctcgaagcatgaatatttcaatctgggggtttaccgaaagttttctgacttctcagtgggtgtcatataccatcgattttaaggacattttggagcgtaattgcgaggagaaggactataccatctggctggctcacagtactgatcccgaggactatgaggacggttgtatccttggatacaaagaacagtttctgcgcctgaggaagtcctcagtttgccaaaacggcagagactatgtggttaccaaacagccctccatatgtctctgctccctggaagactttttgtgcgattttggctattataggccagagaatgatagcaaatgcgttgagcaaccagaactcaagggccacgatttggagttctgcctttacggaagggaggaacaccttactacaaacgggtaccggaaaatcccaggcgataaatgccagggaggagtgaatccagtgcgagaagtgaaggacctgaaaaaaaagtgcacctcaaattttctcagtcccgagaagcagaactcaaagagcaattccgttcccattatcctcgctattgtggggttgatgcttgtcacagtggtcgccggtgtgctgattgtgaaaaaatatgtgtgcggaggcagatttctcgttcatagatactccgtgttgcagcagcatgccgaggcaaacggtgtggatggagtggacgccctggacacagctagtcataccaataagagcgggtaccacgatgattctgacgaggaccttcttgag

SEQ ID NO: 19631 - DNA, 2082 bp, Artificial Sequence
  Description of Artificial Sequence: Synthetic coding sequence
atgaccttcggacagtctaaactataccggagtgaggactacggaaagaacttcaaagacattacggatctcattaacaatacattcattagaacggagtttggaatggccatagggccggaaaactccggaaaagtcgtactgactgcagaggtgtccggtgggtcacgcggtggcaggatctttcgaagcagcgacttcgctaaaaatttcgtgcaaactgacctgcccttccatccactgactcagatgatgtacagcccgcagaattccgactacttgctggcattgagtacggaaaacggattatgggtttcaaaaaactttggaggcaagtgggaagaaatccataaagccgtatgtctagcaaaatggggcagtgacaacaccattttctttacaacctatgcaaacggatcctgcacagacctaggcgccctggaactttggcggaccagtgacctggggaagagtttcaaaaccattggggttaaaatctactctttcggactgggcggcaggtttctttttgccagcgtaatggccgacaaggacacaacccgcagaattcacgtgagcaccgatcagggtgacacctggtccatggcgcaacttccctccgttggtcaagaacagttttacagtattctggccgcaaatgacgatatggtgtttatgcatgtggatgaaccaggcgacactggtttcgggaccatattcacgtcagacgaccgggggatcgtttactctaagagtctggacagacacctgtatactacaactggcggcgaaactgactttacaaatgtaacaagtctccggggcgtctatatcaccagtgtgctgtccgaagacaattccatccagaccatgattacgttcgatcagggcggcagatggacccacctgaggaagcctgagaatagtgaatgtgatgctaccgctaaaaataaaaatgagtgtagtctgcacattcacgcatcttatagcattagccagaagcttaacgtgccaatggcacccctatcagagccgaacgctgtgggaatcgtgatcgctcacggttcagtgggggatgcaataagcgtgatggtgccggacgtctatatatccgacgacgggggatattcctggactaagatgctcgaaggtccccactactacacgatcctggacagcggtggcataatagttgccattgaacacagctcccgcccgataaatgttatcaaattttctaccgacgagggccaatgttggcagacgtacactttcacaagggatcctatttacttcacgggcctcgcctctgagcccggggcgaggagcatgaatatcagcatctgggggtttactgaaagctttcttacctcacagtgggtgtcatacaccattgactttaaagatattttggaacgcaactgcgaggagaaggattacacgatctggctggcccacagtacggaccccgaggactacgaggatggctgtatcctgggatataaggagcagttcctaagactgagaaagagctccgtgtgccaaaatgggcgagactatgtggttaccaagcagccatctatctgtttgtgctccctagaggatttcctctgtgactttggctactaccggcctgaaaatgattctaaatgtgtggaacagcccgaattaaaaggtcacgacctcgagttctgtctgtacggcagggaggagcaccttacaacaaatggatacagaaaaataccaggcgacaagtgccagggaggggtcaatccagtgcgggaggtgaaggatttaaagaagaaatgcacaagcaacttcctaagccccgaaaagcaaaattccaagtcgaattccgtgccaataattttggccatcgtaggactgatgctggttaccgtggtggcgggtgtgcttatcgtgaagaagtatgtttgcggcggacgtttcctagtgcatcgctactctgtcttgcagcagcacgctgaggcaaatggcgtggacggggtggatgcattggacactgcctcccatacgaacaagtccggctaccatgacgactccgacgaagatctgctggag

SEQ ID NO: 19632 - DNA, 2082 bp, Artificial Sequence
  Description of Artificial Sequence: Synthetic coding sequence
atgacctttggacaatcgaagctctataggtccgaggactacggtaaaaactttaaagatatcactgatcttatcaataacactttcattagaaccgagtttggaatggccattggtcctgaaaacagcggtaaagtggtgcttactgcagaagtgtccggtggctcgcggggtggacggatatttcgttcatcggattttgcgaagaactttgtgcagactgatctcccttttcatccactgactcaaatgatgtactcacctcaaaactcagactacctgctggcactgtcgaccgaaaacggactgtgggtgagcaaaaactttggcgggaaatgggaagaaatccataaagcagtgtgtcttgcaaagtggggttccgacaacactatctttttcaccacgtacgcaaacgggtcctgcaccgacctcggcgcacttgagctctggaggacctctgatcttggaaagtcgtttaagaccatcggtgtgaagatctactccttcggactcgggggaagattcctctttgcaagcgtcatggccgataaggataccactcgacgtatccatgtctcaaccgatcaaggggatacgtggtccatggcacaacttccgtccgtgggtcaggagcagttttactccattctcgcagctaacgacgatatggttttcatgcacgtggatgagcctggggatactggattcggaaccattttcacttcagacgatcgcggaatcgtgtattctaagagccttgatagacacttgtacactaccaccggcggcgaaacggacttcactaatgtgacctcacttcgcggagtctacataacctctgtcctgagcgaagataacagcattcagaccatgatcacctttgatcaagggggacgttggactcatctgagaaagcccgaaaactccgagtgtgatgccacggcgaaaaacaagaatgaatgttccctccatattcacgcctcctactcaatctcccaaaagctgaacgtgcctatggcacctctgtcagaacctaatgcagtgggtattgtgatcgcacacgggtcggtaggtgacgctatatcagtcatggtgcctgacgtgtacattagtgatgatggaggatactcttggaccaaaatgctcgagggcccacattactacactatacttgactccggaggaatcattgtcgccatcgaacattcaagcagacctatcaatgtgattaagttttcgaccgacgaagggcaatgttggcagacttacactttcacccgtgacccaatttactttaccggtcttgcatcagagccaggagcaagaagcatgaacatatcaatttgggggtttactgagtcctttctgacctcacaatgggtgagctacacgattgatttcaaggatatcctggagaggaactgcgaggaaaaggactatactatttggctggcacactcaaccgatcctgaagattacgaagatggctgtattctcggttacaaggagcagtttctccgcctcagaaagtcatccgtctgccagaacggacgggactacgtggtgactaagcaaccctccatttgtctgtgctcgctcgaggattttctttgtgatttcggctattacaggcctgaaaacgactcgaaatgtgtcgagcaacctgaacttaagggacatgacctggaattttgcctttacggacgggaggagcatctgacgactaacggttaccggaaaattcctggagataagtgccaaggtggagtcaacccggtcagagaagttaaggacttgaagaaaaagtgtacttcaaacttcctgtcacctgaaaagcagaactccaaatcgaacagcgtgcctattatcctggccatcgtgggacttatgctcgttactgtggttgcaggtgtgctgattgtgaagaaatacgtgtgtggcgggagattcctggtccacagatactccgtcctgcaacagcacgcagaagcgaacggagtggatggtgtcgacgcactggataccgcatcgcatacgaataagtccggataccacgatgattcagacgaagatcttctggag

SEQ ID NO: 19633 - DNA, 2082 bp, Artificial Sequence
  Description of Artificial Sequence: Synthetic coding sequence
atgacattcggtcaaagcaaactttatcggtctgaagattacggaaaaaacttcaaggacatcaccgacttaattaataatacattcattaggacagaatttggaatggctatcgggcccgaaaattctggcaaggttgtcttgacggcagaggtttcagggggatctcggggtggacgcatcttcagaagtagtgacttcgctaagaatttcgtgcagactgaccttccctttcacccactgacgcaaatgatgtattctccacaaaattctgattacctcttggccttgagcactgaaaatggactatgggtttccaaaaattttggtggaaaatgggaagaaattcataaagccgtttgcttggctaaatggggctctgacaacacaatattcttcaccacttatgcaaatggctcatgcactgatttaggagcccttgagttatggcgaacaagcgacttggggaaatcgtttaagacaattggagtgaaaatttacagcttcgggttgggaggaaggttcttgttcgcttcagttatggctgataaagacacaactaggaggatacatgtctctacagatcaaggagacacttggtccatggctcaacttccatcagtcgggcaagagcaattttactcaattttagcggccaatgacgatatggtctttatgcatgtggatgagccaggtgatactggtttcgggaccatattcacctcagatgatagaggaatagtatactcaaagtcgttggatagacacctttacacgactactggaggggaaactgattttaccaatgttacgagcttaagaggtgtgtacattactagcgtgttgtctgaagataatagtattcagaccatgatcacatttgaccagggtggtaggtggactcaccttaggaagccagaaaattcagaatgtgatgcaaccgcgaagaacaagaatgagtgttctttgcatatacatgcctcctattctatcagccaaaagttaaatgttccgatggctcctcttagcgaacctaatgctgtcggtattgttattgctcatggttcagtgggggacgctatttcggtaatggttcctgatgtatatatttctgatgatggcggatacagctggaccaaaatgttggaaggcccccattattacacaattctggactcgggtgggattattgtcgcaattgaacacagctcgagaccaatcaacgtgattaagttctccacggatgagggtcagtgctggcagacatacacatttactagagaccccatctattttactggcctagcaagtgagccgggtgctagatcaatgaatatttctatctggggttttacagagagtttcctaactagtcaatgggtgtcgtatacgattgattttaaggatatattggaaagaaactgtgaagaaaaggattacacaatttggttggctcacagcactgatccagaagattacgaggacggttgcattttggggtacaaagaacagtttttgaggcttaggaagagctctgtctgtcagaacgggagggattacgtggttactaagcagccgtccatatgtttatgttccttagaggattttctttgtgactttggctattatcgtccagagaatgatagcaagtgcgtggaacaaccagagttgaagggacatgatctggaattctgcttgtacggaagagaggaacatctaaccacgaacggatataggaagattcccggcgataagtgccaaggaggcgtaaatcctgtgagagaggtcaaggacctaaagaaaaaatgcactagcaacttcttaagccccgagaagcagaacagcaaatctaattccgttccgatcatattagctattgtcgggcttatgttggtaaccgtagtggccggcgttcttatcgtcaagaagtatgtgtgcgggggaaggttccttgttcataggtatagcgtattgcaacagcatgctgaagctaatggagttgatggtgttgacgcacttgatactgcctcacataccaacaagtctgggtaccatgacgactctgatgaagatctacttgaa

SEQ ID NO: 19634 - DNA, 2082 bp, Artificial Sequence
  Description of Artificial Sequence: Synthetic coding sequence
atgacgttcggacaatccaaactgtatagatcggaggattacggcaaaaactttaaggacatcaccgacctgatcaataacaccttcatccgcaccgagtttggaatggctatcggaccagaaaactccggtaaggtggttctcactgctgaggtgagcggcgggtcccgcggagggcgcatcttccgctcatcggacttcgcaaaaaactttgtgcagaccgacctgcctttccatccgctcacgcagatgatgtacagcccccagaactccgactacctgctcgcactctccacggaaaatgggctgtgggtgtccaaaaacttcggaggaaagtgggaagaaatccataaggcggtgtgccttgcaaaatggggctccgacaacactatctttttcactacctacgccaacggatcatgcactgatctcggggcactggaactgtggaggacctcagatttgggtaagtcgttcaagactattggagtgaagatctactcgttcggcctgggcgggcgctttttgttcgcctccgtgatggccgataaggatactactagacggatccacgtgtcgacggatcaaggggacacctggtcgatggcgcagctgccttccgttggtcaggaacagttctactcgatcctcgcagcgaacgatgatatggttttcatgcacgtcgacgaaccgggagatactgggtttggtaccatcttcacctcggatgaccggggaatcgtgtactcaaagagtctcgacaggcacctgtacaccactacgggcggagagactgacttcactaatgtgactagccttcgcggagtgtacatcactagcgtgctgagcgaggacaactcaatccaaaccatgattaccttcgatcaaggaggccggtggacccatctcaggaagccggaaaattccgaatgtgatgcgaccgccaaaaacaaaaacgagtgctcgctgcacattcacgcgtcctactccatcagccaaaagttgaatgtcccgatggcgcctctgtcagaacccaacgcggtggggatcgtgatcgcacacggatcagtgggcgacgccatctccgtgatggtgccggatgtgtacatctcggatgacgggggatacagctggactaagatgctggaggggccacactactacactattctggactcgggagggattatcgtggcgatcgagcactcctcgcgcccgattaacgttatcaagttttcaactgacgaaggacagtgttggcaaacctacactttcacccgggatccgatctacttcaccggcctcgcgagcgagcctggagcacgctcgatgaatatcagcatttgggggttcactgaatccttcctcacttcccagtgggtgtcgtacactatcgacttcaaagatattctggaaagaaactgcgaagagaaagactacactatctggctcgctcatagcactgatccagaagattatgaagatggatgcatccttggatacaaggagcagttcctccgcctgcgcaaaagctcggtgtgtcagaatggacgggactacgtcgtcaccaagcagccgtcaatctgcttgtgttcactcgaggattttctgtgcgatttcggatactacagaccggaaaatgactcgaaatgcgtcgaacagcccgaactgaagggacatgatttggaattttgcctgtacgggcgcgaagaacatctgaccacgaacggctacagaaaaatccctggcgacaaatgccagggaggtgttaacccagtgcgggaggtgaaggatctgaagaagaagtgcacctcgaacttcctgtctccggagaagcagaattccaaatctaacagcgtgccaatcatcctggcgatcgtgggccttatgctggtgactgtcgtggccggtgtcctgattgtgaagaagtacgtgtgcggggggcggtttctcgtgcaccgctactcagtcctccaacagcatgcagaagcgaatggagtggatggagtcgacgcccttgataccgcctcgcacacgaacaaatccggataccacgacgattcagacgaggatctgcttgag

SEQ ID NO: 19635 - DNA, 2082 bp, Artificial Sequence
  Description of Artificial Sequence: Synthetic coding sequence
atgacctttggccaaagcaagttgtaccggagtgaggattatggaaagaacttcaaagatatcaccgatcttataaataacaccttcatcaggaccgaattcggcatggccataggtcccgagaactctggcaaggtcgtcctgacagctgaggttagcggtggctctcgcggcgggcgcatctttaggagttccgactttgccaagaactttgtgcagaccgatctacctttccatcctctaacccagatgatgtattcaccccaaaacagcgattacttacttgccctctcaaccgagaacggactgtgggtctccaagaattttggaggaaagtgggaggagatccacaaagcggtgtgcttagcaaaatggggatctgataacaccatattctttacaacatacgccaatggcagttgtacagacctgggagcactggagttgtggagaacttctgatctgggcaagtccttcaagaccatcggcgtgaaaatctactcttttgggttgggcggcagatttctcttcgccagcgttatggctgataaagatactaccaggcgcattcacgtgtctacagatcaaggggatacttggtcgatggctcaacttccaagcgtgggccaagaacagttctacagcatactggccgctaatgacgacatggtgtttatgcacgtggacgagcccggagatacaggattcgggacgatttttacctccgacgatcgcggcattgtgtacagcaaatctcttgacaggcacctgtacacaaccacaggaggagagaccgatttcaccaatgttaccagtctgcgcggcgtctacatcacatccgtgttaagcgaagacaactcaattcagaccatgataacttttgaccaaggaggcaggtggacccatctgagaaagccagaaaatagcgaatgtgatgctaccgctaagaataaaaacgaatgctccttgcacatccacgcttcctactcaatcagccaaaagctgaatgtgcctatggctcctctgtctgaaccaaacgctgttggcatcgtcatcgcacacggaagcgtgggcgatgcaatcagcgtaatggtgcccgatgtgtatatctccgacgatggaggatactcctggactaaaatgctggagggacctcactactacaccatactcgacagcggaggcattatcgtcgccatcgagcacagcagcagaccaatcaacgtgatcaagtttagcaccgatgaaggtcaatgttggcaaacctatactttcactcgcgatcctatctatttcactggcttggcttccgaaccaggcgcacggtctatgaacattagtatttggggctttacagagagttttctgacgagccagtgggtaagttacaccatagacttcaaagacatcctagagagaaactgcgaagaaaaggactatacaatttggctcgcccacagtactgaccctgaggactacgaagacggctgtatcctgggctataaggaacagtttctgcgcttgagaaaaagtagcgtttgccagaacggacgggactacgtagttaccaaacaaccatcgatctgcctgtgtagcctggaggacttcctctgtgactttggctattacagacctgagaacgacagcaagtgtgtggagcagccagaattgaagggtcatgacctggagttttgcctctacggcagagaagaacacctcacaaccaacggatatcgcaaaatacctggcgacaagtgccaaggcggagttaacccggtgcgcgaagtgaaagatctcaaaaaaaaatgtacctcgaactttctgtcccccgagaaacagaacagcaaatccaactccgtgccaattatccttgctattgtgggcttgatgctggtcacagtggtggccggcgtgctcatagtcaagaaatacgtgtgcggagggaggttcctggttcacagatacagcgtgctgcaacagcatgccgaagccaacggagttgatggcgttgatgcactcgacaccgcaagtcacacaaacaaatcaggttatcacgatgacagcgacgaagaccttctcgag

SEQ ID NO: 19636 - DNA, 2082 bp, Artificial Sequence
  Description of Artificial Sequence: Synthetic coding sequence
atgacattcggccagtctaagctgtacaggtccgaggactacggaaagaattttaaggacatcacagatctgattaataacacctttatccggaccgagtttggcatggcaataggacccgaaaatagtggcaaggtggtgctcactgccgaggtatccggcggctcccgcggaggccgtatcttccgtagtagtgacttcgctaagaatttcgtccagacggacttgccatttcatccgcttacacagatgatgtactctccgcagaactccgactacttgctggcgctcagtacagaaaacggtctttgggtgagtaagaacttcggagggaaatgggaagaaattcataaggctgtgtgtttagctaagtggggcagtgacaatacaattttttttaccacctatgccaacggaagctgcaccgaccttggagctttagagctctggagaacctccgatttgggaaaatcttttaaaaccatcggagttaagatctatagttttgggcttggcgggaggtttctgttcgcatcagtgatggccgataaggacactaccaggcggattcacgtgagcaccgatcagggtgacacctggtcaatggcccagttgccttcagttgggcaagaacagttctacagcattctggcagcgaacgatgatatggtcttcatgcacgtcgacgagcctggtgatacaggctttggaactatattcacttctgatgaccgtggtatcgtatattcaaagtccctggaccggcatctatataccaccaccggcggtgaaactgattttacaaacgtgacctccctgcgcggggtgtatataacttccgtgctcagtgaggacaactcaatccagacaatgatcacctttgatcaaggtggacggtggacgcacctgcggaaacctgagaacagtgagtgtgacgctacggctaagaacaagaacgagtgctccttacacatccatgcttcatatagcattagtcagaaactgaacgtacctatggcccccctgtctgaacctaacgcggtaggaattgttatcgcccacgggagtgtcggcgatgcgataagtgtcatggtccctgacgtgtatatatccgacgatggggggtactcttggactaagatgcttgaaggaccacattactatacgattctggactccggtggaatcatcgtggcaatcgagcatagcagtagaccaatcaacgtgataaagttctcgaccgacgagggtcagtgctggcagacttacactttcacccgtgatcccatatattttacagggctggcatccgagcctggagcccggtcaatgaacataagtatttggggtttcactgaatcatttttaacgtcccagtgggttagctacacaattgattttaaagacattttggagaggaattgtgaggaaaaggactacacaatttggctggcacattccaccgaccccgaggactatgaggatggctgtatcctcggatataaagaacaatttctgcgactacggaaaagcagcgtgtgtcaaaacggaagagactacgtggtaacaaaacagccatctatatgcctgtgctctttagaggatttcttgtgtgacttcggatattatcgacctgagaacgacagcaaatgcgtggagcagccagaactcaagggacatgacctggagttttgtctctatgggcgtgaagagcatctcacaacgaatgggtatcggaaaattcctggcgataagtgccaggggggagtcaatccagtgagggaagtgaaggacttaaaaaaaaaatgtacaagtaactttctgagtccagagaagcagaactcgaagtccaattcggtgcccattattcttgccattgtgggcttgatgttggtgacagtcgttgctggagtacttatcgtgaagaagtatgtctgcggaggtcgtttcctggtgcaccgatactccgtgcttcagcagcacgcggaagccaatggcgttgatggtgtcgatgctctcgacactgccagccacaccaataaatccgggtatcacgacgactccgacgaggacctactggaa

SEQ ID NO: 19637 - DNA, 2082 bp, Artificial Sequence
  Description of Artificial Sequence: Synthetic coding sequence
atgactttcggccagtctaagctgtatagaagtgaggactatggaaaaaatttcaaggacattacggacttaatcaacaataccttcattcgcaccgagttcggtatggccatcggacctgagaattccggtaaagtggtcctgacagccgaagtgtctggaggcagccgcgggggcaggatctttaggtcttctgatttcgctaagaatttcgttcagacagatttaccttttcatccgcttacccagatgatgtattctccccagaactccgattacctactcgcgctgtctacagagaacggactgtgggtgagcaagaattttggggggaagtgggaggagatccacaaggctgtctgcctggccaaatggggatctgacaacaccattttcttcactacatacgccaacgggagctgcaccgaccttggtgccctcgagctttggcgcaccagtgacctgggtaagagttttaagacaataggggtgaagatttacagctttggacttggcggcaggttcttgttcgccagcgtgatggcggataaagatactacgagacgaattcacgtcagtacagatcaaggggatacgtggtccatggcccagctcccttccgttggtcaggaacagttctactccatccttgcagcaaacgatgacatggtgttcatgcatgttgacgaacctggcgacacaggatttggcacaatctttacttccgatgaccgcggaatagtgtactcgaagagcctcgaccgacatctgtataccactacaggaggggagaccgatttcactaacgtgaccagcctcaggggtgtgtatatcacgagcgtcctgagtgaggacaattctattcaaactatgatcacgtttgaccaggggggaagatggacgcacctgcgaaagcctgaaaatagcgaatgtgacgcaacagccaaaaacaagaacgagtgtagtctgcacatccacgcctcctatagtatatcccagaaactgaatgtgccaatggctcctctatcagagccaaacgccgtgggaattgtgattgctcatggaagcgtaggggacgccatttccgttatggtgcctgatgtgtacatttctgacgacggaggatactcatggacaaagatgctcgaggggccccactattatacaatccttgattctggaggtatcattgttgccatagagcactcaagtaggcccattaatgtcataaagttttctacagacgagggccagtgttggcagacgtacacatttacccgcgatcccatttatttcaccggcctggcctctgagcctggggcgagatccatgaatattagtatttggggattcacagagagcttcttgaccagtcagtgggtgtcatatacaatagacttcaaggatatattggagcgcaactgcgaggagaaggactataccatctggctggcgcactccactgaccccgaagattacgaagacgggtgtatcctggggtataaggagcaattcctgcgtctgcgtaaatcctccgtctgccagaatggtagggattacgtggtgacaaagcagccttcgatctgcctctgcagtctggaggattttctatgcgactttgggtactaccgccccgagaatgattctaaatgcgtcgagcaaccagaactcaaggggcacgatctcgaattttgcctgtatgggcgcgaagaacacttaaccaccaatggctatcgaaaaatccccggagataagtgccagggaggcgtaaatcccgtcagggaagtcaaggacttgaagaaaaaatgcacatcaaattttctttctccagaaaaacagaattcgaagagcaactctgtgcctattatcctagccatcgtggggctcatgctggtcaccgtcgttgccggcgtgctgatcgtgaaaaagtacgtatgcggaggccgctttctcgtccatcggtactcggtgctgcagcaacacgcggaggctaatggagtggacggagtcgacgcgttggataccgcaagccacaccaacaagtccggatatcacgacgattccgacgaagatctgctcgag

SEQ ID NO: 19638 - DNA, 2082 bp, Artificial Sequence
  Description of Artificial Sequence: Synthetic coding sequence
atgactttcggacaatccaagctgtataggagcgaagattacggcaagaactttaaggatatcactgatcttatcaacaataccttcatccgaaccgagtttggtatggccatcggtccggaaaattcgggaaaagttgtgctgactgcggaggtgtccggcggctcgcgcggaggacgcatcttccggtcgtcagacttcgccaagaacttcgtccagaccgacctgcccttccatccactcactcagatgatgtatagcccacagaattctgactacctgctcgcactctcaacggagaacggtttgtgggttagcaaaaactttggaggcaagtgggaagaaattcataaggcggtgtgcctggccaaatggggatcggacaacacgatcttcttcaccacttatgccaacgggagctgtacggacctgggtgctctcgagctttggcgcacttcagacctcggaaagtcgttcaagactatcggggtgaagatctactcgtttggcttgggaggccggttcctctttgcgtcggttatggccgacaaagataccactagaaggatacatgtgagcacggaccaaggagatacctggagcatggcccagctgccatctgtcggacaggaacaattctacagcatcttggcggcaaacgacgatatggtgttcatgcatgtcgatgaaccgggagatactggatttggcaccatctttacgagcgatgaccgcggcatcgtgtactcgaaatcacttgatcgccacctgtacaccactactggtggagaaactgacttcacgaacgtgactagcctgcgcggtgtgtacattacctccgtgctctcagaggacaactccatccaaacgatgatcacttttgaccagggaggacggtggacccacctgcgcaaaccagaaaacagcgagtgtgacgccaccgcgaaaaacaagaacgaatgctcactgcacatccacgcttcgtactcaatctcgcaaaaactgaacgtccctatggctccgctgtcagagcctaatgcggtgggaattgtcatcgctcatgggagcgtgggggacgcgatcagcgtgatggtgcctgacgtgtacatctccgacgatgggggatactcctggaccaagatgcttgaggggccgcattactatacgatcttggactcgggcgggattatcgtggcaattgagcactcatcgcggcctatcaacgtcattaagttctcgaccgatgagggccaatgctggcagacctacacctttactcgtgacccgatctacttcactggtctggcttccgaaccgggagccagatccatgaacatttcaatatggggcttcaccgagtcgttcctgactagccagtgggtgtcgtacaccatcgacttcaaggacatcctcgaacggaattgcgaggagaaagattatactatctggctggcgcacagcactgatccggaagattacgaagatgggtgcatcttggggtacaaggaacagttccttagactcaggaagtcatccgtgtgtcagaatggacgcgactacgtggttaccaagcaaccctcaatttgcctttgctctctggaggacttcctgtgcgacttcggatactaccggccggagaatgactcgaaatgcgtggaacaaccggagctgaagggacacgacctcgagttttgtctgtacggacgcgaggaacacctgaccacgaacggataccgtaagattccgggggataagtgccagggcggcgtgaatccggtccgcgaagtcaaggatctcaagaagaagtgtacgagcaattttctgtcgccagaaaagcaaaatagcaaatccaatagcgtcccaatcatcctggcgatcgtcggcctgatgctggtgactgtggttgctggagtgttgatcgtcaagaagtacgtgtgcggaggacggttcttggtgcaccgctactcggtgctccagcagcatgctgaagccaacggggtggatggagtcgacgcgctggacaccgcctctcacactaataagtccggataccacgacgactccgatgaagatctgctggaa

SEQ ID NO: 19639 - DNA, 2082 bp, Artificial Sequence
  Description of Artificial Sequence: Synthetic coding sequence
atgacctttggccagagcaagctgtatagatcagaggattacggaaaaaactttaaggacattactgaccttattaacaacaccttcatccggaccgagttcggcatggcgattgggcccgaaaattctggtaaggtggtgcttacggccgaggtttctggtgggagcagaggcggtagaatcttcaggagcagcgatttcgctaagaacttcgttcagactgacctgccatttcacccgttgactcagatgatgtactcaccacaaaattccgactatttacttgccttgagcaccgaaaatggcttgtgggtgtcgaagaacttcgggggcaaatgggaggaaatacacaaggcggtgtgcttggctaaatggggcagcgataatacaatcttcttcactacctacgccaatgggtcgtgtaccgatctcggcgcactcgaactatggcgtacatcagacctggggaaatctttcaagacaatcggggttaagatctactctttcgggctgggaggcaggtttctatttgcatcggtcatggcagataaggataccaccaggcggatccatgtgagcaccgatcagggggatacatggagcatggcccagctcccgtctgtgggtcaggaacagttctactcaatcctggcagccaatgatgatatggtttttatgcacgttgacgaacccggggataccggtttcggaacgatctttacctccgacgaccgagggatagtgtatagcaaatctctggacagacacctttataccactactggcggagagacagactttacaaatgtcacctctcttcgaggcgtctacataacgtcagttttatcagaagacaattccatccaaactatgatcaccttcgatcagggggggcgatggacccacctccggaagcccgagaattccgaatgtgacgcaacggccaaaaacaaaaatgagtgcagcttgcacatacatgcgtcgtactctatttcacagaagttaaatgttccgatggctcctttgtccgagccaaatgccgtgggaattgttatcgcccacggttcggtgggggatgcaatatctgtaatggtccctgacgtgtatatttccgatgatggaggctattcttggacgaagatgctggagggcccccactactacacaattctcgattcgggaggaatcattgtggccatcgagcactcctcacgcccaattaatgtgatcaaattcagcactgacgaagggcagtgttggcagacctatacctttacgagggatcccatttactttacgggactggcctccgagccaggagcgcggagcatgaacatttcgatatggggttttacagaatccttcctcacctctcagtgggtctcttacacgatcgattttaaggatatcctcgagcgtaactgtgaggagaaggattatactatctggttggcccacagcaccgaccccgaagactatgaagacgggtgcattcttgggtataaggaacaattcctgcgcttgagaaagtcatctgtatgccagaacggcagggactacgtcgtcaccaagcagccctccatctgcctgtgttcactggaagactttctctgcgacttcggttactacaggcccgagaacgactcaaaatgcgtggagcagcctgagctgaagggccacgatctcgagttttgcctctatgggagggaggaacacctgaccaccaatgggtataggaagatccccggagacaagtgccagggcggtgttaacccagttcgcgaggtgaaagaccttaagaaaaagtgtacctccaactttctgagtcccgaaaagcaaaacagtaaatcaaatagcgtaccaatcatactggctatcgtgggtctcatgctggtgaccgtcgtggctggtgtgttaatcgttaagaaatacgtttgcgggggccggttcctagtccatcgctactcggtgttacaacaacatgctgaagccaacggcgttgatggcgtagatgccctggacactgcttcccacactaataagtcagggtaccacgatgattcggacgaagaccttctggag

SEQ ID NO: 19640 - DNA, 2082 bp, Artificial Sequence
  Description of Artificial Sequence: Synthetic coding sequence
atgacctttgggcagtcaaagctgtaccggtccgaagattatgggaagaactttaaggacataaccgatttgataaacaatacgttcatccgtacggagttcggcatggccattggtcccgaaaactcgggaaaagtcgtgctgactgctgaggtttcaggaggttcgcgcggaggcaggatatttcggtcgtccgacttcgcgaagaactttgtccagactgatctccctttccatcctctgacccagatgatgtactcccctcaaaatagcgattacctgcttgccctttcgacggaaaatggtctgtgggtgtcaaagaactttggcgggaaatgggaagagatccataaagcagtgtgtcttgcgaaatgggggagcgataacactattttctttactacttatgcgaatggctcgtgcacggacctgggtgcccttgaactgtggagaacctctgatcttggtaaatcttttaagaccattggggtgaaaatctattccttcggccttggaggcagatttctctttgcttccgtgatggcagacaaggacactacccggagaatccacgtgtccaccgatcaaggtgacacgtggagcatggcccaacttcctagcgtgggtcaagaacagttctattctattctggctgcaaacgacgatatggtgttcatgcatgtcgacgagccaggagatacgggattcggaaccatctttacctccgatgacaggggaatagtgtactcaaagtcattggaccgccacctctacactaccactggcggtgaaaccgattttaccaacgtcacctcgcttagaggtgtgtacattacttcagtcctttcggaagataactcgatccaaaccatgattacttttgatcaaggagggcgctggacccatcttaggaagccagaaaactcggaatgtgacgcaaccgcaaagaacaagaatgagtgttccctgcacatccatgcaagctattcgatctcgcaaaaactgaacgtgcctatggcacctcttagcgagccgaatgcggtcggtatagttattgctcacggttccgtcggagatgccatttcggtgatggtgcctgatgtgtacatatcggacgatggtgggtacagctggaccaagatgctcgaaggaccacattactacaccatacttgactccggaggtatcattgtggcgatcgaacactcttctcgtccgataaacgtgattaagttctcgactgatgaagggcagtgctggcagacgtacacttttactagagatccaatttactttactggcctggcatcagaacctggagcacggagcatgaatatcagcatctggggattcactgagtcgtttctgaccagccaatgggtttcatacactatcgacttcaaggatattctcgaaagaaactgtgaggagaaagattacactatttggttggcccattcgaccgatccggaggactacgaggatggatgcattcttgggtacaaagaacagttcctgcggcttaggaagtcctcagtctgtcaaaacggacgggattacgtggtgaccaagcaaccatccatctgcctgtgttcgctcgaggactttctttgtgactttggatactaccgaccggaaaatgattcgaagtgtgtcgaacaaccggagctcaagggccatgaccttgagttctgtctgtacggacgagaggaacaccttactaccaatggctacagaaagatccctggtgacaaatgccagggcggtgtcaaccccgtgagggaagtgaaagatctcaagaagaagtgtacttccaattttctgagcccagagaagcaaaacagcaagtcaaattctgtgccgataattcttgcgattgtcggtctgatgctggtgactgtggtggcgggcgtgctcattgtgaaaaagtacgtgtgcggaggacgctttctcgtgcatcggtacagcgttctccagcagcatgccgaagcaaacggggtggatggcgtcgatgcactggacaccgcatcccacacgaacaaaagcgggtaccacgacgattcggatgaagatttgctcgaa

SEQ ID NO: 19641 - DNA, 2082 bp, Artificial Sequence
  Description of Artificial Sequence: Synthetic coding sequence
atgacgttcggccaatctaagttgtataggtccgaagattatggcaaaaactttaaggatattaccgatctcattaacaacaccttcatccgcacagagtttggaatggccattggtccagagaacagcggaaaggtggttctgaccgcagaagttagcggtgggagtaggggcggaaggatcttcagatctagcgatttcgcaaaaaattttgttcaaactgatctgccgttccatccactgacgcaaatgatgtatagcccacaaaactccgattatcttctggcactctctaccgagaacggattgtgggtctccaaaaacttcggtggaaaatgggaggaaatccacaaagccgtgtgtttggctaagtggggcagtgacaacactatattttttacaacttacgctaatggctcctgcaccgatctcggagccctagaattatggcgcacgtcagacctgggtaaaagcttcaaaaccatcggcgtgaaaatatactcattcggactgggcgggaggtttctcttcgcgagcgtcatggccgacaaagatacaacacgccgaatccatgtctctaccgatcaaggcgacacctggagcatggctcagctgccttctgtgggccaagagcaattctatagcatcctggccgctaatgacgatatggttttcatgcacgtcgacgagcccggagacacgggatttggcactatcttcacctccgatgaccgcggcatcgtttattctaagagtctggataggcatctgtacaccacaactggaggcgagaccgacttcacaaatgtcacctctctgcgcggagtgtatatcacttctgtcctgtccgaggataattctatccagacgatgattaccttcgatcagggcgggaggtggacccaccttagaaaaccggagaattctgaatgcgatgcgaccgcaaagaacaagaatgagtgttctctccacatccacgctagctacagcataagccagaagctgaacgtgccaatggctcccctgtcagaacctaacgctgtcggaatcgtcatcgctcacggatccgtgggcgatgccatctccgttatggttcctgatgtttacatcagcgacgatggaggctacagttggactaagatgctggaggggcctcactactatactatccttgattcaggtggaatcatagtcgccatcgaacattcttctcgccctatcaacgtgataaagtttagtacagacgaaggccagtgctggcaaacatatacctttactcgggacccaatctactttactggtctggctagcgagcctggagcgaggtcaatgaacattagcatctggggctttacagagtcttttctgacgtcacaatgggtctcttacactatcgatttcaaggatatcctcgaacgcaactgtgaggagaaagattataccatatggctcgctcacagcaccgacccagaggactatgaggacggctgcattcttggctacaaagaacaattcctgaggctcagaaagtccagcgtatgtcagaacggccgcgattatgtcgtaaccaaacagccatcaatttgcctgtgttctctggaagactttttgtgtgacttcggatattaccgacccgagaacgacagtaagtgtgttgagcagccagagctcaaaggacatgatttggaattctgtctctatggcagggaagagcacctgacaaccaacgggtacagaaagatccctggcgacaagtgtcagggaggcgtcaaccctgtacgggaagtcaaggaccttaaaaagaagtgcaccagcaactttttgtcacctgagaagcagaatagtaagagtaacagcgtaccgattatccttgctatcgtgggtctgatgcttgtgacggtggttgcaggcgtcttgatagtcaaaaaatacgtatgcggtggcaggtttctcgtgcataggtattcagtgcttcaacagcatgcagaggcaaacggagtggacggtgtcgatgctctggacaccgcaagccacaccaacaagagcggttaccatgatgatagcgacgaagatcttctcgaa

SEQ ID NO: 19642 - DNA, 2082 bp, Artificial Sequence
  Description of Artificial Sequence: Synthetic coding sequence
atgaccttcggccagtccaagctctaccgctcggaagattacggaaagaactttaaggacattactgacctgattaacaacactttcattcgcactgaattcggcatggcgatcgggcctgaaaatagcggaaaggtggtgctgactgccgaagtttcggggggctcaagaggaggacgtatctttaggagttcagacttcgctaagaactttgtgcagaccgacctccccttccatccgctcactcaaatgatgtactcgccgcagaattcggactacctcctcgccctgtcgaccgaaaatggactctgggtgtccaagaattttggcggaaagtgggaggaaatccacaaggcggtctgtctggcaaagtggggatccgacaacactatcttcttcactacctatgccaatggatcatgcactgatctcggagcccttgagttgtggcgtacctccgacctgggcaaatcgttcaagactatcggagtcaagatctattcattcggcctgggcggtcggttcctgttcgcctcggtgatggcggacaaagacaccactagacggatccacgtgtccaccgatcagggtgacacgtggtcaatggcgcaattgccttcggttggccaggagcaattctatagcattctcgctgccaacgatgatatggtgttcatgcatgtcgatgagcccggcgacacgggctttggaaccattttcacctcggatgataggggaatcgtgtactcgaagagccttgataggcacctctacaccaccaccggtggagagactgactttaccaacgtgacctcactccggggagtctacattaccagcgtgctctcggaggacaattcgattcaaactatgatcaccttcgaccaaggcggtcggtggactcacttgcgcaagccggaaaacagcgaatgcgatgccactgctaagaacaagaacgaatgttcgctccacatccacgcgtcgtactctatttcccagaagctgaatgtgccgatggcgccgctttccgaaccaaatgccgtgggaattgtgatcgctcacggatcggtaggagacgccatctcagtgatggtgccggacgtgtacatctcagacgacggcggctattcatggactaaaatgctcgagggacctcattactacaccattctggattcgggcggcatcatcgtggcaatcgaacattcatcccgcccaatcaacgtcattaagttctccaccgacgagggacagtgctggcagacgtacactttcacccgggacccgatttacttcaccggactggcgtcggaaccaggcgcccgctccatgaacatctcgatctgggggtttaccgaatcatttctcaccagccagtgggtgtcctacaccatcgactttaaagatatactcgaacgcaactgcgaggagaaggattacactatctggctcgcacattccactgacccagaggactacgaggacggatgcatcctgggatacaaagagcaattcctgcggctcaggaaaagtagcgtgtgccaaaatggacgagactacgtggtgaccaaacaaccgagcatctgcctgtgctcgctcgaggatttcctgtgtgacttcggatactaccgacccgagaacgattccaagtgtgtggaacagccggaactgaagggccacgatcttgagttttgcctctacggacgagaagagcaccttaccaccaacgggtacaggaagatccctggagataagtgccaaggaggcgtcaatccggtgcgcgaggtcaaagatctgaaaaagaagtgcacctcaaacttcctgtctccagaaaagcagaactctaaaagcaacagtgttccgatcatcctggcgattgtgggcctcatgctggtcaccgtggtggccggtgtccttatcgtcaagaagtacgtgtgtggagggagattccttgtgcaccgctacagcgtgttgcagcaacatgccgaagcgaacggagtcgacggtgtggacgccctcgacactgcgagccacactaacaagtccggataccatgacgattcggacgaggatcttctggaa

SEQ ID NO: 19643 - DNA, 2082 bp, Artificial Sequence
  Description of Artificial Sequence: Synthetic coding sequence
atgaccttcggacagagcaagctgtaccggtccgaggattacggaaagaactttaaagacatcactgatctgatcaacaacacgttcatccgcaccgaattcggcatggctatcggacccgagaacagcggtaaggtcgtgcttacggcagaggtttccgggggttcgcggggaggccggatctttagatcgagcgattttgcgaagaacttcgtgcaaactgacctcccgttccatccactgacccagatgatgtactccccgcagaactccgattatctgcttgccctgtccacggaaaacggcctctgggtgagcaaaaactttgggggcaagtgggaggagatccacaaagcggtgtgccttgcgaaatggggatccgacaacaccatctttttcaccacttacgcgaacgggtcatgcactgacctcggagcgctggaactgtggcgcaccagcgatctgggtaaatcattcaaaaccatcggagtgaagatctactcgttcggactgggaggaagattccttttcgcgtccgtgatggctgataaggacaccactcgcagaatccatgtgtcgactgaccagggcgatacctggtcgatggcccaactcccatcagtggggcaggagcagttctacagcatcctggcagccaatgacgacatggtgtttatgcatgtcgacgaacctggcgacactgggttcgggaccatcttcacctcagacgatcgcggaatcgtgtacagcaagtcgcttgaccggcatctctacactaccaccggaggcgaaaccgacttcactaatgtgacctcgctgcgcggtgtctacatcacttcggtcttgtccgaggataactcgatccaaactatgatcacctttgaccaaggaggacggtggacccatctgcggaagccggagaacagcgaatgcgacgcaactgcaaagaacaagaacgaatgtagcctgcacatccatgcctcgtactctattagccagaagctgaacgttccgatggccccgctgtccgagccgaatgccgtgggcattgtgattgcacatggcagcgtcggagacgcgatcagcgtcatggtgccggacgtgtacatcagcgatgacggcggatacagctggactaagatgctcgaagggccgcattactacactatcctggattcagggggaatcattgtggcaatcgagcacagcagccgccccatcaatgtcatcaagttttccaccgatgagggacagtgctggcagacttatactttcacccgcgaccccatctacttcacgggccttgcctcagaaccaggagcccggtcgatgaatatctcgatctggggattcactgaatcgtttctgacctcccagtgggtgtcatacaccatcgactttaaggatatcctggaacggaattgcgaagagaaggattacactatctggctcgcgcacagcaccgatcctgaggattacgaggatggctgtatcctcggatacaaggaacaatttctccggctgcgcaagtccagcgtgtgccagaacgggcgggactacgtcgtgactaagcagccgtcgatctgcctgtgttcattggaggacttcctgtgcgatttcggctactacagaccggaaaacgactccaaatgcgtcgaacagcctgaactcaaaggacacgacctggaattctgcctctacggacgcgaggagcacctgactactaacggctaccgcaaaatcccaggcgataagtgtcagggcggtgtgaatccggtcagggaagttaaagatctcaaaaagaagtgtacctcaaacttcctctcgcccgagaagcagaattccaagtcgaacagcgttccgatcatcctcgcaattgtggggctcatgctcgtgactgtcgtggcgggtgtgttgatcgtcaagaagtacgtgtgcggaggacggttcctggtgcatcgatactcagtcctgcagcagcatgctgaagctaacggcgtggacggggtcgacgctctcgataccgcgtcgcacaccaacaaatcggggtaccacgatgactccgacgaggatctgctggag

SEQ ID NO: 19644 - DNA, 2082 bp, Artificial Sequence
  Description of Artificial Sequence: Synthetic coding sequence
atgacctttggtcaatccaaattatacagatcggaggactacgggaagaactttaaagatattaccgacctgatcaacaacacgtttattcgcactgaatttggcatggccattggcccggaaaactccggcaaagtggtgctgacggcagaagtgtcaggggggagtagaggaggcagaatttttagatcaagcgacttcgcgaaaaacttcgtgcagaccgatctcccctttcatccactgacgcagatgatgtactcgccacagaattccgactacctgctggctctgtcaacagaaaacggcctatgggtcagcaagaatttcggcggtaagtgggaagagatccacaaagctgtctgtctcgccaagtggggctcagataacacgatttttttcactacctacgccaacgggtcctgtacggacctaggcgccctcgagctctggagaacatccgacttgggaaaaagcttcaagacaataggcgttaaaatatactcttttggcctgggaggaaggttcctgttcgcaagcgtgatggctgataaggatactacacggcggattcatgtatcaaccgatcagggcgacacttggtcgatggcacaacttccaagcgtaggccaggaacaattctacagtattctcgcggctaatgatgacatggtttttatgcatgttgatgagcccggagatactggattcggcactatctttacatctgatgaccggggaattgtctactcaaagtccctggatcgtcacctgtacaccacaaccggaggagagaccgatttcacaaacgttacgtctctccggggtgtgtacatcacgtctgtactcagtgaagataactccattcaaactatgattacatttgaccagggtggaagatggacccatctgcgtaagcctgagaactccgagtgtgatgccaccgccaaaaataaaaatgagtgcagtcttcatattcacgcttcctactcaatctctcagaagctgaatgtcccaatggcccccctgtccgagccgaacgcagttggaatagtgattgcacacgggtccgtgggggacgcgataagtgttatggtccctgacgtctatatatctgacgacggcggctacagctggacgaaaatgcttgagggcccccactactataccatcctggattctgggggcatcatcgttgccatagaacactctagtcggcccataaacgtgatcaagtttagtacagacgaaggacagtgttggcagacttatacgtttaccagagatcccatctatttcacaggcctggccagtgaaccaggagcacggtccatgaacatatccatctggggctttactgaatcctttctgacatcccagtgggtctcctatacgatcgactttaaggatatacttgagcggaactgcgaggaaaaggattataccatttggttggcccactctacagatccggaggattatgaggacggctgcatactgggctataaggaacaattcttgaggctccggaagtcatcggtgtgccagaacgggagagactatgtagtgacaaagcagccaagcatttgtctttgctccctggaagatttcctttgcgatttcggttattataggcctgaaaacgatagtaagtgcgtggagcagcccgaactcaaaggccacgatctagaattctgcttgtatggcagagaagagcacctgaccaccaacggatacaggaagatccccggcgacaagtgccaaggtggcgttaatcctgttagagaagtcaaagatctcaagaagaagtgtacatcaaactttctgtcccccgagaaacagaattcaaagtcaaatagcgttccaatcatactagctattgtgggcctgatgctggtgacagttgtggcgggggtgttaattgtgaaaaagtacgtgtgcgggggtcggttcttagtgcaccggtactcagttctgcagcagcacgctgaagcaaatggcgtagatggagtggacgctctcgatactgcatcccatactaacaagtcaggataccacgacgacagcgacgaggatctcctggag

SEQ ID NO: 19645 - DNA, 2082 bp, Artificial Sequence
  Description of Artificial Sequence: Synthetic coding sequence
atgactttcggccaatctaagctttaccggagcgaggactacggtaaaaacttcaaggacattacagatctgattaacaataccttcataagaaccgagtttggtatggctatcggccctgagaactcaggtaaagttgtgcttactgccgaggtgtcaggcggaagtcgcggcggtaggatcttccggtcttcagattttgctaagaatttcgtgcaaacggacctccctttccaccctctcacacagatgatgtacagcccccagaatagtgattatcttctggcgctgtccacagagaatggcctgtgggtgagcaagaacttcgggggcaagtgggaggaaatccacaaagcggtctgcctggctaagtggggaagtgacaacaccatcttcttcacaacttacgccaatgggtcctgcaccgacctgggcgctctggaactgtggcggacctcagacttgggaaagtctttcaaaacaattggagtaaagatttactcttttgggctcggcggcagattcctgttcgcgagtgttatggcggacaaagacaccactcgccgcattcatgtaagcacggaccaaggcgatacatggagcatggcacagcttccctcagtgggtcaagagcagttctactccattctggcagccaacgacgacatggtgttcatgcatgttgatgagcccggcgacacgggatttggaacaattttcacttctgacgaccgcggaattgtgtattctaaatcacttgataggcacctttacacaaccacaggaggggaaacggacttcactaacgttacttccctgcggggagtatacatcacctcagtgctttccgaagacaattccatacagaccatgatcaccttcgatcaggggggcagatggacccacctgagaaaacctgaaaactctgaatgcgatgctaccgcaaaaaacaagaacgagtgtagcctgcatatccacgcgtcttactctataagtcagaaactcaatgtgcctatggctcccctgagcgagccaaacgcggtgggaatcgtcattgcgcatggaagcgtgggcgacgctatatccgtgatggttccggacgtgtacatctccgatgacggagggtactcctggacaaagatgctggaaggccctcattattatacgattttggatagcggcggaattatagttgctatcgaacacagttcccgccctataaacgtgatcaagttctccacagatgaaggacagtgctggcaaacatacacattcaccagagatcctatctatttcaccgggttggcatctgagcccggtgcgagaagtatgaacattagtatatggggcttcactgagtccttccttacaagccagtgggtgtcatacacaatcgacttcaaagacatcctggagaggaactgtgaggagaaggattacactatctggctggctcattctaccgaccccgaagattatgaagacgggtgtattctgggctacaaagagcagttcctcaggctgaggaaatcaagtgtgtgtcaaaatggacgagattacgtggttacgaagcaaccatccatctgtttgtgctccttggaggacttcctctgcgattttggttactatcggcccgagaacgattccaaatgcgtggaacaacctgagcttaaagggcacgacctggagttttgcctgtacggcagggaagagcatctgaccacgaatgggtacaggaagatccccggcgacaagtgtcagggtggggtaaaccctgtgagggaggtgaaagatctgaaaaaaaagtgcacatctaatttcctgtcaccagagaagcagaatagcaagtccaactccgtgccaattatactggctatcgtgggcctcatgctggtgaccgtggtggccggagtccttatagttaaaaagtatgtgtgcggcggaagattcctcgtgcataggtattccgtgctgcaacagcacgctgaagccaatggcgtcgatggtgtcgacgctctggacaccgctagccacaccaacaagagcggatatcatgatgacagcgatgaggatctgctggaa

SEQ ID NO: 19646 - DNA, 2082 bp, Artificial Sequence
  Description of Artificial Sequence: Synthetic coding sequence
atgactttcggccagtcaaaattgtacagatcggaggactatgggaagaatttcaaggacattaccgatctgatcaacaacacttttatcagaaccgagttcgggatggcaattggtccagaaaattcgggtaaggtggtccttaccgcagaagtctcgggcggaagccgaggtgggaggatctttaggtcctcagattttgctaagaatttcgtccagaccgacctcccttttcaccctttgacccaaatgatgtacagccctcagaactcggattacctcctggctctgtcgaccgaaaacgggctgtgggtgtccaagaattttgggggtaagtgggaggagatacataaggcggtctgtcttgcaaaatggggcagcgataatactattttctttacgacttacgccaatggatcatgcaccgatctcggcgcactcgagttgtggagaaccagcgatcttggtaagtccttcaagaccattggagtcaagatctactcgtttggacttggaggaaggtttctctttgcaagcgtcatggcggacaaagatactactagaaggattcatgtctcaactgatcaaggagatacctggtcgatggcgcagctgccttcagtaggtcaagaacaattctactccattctggccgcaaacgatgatatggtgtttatgcatgtggatgagccaggtgataccgggttcggtactattttcacgagcgacgaccgtggaatcgtgtactcgaagtcgttggataggcacctttacaccaccaccggaggtgaaaccgactttactaacgtgacctcactccgtggtgtctacattacctctgtgctttcggaagataattcgattcagactatgataacttttgatcagggaggacgctggactcatctgagaaagcctgagaattcggaatgtgatgcgaccgccaaaaacaaaaacgaatgctcccttcatatacatgcatcatacagcatttcgcagaaactgaacgtgcctatggcgcccctgtccgagcctaatgccgtgggaatagtgatcgcacatggatctgtcggagatgccatttctgtgatggtgccggacgtttacatctcggacgacggaggctactcttggaccaaaatgttggaaggaccccattactacaccatccttgattcgggtggtattatcgtggctatcgagcactcctcgcggccaatcaatgttatcaagttttcaaccgacgaaggtcaatgttggcaaacctacacttttaccagagatcccatatacttcactgggcttgcatccgagcctggagccagaagcatgaacatttccatttggggatttactgagtcttttcttacgtcccagtgggtgagttacaccattgatttcaaagatattcttgaaagaaattgcgaagaaaaggattatactatctggctcgcacactcgaccgaccctgaggactacgaggacggatgtattctggggtacaaggaacaattccttcgcctgcggaagtcaagcgtgtgtcagaatgggcgtgactatgtggtaactaagcaaccatcaatctgtctgtgctcactggaagattttctttgcgacttcggatactacagacctgagaacgattccaagtgtgtggaacaacccgaattgaagggtcacgacctggaattttgcctgtacggtcgcgaagagcaccttaccactaacggataccgaaagattccaggagacaaatgtcagggtggagtgaacccggtgcgggaagtgaaggatcttaagaagaagtgtacttccaactttctgagtcctgaaaagcaaaattcaaaatcgaactcagtgcctatcatcctggcaattgtcggattgatgctcgtgaccgtcgtcgctggagttctgatagtcaagaagtacgtgtgtggaggcagatttctggtgcatagatactctgtgctgcagcaacacgcagaggctaacggggtggacggtgtggatgcccttgatactgccagtcatactaataagagcggataccatgatgattcagatgaggacctgttggag

SEQ ID NO: 19647 - DNA, 2082 bp, Artificial Sequence
  Description of Artificial Sequence: Synthetic coding sequence
atgacctttgggcagagcaaactttaccgctccgaagattacggcaagaacttcaaggatatcactgacctgattaacaataccttcataagaactgaatttggtatggccattgggcctgagaattccggcaaggtcgtgcttactgcggaagtgtccggcggatcccgaggtggcaggattttcagatcctccgattttgccaagaactttgtgcaaacggaccttccattccatcctctgactcagatgatgtactcgccccaaaattctgattacctcctggctctttccactgagaacggcctttgggtgagcaaaaactttggaggtaaatgggaggaaatccataaggcagtgtgtctcgcaaagtggggaagcgataacacgatctttttcaccacttatgcgaacggatcgtgtactgatctgggtgcactcgaactgtggcggacttcagaccttgggaagtcctttaagaccatcggtgtgaagatttactcatttgggcttgggggaagatttctgtttgcctcagtcatggcggacaaagatactaccagacgtatccatgtgtcaacggatcagggtgatacgtggtcgatggcccaacttccttccgtgggtcaagaacagttttactccatactggccgcgaatgacgatatggtgtttatgcacgtggacgaacctggggacactggcttcgggactattttcacttcggatgaccgtgggattgtttacagcaagtccttggatcgacacttgtacactaccaccggcggagaaacggactttactaacgtcacctcgctgagaggcgtgtacatcacttccgtgctgtcagaagataactcaatccagactatgattacttttgatcagggtggacgctggacccatttgcggaaacctgaaaactcggaatgtgatgccaccgccaagaacaaaaatgaatgctcacttcatattcatgcgagctatagcatatcccagaaacttaatgtgcccatggcaccactttcggaaccaaatgcagtcggaatagttattgcgcacggatcagtgggagatgcgatatctgtgatggtcccagatgtgtacatctcagacgacggaggttactcctggaccaaaatgctcgaaggaccacattactacacgatcctggacagcggtgggatcattgtggcaatagagcactcgagccgtccgatcaacgtcatcaagtttagcaccgatgaaggacaatgttggcaaacttacaccttcactcgcgatccaatttactttactggattggcatcggaacctggcgcacggagcatgaatatctcaatttggggatttaccgaatccttccttacttctcagtgggtgtcctacaccatcgatttcaaggacattttggaacggaactgtgaagaaaaggattacactatatggttggcccattccacggatcctgaggactacgaggacgggtgtattttgggctacaaggagcagtttctcaggctgcggaagagctccgtctgccagaatggtagggattacgtggtcactaagcaaccttcgatttgcctttgtagccttgaagattttctttgtgatttcggctactacagacctgaaaatgattcaaagtgtgtcgagcaacctgaacttaagggacatgacctcgaattttgcctttatggaagagaggagcatctcactactaatggctatagaaagattccgggcgataagtgccagggcggggtgaacccagtgagagaggtgaaagatttgaaaaagaagtgtacttccaactttctctccccagagaagcaaaacagcaagtcgaactccgtgccgattatcctcgcaattgtgggattgatgcttgtgactgtggtggccggtgtccttattgtgaagaaatacgtgtgtgggggacggtttctggtccatcgttactcggtcctgcaacaacacgccgaagctaatggcgttgatggagttgatgcgctggataccgcatcgcacacgaacaagagcggttaccatgatgattctgatgaagatcttctggag

SEQ ID NO: 19648 - DNA, 2082 bp, Artificial Sequence
  Description of Artificial Sequence: Synthetic coding sequence
atgacgtttggtcaaagcaaactttatcgttcggaagattatggtaaaaactttaaagatatcacagatttaattaataacacatttattcgtacggaattcgggatggcgattggacccgagaattcaggcaaagtagtattaacagcggaggtctctggaggttctcggggaggtcgcatttttaggtcgtctgactttgctaaaaattttgtgcagaccgacttaccgttccatccgttgacgcagatgatgtattccccacaaaacagcgattatttgttagcattatctactgaaaacggattatgggtatcaaagaactttggtggtaaatgggaggaaattcataaagccgtttgtcttgctaaatgggggtctgataacacaattttcttcacgacatacgctaacggttcttgtacggacctcggagctctggaactttggagaacgtcggatttgggtaaaagcttcaaaacgattggagttaaaatctattcattcggtctggggggccgcttcctgtttgccagcgtgatggcggataaggatacaacgagaaggattcatgtctcgacggatcaaggagatacatggtctatggcccagttgccgagcgtcggtcaggaacaattttactcaatattagctgctaatgatgatatggtttttatgcatgtagacgaaccgggagacacaggctttggcacaatttttacaagcgatgatcgagggattgtttattcaaagtcactggaccgccatctttatacaacgacgggcggagaaacagattttacaaacgtgacaagcttaagaggagtctatattacaagcgtactttctgaagacaatagcatccagacgatgattacatttgaccaggggggtcgttggacacacttgagaaaaccagaaaacagcgagtgcgacgccacggctaaaaacaaaaatgaatgctcactccacattcatgcgtcttattctatttcgcagaaattaaatgtacctatggccccattaagtgaaccgaatgccgttgggattgttattgcccatggatctgtgggagacgcaatttctgttatggttccagatgtatatatttctgacgacggaggctatagctggaccaagatgttagaaggaccgcattactatacgattcttgacagtggcggcataatcgttgctattgaacactccagccgtccgatcaacgttattaaatttagcacagatgaggggcaatgttggcaaacttatacttttacacgcgatcctatttattttacgggcctggcctccgagcctggagcacgttctatgaacattagcatttggggatttacggaatcctttttaacatctcaatgggtttcatacacaatcgactttaaagacatcttagagcgtaattgtgaagaaaaagattatacaatctggctggcgcattcaacggatccggaagattacgaggatggctgtattcttgggtacaaagagcagtttttgagacttaggaaatcttctgtctgtcagaacggtagagactacgtagtcacgaagcagccgtcaatctgtctttgttccctcgaagattttctttgtgacttcggctattatcgtcccgaaaatgattctaaatgcgtggaacagccggaacttaaaggccatgatttagaattttgcctttacggccgggaggaacacttgaccactaacggttataggaaaatccctggcgataagtgccagggcggagtgaatccggtacgtgaagtaaaagatcttaaaaaaaagtgtacgtctaacttccttagtccggaaaaacagaactccaaaagcaactctgtacctataatcttagctatagtgggcctgatgcttgttacggttgtcgccggggtcttgatcgtaaagaaatatgtttgcggaggacgttttttagtacatcggtattccgtcttacaacaacatgcggaagctaacggagtggacggtgttgacgcgttagatactgcctcccatactaataaatctggttaccatgatgactcagatgaagacttactggag

SEQ ID NO: 19649 - DNA, 2082 bp, Artificial Sequence
  Description of Artificial Sequence: Synthetic coding sequence
atgactttcggccagagcaaactctacagaagcgaggactatggaaagaactttaaggacatcactgacctgattaacaacaccttcatccgcaccgaattcggcatggctatcggaccagagaattcgggaaaggtggtgctgactgctgaagtgtcaggcggatcgcggggaggccggatcttccgttcgtcagatttcgcaaagaatttcgtgcagaccgacctcccctttcatccgctgactcaaatgatgtactcgcctcaaaacagcgattacctgttggcattgtcaaccgagaacggcctctgggtgtcaaaaaacttcggagggaagtgggaagagattcataaagctgtgtgcctggccaaatggggttccgacaacaccatcttcttcactacttatgctaatggcagctgcactgatttgggggcactcgagctgtggagaacttccgatctgggcaaatcgtttaagaccatcggagtgaaaatctactcattcgggctgggtggaaggttcctctttgcttcggtgatggccgacaaggacacgacccgccggattcatgtgtcgaccgatcaaggtgacacctggtcgatggcacagcttccaagtgtcggacaggaacagttttactcaattctggccgcgaacgacgacatggtattcatgcacgtggatgagccaggcgacaccggcttcggaacgattttcacgtcagacgacaggggtatcgtgtacagcaagtccctggatcgccacctttacacgaccaccggcggggaaaccgacttcactaatgtcacttcactgcgcggcgtgtacataacctccgttttgtccgaagataattcaatccagaccatgatcaccttcgatcaaggcggcaggtggacgcacctccgcaaaccagagaactcggaatgtgatgcaactgccaagaataagaacgaatgttccctgcacatccatgccagctactctatctctcagaagctcaacgtgccgatggccccgctgagcgaacctaatgcagtgggaatcgttatcgcacacggtagtgtgggagatgccatctccgtgatggtcccagacgtctacatctctgatgacggtggctattcctggaccaagatgcttgaggggccgcactactacaccatcctcgactcgggagggatcatcgtggcaatcgaacactcctcgcggccgataaacgtgatcaaattctccacggacgagggacagtgctggcaaacttacacctttactcgagatcctatctactttaccggactcgcaagcgaaccgggggcgcgttcgatgaacatctcgatttggggcttcactgaatcatttctcacttcgcagtgggtttcttacactattgacttcaaggacatcctggagcgcaactgcgaggagaaggactacacgatttggctcgcccacagcaccgaccccgaggactacgaagatgggtgcatcctcggatacaaagaacagttccttaggctccgaaaaagctctgtctgtcaaaacggcagagattacgtggtgactaagcagccgagtatctgcctgtgctccctcgaagattttctgtgcgacttcggatactaccgcccggaaaacgatagcaagtgcgtggaacaacctgaattgaagggacacgatctggagttctgcctgtacggtcgggaggaacatctgaccactaatggttatcgcaaaatccctggagacaaatgccaaggaggtgtgaaccctgtcagagaagtgaaggacctcaagaagaagtgtacctcgaatttcttgtcccccgaaaagcagaactccaagagcaattccgtccccatcattctggccatcgtgggactgatgctcgtcactgtcgtggcgggggtcctgatagtgaaaaagtacgtgtgcggaggacggttcctggtacacagatactccgtgctgcagcagcatgcagaagcgaatggagtcgacggggtcgacgcccttgacacggcttcccatactaacaagagcggataccatgatgatagcgatgaggacctgctggag

SEQ ID NO: 19650 - DNA, 2082 bp, Artificial Sequence
  Description of Artificial Sequence: Synthetic coding sequence
atgacgtttggccagtcaaagctctataggagcgaagattacggcaaaaattttaaggatattaccgatctgattaacaataccttcatcaggaccgaattcggaatggcaattggtccagaaaacagtggcaaggtggtattgaccgcagaggtgagcggaggctcccgcggcggccgcatcttccgcagctccgacttcgcaaagaatttcgttcaaaccgacctcccttttcatccactgacacagatgatgtactcaccgcagaacagtgactacctcctcgccctgagcactgagaacggcctgtgggtttctaagaacttcggtggcaagtgggaagaaattcacaaagccgtttgcctcgccaagtggggatccgacaacaccatcttcttcacaacctatgccaacggaagctgcacagatctcggcgcactcgaactttggagaacaagcgacttgggcaagagttttaagacaattggagtaaagatctactcctttggcctgggaggtcgctttcttttcgcttccgtaatggctgacaaggatactacacgcagaatccacgtcagtacagaccagggcgacacatggagcatggcccagctgccgagcgtgggtcaggaacaattctactccattctggctgccaatgatgatatggtttttatgcacgtggacgagccgggtgacaccggtttcggcacaatttttacctctgacgacaggggcatagtctatagcaaatctcttgaccgccacctctacactaccacgggaggtgagacagactttacaaacgtaacgtccctgcgcggagtgtatatcacatccgtcctctctgaggacaattccattcaaaccatgataacatttgaccaaggaggtcgctggacacatcttaggaaaccagagaacagcgaatgcgacgcaaccgctaagaacaagaacgagtgttcactccatattcatgcttcctacagcatctctcaaaaattgaacgttcccatggccccattgtctgagccgaacgccgtgggcatcgtgatcgctcacggctcagttggagacgctatctcagttatggtccccgacgtatacatatcagacgacggaggttatagctggacaaagatgctggagggcccccactactacaccatcctggacagcggcggtattatcgtggccatcgagcactcttcaagacctattaatgtcattaaattcagcactgacgagggccagtgctggcagacgtatacattcactagggatcccatctactttactggactcgccagcgagccgggcgcaagatcaatgaacatctctatttggggattcacagagtctttcctcaccagtcagtgggtgtcatacaccatagactttaaagacatcctcgagagaaactgcgaagagaaagactacaccatctggttggcccattcaactgacccggaggactacgaggatggttgtattctgggatacaaggaacagttcctcaggctcagaaagtcaagtgtatgccagaacggcagggattatgtcgtcactaagcagccctctatttgtctgtgttccctggaggactttctctgcgattttggctattacaggccagaaaacgatagcaagtgcgtggagcaacctgagcttaagggccacgaccttgagttttgtctctacggtagagaggaacatctgaccactaatggatacaggaagattccaggcgataagtgtcagggaggtgtaaaccccgtaagggaagtaaaggacctgaagaaaaaatgcacttcaaactttctgtcccccgagaaacagaactctaagagtaactccgttccaatcattctggccatcgtcggtctgatgctggtgaccgtggtggccggagtattgattgttaagaagtacgtatgtggcggtcgcttcctggtacacaggtattcagtgttgcagcagcacgctgaggcgaatggcgtcgacggtgtggacgcacttgacactgcaagccacacgaataagtctggataccatgacgattctgacgaggatctcttggag

SEQ ID NO: 19651 - DNA, 2082 bp, Artificial Sequence
  Description of Artificial Sequence: Synthetic coding sequence
atgacctttggtcaatccaagttgtacagaagcgaagattacggtaagaactttaaagacattaccgaccttatcaataacacctttattcgcaccgaattcggaatggccattggcccagaaaactccggtaaggtggtgttgaccgcagaggtgtcgggcggctcgcgtggtggacggatctttagatcgtccgactttgcaaagaactttgtgcagaccgatctcccctttcatcccctcacccagatgatgtattcaccacaaaattcagactacctgctggccctgtcgaccgaaaatggtctttgggtcagcaagaacttcggtggcaagtgggaagaaatccataaggcagtctgtcttgctaagtggggctcagataatacgatcttctttacgacctacgcaaatgggagctgtaccgatttgggagccctggaactttggcgcacttccgatctgggtaagtcctttaagacgattggcgtgaagatctacagctttggacttggaggaagatttctgtttgcctccgtgatggcggacaaggataccacccgccgtatccatgtctccactgatcagggagacacttggtcgatggcacagctgccctcggtcggacaagagcagttttactcgatcctggccgcaaatgatgacatggtgttcatgcacgtcgatgaaccaggtgataccggctttggaaccattttcacgagcgatgaccggggaattgtctactcgaagtcgcttgacagacatctgtacaccactaccggcggagagactgattttactaacgtgacttcccttaggggagtctacataacttcggtgctttcggaagataatagcattcaaacgatgattactttcgatcagggtggacggtggactcacctcagaaagcctgaaaattctgagtgtgatgcaactgcaaagaataagaacgaatgttcactgcatatacacgcatcgtactccatctcccagaagctgaatgtgccaatggcgcccttgagcgaaccaaacgcagtgggtatcgtgatcgcacacgggtcggtcggtgacgccataagcgtgatggtccctgatgtttacattagcgacgatggtggttactcgtggactaaaatgcttgaaggtcctcattactataccatcctcgactcaggaggcattattgtggctatcgagcatagctccagaccaattaacgtgatcaagttttcgaccgatgagggtcagtgctggcaaacctacactttcacccgagatccaatttacttcaccggtctggcgtcggaaccaggtgctcggtccatgaacatctcaatctggggatttactgagtcgtttctgactagccaatgggtttcatacactatcgactttaaggatattctcgagagaaactgtgaagagaaagactataccatttggctggcacacagcactgatcctgaagattacgaagatggttgtatactcggatataaggagcaattcctgaggcttcggaaatcctcagtgtgccaaaatggacgagattacgtggtgaccaagcaaccaagcatttgtttgtgctcgctggaagattttctctgtgacttcggctactaccgcccagaaaacgactccaagtgcgtggaacaacctgaactcaagggacacgatctggagttttgtctttatggaagggaggaacatctcactactaatggatacagaaaaatccctggagataaatgccagggaggggtgaacccagtgcgggaagtgaaagacctgaagaaaaagtgtacgtccaatttcctttcaccagaaaagcagaattccaagagcaattcggtcccgatcattctcgcaatcgtcggattgatgctggtcactgtggtggccggtgtccttattgtgaaaaagtacgtgtgcggtggtcggtttctggtccataggtactcggtgctgcagcaacacgcggaagcaaacggtgtcgatggcgtggatgccctggacaccgcctcccacactaacaaatctggataccatgacgatagcgacgaggacttgcttgaa

SEQ ID NO: 19652 - DNA, 2082 bp, Artificial Sequence
  Description of Artificial Sequence: Synthetic coding sequence
atgaccttcgggcagtctaagctctacagaagcgaggactacggcaagaatttcaaggatattactgacctgatcaacaatacttttattcggactgaattcgggatggctatcggccctgagaattcaggaaaagtggtcctgaccgccgaagtgtcgggtggatcgcgcggaggaaggatcttcaggtcctccgactttgcgaaaaacttcgtgcaaaccgatctcccgttccacccactgacccagatgatgtactcgcctcaaaactccgactacctgctggccctgtcgactgagaacgggctctgggtgagtaagaatttcggaggcaaatgggaggaaatccacaaagccgtgtgtctggcgaagtggggttccgacaataccattttcttcaccacttacgctaacggctcctgcacggacttgggagcactggagctctggcggacctcggacctcggtaagtcgttcaaaactatcggagtgaagatctacagcttcggattgggaggcaggttcctttttgccagcgtgatggcggacaaggataccactaggagaatccacgtgtcgaccgaccaaggagacacctggtcaatggctcagctgccgagcgtgggtcaggaacagttctactccatcctcgcggccaacgatgatatggtcttcatgcatgtggacgagcccggggatactggatttggtactatcttcacttcggatgaccgcgggattgtctactcgaagtcgctggacagacacctctacactaccactggaggagaaacggacttcactaatgtcacttcactgcgaggagtctacatcacttccgtgctgtccgaagataactcaatccagacgatgatcaccttcgaccaaggaggacggtggacccaccttcggaaaccagagaattcggagtgcgatgctactgccaagaacaagaatgaatgctcccttcacatccacgcatcttactcgatctcgcagaaactgaatgtgccaatggcgccactgtcagagccgaacgctgtcggtatcgtcattgctcacggctcagtgggagatgccatcagcgtcatggtgccggatgtgtacatttccgatgatggcggctactcctggaccaagatgctggaagggccgcactactacaccatcctggacagcggaggaatcatcgtggctatcgagcatagcagccggccgatcaatgtgatcaaattttcgaccgatgaaggccagtgttggcaaacctacactttcactcgggaccccatctacttcaccggcctggcctccgagccaggcgcccgctcaatgaatatctctatttggggatttacggagtcattcctcacttcccaatgggtgagttacacgatcgacttcaaagacattttggaacgcaactgcgaagagaaagactacactatctggttggcgcattccaccgatccggaggattacgaggatggttgtatcctgggatacaaggaacagttcctgcggctgcgcaaatcgtcagtctgccagaacggccgcgactacgtggtgaccaagcagccttctatttgcctgtgctccctggaagatttcctgtgcgacttcgggtactaccggccggaaaacgactcgaagtgcgttgagcaacctgagctgaagggacatgacctggaattctgcctctacggacgcgaagaacacctgaccacgaacggctaccggaagataccaggagacaaatgccagggtggggtgaatccggtgcgcgaggtgaaagacctgaagaagaagtgtacttccaatttcctgtcaccagaaaagcaaaacagcaagtcgaattccgtgcccatcatcctggcgatcgtgggcctgatgctggtgactgtggtggcgggagtcctgatcgtcaagaagtacgtgtgcggcggacgatttctggtccatcgctactccgtgctgcaacagcatgccgaagctaacggagtggacggagtggatgcccttgataccgcatctcataccaataagtcgggctaccacgacgattccgacgaagacctcttggaa

SEQ ID NO: 19653 - DNA, 2082 bp, Artificial Sequence
  Description of Artificial Sequence: Synthetic coding sequence
atgaccttcgggcagtccaagctgtacaggtccgaagactatgggaagaatttcaaggacattactgatctgatcaataatacattcatacgtaccgaatttgggatggccattggccctgagaactccggcaaggtggtgctgacggcagaggtaagcgggggtagtcgtggcgggagaatctttaggtcgtccgacttcgcaaaaaattttgtgcagactgacttaccctttcatccactgactcagatgatgtatagtcctcagaattcagattaccttcttgccctgtctaccgaaaacgggctctgggtgtccaagaatttcgggggcaagtgggaagaaattcataaagctgtatgcctggccaagtgggggagcgacaataccatcttcttcacaacctacgccaatggctcgtgcacagacctgggagcactggagctgtggcggacgtcagatttgggaaaatcttttaagactatcggcgtcaaaatttactcttttggtttaggcgggcggttcctgtttgctagcgtcatggccgacaaagacaccaccagacgaatccacgttagcactgaccaaggggatacctggtcaatggcacagcttcctagcgtgggccaggagcagttttattccattttggctgccaatgacgatatggtgttcatgcacgttgatgaaccaggcgatacaggcttcggcacgattttcacatccgacgacagagggatcgtttattctaaatcacttgaccggcacctgtacaccacaaccggcggcgagacagactttaccaacgtgacttctctgcggggtgtctacattacctctgtcctgtcagaggataattcaatccaaactatgataaccttcgaccagggtggacgctggacccatttacgcaagcccgagaattccgaatgtgatgccactgcaaagaacaaaaacgagtgctccctgcacatccatgctagttattccatctctcagaaacttaatgtgcctatggcaccgttgagtgaaccaaacgccgtaggaatagtaatcgcacacgggagcgttggagatgctatttcagtcatggtaccagacgtgtacatatctgatgacgggggctactcatggaccaaaatgttggaaggcccacactattatacaatcttggacagtggaggcataatagttgctattgaacactcctctcggcccattaacgtcattaaattctccacagacgagggacaatgttggcagacctacacttttacacgggacccaatctactttacagggctcgcttcagagcccggagcccggagtatgaacattagcatatggggattcactgagtcgttcctgacatcgcagtgggtgagttacaccattgactttaaagacatcctggagaggaattgcgaagaaaaggactatactatttggctggcccattcaactgaccccgaagactacgaggacggctgtatccttggatacaaagagcagtttctccgccttcgcaagagttcggtctgccaaaatggccgtgactatgtcgtcacaaagcagccttcaatctgtctgtgttccctggaggattttttatgtgattttgggtattacagacctgaaaacgacagtaagtgcgtggagcagcctgaattaaaggggcatgacctggagttctgcctgtacggacgtgaagaacaccttacgaccaacggctatcgcaaaatcccgggcgataagtgtcagggaggcgtcaaccccgtgcgggaggtcaaggacctgaaaaagaagtgtacttctaactttttgtctccggaaaagcagaattctaaatcgaattccgtgcctatcattcttgcgatcgtgggactaatgctcgtgacagtcgtggcaggcgtgctcattgtgaagaagtacgtgtgtggtggccgtttcctggtccatagatactcggttctccagcaacacgcggaggcaaacggtgtggatggcgtggatgccctcgatacagcctctcatactaacaagagcgggtaccatgacgactctgacgaggacctgttggaa

SEQ ID NO: 19654 - DNA, 2082 bp, Artificial Sequence
  Description of Artificial Sequence: Synthetic coding sequence
atgaccttcggacaaagtaagctgtaccgcagtgaggactacgggaagaacttcaaggacattaccgacttgatcaataatacattcatccggaccgagtttggaatggccattgggcccgaaaacagcggtaaggtggtgctgaccgccgaggtgtccggggggtcacgcggaggccgcatctttaggtccagtgattttgctaaaaacttcgtgcaaactgatcttccattccatcccttgactcagatgatgtacagcccacaaaactccgattacttgctggctctctccaccgagaacggactgtgggtaagcaagaactttggtggaaaatgggaggaaatccacaaagctgtctgtctcgctaagtggggatccgacaacactatttttttcaccacatacgccaacggctcctgtacagacctgggagccttggaactgtggagaaccagcgacctcggaaaatcctttaaaacaattggcgtcaagatctattcttttggactggggggacggttcctgttcgcctccgtcatggccgataaggatactacgcggaggatccatgtgtcaacagatcaaggagacacctggtccatggcgcagcttccctccgtgggccaggagcagttctacagcatcctcgccgcgaacgacgatatggtgttcatgcacgtggatgagcccggtgacacaggcttcggaacgattttcacatcagacgacagggggatcgtttacagcaagagcctggataggcatctctatactaccacggggggagagactgacttcacaaatgtgacctccttgcggggggtatatatcacgtccgtcctgagcgaggataactcaattcagaccatgatcacattcgatcagggcggcaggtggacgcatctcaggaagccggagaattctgaatgcgacgccactgcaaaaaataagaatgaatgttcactgcatatacacgcttcctacagtatcagtcagaagttgaacgttcccatggctccgctcagtgagcctaatgcggtgggtatcgttattgctcatggatctgtgggtgatgccataagtgtgatggtccccgacgtgtacatcagcgatgacggggggtactcatggactaagatgctcgagggcccccattactacaccatccttgattccgggggcattattgttgcaattgaacactcatccagaccaatcaatgtgattaagttctctaccgacgagggccagtgttggcagacatatacattcactcgcgaccccatctacttcacgggactggctagtgagccaggagcgcgctccatgaacatttctatctgggggttcacagaatcttttcttaccagccaatgggtaagctatacaatcgactttaaggacattctggagcgaaattgcgaagaaaaagattataccatatggctggcccattctacggatccagaggattatgaagacggatgcattctgggctataaagagcagttccttaggttgcggaagagctccgtgtgtcagaatggccgagactatgtcgtcactaaacagcccagtatatgcctctgcagtttggaagactttctctgtgactttgggtactatcgccccgagaacgattctaagtgcgtggaacagccagaactgaaaggacacgatcttgagttctgcctgtacgggcgcgaagaacatctgactactaacggttataggaagataccaggcgacaaatgccagggtggggtgaatccagtacgggaagtgaaggacctgaaaaagaagtgtaccagcaatttcttgagcccagagaaacagaactctaaaagcaacagtgttccgataatccttgccatagtgggactgatgctcgtgacagttgtggcgggcgttctgattgtcaagaaatatgtgtgtgggggacggttcctcgtgcacaggtactccgtcctccagcagcatgccgaggcaaacggtgtggacggagttgatgccctcgacaccgcaagccataccaacaagagtggataccacgacgattctgacgaagacctgctggaa

SEQ ID NO: 19655 - DNA, 2082 bp, Artificial Sequence
  Description of Artificial Sequence: Synthetic coding sequence
atgaccttcgggcagtcaaaactttaccgctcggaggactacgggaagaactttaaagatattactgatctcatcaacaacacctttatcagaaccgaattcggcatggcaatcggacctgagaactcaggaaaggtggtccttaccgcagaggtatccggaggatcccgtgggggacgcatcttcagatcgtcagatttcgctaaaaactttgtgcaaacggatcttccttttcaccctctgacccaaatgatgtactcgccccaaaactctgattatctgcttgcactcagcactgagaacggactgtgggtgtcgaagaattttggaggtaaatgggaagaaattcataaagcagtgtgtttggccaaatggggaagcgacaacactattttcttcaccacctacgcaaacggatcatgcaccgaccttggagcacttgaactgtggaggacctcggatctgggtaagtcatttaagacgattggcgtgaagatttactccttcggactcggtgggagatttctttttgcgtcagtcatggcagataaagataccaccaggcggatacatgtgtccactgatcagggtgacacctggtcgatggcccagttgccatcggtcggtcaagagcaattctactcgatcctcgcagcaaatgatgacatggtgtttatgcatgtggacgaacccggtgataccggttttggaaccattttcacctcggatgacagaggaatcgtgtacagcaagagccttgatcggcatctctacaccactacgggcggcgagactgattttactaacgtgacttcgctcaggggtgtgtatatcacctcggtgctgtccgaagataatagcattcaaactatgattacctttgaccagggcggaagatggactcatcttcgcaagcccgaaaacagcgaatgtgatgctaccgctaagaacaaaaacgagtgctcacttcatatacatgcaagctactcgatttcacagaagctcaatgtgccaatggcccctctgtccgaaccaaatgccgtgggcatcgtgatcgcacacggttcagtgggagacgccatttccgtgatggtgccggacgtgtacatttcagatgacggaggttactcctggacgaagatgctcgaaggaccacattactacaccattcttgattccggaggcataatcgtggcaatcgagcattcaagcagacctataaacgtcattaagtttagcacggatgagggacaatgctggcaaacttatacctttacccgcgaccccatatactttacggggctggcatcagagcctggcgcacggtcgatgaacattagcatttggggtttcaccgaatcctttctcacttcgcagtgggtgagctataccatcgatttcaaggatatcctggagcggaattgcgaggaaaaagactacaccatttggctggcccattcgactgaccccgaagattatgaggatggttgtattttgggttacaaggagcaatttcttaggcttagaaaaagttcggtgtgtcaaaacgggagagattacgtggtgaccaagcaaccatctatttgcctttgctcacttgaggatttcctgtgtgattttgggtactaccggccagagaacgattctaagtgtgtggagcaaccagaactgaagggccatgacctggagttttgtctttacggaagggaagaacacctgactaccaacggttacagaaaaatcccgggtgataaatgtcaaggtggtgtgaaccctgtgcgcgaggtgaaggaccttaagaagaagtgtacttcaaactttctgtcccctgaaaagcagaactcgaaatcgaacagcgtgccaattatcctggccattgtggggctgatgcttgtgacggtggtcgcgggggtgcttattgtcaagaaatacgtgtgtggaggaagatttcttgtgcatagatactcggtgcttcagcaacatgcagaagcgaacggagttgatggtgtggacgcattggacacggcgtcacatactaataagagcggttaccatgatgactcagatgaagatctcctggaa

SEQ ID NO: 19656 - DNA, 2082 bp, Artificial Sequence
  Description of Artificial Sequence: Synthetic coding sequence
atgacgtttggccagtcaaagctgtacagatcggaagattacggtaagaactttaaagatatcactgacctgatcaacaacactttcattcgcaccgagttcggtatggccatcggtcctgaaaacagcggaaaagtcgtgctcactgccgaagtctcaggagggtcgcgtggcggacgcatcttccgcagttcggacttcgccaagaatttcgtgcagacggacttgccgttccatcctcttactcagatgatgtactcgcctcagaactcggactacctgctggccctctcgaccgagaacggactgtgggtttcgaagaatttcggaggaaagtgggaggaaatccataaggcggtgtgtctggccaagtggggatccgacaacaccattttctttactacttacgccaatggatcatgcactgatctcggcgcactggaactctggcgcaccagcgatcttggaaagagtttcaaaacgatcggtgtgaaaatctactcgtttggactgggcggacggtttttgttcgcgtctgtcatggccgacaaagacaccactcggcgaatccatgtgtccaccgaccaaggagacacttggagcatggcacagttgccgtcggtggggcaagagcagttctactcgatcctcgcggccaatgacgacatggtgttcatgcatgtcgacgagccaggcgatactggattcggaactatcttcacttccgatgataggggaattgtgtactcgaagagcctggataggcacctgtacaccaccaccggtggagaaaccgacttcaccaacgtgacttcccttcgcggggtctacatcacttcggtgctgtcagaagataattccatccaaaccatgattaccttcgatcaaggagggaggtggactcacctccgaaagccagaaaattccgagtgcgacgccactgcaaaaaacaaaaatgaatgctcgttgcacatccatgcatcctacagcatctcacaaaagctgaatgtgccgatggccccgctctccgagcctaatgccgtgggcatcgtgatcgcccatggatccgtcggagatgccatttccgtcatggtcccggatgtgtatatctcagacgatggaggatactcgtggaccaagatgctggaaggtccgcattactacaccatcctcgattcgggagggattatcgtggctatcgagcactcaagccggccgatcaacgtgatcaaattctctaccgacgagggccagtgctggcaaacttataccttcacccgggatcctatctatttcactgggctggcgtctgagccaggagccagatcaatgaacatcagcatctggggattcaccgaatcgtttcttacctcgcagtgggtgtcgtacactatcgactttaaggacattctggagcgcaactgcgaagaaaaggactataccatctggcttgcccacagcaccgatccggaggattatgaggacggatgtattctcggttacaaggaacagttcctgcggctgcgaaagtcatccgtgtgccagaatggtcgggactacgtggtaaccaagcagccatcaatctgcctctgctccctggaggactttctgtgcgacttcggatactaccgcccagagaacgattcgaaatgtgtggaacagcctgagttgaagggccacgacctggaattttgtctgtatggacgcgaggaacacctgactacgaacggttacaggaagataccaggtgacaaatgccagggaggcgtgaatcccgtccgcgaagtgaaggatcttaagaagaaatgtacctccaatttcctgtccccggaaaagcagaatagcaagtcgaactccgtgccgatcatccttgcaatcgtaggactgatgctcgtcactgtggtggctggagtgttgatagttaagaagtacgtgtgcggaggacggttccttgttcacaggtactcagtgctgcaacaacacgcggaagccaacggagttgacggagtggatgctttggacactgctagccacactaataagtcgggataccatgatgattctgacgaagatctgctggaa

SEQ ID NO: 19657 - DNA, 2082 bp, Artificial Sequence
  Description of Artificial Sequence: Synthetic coding sequence
atgacattcggacaatctaaactatatagatctgaggattatggtaagaattttaaagatatcactgatttaattaataatacttttatacgaactgaattcggtatggcaataggaccagaaaatagtggaaaggttgtcttaacagcagaggtatcaggaggtagtagaggtggaagaatatttagatctagtgactttgcaaaaaactttgttcaaaccgatcttccattccatcctttaacacaaatgatgtattcaccacaaaacagtgattacttattagcattatcaactgaaaatggattatgggtttctaagaatttcggaggaaaatgggaagaaattcataaagcagtatgtcttgctaaatggggatcagataatactatattttttacaacatatgcaaatggatcttgtacagacttaggagcattagagctttggagaacttctgatcttggaaaatcattcaaaactattggagttaaaatatatagttttggacttggtgggagatttttattcgcaagtgtgatggcagataaggatacaacaagaaggattcatgttagtacagatcagggagatacatggtcaatggctcaattaccatcagtcggacaagaacaattttattctattttagctgctaacgatgatatggtattcatgcacgttgatgaacctggagatacaggatttgggacaatcttcacatcagatgatagaggaatcgtttattcaaaatcattagacagacatctttatactactactggaggtgaaacagattttacaaatgttacaagtttaagaggagtttatatcacttctgtattatctgaagacaattctattcaaacaatgattacttttgatcaaggaggaagatggacacatcttagaaaacctgaaaactcagagtgtgatgctacagcaaaaaataaaaatgaatgttcacttcatatacatgcttcttatagtatttcacaaaaacttaatgtgcctatggctccattatcagaaccaaatgcagtaggtattgttatagctcatggatcagttggtgacgctatttcagttatggttccagatgtttatatctccgatgatggaggatattcatggactaaaatgttagaaggaccacattattatacaattttagactcaggaggaattatagtcgctatagaacattcttcaagaccaattaatgttatcaaattttcaactgatgaaggtcagtgttggcaaacatatacattcactagggatccaatttatttcacaggattagcatctgaaccaggagcaagatcaatgaatatatcaatatggggatttactgaatcatttttaacctcccaatgggtttcatatacaattgattttaaggatattcttgaaagaaattgtgaagaaaaagattatactatttggttagctcatagtactgatccagaagattatgaagatggatgtattttaggttataaagagcaatttttacgtttaagaaagtcatcagtttgtcaaaatggtagagactatgtagtaactaaacaaccatcaatttgtctttgttcattagaagactttctttgtgattttgggtattaccgaccagaaaatgattcaaaatgtgtagaacaacctgaattaaaaggacatgaccttgaattctgtctttacggaagagaggaacatttaactactaatggatatagaaagattcctggagataaatgtcaaggaggagttaatccagttagagaagttaaagatttaaagaaaaaatgtacatcaaattttttaagtccagaaaagcaaaatagtaaatctaattcagttccaattattcttgctattgtaggattgatgttagttacggtagttgctggagttttaatcgttaaaaaatatgtatgtggaggtagatttttagttcatcgttattctgttttacaacaacatgctgaggcaaatggtgttgatggagtagatgcacttgatactgctagtcatactaataaatcaggttatcacgatgatagtgatgaagatttacttgaa

SEQ ID NO: 19658 - DNA, 2082 bp, Artificial Sequence
  Description of Artificial Sequence: Synthetic coding sequence
atgacattcggacaatctaaactgtacagaagcgaggactacgggaaaaattttaaggacatcacagacctgatcaacaacaccttcataagaacagagttcggcatggctattggcccagagaattctgggaaggttgtgcttacggccgaggtgtccggcgggagtagggggggcagaatctttagatcttctgatttcgccaagaacttcgtgcagacagaccttccattccacccactgacacagatgatgtacagtcctcagaactctgattacttgttagccttaagcaccgaaaacgggctatgggtaagcaaaaatttcgggggaaaatgggaggagattcacaaagccgtgtgtttagcaaagtggggaagcgataatacaatattcttcactacatatgctaatggcagttgtacagacctcggtgccctcgaactatggcggacaagtgacctgggtaaatcttttaaaacaattggggtgaaaatctactcctttgggctgggcgggcgtttcctgttcgcctccgtcatggccgacaaagacacaacacgccgcattcatgtgtccactgatcagggggacacatggtcaatggcccaactgcccagcgtcggacaggaacagttctactctattctggccgcaaatgatgacatggttttcatgcacgtggatgaacccggcgatactggcttcggaaccatcttcaccagcgatgatagaggtatagtctactctaagagcttagatcggcatctctataccaccacagggggcgaaactgatttcacaaacgtcacttcccttaggggcgtctatattacctccgtgctgtcggaggacaacagtatccagacaatgatcacctttgatcaaggggggagatggacccacctgagaaagcccgagaattcggaatgcgatgccactgccaaaaacaagaatgaatgctccttgcacattcacgcttcctatagtatatcacagaaattgaacgttcctatggcccccttaagcgaacctaacgcagtcggtatcgtgattgctcatggctccgtcggcgatgcaatctccgtgatggtacccgacgtgtacatctcggacgacgggggctactcatggacaaaaatgttggagggacctcactattatacaatcctggattcgggtgggatcatcgtggctatcgaacactcatcgagacccatcaacgtgattaagttttcaaccgacgagggccagtgttggcagacatatacctttactagagaccctatctactttacgggacttgcaagcgagccaggggcacgttcaatgaatatctcaatttggggcttcactgagagctttctgaccagccaatgggtgtcatacactatcgacttcaaggacatcctggaacggaattgcgaggagaaggattataccatctggttggcccactccactgatcctgaggattacgaagatgggtgtatactcgggtataaagaacaattcctcagacttcggaaatctagcgtttgccagaacggaagggactatgtcgtgactaagcaaccatctatttgcctgtgtagccttgaagacttcctttgcgactttggctattaccggccggagaatgacagtaagtgtgtcgagcagccggagttaaaggggcacgatctcgagttctgtctgtatgggcgagaagagcatctcaccacgaatgggtacaggaaaatcccaggggataagtgtcagggaggagttaaccccgttagggaagtgaaggacttaaagaagaagtgcacttcgaatttcctgagtcctgagaaacagaatagcaaatccaatagtgtccctattattttggcaatcgtcggtctgatgctggttacagtagtggctggagttcttattgttaagaagtacgtttgtgggggacgattccttgtgcatcgctactcagtgctccagcaacacgcagaggccaacggggtggacggagtcgatgccctggatactgcctcacacactaataagtctggttatcacgacgattccgatgaagatctgcttgag

SEQ ID NO: 19659 - DNA, 2082 bp, Artificial Sequence
  Description of Artificial Sequence: Synthetic coding sequence
atgacgttcggacagtctaagttatacaggtccgaggactacggcaaaaactttaaggacatcactgatttaatcaacaacactttcattcgcaccgagtttggaatggccatcggtccggaaaatagcgggaaggtcgtgctcaccgctgaggtatcgggaggaagcagaggtggccgcatctttaggagcagcgatttcgccaagaattttgtccagacggatttgccattccaccccctaacccagatgatgtatagcccgcagaactccgattacctgctggcactgtcaacggaaaatggactctgggtgagcaagaacttcggcggcaagtgggaggaaattcacaaggctgtgtgccttgccaagtggggatcagataacactatcttcttcacaacttatgccaacggcagttgcaccgatctgggcgctctggaactgtggcggacctctgatctcggtaagtccttcaaaactatcggggtgaaaatatactcgttcggattgggcggccggttcttgtttgccagcgtaatggccgacaaggacaccaccaggcgcattcatgtttccaccgatcagggcgatacatggtcgatggcccaactcccctccgtaggtcaagagcaattctattctatcttggccgccaacgatgatatggtgtttatgcatgtggatgagccgggcgatacgggtttcggtaccatttttacgtcagacgaccgcggcatcgtttatagtaagagcctggaccgtcacctatatactacaactggcggcgagacggacttcactaacgtcactagccttcgcggagtttatatcacgtcggtgctgtccgaggataactcgattcaaaccatgataacgtttgaccaaggcggacgatggacgcatctccgcaagccggagaattcggagtgtgatgcaacagcgaagaacaagaacgagtgctcgcttcacattcatgcctcttacagtatttctcagaagttgaacgtgcctatggcgcccctaagtgagccgaacgcggtcggaatcgttattgcccacggaagcgtgggcgacgccataagcgtgatggtgcctgatgtttatatcagcgatgatggcggatattcatggaccaagatgttggagggaccgcactactacacaatcctggactctggaggcatcatcgtggcaatagagcattcttcacgtcccatcaacgtgattaagttctcgaccgacgagggacagtgctggcagacctatacgtttacgagggatcccatatactttaccggtctggcctcggagcccggcgcccgaagcatgaatatctccatatggggttttaccgagtcatttcttacgagtcaatgggtgtcatatacgattgattttaaagacatccttgagagaaattgcgaagagaaggattataccatttggctcgcccatagcaccgacccagaggactatgaagatggttgcatcttgggctacaaggagcagtttctccgtttgcgcaagtcgtcagtttgtcaaaacggccgtgattatgtcgttaccaagcagcctagcatctgtctgtgcagcttggaagactttctgtgcgatttcggatattaccgtcccgaaaacgattccaagtgcgtggagcaacccgagcttaagggccacgatctcgagttctgtctctacggccgcgaggagcatctgacaacgaacggctacagaaaaattcccggagacaaatgccagggcggcgttaacccagtgcgcgaagtcaaagaccttaagaagaaatgcacgtcgaacttcctgagtccggagaaacagaattcaaagtccaactcggttccgatcatcctggccattgtcggcctaatgctggtcactgtcgtggccggcgtcctaatagttaagaaatacgtatgcggtggacgtttccttgtgcaccggtactcggtactgcaacagcacgccgaggctaacggtgttgacggcgtggacgcactagacactgcatctcatactaacaagagcggttatcacgacgactccgatgaggatctgctagag

SEQ ID NO: 19660 - DNA, 2082 bp, Artificial Sequence
  Description of Artificial Sequence: Synthetic coding sequence
atgacctttggacagtcaaaactgtaccggtccgaagattacggcaagaacttcaaggacatcactgacctgatcaataacacctttatccgcaccgagtttggaatggcaattggccccgagaattcgggaaaggtggttcttaccgcggaagtgtctggcggttccaggggaggcagaatctttcgctcaagcgatttcgcaaagaacttcgtccagaccgatctcccatttcaccccctcacccagatgatgtactccccgcaaaactccgattaccttctcgcccttagcactgagaacgggctgtgggtgagcaagaatttcggggggaagtgggaagagatccacaaagcagtctgccttgccaagtggggatccgataacaccatcttctttaccacctatgccaatgggtcatgcactgatctcggcgcccttgaactttggcggaccagtgatttgggcaagtcctttaagaccattggtgtgaagatctactccttcggactgggaggtcgctttcttttcgcctcagttatggcagataaggataccactaggagaattcacgtgtcgaccgaccaaggagatacctggtcaatggcacaacttcctagcgtgggccaagaacagttttactcaattttggcggccaacgatgatatggtctttatgcatgtggatgagcctggtgatactggtttcggtactatcttcacgtctgacgatagggggattgtgtactcaaagtcgttggatcgccacctgtacaccactaccggaggagagacggattttactaacgtgaccagcctgcggggcgtgtacattacctcggtcctgtcggaagataactcgattcagactatgatcacgttcgatcaaggaggacggtggacccacctgagaaagccagaaaattcggaatgcgatgcaactgctaagaacaaaaacgagtgtagcctgcacatccacgccagctacagcataagccagaagctgaatgtgccaatggcccctctgtcggaacctaatgccgtgggaatcgtcattgcccatggatcggtgggggatgcaatctccgtcatggtccctgacgtgtacattagcgatgacggtggatatagctggacgaaaatgcttgaaggcccgcattactacactattctggattccggagggattattgtcgcaatcgaacatagcagccggcctattaacgtgataaagttttcgactgacgaaggtcaatgttggcagacctacacctttaccagagatcctatttacttcactggtctggcttccgaacctggggcacgctcgatgaacatttccatctggggattcaccgaatcatttctgactagccagtgggtgtcctacactatcgactttaaggatattcttgaacgtaattgcgaggagaaagactacacgatttggcttgcgcattcgaccgatcctgaggattacgaagatggttgtattctcggttacaaggagcaatttcttagactgagaaagtcgtcggtgtgtcaaaacggtcgggattatgtggtcactaaacaaccttctatttgtctgtgtagcctggaggactttctttgcgatttcggctactacagaccagagaacgattcaaagtgtgtcgagcagcctgaacttaaaggtcacgatctcgaattttgcctctacggaagagaagaacacttgactaccaacggctacagaaaaatccccggtgataagtgtcaaggtggggtgaaccctgtccgtgaggtcaaggacttgaaaaagaaatgtaccagcaatttcttgtcgccagaaaagcaaaattctaagagcaattccgtccccattattcttgcaattgtcggtctgatgcttgtgactgtcgtggcaggagttttgatcgtgaagaagtacgtttgcggaggccgctttctggtgcatcgctacagcgttctgcagcagcatgccgaagctaatggtgtcgacggtgtggatgcgctggataccgcctcgcatactaacaaatcgggataccacgatgattcagatgaagatctgctcgag

SEQ ID NO: 19661 - DNA, 2082 bp, Artificial Sequence
  Description of Artificial Sequence: Synthetic coding sequence
atgacctttggccagtccaagctttatcgatctgaagactatgggaagaattttaaagacataacagacttaattaataacactttcatacggacagaatttggaatggccatcggcccagagaactccggcaaggtggttctcaccgctgaagtgtctggcgggtctcgcgggggcagaatttttaggtcttccgattttgctaagaactttgttcagactgacttacccttccaccctcttacacagatgatgtacagcccacagaactctgactacctgctagccctcagcaccgagaatggactatgggtctctaagaatttcggaggcaaatgggaggaaattcataaagctgtttgcttggcaaaatggggctcagacaacaccatcttcttcacaacttatgctaacggatcttgcacagacctcggggcactggaactctggcggacttccgacctaggcaaaagtttcaagacaatcggcgtgaagatatactccttcggcctgggcggccgatttctatttgcatctgtgatggcagacaaggataccacccggagaatacacgtgtccactgaccagggggatacttggagcatggcccagctgcccagtgttggccaggaacagttttattcaattctagcagccaacgacgacatggtgttcatgcacgttgatgagcccggagatacaggttttggcaccatcttcacctctgatgatcgtggtatcgtgtacagcaagtctttagaccgtcacctatatacaaccactgggggggagaccgacttcaccaatgtgacttctctgcgtggagtgtacattacatccgtattaagcgaggacaattctattcagaccatgattacattcgaccagggcggcagatggacacacctgaggaaacctgaaaattctgagtgtgacgcaaccgccaagaataaaaatgagtgcagcctgcacatacacgccagttattctataagtcagaaactgaatgtccctatggcacctctctccgagcccaatgccgtcggaatagtgatagcacatggctctgttggcgatgccatatcagttatggtcccagacgtctacatatctgatgacggcgggtactcttggactaaaatgctagagggcccacattactacaccattctcgacagcggcggcatcattgtggcaattgaacacagctccaggccaattaacgtgataaaatttagcacagatgaagggcagtgctggcagacttacacattcaccagagaccccatatactttacagggctcgcctcagaacccggagcaaggtccatgaacatctccatttgggggtttactgagagttttcttacatcacagtgggttagctacaccattgactttaaagacattttagaacgcaattgtgaggagaaggactataccatctggctggcacactcaaccgatcccgaagactacgaggatgggtgtatcctgggctataaggaacagttccttagactgcgaaagtcttctgtttgtcagaatggacgggactatgtggttaccaaacaaccatccatatgtctgtgtagcttagaagactttctgtgtgacttcggctactacaggcctgagaatgatagcaaatgcgtggaacagcccgagctcaaaggtcacgacttagaattttgcctatacggccgggaggaacacctcactaccaatggttataggaagatacctggcgataaatgccaggggggtgtcaatccagttcgcgaagtgaaggatctgaagaaaaagtgtacttccaacttcttaagtccagaaaaacagaatagcaagagtaatagcgttcctataattctggccattgtgggcttgatgctggtgacagtcgtggctggggttctgattgtgaaaaagtacgtgtgtggcggtcggtttcttgttcatagatattctgtactgcagcagcatgccgaagctaacggcgtcgacggggtcgatgccctggatacagccagccacacaaacaaatccggataccatgacgattccgacgaggacctgctggaa

SEQ ID NO: 19662 - DNA, 2082 bp, Artificial Sequence
  Description of Artificial Sequence: Synthetic coding sequence
atgacctttggacaatcaaagctgtaccgttcggaggactacggcaaaaacttcaaagacattactgaccttatcaacaacacctttatccgtactgaatttggaatggctatcggaccagaaaactcgggcaaggtggtcctgaccgccgaagtcagcggtggatcgaggggaggacgcatctttcggtcgtcagattttgcgaagaattttgtgcaaaccgatctgcctttccatccactgacccaaatgatgtactcgcctcagaattccgattaccttctggcactgtccactgagaatggactgtgggtttcgaagaactttggtggcaaatgggaggaaatccacaaagcagtgtgcttggctaaatggggttcagacaacacgatattctttaccacctacgcgaacggatcgtgtaccgatctgggagctcttgaactttggcgcaccagcgatctgggtaagtcattcaagactattggcgtcaagatttacagctttggccttggagggaggtttctttttgcctccgtcatggcagataaagacaccactagaagaattcacgtgtcaaccgaccaaggagatacttggtccatggcccaactgccgtcggtgggtcaggaacagttttactccattctcgcggccaatgatgatatggtgtttatgcatgtcgacgaacctggtgacaccggatttggaacgattttcacgtccgacgatcgcggtatcgtgtattcgaaatccctggataggcacctttacaccactactggcggcgagactgattttaccaatgtgacctcattgcgaggcgtctacattacttcagtcctctctgaggacaattccatacaaactatgatcacctttgatcaaggcggtcggtggactcatctgcggaagccagaaaatagcgaatgcgatgcaaccgcaaagaacaagaatgaatgtagccttcacatccatgcatcctacagcatttcgcaaaaactgaatgttcctatggctcctcttagcgaaccaaacgcagtgggtattgtgattgcacatggcagcgttggtgacgccatttccgttatggtgcccgatgtgtacatttcggacgatggaggctactcttggaccaaaatgttggaaggcccccattactacactatactcgattcgggtggaatcatagttgctattgaacattcgtcgcgccccattaacgtgattaagttttcaaccgacgaaggccaatgctggcagacctacacttttacccgggatcctatttacttcaccggtttggcatccgagccaggtgcaagatcaatgaacatttccatctgggggtttactgaatcctttcttactagccagtgggtttcatatactatcgactttaaagatatcctcgagcgaaactgtgaagaaaaagattacaccatttggctcgctcactcaacggatcctgaggactacgaagatgggtgcattttgggatacaaagaacaattcttgcgtctccggaaatcgtccgtctgtcagaacggcagagattacgtcgtcactaagcagccgtcaatctgtctctgctccctcgaggactttctttgtgatttcggatactaccgcccagaaaacgactccaaatgtgtggagcaaccagagctgaagggccatgatctggaattttgtctttatggtagagaagaacatcttaccactaatggctacagaaagataccaggtgataaatgtcaaggcggcgtgaacccagtccgcgaggtgaaggacctcaagaagaaatgtacctcgaatttcctgtcacccgagaaacaaaattcgaagtcaaacagcgtgcccattatcctcgccatcgtgggtctgatgctggtgactgtggtggcaggtgtgctgattgtgaagaagtacgtctgtggcgggagatttctcgtgcacaggtacagcgtccttcaacaacatgcagaagccaacggggtggatggagtggacgcactggatacggcatcgcatactaacaagtcgggctaccacgacgacagcgacgaggatctgctcgaa

SEQ ID NO: 19663 - DNA, 2082 bp, Artificial Sequence
  Description of Artificial Sequence: Synthetic coding sequence
atgacattcggacagagtaagctgtacaggtccgaggactacggcaagaattttaaggatatcactgaccttataaacaacaccttcataaggactgaatttggaatggctattgggcctgagaactctgggaaagtggttctgaccgctgaggtgagcggtggctctcggggcgggaggatctttaggtctagtgatttcgcgaagaacttcgttcagactgacctcccttttcatcctctgactcagatgatgtacagccctcagaactcggattacctcctggccctctccaccgagaatggcctctgggtgagcaagaattttggcgggaagtgggaggagatacataaggccgtgtgtctcgctaagtggggctctgacaatactatcttttttaccacttacgccaacgggagctgcaccgacctcggagcactcgaactctggagaacaagcgacttagggaagtctttcaaaactatcggggttaaaatctactcattcggactgggcgggcggtttctgttcgcttctgtcatggccgataaggacactacgaggaggatccatgtatccacagatcagggcgatacctggtcgatggctcagctgccctccgtcggtcaggaacagttctactcgatcctcgcagccaatgacgacatggtctttatgcatgtcgacgaacccggagatacaggatttgggacaatctttacctcagacgaccggggcatcgtgtatagcaaatcattggatcggcacctctacaccacaacgggtggtgagacagacttcacgaatgtcaccagtttgagaggggtttacatcacatcagtgctctctgaggataattcgatccagacaatgattacttttgaccagggcggaaggtggacccatcttcggaaacccgaaaatagtgagtgtgatgctactgccaagaacaagaatgaatgctctctccatatccatgcatcctatagtattagtcagaagcttaatgtgcccatggccccactgtccgagcccaatgccgtgggaatcgtcatagcacacgggagcgtgggtgatgccatctccgtgatggttcccgacgtctacatctctgatgacggcgggtatagctggaccaaaatgctcgaaggcccacactactacactatcctggattcaggtggaatcattgtcgcaattgagcactcatcccgtcccattaatgtaataaagttttccaccgacgagggacagtgctggcagacgtacacttttactagagatcctatatatttcacaggtctggcatcagagcccggggcccgatccatgaacattagcatctggggctttacagagtccttcctgacaagtcagtgggtgagctacaccattgattttaaggatatcctggaaaggaactgtgaagaaaaggactacacaatttggctggcccattccacagaccccgaggactatgaagatggttgcattttgggctacaaggagcagtttctgcgccttcgcaaatcctccgtatgtcaaaatggaagggactacgttgtcacaaagcagccttcaatctgtttgtgttccctggaggatttcctatgcgatttcgggtactaccggccagagaacgattccaagtgtgtggagcaacctgagctcaagggccatgacctggagttctgtctgtacggccgcgaggagcatctgaccactaatgggtaccgaaaaatccctggggataaatgtcaggggggggttaatcccgtgagagaagtgaaagacctaaagaaaaagtgtacctccaatttcctgagcccagaaaagcagaactctaagagtaattcagtgcccattatcctggcaattgtggggctgatgttggttaccgtggtcgccggagtgctgatcgtgaagaagtatgtctgtggaggcagattcctggtgcaccggtactcagttttgcagcagcacgccgaggccaatggcgtggatggagtagacgcattggatactgcaagccacaccaataaaagtggttaccatgacgactccgatgaggatctcctggag

SEQ ID NO: 19664 - DNA, 2082 bp, Artificial Sequence
  Description of Artificial Sequence: Synthetic coding sequence
atgaccttcggacagtccaaattgtataggtctgaagattatggtaaaaactttaaggacatcaccgatctcatcaataacacgttcattcgaacagagttcgggatggccatcggacccgaaaacagtggaaaggttgtgctgacagcagaggtcagcggaggcagccggggagggagaatcttccggtcctcagatttcgctaagaacttcgtgcaaaccgacctgccctttcaccccctcactcagatgatgtactctcctcaaaactccgactatctgctggccctcagtaccgagaacggtctgtgggtgagcaagaatttcggcggcaaatgggaggagattcataaggcagtatgtctggccaaatggggttccgacaacaccatcttctttactacttacgcgaatggatcctgcaccgacctgggggctttggaattgtggaggacctcagatctgggtaagagctttaaaacaatcggtgtgaaaatatactccttcggtttgggtggtcgctttctttttgcatcagtgatggcggacaaggacacaacacgcaggatccacgtttccactgaccagggagatacatggtcaatggcccaactgccctccgtgggtcaggagcagttctattctattctcgctgcgaacgatgacatggtattcatgcatgtcgatgaaccaggtgacaccggcttcgggacaattttcacatccgatgacagagggatagtgtatagcaaaagcctggatcgacatctgtacactacaaccgggggagaaaccgactttaccaacgtcacttccttgcggggagtatacattacaagcgtcctctctgaagacaactccatccagactatgattacattcgaccagggggggaggtggacacatctcaggaagcctgaaaactcagaatgtgacgcaacagccaagaacaagaatgagtgctctctgcatattcatgcaagctattctatttctcagaagctgaatgtgcctatggctccgctgtctgagcctaacgcagtgggcatcgtaatcgcccacggatccgttggcgatgcaatcagcgtgatggtgcccgatgtgtacatctcagatgacggcggctatagctggacaaaaatgctcgaggggccacactactacactatactcgatagtggtggaatcatcgtggctatcgagcacagctcacgacccatcaatgtgatcaaatttagcactgacgaaggccaatgctggcaaacctacacatttacacgagacccgatctactttaccggcctggcctctgagcctggggcaaggtctatgaatattagcatttggggtttcaccgaatctttcctgaccagccaatgggtaagctataccatcgacttcaaggatatccttgagagaaattgcgaagaaaaggactacaccatctggctcgcacacagcactgaccccgaggactacgaggatggatgcattttgggctacaaggaacagtttcttagacttcggaagtctagcgtctgccagaacggacgcgactatgtagtcacaaagcagcctagtatctgcttgtgttctctggaagactttctctgcgattttggatattataggcctgagaatgattcaaagtgcgtggagcagcctgaacttaagggtcatgatcttgagttctgtctttatggacgcgaagaacacctgaccacaaatggttaccggaagatcccaggggacaaatgtcagggcggggtgaacccagtcagggaagtgaaagatctgaagaagaagtgcacctctaactttctctccccagagaagcaaaactcaaagtctaacagtgtgcctattatcttggcgatagtggggcttatgctggtcaccgtagtggctggagtactgattgtgaagaaatacgtttgtgggggtcgctttctggtccatcggtattcagttttgcaacagcatgcagaggctaacggcgtggatggcgtggatgctttggatactgcctcccatacgaacaaaagtggttaccacgacgactccgatgaagacctcctcgag

SEQ ID NO: 19665 - DNA, 2082 bp, Artificial Sequence
  Description of Artificial Sequence: Synthetic coding sequence
atgaccttcggccagtccaagctctatcggagcgaggactacgggaagaatttcaaggatatcactgacctgatcaataacactttcatccggacagaatttggaatggcgattggcccagagaattccgggaaagtggtcctcaccgccgaagttagcggcggctcgagaggaggcaggatctttcgttcatcagactttgcaaaaaatttcgttcagaccgatctaccattccaccccctcactcagatgatgtattcgccacagaactccgactacctgctcgctctgtccaccgagaacggcttgtgggttagtaagaattttggcggaaaatgggaggaaatacacaaagccgtgtgcctggcaaagtggggcagcgataacactattttttttactacctacgctaatgggtcctgtacggatcttggagctctcgaactttggcgcacctccgatctgggaaagtcattcaagactatcggcgtgaaaatctattctttcggtctgggaggaagatttctcttcgcttccgtcatggcggataaggacaccacgaggagaattcacgtgtcgaccgaccagggcgatacgtggagcatggcacagcttccttcagtgggacaggaacagttctattcaatcctagccgccaatgatgacatggtgtttatgcatgtcgatgagccaggcgataccggcttcggcaccatcttcacctctgacgatcggggaatcgtgtactctaagtcattggatcgccatctgtataccactacaggtggagaaacagactttaccaacgtcacaagcttaaggggcgtgtacattacatcggtgttgtcagaggataactcgattcagacaatgatcacgttcgaccagggcggtcgttggacacacctgaggaaacctgaaaatagcgaatgcgacgcgaccgctaaaaacaagaacgaatgttctttgcatatacatgcgagttacagcatcagccagaagctgaacgtgccgatggccccactctccgagccgaacgccgtgggcatcgtaatagctcacggctctgtaggcgacgccattagcgtgatggtgccagatgtctatatttccgacgacggaggctactcatggacaaaaatgctcgagggaccgcattattacactatcctcgactccggcggaataattgtggcaatcgagcatagttcacgccctatcaacgttataaagtttagtactgacgagggacagtgctggcaaacctatacttttacacgagatcccatttactttaccggcctggccagtgaacccggcgccagatccatgaacatctccatctggggctttacagagtccttcctgaccagtcagtgggtgtcatatactattgactttaaagatattcttgagagaaattgcgaggagaaggattatacgatatggctggcccacagcaccgatcctgaggattatgaggatggctgtatattgggctataaagagcagttcctgaggttgcggaagtcctctgtgtgccaaaatggccgcgactatgtcgtgacaaaacagcccagtatttgtctgtgctccctggaggattttctctgcgacttcgggtattatagacctgagaatgattcgaagtgtgtggagcagcccgaattgaagggacacgatctcgaattttgcctgtatggccgggaagagcatctgacaacaaacggatacaggaaaattcccggcgataagtgccagggcggtgtgaatcccgtacgggaagttaaagacctcaagaagaaatgtacatccaattttctcagtcccgagaaacagaacagcaagtcaaatagtgtgcctattatactggcaatagtgggactgatgcttgtgactgtggtcgccggagtgttgatcgtcaagaagtacgtgtgtggtgggaggtttctggtccacagatatagcgtcttacagcagcatgcggaggctaatggggtagacggcgtggatgccctggacacagcctcccatactaataagagtggctatcatgacgactcagacgaggacctgctggag

SEQ ID NO: 19666 - DNA, 2082 bp, Artificial Sequence
  Description of Artificial Sequence: Synthetic coding sequence
atgacctttggccagagcaagctatatcgaagcgaggattacggaaaaaactttaaagatataacagacctgattaacaacacttttattcggacagagttcgggatggctatcggacccgagaactctgggaaagtcgtccttactgcagaggtgtccgggggctctagaggcggacgtattttccgcagcagtgatttcgcaaagaactttgtgcagacagatttgccattccatccgctgactcagatgatgtactctcctcagaactcggattatctgctggccctatccaccgagaatgggctttgggtgtccaagaactttggcggcaagtgggaggaaatccataaggcagtttgcttagccaagtggggctccgacaacaccatcttctttaccacctacgccaatggcagttgtactgatctcggggcattggagttgtggcgaacatccgatctgggaaagtccttcaaaactattggcgttaaaatatattcctttggattgggaggaaggtttctgtttgcctcagtgatggccgacaaagatacaacccggcgcattcacgtctccactgatcagggagacacttggtccatggcccaacttccatccgtcgggcaagagcagttttattccatcctggctgctaatgacgacatggtctttatgcatgtggacgagcccggggatacaggattcgggacgatctttacgagcgatgatcggggcatcgtgtactctaagagtctagacagacacctgtatacaactaccggcggggagacagactttaccaacgtgacaagtctgaggggggtgtatataaccagcgtgctgtctgaggataattcaattcaaactatgataacattcgatcaaggcggccggtggacccacctccgaaagcccgagaactcagagtgtgatgccaccgccaagaataaaaacgagtgttcccttcacatacatgcttcttattcgatctcacagaagctgaacgtgcctatggccccactgagtgaacccaacgcagttggtatcgtgattgctcatggcagcgtcggggatgcaatttcagtgatggtgcctgacgtgtatatctccgatgatggcggttactcatggactaagatgcttgaggggccccactattacacgattctcgattccggcgggattatagtggcgatcgagcacagctccaggcccattaatgtaataaaattcagtaccgacgagggccagtgctggcagacctacactttcacccgcgaccccatttacttcaccggccttgcgtctgaaccgggagccagatctatgaacatctccatttggggcttcactgagagttttctgacgtcccagtgggttagctacactatagacttcaaagacatattggagcgcaattgtgaggagaaagactatacaatttggctggcacattctaccgaccccgaggactatgaagacggctgtattctggggtataaagagcagttcttacgcctgagaaagtcgagcgtctgtcaaaacgggagggattatgtggtgaccaagcagcctagtatctgcctgtgttccttggaggattttctgtgcgattttggttattaccgaccagagaatgattcaaaatgcgtagagcaacccgagctgaaaggacatgatctggaattttgcctgtatggaagggaggagcacctcactactaatggatacaggaagattcctggcgataaatgccagggtggggtaaaccccgtgcgcgaggttaaggatttaaagaagaagtgcactagcaatttcctgtcacccgaaaagcagaatagcaaatccaatagcgtgccaattattctggccattgtcggattgatgctggtgacggtggtggccggcgtgctcatcgtcaagaaatacgtttgtggtggacgctttttggtgcatcggtattccgtactgcagcagcatgccgaggctaatggggtcgacggagtagatgccctggatacagcttcccatactaacaagagcggctaccacgacgactctgacgaagatctgctggag

SEQ ID NO: 19667 - DNA, 2082 bp, Artificial Sequence; identical to SEQ ID NO: 19644
  Description of Artificial Sequence: Synthetic coding sequence

SEQ ID NO: 19668 - DNA, 2082 bp, Artificial Sequence
  Description of Artificial Sequence: Synthetic coding sequence
atgaccttcgggcaatctaagttgtacagatcggaggactacggaaagaacttcaaggatattactgaccttatcaataacactttcatccgaaccgagtttggaatggcgattgggccagagaactcaggaaaggttgttctcaccgcagaagtgtccggcggatcacgcggcgggaggatttttcgtagtagcgactttgctaagaatttcgtccagactgatcttcctttccatccactgactcaaatgatgtatagcccacaaaactcggactaccttctcgcgctttctactgaaaatggcctttgggtgtccaaaaacttcggtgggaagtgggaagaaattcataaggccgtgtgtcttgcaaagtggggttcagacaatactatctttttcaccacttacgcaaacggaagctgtaccgatctgggggcccttgaattgtggaggacctcggatctcggaaaatcatttaagactataggggtgaagatttacagctttggactgggaggccggtttctctttgcatccgtgatggcagacaaggatactacccggagaatccatgtgtctaccgaccagggggacacctggtcgatggcacaactgccatcagtcggacaggaacagttttacagcatcctcgcagcaaatgatgatatggtgtttatgcatgtggatgaaccaggagacaccggatttggtactatattcacttccgacgatagaggtatcgtgtactcgaagtccctggatagacatctgtacacgaccactggcggtgaaacggactttactaacgttacgtcattgaggggagtgtacattacttccgtgctgtccgaagataactctattcaaaccatgatcaccttcgatcagggcggacgatggacccatctgcgcaaacctgaaaactcggaatgtgatgcaactgccaagaacaaaaacgaatgttcattgcatattcacgccagctattcaatatcgcaaaaactcaacgtgccgatggcacctttgtccgagcctaacgcagtcggaattgtgattgcacatggcagcgtgggcgatgcaatctcggtgatggttcccgacgtctacatctcagacgatggaggatactcatggaccaagatgcttgagggtccgcattactacactatacttgattccggaggcatcattgtggcgatcgaacattcgtcccggcctatcaatgtcatcaaattctccactgatgaaggacaatgttggcagacctacacttttacccgcgaccctatttacttcactggactcgcatcggaaccaggagcacgatcgatgaacatctcgatatggggtttcacggaatccttcctcacctcccagtgggtgtcgtatactatcgacttcaaggacattctcgagcgcaattgtgaagaaaaagattacacgatttggctcgcacacagcacggatccagaggactacgaagatggctgtatactgggttacaaagaacaatttctcagactgagaaaatcgtccgtgtgtcagaacgggcgcgattacgtggtcaccaagcagccctccatctgcctttgttcgctggaagatttcctgtgcgatttcgggtactacagacctgaaaatgattccaaatgtgtggaacagccagagctgaagggtcatgacttggagttttgtctgtacggaagggaggagcacctcactaccaatggataccgcaagattccaggggacaagtgtcaaggaggagtgaaccctgtcagagaggtcaaggaccttaagaagaaatgcacttctaatttcttgagcccagaaaagcaaaacagcaaatccaactcggtccccataattctggcgatcgtgggactgatgctcgtcactgtggtcgcaggagtgttgatagttaagaaatacgtctgtggaggtcgctttctggtgcataggtactcagtgctgcagcagcatgcagaggcaaacggagtcgatggagtggatgccctggatactgcatcgcataccaacaagtccggataccacgacgattcagacgaggatctgctcgaa

SEQ ID NO: 19669 - DNA, 2082 bp, Artificial Sequence
  Description of Artificial Sequence: Synthetic coding sequence
atgacgtttggtcagtcgaagctctatcgcagcgaagactatggaaagaatttcaaggatatcactgatttgatcaacaacaccttcatccggaccgagtttggtatggccatcggtccagaaaactctggcaaggtggttctgaccgccgaagtctctggcgggtctcgcggtggtcgcatcttccgctcttctgacttcgccaagaatttcgttcagaccgacctgccattccacccgctgacccagatgatgtacagcccacagaattcagactatctgctcgctctgtctaccgaaaatggtctgtgggtatcgaagaatttcggtggaaaatgggaagagattcataaagcagtttgcctggctaagtgggggagcgacaacacgatttttttcaccacttacgcgaacggttcgtgcacggacctgggcgccctggaactgtggcgcacatcagatctgggaaagagctttaaaaccattggtgtgaagatttacagctttgggttgggtggacgcttcttgttcgctagcgtgatggcagataaggatactactcgtcgcatccacgtcagcacggatcagggcgatacctggtctatggcgcagttgccttcagttggtcaagaacagttctactctattttagctgctaacgatgatatggtgttcatgcatgtcgatgagccaggcgacacgggttttggcaccatcttcacctccgatgatcgcggtatagtctacagcaagtctctggaccgccatttgtacacgaccactggtggcgagaccgacttcaccaatgttacgagtctgagaggtgtctatattacttccgttctgtccgaagataacagcattcagacgatgatcacgttcgaccagggcggccgctggacacatcttcgcaaaccagaaaatagcgaatgcgacgctactgcgaagaataaaaatgaatgtagcctgcatattcatgcgagctacagcatcagtcagaagcttaatgtgccgatggcgcctctttctgaaccaaacgccgttggcattgtcatcgctcatggttccgtcggtgatgccatcagcgttatggtgccggacgtttatattagcgacgacgggggctatagctggactaagatgctggagggaccacattattacacgattctggatagcggtggaattattgtggctattgaacattcatcaagaccaatcaacgttatcaagttttccaccgacgaaggtcaatgctggcaaacgtacacttttacgcgtgacccaatttacttcacgggactagcctccgagcctggtgcaagaagcatgaacatttccatctggggttttaccgaaagcttccttacctcacagtgggtcagctacacgatcgatttcaaagacatcctggagcgcaactgcgaggaaaaagattataccatctggctggcgcatagcactgacccagaggattatgaggatgggtgtatcctggggtataaagaacagttcctgcgactccgtaaatcaagcgtctgccagaatggccgcgattacgtagttactaaacagccgtctatctgtctgtgctcattggaggacttcctgtgtgactttggttattacaggcctgaaaacgatagcaaatgtgttgagcagccagagctgaagggccatgacttggagttttgcctgtatggacgagaagagcacctgacgaccaacggctaccgtaagatcccgggtgataagtgccagggtggggtcaaccctgtgcgcgaagtgaaagacctgaaaaaaaaatgtacctcgaacttcctaagtccagagaaacagaattcgaagtctaacagcgtgccaattattctggcaattgtcgggctgatgctggttaccgttgtggctggggtgctgattgtgaaaaagtacgtttgcggcggtagatttcttgttcaccgctattctgttttgcagcagcatgccgaagcgaacggtgtggatggagtagatgctctcgatacggcttcccataccaacaaatctggttaccacgacgacagcgacgaagacctgctggaa

SEQ ID NO: 19670 - DNA, 2082 bp, Artificial Sequence
  Description of Artificial Sequence: Synthetic coding sequence
atgacatttgggcaatcaaagctgtatcggtcggaggattacgggaaaaactttaaggatattaccgacctgatcaataatacatttataagaactgagttcggcatggcaatcggccctgagaactctggaaaggtcgtcctaacagccgaggtgagcggtgggtcacgggggggccgtatattcagaagtagtgacttcgcaaagaactttgttcagactgatctcccatttcatcctctgactcagatgatgtactctccccagaattccgattatctgttggccctctctacagagaatggtctgtgggtcagcaagaatttcggagggaaatgggaggagatccataaggccgtttgcttggccaaatggggcagtgataataccattttcttcacaacttatgccaatgggagctgcaccgacctcggagcactggagctgtggcggacttccgatcttggaaaatcctttaagaccatcggcgtcaagatatactcctttgggctggggggtcggtttttgttcgccagtgttatggcagataaagacaccactcgacgcatccacgtttctactgaccagggagacacatggagcatggctcagttgccgtccgtgggacaggagcagttctactctattctggcagctaatgacgacatggtgttcatgcacgttgatgaacctggagacacaggcttcggtacaattttcacctccgatgatagaggtattgtgtattctaagtcactcgataggcatttatacacaaccacagggggagagaccgattttactaatgttacctcactaagaggggtctacattaccagcgtcctgagcgaagataattcgattcagaccatgattacattcgaccagggaggcagatggacacacttaaggaagccagaaaactctgaatgcgacgccaccgccaagaacaagaacgaatgttcactacatatacacgccagttattcaatttcacagaagctgaatgtgcctatggcaccactgtctgagccgaacgccgtgggaatcgtgattgcccacggttcggtgggggacgcaatctccgtgatggtgcctgacgtttatattagcgacgatggcgggtactcgtggactaagatgttggaaggtccccactattacacaatcttagattccggggggatcatagtcgcaatcgagcatagcagtagacccattaacgtaatcaaattttccacagacgaggggcaatgttggcagacatatacctttacgagggatcccatttattttacgggtctggccagcgagccaggcgcacggtctatgaatatctctatctggggatttactgagagcttcttgacctcccagtgggtatcatacaccatagatttcaaggatatcctggagcgaaattgcgaggagaaagattacaccatatggctagctcactccacagaccccgaggattatgaggacggttgcatactcggatacaaagaacagtttctgcgattgaggaaaagctccgtgtgccagaacggccgggattatgttgtgactaaacagcccagcatttgtttatgcagtcttgaagacttcctgtgcgacttcggatactaccgacctgagaacgactccaaatgcgtggagcagccggagttgaagggacatgatctcgaattctgcctgtacggtagggaagagcacctgactactaacggataccggaagatacccggtgataagtgtcagggaggggtcaacccagtgagggaggtaaaggatctcaagaaaaaatgtacatccaactttctgtcgccagagaaacagaactccaagtccaactcagtcccgattatcctggctattgtgggcctaatgttggtgactgtggtagcaggcgtcctgattgtgaaaaagtatgtttgcggcggccggtttctggtgcaccggtacagcgtcctgcagcagcacgccgaggccaacggtgtggacggggtggacgccctggatacagccagtcatacaaacaaatccgggtaccacgatgattctgatgaagacctcttagag

SEQ ID NO: 19671 - DNA, 2082 bp, Artificial Sequence
  Description of Artificial Sequence: Synthetic coding sequence
atgacctttgggcagagcaagctctaccgctcggaggattacggaaagaactttaaggatatcactgatctgatcaataacactttcattcgcaccgaattcgggatggcaattggacctgagaattccggaaaagtcgtgcttactgccgaagtgtcaggtgggtccagaggggggcgaatattccgatccagcgattttgctaagaactttgtccaaacggatcttccttttcatccacttactcaaatgatgtacagcccacaaaatagcgactacctgctcgctctgtccactgagaacggactgtgggtgtcaaagaattttggtggaaagtgggaagagattcataaggccgtctgtctggccaagtggggatccgataataccatctttttcactacgtacgccaatggatcgtgcactgacctgggggcacttgaactttggcgtacctccgatctcggaaagtcattcaaaaccattggagtgaaaatctactcgttcggacttgggggccgttttctcttcgcatccgtgatggccgacaaggataccaccaggagaattcatgtctccaccgatcagggagatacctggagcatggcccaactgccctctgtcggccaagagcagttctactccatcctggcagccaatgacgatatggtgtttatgcatgtggacgagccaggtgacactggatttggtaccatattcacgagcgatgaccgcggaattgtgtactcaaaatccctggatagacacctttacaccaccactggcggagaaaccgactttaccaacgtgacttccctccgcggagtgtacatcaccagcgtgctctcggaagataattccattcaaactatgattacctttgatcagggaggaaggtggacccacctcaggaagcctgaaaactcagagtgtgatgcaaccgcgaaaaacaagaatgaatgtagcctccacatccatgccagctactccatttcccagaagctcaacgtccctatggcaccgctttcagagcctaatgcagtgggaattgtaattgcgcacggatccgtcggtgacgcaatttcagtcatggttcctgatgtgtacatttcagatgacggtggctactcctggactaaaatgcttgagggaccgcattactacactattctcgactcaggaggaatcatagtcgctatcgaacattcatcccgccccatcaacgtgatcaagttttcgactgacgaaggacagtgttggcaaacttacacctttactagggatccgatctactttaccggtctggcctcggagccaggtgcacggtcgatgaatatcagcatatggggatttactgaatcgtttcttacgtcgcaatgggtgtcgtacaccattgacttcaaggacattcttgagagaaactgcgaagaaaaggattacaccatttggttggcacactcaactgatcctgaggactacgaggacgggtgtatactgggatacaaagaacaattccttcggttgcggaaatcttcggtgtgtcagaacggcagagattacgtcgtgactaaacagccaagcatctgcctttgttccctggaagatttcctttgcgatttcggctactacagacctgagaacgattccaagtgtgtggagcagcccgaactcaaaggtcatgacttggagttctgtctctacgggcgagaagaacacctgaccacgaatggatacagaaagattcccggggataaatgtcaggggggtgtcaatcccgtgagagaagtcaaggacctgaaaaagaaatgtacctcaaacttcctcagccccgagaagcaaaactccaaatcgaactctgtccccatcatcctggccatcgtgggcttgatgctggtgaccgtcgtggcaggtgtccttatagtgaagaagtacgtctgtggtggacggttccttgtgcatagatactcagtgctgcaacagcatgccgaagcgaatggggtggacggagtggacgctctcgataccgcttcgcataccaacaagtcaggataccatgacgatagcgacgaggatcttctggaa

SEQ ID NO: 19672 - DNA, 2082 bp, Artificial Sequence
  Description of Artificial Sequence: Synthetic coding sequence
atgactttcggtcagagcaagttatatcgttccgaggattacggcaagaacttcaaggacatcacagatctcatcaacaatacctttattagaacagaatttggaatggcgataggtccagaaaattcgggcaaggtggtgcttacggccgaagtcagcggcggcagccggggaggaagaatctttagaagcagcgactttgcaaagaatttcgtacagaccgatctgccatttcacccactcactcagatgatgtactctccacagaactctgactatctgcttgctctgtccaccgagaacggcctgtgggtgagcaagaacttcggtgggaagtgggaggagatccacaaagcagtctgtttagcgaagtggggctccgacaatacaatatttttcacaacatacgcaaatggctcttgcacagatttgggagcactagaactttggaggacaagtgacttgggcaagagttttaagacaataggagtgaaaatatattcattcggactcggagggagatttctgttcgcttcagtgatggctgacaaggatacaacacgacgaatccacgtgagtaccgaccagggtgacacttggagcatggcccagctgcctagtgtggggcaggagcaattttattcaatccttgccgccaatgacgacatggtattcatgcacgtcgatgagccaggtgacacaggcttcggaaccatctttacatctgatgaccgggggatcgtgtattctaagagcctcgacagacatctgtacacgacaactggcggcgaaacggattttaccaatgttactagtctccggggggtctacatcactagcgttctgagcgaggataattctatccagacaatgattactttcgaccagggggggcggtggacccacttaaggaagccagaaaacagcgagtgtgacgctactgctaaaaacaaaaatgagtgctcgctccacattcacgcttcttactctatcagccagaaactcaatgtaccaatggcacctctaagtgagcctaatgctgtgggaatagtgatagcacacggtagcgtaggggatgctatcagtgtgatggttcccgatgtgtacatcagtgatgacggcggatattcatggaccaagatgttagagggaccacattactacactatcttggatagtggtggcatcatcgtggccatagagcattcgtcccggcccatcaatgtgattaagttctcgactgatgaaggccagtgctggcagacatacacctttactagggaccctatctactttaccgggttggcatctgagcccggggcccggtctatgaacatcagcatttggggattcacagagtccttcttgacctctcaatgggtctcatacacaattgatttcaaagatatcctagagcgcaactgcgaagaaaaggattataccatctggctggcgcactccactgatcctgaagactatgaagacggctgcatactgggatacaaggaacagttcctccggcttaggaagtcatctgtatgtcagaacggacgggattacgtcgtgactaagcagccttctatttgtctctgctcactggaagactttctttgcgactttggctattaccgccctgagaacgattcaaaatgcgttgagcaacccgagctcaagggacacgacttggagttctgcctttacggcagggaggagcaccttacgacgaatggatatcgaaagatccccggcgacaaatgccagggcggcgtaaacccagtgagggaagtgaaggatctcaaaaagaagtgcacctccaattttctttcacccgaaaagcagaattcgaagtctaacagcgttccaataatcctcgcgatcgtgggtctgatgctagtcactgtagtggccggcgtgctgatagtcaaaaagtatgtgtgcggcggtcggttcttggtccatcggtattcagtgctgcagcagcatgcagaggcaaacggagtagatggggtggatgctctggacacagcttcacacaccaacaaatccggctaccatgatgatagtgacgaggacctgttggaa

SEQ ID NO: 19673 - DNA, 2082 bp, Artificial Sequence
  Description of Artificial Sequence: Synthetic coding sequence
atgacttttggtcagtccaagctgtaccgatccgaagattacggaaaaaacttcaaagatataaccgacctgattaacaacaccttcatccgcactgaatttgggatggcaattggacccgagaactcgggtaaagtggttcttaccgcagaggtgtcgggtggaagcagaggcggtagaatcttcaggtcatctgattttgcaaaaaacttcgtccaaactgatcttcctttccatccccttacgcagatgatgtactcaccacaaaatagcgactacctgctggccctgagcacggagaacggcctttgggtttccaagaactttggggggaagtgggaggaaattcataaggctgtgtgcctcgctaagtggggatcggacaataccatattctttactacctacgcaaacggatcgtgtaccgatctcggcgcactggagctctggcgaacctccgatctgggcaagtcgttcaaaaccataggtgtcaagatctactcctttggtcttggtggaagatttctttttgcatcggtcatggcagacaaggatacgacccggaggattcatgtatctacggatcaaggtgatacttggtcaatggcccaactcccaagtgtgggtcaggaacagttttactctattcttgcagcaaacgacgacatggtgtttatgcacgtggatgaaccaggggataccggtttcggcaccattttcacttccgatgaccgtggaatcgtatactcaaagtcactcgatcgtcacctgtacactactactgggggcgaaaccgattttaccaacgtgacgagcctcagaggagtgtacattacttccgttttgagtgaagataacagcatccaaaccatgatcacgtttgaccaaggtgggcgatggacccatcttaggaagccggaaaatagcgagtgtgacgctaccgcaaagaacaagaacgagtgctcacttcacatccatgcttcatattccatatcccagaaactgaacgtccctatggcccctctgtccgaaccaaatgcagtcggaattgtgattgcgcatggaagcgtgggcgacgctattagcgtcatggtgcctgatgtgtacatcagcgatgatggaggctactcatggaccaaaatgcttgaaggacctcactactacaccatccttgattcgggcgggatcattgtggcaattgaacatagctcaaggcccatcaatgtgattaagttcagtaccgacgaaggacaatgttggcagacttacactttcacccgggaccctatctactttactggccttgcctcggagccgggagcacgctcgatgaacatctcgatttgggggtttactgaatcttttctgacctcgcaatgggtgtcctataccatagacttcaaggacatattggagcggaattgtgaagaaaaggattacacgatttggctcgcgcattcgactgaccctgaggactatgaagatggttgcatactcggatacaaagagcagtttcttcgcctccgtaaatcctcggtctgtcagaacggcagggactatgtggtgaccaaacaaccaagcatttgcttgtgttcacttgaggattttctctgtgattttggatactaccgccccgagaacgactcgaagtgtgtggagcagccagaactgaaaggtcatgatctggaattctgtctgtacggacgcgaagagcacctcaccacgaatggttacagaaagatccccggagataagtgccagggaggagtgaaccctgtaagagaagtgaaggacctgaagaagaaatgcactagcaatttcctgtccccagaaaagcaaaattccaagtcaaactctgtgccaattatcctggccattgtaggcctgatgcttgtgaccgtggtggccggagtcttgattgtgaaaaagtacgtgtgtggggggcggtttctggtccataggtactcagtgctgcaacaacacgcggaagccaatggtgtggacggagtggatgcgctggatacggcgagccacaccaataagtcaggataccatgatgattcagacgaagatctgttggaa

SEQ ID NO: 19674 - DNA, 2082 bp, Artificial Sequence
  Description of Artificial Sequence: Synthetic coding sequence
atgacatttggtcaatcaaagctttacagatcggaggactatggcaaaaatttcaaagatataaccgatctgatcaacaatacctttattcgcacggagttcgggatggccatcgggccagagaacagcggaaaggttgttttaaccgcggaagtctcaggtggctctcgtggggggcgcatcttccgctccagcgactttgcgaagaattttgtccaaacagatttgccgttccatcctctcacccaaatgatgtactcaccacagaattctgactacctgctagccctcagcacggaaaacgggctatgggtaagtaaaaatttcggcggcaagtgggaagaaatccataaggccgtgtgcctggcaaagtggggctcggacaacacaatatttttcacgacctatgcaaatggcagctgcacagatctgggcgctctggagctgtggcgcaccagcgacctggggaaatctttcaagacgattggagttaagatctactccttcggcctgggaggcagattcctcttcgcgtctgtcatggcagacaaagacacgacccgtcgcatccacgtgtctaccgaccagggagacacatggagcatggcccaactgccgagtgtcggccaggagcagttctactctattctggccgccaatgacgacatggtgtttatgcatgttgacgagccaggcgacaccgggtttggcaccattttcacaagtgatgaccgaggcatcgtatactctaaatcgctggaccgccacctctacacgactaccgggggggagacagacttcaccaacgtcactagtctgcggggggtgtatataacaagcgtgctttccgaggacaatagtatccagacgatgataacttttgatcagggaggaaggtggacacacctgcgcaagcctgagaattctgagtgcgatgcaaccgctaaaaacaagaacgaatgttctctccacatccacgcttcctactccatcagtcagaaactgaatgtgcctatggctcccctgagtgaacctaacgcagttggaatcgttatcgcccatggatccgtcggcgacgccatctcagtgatggtgccagatgtgtatatttccgacgacggggggtacagctggacgaaaatgctggagggccctcattactataccatcttggactccggcgggatcatcgtcgcaattgagcattcaagtaggccaattaatgtgatcaagttcagtaccgacgaggggcagtgctggcagacgtacacgttcaccagggacccaatctacttcaccggactggcatccgagcccggggctagatctatgaacatttccatctgggggttcaccgaaagcttcctgacttcacagtgggtgagctacaccattgactttaaggatatcctcgagagaaattgtgaggagaaggactatacaatttggctggcgcattccacagatcctgaggattatgaggacgggtgtatactcgggtacaaagagcagttcctgcggctgcgcaaatcctccgtgtgtcaaaacggacgggactatgtggtcaccaagcagccaagtatctgtctctgttcgctggaggacttcttatgcgactttggctactatcgccctgaaaacgacagcaaatgtgttgagcagccagagctgaagggacatgacctcgagttctgtctgtacggccgcgaagagcatctgactacaaacggatatagaaaaatccctggagacaaatgccaggggggcgtgaatccagtccgcgaagtgaaggacctgaagaaaaagtgtacttctaatttcttgagccctgaaaagcagaactcaaagagtaattccgtaccaatcatcctggcaatcgtgggcctgatgctggtcaccgtggtcgccggcgtgttaatcgtgaagaagtacgtgtgcggcggtcgcttcctggtgcaccggtacagcgtcctccagcagcacgcagaggctaatggcgtggacggcgttgatgccctagacaccgcaagccacacaaacaaatccggctaccatgacgatagtgatgaagacctcctggag

SEQ ID NO: 19675 - DNA, 2082 bp, Artificial Sequence
  Description of Artificial Sequence: Synthetic coding sequence
atgacgttcggtcagtcgaaactctaccggtcagaggattacggtaaaaactttaaagacattaccgatctgatcaataacacctttatcagaacggaatttggaatggctattggcccagaaaattcaggaaaggtcgtccttaccgccgaagtgagcggtggtagcaggggtggtagaatctttcggtcctcggattttgcaaaaaactttgtccagaccgacctgccttttcatcccttgacgcaaatgatgtattcgccacagaatagcgattacctgttggcactgtcaactgaaaatggtttgtgggtgtcgaaaaactttggcggaaagtgggaggaaattcataaggcagtgtgccttgccaaatggggatctgacaacacgattttcttcaccacctacgcaaacggttcctgtaccgacctgggagcattggaactctggcgcacttccgacctcggaaagtcatttaagactatcggagtgaagatttacagctttggacttggggggcgctttctttttgcctcggtgatggcggataaggatactactcgccgaattcatgtgtcgacggatcagggcgacacctggtccatggcacaacttccatccgtgggtcaggaacaattctactcgattctggcagcaaacgacgatatggtctttatgcatgtggatgaaccaggagatacgggcttcggtaccattttcacctctgatgatagaggaatcgtgtactccaagtcgctggatagacacctctacactactactgggggcgaaactgatttcactaatgtcaccagcctgaggggagtctatatcacctcagtccttagcgaagataactcaattcagactatgatcactttcgaccaaggtggccggtggactcatcttagaaagccagaaaactcagaatgtgacgcaaccgccaagaacaaaaacgaatgtagcctgcacatacatgcttcgtacagcatttcgcaaaagctcaatgtcccgatggctccactttcggaacctaacgcagtcggtattgtcattgcccatgggtcagtgggcgacgcaatctcggtgatggttcccgacgtgtacatcagcgatgatggaggttactcatggacgaagatgctggaaggtccacactattacaccatcttggatagcggcggaatcattgtcgccattgaacattcatcgcgccccataaatgtcataaagttctccaccgatgagggtcaatgttggcagacctacaccttcactcgtgatccgatttactttacgggcctggccagcgaaccaggagcgcgctctatgaacattagcatatggggattcactgagtcgttcctgacgtcccaatgggtgtcgtacaccattgatttcaaggacatcctggaacgcaactgtgaggaaaaggactacaccatctggttggctcacagcaccgacccggaagattacgaggatgggtgcattctgggctacaaggaacagtttcttaggttgcgcaagtcatcggtgtgccaaaatggcagagattacgtggtgactaaacagccctccatttgtctgtgcagcctggaggattttctgtgtgatttcggttactaccgtcctgaaaacgattcgaagtgtgtggagcagcctgaattgaagggacatgaccttgaattttgtctgtacggccgggaagaacatctgacgactaacggctacagaaagataccaggtgacaaatgccagggtggggtcaatccagttcgggaggtgaaagatttgaagaagaagtgtacgtctaacttcctgtcccccgagaagcaaaactcgaagtcgaacagcgtccccatcattctcgcgatcgtgggactcatgcttgtgactgtcgtggcaggggtgcttattgtcaaaaagtatgtctgcggtggtcgatttcttgtccatcgttacagcgtgctgcaacaacatgccgaagcaaatggagtggacggagtggacgcacttgacaccgcctcacacactaataagtcgggctaccatgatgattccgacgaggatttgctggaa

SEQ ID NO: 19676 - DNA, 2082 bp, Artificial Sequence
  Description of Artificial Sequence: Synthetic coding sequence
atgacctttggacagtcaaagctgtaccgcagtgaggactatgggaagaatttcaaagatattaccgaccttatcaataacacttttattcgcaccgagtttggcatggccatcggtcccgaaaactctggcaaggttgtcctcactgcagaggtatcgggaggaagccgtggagggagaatcttccgcagctccgattttgccaagaattttgtgcagacagacctacccttccatccgctgacacaaatgatgtattcccctcagaactcggactatctgctggctctatcaaccgagaacggactgtgggtcagtaagaactttgggggcaagtgggaagagattcacaaagccgtatgtcttgccaagtggggaagcgataacacaattttttttaccacttacgccaacggatcatgtacggatttgggcgctctagaactctggagaacttccgatcttggtaagtctttcaagactataggggtgaaaatttattcatttggcctgggaggcaggtttcttttcgccagtgtgatggcagataaggatacaacgcggaggattcacgtttctacagatcagggcgacacctggagtatggctcaacttccgagtgtcggacaggagcagttctatagtatcctggctgccaatgacgatatggtgtttatgcacgttgacgagcccggcgacaccggttttggtaccatctttacctctgatgacagaggcatcgtctacagtaagtctttggatcggcacctgtatacgactaccggcggggagaccgacttcactaacgtgactagcctgagaggagtgtacattacttcagtcctcagcgaggacaactctatccaaaccatgataacatttgaccaggggggtcggtggacgcatttgcgcaaacctgagaacagtgagtgcgatgcaactgccaagaacaaaaacgaatgttcattgcacatacacgcttcctactccatctcacagaaactaaatgtaccaatggcacctctctccgaacctaatgctgtgggcattgttattgcacatggctctgttggcgacgccatctctgttatggtccccgacgtgtacattagcgacgacggcgggtatagttggaccaaaatgctggagggaccccattattatacaatcctggattcgggtggtatcatcgtggccatcgagcattcctctcgacccatcaacgtgatcaaattttctacagatgagggacagtgttggcagacgtatacatttactagggatcctatttatttcacaggcctggcttccgaaccaggcgcacgctccatgaatatcagtatctgggggttcaccgagtccttcctgacctctcagtgggtgtcctatacgatcgacttcaaagatatcctcgagcgtaactgcgaggagaaagactatacgatttggctcgctcactctaccgaccccgaagactatgaggatgggtgtattctggggtacaaagagcaattcttgagacttagaaagagttctgtctgccagaatgggagggactacgtcgtgactaagcaaccgagtatctgtctgtgcagccttgaggattttctgtgtgattttggatactatcggcctgagaatgattcaaaatgcgtggagcagccagagctgaagggacacgacctcgaattctgcctgtatgggcgcgaggagcacctgactacaaatgggtatcggaagatcccaggagataagtgtcagggaggggtgaacccggtgcgcgaggttaaggacctgaagaaaaaatgtacaagcaatttccttagcccagagaagcagaatagcaagtccaatagtgttccaatcattctggctatcgtcggactcatgcttgtgaccgtggttgccggagtcctgatcgtgaaaaaatacgtctgcggcgggaggttcttagtgcatcggtacagcgtccttcagcagcacgcggaggctaatggcgtggatggcgtcgacgcgctcgatacagccagccacaccaataagtccggataccatgatgacagtgacgaagacctgcttgag

SEQ ID NO: 19677 - DNA, 2082 bp, Artificial Sequence
  Description of Artificial Sequence: Synthetic coding sequence
atgactttcggacagtcaaagctctaccggtcggaggactacggtaaaaacttcaaggatatcactgatctgattaacaacaccttcattcggactgaatttggcatggccatcggaccggaaaattcaggcaaagtcgtcctgactgcggaggtcagcggcgggagccggggaggaagaatcttcagatcaagcgattttgccaagaacttcgtgcagactgatctccctttccaccccctgacccagatgatgtattctccgcaaaattcagactacctcctggccctgtcgactgaaaacggcctctgggtgtctaagaacttcggtggcaagtgggaagaaatccacaaggctgtctgcctcgccaaatggggcagcgataatactatctttttcaccacttacgcgaacggaagctgcactgacctgggcgcgctggagctgtggcggacttccgatctcggaaagtcgttcaagacgatcggagtcaagatctacagcttcggactcggaggacggttccttttcgcctccgtgatggcagacaaggatacgaccagaaggatccatgtgtcgactgaccaaggcgacacctggtccatggcccaactgccttcggtcggacaggagcagttctactcaatcctggcagctaacgacgacatggtattcatgcatgtggacgagccaggtgatactggattcggaactatctttacgtccgacgatcggggaatcgtgtattccaagtcactggaccggcacttgtacactaccaccggaggggagactgatttcaccaatgtcaccagcctgcggggcgtctacatcaccagcgtcctgtccgaagataactccatccagacgatgattacctttgaccagggaggccgctggacccacctgcgcaagcctgagaactccgaatgtgacgcgaccgccaaaaacaagaacgagtgcagccttcacatccatgcttcgtactcaatctcccagaagctgaatgtgccgatggcaccgctctcggaacctaacgctgtgggtatcgtgatcgctcacggatccgttggtgatgccatcagcgtgatggtgcctgacgtctacatatccgacgacggtggatactcctggaccaaaatgctggagggacctcactactacacgatattggactcaggcggcattatcgttgccatcgagcactcatccagaccgatcaatgtgatcaaattctccactgacgaaggacagtgttggcaaacttacactttcacccgggacccgatttactttactggtcttgcctcggaaccgggcgcccgcagcatgaatatcagcatctggggattcaccgagtccttcctgactagccagtgggtgtcttacaccatcgacttcaaagatatcctggagaggaattgcgaggagaaggattacactatatggcttgcacattcaaccgacccagaggattacgaggacggatgcatcctcggttacaaggagcaattcctgcgcctccggaagtcatccgtgtgtcaaaacggtcgggactacgtggtgaccaagcaaccatcgatctgcctgtgctcgcttgaagattttctgtgcgatttcgggtactaccggccggagaatgactccaagtgtgtggaacagcctgaattgaagggacatgacctggagttctgcctgtacggccgcgaggaacacctgactacgaacggataccggaagatcccaggggataaatgtcaaggcggagtgaacccggtccgggaggtcaaggaccttaagaaaaagtgcaccagcaactttctgtcaccggagaaacagaatagcaaatccaactcagtgcccattatcttggcaattgtcggtctgatgctggtgactgtggtggccggcgtgctgatcgtgaaaaagtatgtctgcggaggcagattcctcgtgcacagatactcagtgctgcagcagcacgcggaagcgaatggagtggacggagtggatgcgctggacaccgcctcacacaccaataagagcggctaccacgatgattcggatgaagatcttctcgag

SEQ ID NO: 19678 - DNA, 2082 bp, Artificial Sequence
  Description of Artificial Sequence: Synthetic coding sequence
atgacgtttggtcaatcgaaactatatcgttcggaagattatggtaaaaattttaaagatataacggatttaataaataatacgtttatacgtacggaatttggtatggcgataggtccggaaaattcgggtaaagtagttttaacggcggaagtatcgggtggttcgcgaggtggtcgaatatttcgttcgtcggattttgcgaaaaattttgtacaaacggatttaccgtttcatccgctaacgcaaatgatgtattcgccgcaaaattcggattatttactagcgttatcgacggaaaatggtttatgggtttcgaaaaattttggtggtaaatgggaagaaatacataaagcggtatgtttagcgaaatggggttcggataatacgatattttttacgacgtatgcgaatggttcgtgtacggatttaggtgcgttagaactatggcgtacgtcggatctaggtaaatcgtttaaaacgataggtgtaaaaatatattcgtttggtctaggtggtcgttttttatttgcgtcggtaatggcggataaagatacgacgcgtcgaatacatgtatcgacggatcaaggtgatacgtggtcgatggcgcaattaccgtcggttggtcaagaacaattttattcgatattagcggcgaatgatgatatggtttttatgcatgttgatgaaccgggtgatacgggttttggtacgatatttacgtcggatgatcgtggtatagtttattcgaaatcgttagatcgtcatctatatacgacgacgggtggtgaaacggattttacgaatgttacgtcgttacgtggtgtttatataacgtcggtattatcggaagataattcgatacaaacgatgataacgtttgatcaaggtggtcgatggacgcatctacgtaaaccggaaaattcggaatgtgatgcgacggcgaaaaataaaaatgaatgttcgctacatatacatgcgtcgtattcgatatcgcaaaaactaaatgtaccgatggcgccgctatcggaaccgaatgcggtaggtatagttatagcgcatggttcggttggtgatgcgatatcggtaatggtaccggatgtatatatatcggatgatggtggttattcgtggacgaaaatgttagaaggtccgcattattatacgatactagattcgggtggtataatagttgcgatagaacattcgtcgcgtccgataaatgttataaaattttcgacggatgaaggtcaatgttggcaaacgtatacgtttacgcgtgatccgatatattttacgggtttagcgtcggaaccgggtgcgcgttcgatgaatatatcgatatggggttttacggaatcgtttttaacgtcgcaatgggtttcgtatacgatagattttaaagatatactagaacgaaattgtgaagaaaaagattatacgatatggttagcgcattcgacggatccggaagattatgaagatggttgtatactaggttataaagaacaatttctacgactacgtaaatcgtcggtttgtcaaaatggtcgagattatgttgtaacgaaacaaccgtcgatatgtttatgttcgttagaagattttttatgtgattttggttattatcgtccggaaaatgattcgaaatgtgtagaacaaccggaactaaaaggtcatgatttagaattttgtctatatggtcgtgaagaacatctaacgacgaatggttatcgtaaaataccgggtgataaatgtcaaggtggtgttaatccggtacgtgaagttaaagatttaaaaaaaaaatgtacgtcgaattttttatcgccggaaaaacaaaattcgaaatcgaattcggttccgataatattagcgatagttggtttaatgctagtaacggtagttgcgggtgtactaatagtaaaaaaatatgtatgtggtggtcgttttctagtacatcgatattcggtattacaacaacatgcggaagcgaatggtgtagatggtgtagatgcgttagatacggcgtcgcatacgaataaatcgggttatcatgatgattcggatgaagatctattagaa

SEQ ID NO: 19679 - DNA, 2082 bp, Artificial Sequence
  Description of Artificial Sequence: Synthetic coding sequence
atgactttcgggcagtccaaactgtacagatcggaggactacggaaagaactttaaagacatcacggatctgatcaataatactttcatccggacggaattcggaatggcgattggccctgagaacagcggaaaggtcgtcctgactgccgaagtgtcgggaggttcccggggaggccggatcttccgctcgtcggatttcgccaagaattttgtccagaccgatctgcccttccaccctctgacccaaatgatgtactccccgcagaacagcgattacctcctggccctgtcgaccgagaatggcctgtgggtgtcgaaaaacttcggaggaaaatgggaagagatccataaggcggtctgtctcgcgaagtggggctcagacaacaccatcttctttactacctacgccaatggatcttgcaccgatctcggggcgctcgaactctggcgcacttctgatctgggaaagtcattcaagaccattggtgtcaagatctactccttcggtctgggcggtcggtttctcttcgcaagcgtgatggccgacaaggatacgactagacgaatccacgtctccactgaccaaggcgacacctggagtatggcgcagctcccgtcagtcggacaggagcagttttactcgatcctcgccgccaacgatgacatggtgtttatgcatgtcgacgagccgggcgatactggcttcggcactatctttaccagcgacgatagaggcatcgtgtacagcaagtccttggacagacatctgtacaccactactggaggagagactgatttcaccaacgtcacctcactccggggagtctatatcacctcagtgctctcggaggacaactcgatccagacgatgatcactttcgaccaggggggacggtggacccacctgcggaaaccggaaaacagcgaatgcgacgctaccgcaaaaaacaagaatgagtgctccctgcacattcatgcttcctatagcatctcccagaagctgaacgtgccaatggcgccgttgtcggaaccgaatgctgtgggaatcgttatcgctcacggtagtgtcggcgacgcaatctccgtcatggtgccggacgtgtacatctcggacgatggtggatacagctggactaagatgcttgaaggaccacactactacacgatactggactccggaggaatcatcgtggcaatcgaacactcatcccgcccgatcaacgtgatcaagttctcgactgatgaagggcagtgctggcagacctacactttcacccgcgacccaatttacttcactgggctggcatcggaaccaggagccaggtcaatgaacatctccatttggggtttcaccgagtcattccttacctcacagtgggtgtcctacactatcgacttcaaggacattctggaacgcaactgtgaggagaaggattacactatctggctggcccattcgacggaccctgaagattacgaggatgggtgtatcctgggctacaaggaacaatttttgagactccggaaaagctccgtgtgccagaacgggcgcgactacgtggtgaccaagcaaccaagcatctgcttgtgcagcctggaggatttcctctgcgatttcggatactacaggccggagaacgactctaagtgcgttgaacaaccagagctcaaagggcatgatctggaattctgtctgtacggccgcgaggaacacctcaccaccaatggataccgcaagatccccggagacaagtgccaaggaggagtgaaccctgtgcgcgaagtgaaggacctgaagaagaagtgcacgtcgaattttctgtcacccgaaaaacagaacagcaaatcaaatagcgtgccgattatcctggccatcgtgggacttatgctggttaccgtcgtggcaggagtgttgattgtgaaaaaatacgtctgtgggggcaggttccttgtgcaccgttactcggtgctgcaacaacacgccgaggcgaatggcgtggacggtgtggacgccctcgacactgcttcccacaccaacaagagcggatatcatgacgactcggacgaagatcttttggaa

SEQ ID NO: 19680 - DNA, 2082 bp, Artificial Sequence
  Description of Artificial Sequence: Synthetic coding sequence
atgaccttcggccagtctaagctttaccgctcggaggattacggcaaaaatttcaaggatatcactgatctgattaacaataccttcatccgcacggagttcggcatggcaattggccccgaaaacagtgggaaggtggttcttacagcggaggtgtccggaggctctagaggaggccggatcttccggagtagtgacttcgccaagaacttcgtgcagacagatctgcctttccatccacttacccagatgatgtacagccctcaaaactctgattatctgctcgccctgagcacagagaatggattgtgggtgagtaagaacttcgggggtaaatgggaggaaatccacaaggcggtgtgtctagccaagtggggtagtgataacaccattttttttacaacctatgccaacggcagctgtactgatttgggcgctcttgaactgtggagaacatccgacctcgggaagtcttttaaaacaatcggcgttaagatttactcttttggattaggggggcggttcctcttcgccagcgtgatggctgataaggatactacccggcgcattcacgtgtcaacagaccaaggcgacacttggtccatggcacagctgcccagcgtcggccaggagcaattttactccatcctcgcagcaaatgacgatatggttttcatgcacgtagacgagccgggagatacgggtttcggtaccatttttacctctgatgaccgcggaattgtgtactccaaatccttggataggcatctttatactacaacaggaggcgagactgactttactaatgtaacttcactacggggggtgtatattacaagtgtgttgagtgaggataacagcatccagaccatgatcaccttcgatcagggcggtcgttggacccacctgcggaagccggagaactctgagtgtgacgctactgccaaaaacaaaaacgagtgttcgctgcacattcacgcttcctacagcatctctcagaaactcaatgtccccatggccccattatctgaaccgaatgcagttggtattgtgattgctcatggatccgtgggagatgctatctccgtgatggtgcctgatgtttacatcagcgacgatggaggatactcatggacaaagatgctggaggggccccactattacactatccttgacagcggtggaattatcgtggctattgaacattcatcgcgacctatcaatgtgataaaatttagcaccgatgagggccagtgttggcagacttacacattcactcgcgaccctatttactttacgggtctggccagtgagccaggagcccgctctatgaatatttccatatgggggttcaccgagtcctttctaacctctcaatgggtgtcctacaccatcgacttcaaggatattttggaacgcaactgtgaagagaaggactacacaatctggttagcgcattccactgacccggaggactacgaggacgggtgcatactcggatacaaagagcagttcctccggctaaggaagtcgtctgtgtgtcagaatgggagggattacgtggtgaccaaacagccatccatctgcctttgctcgttagaggattttctctgtgattttggatactaccggccagaaaatgactctaagtgtgtggaacagcctgaactaaagggacatgatctggaattctgtctgtacggccgagaagagcacttaacgacaaacggatacagaaagatccctggagataagtgtcagggcggagttaaccccgtacgggaggtgaaagacctgaagaagaagtgtactagtaactttctcagtccggagaagcagaactccaagagcaatagcgtcccgattatcttagcgattgtgggccttatgctcgtaacagtcgttgctggggtgctgattgtaaagaagtatgtgtgtggtggaagatttctagtgcatagatacagtgtgcttcagcagcacgctgaggcaaatggcgtggacggggtggacgcactcgatactgctagccacacaaacaaaagtggctatcacgatgactccgacgaggacctgctagaa

SEQ ID NO: 19681 - DNA, 2082 bp, Artificial Sequence
  Description of Artificial Sequence: Synthetic coding sequence
atgacctttggtcaaagcaagctgtacagaagcgaggattacggaaagaactttaaggacataactgatcttatcaacaatacgttcatcagaaccgagttcggtatggccattggtccagaaaattcgggaaaagtggtccttactgccgaggtgtccggtgggagcagaggtgggcgcattttcagatcatccgacttcgcaaagaactttgtccaaactgatctgccttttcatcctcttacccagatgatgtacagccctcagaattcagactacctgctcgcgctttcaaccgaaaacggcctctgggtttcaaaaaacttcggaggcaagtgggaagaaattcataaggctgtgtgtcttgcaaagtggggctcagacaacaccatcttcttcactacctacgcaaacggctcgtgtaccgatctgggagcattggaattgtggcgcacctccgacctcggcaagtccttcaaaacgattggtgtgaagatctattctttcggccttggtgggcgatttctgtttgcatccgtgatggcagacaaggacacgactcgccgcattcatgtgtcgaccgaccaaggagatacttggagcatggcacagcttccatcggtgggtcaggaacagttttactctatcctggccgcgaacgacgatatggtgttcatgcacgtggatgagccaggtgatactggatttggtaccatctttaccagcgacgatcgcggtattgtgtactctaagagcctggatcggcatctttataccactaccggaggagaaactgattttaccaacgtgacttccttgagaggcgtgtacataacctcagtgctcagcgaagataacagcattcaaactatgattacctttgaccaaggagggagatggacccatcttaggaagcctgagaattccgagtgtgatgcaaccgcaaaaaacaagaacgaatgctcgcttcatatccacgcctcgtactccatttcgcagaagctgaacgtgcctatggcacctctgtcggaaccaaatgcagtgggaatagtgattgcccatggatccgtgggtgatgcaatatcagtgatggtgcctgatgtgtatatcagcgacgatggcggctactcatggaccaagatgctggaggggccgcactactacactatcctcgatagcgggggtatcatcgtcgccattgaacactcgagtagacccattaacgtgattaagttttcgactgatgaaggacagtgttggcaaacttacacttttacgcgggatcccatctacttcacgggactcgcaagcgagccaggcgccagatccatgaatatcagcatttggggatttactgaatccttcctgacctcccagtgggtgtcctacactatcgactttaaagatatactggagaggaattgtgaggagaaggactacactatttggttggcgcattcaaccgatcccgaagattacgaggacggttgtatacttggatacaaggaacagttccttcgcttgagaaagagctcagtgtgtcaaaacggtagagattacgtggtgactaagcaaccttccatttgtctttgttcgctggaggactttctttgtgatttcgggtattaccggcccgagaacgattcgaagtgcgtcgaacagcccgagctgaagggacacgatctggaattctgtctctacggacgggaagagcatctgaccacgaatggatacaggaaaatacctggagataaatgtcaaggtggtgtgaatcctgtgcgcgaagtcaaagatcttaagaaaaagtgtacttccaactttcttagcccggagaaacagaattcaaagtcgaactcagtaccaatcattcttgcaatcgtggggctcatgctggtgaccgtcgtggcaggagtgctgatcgtcaagaagtacgtctgtgggggtaggttcttggtgcataggtactccgtgttgcaacaacatgcagaagcaaacggcgtggacggagtcgatgcactggatactgcatcccatacgaataagagcggctaccatgatgattctgacgaggaccttctggaa

SEQ ID NO: 19682 - DNA, 2082 bp, Artificial Sequence
  Description of Artificial Sequence: Synthetic coding sequence
atgactttcggccaaagcaaactttaccgctccgaggactacggaaagaactttaaggatatcactgacctcatcaacaataccttcatccgcacggagttcggcatggcgatcggaccagaaaactccgggaaagtcgtccttactgccgaggtgtcagggggcagccgcggtggcagaatctttaggtcgtccgacttcgccaagaatttcgtccagactgatctgccgttccaccctctgacccagatgatgtattcacctcagaactccgactacctcctggcgctgtcaactgaaaacggtctgtgggtttccaagaattttggaggaaagtgggaggaaattcacaaagcggtctgcctcgcgaagtggggttcggacaacaccatcttctttacgacctacgccaacggctcgtgtaccgaccttggagccctggaattgtggcgaacctcagaccttggaaagtcattcaaaactatcggtgtgaagatctactcgtttgggctcgggggacggttcctgttcgcgagcgtgatggccgacaaggataccactagacggattcacgtgtcgactgatcagggagacacttggagcatggcgcagctgccttccgtgggacaagagcagttctactctatcctggcagccaacgacgatatggtgtttatgcatgtcgacgaaccgggagacaccggatttggtaccatctttaccagcgatgatcgaggcatcgtctactcaaagtcactggacagacatctctacactaccaccggcggagaaaccgacttcaccaacgttaccagcctccgtggagtttacatcacttccgtgctgagcgaagataactctatccagactatgatcaccttcgaccaaggaggtcggtggactcacttgcggaagccggaaaatagcgagtgtgatgctaccgccaagaataagaacgaatgttcgcttcatatacacgccagctactcgattagccagaagctcaacgttccaatggctccccttagcgaaccgaatgcggtgggcattgttatcgctcacggcagcgtcggagacgcaatctccgttatggtgccggatgtgtacatctccgatgatggcggctactcttggactaagatgttggaaggaccgcactactatacgatcttggactccggcggaattatcgtggccatcgagcattcgtcccggccaatcaatgtcattaagttttcaactgacgagggccaatgctggcagacgtatacttttactcgcgatccgatctacttcaccggtctggcgagcgagccaggggcacgctccatgaatatctccatttggggatttaccgaatcgttcctcacgagccaatgggtgagctacactatcgacttcaaggacattctggaaagaaactgcgaggagaaggattataccatctggctcgcccactcaaccgatccggaagattacgaggacggttgcatcctgggatacaaggaacaatttctgcgcctcagaaagtcgagcgtctgtcaaaacggaagagactacgtcgtcactaaacagccgtcaatctgcctgtgctcccttgaggacttcctctgcgacttcggatactaccgcccggagaatgattcgaagtgcgtcgaacaacccgagctcaagggccatgatctcgagttctgcctgtacggccgcgaggaacacttgaccaccaatgggtacagaaagatccccggggacaagtgccaaggcggggtgaatccagtgcgggaggtgaaagatctgaagaaaaagtgcactagcaatttcctgtctccagaaaagcagaattcgaaatcgaacagcgtgccgatcatactggcaatcgttggactgatgctggtgactgtggtggctggtgtgctgatcgtcaaaaagtacgtgtgcggaggccgctttcttgtgcataggtactcggtgttgcagcaacatgccgaggcgaacggagtcgatggggtcgatgctctggataccgcttcacataccaacaaaagcggctatcacgatgattcggacgaggacctgctcgaa

SEQ ID NO: 19683 - DNA, 2082 bp, Artificial Sequence
  Description of Artificial Sequence: Synthetic coding sequence
atgacttttggacaatctaagttgtatcgaagtgaggactacgggaaaaatttcaaagatatcactgatctgatcaacaatactttcatccgaacagaatttgggatggctattggacccgagaattctggcaaagtagtcttaacagctgaagttagtggaggaagccgaggggggcgaatattccgaagtagcgatttcgcgaagaatttcgttcaaaccgatcttccgtttcatccacttacccaaatgatgtatagtccacaaaatagcgactatttattggcactgtcgactgaaaatggactgtgggtaagtaaaaacttcggcggaaagtgggaagaaattcacaaagcggtgtgcttggctaagtggggatctgataacacgatcttttttacaacctatgcaaatggctcatgcacggatctcggagcattagaactttggagaacatcagacctcggaaagtccttcaaaacaattggcgttaaaatatacagtttcggactcggcggaagattcctctttgcgtccgtcatggctgataaggataccactagacgaattcatgtctctacggatcaaggagatacttggtcaatggctcaattgcctagcgtgggacaagagcaattttactcgatattagctgctaatgatgatatggtcttcatgcatgtcgacgaaccgggcgatactgggttcggaacaatctttacttccgatgacagaggtatcgtctactctaaaagtctcgaccgtcacctttacaccactactggaggagagactgactttaccaacgtaacctcactgcgtggagtttatattacgagcgtgctgtccgaagataattctattcaaacaatgattactttcgatcagggtggtaggtggactcacttacgtaaaccagagaattcagagtgtgacgccacggctaaaaataagaatgagtgcagtttgcacattcacgcttcttatagtatctcacaaaagcttaatgtaccaatggctccattaagtgaaccaaatgctgttggaattgtcattgctcacggttcagtcggggatgctatttccgtgatggtcccagatgtttatatttccgatgatgggggatattcatggactaagatgcttgaaggtccacattattatacgatcttggattcgggcggaatcattgtagcaatcgaacactcgtcgcgacctatcaacgttattaaatttagcacagatgaaggtcaatgttggcaaacctacacattcaccagagatccaatttatttcactggtctcgcgtcggaaccaggagcacgctctatgaatatttctatatggggtttcacagagtcgttcctgacgtcccagtgggtttcatataccattgacttcaaggacatcttggaacgtaattgtgaggaaaaagattacactatttggctagcacactccactgatcctgaagattacgaagacggatgtattctcggttataaggaacaattccttcgtctccgcaaatcatccgtctgccagaatggccgtgactatgtggtcacaaaacaaccgtcaatttgtctctgctctctggaggattttctttgtgacttcggttattatcgacccgaaaacgattccaaatgtgttgaacagccagagcttaaaggacatgacctcgagttttgtttgtacggccgagaggaacatcttacaaccaacgggtaccgaaaaattccaggggataaatgtcaaggtggagtgaatccggttcgtgaggtgaaagatcttaaaaaaaagtgcacttcaaatttccttagtccggagaagcaaaactcaaagtcaaattccgttccaattattcttgcgattgtgggcttgatgcttgtgactgttgtagccggagtcttaattgtgaaaaaatacgtctgtggaggaagatttttagttcacagatactccgtgttgcaacagcacgctgaagccaacggtgttgatggagtagacgccctcgatactgcgtctcatactaataaaagtggatatcatgacgattcagatgaagaccttctagaa

SEQ ID NO: 19684 - DNA, 2082 bp, Artificial Sequence
  Description of Artificial Sequence: Synthetic coding sequence
atgacgttcgggcaaagtaagttatacagatccgaggactacgggaaaaattttaaggacataaccgatctgattaataatacctttattcggaccgagttcggcatggcgattggccctgagaactccgggaaggttgtacttaccgcagaggtgagtgggggatccagaggagggcggatctttcgcagctcggactttgctaaaaacttcgtccaaaccgatttgccattccatcccttgacgcagatgatgtactcccctcaaaatagcgattacctgctggcactcagtacagagaacggcttgtgggtctccaaaaatttcggcggaaagtgggaagaaattcacaaagccgtctgtctcgcgaagtggggaagcgacaatacgatcttcttcactacatacgccaatggctcttgcacagatctaggagctcttgagctgtggcgcacttcagacctgggaaagagcttcaaaaccataggagtaaagatttattcattcggcctgggagggaggtttctgtttgcttctgtgatggcagataaagacactacgcggcggatccacgtgagcacagaccagggcgacacctggagcatggcccaacttcctagtgtaggacaggagcagttctattctattttagccgctaatgacgacatggtattcatgcacgtggacgagcccggcgacacgggatttggaacgatcttcacttcggacgatcggggtatcgtctacagcaaaagcctcgataggcacctgtataccacaacaggaggcgagacagactttaccaacgtaacctcgttgcgcggtgtttacataaccagtgtgctctcagaggacaatagcatccagaccatgattactttcgaccagggcggccggtggacgcatctaagaaagcctgagaattcggaatgtgacgcaacagccaaaaacaaaaatgagtgctcactacacatccatgcctcatattctatcagccagaaattaaatgttccaatggcaccactgagcgagccgaacgcagtagggattgtgattgcacacggctctgtgggtgacgcaatctccgtcatggttcccgatgtgtacattagcgatgacgggggatatagctggacaaagatgctggaagggccccactattacacgatcctggacagtggggggattatagtggctattgaacactcctccagaccgatcaacgtgattaagttcagcaccgacgaaggacagtgttggcagacctataccttcacgagagaccctatctacttcaccgggcttgctagcgagcccggcgccaggagtatgaacataagtatttgggggtttactgagtctttcctcacgtctcaatgggtgtcttatactatagatttcaaagatatattggagcgcaattgtgaagagaaggactatacaatatggctggctcactctaccgaccctgaggactacgaggacggttgtatcttaggttataaggagcagttcctgcgtctgcggaaaagttccgtgtgccagaacggcagagactatgtggttactaagcagcctagcatctgtttatgcagcctggaagattttctgtgtgatttcggctattatcgccctgagaatgactcgaagtgtgtggagcaaccagaactaaaagggcacgacctggagttttgcctgtatgggcgggaggaacatctgactacaaacggatacaggaagatccctggagacaagtgtcaggggggagttaatcccgtccgcgaggtcaaagacctgaagaagaaatgtacatcaaactttctgtctccggaaaaacagaacagcaaatctaactctgtcccgatcattctggccatagttggcctcatgttagttactgtagtcgcaggggtgcttatagtgaaaaagtacgtctgcggagggaggttcttagtccaccgatactctgtgctgcagcagcacgcagaggctaatggtgttgatggtgtcgatgccttagacactgccagccacaccaataagtcaggctatcatgacgacagcgacgaggacctactcgag

SEQ ID NO: 19685 - DNA, 2082 bp, Artificial Sequence
  Description of Artificial Sequence: Synthetic coding sequence
atgacattcggccaatccaagttataccgtagtgaggattatggcaagaatttcaaagatatcacggatctgattaataacacttttatccgcacagaatttgggatggcaattgggcctgaaaactcaggcaaagtcgtgctcactgccgaggtgagtggtgggagccggggcggtaggatcttcaggagttcggactttgccaaaaacttcgtgcagaccgatctgcccttccatccattaacacaaatgatgtactcaccacagaactctgactatctcttggctctgtccaccgagaatgggctgtgggtctctaagaattttggaggtaaatgggaagagatccacaaagctgtctgtctggccaagtggggtagcgataacacgatctttttcacaacgtacgccaacggcagctgtactgaccttggggccctggagttatggcgaacaagcgatctgggcaaatcatttaagactattggcgttaaaatttacagtttcggcctgggcggtcgctttctttttgccagtgtgatggccgacaaagacaccaccaggagaatccatgtgagtacagaccaaggcgacacatggtcaatggcccagctccccagcgtgggccaggaacagttctactcgattctggctgccaacgacgatatggtttttatgcatgtggacgaacccggtgatacgggttttggtactatctttacttctgatgacaggggaatcgtttactctaaaagcttggaccggcatctgtacactacaaccggaggagagaccgattttaccaatgttacgtcactgcggggcgtgtacatcacatcagtgctctctgaggacaacagcatccagaccatgatcacatttgatcagggcggtcgctggacgcatctgcgaaagccagaaaattccgaatgtgatgccacagctaagaacaagaatgaatgcagcctccatattcacgccagctattccatcagccaaaaactgaatgttccaatggctcctctctctgaacctaatgccgttggaattgtaattgcacatggctccgtcggagatgccatctccgttatggtgcccgatgtttatatatcagatgacggaggctatagttggactaaaatgctcgaaggcccacactactacaccatcctggacagcggcgggataattgtggccatcgagcacagctcccgtccgatcaatgttatcaagttctcgacggatgaaggccagtgctggcagacctatacatttacacgggatccgatctactttacaggcctggccagtgaacctggcgcccgtagtatgaatatctccatttgggggtttactgagtcctttctcactagccagtgggtatcttataccattgactttaaggacattttggaaagaaactgcgaggaaaaggactatacaatctggctggcacactccactgatcccgaggattatgaggacggctgcatactggggtacaaagaacaatttctgcggttgcggaaatcctcagtctgccagaacgggagagattacgtggtgaccaagcagcccagtatatgcctgtgtagtctggaggattttctgtgcgacttcggctactacagacccgaaaacgatagtaaatgtgtggagcagccagaactaaaaggtcacgaccttgagttttgtctctatggcagggaagaacacctgaccacaaatggctaccggaagattcccggtgataaatgtcaagggggcgtcaatcctgtgcgggaagtcaaagatctcaagaagaagtgcaccagcaattttctgtctcccgagaaacagaattcaaagagcaatagcgtgccaattatcctggctatcgtgggtctgatgttggtgactgttgtcgccggcgtgttaatagttaaaaagtacgtgtgcgggggacgcttcttggtgcatcggtactcagtgctgcagcagcatgccgaggccaatggcgtagacggcgtcgacgccttggatactgcctcccacacgaacaagagcggctatcatgatgactccgatgaggacctacttgag

SEQ ID NO: 19686 - DNA, 2082 bp, Artificial Sequence
  Description of Artificial Sequence: Synthetic coding sequence
atgacttttggccagagcaagctgtacagatcagaagattacggtaagaactttaaggatatcaccgatctgataaacaacaccttcattaggaccgaatttggcatggcaattggtcctgagaactccggtaaagtggtgctgaccgcggaagtgagcggcggttcaaggggaggaagaatctttagatcatctgatttcgccaagaacttcgtccaaaccgacctccctttccatcctcttactcagatgatgtactcgcctcagaactccgattaccttctggcgctttccactgaaaacggactctgggtgtcaaagaattttggaggtaagtgggaagaaattcacaaagcggtctgcctggcaaagtggggatcagataatacgatattctttaccacttacgcgaacggatcgtgtaccgatttgggtgcactggaactttggcgcaccagtgaccttggtaaatcgttcaagactattggagttaagatttactcctttggtcttggcggtagatttctgttcgcatccgtgatggcagacaaggatactacccggcgtatccatgtctcaacggatcagggtgatacttggagcatggcacagctgccgtccgtggggcaagagcagttttactcaattctcgccgcaaacgacgatatggtctttatgcatgtggatgaaccgggagacaccggatttgggaccattttcacttcggatgaccgcggaatcgtgtactccaagagcctggatcgccatctttacaccaccactgggggagaaaccgacttcaccaacgtgaccagcttgcgaggcgtgtacattaccagcgtcctgtcagaagataactctatccagaccatgattacttttgaccaaggaggaaggtggacccatctgcgcaagcccgaaaacagcgagtgtgacgccaccgcaaagaacaagaacgagtgctctcttcacatccatgccagctactccatatcccagaagctcaatgtgccgatggcccccctgagcgagccaaacgcagtgggaattgtgattgcacacggaagcgtgggcgatgccatctcagtcatggtgcctgacgtgtacatttcggacgatggcggctactcatggaccaagatgttggaaggccctcactactacacgattcttgacagcggtggtatcattgtcgccatagaacattccagcagacccataaatgtgatcaaattctcaacggatgaaggacagtgttggcaaacttacactttcacccgcgaccccatttactttaccggacttgcgtccgagcctggtgcccggtctatgaacatatcaatttgggggttcaccgagtccttcctcacctcacagtgggtatcgtacaccattgatttcaaggatattctggaaagaaattgtgaggaaaaggattacaccatctggctcgcccattcgactgatccagaggattacgaagatgggtgtatactcggatacaaagagcagttcctgaggttgcggaagtcgtcagtgtgtcagaatgggcgagattacgtggtcacgaagcagccatcgatctgtctctgttcgctggaagattttctgtgtgattttggttattaccgcccggagaacgacagcaagtgtgtggaacaacctgagctgaagggacatgaccttgagttctgtttgtacggccgtgaggaacaccttactactaatggttaccggaagataccaggagataagtgccaaggaggagtgaacccagtgcgcgaagtgaaggaccttaagaaaaagtgtacctccaacttcctgtccccagaaaagcaaaatagcaagtccaactctgtgcctatcatcctggcaatcgtcggacttatgttggtgactgtcgtcgccggagtgctgatagtgaagaaatacgtctgcggtggtcggtttttggtgcatagatacagcgtccttcaacaacacgcagaagcgaacggggtggatggagtggatgcattggataccgcatcgcatactaacaaaagcggatatcacgatgacagcgacgaagatcttcttgag

SEQ ID NO: 19687 - DNA, 2082 bp, Artificial Sequence
  Description of Artificial Sequence: Synthetic coding sequence
atgactttcggacagagtaagctctaccggtcagaagattatggaaagaatttcaaagacatcacggacctcattaacaacacattcatccggaccgagtttggcatggcaatcgggcccgagaacagtggtaaagtggttcttaccgccgaggtatctggaggatcgaggggcggccggatatttagatcctcagatttcgccaagaactttgtgcagacagatcttccatttcatccgctgacccagatgatgtattctccgcagaacagtgattacctgctcgccctgtccacagaaaatggcctgtgggtttcaaagaatttcggaggtaagtgggaggaaattcataaggcggtatgcctggccaaatggggaagcgacaataccatctttttcaccacatatgctaacgggtcgtgtaccgatttaggcgcccttgagctctggcggacctctgacctggggaaaagtttcaaaacaattggcgtcaaaatctacagtttcggactcggtggaaggtttttattcgcctctgttatggcagataaagacaccactaggaggatccacgtcagcactgaccagggcgacacatggtcaatggcccagctacctagtgtcggacaggagcagttctatagtattctagcagccaatgacgatatggtcttcatgcatgtcgatgagccgggagataccgggttcggcaccattttcacctccgacgatcggggcattgtgtactcaaaatccttagaccgtcacttgtacacaaccacagggggagagaccgattttactaatgtgacgtctcttcgtggggtatatatcaccagcgtcctgtcagaagacaactccatacagacaatgatcacgttcgaccaggggggtcggtggacacacctgcgaaagcccgagaactcagagtgcgacgccacagctaagaacaagaacgagtgctccctgcatattcatgcctcctatagtattagccagaaactaaatgtgcccatggcccctctgtcagaacctaatgccgtcgggatagtgattgcccatgggtccgtgggcgacgctatcagtgttatggtccctgatgtctacatctcagatgatggaggatattcatggacgaaaatgcttgagggcccccattattataccattttagatagtggcggaatcattgttgctattgagcactccagtagacccattaatgtgattaaattttctactgacgagggccagtgttggcaaacatatacattcactcgcgatcccatctattttaccggcctggccagcgaaccgggtgctcgatctatgaacatttctatttggggcttcacggaatccttcctaacctctcaatgggtctcttataccatcgatttcaaagacatactggaaaggaattgtgaagagaaagactacacgatctggctagctcacagcaccgatcccgaggactatgaggatggctgcatattagggtataaggagcagttcttgcgattgcggaaaagttctgtgtgtcagaatgggcgcgactacgtggtgacaaagcagccatccatctgcttgtgcagcctggaggacttcctgtgcgacttcgggtactacaggcccgagaatgatagcaaatgcgttgagcagcctgagctgaaaggccacgatttggagttctgcctctatggtcgcgaagagcatctcacaacaaacggctataggaaaatcccgggggataaatgtcaaggaggcgttaaccccgtaagagaggttaaagacctgaaaaaaaagtgcacctccaacttcctatcccctgaaaaacaaaattctaagtctaacagcgtgcccatcattttggctatcgtcggcctgatgttagttactgtcgtggcaggcgttttgattgtcaaaaagtacgtatgcggcgggaggtttctggtgcatcgttactcggttctgcaacagcacgccgaggcaaacggtgttgatggtgtagacgccctggacacagcaagtcacactaataagagcggatatcatgatgatagcgacgaagacctgctggaa

SEQ ID NO: 19688 - DNA, 2082 bp, Artificial Sequence
  Description of Artificial Sequence: Synthetic coding sequence
atgacctttggccagtcaaagctgtaccgctccgaggactacgggaaaaatttcaaggacatcaccgacctgattaacaacaccttcatcagaacagagtttggtatggcaatcggcccggagaattccggtaaggtggttcttaccgcggaggtctccggtggttcccggggtggtcggattttcaggtcctcggattttgctaagaattttgtccagactgatcttccattccatcccctaacacagatgatgtactcgccgcagaactccgattacctgctggctttgagcaccgagaatggtctttgggtctccaagaactttggtggcaaatgggaggagatccacaaggccgtttgtctcgcaaagtggggctccgacaacaccatctttttcacgacctacgccaacggttcttgtacagacctgggtgcactcgaactctggcgaacctccgacctgggaaagtccttcaagaccatcggtgttaagatttacagcttcggacttggtggcagattcctgtttgcatctgtcatggctgataaggataccacacgtcgcatccatgtctccactgaccaaggggacacatggtctatggcccagctgccctcggtgggtcaggaacaattctacagcatcctggcagctaacgacgacatggttttcatgcatgtagatgagcccggtgatacaggcttcggtactattttcacctccgatgaccgcggaatcgtttactcaaagagtctggacagacacctctacaccaccaccgggggagaaaccgatttcaccaacgtcacgtcccttcggggcgtctacatcacctcagtgctgagtgaggacaatagtatccagaccatgataacattcgaccagggcggccgttggacccacctgaggaagccggagaacagcgagtgcgacgctaccgctaagaataagaacgaatgctccctccatattcacgcttcctacagcatatcccaaaagctcaacgttcccatggcacccctgagcgagccaaacgcggttggcattgtcatcgcccatggttctgtgggtgatgcgatcagtgtcatggtccctgacgtttatatctctgacgatggaggatactcgtggacgaagatgctggaaggtccgcactactatactatcctggactcgggtggcatcattgtcgccattgagcacagctcacgtcctattaacgtgattaagttctccaccgacgagggtcagtgctggcaaacttacacctttacgcgcgaccccatttactttaccggtctcgcatctgagcccggcgcccgcagtatgaacatctctatatggggattcactgagtccttccttaccagtcaatgggttagctacacaattgatttcaaagacatcctagagcgtaactgcgaggaaaaggattataccatctggttggcccatagcactgatcccgaggactacgaggacggttgtattctcggctacaaggagcagttcttgcggcttcgtaagtcctccgtatgccagaatggccgcgactacgtggtcacgaagcagccctccatctgcctttgctctctcgaggattttctctgcgacttcggttactatcgaccagagaatgactcgaagtgcgtggaacaaccagaactaaagggccatgacctggagttctgcctttacggacgtgaggagcacctgaccaccaacggttatcgtaaaattcctggagacaagtgtcagggcggcgtcaaccctgtgcgcgaggtcaaagacctaaaaaagaagtgcaccagtaacttcctctcaccggaaaagcagaattccaagtccaacagtgtgccgatcattctggcaatcgttggcctgatgctggtcaccgtcgtcgccggagtcctcatcgtcaagaagtatgtatgtggcggaagattccttgtccatcggtactcagtgttgcagcagcatgccgaggcgaatggtgttgacggtgtcgacgccttggacaccgcatcgcatactaacaagtctggctatcacgatgacagcgacgaggatcttttggag

SEQ ID NO: 19689 - DNA, 2082 bp, Artificial Sequence
  Description of Artificial Sequence: Synthetic coding sequence
atgacgtttggtcaatcgaagctctaccggtctgaggactacggaaagaactttaaggatattaccgacctgatcaacaatacgttcatcaggaccgagtttggaatggcgatcggaccagaaaacagcggaaaggtggtgctgaccgcagaggtgagcggaggctcgagaggcggtagaattttccggtcatcagacttcgccaagaatttcgtgcagactgacctgccgttccatcctctcactcagatgatgtactcccctcagaactccgactacctgcttgcattgtcgacggagaatgggctgtgggtgtcgaagaatttcggcgggaaatgggaggaaatccacaaagcggtctgtctggccaagtggggttcggacaataccatcttcttcactacctatgcgaatggatcctgtactgatctcggagcactggagctttggcgcacttcggacctcggtaagtcgttcaagaccattggcgtgaagatctacagcttcggactgggtggacgcttcctctttgccagtgtgatggcggacaaggacactactaggcgcatccatgtgtcgactgatcaaggtgatacttggtcaatggcccagctgccatcagtcggacaggagcagttctacagcatcctcgccgccaatgatgatatggtgttcatgcacgtggacgaacctggagataccgggttcggcactatcttcacctcagacgatcgcggaatcgtctactccaagtcactcgaccggcacctgtacactactactgggggcgagactgatttcactaacgtcacttccctgaggggggtgtacattacctcagtgctttccgaagataactcgatccagaccatgatcacgttcgatcagggagggcgctggacccatctgcgtaagccagaaaattcagaatgtgacgcaaccgccaagaataagaatgaatgctcactgcacatccacgcgtcatacagcattagccagaagctcaacgtgccgatggcccctctgtcggagccgaacgccgtgggaatcgtgatcgcacacggctcagtcggcgacgccatctccgtgatggtcccggacgtgtacatctcggacgacggcggctactcctggaccaagatgctggagggtccccactactacactatccttgactcaggaggaatcatcgtcgccatcgagcactcgtcgcgaccaatcaatgtgatcaaattcagcacggatgagggccagtgctggcagacctacaccttcactcgggacccgatctacttcaccggacttgcctccgaaccaggggcacgctcaatgaacatttcgatctgggggttcactgaatcctttctgacctcgcagtgggtgtcatacaccatcgatttcaaggatattctggaacgcaactgcgaggaaaaggattatactatctggctcgcgcactcgaccgatccagaggactacgaggacggatgtatcctgggctacaaggagcagttcctccggctgagaaaatcgtccgtgtgccagaacggaagagattatgtggtgactaagcagccatcgatttgcctgtgctcgttggaagatttcctgtgcgacttcggctactaccggcccgaaaacgactctaagtgcgttgagcaacctgagctgaagggtcacgacctcgagttttgcctgtatggacgcgaagagcacctcactacgaacggatataggaagatcccgggagacaagtgtcaaggaggcgtcaatccggtgcgggaggttaaagacctgaagaaaaagtgcacctcaaactttttgtccccagaaaagcagaactcgaagtcgaattcggtccctattatcctggcaattgtgggactcatgctggtcaccgtcgtcgcgggagttctcatcgtgaagaagtacgtgtgtggcggccgcttcctggtgcatcgttactcagtgctgcaacaacacgctgaggctaacggggttgacggagtggatgctctggacacggcgagccatacgaacaagtcgggttaccatgacgattcggatgaggatctgctggaa

SEQ ID NO: 19690 - DNA, 2082 bp, Artificial Sequence
  Description of Artificial Sequence: Synthetic coding sequence
atgacctttggacaatcaaagttatacagaagcgaggactacggcaaaaatttcaaggacattacagacctcatcaataatacatttatcagaaccgagttcggaatggccatcgggcctgagaattcaggaaaagtcgtgttgacggcagaggtttcaggagggtcgcgcggtggccggatctttagatcctcagactttgctaagaactttgtgcaaacggacttgccctttcaccctctgacccaaatgatgtatagccctcagaattccgactaccttctagcactgtccaccgaaaacggactctgggttagcaagaacttcggcggcaaatgggaggagattcacaaagcagtctgtctggctaagtggggatctgacaacactatcttctttaccacatacgcaaatggatcatgcaccgacctgggagccctggagctctggcgaacttccgatttgggtaagtcctttaagactatcggagtgaagatctattccttcggattgggaggaaggttcctctttgcctccgttatggccgacaaggacacgacccgtagaattcacgtgagcaccgaccaaggagatacctggtcaatggctcagttgccctctgtcgggcaggaacaattctacagtatactggccgcaaacgacgacatggtattcatgcacgtggacgagccaggagatacaggctttggcactatcttcactagtgacgatcgcggaatcgtgtacagcaaaagcttggaccggcatctatatacgacaaccgggggcgagacagattttactaatgtaacgtctctgcggggggtgtacatcacatcagttctttctgaggataactcgatccagaccatgatcacattcgaccagggtgggcgctggactcacctcagaaagcctgagaattccgagtgcgacgcaacagcaaagaataaaaatgagtgtagcctgcacatacacgcatcctatagcatcagtcagaagctaaacgtgccaatggcccctctgtccgaaccgaacgctgtgggtatcgttattgctcacggctccgtaggtgacgccatatctgtgatggttcctgacgtgtacattagcgacgacggtggatactcttggaccaaaatgttagagggacctcactactatactatcctagattcaggcggcatcatcgtcgcaattgagcatagtagtcgccccatcaatgtaataaaattctctacggatgaggggcaatgctggcagacatacaccttcacacgggatcctatctactttactggcctcgccagcgagcccggcgcacgaagtatgaacataagcatctggggattcactgaaagcttcctgacctctcagtgggttagctatactatcgactttaaagatatcctggaacgcaactgcgaggaaaaggactacactatatggctggcgcactctactgatcccgaagattacgaagatggctgtattctggggtacaaggagcagtttctgcgcttgcggaaaagtagcgtctgtcaaaacggccgcgattacgtggtcaccaagcagccttctatttgcttgtgcagcctggaagattttctatgcgactttggatactatcgaccagagaacgactccaaatgtgtcgaacagcctgaactgaaggggcacgacttggaattctgcctatatggtagagaggaacatttaacgactaacgggtaccggaaaatcccaggagataagtgtcaggggggcgtcaatcccgttcgcgaagtcaaagacttaaagaaaaaatgtacgtccaattttctttctcccgaaaagcaaaactctaagtcgaatagcgtcccaataatccttgcgatagttggactgatgctagtgacggtagttgcaggtgtgctgattgtcaaaaagtatgtatgcgggggccgcttcctcgtgcataggtattcagtcttgcagcagcatgccgaagccaatggcgtcgacggtgtagatgccttggacacggccagccacacaaataagtcgggctatcatgatgatagcgatgaagatctgttggaa

SEQ ID NO: 19691 - DNA, 2082 bp, Artificial Sequence
  Description of Artificial Sequence: Synthetic coding sequence
atgacattcggacagtccaaactatatagaagtgaagattacgggaagaattttaaagatataacagatttgatcaacaatacattcatcaggactgaatttggaatggccatagggcccgaaaactcgggaaaagttgtcctcacagccgaggtctccggaggatcaagagggggaaggattttcagatcttcagattttgccaaaaacttcgtacagacagacctaccattccatcctttgactcagatgatgtattcccctcagaactccgattatcttctggctctctctacagaaaatggattgtgggtttctaagaatttcggaggaaagtgggaggagattcacaaagccgtgtgtttggccaaatgggggtctgataatacaattttttttacaacatatgctaacgggtcatgtactgatttaggagctctggaattatggcggacttcagatcttggaaaatctttcaagactatcggggtgaaaatttactcttttggacttggagggaggttcctttttgcttccgttatggccgataaagatacaacaagacgaatccatgtatcaactgatcagggagatacatggtccatggcccagttaccttcggtagggcaggaacagttttatagtatactcgcggcaaacgacgatatggtgtttatgcatgtggacgaacctggagatactggatttgggactatcttcacttctgatgatagagggatagtatacagtaaatcactggataggcatctgtatactactacaggaggggaaacagatttcacaaatgtcacaagtttacgaggagtatacattacttctgttctttcagaagataactctatacagacaatgatcacattcgatcaggggggaaggtggacacatcttcgaaaacccgaaaattctgaatgtgatgcaactgccaaaaataaaaacgaatgttccttacatatacacgcaagttacagtatttcacagaagctaaatgtgccaatggctcccctatccgaaccaaatgccgtggggatagttatcgctcatggatccgtcggggatgcaatctctgtcatggtccctgacgtgtatatctctgatgatgggggatactcatggactaagatgctcgaagggcctcattattatactattttggattccggggggataatcgtggctatagaacattcaagtcggcctataaatgttataaaattttcaacagacgaagggcagtgttggcagacatacacattcacgcgagatcctatatattttacagggctggcctccgaaccaggggcccggagtatgaacatcagtatctgggggtttacagaatccttcttgactagtcagtgggtgtcttacacaatcgattttaaggatatcctggaaaggaactgcgaggaaaaagattatacaatctggctggcacactctacagatccagaagattatgaagatgggtgtatacttgggtacaaggaacagttcctgcggctcagaaaatcaagtgtgtgccagaatggacgagattatgtagtcactaaacaaccctcaatatgcctttgttccctggaagatttcctctgcgattttgggtattatcggccagagaacgatagtaagtgcgtggaacagcccgaactcaaaggacatgatctagaattctgtctgtatggacgggaagaacatctcacaacaaatgggtacagaaaaatccccggagataaatgtcaggggggagttaatcctgttagggaagtaaaagatctgaagaaaaagtgtacttctaacttcctctctccagaaaagcagaacagtaagtccaattccgtaccaatcatccttgccatcgtaggacttatgctagttactgtggtagcaggggtcctaatagtgaaaaagtatgtctgtggagggaggttccttgtccaccgatattcagtgctccagcagcacgctgaagccaacggggtagatggagtcgatgcactcgatacggcttcgcatactaacaaatcggggtatcacgatgattctgatgaagatttacttgaa

SEQ ID NO: 19692 - DNA, 2082 bp, Artificial Sequence
  Description of Artificial Sequence: Synthetic coding sequence
atgacattcggccagtcaaagctgtatcggtctgaggattatggaaagaactttaaagacattaccgacctgatcaacaacacctttatacgcaccgaattcggaatggctatcggccccgagaactctggaaaagtggtgcttaccgctgaggtttccggtggctcacgaggaggtcggatctttcggtcgtcagactttgctaaaaattttgtgcagaccgaccttccctttcacccactgacgcagatgatgtattccccccaaaactctgattacctgctcgctctgagtacagaaaacggcttatgggtgagtaagaatttcggcggcaaatgggaggaaattcataaggccgtttgcttggccaagtggggctccgataatacaattttttttaccacgtatgcgaacgggagttgcacggatcttggggcccttgaactgtggcgtacttccgacctgggcaagagcttcaaaaccattggcgtgaagatttactcctttggcctcggtggacgcttcctgttcgcaagtgtcatggccgataaagatacaacccgtcgaatccacgtatcgacagatcaaggcgacacttggagcatggcacagctcccctccgtgggacaggaacagttctactcaatattggctgcaaacgacgatatggtgttcatgcatgtggacgaacctggtgacaccgggttcggcaccatcttcaccagcgatgaccgaggcatcgtgtatagcaaatctcttgaccgccacctttatactactaccggcggtgaaacagacttcacgaacgtgacatctctgcgcggagtctatattacgagcgtgctctcggaagacaatagcatccagaccatgataaccttcgatcaaggaggaagatggacacacttgcgcaaacccgagaattctgagtgcgacgcgacagcgaaaaataagaacgagtgcagcctccatatccacgcctcgtactcaatcagccagaaactgaatgtgccaatggcccctctgtctgagcctaacgccgtagggatcgttattgcgcatgggtccgtcggcgatgccatctcagtcatggtgcctgatgtgtatattagtgatgacggtggatatagttggacgaaaatgctcgagggccctcattattacacgatcttggattcgggtgggatcattgtagctattgagcatagtagtagaccaattaatgtcatcaaattctccacagatgagggccagtgctggcaaacctacacattcacccgcgaccctatctacttcacggggctggcttccgaacccggagctcggtcgatgaacatctctatctggggctttacagaaagtttcctgacaagccagtgggtatcttacactattgattttaaggatatcttggagagaaattgcgaggagaaggattacactatttggctggcgcacagcacggacccagaagattacgaggacgggtgcatcctggggtacaaggagcagttcctgaggctgcggaagagttccgtgtgtcagaacggtagagattatgtcgtgaccaagcaaccctccatctgcctatgtagccttgaggactttctatgcgactttggatactaccggcccgagaacgacagcaaatgtgtggagcagccagagctgaagggccatgacttggagttctgtctatatgggagggaggaacacctgactactaatggataccgcaagatcccaggggataagtgccaaggaggtgtcaatccggtgagggaagtcaaggacttgaagaagaagtgtacctctaatttcctctctcctgaaaaacagaactccaagtcgaatagcgtgccaatcatcctcgccatcgtgggtttgatgctcgtgacggtagtcgcaggtgtactgatcgttaagaaatacgtatgcgggggaaggttcctggtccacaggtactcagtgctacaacaacacgctgaagcaaacggcgttgacggagtcgacgctctggataccgcaagtcataccaacaagtctgggtatcacgacgattccgacgaggatctgctcgaa

SEQ ID NO: 19693 - DNA, 2082 bp, Artificial Sequence
  Description of Artificial Sequence: Synthetic coding sequence
atgaccttcggacagtccaagctttatagaagcgaagattatggaaagaacttcaaagatataacggatctgatcaacaatacttttattagaactgagttcggcatggctataggacccgaaaactctggcaaggttgtgctcacagctgaggtctcggggggctcaagaggggggaggatttttcggagtagcgacttcgcgaaaaactttgtacaaacagacctcccctttcatccattaacgcagatgatgtattcaccacagaactcagactatctcctagctctctctacagaaaacggtctttgggtgagcaaaaattttggaggaaagtgggaagagatccataaggccgtgtgcttggctaagtggggatccgacaacacgattttcttcactacctatgctaatggttcttgtaccgacctgggagctcttgagctatggaggacaagtgatctagggaagagtttcaagaccatcggcgtgaaaatatacagcttcgggctgggagggcgattccttttcgcttctgtgatggcagacaaagacactacgagaagaattcacgtgagcactgatcagggcgatacatggagtatggctcagctgccttccgtgggccaggaacaattttatagcatcttggcggcaaacgacgacatggtgtttatgcatgttgacgagcccggagatacaggcttcggaactatcttcacaagtgatgaccgaggaatcgtctacagtaaaagcctcgatcgccacctgtataccacaaccgggggcgaaactgatttcaccaatgtcacaagtttgaggggtgtgtacatcacctctgtgctgagcgaggacaatagcattcagactatgattacattcgatcagggcggtcgttggacccacttgcggaaacccgaaaacagtgaatgtgacgctactgcgaagaataagaatgagtgctctctgcacattcacgccagctacagtatcagccagaagctgaacgtgcccatggcgcctctctcggaaccgaacgccgtgggcattgtcattgcccatgggagtgtaggggacgctataagtgtgatggtgcccgacgtctacatcagtgacgatggtggatactcatggacaaagatgttagaaggcccccactactacacgatcctggattcaggtggaatcatcgtcgccattgagcattccagccgacctatcaatgtgatcaagttctcaacagatgaaggtcagtgctggcagacctatacatttactcgagacccaatttatttcaccggactggctagtgagccaggcgctcgatctatgaatattagcatatggggttttactgaaagcttcctcaccagccagtgggtgagctatacgatagattttaaggacattctggaaaggaactgtgaagagaaggactataccatctggctcgcgcatagtaccgatcctgaagactacgaggatgggtgtatcctcggatataaagagcaattcttgagacttagaaaaagctcagtgtgtcagaatggtagggattatgtggttacgaaacaaccttccatctgcttgtgctctctagaggactttctttgtgattttgggtactacaggcccgaaaatgactcaaagtgcgtagagcaacctgagttaaaagggcacgaccttgagttttgcctgtacggtcgagaagagcatcttacaacaaacggataccgaaaaattccaggggacaagtgccaaggtggtgtgaacccggtgcgcgaggtaaaggatctgaagaaaaaatgcacaagtaatttcttgagtcccgaaaagcagaattctaaatcgaactcagtgcctataattctagctatcgttggcttaatgctcgtgacagtggtggccggtgtacttatcgtgaagaagtacgtgtgcggaggaagatttttggtgcatcgttactccgtgctgcaacagcacgctgaggctaatggagttgacggggttgacgccctcgataccgcctcccatactaataagagtggatatcacgatgactccgacgaagatctgctggaa

SEQ ID NO: 19694 - DNA, 2082 bp, Artificial Sequence
  Description of Artificial Sequence: Synthetic coding sequence
atgaccttcggacagtccaaactgtaccgatcagaagattacggtaagaacttcaaagacattaccgatctgattaacaacacctttatccgcactgaattcggtatggcgatcggaccagagaactcaggtaaagtcgtgctgactgccgaagtgagcggtggatcgcgcggcggacgaattttccggagctcggatttcgccaagaactttgttcaaaccgatcttccattccatcctttgacgcaaatgatgtactcaccgcagaactccgactacctgcttgctcttagcactgaaaacgggctgtgggtgtcgaagaattttggaggtaagtgggaggaaattcataaagcagtatgccttgcgaaatgggggtctgataatactatcttcttcactacttacgcaaacggatcctgtaccgacctcggagcactcgaactttggaggacctcagatctggggaagtcctttaagactattggagtgaagatatacagctttggtcttggaggaagatttctgtttgcctccgttatggcggataaggatactacgaggcgaattcatgtgtcaaccgaccagggtgatacctggagcatggcacagctcccatctgtgggccaagagcagttttactcaatactggccgccaacgacgatatggtgtttatgcacgtggatgaacctggtgacaccggtttcgggaccattttcactagcgatgatcgtgggattgtgtactcgaagtcacttgaccgccacctctatactaccacgggaggtgagacggactttaccaatgtgaccagcctgaggggggtctacattacctctgtgctgtcggaggacaacagcattcagactatgattacctttgaccagggcggtcggtggacccatcttcgcaagccagaaaattcggaatgtgacgcaactgcaaaaaacaagaatgaatgctcactccacatccatgcctcgtactcgatttcgcagaaacttaatgtgccaatggcgccactgtccgaaccaaacgcagtgggaatcgtgattgcacacggatcggtcggagatgcaatctccgtcatggtgccagacgtgtacatatcggacgatggtggttactcctggaccaaaatgcttgaaggacctcattactataccatactggatagcgggggcataatcgtggctattgagcactcttccagaccgattaacgtcattaagttttcaaccgatgaaggccagtgttggcaaacctacaccttcacgagagatccgatttactttacgggactcgccagcgaacctggggccaggtcaatgaatatctccatttggggcttcaccgagagctttctgacttcgcaatgggtgtcatacactatcgatttcaaagatatacttgaacgtaattgtgaggagaaggactacactatttggttggcccattcgactgatcctgaggattacgaagatggctgtattctgggatacaaggaacagtttctgagactgcgcaagtcgtcggtctgtcaaaatggtagggactatgttgtgaccaaacagccttcgatctgtctttgctcccttgaagatttcctctgtgatttcggttactaccggccagaaaatgactcaaagtgtgtggagcaaccggagcttaagggccatgatcttgaattttgcctgtacggtcgcgaagaacatcttacgactaacggttaccgcaagatccccggcgacaagtgtcagggaggcgtaaacccagtccgcgaagtgaaggatctcaagaagaagtgtacctccaacttcctgtcgcctgagaaacaaaactctaaatcaaactcggtcccgattatcctggctattgtgggccttatgctcgtgaccgtggtcgcaggagtcctcattgtcaagaagtacgtgtgcggcggacggtttcttgtgcatcggtactcggtcctgcaacaacatgcagaagctaacggtgtggacggagtggatgctctggatactgcatcacatactaacaagtctgggtatcatgatgattcagatgaagatctgcttgag

SEQ ID NO: 19695 - DNA, 2082 bp, Artificial Sequence
  Description of Artificial Sequence: Synthetic coding sequence
atgaccttcggccaaagtaagctgtatcgatcagaagactacggaaagaactttaaagatataacggacctcatcaataacaccttcatccggactgaatttggaatggcaatcggccctgaaaatagcgggaaagtcgtgctgaccgccgaagtgagcggcggtagccgaggcggcaggatttttaggtcaagcgactttgctaagaacttcgtccagactgatctccctttccatcccctcacgcagatgatgtactctccacagaacagcgactaccttcttgccctgtctacggaaaacgggctatgggtgtcgaagaatttcggaggcaagtgggaggaaatccacaaggcagtctgcctcgcgaagtgggggtccgataatacaatctttttcaccacatacgctaacggttcatgcaccgacctcggcgcgctggagctttggcgcacctcagatctgggtaagtctttcaagacaatcggagtcaaaatatattctttcggcttgggcggtcgttttctattcgctagtgttatggctgacaaagataccacacgcaggattcacgttagcactgatcagggagatacctggtcaatggctcaactcccttccgtgggccaggagcagttttacagcatcctggctgctaacgacgacatggtgttcatgcatgtcgacgaaccaggcgacacagggtttggaaccatattcacatccgatgatagagggatcgtgtattcaaagagtcttgaccgccatctgtataccactacaggaggagagacagacttcacaaatgtaacctctttaaggggggtctacatcaccagcgtgctatctgaagacaattcaatacaaaccatgataacctttgatcaaggtggaaggtggacacaccttagaaaaccggagaattcagagtgcgatgcaacagccaagaacaaaaacgagtgtagcttacacatccacgcatcgtatagcattagccagaaattaaacgtgccaatggccccgttatctgagcctaacgctgtggggatcgtcattgcgcacgggtccgtgggcgacgctatctccgtcatggtgcccgacgtttatatcagcgacgatggaggctactcatggactaagatgttggagggcccacattattataccatcctggattcaggagggataattgtggctattgagcactcttcccgccccatcaatgtgatcaaattctccactgacgagggccagtgctggcagacgtacactttcactcgggatcctatctactttacagggcttgcctctgagcccggagctagatccatgaatatcagcatatggggatttacagaaagcttcttgacaagtcaatgggtttcctacaccattgacttcaaggatatcctggaaagaaactgcgaagagaaagattatacgatttggctcgcccacagtaccgatcctgaggattacgaggatgggtgcattctgggatataaggagcaattcttacgtctgaggaaaagctccgtatgtcagaacgggagagattacgtagtgaccaaacaacccagtatctgtctgtgttccttggaggactttctgtgtgacttcggctactaccggcccgaaaacgactccaaatgcgttgaacaaccagagctgaaagggcacgatcttgagttctgcctgtacggcagggaggagcatctgacaactaatggatacagaaagatccctggcgacaagtgtcagggtggagttaaccccgtgcgcgaagtcaaagatcttaagaagaagtgtacgtcaaatttcctaagccctgagaaacagaactcgaagtccaattccgtgcccattatcttagccatagtgggacttatgctagtgactgttgtcgccggcgtgttgatcgtgaagaagtacgtgtgtgggggtcgattcctcgtgcataggtactccgtgctacaacagcacgccgaggccaatggcgtggatggcgtggacgccttggataccgcttcacataccaacaagagtggttatcatgatgattctgatgaagacctgcttgag

SEQ ID NO: 19696 - DNA, 2082 bp, Artificial Sequence
  Description of Artificial Sequence: Synthetic coding sequence
atgacttttgggcaaagtaagctctaccgctcagaggactacggaaaaaacttcaaggatatcactgacctgatcaataacacctttatccgaactgaattcggaatggctatcggtccagagaactccggcaaggtcgtgcttacggccgaggtgtccggaggctcgagaggagggcggatctttaggtcatcagatttcgccaagaacttcgtgcaaactgatctgccattccatccgcttacccaaatgatgtactccccgcagaactcggactatctgctggcgctgtcgactgagaatggtttgtgggtgtctaagaacttcggcggaaagtgggaagaaatccataaggccgtctgcttggcgaagtggggtagcgacaacactatcttctttaccacctacgctaacggctcgtgcactgatcttggagccctggaactttggcggactagcgacctgggcaagtccttcaaaaccatcggcgtcaagatttactcgttcggactcggtggtagatttcttttcgcatcagtgatggccgacaaggataccactcggcggatccatgtgtcgacggaccagggcgacacttggtccatggcgcagctgccgtcagtgggtcaggaacaattctactccatcctggcagccaacgacgacatggtctttatgcacgtggatgaacccggtgacaccggatttggaacgatcttcacctcggatgataggggcatcgtgtactcaaagtcattggatcggcacctgtacactaccactggaggggagactgacttcactaatgtcaccagcctccgcggagtgtatatcacttccgtgctgagtgaggacaactccatccagacgatgatcacctttgaccagggaggccggtggactcatctgcgcaaaccggagaactcggagtgcgatgcaaccgccaagaacaaaaacgaatgctcgctgcacatccatgcctcctactcgatttcacagaagctgaacgtgccgatggccccgctcagcgaacctaatgccgtgggtatcgtgattgcccacggttccgtgggagatgcaatctcagtgatggtgccggatgtctacattagcgacgacggtggctacagctggaccaagatgctggaaggtccacactactacactattctggatagcggaggcattattgtcgcaatcgaacattcgtcgcgccccatcaatgtgattaagtttagcaccgacgaaggccagtgctggcagacgtacaccttcactcgcgatccgatctactttacgggcctggcatccgaaccgggagccagaagcatgaacatctcaatctggggtttcactgaatctttcctcacctcccagtgggtgtcttataccatcgacttcaaggacatcttggaacgcaactgcgaagagaaggattacactatatggctggcccactccaccgaccccgaagattacgaggacggatgcattctgggatacaaagaacaattcctgcggctgagaaaatcgagcgtgtgccagaacggacgggactacgtggtgacgaagcaaccgtcgatctgtctgtgctccctcgaggacttcctctgcgattttggatactataggccggagaacgactcaaagtgcgtcgagcaaccggagctgaagggtcatgacctggaattctgcctgtacgggagagaagaacacttgaccaccaatggataccgcaagatccctggagacaagtgtcagggaggcgtcaacccggtccgcgaagtgaaggatctcaagaagaagtgcacctcaaacttcctgagcccagagaagcagaacagcaagtcgaactcggtcccgatcatcctggccatcgtgggattgatgctggtgacggtggtggctggagtcctgatcgtgaagaaatacgtctgcggcggacggttcctggtgcatagatacagcgtgctccaacagcatgccgaggcaaatggcgtcgacggggtggatgccctcgacaccgccagccacactaataagtcgggctaccacgacgactcggatgaggacctcctggaa

SEQ ID NO: 19697 - DNA, 2082 bp, Artificial Sequence
  Description of Artificial Sequence: Synthetic coding sequence
atgacttttgggcagtccaaactatatcgaagtgaagactatggaaaaaacttcaaagatataactgatctcatcaacaacactttcataagaactgagtttggaatggccatcgggccagaaaattctggaaaagtagtactcactgccgaagtatctgggggatcacgcggagggcgcatcttcagatcctctgacttcgccaaaaattttgtgcagacagatttgccctttcatccactaacgcagatgatgtatagtcctcagaatagtgattatttgctggccctgtcaactgaaaatgggctgtgggtgtcaaaaaactttggaggaaaatgggaagagatccacaaggctgtgtgccttgcaaaatgggggtctgacaatactatttttttcacaacatatgccaatgggtcttgtactgacctaggagctttagaactttggcggacaagtgacctcggaaaatcattcaaaactatcggggtcaagatttactcgttcggattggggggacggttcctcttcgcatcagtgatggctgataaggatacaactcgcagaatccatgtgtccactgatcagggggatacatggtcaatggctcagctcccttcagtcgggcaggaacagttctattccatactagcggcaaacgatgatatggtcttcatgcatgtagacgaacctggagatacaggattcggaacaatctttacaagtgatgatagaggaatagtctattcaaaaagtcttgataggcacctctatactacgacaggaggggagactgactttacaaatgtcacatcccttagaggggtgtacataacatccgtgctcagtgaagataatagtattcagactatgattacatttgatcagggagggaggtggacacatctgagaaaacctgaaaattctgaatgcgatgcgacagccaaaaataaaaacgagtgctcccttcacattcacgctagttatagtatctcccagaaacttaacgtgccaatggctcctctatcggaacccaatgccgtagggatcgtaatagctcatggaagtgtgggggatgcaatttccgtgatggtgcccgacgtgtatataagtgatgatggaggatatagttggacaaaaatgctagaaggaccacattattatacaatacttgatagtggagggattatcgtggcaatcgaacattcctccagacccatcaatgtcattaagttctctacagatgaggggcagtgttggcagacttatactttcacacgggatcccatctattttacaggactggcatctgaaccaggggcacgatccatgaatatctcgatttgggggtttactgaatctttcctcacaagtcagtgggtgtcatatactatcgatttcaaggatatcctcgaacgaaattgtgaggagaaagactacactatatggcttgcccattccacagatcccgaagattatgaagatggatgtatcctaggatacaaagaacagtttttacgcctacggaaatccagtgtatgccagaacgggcgggattatgtcgtgactaaacagccatcaatttgtctctgttcccttgaagatttcctctgtgatttcgggtattataggccggagaacgattccaaatgtgtggagcagccagaactaaaaggacacgacctcgaattttgcttgtacggacgagaagagcatctgactactaatggatatcggaaaatccctggagataaatgtcagggaggagttaatcccgtccgggaagtaaaagaccttaaaaaaaaatgcactagtaattttctctctcctgaaaagcagaattccaaaagtaacagtgttccaataatactggcaatagtcgggctgatgctagtaacagtagtcgctggggtactgatcgttaaaaaatacgtttgtggagggagatttttggtgcataggtactccgtgctccagcagcacgctgaagcaaatggggtagatggggttgacgccttggatactgcttctcacactaataaatcagggtatcatgatgattctgacgaagatctattggag

SEQ ID NO: 19698 - DNA, 1893 bp, Artificial Sequence
  Description of Artificial Sequence: Synthetic coding sequence
atgcctaggtatggagccagtctgcgacagagttgccctaggtccggaagggagcagggccaggacgggacagctggggcccctgggctgctatggatgggactggtactggctctggcgcttgcactggcccttgccctggcactttccgacagcagggtgctctgggcaccagctgaggcccacccgttgtcgccacaaggccaccccgcccgactgcataggattgtgcctcgattgagagatgtctttggttggggtaatctgacttgtcctatctgcaagggcttgtttacagcaatcaatcttggactgaaaaaggagcccaatgttgcacgtgtaggctctgtcgctattaagctttgtaacctgctgaaaattgccccgcctgctgtgtgccaatcgattgtccaccttttcgaggatgacatggttgaagtttggagaaggtctgttctatcaccgtccgaggcctgtggcctgttgctaggcagtacttgtggccactgggacatcttctcttcttggaacatctctcttccaaccgttccgaagcctccgccaaagccgccgagccctccagctcctggcgctcctgtatcacggattctctttctcacggatctccactgggaccacgattacctggagggtaccgaccccgattgtgcagacccactctgttgcagacggggtagtggcctgcctcccgcttcacgccctggcgcaggatattggggagaatacagtaagtgcgacctgccgttgaggacgctcgagtctctgcttagcggtctcggccccgcggggcccttcgatatggtgtattggaccggcgacatcccagcgcacgacgtatggcatcagacacgccaggatcagctgcgcgccttgacaactgtgaccgctttagtgaggaaattcctcggccctgtgccagtctatcccgccgttggaaatcatgagtccacaccagtaaatagcttcccgccgcccttcatcgagggtaaccactctagcagatggttgtacgaagccatggccaaagcctgggagccttggctcccggccgaggctctgcggactctgcgcatcggtggattttatgccctgtctccttaccccggccttagattgatttccctgaatatgaatttttgttccagggagaacttttggttactgatcaactctactgatcccgctgggcagcttcagtggttagtgggagagctccaggcagcagaggatagaggggacaaggtgcacattatcggccatattccgccagggcattgccttaagtcttggagctggaattattaccggattgtagcccggtatgagaatacacttgcagcccagttcttcggacacacacacgtggatgaattcgaggtattctatgatgaggaaaccttatcaagacctctggcggtcgcgttcttagctccatcagccaccacgtatattggactgaatcctggctaccgcgtttatcagattgacgggaattacagcggttcctcacatgtagtgttggaccatgagacatatatcttgaatttaactcaagcaaacattcccggagcgattccgcattggcagctgctgtaccgcgctcgagagacctatggcctacccaatacactgcctaccgcgtggcataacctggtgtatagaatgagaggagatatgcagttatttcagacgttttggtttctgtaccacaagggacatcccccatctgaaccctgtggaaccccttgtagattggcaaccctttgtgcgcagctatccgcgagagccgatagccctgctctatgcagacacctcatgcccgacggctcacttccagaggcacagagcctgtggcctagacccctgttctgc

SEQ ID NO: 19699 - DNA, 1893 bp, Artificial Sequence
  Description of Artificial Sequence: Synthetic coding sequence
atgcctcgttacggcgctagcctccggcaatcatgccctcggtcgggacgggagcaaggacaggacggcactgccggagcccctggtctgctttggatggggctcgtgctggccctcgcgctggctctcgccctggctctggccctgagcgattccagggtgctgtgggcgcccgcggaggcccacccgctgtcgccacagggccaccctgcccgcctgcacagaattgtgccccggctcagggacgttttcggatggggaaacctgacttgtccaatttgcaagggacttttcaccgccattaatctcggccttaagaaggagccaaacgtcgctcgcgtgggttccgtggcgatcaaactgtgcaacctgctgaagatcgccccgcccgccgtttgtcagtcgatcgtgcatcttttcgaggatgatatggtcgaggtgtggcgccgcagcgtgctgtcaccgtctgaagcctgcggcctgctgcttggatccacgtgcggtcactgggatatcttctcaagctggaacatctctctgcccaccgtcccgaagccgccaccaaaaccgccgtcgcccccggctccaggagcgccagtgtcgagaatcctgtttctcaccgatctccactgggaccacgactaccttgagggcactgatccagactgcgctgacccactgtgctgtagacgcggctctggactcccgccggcgtcacgcccaggagcaggatactggggggaatactccaagtgcgacctcccgctcaggaccctggagtcactgttgtctggactgggccctgccggacctttcgacatggtgtactggactggggacattccggcgcacgacgtgtggcaccaaacccgccaagatcagcttcgggcactgaccactgtgactgctttggtgcggaaattcctcggacctgtgccagtgtatcccgcagtcgggaatcacgaatcaaccccggtgaattccttcccgccaccctttatagaaggtaaccactcatcacggtggctctacgaagcaatggctaaggcatgggaaccttggttgcccgccgaggcccttcgcacgctcagaatcggaggcttctacgcgcttagcccgtatccggggctgaggctgatctcgctgaatatgaacttttgtagccgggaaaacttttggctgctcatcaactcgacggatccggccggacagctgcagtggctggtcggcgagcttcaggccgcggaagatcgaggcgataaggtccacattatcggacatatcccccctgggcattgcctgaaatcgtggtcctggaactactaccgcatcgttgcacgttatgaaaatactttggccgcacaattcttcgggcatacccatgtggacgagttcgaagtcttttacgacgaggaaacgctgagccgccctctcgcagtggcgttcctggccccatccgcgaccacttacatcggcctgaatccgggataccgcgtgtaccaaatcgacggtaactattccggatcctcccatgttgtcttggaccatgaaacttacatactcaatctcacccaagccaacattcctggtgcgattcctcattggcaattgctgtaccgcgcgcgagaaacctacggacttcctaacactttgccgactgcctggcacaacctggtctaccggatgagaggcgacatgcaactctttcagaccttttggttcctgtaccacaaggggcacccgccgtcggaaccgtgtggaaccccatgcagactcgcaaccctctgtgcccagctgtcagcgagagcggattcaccggccctgtgtcgacatctgatgcccgacggctctctgccggaagcccagtcgctctggccgcggcctcttttttgc

SEQ ID NO: 19700 - DNA, 1893 bp, Artificial Sequence
  Description of Artificial Sequence: Synthetic coding sequence
atgcctagatacggtgcgtccctccggcagtcgtgtccccggagcgggcgagaacaagggcaggatggaaccgcgggagctccggggctgctgtggatgggactggtccttgcactcgccttggcacttgccctggccctcgccttgtcagactcacgtgtgttgtgggcaccggctgaggctcacccgctctcaccgcaaggacaccctgcgaggcttcacagaatcgtccctcgcctccgcgatgttttcggctggggcaacctcacttgtccgatttgtaagggactgtttaccgctattaacctcggtctgaagaaggagccaaatgtggcccgggtgggatcggtcgccatcaagctgtgcaatcttctgaaaatcgccccgccggctgtgtgtcagtcgatcgtgcatctgttcgaggatgacatggttgaggtgtggaggcgctcagtgctctccccgagcgaggcttgcggactgctgttgggaagcacttgcggacactgggacatcttttcgtcctggaacatctcactgcctacggttccgaagccgccgccgaagcctcccagcccgccagcacctggcgcacctgtcagccggatcctgtttctgactgacctgcactgggatcacgactacctcgaaggaaccgatccggattgcgcggatccgctgtgctgtcggagaggaagcggattgccccccgcgagccgccccggcgctggatactggggcgaatactccaagtgcgatcttccactccgcaccctggaatcactcctgtcgggactcggaccagcagggccgttcgacatggtctactggaccggcgacatcccggcgcacgatgtctggcatcaaactagacaggaccagctgagggctctgaccactgtcactgcgctcgtcagaaagttcctcggaccggtacctgtttacccagcagtggggaatcatgagtccacccctgtcaatagctttcccccaccattcatcgaaggaaaccattcgtcgaggtggctgtacgaagcaatggctaaggcttgggaaccgtggctgcctgccgaggcgctgcgcacgctcagaatcggaggattctacgctctgagcccatacccgggacttagactgatctccctgaatatgaacttctgctcaagagaaaacttctggctgctgatcaacagcaccgatccggcggggcaactgcagtggttggtgggcgaactgcaggctgcggaagatagaggagataaggtgcacatcatcgggcacatcccgccgggacactgtcttaaatcctggtcgtggaactactaccgcatcgtcgctcgctacgaaaatactctcgcggcacagtttttcgggcacacccacgtcgatgagttcgaagtcttttacgacgaagaaaccctgagccggccacttgcggtcgccttcctcgcaccgtcagctactacttatatcggactcaacccaggataccgcgtgtaccaaatcgatggcaactactccggttcatcacatgtcgtgctggaccacgaaacctacatcctgaatctgacccaggccaatatcccgggcgccatcccacactggcaactgctctaccgggcgagggaaacttatggactgccaaacaccctgcctacggcatggcataacctggtctaccgcatgaggggcgatatgcagttgtttcagactttctggttcctgtaccataagggacatcctccgtcggaaccatgcggtaccccgtgccgcctggcgactctctgcgcccagctgagtgcccgcgccgattccccggccctctgccgccacctgatgccggacggatcacttccagaggcccaatcgctgtggccgcgcccgcttttctgc

SEQ ID NO: 19701 - DNA, 1893 bp, Artificial Sequence
  Description of Artificial Sequence: Synthetic coding sequence
atgccaagatatggagccagcctgcgccagtcctgcccacggtctggccgcgagcagggacaggatggaacagcgggcgcccctggcctgctttggatgggcctggtgctggcactggcactggctctggcactggcactggcattgagcgatagccgcgtgctgtgggcgccggcggaggcccacccactgagcccccaggggcaccccgctcgattgcatagaatcgtaccaagactaagagacgtgttcggttggggcaatctcacctgtccaatctgcaaaggcctgtttaccgcgatcaacctgggcctgaaaaaggagccaaatgttgcgcgcgtaggtagcgtggctattaaactatgtaatctgctcaaaatcgcccctcctgccgtctgtcagagcatagtgcatctgtttgaggatgacatggttgaagtgtggcgtcgcagcgtgctgagcccatctgaggcgtgtggcctgcttcttgggtccacctgcggccattgggacatcttttccagctggaatattagtctgccgacggtcccgaaaccgccaccaaaaccaccgtccccacctgccccaggagcaccggtttcacgtattctgtttctgacggacctgcactgggatcatgattacctggagggtaccgatccggactgcgctgacccgctgtgttgccgacgcggttccggtctgccacctgcgagccgcccaggagctgggtactggggtgagtatagcaaatgtgatttgcctttacgaactctggagtccctgctgagcggcctgggcccggccggtccgtttgacatggtctactggactggtgatattccggcgcatgatgtgtggcaccagacgaggcaagaccagctgcgcgccctcactacagtcactgctctggtgaggaaattcctgggtcctgtccctgtttaccctgctgtgggtaatcacgagagcacacctgttaactcctttcctcccccgtttatcgagggcaaccactcaagccggtggttgtacgaggcgatggctaaagcgtgggaaccatggctgccagcggaggccctgaggacgctgcggattggtggcttttatgccctgtccccgtatcctggtctacgtttaataagcctgaacatgaacttttgctctcgcgagaatttttggctgctgatcaattctaccgatccagcgggtcaattgcaatggctggtaggcgaactccaggcggcggaggatagaggtgataaggtccacattatcggccatattcctcccgggcactgtcttaagagctggtcttggaattactaccgcatcgtggcccgctatgagaacactctcgctgctcagttctttggccacactcatgtagacgagtttgaggtgttttacgatgaggagaccctgtcacggccactggctgtggcgtttcttgccccgagcgcaacgacgtacatcggtctgaatccaggttatcgcgtttaccagatcgatggtaactacagcggtagcagccacgtagttctggatcacgagacttacatccttaatttgacgcaggcgaatattccgggagccatccctcactggcagttgttatatcgggctcgtgagacctacggcctcccaaacaccctgccgacggcctggcataatttggtctacaggatgcgtggagatatgcaactgttccagacgttctggtttctgtaccacaaaggtcatcctccgagcgagccttgtggtaccccatgtcgccttgcaaccctgtgcgcgcagcttagtgccagggcggacagcccagccctgtgccgccatctgatgccggacggtagcctgccggaagcccaatctctgtggccacgcccgttgttctgc

SEQ ID NO: 19702 - DNA, 1893 bp, Artificial Sequence
  Description of Artificial Sequence: Synthetic coding sequence
atgcctcgctacggtgcaagcctgagacaatcttgcccgagaagcggaagggagcaggggcaggacgggactgcaggggcgccaggattgctgtggatgggtctggtgcttgctctggcattggcgctcgcgctggcactcgcattgagcgattcgcgagttctgtgggccccggcagaagcccatccactctcaccacagggccaccctgcgaggttgcataggattgtccccaggctccgcgacgtgttcgggtgggggaatcttacctgcccgatctgtaagggactgtttacggccatcaatctgggactcaaaaaagaaccaaacgtggcaagagtcggttcggtggctatcaagctgtgtaacctgcttaagattgccccaccggcagtctgccagtcgattgttcatctttttgaagatgatatggtggaagtctggcggagaagcgtcctctcgcccagcgaggcatgcggacttctccttggttcgacctgtgggcattgggacattttcagctcgtggaatatctctctcccgaccgtccctaagccacctccaaagccccctagtccacccgcacccggagcaccagttagcagaatcctttttctgactgatttgcattgggaccacgattacctcgagggcacggatccagattgcgctgatcctctctgttgtagacgtggatcagggcttcctcctgcttcacgcccaggtgcaggttattggggtgaatactcgaagtgtgatctccctcttcgaactctggaatcgctgctcagtgggttgggacctgcaggaccatttgacatggtgtactggaccggcgatatcccagcccatgacgtgtggcatcaaacgagacaagatcaacttagggccctgactactgtgactgcactggtcagaaagttcctgggaccagtcccggtgtacccggcagtggggaaccacgaatcgactccagttaattcatttccacccccctttattgaagggaaccattcgtcccgatggctttacgaagctatggcgaaggcttgggaaccctggctgcctgcagaagcccttagaactctccgaataggaggcttctacgcactgagcccttatcctggtctgcgccttatttccctgaacatgaatttctgcagcagggagaacttttggctcctgatcaactcaaccgatccggcaggacagttgcaatggcttgtgggtgagctccaagctgcagaagatagaggcgacaaagtccacataattggacacatccctccgggacactgtctcaagagctggtcctggaactactacagaattgtggcgcgctacgagaacacccttgcggcgcagtttttcggccatactcacgtcgacgagttcgaggtcttttacgatgaagaaactctgtcgcgcccacttgcagttgcattcctggccccctcggccaccacgtacataggactgaatccaggttacagagtctaccaaattgatggtaactactctggctcgtcccacgtggtgcttgatcatgaaacctatatacttaacctgacccaagcaaacatccctggtgcaattcctcattggcagctcctttaccgcgcccgcgaaacctacgggctgccaaataccttgcctaccgcctggcataatctcgtgtacagaatgaggggagacatgcagctcttccaaactttttggtttctgtaccataaaggtcaccctccttccgaaccgtgtggaaccccttgtcgcctggcaaccctttgcgcgcaactgtctgcaagagccgatagccctgcgctgtgtagacacttgatgccagacggttcacttcctgaggctcagtcgctttggcctcgacctctcttttgt

SEQ ID NO: 19703 - DNA, 1893 bp, Artificial Sequence
  Description of Artificial Sequence: Synthetic coding sequence
atgcctaggtacggcgccagcctgagacagtcttgtcctcgctcaggcagagaacaggggcaggatggtactgcaggcgcccctggattactgtggatgggtctggttctcgccctagctctggccctcgccctggccctggccctatcagattcaagagttctgtgggccccagccgaggctcacccactgagcccccagggacaccctgcccggttacacagaatcgttccccgcctacgcgatgtgtttggctggggaaacctgacttgcccaatatgtaaaggcttattcaccgctataaaccttggcctgaagaaggaacctaatgttgcaagagtcggctccgtggcaatcaagctatgtaatctgctgaaaatcgctcccccagctgtttgtcagtccatagtgcacttattcgaggatgacatggtcgaggtgtggcgtcggagtgtcctgtccccctccgaagcatgcgggctgttgctgggctccacatgtggtcattgggatatcttctcttcctggaacattagcctgcccaccgtccccaaacctccacctaagccaccatctccaccggccccaggcgcccccgtgagccggatcctattcctgacagatttgcactgggatcacgattacctagagggtacagatccagactgtgccgatcccctatgctgtagaagaggtagcggccttccacccgctagccgtccaggggctggctattggggcgaatactcaaagtgcgatctgcccttacggaccctggagagtcttctctctggtctgggtccagcaggacccttcgacatggtatattggactggggacattcctgctcatgatgtgtggcaccagaccagacaagaccagcttagggccctaaccacagtgacagcactggttcgaaagttccttggccctgtgccagtctaccctgctgtggggaatcatgagagtacccctgtgaactccttccctcctccatttatcgaaggcaatcattctagccggtggctatatgaagccatggcaaaggcctgggaaccatggctccctgctgaggctctacggacactgagaattggtggattctatgctcttagtccttatcctgggttgcgcctcatctccctgaatatgaacttttgctctagagaaaacttctggctgctcataaacagtactgatcctgccggccagctgcaatggctcgttggcgagctccaagccgcagaagacagaggcgacaaagtgcacataatcgggcatataccccccggccactgcctgaagagttggagttggaattactaccgcattgtggctcggtatgaaaacactctggccgctcagttctttggacatactcatgtcgacgagttcgaggtgttctacgacgaggagacactctctcggcccctggcagtggccttcctggccccttcagcaacaacctatataggactaaaccctggttaccgggtctaccagatagacggtaactactctgggagctcccacgtggtgctggaccacgagacctatattctgaatctgacccaagcaaacatccccggtgccatcccccactggcaactgctctaccgggctagggagacctatggactgcctaacaccctacccaccgcctggcacaatttagtttataggatgaggggggatatgcagctgtttcagacattctggttcctgtatcacaaagggcatcctccttccgagccctgcggcacaccttgcagacttgcaaccttgtgtgctcaactgagcgccagagctgacagtcctgctctgtgcaggcacctgatgccagatgggtctctacctgaagcacagtccctatggccaagacctctgttctgt

SEQ ID NO: 19704 - DNA, 1893 bp, Artificial Sequence
  Description of Artificial Sequence: Synthetic coding sequence
atgccaaggtatggagcatccctgcggcagtcctgtccccggagtggccgggagcaaggccaggacggcactgctggggcgcccggactcctgtggatgggtctggtcctggccctggcgttggccttagctttagccctggctctgagcgatagccgggttctctgggcaccggctgaggctcaccccttgagccctcaggggcatcccgctcgcctgcatagaattgtgccccgcctcagggacgtatttggttggggaaatcttacgtgtccaatctgtaagggcctcttcaccgctattaacttgggactcaagaaggagccgaacgtcgcccgcgtcgggagcgtagcgataaaactctgcaacctcctcaaaatcgctcctcctgccgtctgccagtcgatcgtgcatctcttcgaggacgatatggtggaagtgtggagacgctccgtcctcagcccgtctgaggcttgcggcctcctactcggttccacgtgcgggcattgggatatttttagcagctggaatatttcgctgccaacggtgcctaaacctccacccaaaccacctagtccacccgcaccaggcgcccccgtgagtcgtatcctgtttctcacagacttgcactgggatcacgattatctggagggcactgatcctgattgtgccgatccactatgctgccggaggggctctggcttgccaccagcctccagacccggcgccggctattggggcgagtactcaaagtgcgacctaccattgcgcactcttgagagtcttctttctggcctcggccctgcggggcctttcgatatggtgtattggaccggagatattccagcccacgacgtgtggcatcagacccgacaagatcagttgagagcgctcacaacagttacggcactagtacggaagttcttgggcccagttcctgtgtatccagccgtggggaaccacgagtccacgcctgtcaattccttcccaccccccttcattgaggggaatcactcatcccgttggctctacgaggcaatggctaaagcttgggaaccctggttacctgcagaggcccttcgtaccctccgaatcgggggattctacgcgctgagcccttaccctggactgagactcatctccctcaatatgaacttctgctccagggagaacttctggttactgatcaactctaccgacccggccggtcaattgcagtggttggtgggagaactccaagccgccgaggaccggggcgacaaagtacatattataggacacatcccaccagggcactgtcttaagagctggtcttggaattactacagaattgtggcacgttacgagaacactcttgcagctcaattcttcggccacacacatgtggacgaatttgaggtcttttacgacgaggagactctgagcagacccttggccgttgcgtttctagcgccatcggctaccacttacatcgggctgaacccgggctatagagtctaccagatcgacgggaactacagcggcagctctcacgtggtgttggatcatgaaacatatatactcaacctaacccaggctaatattccaggggccattcctcattggcagcttctgtatagggcccgagagacctacgggctccccaacactctcccaactgcctggcataacctggtctaccgcatgcgcggcgacatgcagttattccagactttctggtttctctatcataaagggcaccccccatcagagccttgtggcaccccatgccgtctcgcaaccctttgcgcacaactatccgcccgcgcggattcaccagcactctgtagacatctaatgcctgacgggtcgctccctgaggcccagagcctgtggccacgcccactgttttgc

SEQ ID NO: 19705 - DNA, 1893 bp, Artificial Sequence
  Description of Artificial Sequence: Synthetic coding sequence
atgcctcgctacggcgcatctctccggcagtcgtgccccagatccgggcgggagcagggacaagacggaaccgctggagcaccagggctgctgtggatgggactggtgctggctctggcactggcccttgcccttgccctcgctctgtcagactcaagggtcctgtgggcacctgcagaagcccatcctctgtcacctcagggacacccggctagactgcaccgcatcgtgccaaggctgcgggatgtctttggatggggaaacctgacctgtccaatttgtaagggacttttcaccgccatcaatctcggcctgaaaaaagagcctaacgtggcccgcgtgggctcggtcgccatcaaactgtgtaacttgctgaagatcgccccaccagctgtgtgccagagcattgtccacctgttcgaggacgacatggttgaggtctggcgcaggtccgtcctgagcccgtccgaggcgtgcggactgctgctcggctcgacctgtggtcattgggacatcttctcgtcatggaacatctccttgcccactgtgccgaaaccgccaccaaaacctccgtccccgcctgcgccaggggcacctgtgtcaaggatcttgttcttgactgaccttcactgggatcacgattacctggaggggactgatccggactgcgcagacccgctctgctgtcgcagggggtcaggccttccaccggcatcaagaccaggcgcaggctactggggagaatactcgaagtgcgacctgccgctgagaacgctcgagtccctgctctcgggcctgggaccggcaggcccattcgatatggtctactggactggtgatatcccggctcacgacgtgtggcaccaaaccaggcaggaccagttgagggcgctcaccaccgtgaccgcgctcgtgcgcaagttcctgggacctgtgcctgtctacccggccgtgggaaaccacgagtccaccccggtgaacagctttccaccaccgttcattgaagggaaccatagctcacggtggctgtatgaagctatggcgaaagcatgggagccatggcttccagccgaagccctccgaaccctgcgtatcggcggattctacgccctgtcgccataccccggactgcgcctcatttccctgaatatgaatttctgttcgcgcgagaatttctggctgctcatcaatagcaccgacccagcgggacaactgcaatggctcgtgggggaactgcaggcggctgaggatcggggagacaaggtgcacatcatcggccatatcccgccggggcattgcttgaagtcgtggtcctggaactactaccgcatcgtcgcccgatacgagaacaccctcgcagcccagttcttcggacatactcacgtcgatgagttcgaagtcttttacgatgaagaaaccctgtcccgccctcttgcagtcgccttcttggcgccgtccgcgaccacctacattggactgaatcccggctaccgggtctaccagatcgacggaaattactctggctcgtcacacgtggtgcttgaccatgaaacctacatcctgaacttgactcaggctaacatccctggtgccattccgcattggcaactcctgtatagagcgcgggaaacctacggcctgccaaacaccctgcctaccgcctggcacaacctcgtgtacaggatgaggggcgacatgcagttgttccagaccttctggttcttgtaccacaagggtcatcccccatcggaaccatgcgggaccccgtgccggctggccactctctgcgcccagcttagcgcgcgcgcggactccccggcactgtgccgccacctcatgcctgacggatcactccctgaagcccaatccctctggcctcggcccctgttctgc

SEQ ID NO: 19706 - DNA, 1893 bp, Artificial Sequence
  Description of Artificial Sequence: Synthetic coding sequence
atgccaagatacggtgcttccctgagacaatcctgtcctaggtccggacgcgaacagggtcaagatgggacggccggagctcctggactcctttggatgggccttgtccttgccctggcgctggcattggcgctggccctcgcactgtcagattcgcgcgttttgtgggctccagccgaagcacatcccctctcgcctcaaggtcaccccgcacgcctgcacaggattgtccctcggctccgggatgtgtttggatggggaaacctcacctgccccatctgcaagggattgttcactgcgattaacctgggactgaaaaaagaacccaatgttgccagagtgggctctgtggctatcaagctctgcaatctgcttaagattgcgccgccagctgtctgccagagcattgtgcacctgttcgaagatgatatggtggaggtgtggaggcggtccgtgctgtcgccctccgaggcgtgcggactgcttctgggctcgacctgcggccattgggacatctttagctcgtggaacatctccttgccgaccgtcccaaagccgccacccaagccgccgagccctccggcaccgggagccccagtctcgagaatcttgttcctcacggacctgcattgggaccacgactacttggaaggcactgacccggactgcgcggacccgctgtgctgtcgacgcggatcgggactccctccagcttcgcggccgggagccggatactggggcgagtacagcaaatgtgatctcccactgcgaactctggaatccttgctgtcaggtctggggccggcgggcccttttgatatggtgtactggactggcgacatcccagcgcacgatgtgtggcatcagactcggcaggatcaactgagggctcttactaccgtgactgcgctggtcaggaagttcctgggacctgtgcccgtgtaccccgccgtcggaaaccatgagtccacgccagtgaactcatttccgccaccattcatcgagggaaaccattcctcccggtggctgtacgaggcaatggccaaagcgtgggaaccgtggctgccggctgaggcgctgaggaccctgcgcattggcggtttctacgcactctcaccgtaccctggactcagactgatttccctgaatatgaacttttgctcgcgggagaatttctggctgctgatcaattcgactgaccctgctggacagctgcagtggctggtcggggaactgcaagcagcagaggaccggggggacaaggtgcacatcatcggccacatccctcccggacactgcctgaagtcatggtcgtggaattactaccgaatcgtcgcgcggtacgaaaacaccttggccgcccaattcttcggacacacccacgtcgacgagttcgaagttttctatgatgaagaaaccctgtcacgccccctggcagtcgcattcctcgcaccgtcagccaccacctacatcggactgaacccgggctacagagtgtaccaaatcgacggtaattactcagggtcctctcacgtggtcctggaccacgagacttacatcctcaatctcacccaggctaacatcccaggcgccatcccgcattggcagttgctgtaccgcgcccgagaaacttatggactgccgaatacgttgccaaccgcgtggcataacctggtctatcggatgcgtggggatatgcaactgtttcagaccttctggttcctttaccataagggacacccaccgtcggaaccgtgtgggacgccctgccgcttggccactctctgtgcacagctgagcgcccgggccgattccccagcattgtgcagacacctcatgccagacggcagcttgccagaagcgcagtctctgtggccgcgtccgctgttctgc

SEQ ID NO: 19707 - DNA, 1893 bp, Artificial Sequence
  Description of Artificial Sequence: Synthetic coding sequence
atgcctaggtatggcgcaagcctgaggcagagctgccctaggtctggcagagaacagggacaggatggaaccgcaggtgccccaggcctgctttggatgggactggtccttgcactggcactcgccctggccctcgctctcgctctgagtgactcacgcgtgctgtgggcccccgctgaagctcaccctctctcaccccaaggacacccggcgagattgcaccgcattgtacccaggctgagagatgtattcggctggggaaatcttacatgccccatatgcaagggactgttcactgccatcaatctgggcctgaagaaggaaccgaatgtggctcgcgtcggttccgtcgctatcaaactgtgcaatctccttaagattgcaccgcccgccgtctgccagagtatcgtgcacttgttcgaggacgatatggtggaagtctggaggagatctgtgttgtccccttcagaagcctgtggactgctgctgggctccacgtgtggtcactgggatatcttctccagttggaacatcagtttgcctactgtccccaagcctccacctaaaccaccctcacctccagcccctggcgcccctgtctctcgcatcttgtttttgactgatttgcactgggaccacgactaccttgagggaacagatcctgattgcgctgacccactgtgctgccgcagaggctccggcctcccaccagcctcccgcccgggagccggttactggggagagtactccaaatgtgacttgcccctcaggacacttgagagcctgctgagcggtttgggacctgccggtcccttcgacatggtgtattggaccggcgatatccccgcccatgatgtgtggcaccaaacaagacaggatcaactgagagctctgactaccgtgaccgcactggtaaggaagttcctgggccccgtgccagtatacccggctgtgggaaaccacgaaagcaccccagtcaacagtttcccccctccatttatcgagggaaatcactccagcagatggctgtatgaggcaatggctaaggcatgggagccatggttgccagcggaggcgcttcgcacactgaggattggcggtttctacgctttgtctccctaccctggcttgaggttgatcagtttgaatatgaacttctgtagcagggagaatttctggctgttgataaattctacagatccagcaggtcaactccagtggttggttggcgagctccaagccgccgaagataggggtgataaggtgcatattattggacacatcccccctggtcattgcttgaaatcctggtcctggaactattatagaatcgtggctcgctacgaaaacacacttgctgcgcagtttttcggtcacacccacgtggacgaattcgaagtgttttacgacgaagagacactgagccgcccgcttgccgtggcatttctggccccttctgcgacgacctatatcggtcttaacccgggctatagggtctaccagatcgatggaaactactcaggaagcagccatgtggttctggatcacgaaacatacattctgaacctgacccaagctaatattcccggagcgatcccacactggcagctcctttaccgcgcccgcgagacttacggcttgcccaacacgttgccgacggcttggcacaacctggtgtatcgcatgagaggcgacatgcagttgtttcagaccttttggttcctttaccacaaaggacacccaccgtccgagccatgtggaacaccatgccgccttgctacgttgtgcgcacagctttctgcaagggctgactctccggcactctgcaggcatttgatgccagatggttcactgccggaggcccagtcactctggcctagacctctgttctgt

SEQ ID NO: 19708 - DNA, 1893 bp, Artificial Sequence
  Description of Artificial Sequence: Synthetic coding sequence
atgcctcgctatggcgcgagcctgaggcagtcctgtccaagatccggcagggagcagggtcaggatggtaccgctggtgcacctggacttctctggatgggactggtgttggccctggcgcttgccctggcacttgctctggcgctctccgacagccgggtattatgggctcctgctgaagcacaccctctgtctccccagggacaccccgcacggctgcacaggatcgtgccacgcctaagggacgtttttgggtggggcaatctcacttgtccgatctgcaagggactcttcactgccatcaatctaggattgaaaaaagagcccaacgtggcacgggtgggtagcgtagcaataaaactgtgcaacctgctgaaaattgctccgcccgcagtctgccagagcatcgtccatctgtttgaagatgatatggtggaagtgtggcgtcggagcgtactgtctccctctgaagcctgtgggcttctccttggcagtacatgcggccactgggacatattcagcagctggaacatttctctgcccaccgtgcccaagcccccccctaagccacccagcccgcctgcccccggggctccagtttcacgtatcctgtttctcactgatctgcactgggaccacgattacctcgaaggcacggatccggactgcgcagaccctttgtgctgccggcgaggttcgggtctgcctcccgccagtcgacccggcgctggttactggggcgaatattcaaagtgtgaccttccacttagaacgctggagtccctgttaagcggactgggccctgccggcccattcgatatggtatattggactggagacattcccgctcatgacgtgtggcaccagacaagacaggaccagctgcgggccctcaccactgtcacagctttagtgcgcaagtttttgggccctgtaccggtctatcccgctgtcggcaaccacgagtccacgcctgtgaattctttccccccaccctttatcgagggcaatcactcttccagatggctttacgaagctatggcaaaggcatgggagccttggttgcccgctgaagcgctccgaaccctgaggatcggcggattctacgctttgtccccatatccaggcctgaggctcatctcgctgaatatgaatttctgtagccgggaaaatttctggctcctgatcaattccacagatcctgccggccaactccagtggctggtgggggaactccaagccgccgaagatcggggcgacaaggttcatatcattggacacataccccctgggcattgtctgaaaagttggagctggaactactaccgcattgtagcacggtacgaaaatacccttgccgcacagtttttcggccatacacatgttgacgaatttgaggtgttctatgacgaagaaacactgtccaggcctctagcagtggccttcctggcgcccagcgctacaacttatatcggcctgaacccaggctaccgggtgtaccaaatcgatgggaactattctggaagctctcatgttgtgttggaccacgagacttacatattaaatctgacgcaggcaaacatacctggagccatcccccattggcagctgttgtaccgggcccgtgagacttacggtcttcccaatacactccccactgcctggcacaacctggtctaccggatgaggggcgacatgcagctgttccaaactttctggttcttgtatcacaagggtcaccccccaagtgagccatgcgggacaccctgtagactggccactctttgcgcccagctttccgcaagagctgattcaccggccctatgtcgccatttgatgccagatggaagtctgccggaggcgcagtctctgtggccgcgtccactcttctgc

SEQ ID NO: 19709 - DNA, 1893 bp, Artificial Sequence
  Description of Artificial Sequence: Synthetic coding sequence
atgccgaggtacggggcctcactgaggcagagttgtccccgatcaggtagggagcagggccaagatgggactgccggcgctccgggcctgctgtggatggggctcgtgctggccctcgctctggccctggcgctcgctctggcactgagcgatagccgggtgctgtgggcccccgccgaggcgcatcctctctcaccgcagggccaccccgcccgacttcaccgaatcgtgcctagactgcgtgacgtattcggctgggggaatctaacctgccctatatgtaaaggactgttcacggccataaacctcgggttgaagaaggagcccaacgtagcgcgggtgggcagtgtcgcgatcaaactatgcaacctactaaagatagctcctcctgcagtctgtcagagtatagttcacctctttgaagacgatatggtagaggtctggcgcagatctgtgcttagcccaagtgaagcttgtggcctgctactgggttctacttgcgggcattgggacatcttctccagctggaacataagtctgccgacagtgcctaagcctcctcccaaaccaccaagcccccctgcacccggtgcacctgtttcgagaatcctcttcctcacggacctgcactgggaccatgactacctggaaggtacagatcccgattgtgcagatcccctttgttgcagacgtggctcaggcctgcctcctgccagccggcctggtgccggttactggggagagtactctaaatgtgacttgcccctgagaacactagagagcctgctctctggactgggacccgctggaccgttcgacatggtgtactggaccggtgacattcctgcacacgacgtgtggcatcagactcgacaggaccaactgcgagccctaactactgtaaccgcactagttcgtaagttcctggggcccgttccagtttatcccgctgtgggcaaccatgaaagtactcccgtgaatagcttcccaccccccttcattgaaggcaaccactcttcccgatggctatacgaggcaatggccaaggcatgggaaccttggctaccggccgaagccctgcggaccctgcgtattggagggttctacgctcttagcccctaccctgggctgcgcctgatttcccttaacatgaacttctgctcccgggagaatttctggttgctcatcaattctaccgatcccgcaggccaactacagtggctggtgggtgagctgcaggcagccgaagaccgaggggacaaggtacatatcatcggtcacatcccccctggtcactgtttaaagagttggtcctggaactactaccgcattgtcgcccgttatgaaaacactctggcggcacagttttttggccacactcatgtcgatgagtttgaggtgttctatgacgaagaaaccctgtctagacctttagctgtcgcatttctggccccgtctgcaaccacatacatcgggctgaaccctggttaccgcgtgtatcagattgacgggaactactccgggagctcacacgttgtgctggatcatgaaacctacattctaaatttgacccaggctaacatacccggggctattccccattggcaattgctgtatcgagccagagagacatacgggctacctaataccttgccgacagcttggcacaatcttgtttatcgaatgcggggtgatatgcagttatttcaaaccttttggttcttataccataaaggccacccgcctagcgagccctgcgggacaccatgtaggctggccacgctctgtgcccagctgtctgccagagctgactcaccggccttgtgcaggcatttaatgcccgacggtagcttgcctgaggcccaatctctctggcctcggccccttttctgt

SEQ ID NO: 19710 - DNA, 1893 bp, Artificial Sequence
  Description of Artificial Sequence: Synthetic coding sequence
atgcccagatacggtgcttcactgaggcaatcctgcccgcggtcggggcgcgagcagggacaggacggtactgctggcgcccccgggctgctgtggatgggacttgttctagctcttgcccttgccctagcattagcgttggcgttgtcggatagtagagtcctctgggctcctgctgaagcgcatccattgtctccacaaggacaccccgcacgattacataggatagtaccgcgcttacgcgacgtattcggatggggcaatttgacatgccccatctgtaagggactttttaccgctatcaatttgggactgaagaaggagcctaatgtcgctcgcgtcggctcggttgccatcaagctatgcaacttgctgaaaattgctccacccgcggtctgtcagtctatcgttcacctttttgaggatgatatggtggaagtttggcgtcgttccgtactcagccccagcgaagcctgcggtcttcttctcggttccacttgtggtcattgggatatcttttcgagttggaacatctctcttcccacggtccccaagccccctcctaagcctccgtcgccgccggcccctggggctccggtttcccgcattctattcctaactgacctgcattgggatcatgactatctggaggggaccgatccggactgcgctgatcccttatgttgccgccggggcagtggtctcccccctgcttcccggccaggagcgggctactggggagaatactcgaaatgcgacctgcccctacgaacattggaatctctcctgtccggtttgggtcccgccggcccattcgacatggtctattggaccggggacatccccgcgcatgacgtttggcatcaaacacgtcaagaccaactccgcgctctgacaacagttaccgctctcgtccgtaagtttcttgggcctgttcctgtgtatccagcagtcggaaaccacgagtcaactccagtgaacagtttccctcctcctttcatagaaggtaaccactcttctcggtggctgtacgaggcgatggcgaaagcgtgggaaccatggctaccagccgaagccttgcgaacactccgaatcggcggattctacgcgttgtctccatacccaggtcttagactcatctctctcaacatgaatttttgctcccgggagaatttctggctgctcataaattcgaccgaccctgcgggacaactgcaatggctggtgggggaactccaggcagcagaggataggggggacaaggtgcatattatcggacatatccctccaggacattgccttaaatcatggagctggaactattatcgaattgtagctcgttacgaaaacactctcgcagcacaattcttcggtcatacgcatgtcgatgagttcgaggtattctatgatgaagagaccctttcgcgaccattagcggtggccttcttggcaccttcggctactacttatatcgggctcaacccaggatatcgtgtgtatcaaatagatggcaattattcaggtagttcccacgtagtgctggatcatgagacctatattcttaatcttacccaggcaaatatccccggtgcaattccacattggcaattgctgtacagagctagggagacctacgggctgcccaatacactaccaacggcatggcacaacttggtgtaccgtatgcgcggtgacatgcaactcttccaaactttttggttcttgtatcacaagggccatccaccttctgaaccttgcgggacgccgtgtcggctggcaactctgtgtgctcaactcagtgcccgggcggattcgccggcattgtgtcgacacctgatgcctgatgggtcgttgccggaggcacagagcctatggccgcgtcccttgttctgc

SEQ ID NO: 19711 - DNA, 1893 bp, Artificial Sequence
  Description of Artificial Sequence: Synthetic coding sequence
atgccgagatacggtgctagcctgaggcagtcctgccctagatcggggagagaacagggccaggatgggactgcgggagcaccaggccttttgtggatgggtcttgtcctggcgctggcacttgcattggcgcttgcactggcactttcggactcgcgcgtgctgtgggcaccagcagaagcacatcctctcagcccacaaggtcacccagccagactgcaccgaatcgtgcctaggctccgggatgtgtttggatggggaaatcttacctgtccaatctgtaaggggctcttcactgctatcaacttgggacttaagaaggaacccaacgtggcaagggtgggttcggtcgccataaaactttgcaacctgctgaagattgcaccgccagcagtctgccaaagcatcgtgcacctcttcgaagatgacatggtcgaagtgtggagaagatccgtgcttagtcctagcgaggcctgtggtctgcttcttggctccacctgtggacactgggatatcttctcctcgtggaacatatccctgcctactgtgcctaagccacctccaaaacctccatcgccacctgcaccaggagcaccagtgagcaggatactgttccttaccgatctgcactgggaccatgattaccttgagggcaccgacccggactgtgcagatcctctgtgttgtagacgaggatcgggactgcctccggcgtcccgccctggggctggatactggggggaatatagcaagtgcgatctgccacttaggaccttggaatcgctcctcagcgggctcggccctgctggcccgttcgacatggtctactggaccggagatatcccggcacacgatgtgtggcaccagacccggcaagatcaactgagagcacttaccactgtgaccgcgctggtcaggaaattcctgggtcctgtcccggtttatcctgcggtgggaaaccatgaaagcacgccagtgaacagctttccaccaccgtttattgaaggcaaccattccagccggtggctgtacgaagctatggcaaaggcatgggagccatggctgcctgcggaggcactgagaactctgagaatcgggggattctacgcgctgagcccttaccctgggttgagacttattagcctcaatatgaacttctgttccagagaaaacttctggctgctgattaactctactgaccctgcaggacagctgcagtggctcgttggagaactgcaggccgccgaagatcgcggagataaggtgcacatcattggtcatattccccccggccattgtctcaagtcctggtcatggaattactacagaattgtggcgcggtacgaaaacactctggcagctcagttttttggacacactcacgtggatgagtttgaagtgttttacgatgaggaaacccttagcaggcctctggcagttgccttcctcgcaccatcagcaactacgtatatagggcttaatcctggctaccgtgtgtaccaaatagacggaaactactcgggttcgtcacatgtcgtccttgatcacgaaacttacatcctcaatctcacccaagccaatatacctggagccattcctcattggcaattgctgtacagagcccgtgagacttacggattgccaaatactcttcccacggcatggcataacctggtctaccgcatgcggggagatatgcagctgtttcaaaccttttggttcctttaccacaagggtcatccgccaagcgagccttgtggcaccccatgccgccttgccaccctttgtgcacaactgtccgcgcgggcagactccccggcactgtgtcggcaccttatgccagacggttcgcttccggaggcccaatccctgtggcctcgcccactgttttgt

SEQ ID NO: 19712 - DNA, 1893 bp, Artificial Sequence
  Description of Artificial Sequence: Synthetic coding sequence
atgcccaggtatggagcaagcttacggcagtcatgtccaaggtcgggccgagaacaggggcaggatggcactgctggggcacccgggctgctgtggatggggctggttttagccctggcgctggccttggccctcgcattagcactctctgactctagagttctgtgggcgcccgctgaagcccacccattatctccccagggccatccagctcgactgcaccgaattgtgcccaggctccgggatgtgtttggatgggggaatctcacctgccctatttgcaaaggccttttcactgcaatcaacttgggcctgaaaaaagaacctaatgtggcaagggtaggttcagtggctatcaaactgtgtaacctgctaaagattgctccccccgccgtgtgccagtcgattgtccacctgttcgaagacgacatggttgaggtctggaggagatccgtgttatcgccgtcagaggcctgcggcctgctgcttgggtctacctgtggacattgggatattttttcgagctggaacattagtttaccgaccgtgcctaagcctcctccaaagccccccagcccgcctgcccccggtgctcccgtttcaagaatcctgttcctgaccgacttgcattgggaccacgattacttggaaggcacagaccccgattgcgctgaccccctgtgttgcaggagggggtccggactgccacctgctagtcgtccgggcgctggatactggggcgaatactccaaatgcgacctgccactgaggactctggaatccctactgtcaggcctgggccccgctggcccttttgacatggtgtactggacgggagacatcccagcccatgatgtctggcatcaaactcgacaagaccagcttcgagcactgactacagtcacagcactcgtaaggaagtttctcgggcctgtccccgtatatcctgcggtgggtaaccacgaaagtactccagtgaatagctttccccctccgtttatcgagggaaatcatagcagccgttggctgtacgaagcaatggccaaagcctgggaaccctggttaccggccgaagcactgaggacgctcaggataggaggcttttacgcgctgtctccctaccctgggctgcgattgatcagcttaaatatgaatttttgctccagggaaaatttctggctgctgattaattccaccgaccctgccggccagttgcagtggctcgtgggagaacttcaagccgccgaggacaggggggataaagtgcatattatcggtcacatccctccaggacactgcctgaagtcatggagctggaattactacaggattgtagctaggtacgagaacaccctggccgcacagttctttggacacacccatgttgacgagtttgaggtgttttacgacgaggaaactctgtctcgtccactggcagtggcattcctcgcaccttcagcgaccacgtatatcggtctgaatcctgggtatagagtgtaccagatcgacggaaattactctggctcctcacacgtagtccttgaccatgagacgtacatcctgaatctcacacaggctaatatccccggggcaatcccccactggcagctactatatcgagcacgggaaacttacggtctgccaaatacgctgcccacagcctggcacaacctggtttaccgtatgagaggggacatgcagttgtttcagaccttttggtttttatatcacaaaggacacccaccctccgaaccttgtggcacgccttgtcgtctggctacactctgtgctcagctctccgccagagccgatagtcctgctctgtgtcgtcatctgatgcccgacggaagcttgcctgaagcccagtccctgtggccacgaccgctgttttgc

SEQ ID NO: 19713 - DNA, 1893 bp, Artificial Sequence
  Description of Artificial Sequence: Synthetic coding sequence
atgcctcgttatggggcgagccttcgccaaagttgccccaggagcggtagagaacaaggtcaagatggcaccgcaggtgcaccagggctgctgtggatgggtcttgtccttgcccttgcactggcacttgccctcgcgttggccttgtccgacagccgggtgctgtgggcccccgctgaggcacatcccctgtcccctcaaggccatcctgcacggctgcatcgaatagtccctcggctgcgtgatgtattcggatggggcaatctgacttgtccaatttgtaagggccttttcactgcaatcaacctgggcctcaaaaaagaacctaacgtggcacgggtcggatcagtggccatcaaactttgtaacttgttgaagatcgctcctcctgccgtgtgtcaaagcattgtgcatctgttcgaagatgacatggtcgaggtgtggcgccgctcggtgttgtcaccctcggaagcatgcggacttctgctcggctccacctgcggccactgggatatcttttcctcatggaacatctcgctgcctactgtgcctaagccgcctcctaagcctccttcccctcctgccccgggagcaccagtgtccagaatcctgtttcttaccgaccttcattgggaccacgactatctggaaggaactgatcccgactgtgcagatccattgtgttgccgtagaggctccggacttccaccagccagcaggcctggggcaggatactggggcgagtactccaagtgtgatcttcctctgagaactcttgaaagcctgctgtcggggcttggtcctgcgggaccatttgatatggtctactggaccggcgatattccggcccatgatgtgtggcatcaaaccagacaggaccagcttagagcgcttaccaccgttactgccctggtccggaagtttctggggccagtcccagtgtatcctgcagtgggcaaccacgaatcgacgccagtcaactcgttcccacctccattcattgagggaaatcattcgtcacgatggctgtacgaagcaatggcaaaggcatgggagccttggcttccagcagaagcactgcggacccttagaataggtggcttttacgccctttccccatacccaggacttcggctgatttccttgaacatgaatttctgctctcgcgaaaacttttggctcttgatcaattctaccgacccagcgggccagcttcagtggctcgtgggcgaattgcaagcggcagaagatagaggcgataaagtgcatatcatcgggcatattcctcccggtcattgtcttaagtcatggtcgtggaactactacagaatcgtggcaagatacgaaaatactctggcggcgcaattctttgggcatactcacgtcgatgagtttgaggtgttctacgatgaggaaactctttcccgccctctggcagtggcattcctggctccttccgcgactacctacatcggtcttaaccccgggtaccgcgtctatcagattgatggaaactactccgggtcgtcgcatgtggtgctcgaccacgagacttacatcttgaatcttactcaggcaaacattccgggagcgatcccccattggcagctgctgtacagggcgcgcgaaacctacggactgcctaatactctccccactgcgtggcataatctggtctacagaatgcgtggagatatgcaactcttccaaaccttttggtttctgtaccataagggtcaccccccgtcagaaccttgtgggactccttgccgtctggcaactctctgtgcacagcttagcgcacgtgcagattcgccggctctctgtaggcatcttatgccagatggctcccttccagaagcacagagcctgtggccaagaccccttttctgc

SEQ ID NO: 19714 - DNA, 1893 bp, Artificial Sequence
  Description of Artificial Sequence: Synthetic coding sequence
atgcctaggtatggggcctccctgaggcagagttgcccaaggtccggacgcgaacaggggcaggacggcactgccggagctcccggactgctctggatgggactcgttcttgcacttgcgcttgcactggctcttgctctggcattgagcgactcaagggtgctgtgggctcccgccgaggcccatccactctctcctcaggggcaccccgcccggctacataggatcgtgccaagactgcgcgatgtctttgggtggggtaacctgacgtgtcccatttgcaaaggcctcttcaccgccattaacctggggctgaaaaaagagcccaatgtagcccgagttggatcagtagcgattaagctatgtaacttactcaagatcgccccccccgccgtttgccagtctattgtgcacttgtttgaagacgacatggtggaggtatggcgcagatccgtgctgtctccatcggaagcttgtggactcctcctgggatctacctgcggccattgggacatcttctctagctggaacataagtctgcctaccgtgcctaagcccccgcccaaacccccttctccacctgctccgggcgcacccgtctctcggatcctgttcctgacagatctgcattgggaccatgactatctggagggcacggatcccgactgtgcggatcccctctgctgcagacgagggagcggacttccgcccgcctcgcggcccggagctggctattggggagagtatagcaaatgtgaccttcctctgcgaaccctggaatctctgctttcaggactcggccccgctgggccttttgacatggtatactggactggcgatatccctgcgcacgacgtatggcatcagaccaggcaggatcagttgcgggctctgaccacagtaaccgccctcgtccggaagtttctgggtcccgtccctgtctatcccgccgtcgggaatcacgagtctaccccagtcaacagcttcccacctcccttcattgagggaaaccactcatcaaggtggttatacgaggctatggctaaagcatgggagccatggcttccagccgaggctctccgaacacttcgtattggaggcttctacgctttgagcccgtaccctggcctgcgactgatatcgcttaacatgaatttctgctcaagagaaaatttttggctgttaatcaattcaacagacccagccgggcagctgcagtggttggtcggcgaattacaggctgcggaggaccgcggagataaggtgcatatcattggccatattcctcccggccactgtctcaagtcctggtcttggaactattaccgcattgtggcacgttacgagaatactcttgccgcacagttttttggccatacgcacgtcgacgagttcgaagtcttttacgatgaggaaaccctctcgagacctctcgctgtggcctttctcgcaccttcagctactacttatattgggctgaatccaggctatagagtctaccagattgacggcaattactcaggtagtagtcatgtggttctggatcatgagacctacatactcaacctgactcaggcgaatattccaggcgccattcctcactggcaactgttgtacagagctcgggagacgtacgggctcccaaataccctgcctacagcatggcacaaccttgtctaccgaatgcggggggacatgcagctcttccagacattttggtttctctatcataaaggccatccaccatctgagccttgcggaacgccctgtcggcttgccactctgtgcgcccagcttagtgctcgcgcggattcccccgcgctctgccgacacctcatgcctgatgggagtttgcctgaagcccagagtctgtggccaaggcctctgttttgc

SEQ ID NO: 19715 - DNA, 1893 bp, Artificial Sequence
  Description of Artificial Sequence: Synthetic coding sequence
atgccaaggtacggagcttcactgagacagagttgcccgaggagtggccgggagcaggggcaagacggaacagcaggcgcacctggccttctttggatgggcctagtgctggctctggctttagctctggccctggcattggccctcagcgatagcagggtattgtgggcaccagctgaagctcatccactatcccctcagggccatcccgccagactccaccgaatcgtcccccgtcttcgagatgtgtttggttggggtaacttaacttgtcctatctgtaagggtctctttaccgccattaacctggggctcaaaaaggaacccaacgtcgcccgtgtggggtcagtagccataaaactgtgcaacctactcaaaattgcgccgcctgcagtgtgtcaatctattgtgcatctgttcgaggacgacatggttgaagtctggagaagatctgttctgagcccgagcgaggcttgcggtctgctgctaggctccacctgcgggcactgggacatattcagttcatggaacatctcgctccctacagtaccgaagccccctcccaaaccaccatctcccccagcacccggggcacctgtctctaggatactgttccttactgacttgcattgggatcatgattatttggaaggaacagaccccgactgtgctgacccactgtgctgccgaagaggctcaggcctgccgcctgcatcccgtcctggtgcaggttattggggggagtacagtaaatgcgatctccctcttagaacgctggagtccctcctgtctgggctggggcccgctggtccatttgacatggtttattggacaggcgacatccctgctcatgacgtgtggcatcagactcggcaggaccaactacgagccttgactaccgtgacagcactggtgcggaagttcctgggccctgtgcctgtttacccggcagtgggtaatcacgagagtacaccggtgaattccttcccgcctccctttatagagggtaaccacagttcacgatggctttatgaagcgatggccaaggcttgggagccctggctgccagcagaggctttaaggacattacgaatcgggggcttttatgcgctctctccatatcctggccttcgtctgatcagccttaatatgaatttctgctccagagagaacttctggcttctaataaactccaccgatccagccgggcaacttcagtggttggtgggcgagttgcaggccgcggaggacaggggcgataaagtccatatcattggccatatccctcctgggcactgcctgaagtcctggagctggaactattatagaattgtggcacgttatgaaaacactctggccgcccagttcttcggccatacccacgtcgacgaattcgaagtcttctacgatgaagaaaccctgtcacggcccctggccgtcgcattcttggctccatctgcaacaacttacatcggactgaaccctggataccgcgtctaccagatcgacggcaattactccgggtcgtcccatgtggttctggatcacgagacttatatactgaatctgacacaggctaatattccgggagccatccctcactggcagctcttgtaccgagctcgggagacctatggcctgccgaataccttaccaactgcatggcataatctcgtttaccggatgagaggcgatatgcagctgtttcagactttctggtttctataccataagggccaccctccttccgaaccatgtgggaccccttgtaggctggccacgctatgcgcacagctgagcgctcgagccgactcaccagctctctgccggcatctgatgcccgatgggtctctcccagaggctcagtctctgtggccccggccgctcttctgc

SEQ ID NO: 19716 - DNA, 1893 bp, Artificial Sequence
  Description of Artificial Sequence: Synthetic coding sequence
atgcctcgttatggagcatctcttcggcaatcgtgcccgaggagcggcagagaacagggccaagacgggaccgcgggagcgccgggattattgtggatgggacttgtattagctcttgccttagcgttggctctcgcactcgcccttagcgatagccgtgtgctgtgggctcctgctgaggctcatcctttgtcccctcagggtcacccggcccggttgcatagaatcgtgcccagactgcgtgatgtcttcggctggggtaatttaacctgcccgatctgcaaaggtttgttcaccgccattaatttgggccttaaaaaggaacctaatgtggccagagttggaagtgttgcgatcaaactatgtaatctgctgaaaattgcaccaccggcggtctgccaaagcattgtacacttatttgaagatgacatggtcgaggtttggcgtaggtctgtcttatccccgtctgaagcgtgcggactgttactcggaagtacatgtggccattgggatatattttcttcctggaatatttcgcttccgacggttccgaaaccgccgccaaaaccgccgtccccgcctgcaccaggcgcacctgtcagcaggatacttttccttacggaccttcattgggatcatgactatctcgaaggcactgatcctgactgtgctgatcccctgtgttgcagacgtggctcaggtttaccgccggcttcgcggcctggagcgggctattggggcgaatattccaaatgcgacctgcccctgcgtaccttggaaagccttctctccgggctgggtccagccggaccgttcgatatggtctactggacgggcgatatccctgcacatgacgtgtggcatcagacccgtcaagaccagctgcgggccttaacaactgtgactgcccttgtgcgtaaatttttgggaccggtaccagtatacccggcggtgggcaaccatgaatctaccccggtgaactcttttcctcccccgttcatagagggcaatcattccagccgctggctttatgaagcgatggctaaggcttgggaaccatggttgccggctgaggcactgcggacgctgagaattggcggattctacgcactcagtccttatcctgggctgcggcttatttctctcaatatgaacttttgttcccgggaaaatttctggttgctgatcaacagcacagatccggctggccaattacaatggcttgtaggcgagttgcaggccgcagaagatcgcggcgataaggtacatattatcggccacatacccccaggtcattgtcttaaatcatggtcatggaactattatcggatagttgctcgttatgaaaacacactggcagcacaattctttggacacacacatgtcgatgaatttgaagtgttctacgatgaagaaacgctgtccaggcctttggctgtcgcattcctggccccttcggcaactacatacattggtttgaatccgggctacagggtctaccaaattgacggaaactatagcgggtcatctcacgtagttcttgatcacgaaacttatattcttaaccttacgcaagcgaacattcctggagcaatcccgcactggcagcttctttatcgggcacgtgaaacttacgggttgccgaacaccttacctactgcttggcacaacttggtctatagaatgcgtggggacatgcaactattccaaactttctggtttttatatcacaaaggacacccaccgtccgagccatgtggcacaccgtgtagacttgctacattatgtgcccaacttagcgctcgagccgattcgcctgctctttgccggcatttaatgccggatggctctttgcccgaggctcagtcactttggccacgaccgttattctgc

SEQ ID NO: 19717 - DNA, 1893 bp, Artificial Sequence
  Description of Artificial Sequence: Synthetic coding sequence
atgccccgatatggggcctctctccgccagtcatgtccacgctcaggacgagaacaggggcaagatggcacagcgggcgctcctgggctgctgtggatgggactagtcctggccttagcattggccctggctttggctttggctctgtcggacagcagggtgctttgggcccccgcagaggctcaccccctgagccctcagggccaccccgcccgccttcatcggattgttccacgtctgagggatgtctttggatggggaaacctaacgtgtccaatttgtaagggcctttttactgcaataaacctcggacttaaaaaggagcctaacgtcgccagagtgggctcggtggccatcaagctctgtaatctgctgaaaattgcacctcccgcagtgtgccagagcatagtgcatttgttcgaggatgacatggtggaagtctggcggcgatcggtacttagccccagcgaggcgtgcggccttctgttgggttccacatgtggccactgggacatcttctcatcatggaacattagcctgccaaccgtgcccaagcctccgcctaaaccaccgagtcctccagcgcccggcgctcctgtgtctaggatcttgttccttactgacctgcactgggatcacgactatctggagggcacagacccagattgtgctgaccctctctgttgcaggcgcggaagcggcctgccccctgcctcaaggccgggcgctggttattggggagagtatagcaagtgcgaccttccgctgaggactttggagagccttctcagcggactaggacctgccggtccattcgatatggtatattggacaggcgatatccctgctcatgatgtgtggcatcagaccaggcaagaccaactgcgggcgttgaccacggtgaccgcgctggtgaggaagtttttaggtcctgtccctgtgtatccagccgtgggaaaccatgagagcacgcccgtgaattcttttcctcctcccttcatcgagggtaaccatagctctagatggctatatgaggccatggcaaaagcctgggaaccctggctgccggccgaagctctgaggacgcttcgcatagggggattctatgccctaagtccttaccccggcctgagattgatttcccttaatatgaacttttgcagccgagaaaatttttggcttctgataaattctacagaccccgctggtcagttacagtggctggtgggggaactccaagccgctgaagatagaggtgataaggtccacatcatcggacatattccgcccggtcattgtcttaaatcctggtcttggaactactaccgtattgtggccaggtacgaaaacactctcgctgcacaattcttcggacatacccatgtggatgaatttgaggttttttacgatgaggaaactctgagcagacccctggctgtggccttcctagccccctcagccaccacttacattggcctgaacccggggtaccgagtgtaccagattgacggtaattactcaggtagtagccacgtggtgctggatcatgagacttatatcttgaacctcacccaggccaacattcctggagcaatcccccactggcagctcttgtacagagctagggagacttatggcctaccgaatacgctgcctaccgcttggcataacttggtgtataggatgcggggtgacatgcagctcttccagaccttttggttcctttatcataaaggccacccgccatccgagccttgcgggacaccatgtagactcgctaccctgtgcgcccaactgagcgcaagagcagacagccccgcactgtgcaggcatctgatgcccgatggaagcctgcccgaagctcaaagcctctggccaaggcccttgttttgt

SEQ ID NO: 19718 - DNA, 1893 bp, Artificial Sequence
  Description of Artificial Sequence: Synthetic coding sequence
atgccacgatatggcgcgtctctgcggcagtcttgccctagatcggggcgcgaacaaggtcaagatggaacagccggtgctcctggtctcctctggatggggctggtgctcgcccttgctcttgcgctggctctggccctcgctctttccgattcaagggtcctctgggccccagccgaggcccatccactgtcaccgcagggacaccccgcccgtctgcaccggattgttccccgactgagagacgtgttcggatggggaaatctcacttgcccaatttgcaagggactgttcaccgccatcaatctcggcctgaagaaagagccaaatgttgccagggtgggaagtgtcgccattaaactgtgtaatcttctaaaaattgctcctccagccgtctgtcagtcaatagtgcatctgtttgaagacgacatggtggaggtttggagacggtctgtgctgtcaccttctgaggcttgtgggctgctactgggtagtacttgtgggcattgggatatttttagttcttggaatattagtttgccgactgtgcccaagccccctcctaagcctccaagcccccccgccccaggtgcacctgtgagccgaatactgtttctaacggacctgcactgggatcatgactatttggaaggtacagaccctgactgtgcggatccactgtgttgtcgacgaggttccgggctgccaccggcatctcgaccgggagccggatactggggtgagtactcaaaatgtgacctaccgttgcgcactctggagtctctgctctcggggcttggcccagctggacctttcgatatggtctactggaccggagacattcccgcccacgacgtctggcaccagacaagacaagaccagttgcgagctctcacaacagtaacagccctggtgagaaagtttctgggtcctgttccggtctatcccgctgtcggaaaccatgagtcaactccagtgaatagcttcccccctcccttcatcgaggggaatcacagttctaggtggctgtatgaggccatggccaaggcttgggaaccatggctgccggcggaagccctgcgcacgctccggattggggggttttatgctctgtcaccttaccccggattgcggctgatcagcctcaatatgaacttctgcagcagggagaacttctggttgttgatcaattctacagatccagcaggccagttgcagtggttggtaggggaattgcaggctgccgaagacagaggggataaggtgcacataatcgggcacatccctcctgggcactgcctcaaatcgtggagctggaattactatcggatagtcgcgcgatacgagaacacgctggccgcccagtttttcggccatacccatgtagacgagtttgaggtcttttacgacgaggagaccctgagccggcctctggctgttgccttcttagccccatctgccacgacctacattgggcttaacccaggctatagagtgtatcaaattgatggcaattactccgggtctagccacgtggtgctggatcatgaaacctatatactgaatctgactcaggctaatattcccggagctattccgcattggcaactgttgtacagagcccgcgaaacttatgggctgcctaacacacttcctactgcttggcataatctcgtgtacagaatgcgcggggatatgcagctgtttcaaaccttctggtttctgtatcataaagggcatccgccttcggaaccttgtggtaccccatgtagattagcaactctttgcgcacagctctcagctagagccgatagcccagctttgtgcagacatcttatgcctgatgggagcctccccgaagcccagtcactatggcctcgcccccttttctgc

SEQ ID NO: 19719 - DNA, 1893 bp, Artificial Sequence
  Description of Artificial Sequence: Synthetic coding sequence
atgccacgctacggcgctagccttaggcagtcatgtccaaggagtggacgtgaacagggacaggatggaacagcgggagctcccggacttctctggatgggacttgtgcttgccctcgctcttgcgttagcacttgcactcgctctgagcgattccagagtcctttgggctcctgcagaggcacacccgctgtccccgcaaggacatcctgctcgcctccaccggatagtgccccggcttcgggacgtcttcggatggggaaatttaacctgcccaatctgtaaaggattgttcaccgccatcaaccttggattaaaaaaggaaccaaacgtggccagagtgggatctgtggccatcaaattatgcaacctgctgaagatcgcccctccagctgtgtgtcagtcgatcgtgcaccttttcgaagatgacatggtcgaggtttggaggcggtccgtactttccccatccgaggcatgcggcttgttactgggctccacatgcgggcattgggatatcttcagctcttggaacatttccttgcctactgtccccaaaccacctccaaagccaccctctccacctgcacctggagcccccgtcagcagaatcctgttcttgacagatctccactgggaccacgattacctcgagggaacggatcctgactgtgccgacccattgtgctgtaggcgggggtcaggactgccaccagcgagccgcccaggcgctggatactggggcgagtacagcaaatgcgatttgccactcagaaccctcgaaagcctgctctctgggctgggacctgctggaccgtttgacatggtatactggaccggcgatatccccgcccacgatgtgtggcaccagaccagacaagatcagctcagagccctcactaccgtgacagctctggttcggaaattcctgggccctgttcccgtgtatcccgcagtgggaaatcatgagtcaacccctgttaacagtttccctcccccgtttatcgagggcaaccattcttcaaggtggttatacgaagctatggctaaagcttgggaaccctggttgcccgcagaagcccttcggacactgaggataggaggtttctatgcacttagtccatacccaggacttaggctgatcagcctgaacatgaacttctgctcaagagaaaatttctggctgcttataaactctaccgacccggcgggccagttgcagtggcttgtaggcgagctgcaggctgctgaggaccggggagataaggtccacatcataggccacatccctcctggacactgtctcaagagttggagttggaattactacaggattgtggcacggtacgagaacaccctcgcagcgcagttcttcggtcatactcatgtggacgagttcgaagtcttctacgacgaggagaccttgtcacgcccgctggctgttgctttcctggccccctctgcaacgacatacatcggtttgaacccggggtacagagtgtatcagattgacgggaactatagcgggagttctcatgttgttctggatcatgagacttatatactaaacttgacccaggctaatatccctggcgctatcccccactggcaactgctctacagagctagggagacctacggcctgccaaacactctacccacagcgtggcacaatctcgtatacagaatgcgcggagacatgcagctttttcaaactttttggttcctttatcacaagggccatccgccaagcgagccatgcggaacaccctgccgtctggctactttgtgtgctcaactgagcgcaagagctgatagcccagccctttgccgccacctgatgcctgacggcagcctgcccgaggcccagtcactttggcccagaccactgttctgt

SEQ ID NO: 19720 - DNA, 1893 bp, Artificial Sequence
  Description of Artificial Sequence: Synthetic coding sequence
atgccacggtatggagcatctctccgccagtcttgcccacgctccggccgcgagcagggacaggatggtaccgctggcgctcctggtctcctttggatgggcctcgttctcgctttagccctggcattggcccttgcgctggcactgtctgatagccgggtgctgtgggcaccagccgaggcccacccgctaagtccacaaggacatccggcccgcctgcatcgaatagtgcccaggctccgggatgtctttggttgggggaacctgacttgtccgatctgtaaaggccttttcacggctattaacctcggtctgaagaaagaacccaacgtggccagagttggatcggttgccatcaagctttgcaatttactgaaaatcgctcctccagcagtttgccagagtattgtgcatttattcgaagatgacatggtggaggtttggcgaagatccgtgctgtccccttccgaggcttgcggtttgctgctgggctcgacctgtggacactgggatatattttcgagttggaacatttcactcccgaccgttcccaaacctccccccaagcctccctcacccccggccccaggcgctcccgtttctcgcattcttttccttactgacttacattgggatcacgactatctcgaaggcaccgatccggattgtgcggatcctttatgctgcagacggggtagtgggctgcccccggcttcccggccaggagctggttactggggcgaatatagcaagtgcgatctccccctgagaacactagagtcgcttctttccgggctgggccccgcagggcccttcgacatggtgtactggacaggtgacatccctgcacatgacgtgtggcaccagacccggcaggaccagctaagggcccttactacagtaactgccctggtgagaaagttccttggtcccgtgcccgtttatcctgcggtgggcaaccatgaatcgacgccagttaactcttttcctccacccttcattgagggcaaccacagcagccgatggttgtacgaggctatggccaaagcctgggagccctggctgcccgccgaggccttaaggacattgcggattggcggattttatgccctcagtccttatccaggcctccggctgataagtctgaacatgaatttttgtagccgagaaaacttttggctcttgatcaatagcaccgacccagctgggcagttgcagtggttggtcggtgaactccaagctgccgaagataggggcgataaggtgcacataataggacacatacctcccggacattgtctgaagtcttggagttggaactattatcgaattgttgccagatatgaaaacacgctcgccgctcagtttttcggtcacactcacgtggatgagtttgaagtattttacgacgaagaaaccttgtctcgcccccttgcagtggcatttttagctccttctgccaccacctatattggactgaatccaggataccgggtgtaccagatagatggcaactattctggcagcagtcatgtggttctggatcatgagacgtacattctaaatttgacacaggcgaatatcccaggagcaataccgcactggcagctgctttatcgggcccgcgagacatatggactgcctaacaccctccctacagcctggcacaacctggtgtatcggatgaggggagacatgcagctgttccagactttttggttcctatatcataaaggccatcccccttcggaaccatgtggaacgccgtgcaggctggccactctttgtgctcaactctccgccagagccgactctcccgccctgtgtagacatctaatgccagacggatccctccccgaggcacaatccctctggcctcggcccctgttttgt

SEQ ID NO: 19721 - DNA, 1893 bp, Artificial Sequence
  Description of Artificial Sequence: Synthetic coding sequence
atgccacgctacggagcttcgcttcgccaatcctgtccccgctccggacgtgagcaagggcaggacgggacggcaggcgcaccaggtctgctgtggatgggtcttgtgctggcgcttgcattggctctggccctggctctggcactttcggattcgcgagtcctgtgggcccctgcagaggcccatcctttgagcccacaaggtcatccagcccgccttcatcgcatcgtgcccagactgagagatgtctttggatggggcaacctgacgtgtccaatatgcaaggggcttttcactgccattaaccttggactgaagaaggagccaaatgtcgcccgtgtgggtagcgtggcgataaagctgtgtaatctgctgaagatcgcgccgcccgcggtctgtcaatcaatcgtgcaccttttcgaagatgacatggtggaagtgtggaggcgctcagtgctttccccttcggaagcatgtggcctccttttgggcagcacctgcggacactgggacattttcagctcctggaacatttctcttccaacggtgccaaagcctccccctaagccaccatcacctccggcacctggggcacccgtgtcacgcattctgtttctcactgacctgcattgggatcatgattaccttgaaggtactgacccggattgcgcagatccactgtgttgcagaagaggatcaggcctcccacctgcatcacgacctggagcaggatactggggggaatactccaagtgcgatctccccctgcgtaccttggaatccctcctttcgggacttggtcctgccggcccgttcgacatggtgtactggactggagatatacccgcacatgacgtgtggcatcaaactcggcaagatcaacttagagcattgaccactgtgaccgccctcgtgaggaaattcctcggacccgtgccagtttaccctgcagtgggaaatcacgaatccactcctgttaattcattccctccaccgtttattgaaggaaaccattcctccagatggctttacgaagcaatggcaaaggcatgggaaccatggctgcctgctgaggccttgcggaccctgcgaattggcggtttttacgccctttcgccctacccgggacttcgtcttatctcccttaacatgaacttttgtagccgtgagaacttttggcttttgatcaattcgaccgaccctgccgggcaactgcaatggcttgtgggagaacttcaagccgcagaagatcgaggtgataaggtccatatcatcggccatatcccaccgggacactgcctgaaaagctggagctggaattactaccggattgttgcaagatacgagaacactcttgcagcacagtttttcggtcatacccatgtggatgaattcgaagtgttctacgatgaggagacgctctcgcgcccgcttgcagtggcatttctggcgccttcagcaactacttacatcgggctcaatcctggttaccgcgtgtaccaaattgatggtaactactcaggttcgagccatgtggtgctcgatcatgagacttacattctgaaccttactcaggcaaatatcccaggggcaatacctcactggcagctgctgtacagagcaagagaaacctacggacttccgaacactctgcctactgcgtggcacaatctcgtttacaggatgcggggtgatatgcagctttttcaaaccttctggtttctgtaccataaagggcaccctccaagcgaaccttgcggaaccccttgtcggctggcaactctgtgcgcgcaacttagtgcgagagcagacagccccgcgctttgccgccatctcatgcctgacggatccctcccagaagcacaatcgctttggccaagacctctcttctgc

SEQ ID NO: 19722 - DNA, 1893 bp, Artificial Sequence
  Description of Artificial Sequence: Synthetic coding sequence
atgcctcgatatggcgcctccctcaggcagagctgcccacgaagtggtcgcgagcaagggcaggacggcaccgccggagcccccggattattatggatgggcctggtactggcgctggccttggcgttggcactggctctggccttgagcgactcccgggtcctttgggccccagccgaagcccacccgctgagcccacagggccaccctgctagactacatagaattgttccgcggctgcgagatgtctttgggtggggaaatctcacgtgtccgatctgcaaaggcctcttcaccgctatcaacctgggcttgaaaaaggagcctaatgtggcccgagtagggtcagttgccatcaaactctgtaacttgcttaaaatagctccgcccgccgtttgccagtcgatcgtgcacttgttcgaagacgatatggtcgaggtttggcgacgaagcgtccttagcccgtccgaggcatgtggactgttgctggggtccacctgtggccactgggatatcttttcttcttggaacatatctctgccgacagtgcccaagccaccccccaaacctccctctcccccggcacccggtgcccccgtcagtagaattctgtttctgaccgacttacactgggaccacgactatcttgaaggaacagacccagattgcgctgatcctttatgttgccggaggggctccggcctgccacccgcaagcagaccaggtgcgggctactggggagagtactccaaatgtgacctccctctgcgcacccttgaaagcctcttgagtggattaggccccgccggaccatttgatatggtgtactggacaggagacatcccagcacatgatgtctggcaccaaacacgccaggatcagctgcgggccctcactacagtcaccgccttggtgcgcaaatttctcggtccagttccggtgtatcctgctgttgggaatcacgagtcgactccagtgaactcgtttccaccgcccttcatagagggcaaccattcgtcaaggtggctttatgaagccatggctaaggcttgggaaccctggctacccgcagaggccctgagaaccctgaggatcggaggcttctacgcgctctccccatatcccgggctgcgactgatctctctgaatatgaatttctgttcgagggagaatttctggctgcttatcaatagcaccgatccagccggacagctgcaatggctcgtgggagaattgcaggccgctgaagatcgcggagacaaggttcacatcattggccacatccctcccgggcactgcctgaaatcctggtcctggaattattacagaatagtggcccggtatgagaatacactggccgcacagttcttcggtcacacgcatgtggatgagtttgaagtgttctacgacgaggagaccctgtccaggcctttagccgtggcttttcttgcacccagtgccaccacttacataggcctgaaccccgggtatcgggtctaccagattgatggtaactatagcggaagcagtcacgtggtgctagaccatgaaacctatatccttaatttgacccaggccaacatccccggcgccatcccacactggcagctgctttatcgcgcccgcgagacctacggcctgccaaacaccttacccacagcctggcacaaccttgtgtatcgaatgcgcggagacatgcagttgtttcagacattttggtttctgtatcacaaagggcatcccccttccgaaccttgcggaactccatgtagattggccaccctgtgtgctcagctgtcggctcgggccgacagtcccgctctctgtcgacacctcatgcccgatgggagcttgcccgaagcccaatccctctggcctaggcccttgttctgc

SEQ ID NO: 19723 - DNA, 1893 bp, Artificial Sequence
  Description of Artificial Sequence: Synthetic coding sequence
atgccacgctacggcgcaagtctccgccagtcttgtcccagaagcggtcgggagcaaggccaggatggaacagcgggcgctcccggtttgttgtggatggggctggttctggccctcgccctggcactcgcattggcccttgcgctgtcagactcacgcgtgctgtgggccccagcggaggcgcatcctctgagtccccaaggtcatccagctagattgcaccggatcgtcccacgcctcagggatgtcttcggctgggggaacttgacctgccctatctgcaaggggctttttactgcgattaatctgggactgaaaaaggagcccaacgtagcccgagtggggtcagtcgccatcaagttgtgcaacctgctcaaaatcgccccccccgcagtctgccagagcattgttcacctgttcgaagatgacatggtcgaggtgtggagacgaagtgtgcttagcccctctgaagcctgtgggctgcttctcgggtccacatgtggccactgggacatatttagctcatggaacatttcacttcccacagtgccaaaaccaccgccaaagcctccttcaccgcctgctccaggcgcccccgtctctagaatcctgtttttgaccgatctccattgggatcatgactacctggagggaactgacccagattgcgctgatcctctctgttgtcggcggggttctggtctcccgccagcctccaggcccggcgccggctattggggggaatatagcaaatgtgatctccctcttcgcaccctggagtctcttctcagcggacttggacctgctggccctttcgacatggtgtattggaccggtgacatccctgcccatgatgtttggcatcagacccggcaagatcagcttcgggccctcaccacagtgactgcccttgttaggaagttcctgggccccgtgcccgtctacccggccgttggcaaccatgagagtacccccgtcaattccttcccgcctcctttcatcgaagggaatcattccagtcgatggctctatgaagctatggccaaagcttgggaaccctggctgcccgctgaggcactgaggaccttgagaatcggcgggttttacgcactgtctccatatccaggtctgcgactgatcagtctgaatatgaatttctgctccagggagaacttttggttgctcatcaatagcaccgatcccgccggacagctgcaatggctggtgggagagttgcaggctgccgaggatcggggggataaagtccacataatcggccacatacctcctgggcattgtctgaagtcttggtcttggaactattaccgaatcgtggcccggtatgagaacaccctggccgcccagttttttgggcacacgcacgtggatgagttcgaagtgttctacgacgaggaaactctctcacgacccctggctgtggccttcttggccccttcagctactacctacatcggtcttaatccaggctatcgggtgtaccaaattgatgggaattattccggctcttcccacgtcgtcctcgatcacgaaacgtacatccttaacctgacccaggccaacatcccaggagccatcccccattggcagctgctttacagagctcgagaaacctacggtctgcctaatacactcccaaccgcgtggcacaatctggtataccggatgcggggcgacatgcagctctttcagaccttctggtttttgtatcacaagggacaccccccatccgagccctgtgggacgccctgtcgcttggccacactgtgcgcccagctcagtgcccgggctgatagccctgccctttgccggcatctcatgcctgacgggtcactgcccgaagcccagagcctgtggccacgaccgcttttctgc

SEQ ID NO: 19724 - DNA, 1893 bp, Artificial Sequence
  Description of Artificial Sequence: Synthetic coding sequence
atgcctagatacggcgcgtcactgcggcaaagctgcccacgctcaggacgcgagcaaggacaggacggtactgcaggcgccccaggtctgctctggatgggactggtcctggccctcgctttggcgctcgcgctcgccctggccctcagcgatagccgggtgctgtgggccccggcggaggcgcaccctctgtccccgcaggggcatccggcgcgccttcaccggattgtcccgcggttgcgagatgtctttggatggggaaacctcacctgtcctatatgcaagggcctctttaccgcaatcaacctggggctcaagaaggaaccaaatgtggcaagagtgggatcagtcgcgatcaagctgtgtaatctgctgaagatcgcaccgccagccgtgtgccaaagcatcgtccatctgtttgaggacgatatggtggaggtctggcggcgctctgtgcttagcccttccgaagcgtgcggattgctgctgggaagtacttgcggacactgggatatcttctcgtcatggaatatctcactgcccactgtaccaaagccgccacctaagccgccgtcgccgccggcccccggcgcccctgtgtcaagaatcctgttcctgaccgacctccattgggatcacgattacctggagggcacggatcctgactgcgcggaccctctgtgttgcagacgagggtccggactcccaccagcttcaagaccgggtgctggctactggggtgaatactcaaaatgtgatttgccgctgcgcacccttgaaagcctgctttccggactcggacctgcaggaccattcgatatggtgtactggaccggggacatcccggctcatgacgtctggcaccagaccagacaagatcagctgcgggccttgacgacggtgaccgctctggtgagaaagttcctcggtcctgtgcccgtgtacccagcagtgggtaaccacgaaagcaccccagtgaactccttcccgccgccgttcattgagggaaaccactccagcagatggctgtacgaagcgatggctaaagcctgggagccctggctcccggccgaggctctccgcactcttcggatcggtgggttctacgctctgtccccgtaccccggactgaggctgatctcgctgaatatgaatttctgttcacgggaaaacttctggcttctgattaactcaaccgacccggccggccagcttcaatggctggttggggaacttcaagcagcagaagataggggagacaaagtgcacattatcggacacatcccaccgggacactgcttgaagtcgtggtcatggaactactaccggatagtggccaggtacgagaacaccttggcggcacagttctttggacacactcatgtcgacgaattcgaagtgttctacgatgaagaaactctgagccgcccattggccgtggcgttcctggcgccgtccgccaccacctacatcggactgaacccgggataccgggtgtaccaaatcgatggaaattactccggatcatcgcacgtggtgctcgaccacgaaacctacattctcaatctcactcaagctaatatcccaggagccatcccccattggcaactgctgtacagagcgcgcgaaacgtacgggttgccaaatactcttccgactgcctggcacaacctggtgtatcggatgagaggagatatgcaactgtttcagactttttggttcctgtatcacaaaggacacccgccatcggaaccgtgcggaaccccatgccgcctcgccaccctgtgtgcacaactgtcagcccgggcggactcccccgccctttgcaggcaccttatgccagatggtagcctccctgaagctcagagcctctggccgcggccgctcttttgc

SEQ ID NO: 19725 - DNA, 1893 bp, Artificial Sequence
  Description of Artificial Sequence: Synthetic coding sequence
atgcctcgctatggcgcgtcactgcgccagtcctgtcctcgttccgggagagaacagggacaggacggaacggcgggcgccccgggtctcctttggatgggcttggtgctggctttagcgcttgcacttgccttggcactcgctctgagtgattcaagggtactttgggcccccgctgaagctcacccactgagccctcaggggcaccctgcacgcctgcataggatcgtgccccgattgagagatgtgtttggatggggcaatctgacatgccctatttgcaagggtctttttactgctatcaacctaggactgaaaaaagagccaaacgtagctcgggtggggagcgtcgcaatcaaactatgtaatcttcttaagatcgcccccccagcggtctgtcagtcaattgtgcacctttttgaggacgacatggtggaggtatggaggcggtctgtgttgtcaccttctgaggcatgtggcctgttactgggctccacctgcggtcattgggatatttttagttcctggaacatctctcttcctaccgtgcctaaaccccctccgaaacccccgagcccaccggcccctggagctccagtgtccagaatcctgtttctgaccgacttgcactgggaccatgactacctcgaaggcaccgatccagactgcgctgatccactttgctgtcggcggggatccggtctgccacccgcctctaggcccggcgccggttattggggcgaatactctaaatgcgacctgcccctgcgtacccttgaaagtcttctcagtggactagggcctgccggtccgttcgatatggtctattggacaggcgatattcctgcccatgatgtgtggcaccagacccgccaagatcagttgagagctctgacaaccgtgactgctctggtccgaaaatttctcgggcccgtgccggtgtaccccgccgtaggtaaccatgaaagcacccccgtgaactcctttccacctcccttcattgaaggaaaccatagtagtaggtggctttatgaggccatggctaaggcctgggagccctggctgccggctgaagccctcagaaccctgcgcatcggagggttttatgccctctctccttaccccggtctgagattgatatcacttaacatgaacttctgcagccgggagaacttttggcttctcataaacagcacagaccccgctggtcagctccagtggttggtaggagaactccaggccgccgaagatcggggagacaaagtacatataatcgggcacatccctccaggacattgcttgaaaagctggtcttggaattattaccggatcgtcgctcgctacgaaaatacgttggccgcccagttcttcggacatacccatgtggatgaattcgaggtgttttacgacgaagagactctctccagacccttggccgtggcatttctggctcccagtgccaccacgtacataggactcaaccctggctatagagtttatcagattgatggcaattatagtggttcatcccatgtggtcctggaccacgagacgtatatcttaaacctgactcaggccaacatcccaggagctatcccacattggcagctactgtaccgggcacgcgaaacgtacgggctgccaaatacgctgcccaccgcctggcacaatctagtgtatcgcatgcgcggtgatatgcagctgtttcaaacattctggtttttgtatcacaaggggcaccctccttctgaaccatgcggtacaccctgcaggctcgctaccctgtgtgcacaattatctgcccgcgccgatagtcctgctctgtgccgtcacttgatgcccgacgggtccctgcctgaagcccagagcctatggccccggcccctgttctgc

SEQ ID NO: 19726 - DNA, 1893 bp, Artificial Sequence
  Description of Artificial Sequence: Synthetic coding sequence
atgccgcggtacggcgcttcgctgcgccaatcctgcccacgctccggacgggagcaaggccaggacggaaccgccggagctcccggactcctttggatgggactcgtgctggcgcttgctctggccctcgctcttgctcttgccctctcggattcgagagtgttgtgggcgcccgcagaagcgcacccgttgagcccgcagggccacccagcacggctgcacaggatcgtgccgcgcctgagagacgtgtttggctgggggaacctcacttgcccgatttgcaagggactgttcactgcaatcaacctgggcctcaagaaagaacccaatgtggcccgcgtggggtccgtcgccatcaaactgtgcaacctgctcaaaatcgccccaccggccgtgtgccagagcattgtccacctgtttgaggatgacatggtggaagtgtggcggcggtccgtgctgagcccgagcgaagcatgcggactcctgctgggatccacttgcggacactgggatatcttctcgtcgtggaacatttccctccctacggtgccaaaaccaccacctaaacccccttccccgccggccccgggtgcaccggtgagcaggattctcttccttacggacctccactgggatcacgactacctggaggggaccgaccctgactgcgccgatcctctgtgttgccggagaggatccggactgccccctgcgtcccggcctggagcaggttactggggagaatactcgaagtgtgatctcccccttcggaccctggaatccttgctgagcggattgggacccgcgggcccgttcgatatggtgtactggaccggcgatatccctgctcacgacgtctggcaccagactagacaggaccaactccgggcgctgaccaccgtcaccgcacttgtgcgaaagtttctcggtccagtaccggtgtacccggccgtgggcaatcacgagtcaacgcccgtcaattccttcccgccaccgttcatcgagggtaaccactcctcgcgctggctgtacgaggcaatggccaaggcttgggagccgtggctcccagccgaagccctcagaactctccggattgggggcttctacgcactgtcaccataccctggcctgcgattgatctctctgaacatgaacttttgcagcagagagaacttctggctgctgatcaacagcaccgacccagcagggcagctgcaatggctggtgggagagttgcaggcggcggaggatcgcggagataaggtccatatcatcggccatatcccaccaggacactgcctgaaaagttggtcgtggaattactaccgcattgtggcccgctacgagaatactctcgcggcccagttcttcggacacacgcacgtggacgaattcgaagtgttttacgatgaggaaactctgagccgcccactggctgttgcgtttctcgctccttcagcgaccacttacattggcctcaaccctggatacagggtgtaccaaatcgatggcaactattcgggaagctcccatgtggtgctcgaccacgaaacctacatcctgaatctgacccaagccaatatcccaggtgcaatcccgcattggcagctcctgtaccgcgcccgtgaaacctacggactcccaaacactcttccaaccgcgtggcacaacttggtctaccgcatgcggggagatatgcagctcttccagaccttctggttcctgtaccacaaagggcacccaccgtcggagccctgcggcaccccatgtcggttggccactctgtgcgctcagttgagcgcacgcgccgactcgcctgccctctgccggcatctcatgccggatggaagcctgcctgaagcccaatcgctgtggccaagacctctgttttgt

SEQ ID NO: 19727 - DNA, 1893 bp, Artificial Sequence
  Description of Artificial Sequence: Synthetic coding sequence
atgccccggtacggggcctccctacgccagtcttgcccacgcagtggtcgggaacaaggccaggatggaaccgctggggcaccaggacttctgtggatgggactggtactggctctggcactagctctggccttagcgctggccctgagcgacagccgggtactctgggcccctgccgaggcccaccccctctccccgcagggccacccggcaagacttcaccggattgtgcctaggcttcgggatgtgtttggctggggtaacctcacttgccctatctgcaaaggtcttttcaccgctattaacctgggcctgaagaaggagccaaacgtcgcaagggtcgggtccgtggccattaaactctgcaatctgcttaaaatcgctcctccagcagtctgccagtcaatagtgcacctatttgaagacgatatggtagaggtgtggagaaggtcagtcctgagcccttctgaggcatgcggcttattgctgggatccacctgtgggcactgggatattttctcctcttggaatataagcttgcctaccgtcccaaagcctcctcccaagccccccagtccccctgcgccaggcgcaccagtgtcgcggatcctgtttctgacggatctccactgggatcacgactacctggaggggactgaccctgattgtgccgaccccctgtgctgtcggcggggttccggacttccgcccgccagccgacccggcgcaggctattggggcgagtattcaaaatgtgatcttccacttcgaacgctggagagcctcctgtctggcctgggaccggccggccccttcgacatggtttactggaccggagacatccccgcccatgacgtgtggcatcagaccaggcaggaccaactgcgtgcattgacaaccgtcacagcccttgtgagaaagtttctcggacccgtgccagtatatcccgccgtaggcaaccacgaatctaccccagttaactcatttcccccgcctttcatcgagggaaatcatagtagccgctggctgtatgaggccatggctaaagcctgggagccctggctccccgccgaggccttgaggaccctgaggattggcgggttttacgctctctccccgtacccaggactaagactgatctccctgaacatgaacttctgctcgcgggagaatttttggctactgatcaacagtacagatccggccggtcaactgcagtggctcgtgggcgagctgcaggccgcagaggaccgcggcgataaagttcacatcatcggccacatcccgcccggtcactgcctcaagtcctggagttggaattactaccggatagtggcgagatacgagaacactctagccgcccagttttttgggcacacacacgtggatgagttcgaggtcttttatgacgaggaaacactctcacgccccctggcagtcgctttccttgctccatccgccaccacatacattggactcaaccctggctaccgcgtctatcagatcgatggaaactacagcgggtcctcacatgtggttttggaccacgagacttatattctgaatctgacccaggcgaacatccctggcgccatccctcattggcagctgctctatcgggctcgggagacctatggcctgccaaatacattgccaaccgcctggcacaatctggtttatagaatgcggggcgatatgcaactcttccagacgttctggttcctgtatcacaaagggcaccccccatcagagccatgcggtacaccttgtagacttgccacactatgtgcacagctttccgcccgcgcggacagccccgcactatgcagacatctgatgccagatggcagtctgcctgaggcccagtcactgtggcccagacctctcttctgt

SEQ ID NO: 19728 - DNA, 1893 bp, Artificial Sequence
  Description of Artificial Sequence: Synthetic coding sequence
atgcccaggtatggagcatcattaaggcagtcatgcccaagatccggacgcgaacaggggcaggatggaacggctggagctcctggacttctatggatgggactagtgttggccttggcactcgctttggcccttgccttggcactttctgactctcgggttctgtgggctcccgccgaagcccacccacttagtccacagggacaccccgcaaggctccaccgaattgtccccaggctgcgggatgtctttgggtggggaaacttaacttgtcctatatgcaagggactctttactgctattaacttaggactcaaaaaagaaccaaacgtggctcgggtcgggtcagtagctattaaattatgtaatctcctgaagatcgcccctccagctgtctgtcaaagtatcgtgcatctttttgaggatgatatggtcgaagtctggagaaggtccgtactgagtccatctgaggcctgcgggttactgcttggatccacttgtgggcactgggatatattttcttcctggaacatttctttacctactgtcccaaaacccccacctaaaccaccttctccacctgcgcccggagcccccgtatctcggatcctattcctcacagatctccattgggatcacgattacctcgaaggaacagatccagattgtgcagatcccctgtgctgtaggcgcggaagtggactccctcctgcctctaggcctggagcaggatattggggggaatacagtaaatgtgatctgcctcttagaactctcgaatcgctgctgtcagggctggggcctgcaggacccttcgacatggtgtattggacaggagatatacctgcacatgatgtgtggcatcagacaagacaagatcagctgagggccttgacaacagtcacagctctggttaggaaatttctcggacccgtgccagtatatcccgccgtggggaaccacgagagtacaccagtgaatagtttcccgcctccttttatagaggggaaccatagttccagatggctctacgaggctatggcaaaagcttgggaaccttggcttccagccgaagctcttcgcacactaagaattgggggattctatgctctatctccctatcccggactgaggcttatctcattgaacatgaatttttgttcccgagaaaacttctggcttttgatcaattctactgaccccgctgggcagctccagtggctggtgggagagctccaggccgccgaggatagaggggacaaagtacatatcatagggcacattccccccggacactgtcttaaatcatggtcatggaattattatagaatcgtggccagatacgaaaatacactggcggcacaattctttggacatactcatgttgatgaattcgaagtgttttacgatgaagaaacattaagtcggccattagccgtggcgtttctagccccatcagcaacaacttacattgggctgaacccaggataccgggtgtatcagatcgatgggaattattccgggtcttctcatgtcgtgctggatcatgagacttatatcctaaatctcactcaggccaacattcccggagccatcccccattggcagctactctaccgggcccgagaaacttatggactacccaatactcttcccacagcttggcacaaccttgtttatagaatgaggggagatatgcagctcttccagactttctggtttctctaccacaaagggcatcccccctccgaaccatgcggaacaccatgccggcttgcaacactctgcgctcagctttcggctcgggccgattcaccagccctatgtaggcacctgatgcctgatggatcactgccagaagctcagtccctatggcctaggcctctattctgt

SEQ ID NO: 19729 - DNA, 1893 bp, Artificial Sequence
  Description of Artificial Sequence: Synthetic coding sequence
atgcctcggtatggtgcctcgctgcggcaatcgtgtccaaggagcggtcgggagcaagggcaggacgggacggcaggtgcgcccggcctgttgtggatgggactcgtcctggccctggctcttgccctggctctagcattagcgctctccgactcgagagtcctgtgggcaccagcagaggcccatccattatcgcctcaggggcatcccgcaagattgcatcgaattgtgccccggctccgcgacgtcttcggatggggcaaccttacatgccctatctgcaaaggactgttcacagctatcaacctaggccttaaaaaggagcctaacgtggctagggttggttccgtggcaataaagctatgcaaccttctgaagatcgctccgccagcggtgtgtcaatctatagtccacttgtttgaggatgatatggtggaagtgtggagaaggtctgtgctctctccttctgaggcatgtggcctgctgctcgggtcaacatgtggtcactgggacatcttcagcagctggaatatatctctaccaactgtgcctaagcctccacctaagcccccgtcccccccagcccccggcgcgcctgttagccgaatcctgtttctgacagacctccactgggaccacgattacctggagggcactgaccctgattgtgccgatccgctgtgttgccgacgcggatccggccttcctccggcaagccggcccggagcgggctactggggagaatattcgaaatgcgacctccctcttaggaccctcgagtctctgctatctggccttggccccgctggaccgttcgatatggtgtactggactggcgatatacctgcacacgatgtgtggcatcagactagacaggatcagctcagagccctgactacagtgacggcccttgtgcggaagttcctggggcccgtgccagtctatcccgccgttggcaaccatgagtcaacccccgtgaattccttcccccccccctttattgagggaaaccactcctctcgctggctatatgaagctatggctaaggcctgggaaccatggcttccagcagaagcgcttagaaccctgcggattggaggtttttatgccctttccccctacccgggcctgcgtcttatatccctcaatatgaatttctgcagtcgcgaaaacttctggctcctcatcaactcgaccgacccggctgggcaactgcaatggcttgtgggggagcttcaagccgccgaggaccgcggcgataaggtgcacatcatcggacacattccccccggtcactgcctgaaatcttggagttggaactactaccgcattgtggctagatacgaaaataccctggccgcccagttcttcggccatacccatgtggatgagttcgaggttttttacgatgaggaaaccctgtcccgaccactcgccgtcgcttttcttgcaccttctgccaccacttatataggcctgaacccagggtaccgcgtctaccagatagacggtaattattccggatcctctcacgttgtcctggaccacgagacatatattctcaacctcactcaggctaacatccctggcgctataccccactggcagctgttgtatcgggccagagagacctacggcctcccaaatacactcccgactgcgtggcacaaccttgtctaccgaatgcggggtgatatgcagctgttccagacgttttggtttctctaccataaaggacacccaccgagcgagccttgcggcacaccctgtcgcttagcgacgctctgtgcacagctctctgctagagcggacagtcccgctttgtgtaggcacttaatgccagacggctcactcccggaagctcaatctctctggccaagacccctgttctgt

SEQ ID NO: 19730 - DNA, 1893 bp, Artificial Sequence
  Description of Artificial Sequence: Synthetic coding sequence
atgcccagatacggcgcgtctctgcgccaaagctgcccgcgcagcggacgcgaacaaggtcaagatggcaccgccggagcgcccggactcctctggatggggctcgtcctcgcacttgccctcgcgctcgcactcgcgttggccctgtcagactccagggtcctctgggcaccagccgaggcccacccactttccccacagggtcatccagccagacttcaccgcatcgttccacggctgagagacgtgttcggatggggaaacctgacctgccctatctgtaaaggcctgttcactgcgatcaacctcggcttgaagaaggaaccaaatgtggcgagggtgggatcggtggccatcaaactgtgcaacctgttgaaaatcgcaccaccagcggtgtgccagtcgatcgtccacctctttgaggatgatatggtggaggtgtggcggcggtcagtgctctccccctcggaagcgtgtggacttctcctgggaagcacttgtggccattgggacattttcagcagctggaacatttcgctcccaacggtgcctaagcctcctccgaagccgccttccccaccagcacctggagcccctgtatccagaatcctgttcctgaccgatctgcattgggatcatgattaccttgagggaaccgacccggattgcgctgacccactctgctgccgccggggatccgggctccccccggcctcccgcccgggcgccggctactggggcgaatacagcaaatgcgacctcccactgagaaccctcgaatcgctgctgtctggccttggcccagcggggccgtttgacatggtgtactggacgggagacatcccggcgcatgatgtgtggcaccagacccggcaagaccaactgcgcgcgttgactacggtcactgctctggttcggaagttcttggggccggtacctgtgtacccggccgtcggaaaccacgaatcgaccccggtgaactccttcccgcctccgttcatcgaaggaaatcattcatcaagatggctgtatgaggccatggcgaaggcttgggaaccatggctgccggctgaagccttgaggacccttagaataggcggattctacgcgctctcaccttacccgggccttagactcatctctctgaatatgaatttctgtagccgagaaaacttttggttgctgatcaactcaactgaccccgccggccagttgcagtggcttgtgggtgaacttcaagcagccgaggaccggggtgacaaggtgcacattatcggccacatcccaccaggacattgcctgaagagttggtcatggaactattaccgcatcgtcgctaggtacgagaataccctggccgcacagtttttcgggcacactcacgtggacgagttcgaagtcttttacgatgaggaaaccctgtcccgcccgctggccgtggctttcctggctccatcggcgactacctacataggactgaatccaggttaccgcgtctaccagatcgacggtaactacagcggctcgtcacacgtggtgttggaccacgaaacttacattctgaatctcactcaggctaacatcccgggagcaatcccacattggcaactgctctaccgggcgcgagaaacctatggccttccgaacacgctccccactgcctggcataacttggtctacaggatgagaggggatatgcagttgtttcagactttctggttcctgtaccacaagggacacccgcccagcgagccatgcgggaccccgtgccggcttgcgactttgtgcgctcagctgtcggcacgcgcagatagtccagctctgtgccggcacctgatgccagacgggtcactgcccgaagcccagtccctttggcctcggccactgttctgt

SEQ ID NO: 19731 - DNA, 1893 bp, Artificial Sequence
  Description of Artificial Sequence: Synthetic coding sequence
atgcctcgatacggagcatcgctgagacaatcatgccctcgaagcggccgggaacagggacaggacggaactgcaggagcaccaggacttttgtggatggggctcgtcctcgcgctcgcacttgcgcttgccctggcacttgcactttccgattcgcgcgtgctttgggcccctgcagaagcacaccctctttctcctcaaggtcatcccgcaagactccacagaattgtccctcggcttcgggacgtgtttggatggggaaatctgacctgcccgatttgtaagggcctgtttaccgcgattaacctggggctgaagaaggaacccaacgtggcacgggttggttcggtggctataaagctctgtaatcttctgaaaatcgcccctcccgcagtctgccagtccatcgtccatctgttcgaggatgatatggtggaggtgtggaggcgctcggtgctgagtccgtcggaagcgtgcggattgctgttgggaagcacctgcggtcattgggacattttctcgtcgtggaacatatcacttccgaccgtgcctaagccacctcctaagcctccgtcccctcccgcaccgggtgcacctgtgtcgcggattctgttcctgaccgatctgcactgggatcatgattatctggagggtaccgatcctgattgtgcagaccccctctgctgtaggagaggaagtggactcccacccgcaagccgcccaggagcaggctactggggtgaatactcgaaatgtgatcttcccttgcgcaccctggagtctcttctttccggtctgggcccagcggggccctttgatatggtgtactggaccggagatattccggcgcatgacgtgtggcatcagactcgacaggatcagcttcgggcccttaccaccgtcactgcactggtgcgaaagtttcttgggccagtgcccgtttacccagcagtgggtaaccacgagtcgacccctgttaattccttccctcctccctttatcgagggtaatcattcttcacgctggctgtacgaagcgatggcgaaggcttgggaaccttggcttcctgccgaagcgctgagaacgctccgcattgggggtttttacgctctttcaccttacccgggattgcgcctcatctccctcaacatgaacttttgttctcgcgaaaacttctggcttctgattaacagcactgatcctgccggacagttgcagtggctggtgggtgaactccaagcagccgaggatcgaggtgataaggtccacattatcggccatatccctcctggccattgtcttaagtcttggtcatggaactactatcgcatcgtggcccggtacgaaaacactcttgcagcacaattcttcggtcacactcacgtcgatgaatttgaagtgttttacgatgaagagactctttccagaccccttgcagtggcattcctggccccatcggccactacttacattggactgaatcccggctatagagtgtaccagatagacggcaactacagcggatcctcgcatgtggtgctcgaccacgaaacttacatcctcaaccttactcaagccaacatacctggagccataccacattggcagctgttgtacagagcccgcgaaacttacggactgccaaacaccctgccgacggcgtggcataaccttgtgtacagaatgcgcggggacatgcaattgtttcaaaccttttggtttctttaccataaaggacatcctccatcagagccatgtggaaccccttgccgcctcgcaactttgtgtgcacaactctcagcaagagctgattcacccgctctgtgtaggcacttgatgcccgatggatccctgccagaagcacagtccctttggcctagaccactgttttgt

SEQ ID NO: 19732 - DNA, 1893 bp, Artificial Sequence
  Description of Artificial Sequence: Synthetic coding sequence
atgcccaggtacggtgcgtcgcttcgtcaaagctgcccccgttctggaagagaacaaggtcaagatggaacggctggcgcaccggggttgctctggatgggtctcgttcttgccctcgcattggctctcgctctggccctcgctttatctgactcccgagttttgtgggcacctgctgaggcacatcctttgtctcctcaggggcacccagcgcgtctgcaccgcatcgtgccacgacttagggacgttttcggttggggtaacttgacatgtcctatttgtaaaggattgtttaccgccatcaacctgggtcttaagaaagaaccgaacgtcgctcgtgttgggtccgtcgctattaaactctgcaacttgctcaagattgcacctccagcagtttgtcagtcaatagtgcacctttttgaagatgatatggttgaggtctggaggcgctcggttctcagtccctccgaagcctgcggcttgctgcttggttctacgtgtggccactgggatatcttctcttcttggaatatcagcctaccaactgttccaaaacctcccccgaagcctccttcacctcctgctcctggggcacctgtttccagaattctgtttctgacagacttacattgggaccatgactacctggagggtactgatcccgattgcgctgacccgctttgttgcaggcgtggttccggactaccccctgcatcaaggccaggagcagggtactggggtgaatatagtaagtgtgatctgcccttgcgtactttggagtcattgctctccggtttgggacccgcaggacccttcgatatggtttattggactggagatatccctgctcacgacgtgtggcatcaaacgaggcaagatcaactacgcgcactcacaacagttactgcccttgtgcgaaagttcctcgggcctgtccccgtttacccagccgtcggtaaccacgaaagcaccccagtgaatagcttcccccctccctttattgaaggaaatcacagttctagatggctctatgaggccatggctaaagcctgggaaccatggttacccgctgaggctttacgtacattgcgcattggaggtttctatgcccttagtccctatcctggtttgagattgatttctcttaacatgaatttttgcagtcgggaaaatttttggttacttataaactcaacggacccagctggacagctccaatggctggtcggcgaacttcaggcggctgaggacaggggggacaaagttcatataattggccacatcccacccggacattgtttaaaatcttggtcatggaattattatcgaattgtcgccagatacgaaaacactttagccgcccaattttttggccatactcatgttgatgaatttgaggtgttttatgatgaagagactttatctcgccctcttgctgtagcatttcttgccccgtctgctacgacctatatcggattgaatccagggtacagagtatatcaaatcgacgggaactatagcggctcatcacatgtcgtcttggatcatgagacgtatattttgaacctaacgcaggctaacattcctggcgcaattccgcattggcaactcttgtaccgggctcgggaaacatacggcttgccaaatacgcttcctacagcctggcacaacctagtttacagaatgaggggagatatgcaattgtttcaaactttttggttcctttatcacaaggggcatccgccaagtgagccatgtgggaccccttgcagacttgcaaccttgtgcgcacaactgtccgctcgagcggacagcccggccctctgcagacacctcatgccggatggcagtttgcccgaggcccagtcattatggccaagaccacttttctgc

SEQ ID NO: 19733 - DNA, 1893 bp, Artificial Sequence
  Description of Artificial Sequence: Synthetic coding sequence
atgcctagatacggcgcgtcccttcggcaatcgtgccctcgctcaggtagagagcagggacaggatggcactgcaggtgcccctggattgctgtggatgggactcgtgcttgccttggctttggctcttgcactcgccctcgccctttctgatagccgcgtgctgtgggccccggcggaagcacacccgctgtccccacagggacaccctgccaggctgcatcggatcgtgccgcgcctgcgggacgtctttggctggggaaacctcacctgcccgatctgtaagggtctgttcaccgcaatcaacctgggcctgaagaaggaaccaaacgtcgctagggttggctccgtggcgatcaagctgtgtaatttgctcaaaatcgcgcccccagccgtctgccagtcgattgtgcatttgtttgaggacgacatggtggaagtgtggcgcaggtcggtgctgtcaccatccgaggcgtgcggactcctcctgggaagcacctgcggacactgggatatcttctcgagttggaatatctccctgccaaccgtgccgaagccaccacctaagccgccgagcccacctgccccgggggccccggtatcccgcatcctgttcctgacggatctgcactgggaccacgattacctcgagggcactgatccagactgtgcggacccgctgtgctgcaggagaggatccggcctccctcccgcctcgcgccctggagctggatactggggcgaatacagcaagtgcgacctgcccttgcggactctcgaatcgctgctctcgggacttggaccggcgggaccattcgatatggtctactggactggcgatatccctgctcacgatgtgtggcaccagaccagacaagaccaactgcgggcccttaccaccgttactgcactggtcaggaaattcctgggaccagtgcccgtctacccggcagtgggtaaccacgagtcaactccagtcaacagcttcccaccgccgttcatcgagggaaaccatagcagcaggtggctgtatgaggcgatggccaaggcatgggaaccttggcttccagcagaagcattgcgtacccttcgtatcggaggcttctatgccctctcaccgtaccccggcctgcgcctgatctcgctgaatatgaatttctgctcacgagaaaacttctggctcctgatcaactccacggacccagcgggacaactgcagtggttggtgggtgaactgcaggcggccgaggacaggggcgacaaagttcacatcataggacatatccctcctggccattgtcttaagagttggtcctggaactactatagaattgtcgcacgctacgagaacaccctggcggcacagttcttcggacatacccatgtggatgagttcgaggtgttttacgacgaggaaacgctgtcacgcccgctggccgtggctttcctcgccccgtcggcaactacttacatcggactcaatcctggataccgcgtttaccaaatcgatggaaattactcgggatcatcgcatgtcgtgctggatcacgaaacgtacattctgaacctcactcaggctaacattcctggagccatccctcactggcagctcctgtaccgtgcccgggaaacttacgggctcccaaatacccttccaaccgcttggcataacctggtgtaccggatgcgcggcgacatgcagctgttccaaactttttggtttctttaccataaaggacaccctccttccgaaccttgcggtactccctgtagactggctaccctctgtgcgcagctgtccgcacgggccgactcgccggccctctgtcgacacctgatgcctgacgggagtctgcccgaagcacaatcgctgtggccgcggccgctgttttgc

SEQ ID NO: 19734 - DNA, 1893 bp, Artificial Sequence
  Description of Artificial Sequence: Synthetic coding sequence
atgccacgttatggagcctcattgagacagtcgtgcccaagatcaggaagagaacagggacaagatgggacggccggtgcacccgggctgctttggatgggtttggtgcttgcattggcacttgcacttgcgcttgcgctggcactttcggattcccgagtgctttgggcccctgcagaagcacatcctctcagcccgcaagggcatcccgcccgactccaccgcattgtcccccgactccgggacgtgtttggttggggaaatctcacctgtcccatctgtaagggtttgttcacggcaatcaatcttggcttgaagaaagagccaaacgtcgcacgggtcggatcggtggccataaaactgtgcaaccttctgaagattgcccctcccgcagtttgtcagagcattgtgcacctttttgaggatgacatggtggaggtttggcgtcggagcgtgcttagcccttcggaagcctgtggcttgcttttgggatcgacctgtggacactgggacatcttttcatcttggaacattagccttccaaccgtcccaaaaccgccacctaagccaccatcaccacctgcacctggtgcgcctgtgtcaaggattcttttcttgaccgatctgcattgggatcatgactacctggaagggacggaccctgattgcgcagacccactgtgctgcaggcggggcagcggcctcccacccgcctcccgtcccggggccggctactggggagaatactccaagtgtgacctcccgcttagaaccctggaatcgctgctgtctggacttggaccagcaggtccttttgatatggtgtactggacgggagacatcccggcacatgatgtctggcatcaaactcggcaagatcaattgcgagctctcacgactgtgactgcactcgtgcggaagttcctggggcctgtccctgtgtatcctgcagtcggaaatcacgaatctactccggttaattcgtttcccccacctttcattgaaggcaaccactcgtcaagatggctctatgaggcgatggcaaaggcttgggagccttggcttccagccgaagcccttcggacgctgcgaattggaggcttctacgccctgtctccctacccgggactgaggctgattagtctcaatatgaacttctgttctagggagaatttctggctccttatcaacagcacggatccagctggccaacttcaatggctggtgggagaactgcaggcagccgaggatcgcggtgataaagtgcacattataggccacataccacccggacattgtctgaagtcatggtcgtggaactactaccggatagtggcccgctacgaaaacaccctggcagcgcaattctttggtcacacccatgtggatgagtttgaagtcttttacgatgaagaaaccctctccaggcccctggctgtagcatttctcgcaccgagcgcaactacttacatcggactgaaccctgggtatcgagtgtaccagattgatggcaattactccgggtcgtcccatgtcgtgctcgaccatgaaacctacattctcaaccttacccaggcaaacatcccgggtgcgatcccacattggcagctgctctaccgtgcccgggagacttacggcctccccaacaccctccctaccgcgtggcataatctggtgtacagaatgcgcggtgatatgcaactgtttcagaccttttggttcctgtaccataaggggcatcctccatcggaaccttgtgggactccctgtaggcttgcaactctctgcgcacaactttccgcccgagcagactctccagcactgtgtcggcacctgatgcctgatggatccctgcccgaggcacagtcactgtggccacggccacttttctgc

SEQ ID NO: 19735 - DNA, 1893 bp, Artificial Sequence; identical to SEQ ID NO: 19715
  Description of Artificial Sequence: Synthetic coding sequence

SEQ ID NO: 19736 - DNA, 1893 bp, Artificial Sequence
  Description of Artificial Sequence: Synthetic coding sequence
atgcctaggtacggtgcatcactgagacagtcctgtccacgatcaggacgggaacagggccaagatggaactgcaggagcacctggccttctgtggatgggtctggtgttggcgctggccctggctcttgcccttgctctcgcgctctcagattcgcgggtcctctgggcaccggcagaggcgcatcctctgtcgcctcaagggcatccggctagactgcatcgcatcgttccacggttgcgagatgttttcggttggggcaatctcacctgccctatttgtaagggcctgtttactgcaatcaatctgggccttaagaaggagcctaacgtggcccgagtgggtagcgtcgcgatcaaactctgcaacctgctgaaaatcgcacctcccgcagtctgtcaatctattgtgcacctgttcgaagatgatatggtggaagtgtggagacggtctgtcctgagcccatcagaggcctgtggcttgctcctgggttcgacttgtggacattgggatatctttagctcctggaacatttcccttcctaccgtgcccaagccccctccaaaacccccctcgccacctgccccaggtgctccggtcagcaggatactttttctgactgatctgcattgggaccatgactacctcgaagggactgacccggactgtgccgacccgctgtgctgccgtaggggttccggactccctccagcgtcgcgcccaggtgcaggatactggggcgaatactccaagtgtgatctgcctcttcgaaccctcgagtcccttttgtcgggacttggtcctgccggaccttttgatatggtgtactggacgggcgacattccagcgcatgacgtgtggcatcaaacccgccaggatcaactcagagcccttactactgtgacggcacttgttcgaaagtttctgggacctgtgccagtgtaccccgcagtgggaaaccatgaaagcacccctgtcaacagcttcccacctccctttatcgagggtaatcattcgagccgctggctctacgaggcaatggcaaaggcttgggaaccgtggctgccagctgaagcattgcggacgctccgcatcggaggtttctacgcactgtcgccatacccaggacttcgactcatttcactcaacatgaacttctgtagcagagagaatttctggcttcttatcaactcaactgatccagccgggcaactccaatggcttgtgggggaactgcaggcagccgaggacagaggcgataaggtgcacattattggacatatacccccgggtcactgtctgaaatcatggtcttggaactattaccgtattgtggcgagatacgaaaatacccttgcagcccagtttttcggacatacgcatgttgatgaatttgaagtgttctacgatgaagagactctctcaagaccacttgctgtggcatttcttgcaccatcagcaacgacttacatagggctgaatcctggataccgggtgtatcagattgacggcaactactccggatccagccatgtcgtccttgatcatgaaacctacattctgaacctgactcaagcaaacatccctggcgctattcctcattggcaattgctgtaccgagcacgcgaaacttatgggttgccgaataccctgccaactgcttggcataatctggtgtaccggatgaggggtgatatgcaactttttcagaccttttggtttctttaccataaaggtcatcccccctcggagccctgcggcaccccatgccgtctcgctactctttgcgcacagctttccgcgagggcggactcgccagccctctgcagacatcttatgcctgacgggagcctccctgaggcacagtcactgtggccgcgccccctgttttgc

SEQ ID NO: 19737 - DNA, 1893 bp, Artificial Sequence
  Description of Artificial Sequence: Synthetic coding sequence
atgcccagatacggagcatccttgaggcagtcgtgcccacgatccggtcgcgagcaggggcaagacggcactgccggagcccccggactcctgtggatggggctggtcttggccctcgccttggcgctcgcgcttgcgctggccttgtccgactccagagtgctttgggctccggccgaagcccaccccctgtcgcctcaaggtcacccggcccggctccatcggatcgtcccacggctccgcgacgtgttcggatggggaaacctgacttgcccgatctgcaagggactttttactgcgatcaacctgggcctcaagaaggaaccgaacgtggcacgcgtcggaagtgtcgctatcaaattgtgcaacctgcttaagattgccccgccggccgtgtgccaatcgattgttcacctctttgaggacgatatggtggaggtctggagacgttcggtgctgtcgccgtccgaagcgtgcggactcttgctgggatcgacttgcggacactgggacatcttttcgtcatggaatatctcgctgccgacggtcccaaagcctccgcctaagccaccgtccccacctgcgcccggagcaccggtgtcccgcatcctgttcctgaccgacctgcattgggatcatgattacctggagggaactgatccggactgcgcagacccactttgctgtcgccggggctcgggcctcccgccggcgagtcgccctggagccggttactggggagaatacagcaagtgtgacttgcctctgaggactctggaatccctcctgtcgggccttggtccggctggcccttttgacatggtttactggaccggcgacatccccgctcatgacgtctggcatcagacccggcaagaccaactccgggccctcaccaccgtgacggccctcgtcagaaaattccttggacctgtgcctgtgtatcctgctgtgggcaaccacgagagcactccggtgaacagcttcccgccaccgttcatcgaaggtaatcactcatcacgctggctgtacgaggctatggcgaaggcctgggagccgtggttgccggccgaagctctgcgcactcttcggatcggcggtttctacgccctgtcaccgtacccaggtctgcggctcatctcgctgaacatgaacttctgttcccgggagaacttttggctcttgattaactcgactgacccagcgggacagttgcagtggctggtcggagagctgcaggctgccgaggaccggggagacaaagtgcacatcatcggccatatcccgccggggcactgcctgaagagctggtcgtggaactactacaggatcgtggccagatacgaaaacaccctggctgcgcagttcttcggacacacccacgtggatgaatttgaagtgttttacgatgaagagactctgtcccgcccacttgctgtggcctttctggccccatcagcgaccacctacatcggactgaatccgggctaccgcgtctaccagatcgacggcaactactccggatcctcccacgtggtcctggaccacgagacgtacatcctgaacctgacgcaggcaaacattccaggggctataccacattggcaattgctttacagggcacgggaaacctacggcctgccaaataccctcccgaccgcctggcataacttggtgtacagaatgcgaggcgatatgcagctgtttcagactttttggttcctgtaccacaagggtcatcctccgtcagaaccgtgtggaactccgtgtcggctggcgaccctttgcgcgcagttgtcagcccgagctgactcaccggcgctgtgcagacatcttatgccggacgggagcctgcccgaagcccagagcctgtggccacgcccgctgttttgt

SEQ ID NO: 19738 - DNA, 1893 bp, Artificial Sequence
  Description of Artificial Sequence: Synthetic coding sequence
atgccaagatacggcgccagtcttcgtcaatcttgtcctagatcaggacgcgagcagggacaagatggcaccgccggcgcacccgggctactgtggatgggcctggtacttgctttagccctggcgcttgctctcgctcttgccctgtcagactcgagggttttgtgggcgcctgcagaggcgcacccactcagtccccagggacaccctgcgagactacacagaattgtcccaaggctgcgggatgtgttcggctggggtaatttgacctgtccaatctgtaaaggcctgttcacggcgatcaacttgggcctgaaaaaagagccaaatgtggcaagggtgggatcagtggccatcaaattatgcaatctcctgaagattgccccccctgcagtttgtcagagcattgtgcacctttttgaggacgatatggtggaggtttggaggaggtccgtgctgagccctagcgaagcctgtggactacttctgggatccacctgtggtcattgggatatcttttcgtcttggaatatctcgctccccaccgtgcctaaacccccaccaaagccacctagtcctcccgcccctggcgccccagtgagtcggatccttttccttacagatcttcactgggatcacgactacctcgaggggacagaccccgactgtgccgacccactctgttgcagacgcgggtcaggacttcccccagcatcacgtccgggcgccggctattggggcgaatacagcaagtgcgatctccctctgcgcactctcgagtctcttctttccggtctgggcccagccggtccttttgatatggtctactggacgggggatattccggcacacgacgtttggcaccagacaaggcaggaccaactgcgagcgttaaccacagttaccgccctggttaggaagttcctgggcccggtgccagtttaccccgctgtgggcaaccatgagagcactccagtcaatagctttcctccgccctttatcgagggtaaccactcttcccggtggttgtacgaggccatggcaaaggcctgggagccatggctgcctgcggaggccttgcgtactttgagaattggcggcttctacgccctctctccctatcccggattgcggctgattagtctcaatatgaatttttgcagcagagaaaacttctggctgcttatcaattcgactgacccagcaggccaattgcagtggctggtgggagaacttcaggccgcagaggataggggggataaggtgcacatcatcgggcacatcccacccggacactgcctgaaaagttggagctggaattactaccgcatcgtcgctcggtatgagaacaccctggcggcccagttttttggccacacgcatgtggatgagttcgaagtgttctatgatgaagagacactgagccgccccctcgcagtagcctttctggcccctagcgccaccacctatatagggttgaatcctggataccgcgtatatcagattgacgggaattacagtgggtccagtcacgtggtgctcgaccacgagacctacatcctgaacctcacccaagccaacatccctggggctatcccgcattggcagctcttgtatagggcccgcgagacctatggcttaccaaacaccctccctactgcctggcacaatcttgtatacaggatgcgtggagatatgcagttgttccagacattctggtttctctatcataagggccatccaccgtctgagccatgtggcaccccctgtcgcttagctacactctgtgcccagctctctgctcgggctgattcaccggcactgtgtcggcatctgatgcctgacggctccctgcccgaagctcaaagcctctggccccgccccttattctgc

SEQ ID NO: 19739 - DNA, 1893 bp, Artificial Sequence
  Description of Artificial Sequence: Synthetic coding sequence
atgccgcggtacggtgcctcactccgccagtcctgcccgaggtccggaagagaacagggccaggacggcaccgccggggcaccagggctgctctggatgggactcgtgctggctctggcgctggccctcgccttggcactcgctttgagcgatagtcgggtcctgtgggccccggcagaagcacaccctctgtccccgcaaggacatcccgcccgcctccatcgcatcgtgcctcgcctgcgggacgtgttcggatggggcaacttgacttgcccgatctgcaagggactgttcacggccatcaatcttggcctgaaaaaggaaccgaatgtggcgcgagttgggtccgtggccattaaactctgcaatctgctcaagatcgctcctcccgcagtgtgccagtcgatcgtccacctgttcgaggacgacatggtggaggtgtggagacggtcagtcctcagcccgtcagaggcgtgtggactcttgctgggctccacttgcggccattgggacatcttctcatcatggaacattagcttgccgaccgtgccgaaaccacctccaaagccaccgtcaccgccggccccaggagcccctgtgagccggattctgtttcttaccgatctgcactgggaccacgattacctggagggaaccgatccggactgcgccgacccgctctgctgtcgccgcggatccgggctcccaccggcatcccgcccgggagccggctactggggggagtactcgaagtgcgatctgccgctgcgcaccctggagtctctgctgtccggcctcggtccagcgggcccgtttgacatggtctactggactggagacatcccggcacacgatgtctggcatcagacccggcaggatcagctgagagcgctgactaccgtgaccgcgctggtgcggaaattcctcgggccggtcccggtctacccggcggtgggcaaccacgagagcactcccgtgaatagcttccccccgccgttcattgagggaaaccactcatccaggtggctgtacgaagctatggcaaaggcctgggagccgtggctgcctgcagaggccttgagaacccttcgcatcggaggattctatgcactttcaccttacccgggactgagattgatctcccttaacatgaacttttgctcgagagaaaacttctggctgctgatcaattccaccgaccccgccggacaactgcagtggctggtgggagagctccaggccgcggaagatcgtggagacaaggtgcacatcatcggccacatcccaccgggacactgccttaaatcgtggtcctggaattactaccgcatcgtcgcaaggtacgaaaacaccctggcggctcagttcttcggacacacgcacgtggacgaattcgaggtgttctacgacgaagagactctctcgaggccgctcgccgtggccttcttggccccgtcagctaccacttacatcggactcaatcctggataccgggtgtaccaaatcgatggcaactactcgggttcgagccacgtggtgctggaccacgaaacctacatcctgaatctcactcaggcgaatatcccgggagcaataccgcactggcaactgttgtaccgcgcgcgagaaacctacggacttcccaacaccctgccgaccgcgtggcataatctggtgtacaggatgcgcggcgacatgcagctcttccagaccttctggttcctgtaccacaagggccacccaccttcagagccgtgcggaaccccctgccgcctggcaacgttgtgtgctcagctctcagcgcgcgccgactcccctgccctttgccgccacctcatgccagatgggtccctgccagaagcccagtccctctggccgcgccccctcttctgc

SEQ ID NO: 19740 - DNA, 1893 bp, Artificial Sequence
  Description of Artificial Sequence: Synthetic coding sequence
atgccgcgatatggggctagccttaggcaatcatgccctagatccgggagggaacaggggcaggatggcactgcaggagccccagggctgctctggatgggcctggtcttagcgctagcgctggcactcgccctggctctagcgctgagcgattcgagggttctgtgggcaccggctgaggcccatccgctaagtcctcagggccatcctgccagactgcacagaatcgtaccacgattacgagatgtcttcggctggggaaatctgacctgccccatctgcaagggcttattcacagccataaatctcgggctgaaaaaggaaccaaacgtggctcgggttggctctgttgccatcaagctctgtaacttgcttaagatcgcaccacccgccgtgtgtcagtccattgtgcacttgttcgaggatgacatggtcgaggtgtggcgacgcagcgtcctgtcaccgagtgaggcatgtgggttactcttagggtcgacttgcggccactgggacatattcagttcctggaacataagtctccctacagtgcctaagcccccgcctaagccaccttctcctcctgctccaggtgccccagtttcccggattctgtttttgacagacttgcactgggatcacgattacctggaggggaccgatcccgactgtgccgaccccctatgttgcagacggggttcagggctcccacccgccagcaggccaggcgctgggtactggggagagtattcgaagtgcgacctgcccctgaggaccctggaatctttgctcagtgggctcggtccggcagggcccttcgatatggtgtactggacaggcgatattccagcccatgacgtgtggcatcagaccagacaggaccagctaagggctctgaccacagttaccgctttagtgcggaaattcttggggccagtgccggtttaccccgctgtcggcaaccacgagtcaaccccagtgaattcatttccccctccctttattgagggcaatcattcatccaggtggctctatgaagcgatggccaaggcttgggaaccttggctccccgccgaagctctcaggactcttcgtatcgggggcttctatgctctgtcgccttacccgggtctaagattgatatccctgaacatgaatttttgctcgagggaaaacttctggcttttaattaactcgacagaccccgcaggccagcttcagtggctagtgggtgaactacaggccgcggaggacagaggtgataaggtccatatcattggtcacatcccccccgggcattgtttaaagtcttggtcctggaactactacagaatagtggcgcgctacgagaataccctggccgcccagtttttcggacacacacacgtggacgaatttgaggtattttatgacgaggagacattgtcgcgtcccctggctgttgcatttttggcaccctctgccacaacatacattggtctcaatccggggtaccgagtgtatcagatcgacggtaactactcagggtcctcccacgtggtactcgaccacgagacatacatccttaatttgacacaggcgaacatcccaggcgctattccccattggcagttgctctatcgggccagggagacctatgggctgccgaacacgctgccgaccgcatggcataatttggtctacaggatgaggggggatatgcagctgtttcagacattctggtttttgtaccataaagggcatcccccgagtgagccctgtggcacaccctgtcggttggctactctatgcgcgcagctcagtgcacgcgccgattctcctgctttgtgccgacacctcatgcccgacggatccctgcccgaggcgcagtccctttggccacgtccgctcttttgt

SEQ ID NO: 19741 - DNA, 1893 bp, Artificial Sequence
  Description of Artificial Sequence: Synthetic coding sequence
atgcctcggtatggcgcttctctacgacaaagctgcccacgatccgggcgagagcagggtcaggacggtacagccggcgccccaggccttctgtggatggggctggtgctggctttggccctggccctcgccttggctctggctctgagtgactcgcgcgtcctgtgggctcctgcagaggcccatccgctgtccccccagggacatcctgcaagacttcacagaatcgtcccccgtctcagagacgtgttcggctggggcaatctcacgtgcccgatctgcaaaggcctattcactgctatcaatctgggtcttaaaaaggaacctaacgtcgccagagttggctctgtggcaataaagctctgtaatttgcttaagattgcgcctcctgccgtgtgccaatctatcgtgcacctgttcgaggatgacatggtggaggtgtggcgtagaagtgtgctcagccctagcgaggcgtgtggcttgcttctgggctctacttgtggccactgggacatcttcagctcttggaacatctccctacctacagtgcctaagcctccccctaagccgccatcgccacctgctcccggcgccccagttagccgaattctctttttgactgatctccactgggatcacgactacctggagggaaccgatcctgattgtgcagatcccctgtgttgtcgtcgcggatccggtctcccccccgccagccggccaggggccggctactggggagagtactcaaagtgcgacctaccactgcggactttagaatctctgttgagtggcctcggtcctgccggacccttcgatatggtgtattggacgggagatatccctgcacacgacgtgtggcaccagaccagacaggaccaactccgggcactgactacagtgacagctctcgtccgaaaattcctgggtccagtgccagtttatccagccgtgggcaaccacgagtctacacccgttaattcgtttcctccaccctttatcgaaggcaaccactctagtaggtggttgtacgaagctatggcaaaagcatgggaaccatggctgccagcagaagccctgcggacactgcgaataggaggtttttatgctctctcaccataccctggactgcggctgatttcacttaatatgaacttttgcagccgcgaaaatttctggctccttatcaattccaccgaccccgctggacagcttcagtggctcgtaggcgagttgcaagcggctgaggatcgtggagacaaggtccatattatcggacacatacctcctggccactgtctgaagtcatggtcttggaattactaccgcatcgtggctagatatgaaaacacactggccgcacagtttttcgggcacacccacgtggacgaattcgaagtattctatgatgaagaaaccttgagcaggccactcgctgtggcatttctagccccatccgcaaccacatatatcggtttaaatcctggatacagagtgtaccagatagatggaaactattccggcagctcccacgtggtcctggatcatgagacctacattctcaatctgacgcaggctaacatacccggagcaataccacattggcaactcctgtaccgggccagggaaacctatgggttgcccaacacactgcctacggcctggcacaacctggtgtaccggatgcgcggggatatgcagctatttcagaccttttggttcctgtatcacaaaggccatccccccagcgagccctgcggaacaccttgtcgccttgcaactctatgcgctcagctctctgcacgagcagactcaccagctctgtgcagacacctgatgcccgatgggtcgctgcctgaggcccagagtttgtggccgcgccctttgttctgt

SEQ ID NO: 19742 - DNA, 1893 bp, Artificial Sequence
  Description of Artificial Sequence: Synthetic coding sequence
atgccacgctacggcgcatccttgagacagagctgtccaagaagcggacgcgagcagggtcaggacggcaccgcaggagctcctggtctgctctggatgggcttggttttggctttggccctggctctggcattggccttggccctcagtgatagccgcgtgctgtgggctcccgcagaggctcacccccttagcccccagggccatcccgctaggctgcataggatcgtcccacgtctgagggacgtgttcggctggggcaacctgacatgtcctatctgcaagggtttgttcacagctataaatctgggcctcaagaaggaaccaaacgtcgcacgtgttggttcagtggcaattaagctgtgtaacctgctcaaaattgctccccctgccgtttgccaaagtattgtacacctgtttgaagacgacatggtagaagtgtggaggaggtccgtcttgagtccctccgaggcttgtggtctgctgttgggcagtacatgtggacattgggacatattctccagttggaacatatctcttcccacagtacccaagcccccacccaagcctccttccccacccgctcccggagcccccgtgtccagaatcctgttcctgactgaccttcactgggaccacgattacctcgagggaacagatcccgattgtgccgacccattgtgctgcagacgcggttctggcctgcctcctgcttctaggcccggtgccggatactggggtgagtactcaaaatgcgaccttcctctcaggaccctcgaatcactgctgagcggactgggcccagctggcccctttgatatggtgtactggactggagacatccctgctcatgatgtctggcatcaaacaaggcaggatcagctccgcgcactcacaacagtgacagccttggtcagaaagtttctcggtccagttcctgtttaccctgccgtgggtaaccatgagagtacccccgtaaattccttcccacctccttttatcgaaggtaaccacagctctcgctggttgtacgaggccatggccaaggcctgggagccttggctgcctgctgaggccctcagaactctccgtattggtggattttacgctctcagcccttaccctggtcttcgtctgatctctctgaacatgaacttttgtagtagagaaaatttctggctcctcatcaattctaccgatcctgctggacaactgcagtggttggtaggtgaacttcaagctgcagaggataggggcgataaagtgcatattatcggccacatcccccctggtcattgcctgaagtcttggagctggaattactatcgtattgtagcacgctatgagaatactctggcagctcaatttttcggccacacccatgtcgacgagttcgaggtcttctacgacgaggagacactcagccgcccactcgctgtggcattcctcgctccttcagccactacttacattggattgaatccaggctaccgcgtctatcagattgatggtaactattcaggtagctcccatgtcgtgcttgaccacgagacatacattctgaacctgacccaggccaatatccctggcgctataccccactggcagctcctgtaccgtgctagggagacatacggtctccctaacactctgcccaccgcctggcacaatcttgtgtatcgtatgaggggtgacatgcagctgtttcagactttctggtttttgtatcataagggtcaccctccctccgagccctgcggaaccccttgcagactggccactttgtgcgcacagctttccgctagagccgactcacccgctctctgccgtcaccttatgcccgacggctctctgcctgaggcacagagcctgtggcccagacccctcttctgc

SEQ ID NO: 19743 - DNA, 1893 bp, Artificial Sequence
  Description of Artificial Sequence: Synthetic coding sequence
atgccccgctacggagcttccctgcgtcaatcgtgcccgagatccggaagggagcagggccaggacggaaccgcgggagcgcctgggcttctgtggatgggtctggtgcttgcactcgcactggctctggcactggcgctggcactttcggattcccgggtgctgtgggcgccggcagaggcacatccgctctcccctcagggtcatcctgccaggttgcatcgcatcgtgcctagactgcgtgacgtctttggttgggggaatttgacttgtcctatttgcaaggggctgttcactgccattaacctgggcctcaaaaaagaaccaaatgtggccagggtgggtagcgtggccatcaagttgtgtaatctcctgaaaattgcacccccagccgtctgtcaaagcatcgtgcatttgttcgaagatgatatggtggaggtgtggagacgtagcgtgctttcgccatcggaagcctgcggactccttctggggagcacttgcggacactgggacatcttctcatcttggaacatttcgctgccgactgtcccaaagcccccacccaagccaccttcaccacctgcgccgggtgcgcctgtgagcaggatactgttcctgaccgatctgcattgggatcacgactacttggaggggactgaccctgattgcgcagacccactttgctgtcggaggggaagcggcctgccaccagcgtccagaccaggtgccggctattggggggaatacagcaagtgtgatcttccactgcggaccctggagtcacttctctcgggacttggtcctgcaggtccttttgacatggtctactggactggcgacatccctgctcatgatgtgtggcatcagactcgccaagatcagctgcgagctcttactacggtgaccgccctggtcagaaagtttctgggaccagtccctgtttatcccgcggtggggaaccatgaaagcaccccagtcaactcgtttccgcccccgtttattgaaggaaatcattcatccagatggttgtacgaagcgatggcaaaagcctgggaaccctggctgccagcagaagcattgcggaccctgcggattggcggcttttacgcactctcgccttaccctggactccgcctgattagcctcaacatgaatttctgttcgagagagaacttctggctgctgatcaattcgaccgatcccgctggacagctgcagtggcttgtgggagagctgcaggcggcagaagatcgcggagataaggtgcatatcattggacacatccctccaggacactgcctcaagtcgtggtcctggaattactaccgtatcgtggcccgttacgagaatacgctcgcagcgcaattcttcggtcacacccatgtggacgaatttgaagtgttttacgacgaggaaactttgtcccgaccgttggccgtggcctttctggcaccgtcggcaaccacctacatcggcctgaacccgggatacagagtctaccagattgatggcaattacagcggatccagccacgtggtgcttgaccacgaaacgtacattcttaacctgactcaagcaaacattcccggtgcaattccccattggcagctcctgtaccgcgcaagagaaacttacggacttccaaacacccttccaactgcctggcataaccttgtgtaccggatgagaggagatatgcagctgtttcaaaccttctggtttctttatcataaaggtcaccctccatctgagccttgcggtactccttgcagacttgctaccctgtgcgcacaactgtcggctagagccgactcccctgcactttgccgccatcttatgccagacgggtcactgccagaagcacaatcactttggccgcgccctctgttttgt

SEQ ID NO: 19744 - DNA, 1893 bp, Artificial Sequence
  Description of Artificial Sequence: Synthetic coding sequence
atgccaagatatggtgcatcattaagacaaagttgtccacgttcaggacgtgaacaaggtcaagatggaaccgctggagccccagggttgctatggatgggacttgttttagcattggcattagctttagcattagctctagcacttagtgattctagagtattatgggcaccagctgaagcacatccactttcaccacaaggacatccagctagacttcatagaatagttccaagacttagagacgtatttggttggggaaatttaacatgtccaatctgtaaaggacttttcactgctataaatcttggacttaagaaggaaccaaatgttgctagagtaggaagtgttgctattaaactttgtaatcttttaaaaatcgctccaccagctgtctgtcaatcaattgtgcatctttttgaagatgatatggttgaagtttggagaagaagtgttttatctccttctgaagcatgtggtcttcttttaggttcaacatgtggacattgggatatttttagttcttggaatatttcattaccaactgttccaaaaccaccacctaaaccaccttcacctccagccccaggagcaccagtatcaagaattctttttctaacagatttacattgggatcatgattatctcgaaggaacagatccagattgtgctgatccattatgttgtagaagaggatcaggtttaccaccagcatctagacctggagcaggatattggggggaatatagtaaatgtgatttgccacttagaacattggaaagtttgctttccgggttaggaccagcaggtccatttgatatggtatattggacaggtgatattccagcacatgatgtatggcatcaaactagacaagatcaattaagagcattaacaacagttactgcacttgtaagaaaatttttaggtccagtcccagtttatcctgctgttggaaatcatgaatcaactccagtaaattcatttcctccaccttttatcgaaggaaatcattcatcacgatggttatatgaggcaatggctaaagcatgggaaccttggttaccagctgaggcacttagaacattaaggattggagggttttatgcactttcaccatatccaggtttaagattaatttctttaaatatgaatttttgttcacgagaaaacttttggcttttaattaattctacagatccagctggtcaattacaatggcttgttggtgaacttcaagctgcagaagatagaggagacaaagttcatatcattggacacattccaccaggtcactgtcttaaatcatggtcctggaattattataggattgttgctagatatgaaaatactttagctgctcaattttttggtcatacacatgttgatgaattcgaagttttctacgatgaagaaacattatcaagaccactagcagttgcatttcttgcaccttctgctactacttatattgggcttaatccaggttatcgtgtatatcaaattgatggaaattattctggttcttcacatgttgttcttgatcatgaaacatatatattaaatttaactcaagctaatattccaggagcaataccacattggcaattattatacagagctagagaaacatatggacttccaaatactcttccaacagcttggcataatcttgtttatagaatgagaggtgatatgcaacttttccaaacattttggtttctttatcacaaaggacatccaccatcagaaccatgtggtacaccatgtagattagcaactttatgtgcacaattatcagcaagagcagattcaccagctctttgtagacatcttatgcctgatggatcattaccagaagctcaaagtctttggcctagacctttattctgt

SEQ ID NO: 19745 - DNA, 1893 bp, Artificial Sequence
  Description of Artificial Sequence: Synthetic coding sequence
atgcctcgttacggtgcttccctccgacagagttgccctcggagtggacgtgaacagggtcaagatggaaccgcgggcgcccctggcctgttgtggatgggactggtgctggctcttgccctcgcgctcgctctggccctggctctgagcgacagtcgggtgctgtgggctcccgccgaggcccacccgctgtctcctcagggacatcccgccagattgcaccgcattgttccacgtttgcgtgacgtgtttggatggggaaacctgacctgtcccatttgcaagggccttttcaccgctatcaacctcggactgaagaaggaacccaacgtcgctcgcgtaggttcggtcgctatcaagctgtgcaacttgttgaaaatcgccccgcctgcggtttgccagtccatcgttcacctcttcgaagacgatatggttgaggtgtggcgtagatccgtgctgtctccgtcggaggcctgtggtctgcttcttggctcgacttgcggacactgggatatcttcagctcctggaatatctctttgcctaccgtccccaagcctcccccaaagccccccagccccccagcgcccggtgccccggtttcgcgcatccttttcctgaccgacctgcactgggaccacgactatttggaaggtaccgaccccgactgtgcagaccccctttgctgtcgccgtggtagtggactgcctcccgcctcgcgccccggtgccggttactggggggagtattctaagtgcgatctccccctccggacgctcgagtccctcttgtcaggtctaggacccgccgggcctttcgatatggtttactggaccggcgacattcctgcccatgacgtctggcaccagacacggcaagatcaactgcgcgctctgactacggtcacggcactcgtccgcaagttcttgggccccgtccccgtctaccccgccgtgggcaaccacgaatctactcctgtcaactccttcccccctcctttcatagagggtaaccacagttcccgatggctgtacgaggctatggctaaggcttgggagccctggctgccagcggaggctttgcgcaccctccgcatcggtggcttctatgcattgagcccatatccggggctccgcctcattagccttaacatgaacttttgctcccgtgagaacttttggctcttaatcaattcaacggatcccgccggccagttgcagtggttagtcggcgagttgcaggccgctgaggaccgcggcgataaggtccatatcatcggtcatatcccccctggccattgcttgaagtcctggagctggaactactaccgtatcgttgcgcgttacgaaaacacgctggccgcgcagtttttcggtcacactcatgttgatgaattcgaggtcttctatgacgaagagactctgtctcgcccgcttgccgtcgccttcctggctccgtctgctacgacgtatatcggccttaaccccggttaccgtgtttaccagattgacggcaactatagcggatcctcccatgtagtgctggaccatgagacttacattctcaacctcacccaagctaacatccccggcgcaattccccactggcaactgctctatagagctagggaaacctacggtctccctaacaccttacctacggcctggcacaatctggtctatcgtatgcgaggtgacatgcagctcttccaaactttttggtttttgtaccataagggtcacccgcctagcgaaccctgcggtaccccatgccggctggccactttgtgcgcccagctgtccgctcgtgccgattcccccgccctctgccggcatttgatgccagatggatccttaccagaggcgcagtcgctgtggccccgtccacttttctgt

SEQ ID NO: 19746 - DNA, 1893 bp, Artificial Sequence
  Description of Artificial Sequence: Synthetic coding sequence
atgcctagatacggcgcctccctccggcaatcttgtcctcggtccggccgcgagcaggggcaggacggcacagccggggccccggggctgctgtggatgggccttgtcctagcgctcgccctggccctggcacttgcactggccttgagcgatagcagagttctgtgggcacctgctgaggcacatccgctaagtccccaggggcacccagctagactccaccggattgtgccaagactccgggatgtgttcggatggggcaacttaacctgccctatctgcaaaggcctctttaccgcaattaacttaggcctgaagaaggaacccaacgtggccagggtgggcagcgtggcaataaagctctgcaatttactcaaaattgctccaccagccgtctgtcaatctattgttcatcttttcgaagatgacatggtcgaagtgtggcgccgctcggtactaagtccgtcagaggcctgcggcctattgctcggctccacctgtgggcactgggatatattcagttcatggaacatcagcttacctaccgtgcctaagcccccacctaaaccaccttccccccccgctcccggagcccccgtgagcaggatacttttccttacagacttgcactgggaccacgattacctggagggtacagatcccgactgtgcagatccgctgtgttgccgtcgcggcagcggactgcctcccgcaagcagacctggcgccggctactggggtgagtattcaaagtgtgacctgcctctgcggacgttggaatccctcctctctggactggggcccgcaggcccctttgatatggtgtattggactggggacatccccgcccatgacgtgtggcatcaaacacgtcaagaccagctgcgggcgctaactaccgtcaccgccttagtccgcaagttcctgggacctgtgcccgtgtatccagcggtgggaaaccatgagagcactcccgtcaactccttccccccccccttcattgagggcaatcactctagccggtggttgtatgaggccatggctaaggcctgggaaccgtggcttcctgccgaagccctgcgcacccttcgaattggtggtttctatgctctgagtccttacccagggctgagactgatcagtcttaatatgaacttttgctccagggaaaatttctggctgctgatcaactccaccgacccagcgggtcagctgcagtggctggtgggcgaacttcaggccgctgaagacagaggcgacaaagttcacataattggccatatcccacctggacattgcctgaagtcatggtcttggaactattaccgcatcgtggccagatacgagaacaccctggcagcgcaatttttcggtcacactcatgtggatgagtttgaggtcttttatgacgaagaaaccttatccagacctctagctgtagcattcctagctccttctgcaactacctacatcgggttgaaccccgggtaccgcgtctaccagatagatggcaattactccggctcttcccacgtagttttggaccacgagacctacatcctaaacctcacgcaggccaatattccaggagccatcccacactggcagctgctttatcgcgccagagaaacctatggtctccccaacaccttgcctacagcctggcataacttagtttaccgaatgcggggggacatgcagttgttccagactttttggtttctgtaccacaagggccatccgccttccgagccatgcggaacaccctgtaggttggccacactctgcgctcagctgtcagcgcgcgccgacagccccgcgttatgtaggcaccttatgccagacggtagtttgccagaagctcagtccttgtggcccagacccctcttttgc

SEQ ID NO: 19747 - DNA, 1893 bp, Artificial Sequence
  Description of Artificial Sequence: Synthetic coding sequence
atgccccgatacggtgccagtctgaggcagtcttgtcccagatccggtcgggaacagggccaagatggaaccgctggagccccaggtctgctttggatggggctggttctggccctcgccctggccctcgccctggcactggcgctgtccgatagccgggttttgtgggcacccgctgaggcccatccactttctccgcaggggcaccccgctcggctgcatcgcatcgtgcctcgactgagggatgtgtttggatggggtaacctcacctgccctatctgcaaggggctctttactgcaataaatcttggccttaagaaggaacctaacgttgcccgcgtgggttcagtcgctatcaaactgtgcaaccttctcaaaattgcccccccggcagtatgccagagcatagtacacctctttgaggacgacatggttgaggtctggagaagatccgtcctgtcccccagcgaagcttgcggactgctcttgggatccacctgtggccactgggatatttttagctcttggaatatctctcttccgacagtgcctaagccaccccccaaaccacccagcccacccgctcctggcgccccagtctctagaatcctttttctgaccgacctccactgggatcacgactatctcgaagggaccgatcccgactgcgccgaccccctctgttgtcgaagaggctcaggtctccctcccgcaagcagaccgggggccgggtattggggagagtacagtaagtgtgacctgcctctgcggactctggaatccctgctctccggactgggtccagccggccctttcgacatggtctactggacaggcgatattcccgcacacgatgtgtggcaccaaacaagacaggaccaactgcgagctcttaccacggtgactgcccttgtcaggaagtttctcgggccagttcctgtgtaccctgctgtaggcaaccatgagagtacccccgtaaattcttttcctccaccttttattgaaggcaaccattcttcaaggtggctctacgaggctatggcaaaggcgtgggagccctggctgcccgctgaggctctgaggacactgagaatagggggattttacgctctttccccttaccctggcctgaggctgatttccctcaacatgaacttctgtagccgggagaacttttggttgctgatcaactcaaccgatcccgccggtcagctgcagtggctggtgggagagctgcaagcagcagaggaccgcggggataaggtgcacataatcggccacatcccgcccggccactgtctcaagagctggagctggaattactacaggatcgtggcacgctacgagaatactctcgccgcccagttcttcgggcatacacatgtcgacgaatttgaggtattctacgacgaggagacactgtcaagaccgttggcggtggcttttttggcccccagcgctacaacctacatcggtctcaaccccgggtatcgcgtctatcagattgacggcaattatagcgggtcaagccacgtcgtgttggatcatgaaacctacatccttaacctcacacaagctaatattcccggagcaatcccacactggcagctgctgtacagagcccgcgaaacatacgggctgccgaacaccctccccaccgcgtggcacaatctggtttataggatgaggggtgatatgcaactgttccagacattctggttcctctaccacaagggccatcctccctcagaaccttgtggcaccccttgccgcctggcgactctctgcgcccagctgtcagccagggccgactcccctgctctctgcagacaccttatgccagacggatctctgcctgaggctcagtccctgtggccacgccccctcttctgt

SEQ ID NO: 19748 - DNA, 1893 bp, Artificial Sequence
  Description of Artificial Sequence: Synthetic coding sequence
atgccaaggtacggtgcatcgctgcgacaatcatgccctcgctccggacgggaacaaggtcaagacggtaccgcaggagcgccaggccttctttggatggggctggtgcttgcactcgcgctggcgctggcgctcgcacttgctcttagcgactcgagagtcctctgggcaccagccgaggcccatccactttcaccccaaggccaccctgcaaggctgcatcgcattgtcccacgcctgagggatgtgtttggatggggtaacctcacttgtccgatttgtaaggggctgtttaccgcaattaacctgggactgaaaaaggaacctaacgtggcaagggttggttctgtggcaattaagctgtgtaacctcctcaagatcgcaccacctgctgtctgtcaatcaatcgtccatctttttgaagatgatatggtggaagtctggcgaagaagcgtcctctcgccatcagaggcatgcggacttctcttgggttctacctgtggacactgggacattttctcctcgtggaacatttctcttcctactgttccaaagccaccgccaaaaccgccttcgccacctgcaccaggcgcacccgtcagccgaattctttttctgaccgaccttcattgggaccatgattacctggaaggcactgacccagactgcgcggatcccctttgttgcagaagaggatcagggctccctccagcctccaggccaggggccggttattggggagaatacagcaagtgcgacctccctcttagaactcttgaatctctgctttcagggctgggtccagcagggccttttgacatggtgtactggaccggtgatatcccggcacatgatgtgtggcatcagactaggcaagaccaactgcgggccctcaccactgtgactgcattggtgagaaaattccttggtcctgtgcccgtgtaccctgcggtgggcaatcatgagtcgacgccagtcaactcgttccctcctccctttattgaagggaaccattcctcgagatggctgtacgaagcaatggcaaaggcttgggaaccttggttgcctgcagaggctctgaggactctgagaattggcggcttttacgcactttcaccatacccaggtcttagactcatctcattgaatatgaatttctgtagccgggagaacttttggcttctcatcaactccaccgatcccgccggacaactgcaatggctcgtgggagagctgcaagccgcagaggatcggggagataaagtgcacattattgggcatattcctccgggtcattgtttgaagtcctggagctggaactactaccgtattgtcgccagatacgaaaacactcttgcagcacaattctttggacatacccatgtggatgagtttgaagtcttttatgacgaagaaacgctgagccggcctcttgccgtggcatttctcgcccctagcgcgaccacctacatcggcctcaatcccggttaccgcgtgtaccaaatcgacggaaactactcaggatcgagccacgtggtccttgaccacgaaacctacatacttaacctgactcaagcaaacattcctggtgcgatacctcactggcaacttctttaccgagcacgcgaaacttacggtctgcctaacactctcccaactgcatggcacaatttggtgtaccgaatgcgcggtgatatgcaactgttccaaacgttttggtttttgtaccacaagggacacccaccttcagagccctgtggaaccccatgtcgcctcgcaaccctgtgtgcacagctttccgcaagagcagattctcctgccctgtgcagacatcttatgccagatggcagcctcccagaagcacaatcgctgtggccccgcccactcttctgt

SEQ ID NO: 19749 - DNA, 1893 bp, Artificial Sequence
  Description of Artificial Sequence: Synthetic coding sequence
atgcctcggtacggggcctcgcttaggcagtcgtgtccgagatcaggccgcgaacaaggacaagacggcactgcaggtgccccgggactcctctggatgggactggtgctggccctggctctggccctggcgctggcactggccttgagcgattcacgggttctgtgggccccggcggaggcacatccgctctcgccacagggccatccggcacggttgcatcgcatcgtcccacgcctgcgggacgtgttcggatggggaaacctcacgtgcccgatctgcaagggactctttaccgccatcaacctgggattgaaaaaggagccgaatgtcgcaagggtgggatcggtggctatcaagctctgcaatctcctgaagatcgctcctccggccgtgtgtcaatccatcgtgcatctgttcgaggacgatatggttgaggtgtggcgccggagcgtgctgtcacctagcgaggcgtgcggcctcctgctcggatcaacctgcggacattgggacatcttctcgtcctggaatatctcactgccgactgtcccgaagccgccgcccaagcccccttcgcccccagcaccgggagcgccagtgtcgaggattctgttcctgactgacctccactgggaccacgactacctcgaaggaaccgacccagattgtgcagacccgctgtgctgccggcgtggcagcgggctcccgccagcctcccggcctggcgccggatactggggagagtactccaaatgtgatctcccactgaggactctggagtctctcttgtcgggacttggtccggcaggaccattcgatatggtgtactggactggagacatccctgctcacgacgtgtggcaccaaactaggcaggaccagctcagagccttgactactgtcaccgcgctggtccgcaaattcctcggaccagtcccggtgtacccggccgtgggaaatcacgagagcaccccagtcaactccttccctcctccgttcatcgaaggaaaccactcgtcgcgctggttgtacgaagctatggccaaggcatgggagccttggttgccggcagaggctctgcggactctgagaattggcgggttctatgctctgagcccatacccaggactgcgcctgatctcgctgaacatgaacttctgttcaagggagaatttctggctgctgatcaatagcaccgacccggccggccagcttcaatggcttgtcggtgaactccaagcggcagaggaccggggcgataaggtgcatatcattggacacattccacctggccactgtctgaagtcgtggtcgtggaactactatcgtatagtggcaagatacgaaaatacgttggcagcgcagttcttcggacatacgcacgtcgatgagtttgaagtgttctacgacgaagaaactctgtcacgcccgctcgccgtcgcgtttcttgccccgtcagctactacctacatcggcctgaatccaggatacagagtgtaccaaatcgacggaaactacagcggatcatcccacgtcgtgttggatcatgaaacgtacattctgaatctcactcaagcgaatatcccaggtgcgatccctcattggcagctgctgtacagggcccgcgaaacttacggcctgccgaacaccctgccaacggcgtggcataacctcgtctaccggatgcgcggagacatgcaactcttccaaactttctggttcctgtatcacaaaggacatccgccatcggaaccctgtggaaccccatgcaggcttgcaaccctgtgcgctcagctgtcagcccgggccgatagcccggccctgtgtcgccacctcatgccggatggttcactgccagaagcccagagcctctggccaagaccgctcttttgc

SEQ ID NO: 19750 - DNA, 1893 bp, Artificial Sequence
  Description of Artificial Sequence: Synthetic coding sequence
atgcccaggtatggggcgagtctgcgacagtcatgtccccggagtggaagagaacaggggcaggacggaaccgctggcgcacccggactgctttggatgggactggtgctcgccctcgctctcgccctggccctcgctcttgctctctccgactctagagtcctgtgggctccagctgaagcccaccctttgtcgcctcagggccaccctgcgcgtttgcatcgaattgtgccccgcctgcgggacgtgttcggctggggaaacctgacatgccctatctgtaaaggcttattcaccgcaattaatttaggtttgaaaaaggagcccaacgtggcccgggttggttccgtggcaatcaaactttgcaatctgctgaagattgccccccccgcggtatgccagagcattgtccacctctttgaagatgatatggtagaggtttggaggcgttcagttttatccccaagtgaagcatgtggtctgcttctgggcagtacatgcgggcattgggatatttttagctcctggaatatcagtctcccaaccgtgcccaagcccccgcccaagccgccttcaccccccgctcctggggcccctgtctcccggatactgttcctcactgaccttcactgggatcacgactatttagagggaactgatccggattgcgctgaccctctgtgttgtagaagagggtccgggttacctccggcgtcacgccccggagcaggatattggggagaatactcaaagtgcgatctacccttgagaaccttggagagtctactctccggtttaggacccgcaggtcccttcgatatggtttactggacaggcgatatccccgctcacgatgtgtggcatcagaccaggcaggatcaactgcgggccctgacgacagtgaccgccttggtgcgcaagttcctgggccccgtaccagtatatcccgcggtcgggaatcacgagtctacccctgtaaattcgttccctccgcccttcattgaaggcaatcattcatccaggtggttatatgaggcaatggccaaggcatgggagccttggctccctgcggaagcgctcaggaccctgaggattggtggcttttacgccctcagcccctaccccggtttgcgacttatctcattgaatatgaatttctgctccagggaaaacttctggttgttaatcaatagcacagatccagcaggccagctgcaatggctcgtgggggaactgcaggctgctgaggaccgaggcgacaaggtccacataatagggcatatcccacccgggcactgcctgaagtcatggagttggaactactaccggatcgtggcccgctacgaaaacactttagccgcccagtttttcgggcacacccacgttgacgaatttgaagtattttacgatgaggaaacactctcgcggccactggccgttgccttcttggctccctccgccacgacctacattggcctcaacccgggttaccgagtataccagatagacgggaactactcaggctctagccacgtggtcttggaccacgagacctacatcttaaacctcacacaggccaatattcccggggcgattcctcactggcagctgctctatcgggcgcgagagacctacggtcttcccaacaccctccccacagcctggcacaacctggtgtaccggatgagaggcgacatgcagctcttccaaacattttggttcctgtaccataagggccatccaccatccgaaccttgtggaactccctgcaggctcgctacactctgtgcccagctctctgctagagcagactccccagcgctttgccgccaccttatgcctgatggatccttgcctgaagcacagtccctgtggcctcgccctctcttctgc

SEQ ID NO: 19751 - DNA, 1893 bp, Artificial Sequence
  Description of Artificial Sequence: Synthetic coding sequence
atgccccgatacggtgcctcacttcgccaaagctgccctcgatccggacgtgaacaaggtcaggatggcactgccggtgcacctgggcttctgtggatgggacttgtcttggccctggccctggctttggcacttgcacttgcactgtccgattcaagagtgctgtgggcacctgccgaagcacatcctctctcaccgcagggccatccagcccgtctgcatcgaatcgtgccaaggctgcgagacgtgtttggatggggtaacctgacttgcccgatatgtaagggactctttacggctataaacttgggcctgaagaaggaaccgaatgtggccagagtgggctcggtcgcaattaagctgtgtaatctgctgaagattgcgcctcctgcagtgtgccagtccatagtgcacttgttcgaggacgacatggtggaagtctggcgccgatccgtcctttcaccttcagaagcctgtggacttcttctgggctccacttgcggacactgggatatcttttcatcgtggaatatctcccttcctactgtgcctaaaccccctccaaagccacccagcccgccagctcccggagcaccagtcagcagaattctgttcctgactgatttgcattgggatcatgattacctggaaggtaccgacccagattgcgccgatcctctttgctgccgccggggatctggactcccacctgcttcaagaccaggagccggttactggggtgaatactcaaagtgcgacctgccccttcggactctggaatcgctgttgtcagggcttggacccgcaggaccatttgacatggtctactggaccggcgatattcccgcgcatgatgtgtggcaccagactagacaggaccaacttcgcgcactcaccactgttaccgcacttgtcagaaagtttctggggcctgtccctgtgtacccggcggtgggaaatcatgaatcgactcctgtgaactcgtttcctcctcctttcattgagggaaaccattcgagcagatggctctacgaagctatggccaaagcgtgggaaccctggcttcctgcagaggcattgcgtaccctccgtatcggaggcttttatgctctgtcgccgtaccctggacttaggcttatctcgttgaacatgaatttctgttcgagagaaaacttttggctgcttatcaattcgacggatcctgcagggcaacttcaatggctcgttggcgagctgcaagccgcggaggaccggggtgataaggtccacattataggtcatataccccctggccactgtcttaaatcgtggtcgtggaactactacagaattgtggcgagatacgagaacaccttggccgcccaattcttcgggcacacccacgtggatgagtttgaggtgttctacgacgaggaaactctttccaggccccttgcagtggcatttctggcccctagcgcaacgacttatatcgggttgaatccaggctaccgggtctaccagatcgatggtaactacagcgggtcctcccacgtggtcctggatcatgaaacctacatcctgaatttgactcaggctaacattcctggggcaatcccacactggcagcttctctaccgggcacgcgaaacctatggcctgccaaacaccctgcctaccgcatggcacaaccttgtgtacagaatgagaggagatatgcagctgttccaaactttctggttcctgtaccacaagggacatccaccatccgaaccttgcgggacgccgtgcagattggcaactctctgtgcgcagctctccgcacgcgctgatagccctgcgctttgccgccatctgatgccggatggctcgctgccagaggcacagtcgctgtggcctagacctcttttctgt

SEQ ID NO: 19752 - DNA, 1893 bp, Artificial Sequence
  Description of Artificial Sequence: Synthetic coding sequence
atgccacgatacggagcgtcactccgtcagtcctgtccaagatcgggacgggaacaaggacaggatggaaccgcaggtgcccctggtctgctctggatggggctggtcttggcattggcactggcgctggcacttgcactcgctctgtcggactcaagagttctgtgggcccctgccgaagcacaccctctctcgcctcaaggacaccctgcaaggctccaccgcatcgtgccacgcctgcgggatgtgtttggttggggaaacctcacgtgccccatctgcaaagggctttttaccgcaatcaatctgggactgaaaaaggaacctaacgtggcaagagtgggctcagtggccatcaaactttgcaatcttttgaaaatcgcaccccctgcggtctgccagtcgattgtgcatctgtttgaagatgatatggtcgaagtctggcgtcgaagtgtgctctccccctcggaagcatgtggcctcttgctggggtcaacctgtggacattgggacattttcagctcatggaacatttcgctccctactgtccctaaacctccacccaaaccaccttcgccccctgcccctggagccccagtctcgagaattctttttctgactgatctgcactgggatcatgattaccttgaagggactgacccagattgtgccgacccgctgtgttgcaggcgcggcagcgggctgcctcctgcatccagacctggagcaggatactggggagagtactcgaagtgtgaccttcccctgcggactttggaatcgctgctcagcggactgggcccagcgggaccctttgatatggtctactggactggtgatattcctgctcatgacgtgtggcatcaaacgagacaagatcagcttcgggccctgacgaccgtcactgcgctcgttagaaagttcctgggccctgtccccgtgtacccggcagtcggcaaccacgagtcgacgccagtcaactccttcccccctccctttattgagggaaaccattcatcgcggtggctttacgaggcgatggccaaggcatgggaaccatggctgcctgcggaagcacttcgcactcttcgtattggtggattctacgctctttcgccgtatcctggtctgagattgattagcttgaacatgaacttttgctccagagagaacttctggttgctcatcaatagcactgaccccgctggccagctccagtggcttgtgggagaacttcaagcagccgaggacagaggagataaggtgcacatcataggtcatattcctcctggtcactgcttgaagtcgtggtcctggaattactaccggattgtggctagatacgagaacaccctggccgcccagtttttcggccacacccatgtggacgaatttgaggtcttttacgatgaagaaacccttagccgcccacttgcagtggcattcctggcaccatcggccaccacttacataggcctgaatcctggataccgtgtgtaccagattgatggcaactactcaggatcgagccatgtggtgctggatcatgaaacctatatactgaatcttacccaggcaaacattcctggagcaatcccacactggcagctgctctacagggctcgggaaacctacggactgcctaatactttgccaactgcctggcataatctcgtgtataggatgagaggggacatgcagttgtttcagaccttctggtttctgtaccacaaaggtcatcctcctagcgaaccatgtggaacgccatgccgtctggcaactttgtgcgctcagctttcagcacgagcagattccccagccctttgtagacatctcatgccagatggctcgttgcctgaagcccagagcctttggcccaggcctcttttttgt

SEQ ID NO: 19753 - DNA, 1893 bp, Artificial Sequence
  Description of Artificial Sequence: Synthetic coding sequence
atgccgcgctacggggcctcattgcgccaatcctgccctagatcaggtagagagcaaggccaggacggaactgcgggggcccctggactgctgtggatgggtctggtcctggctcttgccctcgcgttggctctcgccctggccctctccgacagccgggtgctgtgggctccagcggaagcccatccactgagcccgcagggccatccagcacgcctgcatcggatcgtcccacgactccgcgatgtctttgggtggggaaaccttacctgtcccatctgcaagggattgtttaccgcaatcaacctcggactcaaaaaggaaccgaacgtggcgagggtgggatcggtggctatcaagctctgcaatttgctgaagatcgcgcccccggccgtatgtcaaagcatcgtgcatctcttcgaggatgatatggtggaagtgtggaggcgctcagtgctttccccatcggaagcgtgtggactcctgctcggatcgacctgcggacattgggatattttctcctcgtggaacatctccctgcccaccgttccgaagcccccaccgaaaccgccgtccccaccagcgccgggagcaccagtgtcacggatcctgtttctgactgacctgcactgggaccacgactacctggagggaaccgatcccgactgcgccgatccactgtgctgccggaggggcagcggcctcccgcctgcgagccggccgggcgcaggatactggggtgaatactctaagtgcgacctgccgcttcgtactctggagagcctcctctcagggctcgggcctgcaggaccgttcgacatggtgtactggactggcgatatcccggcacacgatgtctggcaccagactagacaggaccagctgagagctctgaccaccgtcactgccctggtgagaaagtttctgggaccggtgccggtgtaccctgccgtggggaaccatgagtcgaccccagtcaactccttcccgccgccgtttatcgaaggaaaccactcgtcgcggtggctctacgaagcgatggccaaagcctgggagccctggctccccgccgaagctctccgcactctgcgcatcggtggattttacgcgctgagcccatacccaggtctgcgcctgatctccctgaacatgaatttctgctcgcgggaaaatttctggctgcttattaacagcactgaccctgccggacaactgcagtggctggtcggagagctgcaagcagccgaggacagaggagataaagtgcacatcatcggtcatattccgcctggacactgcttgaagtcttggagttggaactactatcgcatcgtggcccgctacgaaaatacgttggctgctcagttcttcggacacactcacgtggatgagttcgaggtgttctacgacgaggaaactctctcccggccgctggcagtcgccttcctggcgccttcggcgaccacctacatcggcctgaacccaggctaccgcgtctatcaaatcgacggcaattactcagggagctcacatgttgtgctggaccacgaaacttacattcttaacctgacccaggccaatatcccgggagctattccacactggcagctcttgtaccgggcacgagaaacctacggactcccgaatacccttcctacggcatggcataacttggtgtacagaatgcgcggcgacatgcaactgttccagactttctggttcctctatcacaagggccacccgccctccgagccttgcggcacgccgtgtcggctggcaaccctgtgcgcccagctgtccgcgagggccgactcgccggccctttgccggcacctcatgccggatggtagcctccctgaagcccagtcgctgtggcctagaccattgttctgt

SEQ ID NO: 19754 - DNA, 1893 bp, Artificial Sequence
  Description of Artificial Sequence: Synthetic coding sequence
atgccgcgttatggtgcgtcgctacgacaatcgtgtccgcgttcgggtcgagaacaaggtcaagatggtacggcgggtgcgccgggtttactatggatgggtctagtattagcgttagcgttagcgctagcgctagcgttagcgctatcggattcgcgagttctatgggcgccggcggaagcgcatccgctatcgccgcaaggtcatccggcgcgtctacatcgaatagtaccgcgattacgagatgtatttggttggggtaatctaacgtgtccgatatgtaaaggtttatttacggcgataaatctaggtttaaaaaaagaaccgaatgttgcgcgagttggttcggttgcgataaaattatgtaatttattaaaaatagcgccgccggcggtatgtcaatcgatagttcatttatttgaagatgatatggttgaagtatggcgtcgttcggttttatcgccgtcggaagcgtgtggtttattactaggttcgacgtgtggtcattgggatatattttcgtcgtggaatatatcgctaccgacggtaccgaaaccgccgccgaaaccgccgtcgccgccggcgccgggtgcgccggtttcgcgaatattatttctaacggatctacattgggatcatgattatctagaaggtacggatccggattgtgcggatccgttatgttgtcgacgtggttcgggtctaccgccggcgtcgcgtccgggtgcgggttattggggtgaatattcgaaatgtgatttaccgttacgaacgctagaatcgctattatcgggtctaggtccggcgggtccgtttgatatggtatattggacgggtgatataccggcgcatgatgtatggcatcaaacgcgtcaagatcaactacgtgcgctaacgacggtaacggcgctagttcgtaaatttttaggtccggtaccggtatatccggcggtaggtaatcatgaatcgacgccggtaaattcgtttccgccgccgtttatagaaggtaatcattcgtcgcgatggttatatgaagcgatggcgaaagcgtgggaaccgtggttaccggcggaagcgctacgtacgctacgaataggtggtttttatgcgctatcgccgtatccgggtttacgtttaatatcgttaaatatgaatttttgttcgcgtgaaaatttttggttattaataaattcgacggatccggcgggtcaactacaatggttagtaggtgaattacaagcggcggaagatcgtggtgataaagttcatataataggtcatataccgccgggtcattgtctaaaatcgtggtcgtggaattattatcgtatagtagcgcgatatgaaaatacgttagcggcgcaattttttggtcatacgcatgtagatgaatttgaagtattttatgatgaagaaacgttatcgcgaccgctagcggtagcgtttctagcgccgtcggcgacgacgtatataggtttaaatccgggttatcgagtatatcaaatagatggtaattattcgggttcgtcgcatgttgtactagatcatgaaacgtatatattaaatctaacgcaagcgaatataccgggtgcgataccgcattggcaattattatatcgagcgcgtgaaacgtatggtttaccgaatacgctaccgacggcgtggcataatttagtatatcgaatgcgtggtgatatgcaactatttcaaacgttttggtttctatatcataaaggtcatccgccgtcggaaccgtgtggtacgccgtgtcgtttagcgacgttatgtgcgcaattatcggcgcgtgcggattcgccggcgctatgtcgacatttaatgccggatggttcgttaccggaagcgcaatcgttatggccgcgaccgttattttgt

SEQ ID NO: 19755 - DNA, 1893 bp, Artificial Sequence
  Description of Artificial Sequence: Synthetic coding sequence
atgccacgctatggagcatctcttcgacaatcgtgcccacggagcggacgtgagcaaggacaagacggcaccgcgggcgcgcctggtttgctctggatgggacttgtactagcactggcgctcgctctcgctctggcgttggcgttaagtgattcccgagttctttgggctccagccgaagctcatccacttagtcctcagggacacccagcacgactgcatcgaatcgttccgaggttgcgtgatgtattcggatggggtaatctaacctgcccaatttgtaaaggacttttcacagcgattaatttgggacttaagaaggaacccaacgtggctagagtcggatcagtagcaattaaactgtgtaatctactcaaaattgcaccaccggctgtgtgccagtccatcgtccatttgttcgaggatgacatggttgaggtctggcgtcgctccgtcttaagcccatcagaagcttgcggattattacttggttctacctgtggacactgggatatctttagttcatggaacatctccttgccaacggttccaaagcccccgccaaaacctccatctccaccagcaccaggagctccagtctcacgtattttgttccttactgatcttcattgggatcacgattatttggagggtaccgatcccgattgcgcagacccattgtgctgtcgaaggggctcaggacttccgcctgcctcaagaccaggggctggatactggggagaatattcaaaatgtgacctccctttgcgtactcttgaatcccttctcagcggactcggtccagcaggtccttttgacatggtttactggacgggagacatccccgcccatgatgtttggcatcagactcgacaggaccaactccgagctcttacaactgtgacagctctcgtcagaaaattcttgggaccggtgccagtttatcccgccgtcggaaatcatgaatctacaccagttaactcttttccccctccattcatcgaaggtaaccattcgtcccgatggttatatgaagcaatggcaaaagcatgggagccctggttaccagccgaagctctgcgtacgctccgaattggtggattctatgcactgtccccatacccaggactccgtcttatctcactgaacatgaacttctgctcgcgtgagaatttctggttacttatcaatagcacggacccagctggacaactgcaatggttggtaggagagttgcaagcagctgaagaccgtggggataaggtccatattattggtcatatccccccaggacattgtcttaaatcctggagctggaattactatcgtattgttgcgcgctacgaaaatactctggccgcacagttcttcggtcacactcatgtagacgaattcgaggttttttacgatgaagagacactatcgcgtcctctagctgttgcatttttggccccatctgcaacaacgtatatcggattgaacccgggatatagggtttaccaaattgacgggaactactccggctcgtcgcacgtggtgctcgaccatgaaacttatattttaaacttgacacaggcaaacataccaggagcaatcccgcattggcaattgttatacagggctcgagaaacctatggtcttccaaatactcttccaactgcatggcacaatttggtttatagaatgcgcggtgatatgcaactgtttcaaacgttttggttcctttaccataagggccatccaccgtcagaaccgtgcggaaccccctgtcggctggctacactttgtgcccagctctcggctcgagctgattccccagctctttgtaggcatttgatgccggatggatctctgccagaagctcaaagcttatggcctcggccgttgttctgt

SEQ ID NO: 19756 - DNA, 1893 bp, Artificial Sequence
  Description of Artificial Sequence: Synthetic coding sequence
atgcctcgttatggcgccagtctgcgccaatcttgtccgcggtcaggcagagagcagggacaggatggtaccgccggagcccccggactactctggatgggcctggtccttgccctggctcttgccctagccctggctctggcattgtctgatagccgggtgctgtgggcccccgctgaagcgcaccctctcagcccacagggacaccccgccaggcttcacagaatcgtcccacgcctgcgggatgtgttcggctggggaaatctgacatgccctatttgcaagggactcttcaccgctattaacctaggactcaaaaaggaaccaaacgtcgcccgcgtagggtctgtcgccatcaagctttgcaacctactgaagattgctcctcccgcagtgtgccagtctattgtacacctgtttgaagatgacatggttgaggtctggagaagaagcgtactcagcccctcagaagcatgcgggctgttgctcggttccacctgtggacactgggatatctttagctcgtggaacatttctctcccaacggtccccaaacctccgcccaagcccccttcacctccagctccgggggcacccgtctctcgtattttattcctgacagatctgcactgggaccacgactacctagagggcaccgaccccgactgtgcagatcctctctgttgtcgccgcggctccggacttccaccagccagtcggccaggagccgggtactggggcgaatacagtaagtgcgacctgcccctacggacactagagtccttgctgtcgggactagggccggccggcccatttgatatggtgtactggacaggtgatattcccgcacacgacgtatggcaccagacgcgacaagaccaattaagggcattgaccaccgtgactgccctggtgcggaaattcctgggccctgtgccggtttacccggcggtcggcaatcatgaaagcaccccagtgaactcatttcctccaccatttatagaggggaaccattcctcccgctggctgtatgaagcgatggctaaggcatgggagccgtggctgcctgccgaagccctacggaccctaagaattggaggcttttacgccttatccccttatcccggccttcgactgatatcattgaacatgaatttttgttccagagagaacttttggctcttaataaacagtactgatcccgccgggcagttacaatggctggtgggggaattgcaggccgctgaggatcgaggagataaagtgcatattattggccacatcccaccaggccactgcctaaagagttggagctggaattattaccgtatagttgcgcgttatgagaataccctcgctgctcagttctttggacacacccacgtcgacgaattcgaagtattctatgacgaagaaacactgagccggcccctggcggtggctttcctggcccccagcgcaactacttatattggcctcaacccaggatatagggtgtatcaaatcgacggcaattacagcggctccagccatgttgtgctggatcatgagacgtatatccttaacctcacacaggcaaatattccaggcgcaataccacactggcagttgctctacagggctcgggagacttacgggcttcccaacacactgcccactgcttggcacaaccttgtataccggatgcgcggcgatatgcagttattccaaactttttggttcttgtaccataaaggccatcccccatccgagccatgcggtaccccctgtagactcgcaactctgtgcgcccagctgtccgcccgggccgattccccagctctatgccggcacctgatgcctgacggatcgcttcccgaggcccagagcctttggcctcggcccctgttttgt

SEQ ID NO: 19757 - DNA, 1893 bp, Artificial Sequence
  Description of Artificial Sequence: Synthetic coding sequence
atgccacggtacggagcctcgcttcgccaatcctgtccgcggtccggaagggaacagggacaagatggaactgccggagcgcctggactgctctggatgggcctcgtcctcgccctcgccttggcactggcgcttgcgttggctctgagcgattcaagggtgctttgggcaccagcggaagcacacccgctgagcccgcagggacacccggcccgcctgcatcgcattgtgcccagactcagggacgtgtttggatggggaaatctgacctgtcccatctgcaaggggctgttcactgcaattaacctcggactgaagaaggagccgaatgtggcgcgcgtgggatctgtcgcgattaagctgtgcaatctccttaagatcgccccacccgcagtgtgccagtcgatcgtgcacctgtttgaggatgacatggtggaagtctggaggcgcagcgtgctttcaccatccgaggcgtgtggactcctcctgggatcaacttgtggacattgggatatcttctcctcctggaacatttccctgcccactgtcccaaagccaccaccgaagccaccgtcgccaccagccccgggagcgccagtgagcaggatcctcttcctcaccgacctccattgggaccacgattacctggagggtaccgatccggactgcgcagatcctctttgctgccgccgggggagcggactgccacctgctagccgcccgggtgccggatactggggagaatactcgaagtgcgacttgcctctccgcaccttggagtcgttgctgtccggtttgggaccggcaggaccgttcgatatggtgtattggactggggatatcccagcacatgacgtttggcaccaaaccagacaagaccagctcagagcgctgaccaccgtgactgcgctcgtgagaaagttcctgggtccggtgccagtgtacccagccgtgggaaaccacgagtcgacgccagtcaactccttcccgccgcctttcatcgagggtaaccatagctcccggtggctgtacgaagctatggcaaaggcgtgggagccgtggctcccagctgaagccctccggacgctgcgaatcggaggattttacgcactctccccctacccgggactgaggctcatctcactcaacatgaacttttgttcccgggaaaacttttggctcttgattaactctaccgaccctgccggacagctccagtggctggtgggagaactgcaagccgccgaggacagaggagacaaagtccatatcattggacacatccctcctggccactgccttaaatcatggtcctggaattactatcgcatcgtcgccaggtatgaaaacaccctggcagcacagttcttcggtcacactcatgttgacgagttcgaagtcttttacgacgaggaaactctgtctcggccactcgctgtggcgttcctggctccgtcggcgaccacctacatcggtctgaacccagggtaccgggtgtaccaaatcgacggcaattactcaggaagctcccatgtcgtgctggatcatgaaacttacatcttgaatctgacccaagccaacatcccgggcgccatcccgcattggcagctcctgtaccgggcccgcgaaacctacggactgccgaatactctcccgaccgcatggcataacctggtgtatagaatgcggggcgacatgcaactgtttcagacgttttggtttctctatcacaaggggcaccccccgtcagaaccatgcggtaccccatgtcggctggcaactctttgtgcgcagctctcagccagagcggattcccctgccctctgccgtcacttgatgccggatggaagcctccctgaggctcaaagcctctggccgcggccgctgttctgt

SEQ ID NO: 19758 - DNA, 1893 bp, Artificial Sequence
  Description of Artificial Sequence: Synthetic coding sequence
atgcctcggtacggcgcatcacttcgtcagagctgtcctagaagcggtagagaacaggggcaggatggaactgccggcgcgcccggactcctttggatgggtcttgtcctggcgctcgccctggcacttgcactcgccctcgcattgtccgattcgagagtcctttgggcacccgcagaagcacacccactgtctccgcaaggtcatcctgcgcgactgcatcggattgtccctaggctccgggacgttttcggttggggaaatcttacttgcccaatttgcaagggtctgtttacggcaatcaatctcggcctcaaaaaggagcctaacgtggcaagggtgggctcagtggctatcaagctgtgcaatcttcttaagattgctccccctgcagtctgtcagtcgattgtccatctgtttgaggacgacatggtggaggtctggcgacgctccgtgttgtcgccaagcgaggcatgcggacttctgctcggatccacgtgtggacattgggacatattctcatcatggaacatttccctgcctaccgtgcctaagcctccaccaaaacctccttccccaccggcaccgggcgcacctgtgtcacgcattctgttccttactgaccttcactgggatcatgactaccttgaaggaactgatcctgattgtgccgatccactttgctgtaggcgcggatccggtttgcctcccgcctcgcgccctggagcgggatactggggggaatacagcaagtgcgatcttccgttgcgaactcttgaatcccttttgtcgggactcggtccggcagggccatttgacatggtctactggaccggagatatccctgcgcatgatgtctggcatcaaactcgacaagatcagctcagagccctgaccaccgtgactgcacttgtgcgaaagtttctggggccagttcccgtgtaccctgccgtgggtaaccatgaatccacccctgttaattcctttccacctccattcatagaaggaaatcattcctcgagatggctttacgaggcgatggccaaggcatgggaaccttggctccctgctgaggcactgagaaccctcagaataggtggattttacgcgctttcgccctaccctggactccgactcatcagcctcaatatgaacttctgttcgagggaaaacttttggctgctgatcaattctacggacccagccggacaactgcagtggcttgtgggcgagctgcaagcagctgaggaccgaggagataaggtgcacataattgggcatattcctcccggacactgcctcaagtcatggtcgtggaactactacagaatcgtcgcacgctacgaaaatactctcgccgcacagttttttggccatacccacgtcgatgaatttgaagtgttttacgatgaggaaactctctcgcgccctctggccgtggccttcctcgctccctcggccaccacctacattggtctgaatcctggctacagggtgtaccaaattgatggcaactacagcggttcgtcccatgtcgtgttggatcacgagacttacatactgaacctgacccaggctaatatccctggagcaattcctcactggcaattgctgtacagagcacgggagacttatggccttcccaataccctccctactgcatggcacaatcttgtgtaccggatgagaggtgacatgcaactgttccagaccttctggttcctgtaccataaagggcatcctccatccgagccatgtggaaccccatgccggctggcgaccttgtgtgcccagctttcagcccgggcagattcaccagcactgtgtaggcatcttatgccggatggttcccttcctgaggcgcagtcgctgtggccccgtccactgttctgt

SEQ ID NO: 19759 - DNA, 1893 bp, Artificial Sequence
  Description of Artificial Sequence: Synthetic coding sequence
atgcccaggtacggggccagtttgcgccagtcctgtcctagaagtgggcgagagcaagggcaagatggaactgcgggtgcccccggtttgctgtggatgggtctggtcctggcgttggcgctggctctagcattggccctagccctgtccgattcgagagttttgtgggcgcccgccgaggcccacccactctccccacagggccacccagctcggcttcatcgcattgtgcccaggctacgcgacgtgttcgggtggggcaacctcacctgccccatctgtaagggcctattcacagctatcaacctgggacttaagaaagaaccaaacgttgctcgcgtaggctccgtggccatcaagttgtgcaacttgctaaagattgccccacccgccgtgtgccaatcaatcgtacatctgtttgaggacgatatggtggaagtgtggaggagatccgttctctcaccttccgaggcatgcgggttactcctgggctccacctgcggacactgggatatattttcctcttggaatatctccctccccaccgtgcctaagccacctccgaaaccaccaagccctcctgccccaggggcccctgtatccaggattctcttcctgacagatctgcattgggatcacgattatctagagggaaccgaccctgattgcgcggatcccctgtgttgcaggcgaggcagcggtttaccacctgcttctaggcctggggcggggtattggggcgaatacagcaaatgcgacctacccctccgcactctggagtccttgttaagcggtctgggacctgctggtccatttgatatggtgtactggactggagacattcccgcccacgatgtgtggcaccaaacgcgtcaggaccagttacgggcgctgaccactgtgacagccttggtgcgtaagttcctcgggccagttcccgtgtatccagcagttggcaaccacgaaagcactcctgtgaactcttttcctccaccattcattgagggaaatcacagcagtagatggttgtacgaggctatggccaaagcttgggagccatggttgccggcggaggctttgagaacactgaggatcggggggttttacgccctgtcgccctacccaggcttgcgcctaatctcgctgaacatgaatttctgctcccgtgaaaatttctggctgttgatcaactcaaccgaccctgccggccaactgcagtggctggtaggggaattgcaggccgctgaggaccggggggataaagtgcacatcattgggcacatcccccccggacattgtcttaagtcctggagttggaactactatagaatcgtggccagatacgaaaataccttagccgcccaattttttggacacacccatgttgacgagttcgaagtattttatgatgaagaaaccctgtccagacctctcgccgtcgccttccttgcaccgtctgcgaccacctacataggcctaaatccgggttacagagtctatcagatcgatggaaattactccggtagcagccacgtggtgctggaccatgaaacttatatcctgaacctgacccaggcaaacatccctggggcaattcctcactggcagttgctgtatcgagcgcgtgaaacatatggcctccctaacactttacctaccgcctggcataatctggtctaccgtatgagaggcgacatgcagctgttccagaccttttggttcctgtatcacaagggccaccctccaagcgaaccatgtggcactccttgtagacttgctactctgtgcgctcagctgtctgcacgcgcggattcgcctgccctttgcagacacctgatgccagatgggtctctgccggaggcgcagagtctttggcctcggccgttattttgt

SEQ ID NO: 19760 - DNA, 1893 bp, Artificial Sequence
  Description of Artificial Sequence: Synthetic coding sequence
atgccgcgatatggagccagcttacgccagtcttgcccccggtctgggcgggaacagggccaggatggtacagccggcgccccaggcctgctttggatgggcctggttctcgctctcgctttggccctcgcgctcgccctcgcactctcggacagccgcgtgctttgggctccggctgaggcccatcccttgtctcctcagggccacccagcccgcctccaccggatcgtcccccggctaagagatgtgtttggctggggcaacctcacctgccccatatgtaaggggctattcaccgctatcaacctcggactcaagaaagaacccaacgtggcaagggtgggatctgtggcaattaaactgtgcaacttgttgaagatcgctcccccagctgtctgccaatccatcgtgcacctctttgaagatgatatggttgaggtatggcgtcgtagtgtcctcagtccatcagaggcttgcggcctgctcctgggttccacctgtgggcattgggatatctttagttcctggaacatctcccttcctactgtgccaaaaccacccccaaaaccaccgagtccgcccgcccccggtgctcctgtctcaaggattttgtttttgactgacttgcattgggaccatgattatcttgaaggcacagaccctgactgtgcagaccctctgtgctgtcggaggggaagcggcctgcctcccgctagtaggccaggggcggggtactggggagaatacagcaaatgtgatctcccgttgcggacactggaatctttgcttagcggactgggacctgccgggcctttcgatatggtatactggaccggcgatattcctgcccacgatgtatggcaccaaaccaggcaggaccaactgcgcgccctaacaacggtcaccgccctggtaaggaaattcttagggcctgtaccagtctacccagcagtgggtaaccatgagtctactcctgtgaacagtttccccccgccattcatcgagggaaatcactcctcccggtggttgtatgaggcaatggccaaggcatgggagccatggctccccgcagaagccttgcggacactgagaatcggaggcttttacgcattaagcccctatccagggctcaggctgattagtctgaacatgaacttttgcagcagagagaatttctggctgctcatcaactcaaccgacccggccggccagttgcaatggctcgtaggcgaactgcaagctgccgaagaccggggggataaagtccatatcattggtcacatacctcctggacactgtttgaagagctggtcatggaactattatcggattgtagcccgatacgaaaatactctggcagcacagttcttcgggcacacccacgtggacgagttcgaagtgttctatgacgaagaaaccctgtctaggccccttgccgttgcctttcttgcccccagtgccaccacctacattggtttgaacccggggtaccgagtgtatcaaattgatgggaattacagcggctcctcgcacgtagtcctggaccacgagacgtacatcctgaacctgacacaggctaacatcccaggagcgatcccacactggcagctcctgtaccgcgcacgcgaaacttatggcctgcctaacaccctgcccacagcctggcataatctggtgtaccgcatgcgcggcgacatgcagctgtttcagaccttctggtttctttatcacaaagggcacccaccctctgagccttgcgggacgccttgcaggcttgctacactgtgcgctcagctctcagctagggctgacagtcccgcactgtgtaggcatctgatgccagatggaagcctgcccgaggcacagagcctctggccccgcccactgttctgc

SEQ ID NO: 19761 - DNA, 1893 bp, Artificial Sequence
  Description of Artificial Sequence: Synthetic coding sequence
atgccgcggtacggcgctagtctcagacagtcttgtccgaggagcgggagggaacagggacaggacggtacggcaggggcccccggactgctctggatgggcttggtgcttgccttggctctcgctttggcgttggccctggcactttcagattcccgagtgttatgggctcctgctgaagcccaccccctgagcccgcagggccaccctgcccgactgcatcgaattgtgccacggctgagagacgtgtttgggtggggcaatctgacatgcccaatctgcaaagggttgtttacagctattaacctcggcctgaaaaaagaaccaaacgtcgcccgggtcggttccgtagccattaaactttgtaatctactcaaaatagccccgcccgcggtgtgtcaaagcatcgttcacctgtttgaagacgatatggtggaagtctggcgtcgatccgtgctgtccccttcagaggcatgcgggttactgctcgggagcacttgcggacattgggacatcttctcgtcttggaatatctcccttcctaccgtccctaaaccacctccgaagccacctagccctcccgcccccggtgcacccgtgagccggattctgtttctcactgacttacactgggaccacgattatttggaggggacggacccagattgtgcagaccctttgtgctgcagaagagggtctggtctacccccagcaagtaggccaggggctggctactggggagaatattcaaaatgtgatcttcccctaaggacactagagagtctacttagcggcctgggtccggccgggccctttgacatggtctattggacaggagatatcccagcacatgatgtctggcaccagactcggcaggatcagctaagagccttgacaaccgtaacagctctggtgcgaaaattccttggacccgtcccggtttatcctgccgttggaaatcacgagtccacaccagtcaatagttttccaccccctttcattgaaggcaatcactcttcgcgctggctgtatgaagcaatggcaaaagcctgggaaccttggctgcccgcagaggcactcaggacactgcgaatcggtggcttctatgctttgtccccttacccaggcctgcgacttataagtttgaacatgaacttctgtagtcgcgagaacttctggctactgattaactcaaccgacccggcaggccagttacagtggctagtgggagagttgcaggccgccgaagaccgcggagacaaagtccatattattggccacattccgcctggccactgcctgaagtcttggagttggaattactaccgtatagtggctcggtatgagaacacactggctgcgcagttttttggacacacgcacgtagacgagtttgaagtgttctatgacgaggaaacattgtcccgacccctagctgtcgccttcctggccccaagcgctacaacttatattggcctcaatccagggtacagggtgtatcagattgacgggaattactccggaagctcccatgttgtgctggatcatgaaacctacatcctgaacttgacacaggccaacattcccggtgccatcccccactggcagctactctatcgagctcgtgaaacatacggcctgccaaatacattgcctactgcctggcacaatctcgtttatcgaatgcgaggcgatatgcagctgttccagactttctggtttctataccataaaggccaccctccatctgaaccgtgtgggacgccttgtagacttgctactctgtgcgcgcagctgagtgcaagggcagacagccctgccctgtgcagacatttaatgcctgacggtagtctacccgaggcccagagtctctggccgaggccgctgttctgc

SEQ ID NO: 19762 - DNA, 1893 bp, Artificial Sequence
  Description of Artificial Sequence: Synthetic coding sequence
atgccgcgctacggagcatctttgaggcagtcttgccccaggtccggtcgggagcagggacaggacgggacagccggcgcacccgggctgttgtggatgggcctcgtccttgcccttgctctggccttggcccttgccctggcactaagcgactcgcgggtcttgtgggcgcccgcagaagcccacccgctgtccccgcagggtcatccggcgcgtctgcaccgaatcgtgccccgcctgcgcgacgtgttcgggtggggaaacttaacgtgtcccatttgtaagggtctctttactgcaatcaatctcggcctgaaaaaagagcccaacgtggcccgcgtgggttccgtggcgatcaagctgtgcaatctcctgaaaatcgcgcccccggcggtgtgtcagagcattgtgcatctcttcgaggacgatatggtcgaagtgtggcgtcgcagtgtgttaagcccgtccgaagcttgcggcctattactgggttccacatgcggacactgggacatcttctcgagttggaatattagcctcccaacggtcccaaagccccccccaaagccaccttcaccgccggctcctggcgccccggtctcccggatccttttcctgaccgacctgcactgggatcacgactacctcgagggcacggacccggactgcgctgatcccttatgctgtcgccgtggaagcggcctcccccctgcctcccggcccggagccggttactggggggaatattcaaagtgcgacttacccctgcgcacgctggagagtctgctgtccggcctcggccccgccggcccgtttgatatggtctattggacaggtgacataccggcacacgacgtgtggcaccagacccgccaggatcagcttcgcgccctgactacggtgaccgccttggtacgcaaattcctcggcccggtcccggtctaccccgccgtgggcaaccacgagagtacccccgtgaactccttcccgccaccattcatagagggcaatcattcgagccgctggctatacgaggcgatggcaaaggcgtgggaaccctggctgcccgccgaggcactccggacactgcggataggaggattctacgcgctttcgccgtacccgggattgcgcctgatcagcctcaatatgaacttttgttcgcgagaaaacttctggttgctaatcaacagcactgatcccgcaggtcaactgcagtggttggtgggagagctgcaggcggcggaagataggggggataaggtacacatcattggtcacattccaccgggacactgtctaaagtcctggtcgtggaactactaccggatcgtggccaggtacgagaacacccttgccgcccagttctttggccacacacatgtggacgagttcgaggttttttatgacgaggagacactgtcgcgcccgctagccgtggcattcttggccccatctgccacgacctatatcggcctgaacccgggctacagggtctaccagattgatggcaactactccggaagctcacacgtcgtgctggaccacgagacttacatcttgaacctgacccaggccaacatccccggagccatacctcattggcagctgctatatcgcgcccgcgagacttacggcttgcccaatactctgccgacggcctggcataatctggtttatcgcatgaggggagatatgcagctgtttcagaccttttggtttttgtaccacaaaggacacccgcccagtgagccgtgcggcaccccgtgtcgactggcaaccctgtgcgcacagctgagtgcccgtgcagatagcccagcgttgtgtcgccatctgatgccagatggctcactgcccgaagcccagtcactatggcctcgtcccctgttttgc

SEQ ID NO: 19763 - DNA, 1893 bp, Artificial Sequence
  Description of Artificial Sequence: Synthetic coding sequence
atgccgaggtatggagcctcactccgccagagttgtcccaggtctggtagagaacaaggtcaagatggcaccgctggtgcccctggcctgctgtggatgggtctagttctcgcactggcactcgcactggccctagccctcgccctcagtgatagccgtgtgctttgggcaccggcagaggcacatccattaagcccccaggggcatcccgcaagactgcaccggatcgtgccccgattacgggacgtgttcggctggggcaatctgacctgtccaatctgtaaggggttatttaccgccatcaatctgggtttaaagaaggagccgaatgtggccagagtggggagcgtcgctattaaactatgcaatttgctgaaaattgccccaccggctgtctgccagtccatcgtgcatctgtttgaagatgacatggtcgaggtgtggcgaagatcagttctcagcccgagcgaagcctgcggccttctgttaggcagcacctgcgggcattgggatattttttcttcctggaacatctcactcccaactgtgccaaagccacctccgaaacccccctctcctcccgcccctggcgcccccgtctctcgcatactcttcctaactgacttgcactgggatcacgactatctggaaggcaccgaccctgactgtgccgacccactgtgttgtcgccgcggctcagggttaccccccgcgtcacgcccgggcgccgggtattggggggagtactccaaatgtgacttgccgctgaggaccctcgagagtctcttgagtggactgggtcctgcagggccctttgacatggtttattggaccggggacatccctgcccatgatgtgtggcaccagacccgccaggaccagctgcgagctcttaccacggtgacggccctcgtgcgcaagttcctgggtccagtgcccgtgtaccccgcagttggaaatcacgaaagcactccagtcaactctttcccacccccctttatagagggcaatcacagctcgcggtggctgtacgaagcaatggctaaggcatgggagccatggttgccagccgaagcactacgaacattgaggatcggcggtttttatgcgctgagcccctatcccggacttcgcctgattagtttgaacatgaacttctgttccagagaaaatttttggcttctgatcaacagcaccgatcccgccggccaactacagtggttggtcggtgagctgcaagctgccgaagacaggggggacaaggtgcatataattggacacattccgcccgggcactgtctaaagtcctggagctggaactattaccggattgtggcacggtacgagaacactctggcagcacagttctttggacacacgcacgtcgacgaattcgaggtgttttatgacgaggaaacactgtctcgtcctttggccgtcgcattcctcgcccccagtgctacaacatatatagggctcaatcccggctatagagtttatcagatagacggaaattacagcggaagttcccacgtagtgctggatcacgaaacatacatactgaatttgacccaggcgaatattcctggagccataccacactggcagctactttacagggccagagagacttatggtctgccgaacacacttcctactgcatggcacaacctggtttatcgtatgaggggagatatgcagttgttccaaactttctggttcctgtaccacaaagggcatccacccagcgaaccttgcggaaccccctgtcgcttggcaaccctgtgcgcgcaactgagcgccagggcagactctcctgcactctgtaggcacttgatgcctgacggatcactccctgaagcccagtccctatggccccggcctcttttctgc

SEQ ID NO: 19764 - DNA, 1893 bp, Artificial Sequence
  Description of Artificial Sequence: Synthetic coding sequence
atgcctagatacggcgcaagtctcagacagtcctgcccaagaagtggccgggagcagggacaggacggaacggccggtgcccccggactactctggatgggactcgtgcttgccttggctctagccctcgcattagccctcgccctcagtgatagcagggtgctgtgggccccagcggaagctcatcccctaagcccgcagggccatccagcccgactacacagaatcgtacctcgcctcagagatgtgtttggctgggggaatctcacctgccccatctgtaaggggctgttcacagcaattaatctggggttgaaaaaagagccaaatgtggcccgcgtgggaagcgtcgcaatcaagctctgcaacttattgaagatcgcgccccccgccgtctgtcagtctattgtccatctttttgaagacgacatggtggaggtctggaggcgtagcgtgctgagtccttccgaggcctgcggactcttgttagggagcacttgtggtcactgggatatcttttcatcttggaacatcagcctcccaacagtgcctaagccaccacccaagcccccatctccccctgctccgggggcccccgtgtccagaatattgtttctcaccgacctccactgggaccacgactatctggaaggaaccgatcctgactgtgccgatccactgtgctgcagacgcggctccggactgcctcccgctagccgacccggtgccgggtactggggagaatattccaagtgtgacttacctctccgaaccctggaatctctcctgtccggcttaggaccggcaggcccgttcgacatggtatattggaccggagatataccagcacatgatgtttggcaccagacccgccaagatcagctgagggctctgacaaccgtgactgcactggtgagaaagtttctcggccctgttccagtctatcctgctgtaggtaaccatgagtcaacaccagtgaactcgtttcccccaccttttattgagggtaaccactccagtcgatggctgtatgaggctatggccaaggcctgggagccttggttacccgcagaggctcttcgtactctgagaatcggcgggttctatgcactgtctccgtaccctgggttacgcctgataagcctgaacatgaatttttgttcccgggaaaacttctggctgctgatcaactctaccgacccggcaggccaattgcagtggttagtgggcgaactgcaggccgccgaagatcggggcgataaagtgcacatcatcggacacatcccaccagggcactgtctcaagtcctggtcttggaactactataggatcgtggctcgatacgaaaacaccttggccgctcagttcttcggacatacacatgttgatgaattcgaggtcttttatgatgaggagaccctgagtcggcccttggccgtggccttcctggcaccgagtgcgacaacctatattggtttaaaccctgggtacagggtttatcaaattgacggcaactactccggatccagccacgtagtgctggaccacgagacatacatcttgaacctgacccaggctaacatcccaggtgcgatccctcactggcagctgctttatagagcacgcgagacatacgggctgcctaacacactgcctacagcatggcataatctggtttatcgtatgaggggtgatatgcagctgtttcaaaccttttggtttttataccacaaggggcaccccccctccgagccgtgcggcaccccttgcaggttagccacactgtgcgcacagctgagtgcgcgtgccgatagccctgcgctttgtagacacctgatgccggacggcagcctgcctgaggcccaatcgttgtggcctcggccattattctgc

SEQ ID NO: 19765 - DNA, 1893 bp, Artificial Sequence
  Description of Artificial Sequence: Synthetic coding sequence
atgccacgatacggggcatccctccggcagagctgtccacgctccggacgggaacaaggacaagatggtactgccggcgccccagggctgctctggatgggacttgtgctggccctggcactggccctggcgcttgcgctggccctgtcggattcgcgcgtgctctgggcaccagccgaggcccacccactgtcaccgcagggacaccccgcccgcctgcacaggatcgtgccgagactgagggatgttttcgggtggggcaacctgacttgcccgatttgcaagggcttgtttaccgccatcaacctgggactcaaaaaggagcctaacgtcgcgcgggtgggatcggtggccattaagctgtgcaaccttctgaagatcgcgccgcccgctgtctgccagagcatcgtgcatctgttcgaggatgatatggtggaggtgtggagacggtcagtcctttctccgtccgaagcctgcggtttgctgctgggatcaacctgcggacactgggacatcttcagcagctggaacatttccctgcccactgtgccgaaacccccgcctaagccgccatcaccaccggccccgggagctccggtgtcccggattctgttcttgaccgacctgcactgggaccatgactatctcgagggaacggaccctgactgcgcggacccactgtgctgtcggcggggttcggggctgccgcctgcctcacgtcccggagcgggttactggggcgaatactccaagtgcgatctgccgctgagaacgctggagtcgctcctgtcgggattgggaccggccggaccatttgacatggtgtactggacgggggacatccctgctcatgacgtgtggcaccaaacccgccaggaccaacttcgagcactgaccactgtgaccgcgcttgtcaggaagttcctgggaccggtgccagtttacccggccgtggggaatcacgagtcgaccccggtgaatagcttcccaccgccgttcatcgaaggaaaccattcgtcgcgctggctgtacgaagctatggcgaaggcctgggaaccttggctgcccgctgaagcgctccgaactcttcgcattggtggattttacgccttgtccccatatcctggcctgaggctcatctccctcaacatgaacttctgttcgcgggagaacttttggctcctgatcaacagcactgacccagcgggacaactgcagtggcttgtgggagaactccaagctgctgaggatcgcggcgataaagtgcacattatcggacacatcccgccgggtcactgcctgaagtcctggtcatggaattactacaggatcgtggcccggtacgagaatacgctggcagcacagttcttcggacatactcatgtcgacgagttcgaggtgttctatgatgaagagactctttcccggccgcttgccgtggcctttctggcaccttcggctaccacctacatcggactgaacccgggatacagagtgtaccagatcgatggaaattactccggctcctcccacgtcgtcttggaccatgaaacctacatcctgaacctgactcaagctaacatccctggcgccatcccgcactggcagctcctctaccgggcgcgcgaaacctacggactgccgaacaccctccccactgcatggcataatctggtctacagaatgcggggggacatgcagctctttcagacgttctggttcctctaccataaaggccacccgccgtccgagccgtgtggcacgccctgccgcttggccactctgtgcgcccagctcagcgcaagggcggacagcccggcgctgtgccgccacctgatgcccgacggctcattgccggaagcacaatccctgtggccaaggccgctgttctgc

SEQ ID NO: 19766 - DNA, 1893 bp, Artificial Sequence
  Description of Artificial Sequence: Synthetic coding sequence
atgcccaggtatggagcatccctccgccagtcatgccctagaagcggtagggagcagggccaggatggtacagccggggcaccaggacttctctggatgggactggtgttggccctggctctggcccttgccttggcccttgcgctgagcgatagccgggtcctgtgggcaccagcagaagcccatcctctgagcccccaaggccatccagcaagactccaccgcatagtcccccggctgagagacgtgttcggctggggcaacctgacatgcccaatctgtaaggggctgttcaccgccattaaccttggtttgaaaaaggaacccaacgtggcacgggtgggatccgtggctatcaaactctgcaatctcctgaagattgcacctcccgccgtatgccagtctatagtgcacctttttgaagatgatatggtggaggtgtggaggaggtccgttctgtctccctcagaggcctgtggattgctgctgggcagcacgtgtggacactgggacattttttcttcctggaacatttccctgccgacagtcccaaagccaccacccaagcctcccagtccaccggcacccggcgctcctgttagtcgcatcctcttcttgaccgacctccattgggaccacgactacctggagggcaccgacccggactgcgctgaccccctttgctgtcgaagaggctcaggactgccccccgcatctaggccgggagctggctactggggggagtactcaaaatgcgacctgccactgcgaacccttgagagcttgctttccgggctcggtcctgctgggccatttgacatggtttattggactggcgacattccagctcatgacgtttggcaccagacaaggcaagatcaattgagggccctgaccaccgtaacggctctggtgagaaaatttctgggacctgtacccgtctaccccgcggtgggcaaccacgagtccacccctgtgaactcatttccccctccctttatcgaggggaaccattcatcccggtggctctacgaggccatggctaaggcgtgggagccctggctgcccgccgaggccctgagaacgctgcgcatcggcggattctacgccctgtccccttacccgggactgagattgatatcactgaatatgaatttctgttctcgggagaacttttggttgctcatcaatagtacagatccagccgggcagctgcagtggttggtgggtgagcttcaagctgccgaggaccgcggcgataaggtgcacatcatcggccatattcccccagggcattgcctgaaaagttggagctggaattattaccgcattgttgcacgatatgagaacaccctggcggcccagtttttcggccatacacatgtggatgaatttgaggtgttttatgatgaagaaaccttgagccgccccctcgccgtcgcatttctcgccccaagtgcgacaacatatatcgggttgaaccctggataccgcgtttaccagattgatgggaattactccggaagctcccatgtggttctggaccacgaaacatatatcctgaatctgactcaggccaatattcctggcgccatcccccactggcaattgctgtacagggcacgggagacgtacggccttcctaatactctcccgacagcctggcataacctggtgtataggatgcgcggagacatgcagttgtttcagacgttttggtttctgtaccataaaggtcaccccccatctgagccatgtggaactccgtgcaggcttgcaaccttgtgcgcccagctttccgcccgagcggactctcccgctttgtgtcgacatctgatgccagatggttctctgcccgaggctcagagtctctggccccggcccttgttttgc

SEQ ID NO: 19767 - DNA, 1893 bp, Artificial Sequence
  Description of Artificial Sequence: Synthetic coding sequence
atgcctagatacggagcatcgttgagacaatcgtgtccaagaagcggcagggagcaaggacaagatggcactgcaggtgcaccaggccttctgtggatgggtttggtccttgcgcttgcactggcactggcccttgcactggctctgtccgattcaagggtcctgtgggctcctgctgaagcccaccctctcagccctcaaggccatcctgcccggctgcacaggattgttccacgcctgagagacgtctttggatgggggaatcttacttgccctatctgcaaaggactgtttactgcaatcaatctgggtctgaagaaggaaccgaacgtggcgcgagtgggaagcgttgcgattaaactttgtaaccttctcaaaattgcgcctcccgcggtgtgccagtcaatcgtgcacctgtttgaagatgacatggtggaagtttggagacgcagcgtgctttcaccaagcgaagcctgcggccttcttctcggaagcacctgtggacattgggacattttctcgtcctggaacatctcacttcccactgtgccaaagcctccccctaagcccccgagcccaccagcaccgggcgcgcctgtgtcacgaatcctgttcctcaccgacctccattgggatcatgattaccttgaaggtaccgatccggattgcgccgatcccctctgttgcagacgcggatccggtttgcctccagcatctcggccaggcgccggatactggggcgagtactcgaagtgcgatcttccccttagaacccttgagagccttctttcaggactgggacctgcagggcctttcgatatggtgtactggactggagacattcccgcgcacgatgtgtggcatcaaaccagacaagaccaactgcgcgcactgaccactgtgacggcactggtgagaaaattccttggaccagtgccggtctaccctgcagtggggaatcatgaatccacccctgtgaacagctttcctcccccattcatcgaaggaaatcattcaagccggtggctctacgaggcaatggcaaaggcatgggaaccgtggctgccagcggaggctctgagaacgctgagaattggaggcttttacgcgctttccccataccctgggcttcgtcttatttcccttaacatgaatttctgctccagggaaaacttttggcttttgataaactcaaccgaccccgcaggtcagcttcaatggttggtgggcgaactccaggcagctgaggaccggggagacaaagtccacatcattggtcatattcctccagggcactgtctgaagtcctggtcttggaactactacagaattgtagctcgatacgaaaatactcttgccgcacagttttttggacatacccacgtggatgagtttgaggtgttttacgacgaagaaaccttgtccagacccctcgccgtggcctttctggcaccatcggcgaccacttacatagggctcaaccccggataccgcgtgtaccagattgacggtaactactcgggatccagccacgtggtcctggatcatgaaacttacattctcaatcttactcaggccaacataccaggagctatccctcactggcaactcctgtaccgcgcgcgcgaaacgtacggactgcccaacaccctccctaccgcgtggcataacctcgtgtaccggatgcgcggagatatgcagctgttccagactttctggtttctgtaccacaagggacacccaccttcagaaccttgcggtactccatgtcgtctcgcaactctctgtgctcagctctcggcacgcgctgattcacccgccctgtgtagacatcttatgccagacggatccctcccagaagcacagtccttgtggccgcgccctttgttctgt

SEQ ID NO: 19768 - DNA, 1893 bp, Artificial Sequence
  Description of Artificial Sequence: Synthetic coding sequence
atgcccaggtacggtgcatctctgcggcagagctgcccacggagcggtcgggaacaaggtcaggatggaaccgctggagcaccgggattgctgtggatggggcttgtgcttgcactggccctcgcccttgcactcgcgctggcacttagcgattccagagtgctctgggcacccgccgaggcacatcctctgtcgcctcaggggcatccagcaagactccatcgcattgtgccacgattgcgggacgtctttgggtggggaaatctgacgtgtcctatatgtaagggactcttcactgccatcaacctcggcctcaagaaagagcctaacgtggcaagagtggggtccgtggcaatcaaactgtgcaacttgctgaagatagcaccacctgcagtttgccagtcaatcgtgcacctgtttgaagatgacatggtggaagtgtggagacgttcggtgctctccccaagcgaggcatgtggtcttttgcttggcagcacctgcggacactgggatatctttagcagctggaacatcagccttccaactgttcctaagcctccgccgaaaccccctagcccacccgccccgggagcccctgtgtcgaggatcctgtttctgaccgatcttcattgggatcacgattacctggaaggcaccgatccagactgtgcagatccactgtgttgtcgacgcggaagcgggcttccgcctgcaagccgacctggagcaggatattggggggagtactcgaagtgtgacctccccctgagaacgctggagtcattgctctccggtttgggtccagcgggcccattcgatatggtgtactggaccggagatatccctgcccacgacgtctggcatcagactagacaggatcaattgcgtgctttgaccaccgtgaccgcacttgtgcgtaaattccttggtccagttccagtctatcctgcagtgggtaaccatgagtcaactcccgtgaattcatttcctccaccatttatcgagggcaaccactcctcgcgctggctttacgaagcaatggccaaggcgtgggagccatggctgccagccgaagccctgagaaccctgcggatcggcggcttttacgcgctgtctccataccccggactgcggctgatctcgctgaacatgaacttttgttcgagagaaaacttttggctcctgattaactcaactgatcctgcaggtcaacttcaatggctggtcggtgaactccaagcagctgaagataggggagataaggtccacatcattggacacatccctcctggccactgtcttaagagctggtcgtggaattactacagaattgtagcaaggtacgaaaataccctggcagcacagtttttcggacatactcatgtggacgaatttgaagttttctacgacgaggaaactcttagcaggccgcttgccgtggccttcctcgccccatccgcgactacttacatcggccttaacccaggctatcgggtgtaccagatcgatggaaactattccggatcgagccatgtcgtgctggaccatgagacgtacattcttaatctcacgcaagcaaacatcccgggggcaatcccccattggcaacttctgtacagagcacgggagacttacggacttcccaatacccttccaaccgcatggcataatcttgtgtacaggatgcgtggtgatatgcagctctttcaaactttctggttcctttaccacaaaggtcatcccccatctgaaccatgtggaaccccttgccggctcgcaaccctgtgcgcacaactctcagcacgggcggattccccagcgctttgcaggcatcttatgccggatggaagcctcccagaagcccagtccctttggcctcggcctctcttttgc

SEQ ID NO: 19769 - DNA, 1893 bp, Artificial Sequence
  Description of Artificial Sequence: Synthetic coding sequence
atgcccagatatggggccagtctccgtcagtcctgccctagatcagggcgggaacagggtcaggatggtacagcaggagcgcccggactactttggatgggtctggtgctcgctttagcactggcattagctcttgctcttgcactgagcgatagccgtgttctgtgggctccggccgaggctcatccccttagcccacaggggcacccagcaagactgcatagaattgtgccacgtcttagggatgtattcggttggggtaatttaacctgcccaatctgtaagggactttttacagccatcaacctcgggctcaaaaaggaacccaatgtggcaagggttggaagcgttgcaataaaactgtgtaaccttctgaagattgccccacctgctgtgtgtcagagcattgtacaccttttcgaagatgatatggtcgaagtatggcgccgtagtgtactgtcaccatccgaggcatgcgggcttctcttgggtagtacgtgtggccattgggacatcttctcctcatggaatatttcactgcccacagtacccaaaccccctcccaagccaccttctcctccagcaccaggagctcccgtatcaaggatcctgttcctgactgatcttcactgggaccacgactatctggaggggaccgacccggactgtgcagacccgctctgttgtagacgtggaagcggactgccccctgcctccaggcccggagccggttactggggtgaatactctaaatgtgaccttccacttagaactctggaatctctgctgtctggacttggcccagcgggcccatttgacatggtctattggacaggagacatccccgcgcacgatgtgtggcatcaaaccaggcaggaccagcttcgggctctcacgacagtgaccgccctggtgcgaaaattcttgggccctgtgcctgtttacccggcagtgggcaaccatgagtctacccctgtgaacagctttcctcccccatttattgaaggcaatcatagtagccggtggctgtatgaggctatggccaaggcctgggaaccctggttgcctgctgaagcccttcgaacgctgcgcatcggcggcttttacgctctgagtccataccctggtctccgcttaatttcccttaatatgaacttctgcagccgcgagaacttctggttgctgatcaacagcactgaccctgccggccagctccagtggcttgtaggagaactgcaggccgccgaggacagaggtgacaaggttcatattatcgggcatataccacccggacactgtcttaaatcctggtcatggaattactatagaatcgtggccagatacgaaaatactttagccgctcagttctttggacacacccatgttgacgaattcgaagtgttctacgacgaagaaacactgtcgcgccccctggcggtggcttttctggctccaagtgccacaacctacattggattaaatcctgggtaccgggtttaccaaatcgacgggaactacagcggatcctctcatgttgtgctggatcacgagacctatattctgaatctcacacaggccaacatcccaggggctatcccccactggcagcttctgtacagggcacgggagacctacggcttgcctaatacactgcccacagcctggcacaatctggtgtatcgcatgcggggggacatgcagttgtttcagactttctggtttctctaccataagggccaccccccttctgagccctgcgggaccccgtgtcggctggctaccttgtgcgcgcagctgtctgctcgggcagattccccggccctgtgtcgacatctgatgccagacgggtccttgccagaggcacagtccctctggccacgccctttgttctgt

SEQ ID NO: 19770 - DNA, 1893 bp, Artificial Sequence
  Description of Artificial Sequence: Synthetic coding sequence
atgcctaggtacggagcaagtctgagacagtcttgtcctcgcagtggccgggagcagggccaggacggcacagccggtgctccaggcctgctgtggatgggtctcgtgctggcgttagcactggctttggctcttgccctggctctttccgatagtagagtgctgtgggccccggcggaggcgcacccgctgagtccccaggggcatcccgctcggttgcacagaattgtgcctcgcctgagagacgtgtttggatggggtaacctgacatgcccaatttgcaaaggacttttcactgcaataaatctcggcctgaagaaggagccaaatgttgcgagagttggctctgtggctattaaactgtgtaatctgctgaaaattgcgcctccagccgtgtgtcagtcaatcgtgcatttgttcgaggacgacatggtggaggtttggagaaggtctgtgctgtccccttcagaggcctgtgggttattactgggcagcacatgtggacattgggacatcttctccagctggaatatcagtttgccgactgtacccaagccaccgcctaagccacccagtccccctgcaccaggtgctccagtctcccggatcctgtttctgactgatcttcattgggaccacgactatctggagggtaccgatcccgactgtgctgaccctttgtgttgccgccggggcagtggcctcccaccggctagcaggcctggtgccggttactggggcgaatatagtaagtgcgacctccctcttcggacattggaatcactcctgagtggactgggccccgccgggccatttgatatggtgtattggactggcgacatccccgctcacgatgtttggcatcaaacgaggcaggatcagttgagagcgctgacgacagtgactgccctggtacgcaaatttctgggtccagtgcctgtgtaccctgccgtgggtaaccacgagtccacgcccgtcaattccttcccaccaccgttcattgaagggaatcactcctctaggtggctctatgaggcgatggccaaagcctgggagccatggttgcccgcagaagccttaaggactttgaggattggagggttttacgcattgagcccctacccaggcttacggctcataagtttaaacatgaacttttgcagccgtgaaaatttttggcttctcattaacagtaccgatcctgctggacaactacagtggctggttggcgaactgcaggctgccgaagacaggggagacaaagttcatataattggccacatcccgcctgggcactgccttaagagttggtcatggaattattaccgcatcgtggctaggtacgagaacactttggccgctcagttcttcggacatactcacgtcgacgaattcgaggtgttctatgacgaagaaactctgagccgccccctggcagtcgcctttttggccccgtcagccaccacttatatcggattaaatccagggtaccgtgtgtatcaaatcgacgggaattacagcggttcctctcacgtcgtgcttgatcatgaaacgtatatcctgaacctgactcaagcgaacatacccggcgctatcccccactggcaactgctctatcgggctagggaaacttatggcttgccaaatacgttgcccactgcgtggcataatctggtatacaggatgcgcggagatatgcagctgttccagacattttggttcttgtaccataaaggacacccgccctcagagccatgtggcaccccctgccgcctcgccactttgtgcgcccaacttagtgcacgggcagattcacccgccctgtgcaggcaccttatgcccgatggatctttgcctgaggcccaatccttgtggcccaggccactcttctgt

SEQ ID NO: 19771 - DNA, 1893 bp, Artificial Sequence
  Description of Artificial Sequence: Synthetic coding sequence
atgccgaggtacggcgccagcctgcgccaatcctgcccgcggtccgggcgcgagcagggacaagacggaaccgctggagccccagggctcctgtggatgggcctggtgctggcacttgccctggcgctcgcactggcccttgccctctccgatagccgcgtgttgtgggcgccggccgaggctcaccctctgtcaccacaggggcatcccgcgcgtctgcacagaatcgtgccgcgcttgagagatgtgttcggctgggggaacctgacttgtccgatctgcaaaggcctgttcaccgcgatcaatctgggcctcaagaaagagcccaacgtggccagagtgggatcggtcgcgataaagctgtgtaatcttctgaagatcgctccaccggctgtgtgccagtcgatcgtgcatctcttcgaggacgacatggtggaggtgtggaggcgcagcgtgctgtcacctagtgaggcttgcggccttcttctgggctcaacctgcggacattgggacatcttcagctcgtggaacatctcgctgccaaccgtgcctaaaccgccgccgaagccgccgtctccccctgccccaggagctccggtgtcgagaattttgtttctgaccgacctccattgggaccatgattacctggagggtaccgacccagactgcgcagatccgttgtgttgccggcgtggatccggtttgccccctgcctcaagaccaggagcaggatactggggggaatattcgaagtgcgacctgccactgcgcaccctcgaatcactgctgtcgggactggggccagcgggtccgtttgatatggtgtactggaccggagatatacctgcacacgatgtctggcaccagactcggcaagaccagctcagggcccttaccactgtgactgcattggtgagaaagttcctcggaccagtgccagtgtatcccgccgtcggaaaccatgagagcaccccggtcaattcctttccccctccgttcattgaaggcaaccactcatcgaggtggctgtacgaagctatggccaaagcgtgggaaccctggctgccagccgaggccttgaggaccctcagaatcggcgggttctacgcgctgtcaccgtaccctggcttgcgcctgatctctctgaatatgaacttctgctcgcgggagaatttctggcttctcattaactccactgatcccgccggacagctgcagtggcttgtcggagagctgcaagccgccgaggaccgtggcgacaaggtgcatatcattggacacatcccgcccggacactgtctgaagtcgtggagctggaattactaccggatcgtcgcccgctacgagaataccctggcggcacagttttttgggcacactcatgtcgacgagtttgaggtcttttacgacgaggaaactctgtcgcggccacttgcagtggccttcctggcaccgtcggctactacctatatcggattgaatccaggctaccgggtgtaccagattgatggaaactatagcggatcctcgcacgtggtgttggaccacgaaacctacattcttaacctgacgcaagcaaacatcccgggagccatcccgcattggcagctgctctaccgcgcacgggagacgtacggcctgcctaacaccctgcctaccgcgtggcataatcttgtctaccgcatgcgcggagacatgcagctgttccagactttctggtttctttaccataagggacacccgccgtcagaaccctgcggtaccccatgccgcctggcgactctttgcgctcagctctcggcgagagcagatagcccggccctgtgcaggcatctgatgccggacgggtccctgccggaagcccagagcctgtggccaagaccactcttctgt

SEQ ID NO: 19772 - DNA, 1893 bp, Artificial Sequence
  Description of Artificial Sequence: Synthetic coding sequence
atgccacgttacggggcgagcctgagacaatcttgtccccgtagcgggagagaacaagggcaggacggcaccgctggagctcctggcttactgtggatgggtctggttctcgccctggcgttagcacttgctcttgctcttgccctcagcgattctcgtgtcctttgggctcccgctgaggcccaccctctcagcccccaagggcacccagcgcgtctgcataggattgttcctaggctgcgcgacgtctttgggtggggtaatctgacatgcccaatttgcaaggggttatttaccgccatcaacctgggcctgaagaaggaacctaatgttgcacgggtagggtctgtggcgattaaactttgcaacctgctcaaaattgccccaccagcagtgtgccagtcgatcgtccatctctttgaagacgacatggttgaagtctggcgcaggagcgttctgagcccttcagaagcctgtggcctgttgttgggaagcacatgcggacattgggatatattcagctcctggaacatctcgctgccaaccgtacctaagccaccacccaagcccccttcacctccagcccccggcgccccagtgtcacggatcctgttccttaccgatttgcactgggaccatgattacttggaaggaaccgaccccgactgtgctgacccactttgttgtcggcgtggtagcggcctgccgcctgccagccgcccaggagccggctattggggagaatacagcaagtgtgatctgcctttgagaacactggaatccttactttcagggctggggccagctggaccattcgatatggtttactggaccggggatatccccgcccatgatgtgtggcaccaaacccgccaggatcaactccgcgctctcaccacggttacagcactcgtccgcaagtttctgggtccagtgcctgtgtacccagcggtgggcaaccacgagagtacacctgtcaacagtttcccaccacccttcatcgaaggcaaccattcatcgcggtggctgtacgaggctatggctaaggcatgggagccctggctgcccgctgaggctctgagaactttgcgaattggcggattctatgctctttcaccatatcccggcctgcgccttatcagcctgaacatgaacttctgtagtcgcgaaaatttctggttactcatcaacagtacagatccagccgggcaactgcagtggctggtcggagaacttcaggccgcagaggatagaggcgataaagtgcatatcattggccacattccccctggacattgcctcaaatcatggagctggaactattacagaatcgtggctcgatacgagaatacgctggcggctcaattttttggacacacacacgtggatgagtttgaggtattttacgacgaagagaccttgagcaggccattggctgttgcattcttggctcctagcgctactacctacatcggcctgaaccccggctaccgcgtgtaccaaatcgatggaaactacagtggctcctcccatgttgtcctcgaccatgagacctatatccttaatctgacccaggcaaatattccaggagccattcctcattggcagttgctgtacagggctcgggaaacatatggcctgccgaacactctgccaaccgcctggcacaacctggtttatcggatgagaggcgacatgcagctctttcagacattctggttcctgtaccacaagggacaccccccttccgagccctgtggcactccctgcagactggcaaccctgtgcgcccagctttccgctagagcagactcccctgctctgtgcagacaccttatgcccgacgggagcttacctgaagcacagtccctctggccgcgccccctgttttgc

SEQ ID NO: 19773 - DNA, 1893 bp, Artificial Sequence
  Description of Artificial Sequence: Synthetic coding sequence
atgcccagatacggagcctccctgagacagtcctgtccgcgttccggacgcgaacagggacaagatggcactgccggcgcacccggtctgctctggatgggactggtgctcgcgctggcgctcgccctcgccctggctcttgctctgtccgattccagggtgctctgggcgccggcggaggctcaccccctgagcccacagggacaccctgcccgcctccacagaattgtgccacggctcagagacgtgttcggatgggggaacctcacctgcccgatctgcaagggactgttcaccgctatcaatcttggactgaagaaagagccgaatgtggcgcgagtgggaagcgtggcgattaagctgtgcaatctgctgaaaatcgcgccgcctgcggtgtgtcagtcaatcgtgcatctgttcgaagatgacatggtggaggtgtggagaaggtccgtgttgtcgccgtccgaggcttgcgggctgctgctcgggtcgacctgcggacactgggacatcttcagctcttggaacatctccctgcctaccgtgccgaaaccgccgccgaagccaccgtcaccgccggccccaggagcgcctgtctcacggatcctgttcctcaccgatctgcactgggaccacgattaccttgagggaaccgatccagactgtgccgacccgttgtgttgccgccggggtagcggactgccaccggcctccaggccgggagccgggtactggggggagtattccaagtgcgatctcccgctgcgtactcttgaatcgctcctgtcgggattgggccccgcaggaccatttgacatggtctactggacgggagacatcccagctcatgacgtctggcaccagactcgacaggatcagcttagggcgctcaccactgtgaccgcactggtcagaaagttcctgggtccggtgccggtgtatccggccgtgggaaaccatgaatcgacccctgtgaactcctttccaccacctttcatcgagggcaatcactcgtcgaggtggctttacgaggcaatggcgaaggcctgggagccgtggctgccggcagaagccctgcggaccctgcggatcggaggcttttacgcgctcagcccttatcctggacttcggttgatctccctgaatatgaacttttgctcgcgggaaaacttctggctcctgatcaattcgaccgaccctgctggacagctccagtggttggtcggagagctccaggccgccgaagataggggagacaaggtccacatcatcggacatatccctcccggccattgcctgaagtcctggtcatggaattactaccggatcgtggcaagatacgaaaacactctggcggcgcagtttttcggtcacacccatgtcgatgagttcgaagtgttctacgacgaagaaactttgtcccgccctctggcggttgctttcctcgcaccttccgcaactacgtacatcggactgaaccctggttatcgggtgtaccaaatagatggtaactacagcggctcgtcacatgtggtcctcgaccacgaaacctacatcctcaatctgactcaggcgaacatccccggggcaatcccacactggcagttgctgtaccgcgcccgggaaacctacggcctcccgaatacccttcccaccgcctggcataatcttgtctaccgcatgcggggtgacatgcagctgttccagactttctggtttctgtaccataagggacacccacctagcgagccatgcggtactccgtgcaggctcgcgactctgtgcgcgcagctttcggccagggcggacagcccggctttgtgtaggcatctgatgccggacggctcgctgccggaggcccagagcctgtggccgcggccgctcttttgc

SEQ ID NO: 19774 - DNA, 1893 bp, Artificial Sequence
  Description of Artificial Sequence: Synthetic coding sequence
atgccgcgctacggagcatcacttcggcagagctgtccaagatcaggtcgcgagcaggggcaagacggaacggccggtgccccaggccttctttggatgggtctggtgctggcattggcactggcccttgcattggcgctcgcactgtcggacagccgtgtcctgtgggcacctgcggaggcccacccattgtctcctcaaggacaccctgcgagattgcacaggattgtgccaagactccgtgacgtctttggctgggggaacctgacctgtcctatatgcaagggtctttttaccgcgattaacctcggacttaagaaagagcccaacgtggcccgggtcggaagcgtggcgattaagctctgtaatctcctgaaaatcgcccctcctgcagtgtgtcaatcgattgtgcatctttttgaggacgacatggtggaagtgtggcggcggtcggtcctttcgccatcggaggcttgtggtctgctgcttggttcaacctgtggtcattgggacattttctcctcatggaacatctcgctgccaaccgttcccaaaccgccacccaaaccaccttccccaccggccccaggcgctccggtttcccggatccttttcctcactgaccttcattgggatcatgattacctggaaggcactgatcctgactgcgccgacccattgtgttgccgtcgtggatcaggacttccacctgcatcccgccctggcgcaggatactggggagaatattctaaatgcgatctgcctctgaggactctggaatccctgctttcggggcttggccctgcaggtcctttcgacatggtctactggacgggagatattcccgcacatgatgtctggcaccagactcgacaggaccagttgagagcacttactactgtgaccgcactggtcagaaaattccttggtcctgtgcctgtgtaccctgccgtcggtaatcacgaatcaactccagtgaattcctttccacctcctttcatagagggtaatcactcctctcggtggctttatgaggcaatggcaaaggcctgggaaccctggcttccagccgaagcgctgagaacccttaggatcggaggcttctacgcactttcaccctaccccggactccgattgatttcacttaacatgaacttttgttcgcgggagaacttttggctcctgattaactctactgatccagcaggtcaactgcaatggcttgtgggtgaactgcaggcagcggaggacaggggagacaaggtccacatcattggtcacatccccccagggcattgtcttaaatcatggagctggaattactaccgaatcgtggcaagatacgaaaacaccctcgccgcacaattctttgggcacactcacgtcgacgaattcgaggtgttttacgacgaagagactctgtcgcgtcccctggcagtggcgttccttgcgccttccgcgaccacctacataggactgaatccaggatacagagtgtaccaaatcgatggtaactactcgggatcgtcgcacgtggtccttgaccatgaaacttacatcttgaacctgacccaagcaaacattcccggggccattcctcattggcaactcctgtaccgcgcaagagaaacctacggacttccaaacaccctgccgactgcttggcataacctggtctaccgaatgcgcggagacatgcagctgtttcagaccttttggtttctctaccacaaggggcatcccccatcggaaccttgtggaactccctgtagactcgcaaccctttgtgcacagttgagcgcaagagcagattcgccagcgctttgtaggcatcttatgcccgacggaagcctgccagaagcccagtccctgtggccccgccccctcttttgc

SEQ ID NO: 19775 - DNA, 1893 bp, Artificial Sequence
  Description of Artificial Sequence: Synthetic coding sequence
atgcccaggtatggggcctcccttagacagtcctgtcctcgcagtggacgcgaacagggacaggacggaacagccggggctcctggactcttatggatggggcttgtgctcgccctagccctcgcacttgctttggccctggccctctctgattctcgagttttgtgggcaccagccgaagcccaccccttatcaccccagggacacccagctagactacatcggattgtgcctaggctcagggatgtgtttgggtggggaaatctcacatgtcccatttgcaaagggctgttcactgccatcaacctcggactcaaaaaggaaccaaacgtggccagggttggatctgtcgctatcaagctgtgtaatttgctaaaaatcgctcctcccgctgtctgtcagagtatcgtgcacctgttcgaagatgatatggtggaagtttggcgcagatccgtcctgtccccctccgaagcatgtggactcctgctagggtccacatgtggacattgggatatattctcttcttggaacatttctctgcctactgtcccaaaacccccacccaaacctccatctcctcccgccccaggagccccagtgtccagaatattgttccttactgacctccactgggatcatgattatcttgaaggaactgatccagattgtgccgatcccctttgttgtcgccggggatcgggattacccccagcgtctcggccaggggctggatattggggggaatactccaaatgcgacttacccctaagaacgctggagtcattgctttcggggctgggacccgctgggccattcgatatggtttattggactggggatatccctgcacacgatgtctggcaccagacaagacaggaccagctgagagctctcactacagtcacagctctggttagaaaatttctagggcccgtgcctgtctatcccgccgtgggaaaccacgagagtacacccgtgaacagttttcctccccccttcatcgagggaaaccattcctccagatggttgtatgaggcaatggctaaagcctgggaaccttggctccccgccgaggccctccggacattaagaatcggagggttttatgccctctctccctatccagggctgagacttatatcattgaatatgaacttttgttctcgggaaaacttctggctactcataaactcaacagaccccgccgggcagcttcagtggctggttggagaactccaggcagccgaagatcgcggggataaagtccatatcatagggcatatccctcccgggcattgtctcaaatcatggagttggaactactatcgaattgtcgcaagatacgagaatactctagctgctcaattcttcggacatacacatgtagatgaatttgaagtgttttacgatgaagaaacactctctcgacccctcgcggtggccttcctagcaccctcggctacaacatacatcggactcaaccccggatatagagtataccagattgatggaaattactccgggtctagtcatgtggtgttggatcacgagacttacatactgaatttgactcaggctaacatacctggagcaatacctcactggcagctgctctatcgggccagggaaacttacggactgcccaacactctgcccactgcctggcataaccttgtttatagaatgagaggagatatgcagctcttccagacattttggttcctataccacaagggacaccccccgagtgaaccttgtggaacaccatgtcggctcgcaactctctgcgctcagctctccgcgagggctgattcccctgctctgtgtagacacttaatgcctgacgggtcactgcctgaagctcagtctctttggccaagacccctcttttgt

SEQ ID NO: 19776 - DNA, 1893 bp, Artificial Sequence
  Description of Artificial Sequence: Synthetic coding sequence
atgcctcgatacggagcttcgctcagacagagctgccctaggtctggacgggaacaaggacaggatggcactgccggagcaccgggattgttgtggatgggactcgtgcttgctctggcactggccctcgcgctcgcgctggctctgtcggactccagggtgttgtgggcccctgcggaggcccacccgttgtccccccaagggcaccctgcacgactgcaccgcatcgtgccccgcctgagagatgttttcggctggggaaatctgacctgccctatttgtaagggtctgttcaccgcaatcaatctgggactcaagaaggagcctaacgtggcccgcgtcggttcagtcgcaatcaaactttgtaacctcctgaagatcgcaccaccagccgtatgtcaatcaatcgtccatctctttgaagacgatatggtggaggtctggcgccgctcagttctgagcccatcagaggcgtgcggactcttgctgggctcaacttgcggtcactgggatatcttctcctcctggaatatttccctcccaaccgtgcccaagccccctccaaagccaccgtccccaccggctccaggagcacctgtttcgcgtatccttttcttgaccgaccttcattgggatcatgactacctggaaggcactgatccggactgcgccgaccctttgtgctgtcggcggggcagcggactgccacctgcttcacggcccggggccggttactggggagaatacagcaagtgcgacctgccgctgcggaccttggaatctctcctctcgggactgggcccagcgggcccgtttgatatggtgtattggactggagatatcccggcccacgacgtgtggcaccaaactagacaggaccaactccgagcactgacgacggtgaccgccctggtgcgcaaattcctggggccggtgccggtctaccctgcagtaggaaatcatgagagtaccccggtcaattcctttccaccgccgttcatcgagggaaaccattcttcaagatggctctacgaggcaatggctaaggcctgggagccgtggctcccggctgaagctctgagaactttgcgcatcgggggattctacgcgcttagcccgtacccaggactgcgcctcattagcctgaacatgaatttttgctcccgcgagaatttttggctgctgatcaactcaaccgaccccgccggtcagctgcagtggcttgtgggcgaactgcaggccgcggaggatcgtggcgacaaggtccatatcataggtcatatccctccgggccactgcctgaaatcgtggagctggaattactacagaatcgtggcccgttatgaaaacaccctggctgcgcagttcttcggtcatacccacgtcgacgagtttgaggtgttctatgacgaagaaactctgtcgaggccgctcgccgtggccttcctggccccgtccgccaccacgtacattgggctgaaccccgggtacagagtctaccagatcgatgggaactactcgggatcctcgcatgttgtgctggaccacgaaacgtacattctcaacctgactcaagcgaacatcccgggagcgatccctcactggcagttgctgtaccgcgcaagagaaacttacggactcccgaacaccctgcctaccgcgtggcacaacctcgtctaccgcatgagaggagatatgcaactcttccagaccttctggttcctgtaccacaaaggacacccgccgtcggaaccatgcggtactccatgtagactggcgaccctgtgcgcccagctgtctgcgcgagcagactccccggcactgtgcagacacctcatgccggatggcagtctcccagaagcccagtcactttggccgcggcccctgttctgc

SEQ ID NO: 19777 - DNA, 1893 bp, Artificial Sequence
  Description of Artificial Sequence: Synthetic coding sequence
atgccgagatacggtgcctcgctgcggcagtcgtgtccacggagcggaagagaacagggacaggacgggaccgcaggggcaccgggacttctgtggatggggctggtcctcgccctggcacttgcacttgcattggcacttgcgctttcagattcacgagtgctgtgggcaccagccgaagcacaccccctcagcccgcaaggacacccggcaagattgcatcgcattgtgccacgtctccgcgacgtgtttggatggggtaacctgacctgtccgatttgtaaaggactgttcactgcaatcaaccttggacttaagaaggagccaaacgttgcgagggtgggttcggtggcgattaagctgtgtaatctgctcaagatagctccgccggcggtatgccagtcgatcgtgcatctcttcgaggatgacatggtcgaagtgtggcgcagatccgttctctccccttcggaagcatgcggactcctgctcggttcaacctgcgggcattgggatatcttttcaagctggaacatttcactccctaccgtccctaagcctccccctaagcccccatcgcccccggcgcccggggcacctgtgtccaggattctttttcttaccgatctccactgggatcatgactacctcgaaggtactgacccagattgtgcagatcccctgtgttgtagaaggggttccggactgccgcccgcgagcaggcccggggcaggttactggggggaatactcgaagtgcgaccttcctcttagaaccctggaatcgcttcttagcggactcgggcctgcaggaccatttgacatggtgtactggaccggcgatatcccagcgcacgatgtgtggcatcaaaccagacaggaccagctccgcgcacttactactgtgactgccttggtgcggaaatttcttggcccagttcctgtttaccctgcggtgggtaaccatgaaagcacgcctgtgaattccttcccccctcctttcattgaaggcaatcattcgtccagatggctgtacgaggcaatggcaaaagcctgggaaccttggctgccagcagaagcactgcggactctgcgaattgggggattctacgcactgtcaccttaccccggactcaggcttatctccctgaacatgaacttttgttcgcgagagaacttctggctgctgatcaattcgactgatcctgccggacaacttcagtggctggtgggtgagcttcaagcggctgaggaccgcggcgataaggtgcacatcattggacatatcccgcctggccactgtttgaagtcatggtcctggaactattaccggattgtggccaggtacgaaaacactctcgcggcgcagttttttggtcatacccacgtggacgagtttgaagtcttttacgacgaggaaaccttgtcacgtccgcttgcagtggcatttctggcaccgagcgccaccacctatattggtcttaatccaggttaccgagtgtaccagattgatggtaactacagcggatcctcgcacgtcgtgcttgaccatgagacttacattcttaatctcacccaagcaaacatcccgggagccatacctcattggcagcttctttaccgggcaagggaaacctacggacttccaaatacgctcccaactgcatggcataacctggtgtaccggatgcgcggagatatgcaactgtttcaaactttttggttcctgtaccacaaaggtcatccaccttctgaaccctgcggaactccatgtagacttgcaaccttgtgcgcccagctgtcagcgcgcgcggacagcccggcattgtgcaggcatctgatgcctgatggatcgcttcccgaggcacaatccctgtggccaaggcctcttttttgt

SEQ ID NO: 19778 - DNA, 1893 bp, Artificial Sequence
  Description of Artificial Sequence: Synthetic coding sequence
atgcctagatacggggcctcacttcggcaatcatgtcctcggtccggtcgcgagcagggacaagatggaaccgcaggagcaccaggactgctttggatgggcctcgtgcttgcactcgcgctcgcattggcccttgcacttgccctttctgattcgcgagtactttgggcaccagcagaagcgcatccgctgtcccctcaaggacaccctgcaaggctccataggattgttccaagactgagagatgtgttcggctggggcaatcttacttgtccaatttgcaagggccttttcacggctattaacctcggtcttaagaaagaacctaacgtggcccgggtcggtagcgtggcaatcaaactctgtaaccttctgaaaatcgcgcctcctgccgtctgccagtccatcgtgcatctttttgaagatgatatggtcgaggtgtggcgacgttcggtcctttcgccttccgaagcatgcggtctgttgcttggatccacctgcgggcattgggatatcttttcgtcgtggaacatatctctgccgaccgtgccaaagccgccaccgaagcctccttcgcctcctgcaccaggtgcacccgtttcgcgtattctctttctcactgatctccattgggaccatgactaccttgaaggaaccgacccggattgtgcagaccctctttgttgtcgcagggggtcgggtttgccacctgctagccgacctggagctggctactggggtgaatacagcaaatgcgatctgcctctgagaacccttgaatcacttttgtcgggactgggacctgccgggccatttgacatggtctattggactggagacattcctgctcatgatgtgtggcaccagaccagacaggatcaactgagagcgctcactaccgtcacggcattggtgagaaagtttcttggacctgtgccagtctaccccgcggtgggaaaccatgagtccaccccagtgaatagcttcccccctccgtttattgaaggcaaccattcgtccagatggttgtacgaagcaatggccaaagcatgggaaccgtggctccccgcagaagccctgcggactttgagaattggaggattctacgccctttccccctaccctggacttcggctcatttcccttaacatgaatttctgttccagagaaaacttctggctcctcataaactccaccgatcctgctggacaactgcaatggctggtgggagaacttcaagcggcggaagataggggagataaagtgcacatcatcggtcatattccacctgggcattgccttaaatcctggagctggaactactacagaatagtcgcccggtacgagaatacccttgccgcccagttctttggacatacccacgtggacgagttcgaagtgttttacgacgaagaaaccctcagccgccctcttgcagtggcattcctggccccctcagcaaccacttacatcggtttgaatcctggatacagagtgtatcaaattgatgggaactactcagggagctcacatgtggtgctggaccacgaaacctacattctcaatctcacccaagcaaacattccgggggcgattccacattggcagctgctttaccgggcgcgtgaaacttacggactgcctaacaccctcccgaccgcatggcacaacctggtgtaccggatgagaggagacatgcaactgtttcaaaccttctggtttctctaccacaagggacaccctccttcggaaccttgtggtactccttgtcgtcttgcaactctgtgtgcacaactgtcggcccgcgccgatagccctgcactttgtagacaccttatgccagatggatcgctccccgaagcacagagtctgtggcctaggcctcttttctgc

SEQ ID NO: 19779 - DNA, 1893 bp, Artificial Sequence
  Description of Artificial Sequence: Synthetic coding sequence
atgcctagatacggagcaagtctccggcagagctgcccccgaagcggtcgcgagcagggtcaggatgggacggccggggcaccagggctgttgtggatgggactggtgctggctttggcattagcgttggcgctagcactagctttgtccgacagcagggtcctgtgggcccccgctgaggctcacccgctgtccccccagggtcacccagctcggctgcacagaattgtgccaaggctgagagacgttttcgggtgggggaacctcacctgtcctatctgtaaaggtctcttcaccgccatcaatttgggccttaagaaagagcccaacgtcgcccgggtcgggagtgtagcaatcaaactgtgtaatctgctcaagattgctcctcccgctgtatgccagagcatcgtacatcttttcgaggacgacatggtggaggtgtggaggaggtcggtgctgagtccttcggaagcttgcggactgctgctgggctctacttgcgggcactgggatatcttttcctcctggaacatctctttacccaccgtgccgaagcccccgcccaagcccccctctcctccggctccaggagctccggttagtcgcattctcttcctgacggatctccattgggaccatgattatttggaaggcacggatcccgattgcgctgatccgctgtgttgtcggcggggttctggactgcctccagcaagccgacctggagccggttattggggtgagtacagcaaatgcgatctccccctgagaacccttgagtcgctgctgtcaggcctgggtccagctggtccttttgatatggtctattggaccggcgatattccagctcacgacgtgtggcaccagactagacaagatcagctgcgagctctgaccacagtgacagccctggtgcgaaaattccttggtcccgtccccgtgtaccctgccgtgggcaaccacgaatcaactccagtgaactcttttccccccccattcatcgagggaaaccactcttcgaggtggctctacgaggctatggcaaaagcttgggaaccatggttgcccgccgaggctctgcgtacgcttcgaatcggcgggttttatgccctgagtccctatcccggactacggctgatatctctcaatatgaacttttgcagtcgcgagaacttctggctgctaatcaacagtaccgatcctgctggacagttgcagtggctcgtgggggagttacaagcggcagaggacagaggtgataaggtccacatcattggacatattccccctggacactgcttaaaatcatggagttggaactactacagaatagtcgctcggtacgaaaatactctggccgctcaattctttgggcacacgcacgtcgacgaattcgaggtgttttatgatgaagaaaccctgagtaggccactggcggtggctttcctggcacccagcgccactacatacatcggcctgaatcctggctatcgggtatatcagattgatggcaactactcaggatcttcccacgtggttctggatcatgagacgtacatactgaacctcacgcaagccaacattcctggagcgattccgcattggcagctgctctatcgggcacgtgaaacatatgggctacctaacactctacccacagcttggcataatctggtgtacaggatgagaggggatatgcagttgtttcaaacgttttggtttctttaccacaagggtcaccccccttcggagccctgcggaacaccctgtagactcgccaccctgtgtgctcaactctcagccagagcagactctccagccctctgccggcacctgatgccagacggcagccttcctgaggctcagtctctctggcctagacctctcttctgt

SEQ ID NO: 19780 - DNA, 1893 bp, Artificial Sequence
  Description of Artificial Sequence: Synthetic coding sequence
atgccaaggtacggcgcgagtctgaggcagtcatgtcccaggtctgggcgtgagcaggggcaagatgggaccgctggcgcgcccgggctgctgtggatgggcctcgtgctggcccttgctttggcccttgctctggctctcgcactgagcgacagccgagttctttgggcacctgccgaagcgcaccctctcagccctcagggccatcctgcccgtctgcatcggattgtgcccagactacgagatgtctttggctgggggaatctcacctgtcctatttgcaaaggtctctttaccgctatcaatctcggtctcaaaaaagagcccaatgttgcacgggttggaagtgtggcaattaaactgtgcaatctacttaaaatcgcaccacccgctgtatgtcagagcattgtacatctgttcgaggacgacatggtggaggtctggcgacgatctgtattgtctccgtctgaggcttgtgggctactcctcggcagcacatgtggacattgggacatattctccagttggaatatctcacttccgaccgtgcctaagcccccgcccaagccgccaagcccccctgcgccaggagcccccgtatcccgtatactcttcctgacagacctccattgggatcacgattatctagagggtaccgatccggactgtgcagacccactgtgctgtcggagaggatctgggttgcccccggcatcaaggccaggggctggctactggggagagtacagcaaatgtgacctgccgctgcgcactctcgagagtctgctatcaggcctgggtcccgccgggccattcgatatggtgtactggactggcgacataccggcacacgacgtctggcatcagacacgacaggatcaactcagggcactaaccacagttactgcacttgtccgcaaattcttgggccccgtacctgtataccccgccgtgggcaatcatgaatccactccagtgaactcattcccgccccctttcatagaagggaaccacagctctaggtggctatacgaagccatggctaaggcctgggagccttggcttcctgcagaggccttacggacactgagaataggcggtttctacgccctatctccctaccctggtctaaggcttattagcctgaacatgaatttttgctctcgtgaaaacttttggttattgatcaactcaacggatcccgctggccagctccagtggctcgtcggtgaactgcaggcggcagaggaccgcggggataaagtgcatataatcggacacattccccctggacactgtttgaaatcttggtcttggaactactatcgcatcgtggccaggtacgagaataccttagcagctcaattcttcggccatacacacgtagatgaattcgaggtcttttacgacgaggaaacactgtctagaccactcgcggtggcattcctggccccttctgcgacgacttatataggcctgaatcccggatatagagtgtaccagattgacggcaactactccggctctagtcacgtggtcctggatcacgagacctacattctgaatttaacacaggctaatatccctggcgcgattccacattggcagctgctatatagggcacgcgagacatacggtttacctaacactctgcctacggcctggcacaacctcgtatatcgaatgagaggagatatgcagctgtttcagactttctggttcctttatcacaaaggccacccgccgtcagagccctgtggcaccccttgccgactggcaaccctctgcgcccaactgtctgcacgagcagacagccctgctctgtgccggcatctaatgccagatggaagcctgcccgaagcgcagagtctgtggccccggcccttgttctgt

SEQ ID NO: 19781 - DNA, 1893 bp, Artificial Sequence
  Description of Artificial Sequence: Synthetic coding sequence
atgccaagatacggcgcctccctgcgccaaagctgcccacgctctggacgtgagcaaggacaggatgggaccgcaggggctccgggacttctgtggatgggtcttgtgctggcactcgctttagccctggccctggcacttgctttatcagacagcagggtgttatgggctccggccgaagcccatcccttgtcccctcagggacaccccgctaggttgcacaggatcgtacctagactaagagacgtctttgggtggggaaatctcacatgtcccatttgtaaaggacttttcactgccattaacctgggactcaagaaagagcctaacgtcgccagggtgggctctgtggctatcaagctgtgtaatcttctaaaaatcgccccccccgccgtgtgccagtctatagtgcacttattcgaagacgacatggtggaagtgtggaggagaagcgtgctctcacccagtgaggcctgcggccttctgcttggctcgacctgtggacactgggacatttttagtagttggaatatttcattgccgactgtgccaaaacctcctcccaagccacccagtccaccagcccctggagctcccgtctcccggatcctcttcctcactgatctccattgggaccacgactatctggaggggaccgaccccgactgtgccgacccattgtgctgtagaaggggttccgggctgccgcccgcatcccgcccaggagccgggtattggggcgagtacagtaaatgtgacctcccactgaggacattggagagtctgctttcaggacttggaccggccggaccctttgatatggtgtattggactggagacatacctgcgcacgacgtatggcaccagactcgccaggaccagctccgggccctcactacggtcaccgcccttgtgagaaaattcctggggccagtgcccgtctaccccgcagtcggcaaccacgaatccacaccagtcaacagcttcccgccaccatttattgagggcaaccattcatctcggtggttgtacgaagcgatggccaaagcctgggaaccctggcttcccgccgaagctctacgtactcttcgcattggaggtttctatgcacttagtccttaccccggcttgaggctgatatcactcaacatgaacttttgctcccgggaaaacttttggctcttgattaattcaacagatccggcggggcagttgcagtggctggtaggggagttgcaggctgcggaagatcgaggggataaggttcacatcatcggccatatcccccccggtcactgcctaaagtcttggagctggaattactatcgtatagtggcgcgttacgaaaataccttggctgcccagttctttgggcatactcatgtagatgagttcgaggtcttctacgatgaagaaacactgagccgaccgctcgccgttgcatttctggcaccgtctgccacaacatacattggactcaaccccggttatcgagtataccaaatcgacggcaactattctggatcaagtcacgtggtgctggatcatgagacttacattctgaaccttactcaagccaacatacccggagcaatccctcattggcagctgctgtacagagcccgcgagacctatgggctacccaatactctgcccaccgcctggcacaacctagtgtaccgcatgcggggagatatgcagctattccaaaccttttggtttctgtaccataagggtcaccccccttcggaaccttgtggaactccttgtagactcgccactctctgcgcgcagctgagcgcacgcgccgattcgccagcgttgtgtcgccaccttatgccagacgggagtttacctgaagcacagtctctgtggcctcgacctctattttgc

SEQ ID NO: 19782 - DNA, 1893 bp, Artificial Sequence
  Description of Artificial Sequence: Synthetic coding sequence
atgccaaggtatggagccagcttaagacagagttgccccagatctggcagggagcagggccaggacggcacggctggtgcccccggcctgttgtggatggggcttgtgctagcactcgctctggcactagcccttgcactggcactctctgactcaagggtgctgtgggctcccgctgaagcccatccactgagcccccaggggcacccagctagactgcatcgcattgtgcctagattgcgggacgtgtttggctggggcaatctgacctgtccaatttgcaaggggcttttcaccgcaataaacctagggctcaagaaggagcctaacgttgccagggttggctccgtcgcgattaaattgtgcaatcttcttaagatagcaccgccagctgtttgtcagagtatcgttcacctattcgaagatgacatggtcgaagtatggagacgttctgtgctgtccccttctgaggcctgcggcctgctgttgggaagcacttgcggccactgggatatattttcttcatggaatatctctctccccaccgttcccaagccgcctcccaagcctccaagtccgccggctccgggagcccccgtgtcacgaattttgttcctgactgatctgcattgggaccacgactatcttgagggtacagacccagactgtgccgaccctttatgctgcaggagggggagcggtttgccccccgccagcaggcccggagcgggttactggggcgaatattcgaagtgcgatttgcctctcaggactctggagtccctgttaagtggactgggccccgctggtcccttcgacatggtgtattggactggcgatatcccagcgcatgatgtgtggcaccaaactcgtcaggaccagcttagggcattaacaacagtgactgcgcttgtccgtaaattcctgggacccgtgcctgtctacccagcagtggggaaccatgaatctaccccggtgaacagcttcccccctccctttatcgagggtaatcactcctcacgctggctgtacgaggcaatggcgaaggcttgggagccctggttacccgctgaagcgttgcgcaccctgcgcatcggggggttctatgctctgagcccctatccgggtctccgcctcatatccttaaatatgaatttttgttctcgcgaaaacttttggctgctgatcaacagtacggaccctgccggccaactgcagtggttagttggcgaactccaagcggccgaggatagaggcgacaaggtgcatattatcggccacattcctccagggcattgtctgaagtcttggtcctggaattattacaggatcgttgcgagatatgaaaataccttggccgcccagttcttcggccatacgcacgtagatgagtttgaagttttttacgatgaggagaccctgtcacgtcccctcgctgtcgcttttctggccccatccgccaccacgtacattggactcaatcccggctatcgtgtatatcaaatcgacggaaattattccggttctagccacgtagttctagatcacgaaacttatatattgaacctcacccaggcaaatatacccggggccatcccgcactggcagctgctgtaccgcgcaagagaaacctatgggctccccaatacactgcccacagcttggcacaacctcgtatacagaatgcggggcgatatgcaactgtttcagactttttggtttctctatcacaagggacaccctccaagcgaaccctgtggaacaccatgtaggctggcaaccttatgtgctcagctatcagcccgtgcggactccccagccttgtgccggcacctgatgcccgatggaagtctgcctgaagcccaatccctgtggcccagacccttattttgc

SEQ ID NO: 19783 - DNA, 1893 bp, Artificial Sequence
  Description of Artificial Sequence: Synthetic coding sequence
atgccacgctatggggcttccctcaggcagtcgtgcccaagatctggaagagaacagggacaagatggaaccgccggcgctccgggcctgctctggatgggactcgtcctggcactggccctggcgttggccctggctttggccctctcagactcgcgcgtgctgtgggcgcctgcagaggcgcatcctctctcaccacaaggacatcctgcacgcctccataggatcgtgccacgattgagggacgtgtttggctggggcaatctgacttgcccaatctgcaagggcctgttcaccgctattaacctgggacttaagaaagaaccaaacgtggcccgggtcggaagcgtcgcaattaagctgtgcaatctgttgaagatcgcgccgcctgccgtgtgtcaatcgatcgtgcatcttttcgaagatgacatggtggaagtgtggcgcaggtcagtcctctcgccatcggaggcttgcggcctgttgctgggatcgacctgcgggcactgggatatcttttctagctggaatatctcccttcctaccgtccctaagcctccaccgaagcctccgtcaccccctgcgcctggtgcgccggtgagccggatcctgtttctgactgatctgcactgggatcacgactacctggagggaaccgacccggactgcgcagacccgctgtgctgcagaagggggagcggcctgccgcctgcgagccgcccgggagccggatactggggtgagtattcgaaatgtgatcttcctctcagaaccctggagtcactcctctcaggcctcggtccagccggaccgttcgatatggtctactggactggggacatcccggcacatgatgtgtggcaccagactcgccaggatcagctgcgcgctctgactaccgtcactgccctcgtgaggaagttccttggaccggtgcctgtgtacccggcagtcggaaatcacgaaagcactccggtcaacagcttcccgccgcctttcattgagggaaaccattcgtcccggtggctgtacgaggcgatggcaaaggcttgggagccgtggctcccagcggaagccctccgcaccctgcgcattggaggcttctacgcactttcaccatacccaggccttcggctgatatccctgaacatgaacttctgttcgcgcgagaatttctggcttctcatcaacagcaccgacccagcaggacagctccaatggttggtcggagaactgcaggccgcagaggaccgcggagataaagtgcacatcatcgggcacatcccgccaggccactgcctgaagtcctggtcctggaactattaccgcatcgtggcgcgctacgagaacacgctggcagcgcagttcttcggccatacccatgtcgacgagttcgaagtgttctacgacgaagagactctgtcgcgccctctggcagtggcctttttggccccctcagccaccacctacatcgggctgaatccaggctatcgagtataccagatcgacggtaactacagcgggtcatcgcacgtcgtgcttgaccatgagacgtatatactgaacctcactcaagccaacatcccgggagcaatcccccactggcaactgctgtaccgggcccgggagacttacgggctccctaataccctgccgaccgcttggcacaatctggtgtacaggatgcggggagacatgcagctgttccagactttctggtttctctatcataaagggcatccgccgagcgaaccgtgcggtactccgtgcagactggcaaccctgtgcgctcaactgtcagcacgggccgattccccggccctgtgtagacatttgatgcccgatggcagcctgccagaggcccaatccctgtggcctagaccgcttttttgc

SEQ ID NO: 19784 - DNA, 1893 bp, Artificial Sequence
  Description of Artificial Sequence: Synthetic coding sequence
atgccgcgctacggggcctccctcaggcagagctgcccaagatcaggacgggaacagggacaggatggcaccgccggagcacctggactgctgtggatgggactggtcctggctttggccctcgcgctggcccttgcactcgcactctcggactcacgggtcctgtgggcgccagccgaggcgcacccgctgtcgccgcagggacacccagcgcggctgcacaggatcgtcccgagactccgcgatgtgtttggctggggtaacctgacctgcccaatctgtaaaggtttgttcactgcgatcaacctcggcctgaagaaggagccgaacgtggctagggtgggctcggtcgccatcaagctgtgcaacttgcttaagatcgcgccaccggctgtctgccagagcatcgtgcaccttttcgaggatgacatggtggaggtgtggagacgctccgtcctgtcgccatccgaggcttgcggcttgctgctgggctcgacgtgtggacattgggacatctttagctcctggaatatctcactgccgaccgtgcctaagccacctcctaagccgccttcacctccggcccctggggcccccgtgtcccgaatcctgttcctgaccgacctgcattgggaccacgactacctcgaaggcactgaccctgactgcgccgacccgctgtgctgccggaggggatccgggctcccgccggcgtcgcgccctggagccggatactggggcgagtatagcaagtgcgaccttccactcagaacgctggagtcgctcttgtcgggactgggacctgctggaccattcgacatggtgtactggaccggcgacatccctgcgcatgacgtgtggcaccaaacccgacaggaccaactcagagccctgactaccgtgaccgcgctggtgcgcaagttcctgggacctgtgccggtctaccctgcagtgggcaaccacgaatcaactcctgtgaacagctttccgccaccgttcatcgagggtaatcactcctcgcggtggttgtacgaggcaatggcaaaagcctgggagccttggctccccgctgaggctctccgcactctcagaatcggagggttttacgccctttccccttatccgggcctccgccttatctccttgaatatgaacttttgctcccgggaaaacttttggctcctgatcaattctaccgaccctgcgggccagctgcagtggctggtgggagagcttcaggcagccgaagatcggggagataaggtgcatatcatcggtcacatcccacctggacactgtctgaagagctggtcgtggaactactacaggatcgtggcaagatatgagaataccctcgccgcgcagttcttcggccacacgcacgttgatgagttcgaagtgttttacgatgaggaaaccctctcccgcccgctggcagtcgccttcctggccccatcagctaccacgtacatcggcctgaacccaggctaccgtgtgtaccagatcgatgggaattacagcggatcctcacacgtggtgctggatcacgagacgtacatcctcaatctgacccaggcaaacatcccgggcgccatcccacattggcagctgctgtaccgggcccgcgaaacctacggactgccaaatacgctgccgaccgcgtggcataaccttgtgtacagaatgcggggcgatatgcagcttttccaaactttctggttcctctaccataagggacatcctccttcagagccatgcggaactccgtgccgcctcgccaccctttgcgcccagctcagcgcgcgggccgattccccggccttgtgtaggcacctgatgcccgatggatcgctgcccgaagctcaatcgctgtggccccgccccctgttctgt

SEQ ID NO: 19785 - DNA, 951 bp, Artificial Sequence
  Description of Artificial Sequence: Synthetic coding sequence
atgtacaacatgatggagactgaactgaagccgcctggacctcaacagactagcggcggcggaggcggcaactctaccgccgcggccgccggaggcaaccagaagaatagcccagatcgcgtcaaacgccctatgaacgcattcatggtgtggtcccgcgggcaaaggagaaagatggcgcaggaaaacccgaagatgcacaattcagaaatctccaagaggctgggcgctgaatggaaactgctgtcggagactgaaaagaggccgttcatcgacgaggcgaagcggcttcgggccctccatatgaaggagcatccggactacaagtacagaccccggcggaaaacgaaaacgctcatgaagaaggacaaatacaccctgcctggcggattgctcgccccgggaggaaattcgatggccagcggtgtcggtgtgggagctggactgggagccggagtgaaccagcggatggattcgtacgctcacatgaatggttggagcaacggatcatattcgatgatgcaagaccagcttggatacccacaacacccggggctgaacgcgcatggcgccgcccagatgcagcctatgcatcgctacgacgtctccgcgctccaatacaattctatgaccagctcacagacgtacatgaacggatcccctacctactcgatgtcatactcccagcaaggaactccgggaatggcgctgggaagcatgggcagcgtggtgaagagcgaagcgtcgtcgtcacctccggtggtcacttcgtcgtcccactcccgggcgccatgtcaggcaggagacttgagggacatgattagcatgtacctgccaggcgccgaggtgcccgagccggcggccccctcgagactgcatatgagccaacactaccaatcgggaccggttccaggcaccgccatcaacggaaccttgccgctgtcccacatg

SEQ ID NO: 19786 - DNA, 951 bp, Artificial Sequence
  Description of Artificial Sequence: Synthetic coding sequence
atgtacaatatgatggaaactgagctgaagcccccaggtccccaacagacctccggcggaggaggaggcaattcgactgccgcggcggcgggcggcaaccagaagaattcgcctgaccgcgttaaacggcccatgaacgccttcatggtctggtcccggggccagcgccgtaaaatggcccaggagaacccgaagatgcataactcggaaatcagcaaacggctgggtgcagagtggaagctgttgtcagaaactgagaagaggccctttatcgatgaggctaagcgcctgcgagctctccatatgaaggagcaccccgactacaaataccgaccgcgacgcaaaaccaagacgctgatgaagaaggacaagtacacgcttccgggcggcctcttggctccaggcggaaattcgatggcatccggagtgggagtgggagccggactgggcgcaggagtgaaccagcgaatggacagctatgcgcacatgaacgggtggtctaatggttcatattcaatgatgcaggatcaactgggttatccacagcatccgggattgaacgcacacggagccgctcaaatgcagccgatgcaccggtacgacgtgtcggctctgcagtacaactcaatgacctcatcgcaaacttacatgaacggctcgcctacctactcaatgtcgtactctcaacaagggaccccggggatggcactgggatccatgggttctgttgtgaaatccgaagcgagctcctcgcctccggtcgtgaccagctcctcgcactcccgggcgccatgccaggccggcgatctgagagacatgatctctatgtacttgccaggagccgaagtccctgaacctgcggcgccgtcgagattgcacatgagccagcattaccaatcggggcctgtgcctggtactgcgattaatggcactctcccactgtcacacatg

SEQ ID NO: 19787 - DNA, 951 bp, Artificial Sequence
  Description of Artificial Sequence: Synthetic coding sequence
atgtataacatgatggagactgaactcaaaccgcctggtccacaacagacgtcgggaggcggcgggggaaattccaccgcagcagcggccggtggaaaccagaagaattcaccagatagggtgaaacgtccaatgaacgcatttatggtgtggtcacgggggcagagacgaaaaatggcacaagagaaccccaaaatgcataactcggaaatctcaaagcggctgggcgcagaatggaagctgttgtcggaaaccgagaaacgcccatttatcgacgaagcaaagcgacttagggcgctgcacatgaaagaacatcctgattacaagtaccggccccgtcgtaagaccaaaaccctgatgaaaaaggacaagtacactctccccggagggcttcttgcacctggaggtaatagcatggcaagcggtgtgggggtcggggctggtcttggtgccggtgtcaaccaacgcatggattcctacgcccatatgaacggatggtccaacggttcgtactcgatgatgcaggatcaacttggatacccacaacatcctggactgaatgcacacggtgctgcacaaatgcagccgatgcatagatacgatgtgtcggctctccaatacaattccatgaccagctcacagacttacatgaatggcagcccgacctacagcatgtcgtactcgcagcagggcaccccagggatggcccttgggtcgatggggtcagtggtgaagagcgaagcctcctcatccccgcctgtcgttactagttcgtcgcactcccgtgcaccctgccaagcaggagatcttcgtgacatgatctcaatgtacctgccgggcgcagaagtcccggaaccagccgctcccagcagactccacatgagccagcactaccaatcaggacccgtccctggtaccgccatcaacggcactctccctctctcacatatg

SEQ ID NO: 19788 - DNA, 951 bp, Artificial Sequence
  Description of Artificial Sequence: Synthetic coding sequence
atgtacaatatgatggaaactgaactgaagccgccaggccctcaacagacctccggcggaggaggcggcaactccactgcggcagcagccggcggcaaccaaaagaattccccggaccgggtgaaaagaccaatgaacgctttcatggtgtggagcagaggacaaaggcgcaaaatggcgcaggaaaaccctaagatgcataacagcgaaatctcgaagcgcctgggagccgaatggaaactcctgtctgaaactgagaagaggccgttcatcgacgaggccaagcgccttcgggctttgcatatgaaagagcatcccgattacaagtacagaccacgcaggaagaccaagaccttgatgaagaaggataagtacaccctgccgggtggacttctggctcctggcggcaactctatggcctcaggggtgggagtgggagccggcctcggcgcgggggtcaatcagcggatggactcctacgcccatatgaatggatggtcaaatggatcctacagcatgatgcaagaccaactgggataccctcagcaccctggcctgaacgcgcacggagccgcgcagatgcagccgatgcaccgctacgatgtttcggcgctgcaatataactctatgacttcctcacagacgtacatgaacggctctccgacctattccatgagctactcccagcagggaacccctggcatggctctcggatccatgggctcggtcgtgaagtcggaagccagctcgagcccgcctgtggtgacctcgtcatcccactcgcgggccccctgccaggcgggtgacctcagggatatgatttccatgtacctgcccggcgctgaagtgcctgagcccgccgctccaagccgactccatatgtcgcagcactaccagtctgggccggtgccaggcaccgccatcaacggaactctgccgctcagccatatg

SEQ ID NO: 19789 - DNA, 951 bp, Artificial Sequence
  Description of Artificial Sequence: Synthetic coding sequence
atgtacaacatgatggagactgaactcaagcccccaggccctcaacagacgagtggaggtggaggcggaaactcaaccgcggcggctgctggtggcaaccagaaaaacagccctgatcgagtcaagcgcccaatgaatgcctttatggtgtggtctagagggcaaagacggaaaatggctcaggaaaatcccaagatgcacaactccgaaatttccaagaggctgggtgcagaatggaagcttctaagtgaaacagagaaacggccattcatagatgaagccaagagattgcgggctctgcacatgaaggaacatcctgactataagtaccgacctcgcaggaagaccaagactctgatgaagaaagacaagtatacgctgccaggaggccttttggcacctggcgggaacagcatggcctcaggcgtgggtgtgggtgcagggctgggcgctggcgtgaaccagaggatggatagttacgcgcatatgaacgggtggagcaatggaagctactctatgatgcaagaccagctgggctaccctcagcatccaggtctcaacgcacacggtgctgcccaaatgcagcctatgcacaggtatgacgtcagcgccctccagtataattccatgacatcatctcaaacatacatgaacggcagtccaacttactctatgtcatactcccaacaaggaactcccgggatggcgcttggcagcatggggtctgttgtgaagtctgaggctagtagtagtccacctgtcgtgacatcgagctctcacagcagggccccgtgtcaggccggagatctccgggacatgatcagcatgtatctgcctggcgcagaggtccccgagcctgccgccccaagtcgccttcacatgtcacagcactaccagtccggaccggttcctggcaccgccatcaatggcacactgccgttgtcccacatg

SEQ ID NO: 19790 - DNA, 951 bp, Artificial Sequence
  Description of Artificial Sequence: Synthetic coding sequence
atgtacaacatgatggaaaccgaattgaaaccgccgggaccacaacagacgagcgggggcggaggaggtaattccacggccgccgcggccggaggaaaccagaagaatagtcctgatcgggtgaagcggcctatgaacgccttcatggtgtggagccgcggacagcgcagaaaaatggctcaagagaatccaaagatgcataactctgaaatctcaaagcggctcggggcggaatggaagttgctttccgagactgagaagcgaccattcattgatgaggcaaagcggctccgcgccctccacatgaaggaacacccggactacaagtaccgcccgcggcgaaagaccaagactcttatgaagaaggacaaatacacgctgccgggtggactcctggccccaggaggcaactcaatggcatccggagtgggcgtcggagccggactgggagccggtgtgaaccagcggatggattcatacgcacacatgaacgggtggagcaacggatcgtactcgatgatgcaggatcagctgggatacccgcagcatccagggttgaacgcccacggagctgcccaaatgcagcctatgcacaggtatgatgtgtcggcgctgcagtacaactcgatgacttcctcgcaaacctacatgaatggatcgccgacttattcaatgtcgtactcgcagcagggaactcctggcatggcactgggatcgatgggatcagtcgtgaagtcggaagccagctcttctccacccgtcgtgacctcgtcgtcccactcccgcgcgccgtgccaggccggcgacctgcgggacatgatctccatgtaccttccaggtgcggaagtgccggagcccgccgcgccgagccggctgcacatgagccaacactaccagtccggaccggtgccgggaaccgccatcaacgggaccctgccgctgtcacacatg

SEQ ID NO: 19791 - DNA, 951 bp, Artificial Sequence
  Description of Artificial Sequence: Synthetic coding sequence
atgtacaacatgatggaaaccgaacttaagccaccaggtcctcaacaaacctccggaggaggaggcggtaacagcaccgcagcagcggccgggggaaatcaaaagaattcccccgatcgtgtgaagcgacccatgaatgcatttatggtgtggtccagaggacaaaggagaaaaatggcgcaggaaaaccctaagatgcacaatagcgaaatctccaagcgtctgggggcggaatggaagctgctttccgaaaccgagaaacggccctttatcgatgaagcaaagaggcttcgggccctgcatatgaaagagcaccctgattacaaataccgccctcgtaggaaaaccaagactctgatgaaaaaggacaaatacacccttcctggtgggctcctggcccccggagggaacagcatggcctcgggagtgggtgtcggagccggcttgggtgcaggcgtgaaccagcgcatggactcttacgcgcacatgaatggatggtccaacggatcctattccatgatgcaagatcagctcggatacccacaacatcctggccttaacgcgcatggcgcggcccaaatgcagcctatgcaccggtacgacgtatcggctctgcaatacaattcgatgacttcttcacagacttacatgaatggcagccctacctactcgatgtcctactcacaacagggtacgccaggcatggcgctgggctcgatgggtagcgtggtcaagtccgaagcctcatcctccccacctgtggtgacctcatcaagccattcgcgcgcaccttgtcaggcaggcgacctccgagacatgatttcgatgtacctgcctggggccgaagtgccagaaccagcggccccgtcgagacttcatatgagccaacattaccaatcgggacccgttccgggtaccgcaatcaacggtaccctccctttgagtcacatg

SEQ ID NO: 19792 - DNA, 951 bp, Artificial Sequence
  Description of Artificial Sequence: Synthetic coding sequence
atgtataatatgatggagacagagctcaagcccccaggcccacagcagaccagcggaggcgggggcggaaactccacagccgcagccgcaggcggtaatcagaaaaatagtccggacagagtgaagagacctatgaatgcttttatggtatggtcgcgagggcagaggaggaaaatggcacaggaaaatcctaagatgcacaatagtgaaatcagtaaaaggctcggagccgaatggaaactgctctctgagacagaaaagaggccttttatcgacgaagctaagcgactgagggccctgcacatgaaggaacaccctgactacaagtatagaccccgcaggaagacgaagactctgatgaagaaagataagtataccctccccggcgggcttctggcacccggagggaactctatggcatccggtgtaggcgtgggggccggcttgggggcaggagtgaatcaacgaatggactcgtacgcacacatgaatgggtggtccaacgggtcctactccatgatgcaagatcagctgggatacccgcaacatccgggactgaatgcacacggagccgctcagatgcagcccatgcatcgctacgatgtgagcgcgttacagtacaatagcatgacatccagtcaaacttacatgaacggatcacctacatatagtatgtcgtatagtcaacagggtacacctgggatggccttggggagcatgggttcagtggtgaagagtgaggcatctagttcccctcctgtagttacatcatctagccactcacgagctccctgtcaggcgggcgacctcagggatatgatttccatgtatttacccggtgccgaggttcccgaacctgccgccccttcaaggctccatatgtcacagcactatcaaagtggacccgtccccgggacagctatcaatggcacactgcctctgagccacatg

SEQ ID NO: 19793 - DNA, 951 bp, Artificial Sequence
  Description of Artificial Sequence: Synthetic coding sequence
atgtacaacatgatggaaaccgaacttaagccacccggacctcaacagacttcgggtgggggcggcggcaatagcacggccgccgcagcaggaggtaatcagaagaacagccccgacagagtcaagcgtcctatgaacgcatttatggtgtggtcacgcggtcaaaggcggaaaatggcgcaagagaaccccaaaatgcacaattccgagatttctaagcgtctgggtgcagagtggaagctgctgtccgaaaccgaaaaacgacctttcatcgatgaggcaaagcggctgcgggcattgcatatgaaggaacaccccgattacaagtacaggccaagacgcaagaccaaaactctcatgaagaaagacaagtacaccttgccaggagggctccttgccccaggcggcaattcaatggcgagcggagttggcgtgggtgccggactcggcgcgggagtgaaccagagaatggattcatacgcacatatgaatggatggtccaatggatcgtactctatgatgcaggaccaactgggatacccccagcatccgggactgaacgcacatggggcggcacaaatgcagccgatgcaccgatacgatgtgagcgctctgcagtataactccatgacctcttcccaaacttacatgaacggatctcctacctactcgatgtcgtattcacaacaagggactcctggtatggccctcggatctatggggtccgtcgtgaaaagcgaagcctcctcttcgccaccggtggtcacgtcatcctcccatagccgcgctccgtgtcaagcaggcgatcttagggacatgatctccatgtacttgccaggcgcggaggtgccagaacctgccgcaccatccagactgcatatgtcccaacactaccagtccggacctgtccccggtactgcaattaacggtaccctgccacttagccatatg

SEQ ID NO: 19794 - DNA, 951 bp, Artificial Sequence
  Description of Artificial Sequence: Synthetic coding sequence
atgtacaatatgatggaaaccgaactgaagcctccggggcctcaacaaacttccggaggaggagggggaaattcgaccgcggcagccgcaggtggcaaccaaaagaattccccggatcgcgtgaagcgcccgatgaatgcctttatggtctggtcgcgcggtcagcgcaggaaaatggcacaagagaatccgaaaatgcataattcagagatctccaagagactgggagctgaatggaagttgctgtcagaaactgagaagcggcccttcatcgacgaggctaagcgcctccgggctctgcacatgaaagaacacccggattacaagtaccgtccgcgacgcaagaccaaaactctcatgaaaaaggacaagtacactctgccaggtgggctccttgctccaggaggaaactcgatggcttcgggagtgggcgtcggagcgggtttgggagctggagtcaaccagcggatggactcgtacgcccatatgaatgggtggagcaacgggtcatactctatgatgcaagatcagctgggatacccacagcatccaggcctgaacgcacacggcgccgctcaaatgcaaccgatgcaccgctacgacgttagcgctctccagtataactccatgacctcgtcgcaaacttacatgaacggatccccgacgtactcgatgtcttatagccaacagggcactccgggaatggcactggggtcaatgggatcagtggtgaagtcggaagcatcctcctcgcctccggtggtcaccagcagctcccattcccgtgctccatgccaggccggtgacctgcgggacatgatctccatgtacctgccgggcgccgaagtgcctgaacctgccgccccgagccggctgcacatgtcacagcattatcagtccggtccagtgcccggaaccgctattaacggtaccctgcctctctcccatatg

SEQ ID NO: 19795 - DNA, 951 bp, Artificial Sequence
  Description of Artificial Sequence: Synthetic coding sequence
atgtacaacatgatggaaacggagcttaagcccccaggacctcaacaaacttcaggaggtggcggcggtaactctactgcagcggcggcgggcggcaaccaaaagaactcgccggaccgcgtgaaacggcccatgaatgcctttatggtgtggtcgagaggacagcgccggaagatggcgcaggaaaaccctaaaatgcataactccgaaatttcgaaacggctcggcgcagagtggaagctcctgtcggagacggagaaaagaccttttatcgatgaagcgaaaagactgcgggcactgcatatgaaagaacatccagattacaagtacaggcctaggcgtaaaaccaagacccttatgaagaaagataagtacactctccctggaggacttctggcgcccggggggaactcaatggcctcgggagtcggagttggcgcagggttgggggcaggagtcaaccaaagaatggattcgtatgctcatatgaatgggtggagcaacggaagctactccatgatgcaggatcagctcggttatccacagcatcccgggcttaacgcccacggagcagctcaaatgcaacctatgcacagatacgatgtgtctgcactgcagtacaattcgatgacttcttcccaaacttacatgaacggctccccgacctactccatgtcgtacagccagcaaggtactcctgggatggctctcggatcgatgggttccgtggtgaagtccgaggcatcgtcgtcaccccccgtggtcacctcatcgtcccattctcgcgcaccgtgtcaggcaggggatctgagagacatgatttccatgtaccttccaggagcagaagtgccggaaccagctgctccttcgagactgcatatgtcccagcactaccaatccggacccgtgcctggtacggcaataaacggaactctgccactgtcacacatg

SEQ ID NO: 19796 - DNA, 951 bp, Artificial Sequence
  Description of Artificial Sequence: Synthetic coding sequence
atgtataacatgatggaaacagagctcaaaccccctggcccccagcaaacctctgggggtggaggaggaaactccaccgcggcggcagcaggcggaaaccagaagaacagcccagatcgagtgaaaaggcccatgaatgctttcatggtgtggagcaggggtcagcgtcgcaaaatggcccaggaaaatccaaagatgcataatagcgagatatcaaagagattgggcgctgaatggaagctgctgtccgagacggagaagaggcccttcatcgatgaggccaagcgcttgagagccctgcatatgaaggaacatccagactacaagtacaggcccagaaggaagaccaagacactcatgaaaaaggacaaatatacgctgccaggcgggctgttagcccccggcggcaatagcatggctagcggggtgggcgtcggagccgggctaggagcaggtgtgaaccagcggatggatagctacgctcacatgaatgggtggtcaaatgggtcctattcgatgatgcaggaccagctggggtaccctcaacaccccggtctgaacgctcatggcgctgctcagatgcagccaatgcacaggtacgatgtgtcagcgctgcaatacaattctatgacctcttcccagacctatatgaatgggtcccccacctacagcatgagctactcacagcagggcaccccagggatggcactggggagtatgggatctgtggtaaaaagcgaggcctcttcttctcctcccgtcgtgacatcttcctcccatagcagggcgccatgccaagccggcgatttgcgggacatgatcagcatgtacctgccaggagccgaggtcccagagcctgcagctccatcacggctacatatgtcacaacactatcagtctggcccagtaccaggtaccgctatcaatggtacactgcccttgagccacatg

SEQ ID NO: 19797 - DNA, 951 bp, Artificial Sequence
  Description of Artificial Sequence: Synthetic coding sequence
atgtacaacatgatggaaaccgagctcaagccgcctgggcctcagcaaacctcgggaggtggagggggaaactcgaccgctgccgcagccggaggtaaccagaagaattcgccggaccgggtgaaacgcccgatgaacgccttcatggtctggtcacgcggacagcggcggaaaatggcgcaggaaaatccgaagatgcacaacagcgaaatctccaagagactgggcgccgaatggaagttgctgagcgaaaccgaaaaacggcctttcatcgacgaagccaagagactgagagcactccacatgaaggagcacccagattacaagtaccggccgaggagaaagactaaaaccctgatgaagaaggacaagtacaccctgcccgggggactcctggcaccgggcggtaactccatggcttcaggtgtgggagtcggcgcgggtctgggtgccggagtgaatcagcggatggattcttatgcgcacatgaacggatggtccaacgggagctactctatgatgcaggaccagctgggatacccgcagcatccgggacttaacgcacatggagccgcgcagatgcagccgatgcaccgctatgatgtctccgctctgcagtacaactcgatgacctcctcacaaacctacatgaatggatcaccgacttactcaatgagctactcccaacaaggcactcctggcatggcgctgggatcgatgggatcagttgtgaaatcggaggcctcctcgtccccgccagttgtgacgtcctcctcccacagccgcgcgccgtgccaagcaggagatctccgggacatgatttccatgtacctgcctggagcagaggtgccggaaccggccgcaccgtcccgcctccacatgagccagcactaccaatcagggccggtgccgggcacggcgatcaacggaaccctgccgctgtcgcacatg

SEQ ID NO: 19798 - DNA, 951 bp, Artificial Sequence
  Description of Artificial Sequence: Synthetic coding sequence
atgtataatatgatggagaccgaactgaagcccccgggcccacagcagacctcaggtggcgggggtgggaactccacagccgcagcagcaggtggcaaccagaaaaacagcccagaccgggtcaagcgacccatgaacgcattcatggtctggagtagaggtcaaaggcggaagatggcgcaggaaaacccaaaaatgcataacagcgagatctcaaagaggctgggggcggagtggaaactcctctcagagaccgagaagagaccttttatcgatgaggccaaaaggttgcgggccctgcacatgaaagagcacccagactacaagtaccggccacgccgaaagactaagactctgatgaagaaggacaagtatacactgcccggcggtctgttggctccgggcggcaactcaatggcctccggggtcggggttggcgcaggccttggcgcgggagttaaccagcggatggactcttatgcgcatatgaacggttggtccaacgggtcctactccatgatgcaggaccaactgggctatccccagcatcccggccttaacgcacatggtgcagcacagatgcagcccatgcatcggtacgatgttagcgcccttcagtacaacagtatgacgagtagtcagacatacatgaatggaagtcccacgtactcaatgagttacagccagcaaggaacgccaggaatggctcttggtagtatgggttcagtggttaagagcgaggccagctcaagtccgccagttgtcacgagctcaagccactcccgggctccttgtcaagcaggtgatctcagagacatgatttcaatgtacctgccgggtgccgaagtccccgaacctgcagccccctcacgactgcacatgagtcagcactatcagtcaggcccagtgccagggacagctatcaacggtacattgcccttgagtcacatg

SEQ ID NO: 19799 - DNA, 951 bp, Artificial Sequence
  Description of Artificial Sequence: Synthetic coding sequence
atgtacaatatgatggagacggagctgaagccgccaggaccgcaacagacttcaggcggaggcggaggaaacagcactgcggccgctgcaggaggaaaccagaagaactcgccggaccgcgtgaagcgaccaatgaacgccttcatggtgtggtccaggggccagcgccggaaaatggcccaagagaacccgaagatgcacaactctgaaatttccaaaagattgggtgccgaatggaagctgctttccgaaaccgaaaagcggcccttcatcgacgaagcgaagagactgcgcgccctccacatgaaggagcatcctgactacaaataccggccgaggaggaaaactaaaactctcatgaagaaggataagtacaccctgccgggaggtctgctcgcgccgggtggaaatagcatggcttccggagttggtgtgggagccggactgggagcgggggtcaaccagcggatggatagctacgcacatatgaacggatggtcaaatggaagctacagcatgatgcaggatcagctgggatatcctcagcatcctggccttaacgcacatggagccgcacagatgcagccaatgcacagatacgatgtgagcgccctgcagtacaactccatgacgtcaagccaaacttacatgaacggatcgccaacctactcgatgtcttacagccagcaggggaccccggggatggcactcggttctatgggatccgtggtcaagtccgaagcgtcaagctcgcctcctgtggtcacctcgagctcgcacagcagagccccttgccaagctggtgatctccgcgatatgatctcaatgtacctcccgggtgccgaagtgcctgaacctgctgcaccgtcgcgactgcacatgtcacagcattaccaaagcggaccggtgccgggcaccgcaatcaacggcacccttcctctgtctcacatg

SEQ ID NO: 19800 - DNA, 951 bp, Artificial Sequence
  Description of Artificial Sequence: Synthetic coding sequence
atgtataatatgatggaaacggaattaaaaccgccgggtccgcaacaaacgtcgggtggtggtggtggtaattcgacggcggcggcggcgggtggtaatcaaaaaaattcgccggatcgtgtaaaacgtccgatgaatgcgtttatggtttggtcgcgtggtcaacgacgtaaaatggcgcaagaaaatccgaaaatgcataattcggaaatatcgaaacgtttaggtgcggaatggaaactattatcggaaacggaaaaacgaccgtttatagatgaagcgaaacgattacgtgcgttacatatgaaagaacatccggattataaatatcgaccgcgacgtaaaacgaaaacgctaatgaaaaaagataaatatacgctaccgggtggtttattagcgccgggtggtaattcgatggcgtcgggtgtaggtgttggtgcgggtctaggtgcgggtgtaaatcaacgaatggattcgtatgcgcatatgaatggttggtcgaatggttcgtattcgatgatgcaagatcaactaggttatccgcaacatccgggtctaaatgcgcatggtgcggcgcaaatgcaaccgatgcatcgatatgatgtatcggcgctacaatataattcgatgacgtcgtcgcaaacgtatatgaatggttcgccgacgtattcgatgtcgtattcgcaacaaggtacgccgggtatggcgttaggttcgatgggttcggtagttaaatcggaagcgtcgtcgtcgccgccggtagtaacgtcgtcgtcgcattcgcgagcgccgtgtcaagcgggtgatctacgagatatgatatcgatgtatctaccgggtgcggaagtaccggaaccggcggcgccgtcgcgattacatatgtcgcaacattatcaatcgggtccggtaccgggtacggcgataaatggtacgttaccgttatcgcatatg

SEQ ID NO: 19801 - DNA, 951 bp, Artificial Sequence
  Description of Artificial Sequence: Synthetic coding sequence
atgtacaatatgatggagactgagctgaaacccccagggccacagcagacttcaggaggtgggggcggaaactcaactgcggcagccgccggagggaaccagaagaactctcctgaccgagtgaaacgcccaatgaacgcttttatggtttggagtaggggccagagaaggaaaatggcccaggaaaatccaaagatgcataatagcgaaatttccaagagactaggagcagagtggaagctcctgagcgagacagagaaacgaccttttatcgacgaggcgaagcggctacgagcactacatatgaaggaacaccctgactataagtaccgcccacgtcggaagaccaaaaccttaatgaaaaaagacaaatatactctgccgggcggtctgctcgctccgggagggaattcaatggcctctggagtcggagtgggcgcagggttgggcgccggggtcaatcagcgtatggacagctacgctcacatgaatgggtggtccaacggatcttatagcatgatgcaggatcaattaggatacccacaacaccctggccttaatgcacatggggcggcccaaatgcagcccatgcatcgatatgacgtatccgcccttcagtacaatagcatgacttcctcacaaacctacatgaacggcagtccaacatattccatgtcttacagccagcaggggacacctgggatggctttaggaagtatggggtcagttgttaaaagcgaggcaagtagttctcctcctgtggtgacttcctcttcacatagccgggccccctgccaggcaggcgacttgagggatatgatcagcatgtatctgcccggggcagaggttcctgagcccgctgccccttcccggttgcacatgtcgcagcactatcagagtggtcccgtgcctgggactgccataaacggcaccctaccgctctcacatatg

SEQ ID NO: 19802 - DNA, 951 bp, Artificial Sequence
  Description of Artificial Sequence: Synthetic coding sequence
atgtacaacatgatggagactgagcttaagccgcctggaccgcaacagacttcaggaggtgggggcggaaattcaaccgccgcagcggccggcggcaaccagaaaaactcccccgatcgggtgaagcggcctatgaatgccttcatggtgtggagtcgggggcagaggcgcaagatggcgcaagaaaatccaaagatgcacaactcggagatctcaaagcgcctcggagcagagtggaagctgctgtccgaaaccgagaagcggccgtttatagacgaagccaaacggctgagagccctgcacatgaaagaacaccccgattacaaataccgccccagacgtaagaccaagaccctgatgaaaaaggataagtacaccctcccaggcggcctcttggccccggggggaaactcgatggcttcgggcgtcggtgtgggtgcaggactcggagccggagtcaaccagaggatggacagctacgcacatatgaatggttggtcgaacggatcgtacagcatgatgcaagaccagcttggttacccccaacacccgggcctgaacgcgcatggagccgctcaaatgcagccgatgcataggtacgacgtttccgcgctgcaatacaactcgatgacctcatcgcaaacttatatgaatggatcgccgacctattcaatgtcctacagtcaacagggaacgccggggatggctctgggttctatggggtcggtggtgaagtcggaggcatcatcctcaccacccgtggtgactagcagctctcactcgcgagcaccatgtcaggcaggagatctgagggacatgatctcaatgtacctcccgggcgcggaagtcccggaaccggcggccccttcacggttgcatatgagccagcactaccagtcgggacctgttccgggaacggccattaatggaactctcccactctcacacatg

SEQ ID NO: 19803 - DNA, 951 bp, Artificial Sequence
  Description of Artificial Sequence: Synthetic coding sequence
atgtacaacatgatggaaacagagctcaagcctcctggaccgcaacagacctccggcgggggtggcggtaactcgaccgctgcagccgcaggggggaaccagaagaattcccctgatagggtgaagcggcccatgaatgcatttatggtatggtctagggggcaacggcggaagatggctcaagaaaaccccaaaatgcacaattccgagatcagcaaacgcctcggcgcagaatggaagctgctctcagagacggagaaaaggccctttattgatgaagccaaacgacttagagcactgcacatgaaagagcaccccgactacaaatacagacctagaaggaaaactaaaacactcatgaagaaagacaaatacacactgccaggcggactgctcgccccaggcgggaactcaatggcttccggggttggggtgggggccggcctaggagccggggtaaaccaaaggatggacagttacgcacacatgaatggttggtcaaacggttcttacagtatgatgcaggaccagctgggctacccccagcatccaggccttaatgcgcacggagcggctcaaatgcagcctatgcatcggtacgatgtgtcagcattacagtacaattctatgactagttcccaaacttatatgaatggttctcctacatatagtatgtcctactcccaacaggggacacctggcatggctcttggatccatgggcagcgtggtcaagtcagaggccagctcttcccccccagttgtgacttcaagctctcactccagagcaccatgccaagccggcgatctgcgggacatgattagtatgtacctacctggggcagaagttccagaacccgctgccccttcccgcctgcacatgagccagcattaccagtctggtccagtgccagggaccgctatcaatggcaccctgcccctgtctcatatg

SEQ ID NO: 19804 - DNA, 951 bp, Artificial Sequence
  Description of Artificial Sequence: Synthetic coding sequence
atgtacaatatgatggaaaccgagctcaagccgcccggaccgcaacaaacctcgggagggggaggaggcaactcaaccgcggccgctgcgggtggaaaccagaagaattcaccggatcgggtgaaaagaccgatgaatgctttcatggtgtggtcccggggacagcgcagaaagatggcccaagaaaatccaaagatgcataattcggagattagcaagcggctcggagcagagtggaagctcctgtcggaaactgaaaaacggcctttcattgacgaagcgaagcgcctgagggctctccacatgaaagaacacccggactataagtaccggccgcggaggaaaactaagaccctcatgaaaaaagacaagtacaccctgccaggaggactcctcgccccgggtggaaattcgatggcgtcaggagtcggtgtcggagcggggttgggggccggtgttaaccaacgcatggactcttacgcccatatgaacggatggtccaacgggagctactcaatgatgcaagatcaacttgggtacccgcagcatccgggactgaacgcgcacggcgccgcccagatgcagcctatgcaccggtatgatgtctccgcgcttcagtacaattcgatgacctcatcacagacctacatgaacggatcgccaacttactcgatgtcctacagccaacaagggacccctggaatggcactgggatccatgggatccgtggtgaaatccgaggcctctagctcgccacctgttgtgacctccagctcgcactccagagccccgtgccaggctggcgacctgagggatatgatttcgatgtacctgccaggagctgaagtgcccgaaccggcagcaccgtcacgcctgcatatgtcccaacactaccagagcggtccggtgcctggtaccgccatcaatggcaccttgccgcttagccatatg

SEQ ID NO: 19805 - DNA, 951 bp, Artificial Sequence
  Description of Artificial Sequence: Synthetic coding sequence
atgtataatatgatggagacagaacttaaacctcctggaccacaacaaacttcagggggaggtggaggaaattcaacagctgcagcagcaggtggaaatcaaaagaattctcctgatagagttaaacgaccaatgaatgcatttatggtttggtcaagaggacaaagaagaaagatggctcaagaaaatccaaaaatgcataattctgaaattagtaaaagattaggagctgaatggaaattattatcagaaacagaaaaaaggccatttattgatgaagctaaaagacttagagcacttcatatgaaagaacatccagattataaatatcgtcctcgtagaaaaactaaaactttaatgaaaaaagataagtatacattaccaggtggtttattagcaccaggaggaaactctatggcatcaggtgttggagtaggtgctggtttgggagctggagttaatcaaagaatggactcttatgcacatatgaatggatggtcaaatggatcttattccatgatgcaagatcaactaggatatccacaacacccaggtttaaatgctcatggagctgcacaaatgcaaccaatgcatcgttatgatgtatcagcacttcaatataattcaatgactagtagtcaaacatatatgaatggatcaccaacatatagtatgtcttattcacaacaaggaactccaggaatggcattaggatctatgggatcagttgttaaatcagaagctagttcttccccacctgttgtaacctcatcatctcatagtcgagctccatgtcaagcaggagatttaagagatatgatttctatgtatttaccaggagctgaagtaccagaaccagcagctccttcacgacttcatatgtcacaacattaccaatctggacctgtaccaggaactgcaattaatggtactcttccattatcacatatg

SEQ ID NO: 19806 - DNA, 951 bp, Artificial Sequence
  Description of Artificial Sequence: Synthetic coding sequence
atgtacaatatgatggaaactgaactgaagccgccaggaccacagcagacgtcgggcggtggcggaggaaacagcaccgcggctgcagctggaggcaaccagaaaaactccccggacagggtgaaacggccaatgaacgcattcatggtgtggtcacgcggccagagacgcaagatggctcaggaaaatcctaagatgcacaacagcgaaatctcgaagcggttgggagcagaatggaagctgctgtcagaaactgaaaagaggccgtttatcgacgaagcgaagcggctccgggctctccacatgaaggaacacccggattacaaataccggccacgccggaaaactaagacgcttatgaagaaggacaagtacactctgccagggggactgcttgcgccgggtgggaactcgatggcgagcggagtcggagtgggagcggggctgggagctggagtcaatcagcgcatggactcctacgcccacatgaatgggtggagcaatggaagctacagcatgatgcaggaccagttgggctacccgcagcatccgggactgaacgcgcatggagccgcccagatgcaacctatgcaccggtacgacgtctcagcgcttcagtacaattcaatgaccagctcgcagacttatatgaacggatccccgacgtactcgatgtcatactcccagcagggtacgccaggtatggccctgggatcaatgggatcggtggtcaaatcagaggccagctcgtcgccacctgtggtgacttcctcatcccactctcgcgccccgtgccaggccggggatctgcgagatatgatctcaatgtacctcccgggagcggaggtgccagagccagcagctccctcccgcctgcatatgagccaacattaccagagcggacctgttccgggaaccgcgattaacgggaccctcccgttgtcgcacatg

SEQ ID NO: 19807 - DNA, 951 bp, Artificial Sequence
  Description of Artificial Sequence: Synthetic coding sequence
atgtataacatgatggaaaccgagctgaagccgccgggaccgcagcagacgtctggaggaggagggggcaactccaccgcggctgccgcgggcggaaaccagaagaatagccctgacagagtgaagcggccgatgaatgcgttcatggtgtggagccgggggcagcgccgcaaaatggcacaggaaaacccaaagatgcacaactcagagatttcaaagcggctgggagcagaatggaaacttctgagtgagacggaaaaacggccgttcattgatgaggcgaaacgactccgggcgctgcatatgaaggaacaccctgactacaaatacaggccacgccgtaagacgaaaactcttatgaagaaagataagtacaccttgccaggaggcctgttggcacctggcggaaattccatggcgtccggcgtgggtgtgggagccggactcggagctggagtgaaccagcgcatggattcatacgcgcacatgaatggttggtccaacggatcgtactcgatgatgcaagaccaactcggataccctcagcatccggggcttaacgctcatggtgcggcccagatgcaaccaatgcaccgctacgatgtgtccgctcttcagtacaatagcatgacttcctcacagacgtacatgaacggatcgcctacgtactcaatgtcctacagccaacagggaacccccggaatggctctcggatcgatgggttcagtcgtcaagagcgaagcatcctcctcaccgccggtggtgacctcgagctcccattccagggccccttgccaagccggcgatttgagagacatgatctcaatgtatctgcccggagcggaagtcccggagccagcagcaccatcacggctccacatgtcgcaacactaccagtccggaccggtgccgggcactgcgatcaatggaaccctgccgctctcgcatatg

SEQ ID NO: 19808 - DNA, 951 bp, Artificial Sequence
  Description of Artificial Sequence: Synthetic coding sequence
atgtataacatgatggagacggaacttaaacctcccggtccacagcagacttccggaggaggtgggggaaattctaccgccgcagccgctggggggaaccaaaagaacagccctgaccgagtgaagcgaccgatgaatgccttcatggtgtggagtcgcggtcaaaggaggaaaatggctcaggagaatccaaagatgcacaattcggaaatatccaagcgtttaggcgccgaatggaaactgttatccgagacagagaagagacctttcatcgacgaggccaaaagactccgagccctgcacatgaaggagcatcctgactataagtataggcctcgaagaaagacaaagacacttatgaaaaaggataaatataccctccccggtgggctcttagcccccggcggtaactccatggcctccggtgtgggcgttggggccggcctgggagctggggtcaatcaacggatggacagctacgcacatatgaacggatggtctaacggttcatacagcatgatgcaagaccagctaggttatccccaacatccaggcctcaacgcccatggagcagcacagatgcagccgatgcatagatacgatgtatcagcactccagtataattccatgacaagctcacaaacttatatgaacggctctccgacctactcgatgtcttattcacaacagggcacccctgggatggcgctgggctctatgggcagcgtagtgaagagcgaggcctccagcagtcccccagttgtgacaagttctagccatagtcgcgccccttgtcaggctggcgatctcagggatatgatcagcatgtacctgccaggcgcggaagtgccagagcccgcggcaccatcacgacttcacatgtctcagcactaccagagtggaccggtgccagggactgccatcaatggaaccctgccacttagccatatg

SEQ ID NO: 19809 - DNA, 951 bp, Artificial Sequence
  Description of Artificial Sequence: Synthetic coding sequence
atgtataatatgatggaaaccgaactgaaaccccctggccctcagcaaacatctggtgggggagggggcaactcaacggcggccgctgcggggggaaaccagaagaattcccccgacagagtcaagagacctatgaacgctttcatggtgtggagccgggggcagcgtaggaagatggcacaggagaatcctaagatgcacaattccgaaatctcgaagagactgggcgctgagtggaagctgctctccgaaactgagaagcgccccttcatcgacgaagccaaaaggctgcgggcactgcacatgaaggagcaccccgattacaagtatcggccaaggaggaaaactaagactctgatgaaaaaagacaagtacacactacccggcggcctccttgccccagggggtaatagtatggcctccggggtcggtgtgggagccggactcggcgccggggttaatcagcgcatggattcatatgcccacatgaatggatggtctaatggatcgtacagcatgatgcaggaccaactgggttatccacaacaccctggcctcaacgctcatggcgcagcacagatgcagccgatgcacaggtacgacgtgtccgcgttgcagtacaacagtatgacaagttcccaaacctacatgaatgggtctccaacttactcaatgtcctatagccagcagggaactcccggaatggccctggggagcatgggcagtgtggtgaaatccgaagccagcagcagcccccccgttgtgaccagtagcagccactctcgggcaccctgccaggcgggggacctacgagatatgatcagcatgtatctgcccggcgcggaggtacccgagcccgccgccccgtctcggttgcatatgtcccagcattaccagtctgggcccgttccaggcacggccatcaacggcaccctgccactgagccatatg

SEQ ID NO: 19810 - DNA, 951 bp, Artificial Sequence
  Description of Artificial Sequence: Synthetic coding sequence
atgtacaacatgatggaaacagagcttaagcccccggggccccagcagacctccggtggcgggggcggaaattccacagcagccgccgctgggggaaatcaaaaaaactctccggatagagtgaaaaggccaatgaacgcattcatggtgtggtccaggggacagcgacgcaagatggcccaggaaaacccaaagatgcataacagtgaaatcagcaaacgacttggcgctgagtggaagctgctctcagagacggagaagagaccatttattgacgaggcaaagagactccgggctcttcacatgaaagagcatcctgattataagtaccgcccgcgccgaaagacaaaaactctgatgaagaaggacaaatacaccctccccggagggctgctggctcccgggggaaatagcatggcctcaggggttggggtgggggctggactgggcgccggcgtcaaccagagaatggacagctacgctcacatgaacgggtggagcaatgggtcatactctatgatgcaggaccagctgggctacccccagcacccaggcttgaacgcccatggggcagcccaaatgcaacccatgcacagatacgacgtgagcgcacttcagtacaactccatgacgtcctcacagacatacatgaacggctcccccacgtacagtatgtcatactctcagcaggggacgcccgggatggccctgggcagcatgggatccgtcgtcaagtccgaggccagttcttcaccccccgtggtaacaagtagttctcacagcagggccccttgtcaagcaggagacctccgcgatatgatctcaatgtatctgcccggcgcagaagttccagaacctgctgcgccctcccggctccatatgtcacagcattatcaatctgggcctgttccaggcaccgccatcaatggtactctgccccttagtcacatg

SEQ ID NO: 19811 - DNA, 951 bp, Artificial Sequence
  Description of Artificial Sequence: Synthetic coding sequence
atgtacaatatgatggaaactgagcttaagcctcccggccctcagcagaccagtgggggagggggcggtaatagtaccgccgccgccgccggcggcaaccaaaagaatagccccgaccgtgttaagaggccgatgaatgcgttcatggtgtggagtagggggcagaggcgaaagatggcccaggagaatccaaagatgcacaattccgaaatctcaaagaggttgggggccgagtggaagctactcagcgagacagagaagaggccatttatcgacgaggctaagcgactgagggccctacacatgaaggaacaccccgactacaaatacagaccacgtcggaagacaaagacacttatgaagaaagataagtataccttgcccggcggactgctggcccccggaggtaacagcatggcttccggcgtcggagtaggggccggacttggcgccggcgtgaatcagcggatggattcttacgctcatatgaacggatggtccaatggatcctacagcatgatgcaggatcagctggggtacccccagcaccccggtctaaacgctcatggagccgcgcagatgcagccaatgcacagatatgacgtttccgctctgcagtataactctatgacctcttcacaaacatacatgaatggctctcctacctacagtatgagctatagtcaacaggggacacccggaatggcgctggggagtatgggaagcgtggtgaagagcgaggccagctccagtcctcctgttgtgacgtcctcctcacattcacgtgccccctgccaggcaggcgatctgcgtgatatgatttccatgtatctgcccggtgccgaggttccagagcctgccgccccatcgcggttgcatatgagtcagcattaccagagtgggcccgtaccaggaacggcaatcaacggaaccctgccattatcacacatg

SEQ ID NO: 19812 - DNA, 951 bp, Artificial Sequence
  Description of Artificial Sequence: Synthetic coding sequence
atgtacaatatgatggaaacagaactaaagcccccggggccacagcagacatcaggaggcggcggcggcaactctacagcagcagccgccggggggaaccagaaaaattcacctgatcgagtgaagagaccaatgaacgcattcatggtatggtcacgggggcagagacggaagatggcccaggaaaaccccaagatgcacaattccgaaatctccaaacggttgggcgctgagtggaagctgttaagtgagaccgaaaagcggccctttatcgacgaggcgaaacgtctgagagccttgcacatgaaagaacatcctgattataaatacagaccgagacgaaaaacaaagaccttgatgaaaaaagacaaatacactctacctggcggcctactcgcccccggaggtaatagcatggcatcgggcgtgggggttggcgcaggcctgggggccggcgtgaaccagagaatggacagctacgcacacatgaatgggtggtccaatggtagttatagcatgatgcaggaccagcttggttatcctcaacatccaggtctgaacgctcacggggcagcgcaaatgcagccaatgcatagatatgacgtttcggccctccaatacaatagcatgacaagttcccagacgtacatgaatgggtcccctacatattctatgtcttacagtcagcagggtacccctggaatggccctgggctccatggggtccgtcgtcaaatcagaggcaagtagcagcccccctgttgtgacctctagcagccactcccgcgcaccttgccaggcgggtgatctgcgagacatgatttccatgtatctgccaggcgcagaggtgccagaaccagctgctccttctaggctccacatgagccagcactatcagtcaggacccgttccgggtaccgcaattaatgggaccctgcccttgtcgcacatg

SEQ ID NO: 19813 - DNA, 951 bp, Artificial Sequence
  Description of Artificial Sequence: Synthetic coding sequence
atgtacaatatgatggagacggaattgaagccaccaggccctcagcagacttcaggagggggaggagggaattcaactgccgcagcggccgggggcaaccagaaaaactcgccggacagagtcaagcgcccgatgaatgctttcatggtgtggtcccggggacagcgccgcaagatggcccaggaaaacccaaagatgcacaactcagagatcagcaaacgcctcggagcagaatggaagctgctcagcgagactgaaaagaggcccttcatcgatgaggcaaagagactgcgcgctttgcacatgaaggaacaccccgactacaagtacaggccgcgccggaaaacgaaaaccctcatgaaaaaggacaagtacaccctgccgggaggtcttttggccccgggtggaaattccatggcctcgggagtgggagttggtgccggactgggagctggagtgaaccaacgcatggattcatacgcgcacatgaatggatggtcgaacggttcatactcaatgatgcaagatcagctgggctaccctcagcatcctggactgaacgctcacggagcggcgcagatgcagccgatgcaccggtacgatgtctcagccttgcagtacaactcgatgaccagctcacaaacgtatatgaatggctcgccgacttattcgatgtcgtacagccaacaaggaaccccgggaatggcgttgggatcaatgggctcggtggtgaagagcgaggcgtcatcatccccacctgtggtgactagctcctcgcacagccgcgcaccgtgccaggctggcgaccttagggatatgatctcaatgtacttgccgggagccgaagtgccagaacctgcggcgccatcccggctgcatatgtcccagcactaccagtcaggaccggtgccgggaaccgccatcaatggcactcttccgctctcgcatatg

SEQ ID NO: 19814 - DNA, 951 bp, Artificial Sequence
  Description of Artificial Sequence: Synthetic coding sequence
atgtacaacatgatggaaaccgagctcaagccacccggaccacagcagacaagtggcgggggaggtggaaactcgacagccgccgccgcgggaggcaatcagaagaattctcccgatcgggttaagcggccgatgaacgcttttatggtgtggtccaggggacagaggagaaagatggcgcaggagaatccaaaaatgcacaacagcgagataagcaaaaggttaggcgccgaatggaagttactctccgaaactgaaaaaagacctttcattgatgaggcaaagcgactacgagctctgcatatgaaggaacacccagattataaatatagacctcgccgtaagaccaagacactcatgaagaaggataagtataccttacctgggggcttgcttgccccaggggggaacagcatggccagtggagtgggggttggtgccgggctgggtgcaggagtgaaccagcgaatggactcgtatgcgcacatgaacggttggagtaacggctcctactctatgatgcaggaccagctggggtaccctcagcatcccgggctgaacgcacacggcgctgcacaaatgcagcccatgcatcgctatgacgtgtccgcgcttcagtataattctatgacttctagccagacatacatgaatggaagcccaacatattcgatgagttattcccaacagggtaccccaggcatggcgctgggttctatgggctcagtcgtgaaatcggaagcttcaagcagcccaccggtggtgacaagcagtagccactcacgggccccctgccaagccggggatctccgagatatgatatcaatgtacctgccaggagcggaagtgccagagcccgcagctccctctcgccttcacatgtcacagcactaccaatccgggcctgtcccaggaactgccatcaatgggactctgcccctatcgcacatg

SEQ ID NO: 19815 - DNA, 951 bp, Artificial Sequence
  Description of Artificial Sequence: Synthetic coding sequence
atgtataacatgatggaaacagaactcaagccaccagggccacagcagacatctggaggagggggggggaattccactgcagccgcagctgggggaaatcagaaaaatagtcccgaccgggtaaagcgccccatgaatgccttcatggtttggagtcggggacagcgaagaaagatggcccaggagaaccctaaaatgcacaactctgagatatcaaaaagactcggggctgaatggaaactattatcagaaacagaaaaacgcccctttattgatgaagcaaagaggctgcgagccctacatatgaaagagcatccagattacaagtaccggcccaggaggaaaactaagactctcatgaagaaagataaatatacacttccaggagggctactggcccctgggggaaactctatggcaagtggagttggggttggggccggactaggagccggggtgaaccagaggatggatagttatgcacatatgaacgggtggagtaatggaagttactctatgatgcaggatcagcttggatacccacaacatcctgggctcaatgcccatggggccgcccaaatgcagcccatgcacagatacgatgtctccgctctacagtataatagtatgacgagttctcagacatatatgaacggatctcccacatacagtatgtcgtactctcagcagggaacacccggaatggccctcgggtccatgggatctgttgtcaaatcagaagccagttcctccccccccgtggtgacttcatcttctcacagtcgagccccttgtcaggctggagatttaagggatatgatttccatgtatcttcctggagctgaggttcccgagccagctgcgccaagtcggttgcacatgtcacagcactaccagagtggacccgtgcccggaactgccataaatggaacacttccattatctcacatg

SEQ ID NO: 19816 - DNA, 951 bp, Artificial Sequence
  Description of Artificial Sequence: Synthetic coding sequence
atgtacaatatgatggaaactgaactgaagcctcccggacctcagcagactagcggtggaggtggaggaaactctaccgctgccgcagcaggcggcaatcaaaagaacagccctgaccgcgtgaaacggcctatgaatgcatttatggtgtggtcccgcggacaacggagaaagatggcgcaggagaaccccaagatgcataactccgagatctcaaagcggttgggggcagaatggaaacttctgtccgaaaccgaaaaaagaccctttattgatgaggccaagcggctgcgagcactccatatgaaagaacatcctgactataagtacagacctcgccgcaagactaagactctcatgaaaaaagacaagtacacccttcccggcggcctgctggcaccagggggaaattcgatggcctcgggagtgggagtcggagccggactcggtgcgggagtgaaccagagaatggacagctacgcacacatgaacggatggtccaacggctcctattccatgatgcaagaccaacttggttacccgcagcaccctggacttaatgcccacggagcagcccagatgcaaccaatgcatagatacgacgtctccgccttgcaatacaattcaatgacctcaagccagacttacatgaacgggtcgccgacctatagtatgtcgtactcgcagcaggggacccctgggatggccctggggtcgatgggctcagtggtgaagagcgaggcctcatcaagccctcctgtcgtgactagctcatcgcatagcagagcaccatgtcaagcaggcgacttgagagacatgatttcgatgtacctgcccggagccgaggtgccagaaccagcggcaccttccagactgcacatgtcccaacattaccagtcgggtccagtgcctggaaccgcgatcaacggaacccttcccctttcgcatatg

SEQ ID NO: 19817 - DNA, 951 bp, Artificial Sequence
  Description of Artificial Sequence: Synthetic coding sequence
atgtacaacatgatggagaccgagttgaaaccccctggaccgcagcagaccagcggcggcggtggtggtaattcaacggccgctgcagctgggggtaaccagaagaactctccagatcgggtcaaacgtcccatgaatgccttcatggtttggagcaggggccagaggcgaaagatggcccaggaaaatccaaagatgcataactcggaaattagcaagcggttgggggccgagtggaagctgctgtcagaaacggaaaagaggccatttattgacgaggccaagagactgcgggccttgcatatgaaagagcaccctgactacaagtacaggcctcgccgcaaaactaaaaccctgatgaaaaaagataagtacaccctgcccggaggcctgctggctccaggcgggaacagcatggctagcggcgtcggcgtgggcgcaggtctcggagcgggagtcaaccagcgcatggacagctacgcgcacatgaacggatggagcaacggttcatacagcatgatgcaggaccagctgggctatccccagcaccccgggctgaacgctcacggcgccgctcagatgcagccgatgcaccgatacgacgtttctgctctccagtataactccatgacgtcaagccaaacctatatgaacggcagtcctacctactccatgagctatagccagcagggtacgccaggcatggctcttggatccatgggctccgtcgtgaagagtgaagcttctagtagcccacccgtcgtgacatcatcctcacacagtagggctccctgtcaggccggagacctgcgagatatgattagcatgtatctccccggcgccgaagtcccagagccagcagcgccctctcgcctgcacatgagccagcattatcagtccggaccggtcccagggacggcaataaacggcacattgcccctctcgcatatg

SEQ ID NO: 19818 - DNA, 951 bp, Artificial Sequence
  Description of Artificial Sequence: Synthetic coding sequence
atgtataatatgatggagacagagctgaaaccgccaggacctcagcagaccagtgggggcggcggtggcaacagtactgccgcagcagcaggaggaaaccagaaaaattcgccagaccgggtgaaacggcctatgaacgccttcatggtgtggtccagaggacagaggcgtaaaatggcacaggagaaccctaagatgcataatagcgaaatatcaaaaaggctgggagcagagtggaagctgctctctgaaacagagaagagacccttcattgacgaagcaaagcgtctaagggccctgcatatgaaggaacacccagattacaaatacaggccaagacgtaagactaaaactctcatgaaaaaagataagtatactctacccggcgggctgctggcaccgggggggaatagcatggctagtggggtgggagtgggtgctggtctcggcgcaggtgtcaatcagcggatggattcttatgcccacatgaacgggtggagcaacggaagttatagcatgatgcaggatcagctggggtacccccagcacccgggcctcaatgcacatggggccgcccagatgcagccaatgcaccgttatgacgttagtgccttgcagtataactctatgaccagctctcagacctatatgaatggatcgcccacctactcaatgagttactctcaacagggaacacctgggatggctctgggttcgatgggctccgttgtgaagtcggaagcctcaagcagtcccccggtggtaacttcctctagccattctcgggccccatgccaggcaggcgaccttagagatatgatatcaatgtatctgcccggtgccgaggtgccagaacccgctgcgccttccaggttacacatgagccagcactaccagagtggcccagtcccgggcacggccattaatgggacattaccactgtcacacatg

SEQ ID NO: 19819 - DNA, 951 bp, Artificial Sequence
  Description of Artificial Sequence: Synthetic coding sequence
atgtataatatgatggagacagaattgaagcctccaggtcctcagcaaacttccgggggcggaggaggaaactctactgccgcagctgccggaggcaatcagaaaaactccccggaccgcgtgaagagaccgatgaacgctttcatggtgtggtcacggggccagcggcggaaaatggcccaggagaaccctaaaatgcacaactcagagatctcgaaacggctcggagcggagtggaagctgctctcagaaacagagaagaggcccttcatcgatgaggccaagcgactgcgagcactccacatgaaagaacaccctgactataagtaccggccaaggagaaaaacaaagactctgatgaagaaggacaaatacactctgccgggcggcctcctggcaccaggaggcaattctatggcttccggagtgggcgtcggcgccggcctaggcgctggagtaaatcaaagaatggattcttacgcccacatgaatgggtggtccaatggcagttattccatgatgcaggatcaactcggttatccacagcatccgggcttgaacgctcacggcgctgcacagatgcagcccatgcacagatacgacgtcagtgctctacagtacaactcaatgaccagcagtcaaacgtacatgaatggttcacccacgtatagcatgtcctactcacagcagggcacacccggcatggctctgggctctatgggaagtgtcgtcaagtcagaagcatccagctcccccccggtcgtaacatctagttcccactcccgcgctccctgtcaagccggcgatttacgggatatgatctctatgtacctgcccggagcggaggttccggagcccgcagccccgtctaggctccacatgagtcagcactaccagtccggccccgtgccaggaacagccatcaatggtacattacccctgtcacacatg

SEQ ID NO: 19820 - DNA, 951 bp, Artificial Sequence
  Description of Artificial Sequence: Synthetic coding sequence
atgtataacatgatggagaccgagctgaaacctcctggcccacagcagacttctggaggcggaggcggcaacagcaccgcagctgcagcaggggggaaccagaagaattccccggacagagtgaaacgtcccatgaatgcatttatggtctggagtagaggacagcggcggaaaatggcacaagagaatccaaagatgcacaactctgagatttctaaaaggcttggggctgagtggaagctgctgtccgagacagagaaaaggccctttatcgatgaggctaagaggcttagagctcttcacatgaaagaacatccagactacaaatatagacctcggaggaagaccaagaccctgatgaagaaggataaatacacattgccaggaggactgctggcccccggcggcaattcaatggcaagtggcgttggcgtgggcgctgggctaggtgcaggcgtcaaccagcgcatggattcatacgcccatatgaatggatggagtaacggctcttacagtatgatgcaggaccagctgggctacccccaacatcctggcctgaatgctcatggcgccgctcagatgcagccaatgcataggtacgacgttagcgccctccagtacaacagcatgactagctcccagacctacatgaatggcagcccaacatattccatgagctactcacagcaaggaacaccaggcatggccctgggcagcatgggatcagtggttaagtctgaggcctccagctccccccccgtcgtcacttctagttcccattcacgcgccccatgtcaggctggcgacctacgcgacatgatatctatgtatctccctggtgccgaggtgccagaacctgcagctcctagtagactgcacatgagccagcactaccaatccggccccgtgcctggcacagccataaacggcaccctgcctctcagccatatg

SEQ ID NO: 19821 - DNA, 951 bp, Artificial Sequence
  Description of Artificial Sequence: Synthetic coding sequence
atgtacaacatgatggagactgaattgaagcccccaggtccacagcaaacaagtggtggcggcggaggtaatagcactgctgcagccgcaggcggaaaccagaagaactctccagatagagtgaagaggcccatgaacgcttttatggtgtggtctaggggacagcgccgcaagatggcacaggagaaccccaagatgcacaactcagagatcagcaagcgcttgggtgctgagtggaagcttctgtccgagactgaaaaaagaccttttatagacgaggcgaagcgcctgcgcgcgctgcacatgaaggagcaccctgattacaaatacaggccgagacgcaagacgaaaacccttatgaagaaggataagtataccttgcctggaggcctgctggccccaggcggaaatagcatggcttctggcgtgggcgtcggagccggtctcggcgcgggcgtcaaccagcgcatggactcctatgcgcatatgaatggctggtccaatggctcctactctatgatgcaggatcagctcggatacccccagcaccctggactgaatgctcacggagccgctcaaatgcaaccaatgcaccgctacgatgtcagcgctcttcaatataattccatgacctcttcccagacgtatatgaacggaagtcccacctattctatgtcttactcccaacagggtacaccgggtatggcccttggatcaatgggtagtgtcgtgaaatccgaggccagctcttcaccccccgtagtgacaagttccagccatagcagggcaccatgccaggccggtgacctccgcgacatgatttctatgtatctccccggagcagaagtacccgagcccgctgcgcctagccgcctgcacatgtcacaacactaccaaagcggacccgtgcccggaacagcaatcaacggaaccctgcccctctcacacatg

SEQ ID NO: 19822 - DNA, 951 bp, Artificial Sequence
  Description of Artificial Sequence: Synthetic coding sequence
atgtacaacatgatggaaaccgagctcaaaccccccggaccgcaacaaacctcgggaggtgggggagggaattccactgcagcagccgcaggcggaaatcagaagaactctcccgacagggtcaaaagaccaatgaacgcatttatggtatggagcagaggccagcgcagaaagatggcacaagaaaatccaaaaatgcataattccgaaatctccaagaggctcggtgcagaatggaaactgctgtcagaaactgaaaagcgccccttcattgatgaagccaaacgtctgcgggcactgcacatgaaggaacacccagattacaagtaccgaccgagacgcaagactaagactttgatgaaaaaggacaagtatacccttccgggaggcctcttggcccccgggggaaactcaatggcatctggagtgggagtgggagcaggactgggtgcgggtgttaaccaaagaatggattcgtacgcacatatgaacgggtggtccaacgggtcctactcgatgatgcaagatcagctgggatatccgcagcatcctggacttaacgcacatggagcggcgcagatgcagccaatgcacagatacgacgtgtcggcactgcagtacaactcgatgacttcgtcccagacgtacatgaacggatccccaacttacagcatgtcctacagccaacaaggtacccctggcatggcacttggctcaatgggatcagtggtgaagtcggaggcgtcgtcgtcgcctccagtcgtgacttcatcgtcacactcacgcgcaccctgtcaagccggggaccttcgcgacatgatctcgatgtacttgcctggagccgaggtcccggaacctgcggcgccctccagactgcatatgagccagcattaccagtccgggccagtgcctggtaccgccatcaacggaactctcccactctcccatatg

SEQ ID NO: 19823 - DNA, 951 bp, Artificial Sequence
  Description of Artificial Sequence: Synthetic coding sequence
atgtacaatatgatggaaactgaactcaagcccccgggcccacaacagacttcgggaggtggaggaggaaacagcaccgccgcagccgcaggtggaaatcagaagaactctcctgacagagtgaagcgtcctatgaatgcatttatggtgtggtcccggggacaaaggcgaaagatggcacaggaaaatcctaagatgcataacagcgaaattagcaaacgacttggagcagaatggaaacttctttcggaaactgaaaagcggccatttatcgatgaagcgaagcgtctccgggcactgcatatgaaagagcatcctgactacaagtaccgcccccgaagaaagactaaaactctcatgaagaaggataagtacaccctgcctggcggattgcttgcacctggaggcaactcaatggcctcgggagtgggagtgggagcgggtctgggtgccggggtgaaccaaagaatggactcctatgcacatatgaatggatggtcaaacgggtcgtactcgatgatgcaggatcaactgggatacccccaacaccctggtcttaatgcacatggagcggcacagatgcaaccaatgcatcgatacgatgtgtccgcacttcagtacaatagcatgaccagcagccagacttacatgaatggatctccaacctactccatgtcgtactcacaacaggggactcctgggatggcattgggttctatgggatcagtggtcaagtccgaggcttcatcatcgccacctgtcgtgacctcctcgtcgcattcgcgcgctccttgtcaggcaggtgatctgcgtgacatgatttcgatgtacctgccgggagccgaagtgcccgaacctgctgcaccatcgcgccttcacatgtcgcagcactaccaaagcggtcctgtgccaggcactgcaattaacggaactctgccactcagccatatg

SEQ ID NO: 19824 - DNA, 951 bp, Artificial Sequence
  Description of Artificial Sequence: Synthetic coding sequence
atgtacaacatgatggagactgagctgaagcctcccggtcctcaacaaactagtggcggcggaggcggtaactctactgccgcggcagccggaggtaaccagaagaattcgcctgaccgagtcaaaagaccgatgaatgccttcatggtatggtcacgaggacagcgtagaaagatggcccaggaaaacccgaagatgcacaattcagagatctctaaaagattgggagctgagtggaaactgttgtcagagaccgagaagagacctttcatcgatgaggctaaacgactaagggccctgcacatgaaagagcaccctgattataagtacagacctaggaggaagaccaagaccttaatgaaaaaggataaatacacactgcccggaggactgctcgcccctggtgggaactctatggcctcgggcgtgggcgtgggcgccgggttgggagccggagtgaaccaacgaatggattcttatgcccacatgaatgggtggagcaacggcagttattctatgatgcaggatcaacttggatatccccagcaccccggactcaacgcacacggagcagcccagatgcagcctatgcatcgttacgatgtttctgccctacagtataactcaatgaccagcagtcagacatacatgaacggctctccaacctactctatgagctatagccagcagggcacccccggcatggcattgggctccatgggttccgtagtgaagagcgaggcctcttccagccccccagtggtcacctcatcttcacactccagggccccatgccaggcaggagatctgcgggacatgatatccatgtatctgcccggggccgaagtgccagaaccggctgccccatcaagattgcacatgagccagcactaccagtccggccctgtgcctggtaccgccatcaacggtaccctgcctctgtcacacatg

SEQ ID NO: 19825 - DNA, 951 bp, Artificial Sequence
  Description of Artificial Sequence: Synthetic coding sequence
atgtacaatatgatggagaccgaacttaagccgccaggacctcaacagactagcggaggaggcggtggaaactccacggcagcggccgcaggcggcaaccagaagaattcaccggacagagttaagcgccctatgaacgcttttatggtttggagcagaggacaacgccgcaagatggctcaggaaaatccaaagatgcataatagcgaaatctcgaaacgcttaggtgcggaatggaaattgcttagtgagacagaaaaacgcccttttatcgatgaagctaagaggttgcgtgcacttcatatgaaagagcatcctgactataagtatcgtccacgtaggaaaacaaagaccctcatgaagaaagacaaatataccctgcctggggggctccttgctccaggcggcaattcaatggcatcgggggttggcgttggggcgggattaggagcgggggtcaatcaacgtatggacagttacgcccatatgaatggttggtccaatggttcatattccatgatgcaggatcagcttggttacccgcaacatccagggttaaatgctcatggcgctgcccaaatgcagccgatgcatagatacgatgtatcagcactgcaatataactctatgacgtcaagccagacatacatgaacggtagtccgacgtactcgatgtcatactcccagcagggaaccccgggaatggcacttggatccatgggaagcgtagtgaaatcggaggcctcctcttcaccgcctgtggtaacaagttccagccattcacgcgcaccatgtcaggccggtgacctacgcgatatgatctcaatgtacctcccgggcgctgaagttccggaacccgcggcaccgagtcggctccatatgtcacagcattatcaatcggggccggttccggggacagccatcaacggaacacttccattaagtcacatg

SEQ ID NO: 19826 - DNA, 951 bp, Artificial Sequence
  Description of Artificial Sequence: Synthetic coding sequence
atgtataacatgatggagactgaactgaagccccccggcccacagcagacttctggagggggaggtggtaattctacggccgcagccgccggggggaatcagaagaactcccccgaccgtgtgaagcgacccatgaacgccttcatggtctggtccaggggacagcgaaggaaaatggcgcaggagaaccctaagatgcacaactctgaaatctcaaaacggttgggcgcagaatggaaacttctatcagaaaccgagaagagaccctttatcgatgaggccaagaggctccgggcccttcatatgaaggaacacccggactacaagtatagacctagacggaagacaaagactctaatgaaaaaagataaatatacattgccagggggattgttggcccccgggggcaatagtatggcctcaggagtcggcgtcggcgcgggcttgggagcgggcgtgaaccaacgcatggacagctatgcacacatgaatggctggtcgaatggcagctactctatgatgcaggaccagctcgggtaccctcaacacccgggtctgaatgcacatggggctgcccagatgcaacccatgcataggtacgacgtttctgctctccagtacaattcaatgactagcagtcagacctacatgaatggttcacccacctactctatgtcttacagtcaacagggtacaccaggcatggcactgggaagcatggggtccgtcgtgaagtccgaggctagctcctccccaccggtcgtcacgagcagtagccattctagagccccatgccaggcaggagatctgcgagatatgatcagtatgtatctcccaggagccgaagtgcctgagcccgcagccccctcccgactccacatgtctcagcactaccagagcggtcccgtcccaggtaccgcaatcaatggcacccttccgctcagccacatg

SEQ ID NO: 19827 - DNA, 951 bp, Artificial Sequence
  Description of Artificial Sequence: Synthetic coding sequence
atgtacaacatgatggagactgagcttaagcctcccgggccccaacagactagtggcggcggaggagggaatagcacggcggccgccgccgggggcaatcagaaaaactctcctgaccgcgttaagcggcctatgaacgccttcatggtgtggagcagaggacagagacggaagatggcccaggaaaaccccaagatgcataatagcgagatatctaagaggctcggcgccgagtggaagctgctgtctgagacggaaaagagaccttttatagatgaggccaaacgcctccgcgctttgcacatgaaggagcatccggattacaagtatcgcccccggagaaaaacaaagaccctgatgaaaaaggacaagtatacactccctggcggcctgctggcccctgggggcaactcaatggcaagcggggtcggcgtgggggcaggtttgggcgcaggtgtcaaccaaaggatggatagttacgcccacatgaacggttggtccaatggttcctattccatgatgcaggaccagctgggatacccacagcatcctggtctgaatgctcatggggcagctcagatgcaacctatgcatcgatatgatgtctctgctctgcagtataacagcatgactagctcccagacctacatgaatggcagcccgacgtattcaatgtcttattcccaacaaggtactccaggaatggcactgggctcgatgggatccgtcgtgaagtcagaggcttcaagctcaccacccgtggtgacttccagcagccactcaagagctccgtgccaagctggggaccttcgggacatgatctcaatgtaccttcctggtgcagaggtgcccgaaccagctgccccctcccgcttacatatgtcgcagcactaccagtctgggccagttccaggaacggccatcaacggcacactcccccttagccacatg

SEQ ID NO: 19828 - DNA, 951 bp, Artificial Sequence
  Description of Artificial Sequence: Synthetic coding sequence
atgtacaatatgatggaaacagagctgaaaccgccaggaccacaacagactagcggcggcgggggtggaaattctaccgccgcagccgcaggtggcaatcagaagaactcacctgatagagtgaagcgcccaatgaatgcattcatggtttggtcgagagggcagcgcagaaagatggcccaggagaaccctaaaatgcacaactctgaaatcagcaagcgccttggcgccgagtggaaactgctcagcgaaactgagaagcgtccattcattgacgaagcaaaacgcctgcgagctctccacatgaaggagcaccccgattataagtaccgcccacgacgtaaaactaagaccttaatgaaaaaggacaagtacaccctgcctggcggactattagctccgggtggaaatagtatggcgtcgggcgtgggcgtgggcgctggactgggagcaggagtgaatcaacgcatggattcctatgcccatatgaacggttggtcaaacgggagctacagtatgatgcaggatcagctgggctatccgcagcatccaggcctgaacgcacacggcgccgcccaaatgcagcctatgcaccgatacgatgtttcagccctgcaatacaatagcatgacttcaagccagacctacatgaatgggagccctacttattccatgtcctacagccagcagggtacacctgggatggcactcggaagcatgggctctgtcgtgaaaagcgaggcttcctcttctcccccagtggtcacgtcttcatcccacagtcgagccccttgccaggctggggatctgagggatatgatttctatgtatctgcctggggccgaggtacccgagccagccgcgccctctaggctgcacatgtctcagcactatcaatcagggccagtgcccgggaccgccattaacggcaccttgcccctctctcatatg

SEQ ID NO: 19829 - DNA, 951 bp, Artificial Sequence
  Description of Artificial Sequence: Synthetic coding sequence
atgtataatatgatggagactgaactgaagccgcccggcccacaacagacgagcgggggaggggggggaaatagtacagctgctgctgccggaggtaatcagaaaaactcacccgacagggtcaaaagacctatgaacgccttcatggtctggtcccgcggccagcgtcgcaaaatggcccaggagaatccaaagatgcacaattcagaaatcagcaagcggctcggagccgagtggaagctgctgtctgaaactgaaaagcggccttttatcgacgaggcgaaacgtctcagggcgcttcacatgaaggaacatcctgattacaaataccggccacggcgtaagactaagacactgatgaagaaagacaaatatacactcccaggcgggttgctcgccccgggtggcaactccatggcctccggtgttggtgttggcgccggccttggcgccggcgttaaccagagaatggactcctatgcccacatgaatggctggtcgaatggatcatactccatgatgcaagaccagctgggctacccgcagcacccagggttgaatgcccatggtgccgcacaaatgcagcctatgcatagatacgatgtgagcgccctccagtataactcaatgacaagtagtcagacttacatgaatggtagccccacttacagtatgagctattcacagcaagggacccccggcatggcactaggtagcatgggctcagttgtgaaatcagaagcctcttctagtcctcccgtcgtgacttcatctagccactctagggcaccatgccaagcaggcgatctgcgggatatgatcagtatgtacttgcccggagctgaggtgcccgaacccgcagcaccctctaggctgcacatgtcccagcactatcaatccggcccagtccctgggaccgctataaacggcacactgcctctgtctcacatg

SEQ ID NO: 19830 - DNA, 951 bp, Artificial Sequence
  Description of Artificial Sequence: Synthetic coding sequence
atgtacaacatgatggaaactgagctcaagccgccgggaccacagcagacctcgggaggcggcggaggaaacagcactgccgccgctgccggcggaaaccaaaagaattcgcctgacagggtgaagcggcctatgaacgctttcatggtgtggagcagagggcagcggcgcaagatggcacaggaaaacccgaaaatgcacaactccgagatctcgaaacgcctcggagccgagtggaagctgttgagcgaaaccgaaaagcgcccatttatcgatgaggcgaagagactgcgcgccttgcacatgaaagaacacccggattacaagtaccggcctaggagaaagaccaagactctgatgaagaaagataagtacaccctgccgggaggattgctggcacctggaggtaactcaatggcatcaggagtgggtgtgggagcgggactcggcgcaggagtgaaccagcggatggattcctacgcgcacatgaatggttggtcgaacggatcatactcgatgatgcaggatcaactgggatacccgcagcatccgggactgaatgcgcatggcgccgcacaaatgcagccaatgcaccgctacgacgtgtccgccctgcaatacaacagcatgacgtcctcccagacctacatgaatggctcgccgacctactccatgtcgtactcacagcaaggcactccgggcatggctctcggcagtatgggaagcgtcgtgaaatcagaggctagctcgagccccccagtggttacctcctcatcccacagccgcgctccgtgtcaggccggcgaccttagagacatgatctcgatgtacctccctggggccgaggttcccgagccggcggccccgtcgcggctgcatatgagtcagcactaccaatccggcccagtgccgggaactgccattaacggcaccctgccactgtcccacatg

SEQ ID NO: 19831 - DNA, 951 bp, Artificial Sequence
  Description of Artificial Sequence: Synthetic coding sequence
atgtacaacatgatggagactgaattaaaacctcccgggccacagcagacttctggtggcggggggggaaattccacagcagctgcagcaggcggcaatcaaaaaaattctccagatagagtaaaacgtccaatgaacgcctttatggtctggtcaaggggccagcgacgaaagatggcgcaagagaaccccaagatgcataatagtgagatctcgaagcgactcggggctgagtggaagttattgtccgagaccgagaagaggccgtttattgacgaggccaaacgactcagagctctacacatgaaagaacatcctgactataaatatcgacctcgaaggaagactaaaactctcatgaaaaaagacaagtatacccttcccggcggattgcttgctcctggtggcaactctatggcaagcggtgttggagtgggcgccggcctcggggcaggtgtgaaccagagaatggattcttacgcccacatgaacggctggtccaacggctcctattcgatgatgcaggaccagctgggctacccgcagcacccaggtcttaatgcccatggcgccgcccagatgcagccgatgcacaggtatgatgtgtcagctctgcagtacaactctatgaccagctctcaaacctacatgaacggttcaccaacatactctatgagttattcacagcagggtacaccagggatggccttgggctcgatgggatcagttgtcaagtctgaagcttcctcgagccccccagtagtcaccagctcctcccactctcgagccccctgtcaagctggggacttgcgcgacatgatctcaatgtatctccccggcgcggaagtgcctgagcccgcagccccctcaaggttgcatatgtcacagcactatcagagcggccctgtgcctggtactgctatcaatggtacattaccactgtcccacatg

SEQ ID NO: 19832 - DNA, 951 bp, Artificial Sequence
  Description of Artificial Sequence: Synthetic coding sequence
atgtacaacatgatggagaccgagctaaagccccctggcccacagcagacctctggcggcggtggtggcaattccacagccgccgccgctggcggcaaccagaagaactcaccggatcgcgtcaagcgtcccatgaatgcattcatggtatggtcgagggggcaacgacgcaagatggctcaggagaatccgaagatgcacaactccgagatctccaaacggctgggtgccgagtggaagctgctctcagagactgagaagagaccgtttattgacgaggcaaagaggctgcgtgccctacacatgaaggagcaccccgactacaaatatcgaccgagacgaaaaacgaagaccctgatgaagaaggacaagtataccctaccgggaggcctgctagccccaggaggtaactccatggcctccggcgtcggcgtcggagccgggctgggcgcgggagtcaaccagcgtatggattcctacgcccacatgaacggctggtcgaacggatcctactccatgatgcaggaccagttgggatacccacagcaccctggtctgaatgcgcacggcgctgcacagatgcagcctatgcacagatacgatgtgagcgctttgcagtataattccatgacatcgagccagacatacatgaacggcagtcccacgtatagcatgtcttacagccagcagggcacgccgggaatggccctgggcagcatgggcagtgttgtgaagtcggaggcctccagctctccacccgtggtgaccagtagttcacactctagagctccttgtcaggccggagacctgcgggatatgattagcatgtatctgccaggtgctgaggtgccggagcccgcggccccgtcacgcttgcatatgagtcagcattatcaatctgggccggtgccaggaaccgccattaatggcactctgccgctgtcacatatg

SEQ ID NO: 19833 - DNA, 951 bp, Artificial Sequence
  Description of Artificial Sequence: Synthetic coding sequence
atgtataacatgatggaaacagagctgaaacctcccgggccccaacagacatcaggcggtggtgggggcaattctacggcggctgcagctgggggcaatcaaaaaaacagcccggacagggtgaaacggcccatgaatgcgttcatggtgtggtcacggggacaaagaaggaaaatggcgcaggagaatcctaaaatgcataactcagaaatctcaaaacgcttaggcgctgaatggaaactgctgtcagaaactgagaagcgtccattcatcgatgaggcaaagagacttagggcgttgcatatgaaggagcatccggactacaagtatcggccccggaggaagaccaaaaccctaatgaagaaagacaaatatacgctgcccggcggtctgctggccccaggtggaaacagtatggcctccggggtgggggtgggggccgggctgggtgctggggtcaatcagagaatggacagctatgctcatatgaatggctggagcaacggaagctacagtatgatgcaggaccagttgggatacccgcagcaccccggcctcaacgctcacggtgccgcgcagatgcagccaatgcataggtacgacgtatccgccctgcaatacaattcaatgactagttcccagacttacatgaatgggtcacctacttactcaatgagctattctcagcagggaacgcctgggatggcccttggatctatgggatctgtcgtaaagtctgaggccagctcaagtccccccgtcgtgacaagctcatctcattctcgagctccttgtcaggccggagatcttagagatatgatctcgatgtacttgcccggggcggaagtccctgagcccgcagccccctcccgcctgcacatgtctcagcactatcagtctggacccgtgcctggaactgccatcaacggtacattacccctctcacacatg

SEQ ID NO: 19834 - DNA, 951 bp, Artificial Sequence
  Description of Artificial Sequence: Synthetic coding sequence
atgtataacatgatggaaacggaattgaagccgccagggccacagcaaacctcgggaggaggcggaggaaattccaccgctgccgcggctggtggtaaccagaagaactcgccagacagggtgaagcgcccgatgaatgcttttatggtgtggagccggggccaacgtcgcaagatggcgcaagaaaacccaaagatgcataactcggagatctcgaaaagacttggcgcagagtggaagctgttgtcagaaaccgagaagcgtccgtttatcgatgaagccaaacgcctgcgcgcactgcacatgaaggaacatccggactacaaatacagaccgcggagaaagaccaagactttgatgaagaaagacaagtacactcttccaggtggactccttgcaccaggcgggaactccatggcgtccggcgtgggggtgggagccggtctgggagctggagtgaatcagcgaatggacagctacgcacatatgaatgggtggtccaacggctcatatagcatgatgcaagatcagctcggatacccgcagcaccctggactgaacgcacatggggcagcgcaaatgcagccgatgcaccgctacgatgtgtcagcgctccagtataactctatgacttcaagccaaacctacatgaatggctcgccaacttactctatgagctactcgcagcagggtaccccgggcatggcactgggatcgatgggatcggtcgttaaatcagaggcttcgtcgtcgcctccggtcgtcaccagctcctcgcactcccgcgccccatgccaggctggcgacttgagggatatgatctcaatgtaccttcccggcgccgaagtgcccgagccggccgctccctcccgacttcacatgtctcagcactaccaatccggacctgtcccggggactgccatcaatgggaccctgcctctctcccacatg

SEQ ID NO: 19835 - DNA, 951 bp, Artificial Sequence
  Description of Artificial Sequence: Synthetic coding sequence
atgtacaacatgatggagactgaacttaagcctcccggccctcagcagacctcgggaggaggaggtggtaactcaaccgcagccgcggcaggtgggaatcaaaagaactcgccagacagggtgaagcggccaatgaatgccttcatggtctggagccgaggtcagcggaggaagatggcacaagagaatcccaagatgcataattcagagatatcaaagagactgggcgcggagtggaaactgctgagcgaaaccgagaagcggccgtttatagacgaagccaagcgtctgcgggcactgcatatgaaggaacacccagactataagtacagacctcgccggaaaactaagaccctcatgaaaaaggacaaatacactctgcctggcggactgctggcaccggggggtaactccatggcatcaggagtcggagttggagcggggctgggagccggagtgaaccagagaatggattcgtacgcacacatgaacggttggtccaacggatcttactcgatgatgcaagatcaacttgggtacccccaacatcctggactgaacgcacatggcgcagcccaaatgcaaccaatgcatcgatacgatgtgagcgccctgcaatacaattccatgacgtcgtcacagacgtacatgaacggatcacccacttactcgatgtcctactcacagcagggaaccccgggtatggcacttggatctatggggtccgtggtcaaatccgaggcatcctcatctcctccagtcgtcacttccagctcccattcgagggcaccatgtcaagcgggagatcttcgggatatgatttcgatgtacttgccaggggcagaggtgcccgaaccggcagcacctagccgccttcacatgtcccaacactaccaatcggggcctgtgcctggtactgcgatcaacggaacccttcctctctcgcacatg

SEQ ID NO: 19836 - DNA, 951 bp, Artificial Sequence
  Description of Artificial Sequence: Synthetic coding sequence
atgtacaacatgatggaaaccgaacttaaaccgcctggcccacaacaaacttcgggtggtggcggcggaaactccaccgccgctgcggcggggggaaaccagaaaaactccccagaccgggtgaaaagaccaatgaatgcatttatggtatggagcagaggacagcgtcggaagatggcacaagaaaaccctaagatgcataattcagaaatttccaaacggcttggggctgaatggaaattgcttagcgaaaccgagaaaagaccctttatcgacgaagcaaagcggctcagagcactgcatatgaaggaacatcctgattacaagtatagacctcgtcgcaagaccaagactcttatgaagaaggataagtacacgctgccaggaggtctgttggctcccggtggtaactcaatggcatccggtgtcggagttggagcgggccttggggcaggtgtgaaccagagaatggattcgtacgcacacatgaacggttggagcaatggctcgtacagcatgatgcaagatcagctgggttatccacagcatcctggtttgaatgcacatggagcagcacagatgcaaccgatgcaccgctacgatgtgtccgccctccagtacaactcgatgacttcatcgcaaacttacatgaatggaagccccacttactccatgagctactcacagcaaggtacccctggaatggccctgggatcgatgggaagcgtggtcaagtccgaggcatcgtcgtctcctccggtcgtgacttcgagctcgcattcccgagccccctgtcaagcaggggaccttcgggacatgatatccatgtaccttccaggggcagaggtgccagagcccgcagcaccatcccgcctgcacatgagccaacactaccaatcagggccagtgcccggaaccgcaattaacgggaccctccctctgtcccacatg

SEQ ID NO: 19837 - DNA, 951 bp, Artificial Sequence
  Description of Artificial Sequence: Synthetic coding sequence
atgtataacatgatggaaactgagcttaagccaccgggtccacaacagacatccggcggtgggggcggcaactccactgcggcggcagcaggcggaaatcaaaagaatagtccggaccgggttaagcgtcctatgaatgctttcatggtttggtctcggggtcagaggcgtaagatggcacaagaaaacccgaagatgcacaactccgaaatatcaaagcgcctgggggccgagtggaagttgctgagtgaaaccgaaaagcgtcccttcattgacgaagctaagcgtctccgcgctctccatatgaaggagcatcctgattacaagtacaggccacgacgcaaaactaaaacgcttatgaagaaggacaagtacaccttacccggcggccttcttgctcctggtggaaactcgatggcgtccggcgtcggcgttggcgccgggcttggcgctggggtaaatcagaggatggattcatacgctcatatgaacggttggagcaatgggtcttatagtatgatgcaagaccaattggggtatccccagcacccaggcctaaacgctcatggcgctgcacagatgcagccgatgcatcgatacgacgtctccgctttgcagtataattcgatgacgtcatcccagacgtacatgaacggatcccctacctattccatgtcatattctcagcaggggacccctggcatggcactgggctctatggggagtgtagtcaagagtgaagcctcgtcttcccctccagtggtgacatcctcgagtcactctcgtgcaccctgccaggctggggacctacgcgatatgatctctatgtatctacctggcgccgaggtgcctgagcccgccgccccctctcgtctccatatgtcccagcactatcaatcgggtccagtgcctggcactgctataaacggcaccttgcctttatcacatatg

SEQ ID NO: 19838 - DNA, 951 bp, Artificial Sequence
  Description of Artificial Sequence: Synthetic coding sequence
atgtacaacatgatggaaacggagctgaagccacccggcccccagcagaccagtgggggcggcggtgggaacagtacagcggccgccgccggcgggaatcagaagaatagccccgatcgggtgaagcggcccatgaacgcgtttatggtatggagccgcggtcaacgcagaaagatggcacaggagaaccctaagatgcacaatagcgaaatctcaaaacgcttgggagccgagtggaagcttctgtcagagaccgagaaacggccttttatcgacgaggctaaacggctccgggcgctccacatgaaggagcacccggactacaagtatcggccccgccgtaagacaaaaacattgatgaagaaagacaaatacacactgcccggggggctgttggcccctggaggaaattccatggcttcaggcgtgggcgtcggggccgggctaggagctggcgtcaaccagcggatggattcatacgcacatatgaacggatggtcaaacgggtcatatagcatgatgcaggatcagctcgggtacccccagcaccccggcttaaacgcccacggcgcagcacagatgcagccgatgcatagatatgacgtgtccgctctccagtataatagtatgacctcgtcgcagacgtacatgaatgggtctcccacctactccatgagctactctcagcagggtacccctgggatggccctgggcagcatgggctcagtcgttaaatccgaggcttcctcgagtccccccgtcgtcaccagcagtagccacagccgcgccccatgccaagccggtgacctgcgagatatgataagcatgtacctccccggggcagaggtccccgaaccagccgctccatcaagactgcatatgtctcagcattaccagagcggccccgtgcccgggactgcgatcaatggaaccctgccattaagtcacatg

SEQ ID NO: 19839 - DNA, 951 bp, Artificial Sequence
  Description of Artificial Sequence: Synthetic coding sequence
atgtacaacatgatggagactgagctgaagccacctggaccgcagcaaacgagcggtggtggaggtggcaactccaccgcggcagcagcagggggcaaccaaaagaattcccctgatagggttaagagacctatgaatgcttttatggtctggtcgagggggcagcgcagaaaaatggcccaagaaaacccaaagatgcacaactcagagattagcaagaggcttggtgccgagtggaagctgctgagtgaaacagagaagagaccctttattgacgaggctaaacggctcagggcactgcacatgaaggagcatcctgactacaagtaccgtcctaggagaaaaacaaagaccctcatgaagaaagataagtacacactgccagggggtcttcttgccccaggaggaaacagcatggcgtctggagttggagtcggtgcggggctcggtgctggggttaaccagaggatggacagctacgcccatatgaatggctggagcaacgggagctatagcatgatgcaggatcagctgggctacccacaacaccccggactaaacgcccacggagctgcccaaatgcaaccgatgcataggtacgatgtgtctgccctgcaatacaactccatgacaagctcacagacttacatgaacgggagccccacatactctatgagttattcccagcagggaaccccgggcatggctctcggctcaatgggctccgtcgtaaagtccgaggcatcgagttctcctccagtggtcacctcatcctcacactccagggctccttgccaggcaggagatttgagggatatgatctctatgtaccttcccggcgccgaggtcccagaacctgccgctcctagtaggctgcatatgagccaacactaccaaagcggtccagtgcctggtactgctattaacggcacactgcccctgagccacatg

SEQ ID NO: 19840 - DNA, 951 bp, Artificial Sequence
  Description of Artificial Sequence: Synthetic coding sequence
atgtacaacatgatggaaacggaacttaaacctccgggtccccagcagactagcggcggaggcggcggtaacagtacggcagcggctgccggaggtaaccaaaagaactcgcctgatcgagtcaagcggcctatgaatgccttcatggtctggagcagaggacagagaagaaagatggcacaggaaaatcccaagatgcacaatagcgaaatatctaagcgcctgggtgccgaatggaagctcttgtcagaaactgagaagcgtccatttatcgacgaggcaaaacggctcagggctcttcacatgaaagaacaccccgactacaagtaccgcccgcgccgtaagactaagactttgatgaagaaagataagtacacccttcctggggggctgctggcccctggaggaaacagcatggcgtcaggtgtgggtgtgggagcggggcttggagcaggggtcaatcagagaatggactcgtacgcacatatgaatggatggtcgaacggatcatactcaatgatgcaggatcagcttggctaccctcaacaccccggactgaatgcccacggggcagcacagatgcaacctatgcacagatacgacgtctcggcgcttcaatacaactcaatgacctccagtcagacttacatgaatgggtccccgacctattccatgtcatactctcaacaaggcactccaggaatggccctgggatcgatgggatcggtggtgaagtctgaagcatcctctagcccgccagtggtgacctcctcgtcccattcgagagcgccctgccaggcaggcgatctgcgagatatgatttccatgtatctgcctggtgcagaggtcccggaaccagcagcgccttcacggcttcatatgtcacagcactaccagtcagggcctgttcccggcaccgcaatcaacggaacccttccactgtcgcacatg

SEQ ID NO: 19841 - DNA, 951 bp, Artificial Sequence
  Description of Artificial Sequence: Synthetic coding sequence
atgtataacatgatggaaactgagctcaagccgcccggaccgcagcagacgagcggaggtggagggggaaactctactgcagcagcagctgggggaaaccaaaagaacagcccggaccgcgtgaagcgccctatgaatgcgttcatggtgtggagccgtggccaaagacggaaaatggcccaggaaaatccgaaaatgcacaattcggagatctctaagaggctgggcgcagaatggaaacttctctcagagactgagaagcgaccatttatcgacgaagcgaagagacttcgcgccctccatatgaaggagcaccctgattacaaataccgccctcggcggaaaactaagaccctgatgaaaaaggacaagtacacgttgccagggggactgctggcccccgggggaaattcgatggcgtcaggagtgggtgtcggtgcgggacttggtgcaggtgtgaaccagagaatggacagctacgcacatatgaacgggtggagcaacggatcatattcgatgatgcaagaccagctcggatacccccagcacccaggcctgaatgcgcacggggctgcccagatgcagccgatgcaccgctacgatgtctcggccctgcaatacaactccatgacttcgtcccagacctacatgaacggcagccctacctactcaatgtcgtactcccagcaaggcactccagggatggcactggggtcgatgggatccgtggtcaagtccgaagcgtcgagctcgccaccggtggtcacctcgtccagccactcgcgcgctccatgccaagccggtgatttgcgggacatgatctccatgtacctgcctggagccgaagtgcccgaaccggcggccccatccagactgcacatgtcccagcattaccagtcgggcccggtgccgggtacggccataaatggcaccctcccgctgagccatatg

SEQ ID NO: 19842 - DNA, 951 bp, Artificial Sequence
  Description of Artificial Sequence: Synthetic coding sequence
atgtataacatgatggagacagaactgaagccccctggaccccaacagaccagcggcggcgggggagggaattccaccgccgctgcggcaggcgggaatcagaagaattccccagacagggtaaagcggcccatgaacgcctttatggtttggagccgagggcagcggcggaagatggcccaggagaatcctaaaatgcacaactctgaaatctctaaaagactcggagcagaatggaaactactgtccgaaactgaaaagcggccatttattgatgaagcaaagagactccgagcactgcacatgaaagagcaccccgattataaatatcgtcctagaaggaagacaaagaccttgatgaagaaggataaatatacgctccccggcggcctgctggctcccggcgggaactcgatggcctctggggtgggggtcggcgccgggctaggcgctggagtgaaccaacgtatggatagctatgcacacatgaatgggtggtcaaacggatcgtatagcatgatgcaggatcagttagggtacccccagcaccctggactgaacgcccacggagccgctcagatgcaaccaatgcaccgatatgacgtgtccgccctgcaatacaactctatgacttcttcccagacttacatgaacggctccccgacctattctatgagctattcccagcaaggcacacctggaatggccctcggaagtatggggtctgtcgtgaagagtgaagcgtcttcctcaccgcctgttgtgacttcttcctcacacagccgagctccctgccaggctggggatctccgcgacatgatctccatgtatctgcccggcgccgaagttccagaaccagccgccccgtctcgtcttcacatgagtcagcattaccagtctggtccagtgccagggactgcgatcaacggtacattaccactgtcacacatg

SEQ ID NO: 19843 - DNA, 951 bp, Artificial Sequence
  Description of Artificial Sequence: Synthetic coding sequence
atgtacaacatgatggagaccgaactgaaacctccaggtcctcagcagactagcggtggtggtggcggcaactccactgcagcggccgccggggggaatcaaaagaactctcctgatagagtgaagcgcccaatgaatgcgtttatggtgtggtcccgtggtcagcgccggaaaatggcacaagaaaaccctaagatgcataattccgaaatatcaaaacgcctgggagcggaatggaaactgctaagcgagacggagaaacgcccttttatcgatgaagctaagcgcctgcgtgctttacacatgaaagaacacccagattataagtatcgcccgcgtcgtaagacgaagaccttgatgaaaaaggataagtatacgctgccaggtggtctgctcgcgcctggtggcaattctatggctagcggggtgggcgtgggtgcgggcttgggtgcaggcgtgaatcagcgcatggattcctatgctcacatgaacggttggtcaaacggcagctattctatgatgcaggatcagctgggttacccgcagcatccgggcctgaatgctcacggcgcggctcaaatgcaacctatgcaccgttacgatgtctcggcactgcagtataatagcatgaccagctcccagacgtacatgaacgggagccctacctacagcatgagctacagccagcaggggactccgggtatggcgttgggaagcatgggctcagtcgtcaagagcgaagcgtcgagctccccaccggtagtgaccagtagctcccattctcgtgcgccgtgccaggcgggtgacctccgggatatgatcagtatgtacctgcctggcgcggaggtcccagagccggcagctccaagcagactgcatatgagtcaacattatcaaagcggcccggtgccaggcaccgctattaacggaactctgccactgtctcacatg

SEQ ID NO: 19844 - DNA, 951 bp, Artificial Sequence
  Description of Artificial Sequence: Synthetic coding sequence
atgtacaacatgatggagacagaattgaagccacctggcccacagcagacaagtggtggaggcggaggtaattctactgctgctgctgccggtggaaaccagaagaactccccagaccgcgtaaaaaggcccatgaatgcatttatggtgtggagtcgcggacagcgccgcaaaatggcacaggagaacccaaaaatgcacaacagtgagatttccaagagattgggagctgaatggaagctgctgtccgagaccgagaagaggcccttcattgacgaggcaaagcgcttgcgcgctctgcacatgaaggagcaccccgactacaaatacaggccacgccgcaaaaccaagaccttgatgaagaaggacaaatataccttgcctggtggtctgctcgccccaggtggtaactctatggccagtggcgttggagtcggcgccggactgggcgctggcgttaaccagcgtatggatagttacgctcatatgaatggctggagcaacggatcctactctatgatgcaggaccagcttggataccctcagcaccctggactcaatgcccatggcgctgcccagatgcagcctatgcaccgctacgacgtttcagcccttcagtacaatagtatgaccagctcccagacttatatgaatggctctcctacctattcaatgagttactcccagcagggtacaccaggaatggcactgggctcaatgggatctgtggtcaagtccgaagcctcttcttcccctcccgtcgtaacatcctcttctcacagccgtgcaccatgccaggcaggcgatcttcgcgatatgatctctatgtacttgcccggagccgaggtacccgaacccgctgcccccagcagactccatatgagccagcattaccagagtggccccgtccccggcaccgctattaatggtactctgcccctgagtcatatg

SEQ ID NO: 19845 - DNA, 951 bp, Artificial Sequence
  Description of Artificial Sequence: Synthetic coding sequence
atgtataatatgatggagacggagttgaagccacccggcccccagcaaacgtccggaggtggcggcgggaatagtacagcagccgctgccggcggtaatcagaaaaattctcctgacagagttaagagaccaatgaatgccttcatggtgtggtctcgaggccagcgccgcaagatggcccaggaaaaccccaaaatgcacaatagcgaaatcagtaagcgtttaggggccgaatggaagcttctgagcgaaaccgaaaagcgcccatttattgacgaggccaaacgcttgcgcgctctacacatgaaggagcatcccgactacaaatacaggccaaggcgcaagaccaaaactctgatgaagaaagacaagtataccttaccaggaggcttgctggcgccaggcgggaattccatggccagcggcgtgggagtgggagctggattgggcgcgggtgttaaccagcgaatggactcttacgcacatatgaacgggtggtctaatgggagttactctatgatgcaggatcaactggggtaccctcagcaccctggactgaacgctcacggagccgctcagatgcagcccatgcacaggtacgatgtcagtgctctgcagtacaattctatgacttctagccagacatacatgaacggctctcccacctattcaatgtcctactcccagcagggcactcccgggatggccctcggctccatgggctctgtggtgaaaagtgaggcctcctcaagccctccagtggtgacatctagttcacacagcagagcaccctgccaggccggcgacctgagggacatgatcagtatgtatctgccaggcgctgaagtgcctgagcctgccgccccgtcacgactccacatgagtcaacattaccagtccggccccgttcccgggactgctatcaatggcaccctgcctttaagccacatg

SEQ ID NO: 19846 - DNA, 951 bp, Artificial Sequence
  Description of Artificial Sequence: Synthetic coding sequence
atgtacaatatgatggaaaccgaactgaagccccctggaccccagcaaacttcggggggcggagggggtaacagcaccgcagcagcagcaggcggaaatcagaaaaactctccggatcgggtcaagcggccgatgaacgcatttatggtgtggtcgagaggacagcgcagaaaaatggcacaagaaaatcctaagatgcataactccgaaatctcaaagcgtttgggagctgaatggaagctgctgtccgagactgaaaaaagacctttcatagacgaggccaagcgtctgcgggccctgcatatgaaggaacacccagactacaaataccgaccaaggcgcaaaactaagacgctgatgaagaaggataagtatacccttcccggaggacttcttgcaccaggaggcaatagcatggcatccggtgtgggtgtgggtgccgggttgggcgccggggtcaaccaacgaatggactcgtatgcacatatgaacggatggtccaacggatcgtactcgatgatgcaagaccaactgggatacccgcaacatccaggactcaacgcccacggagcagcacagatgcagccaatgcataggtacgatgtttcggcacttcaatacaactcaatgacttcgagccaaacttacatgaacggaagccctacctactccatgtcgtactctcagcagggtacccctgggatggccctcggaagcatgggctccgtggtcaaatcggaggcaagctcgtctccccctgtggtcacctcctcctcccactcgagagctccttgtcaggctggagatcttagggacatgatttctatgtacctcccgggtgcagaagtgcctgaaccagccgcaccatcccgacttcatatgagccagcattaccaaagcggaccagtgcctggcacggcgataaacggaacccttcccctgtcccacatg

SEQ ID NO: 19847 - DNA, 951 bp, Artificial Sequence
  Description of Artificial Sequence: Synthetic coding sequence
atgtacaatatgatggagactgagcttaagcctcctggtccacaacaaaccagcggaggtggtggaggtaattcgactgcagcggcagcaggaggaaaccaaaagaactcaccggatcgcgtgaagcgtccgatgaacgccttcatggtgtggtccaggggacagcggagaaagatggcccaagaaaatcccaagatgcataactcggagatttcaaagcgccttggtgcagaatggaagctcctttcggaaaccgaaaagcgcccattcatcgatgaggcaaagcgattgagagctctgcatatgaaagaacatccagactataagtacagacctagacgcaagactaagactcttatgaaaaaggacaaatacacccttcctggaggacttctggcccccggaggaaactcgatggcctcaggagtgggagtcggagcaggacttggtgccggtgtgaaccagagaatggattcatacgcccatatgaacggatggtcgaacggtagctactcgatgatgcaagatcaactcggctacccacaacacccaggtctgaacgcccacggcgctgcacaaatgcagccgatgcatagatacgatgtgtccgctctgcagtacaactccatgacttccagccaaacttatatgaatggttcgccaacttacagcatgtcctactcccagcagggtactcccggaatggcacttgggtcgatgggtagcgtcgtgaaatctgaggcatcatcctcgcccccagtggtgacctcctcctcacattcgagagctccatgtcaagcaggcgatcttagggacatgatttcgatgtacctgccaggagcagaggtgcctgaaccggccgccccatcgcgtctgcacatgagccaacattaccagtccggacctgtgcctgggaccgcgataaacggtactctgcccctgtcacatatg

SEQ ID NO: 19848 - DNA, 951 bp, Artificial Sequence
  Description of Artificial Sequence: Synthetic coding sequence
atgtacaatatgatggaaaccgaacttaaacctcccggcccacaacagactagcgggggcggcggcggaaattcaactgcagcagcagccggtggaaaccaaaagaactccccagatcgtgtgaaaagacccatgaacgcttttatggtttggtcaaggggacagcgaagaaagatggcccaagagaacccgaagatgcataacagcgagatttccaagcgacttggtgcagaatggaagctgctgtccgaaactgaaaaaagaccgtttatagacgaagcaaaacgtctgcgcgcattgcatatgaaggagcacccggattacaaatacaggcctcggagaaagaccaaaactctgatgaaaaaggataagtacactctccctggaggactcctggctcctggcggaaactcgatggcatcgggggtgggcgtgggagcgggactcggtgccggagtgaaccaacgaatggattcctacgcccatatgaacggctggagcaatggaagctactccatgatgcaggaccaactgggttaccctcagcatcctggacttaatgcacatggagcagcacagatgcaacccatgcacaggtacgacgtgtccgccctgcaatacaacagcatgactagcagccaaacctacatgaacggttccccgacgtactccatgtcatactcgcagcagggaactccgggtatggccctgggatctatgggtagcgtggttaagtcggaagcgtcgtcctccccacctgtggtcacctcttcgtcacactcaagagcaccatgccaggcaggagatctcagggacatgatttcgatgtatctccctggagcagaggtgccagaaccagcagcaccctccaggcttcacatgtcgcaacactaccagtcggggccagtgcctggcactgcaataaacggaacgctgccactgagccatatg

SEQ ID NO: 19849 - DNA, 951 bp, Artificial Sequence
  Description of Artificial Sequence: Synthetic coding sequence
atgtataacatgatggaaaccgagctcaagcctccaggacctcagcagacaagcggaggcgggggaggaaacagtaccgctgccgctgcaggcggaaaccagaagaatagtccagatagagtcaagcggcctatgaacgcctttatggtatggtcacgcggccaaagacgtaaaatggcacaggaaaacccaaagatgcacaatagtgagatatccaaacggctcggggccgagtggaagctgctctcagagactgagaagaggcctttcatcgatgaagcaaagcggctgcgtgcactgcatatgaaggaacatccagactataaataccgccctagacgaaaaaccaaaacactgatgaagaaggacaaatatactctgccaggtggcctcctcgcacctggcgggaacagcatggcaagcggggtaggagttggcgccgggctgggtgcgggagtcaatcagagaatggacagctacgctcatatgaacggatggtctaatgggtcctatagcatgatgcaggatcagctcggatatcctcaacatcctgggctgaacgctcacggtgccgcacagatgcaacctatgcacagatatgatgtatcagccctgcaatacaactctatgacatcttctcaaacttatatgaatggaagcccaacttattcaatgtcctatagtcagcagggcactcctggcatggcactgggtagtatgggctcagttgtgaaaagcgaggcatcttcaagcccgccagtggtgactagctcatcccactcaagggcaccatgccaggccggggatttaagagatatgatctctatgtacctaccaggcgctgaggtgcccgagcctgcagccccttcccgattacacatgtctcagcattaccagtccgggccagtgcctggtacagccattaacggcacccttcccctcagccatatg

SEQ ID NO: 19850 - DNA, 951 bp, Artificial Sequence
  Description of Artificial Sequence: Synthetic coding sequence
atgtacaacatgatggaaacagagctgaagcctcctggaccacagcaaacctctggcggcgggggcggcaacagcacagcggccgctgccggcggaaaccaaaaaaattctcctgatcgggtaaaaaggccaatgaacgccttcatggtgtggtcacgaggacagagaagaaagatggctcaggaaaatcccaaaatgcacaacagcgaaatcagcaagcgtctgggcgctgaatggaagctgctgagcgagaccgagaagcgaccttttatcgacgaagcaaagaggcttcgggccttacacatgaaggaacaccccgattataagtacagaccaagacggaaaaccaaaacacttatgaagaaggataaatacacactgccaggcggcctgctcgcccccggcggcaacagcatggcttcaggggtgggagtgggtgccggcctgggggctggagtcaatcaaaggatggattcttacgctcacatgaatggatggagcaatggaagttatagtatgatgcaagaccaactcggatacccacagcatccaggcctgaatgcgcatggagccgcacagatgcagcctatgcataggtacgatgttagcgctctgcagtacaactccatgacatcctctcagacctatatgaacggaagcccaacttactcgatgagttacagtcagcaaggaactccaggcatggctctcggtagtatgggaagcgttgtgaagtcagaagctagttcaagtccacccgtcgtcacaagctcaagccatagccgcgcaccttgccaagcgggcgatctgcgcgacatgatcagtatgtaccttccaggggctgaagtgcctgagcccgctgccccttcccgattgcacatgtctcaacattaccaatcaggacccgtgccgggaaccgctatcaatggtactctcccactgagtcacatg

SEQ ID NO: 19851 - DNA, 951 bp, Artificial Sequence
  Description of Artificial Sequence: Synthetic coding sequence
atgtacaacatgatggaaactgaactgaagcctcctggaccccagcagacctcgggcggagggggtggaaactcgacggcggcagctgctggcggtaaccaaaagaactccccggaccgggtgaaacgaccaatgaatgcctttatggtgtggtcaagaggacagcgccggaagatggcgcaggagaaccccaagatgcacaactcggaaatctccaagcggttgggtgcagagtggaagctgctctccgaaaccgaaaaaaggcctttcatcgacgaggcgaaacgcctgcgggccctgcacatgaaggaacatccggattacaagtaccgcccacggcgtaagacgaaaaccttgatgaagaaggataagtacaccctgcctggaggactgctggctccgggaggcaactctatggcctccggcgtgggagtcggtgcaggcctcggcgccggagtcaatcaacggatggattcgtacgcccacatgaacggctggagcaatgggtcgtactccatgatgcaggaccagctcggatatccacagcacccaggcctgaacgcacatggcgcggcacagatgcagcctatgcatcggtatgacgtgagcgctcttcaatacaattcaatgacctcttcgcaaacctacatgaatggatcgccaacctactcgatgagctactcgcagcaagggactccgggaatggcactgggttccatgggctccgtggtcaagtccgaagcctcgagctcccctccagtggtgacctcgtcatcacatagcagagcaccatgccaagcgggtgatcttcgcgacatgattagcatgtacctgcccggagcagaggtgccagagccagctgccccatcgaggctgcatatgtcccaacattaccagtccggcccagtcccgggaaccgccatcaacggtactctgcccctgtcccatatg

SEQ ID NO: 19852 - DNA, 951 bp, Artificial Sequence
  Description of Artificial Sequence: Synthetic coding sequence
atgtataacatgatggagaccgagctcaagccaccaggaccgcagcaaaccagcgggggtgggggaggcaacagcactgccgccgcagccggcgggaatcagaagaatagtcctgatagggtgaagcgcccaatgaatgccttcatggtctggtcccgcgggcagcgacgaaaaatggcgcaggaaaatcctaagatgcacaatagcgaaataagcaagagattaggggccgagtggaagctcctttccgagactgagaagagaccattcattgatgaggccaagagactgcgggccctccacatgaaagagcatccggactataaatatagaccccgtcgcaagactaaaaccctaatgaagaaagacaaatatactctccccgggggtctgctggccccgggcggtaattcaatggccagcggggtgggtgtcggcgctgggttgggagccggtgtgaaccaaaggatggacagctatgcccatatgaacggatggagtaacggctcttactcaatgatgcaagatcagttgggatacccccagcacccagggcttaatgcgcacggggcggcccagatgcagccgatgcatagatatgatgtttcagccttgcaatacaactccatgactagcagtcagacttacatgaacggatcaccaacctatagcatgtcttattcacagcagggcacccccggaatggcattggggagcatggggtcggtggttaagtcggaggcatctagttctcccccagttgttacatccagctcccatagccgtgccccttgtcaggccggcgatctgcgagatatgattagcatgtacctgcctggcgccgaagtcccggaaccagctgctcccagccgtctccacatgagccagcactatcaaagtggcccagtgccggggactgccattaatgggaccctgccattgagccatatg

SEQ ID NO: 19853 - DNA, 951 bp, Artificial Sequence
  Description of Artificial Sequence: Synthetic coding sequence
atgtacaacatgatggagaccgagcttaaaccccctgggccccaacagacttccggtggtggcggcggaaattcgacagctgcagccgccggaggtaaccagaagaacagcccagaccgcgtaaagagacctatgaatgccttcatggtgtggagtcgaggacagagacgcaagatggcccaggaaaaccccaagatgcataacagcgagatttcaaagcgacttggcgcggaatggaagttgctgtcggagacagagaagcgcccatttattgacgaggcaaaaagactgcgggccctgcacatgaaagagcacccggactacaagtacagacccaggagaaaaacaaaaactctgatgaagaaggacaaatacacactacctggcgggctcctcgcccccggggggaatagtatggcctctggtgtgggtgtcggagccgggctcggcgcgggagtgaatcaaaggatggattcttacgcacacatgaatgggtggtcaaacggctcatactcgatgatgcaggaccagctcggttatccgcaacaccccgggctgaacgctcacggcgccgcgcagatgcagccaatgcatcggtacgacgtttccgctctgcaatacaacagcatgacctcaagtcagacatacatgaatggtagtcctacctactcaatgagttatagccagcagggcacgcccggaatggctctcggatccatgggctccgtggtgaagtccgaagccagctctagtccccctgttgtgacaagcagttcgcattcccgggccccttgtcaggctggagacctgagagacatgatcagtatgtacctgcccggcgctgaagttccggaacctgctgccccctcgcggcttcatatgtctcagcactaccagtcagggcctgttcccggcactgctatcaatggtactcttcccttgagtcacatg

SEQ ID NO: 19854 - DNA, 951 bp, Artificial Sequence
  Description of Artificial Sequence: Synthetic coding sequence
atgtacaacatgatggaaactgagctgaaaccaccagggccccaacaaactagcgggggtggcggtgggaatagcactgcagcagccgcaggtggcaaccaaaagaattcgccagatagggtgaagaggccaatgaacgcatttatggtgtggtcgcggggacaacggcgcaagatggcacaggaaaacccgaagatgcataacagcgaaatcagcaagaggcttggtgcggaatggaagctcctttccgaaaccgagaagcgaccattcattgacgaagctaagcgcctgcgagcactccatatgaaggagcatcctgattacaagtatcgcccccgtagaaagaccaagaccctgatgaaaaaagacaagtacaccttgcccggtggcctccttgccccaggtgggaattcgatggcatccggcgtcggcgttggcgcgggtcttggagcgggagttaaccaaagaatggactcctacgcacatatgaatggatggtctaatggaagctactctatgatgcaggatcaattgggatacccacagcaccctggcctcaatgcacatggagcagcacaaatgcaacctatgcatcgctatgacgtgtcggccctccagtacaacagcatgacttcctctcagacctacatgaatggaagccccacgtacagtatgagctacagccagcagggaacccctggtatggcactgggatccatgggatccgtggtgaaatcggaggcatcttcgtcccctccagtggtgaccagctcctcgcactcacgtgcaccctgccaagccggagatttgagagacatgatctcgatgtatctcccaggcgcagaagttcctgaacctgcagcgccgtccagacttcacatgtcgcaacactaccaatccgggcccgtccctggtaccgctattaacggtacccttcccctctcgcatatg

SEQ ID NO: 19855 - DNA, 951 bp, Artificial Sequence
  Description of Artificial Sequence: Synthetic coding sequence
atgtataacatgatggaaactgaactgaaacctcccgggcctcagcagacttctggagggggaggggggaactccacggccgctgctgctggagggaatcagaaaaactcccccgatagggtgaaacggcctatgaacgccttcatggtgtggtccaggggacagagaagaaaaatggcccaggaaaaccccaaaatgcataactcagaaatctccaaaagactgggagccgaatggaaactgctctcagaaacagaaaaaaggccattcatagatgaagctaaacgactcagagctctacatatgaaagagcatcctgattataagtaccgccctaggaggaagactaaaacattgatgaaaaaagataaatacactctgcccgggggacttctcgctcccggaggaaactctatggcctcaggagttggggtgggggccggactcggagccggggtcaaccagaggatggattcatatgctcatatgaatgggtggagtaacgggtcttactccatgatgcaggaccagctcgggtatcctcagcatccaggacttaacgcacacggagctgctcagatgcagccaatgcataggtatgatgtgtcagctctacagtacaattctatgacaagttctcagacatatatgaatggaagtcctacatattctatgtcatattcccagcaggggactcccgggatggctctcgggtcaatgggatcagtcgttaagtctgaagccagtagttctccacctgtcgtcacatcttcttcccactcaagagcaccttgccaggcaggagacctgagggatatgatctccatgtatttgcctggagccgaagttcccgaacccgctgccccttccaggctgcatatgtctcagcattatcagtctgggccagtgcccgggacagcgattaacgggactctcccactgtctcacatg
